United States Patent 8,999,380 (MODIFIED POLYNUCLEOTIDES FOR THE PRODUCTION OF BIOLOGICS AND PROTEINS ASSOCIATED WITH HUMAN DISEASE) - sequence listing, part 7

SEQ ID NO: 9492 - DNA, 2196 bp, Artificial Sequence
  Description of Artificial Sequence: Synthetic coding sequence
atgtccgaaacctcaagaaccgcattcggcggacgaagggcagtccctccaaataacagcaacgcagccgaggacgatctgccaaccgtcgagctccaaggagtcgtgcctagaggcgtgaacctgcaggagtttcttaacgtgacgtcggtgcatttgtttaaagaaaggtgggacaccaacaaggtggaccaccacaccgataagtacgaaaacaataagctcattgtgagacgcggtcagagcttctacgtccagatcgattttagcagaccatacgaccctcgcagagatcttttcagagtggagtacgtgattggcagataccctcaagagaacaagggaacctacattccagtgccgatagtttccgaattgcagtccggtaagtggggtgcaaaaatcgtgatgagagaggatcgatcggtgcgcctgtcgatccagtcctccccaaagtgtatcgtgggaaagtttagaatgtacgtcgccgtgtggacgccttacggtgtcctgcgtacttcgagaaacccagagactgatacctacattctgtttaatccttggtgtgaagatgatgcggtgtaccttgataacgaaaaggaaagagaagaatacgtcctgaatgacatcggagtgatcttttacggagaagtgaacgacataaagactagaagctggtcctacggacagttcgaagatggtatactggacacctgtctgtacgtgatggaccgcgctcagatggatctgtccgggaggggtaatcctatcaaagtctccagagtgggatcggcgatggtgaacgccaaggatgatgagggtgtccttgtcggttcgtgggacaatatctacgcctacggtgtcccccctagcgcgtggaccggcagcgtggatattctgctggaatacaggtcatccgaaaacccagtcagatacggacaatgctgggtgtttgcaggagtgttcaacacctttctcaggtgtctcggaatcccagcaagaatcgtgaccaactatttcagtgcacatgataacgacgcaaatcttcagatggacatatttctcgaagaagatggaaatgtgaacagtaaacttaccaaggattcggtgtggaactaccattgctggaacgaagcatggatgactcggcctgaccttcctgtggggttcggaggatggcaggcagtggatagcaccccccaagaaaacagcgatggtatgtatagatgcggtcctgccagcgtgcaagctatcaaacacgggcatgtgtgcttccagtttgacgcaccctttgtgtttgcagaagtgaactccgatctgatctacataactgccaaaaaggatggtactcatgtggttgagaatgtcgacgcgactcatattggaaagctcatcgtgactaagcaaatcggcggtgatggcatgatggatattacggacacctacaagtttcaagaaggacaagaagaggagcgactggctcttgaaacggccctgatgtacggcgctaagaaacctctgaataccgaaggggtgatgaagtcgcggtcaaacgtagacatggatttcgaggtggaaaatgcagtgctggggaaagacttcaaactttcaattacctttcggaacaattcccacaacagatacaccattaccgcctacctctccgcaaacattaccttttacaccggagtgcctaaagcagagtttaagaaggagactttcgatgtgaccctcgagcccctgtccttcaagaaggaggcagtgctcatccaggcaggagaatacatgggtcagcttttggaacaagcaagcctgcacttttttgtgactgccagaattaacgagactcgggacgtgcttgccaagcaaaagtcgactgtcctgactattcctgagattatcattaaggtgcgcgggactcaggtggtgggctccgatatgactgtgactgtgcaatttactaacccccttaaggaaaccctgcggaatgtgtgggtgcaccttgatggtcctggtgtgacccggccaatgaagaaaatgtttcgggaaatccgtcctaattccaccgtgcaatgggaggaggtctgtcgaccgtgggtatcgggccatcggaagttgattgccagcatgtcgtcggactcgctcagacatgtgtacggcgagctggatgtgcagatccaaagacggccatccatg

SEQ ID NO: 9493 - DNA, 2196 bp, Artificial Sequence
  Description of Artificial Sequence: Synthetic coding sequence
atgagcgaaacctcgcggaccgctttcggaggaagaagagcggttcctccgaacaattctaacgcagccgaggacgacctgccgactgtggagctccaaggagtggtccctcgtggagtgaacttgcaagaattcctgaacgtgacttcggtgcacctcttcaaagaacgttgggatactaacaaggtcgaccatcacaccgacaagtacgagaacaacaagttgatcgtccggagaggacagagcttttacgtgcagatagactttagcagaccgtacgatccaaggagagacttgttccgcgtcgagtacgtgattgggaggtacccacaagagaacaaaggtacctatatcccggtgccaattgtgtcggaactgcaatcaggcaaatggggggctaagatcgtgatgcgggaagatcgctccgtgcgcctgagcattcagtcgtcgccaaagtgcattgtggggaagttcagaatgtacgttgcggtgtggaccccgtacggtgtcctcagaacttcccggaaccccgagacggacacctacatcctgtttaacccctggtgcgaggatgatgccgtctacctcgacaatgagaaggagcgggaggagtatgtgctgaacgatatcggagtgatcttctacggggaggtgaatgacattaagaccaggtcatggagctacggacaattcgaagatggaatcctcgatacttgcctgtacgttatggaccgcgctcagatggacctgagcggaaggggaaatccaatcaaggtgtcccgtgtgggctccgcgatggtcaacgctaaggacgatgaaggagtgcttgtcgggtcctgggacaatatctatgcctacggagtcccgccgtcggcctggaccggcagcgttgacatcctgctggagtaccgctcctcggaaaaccctgtccggtacggtcagtgttgggtctttgccggagtgttcaatacttttctccggtgccttggtatccccgcgagaatcgtcaccaattacttctccgctcacgataacgacgcgaacctccagatggacatttttctcgaggaagatggcaatgtgaattcgaaactgactaaggattcggtgtggaactaccattgctggaacgaggcatggatgacccgcccggacttgcctgttggctttgggggttggcaggccgtggacagcacgccacaggaaaactccgatggcatgtaccgctgcggaccggcctcggttcaggcaatcaagcatggacatgtctgcttccagttcgatgcgcctttcgtgttcgccgaagtgaatagcgacctgatctacatcactgccaagaaggacggcacccatgtggtcgagaacgttgatgccacccatatcggaaaactcatcgtcaccaaacagatcggaggcgacggcatgatggatatcactgatacttacaagttccaagagggccaagaagaagaaagactggcactggaaaccgcgcttatgtacggagcgaagaagccgctgaacaccgaaggagtcatgaaatcgagatccaacgtggacatggactttgaggtggagaacgctgtgctgggaaaggacttcaagctgtccattaccttccgcaacaattcccataaccgatacactatcaccgcctacctgtccgcgaatatcaccttctacacgggcgtgccaaaagcggaattcaagaaggaaacttttgatgtgaccctcgaaccactctcattcaagaaagaagcggtgctcatccaagcgggagaatacatgggacagctcctggagcaggcatccttgcatttctttgtcactgccagaatcaatgagactcgggacgtgttggcgaagcaaaagagcactgtgctgacgatcccggaaatcatcatcaaggtgcggggtacccaggttgtgggttcggacatgaccgtgaccgttcagttcactaacccgcttaaggagactctgcggaatgtgtgggtgcatctcgacggacctggggtgacccgccccatgaaaaagatgttccgggagatccggccgaacagcactgtccagtgggaggaagtgtgtaggccctgggtgtcgggacaccgcaagctgatagcctcaatgtcgtcggattcactgagacacgtgtacggagaactcgacgtgcagatccaacgccgcccgtcgatg

SEQ ID NO: 9494 - DNA, 2196 bp, Artificial Sequence
  Description of Artificial Sequence: Synthetic coding sequence
atgagcgaaacttccagaaccgcctttggcggacgtagagctgtcccccccaacaattcaaatgccgcggaggacgacctgcccacggtcgagctgcagggcgtggttccgcgaggcgtgaatctccaggagttcctgaacgtcacaagcgtgcatctgtttaaagagcgttgggatactaacaaggtcgaccatcatacagacaagtacgaaaataataagttgattgttcgacgggggcagagtttctacgtgcaaattgacttttcgcgtccctacgaccctagaagggacctgtttcgggtggagtatgtgatcggccggtacccgcaggagaataaaggcacatatattccggtgccaattgttagcgagctacagagtggcaagtggggagcgaagatagtaatgagagaagaccggtcagtgagactcagcattcaaagctccccgaagtgtatagtgggtaaatttcgaatgtacgtcgcagtgtggacaccatacggggtgctaagaacgtcaaggaacccggaaaccgacacttacatactcttcaatccatggtgcgaagatgacgccgtgtacctcgacaacgagaaagagagagaggaatacgtgttaaatgatataggtgtcatcttttatggcgaagtcaacgacatcaaaaccaggtcctggagctacggtcagttcgaggacggcattcttgacacatgtctttatgtgatggaccgggcacagatggacctgtccggcagaggaaaccctattaaggtgtcccgcgtgggctctgccatggtgaatgcaaaagatgacgagggtgtactagtgggatcctgggataacatctatgcttacggagtgccaccctcagcttggacgggcagcgttgacattctgttagagtacaggagcagtgagaatccggtgaggtacggtcaatgctgggtgtttgccggggtttttaatacctttcttcgctgtttgggcatcccggcgcgaattgtgacgaattactttagcgctcatgataatgacgccaatctccagatggacatctttctggaagaagatggtaacgtcaatagcaagctgacaaaggactctgtctggaattatcactgctggaatgaagcatggatgacgcggccagacctgcctgttggatttggaggatggcaggccgtcgacagcaccccacaggagaactctgacgggatgtaccggtgcgggccagcaagtgtgcaggctattaaacatggccacgtctgtttccagtttgacgcaccgttcgtcttcgctgaagtgaacagtgatttgatctatataactgcgaagaaggatggcacccatgtcgtcgaaaacgtggacgctacgcacattgggaagctgatcgtcaccaagcaaatcggaggcgacggtatgatggatattaccgatacatataagtttcaggaaggacaagaggaagaaagactcgctctggaaactgctctaatgtacggtgcaaagaagccgctcaacacagagggcgtcatgaaaagcagatccaatgtggacatggacttcgaagtggaaaatgcggtcttaggcaaagattttaagctatctatcacgttccgaaacaatagccataaccggtatacgatcaccgcctacctgtccgccaatattacgttttatacaggcgtacccaaggccgagtttaagaaagagaccttcgacgtgactctggaaccgttgagctttaagaaagaggccgtgctgatccaggcgggggagtatatgggacagctactcgaacaggcttcactgcatttttttgtgacagcccggatcaacgaaacaagggatgtgctggcaaaacaaaagagtactgttctaaccatcccggaaattatcatcaaggtgagagggacccaggtggtggggtccgacatgaccgtgaccgttcagttcactaacccgctgaaagagaccctgagaaacgtgtgggtgcacctcgacgggccgggggttactaggcccatgaagaaaatgttccgcgaaattcggcccaacagcactgttcaatgggaggaggtttgccggccatgggtttcggggcatagaaagctcatcgctagcatgagctcggacagcctgcgacacgtgtatggcgagcttgacgtgcagatccagaggcgaccctctatg

SEQ ID NO: 9495 - DNA, 2196 bp, Artificial Sequence
  Description of Artificial Sequence: Synthetic coding sequence
atgtctgagacaagcagaaccgccttcggagggcgccgggccgttcctccaaacaacagtaatgccgctgaggacgacctgccaactgtggagctccagggagtggtacctcgcggagtgaatctacaggaatttttaaatgtgacatcggttcatctctttaaggaacgctgggacactaacaaggtggaccaccatacagacaaatatgagaataacaagcttatagtgcgccgcggacagtccttctacgtgcagattgacttctctcgcccctacgacccacgcagggatttgtttcgtgtggagtatgttattggtcgctacccccaggaaaataagggaacgtatattccagtcccaattgtctctgagctgcaatctggcaaatggggagccaagattgtgatgcgtgaagataggagtgtgagattatcaatacagtccagccccaagtgtatagtgggcaagttcagaatgtatgtggcagtctggacgccttatggtgttcttaggacctctagaaaccctgaaactgacacttatatcctgttcaatccctggtgcgaggacgatgcagtttatctcgacaacgaaaaggagcgggaggagtatgtattgaatgatattggtgtaatcttctatggggaagtaaatgatatcaagactcggtcctggtcctacggccagtttgaggacggcattctagatacttgcctatatgtgatggatagggctcagatggatctatctggtcgagggaacccgatcaaagtgtcgcgtgttgggtccgctatggtcaatgcgaaagacgatgaaggagtcctcgtcggatcctgggataatatctatgcgtatggcgtaccccccagtgcctggacaggctctgtcgatatcctccttgagtaccggagcagtgaaaaccctgtgcggtatggccagtgttgggtgtttgctggtgtcttcaatacattcctgagatgcctcggcattccagcacgcatcgtcacaaattacttctccgcccatgacaacgatgccaacctccagatggacatcttcctggaagaggacggtaacgtaaacagcaagctgacaaaggactccgtctggaactaccactgctggaacgaggcatggatgacccggcccgacctgcccgtaggcttcggcggctggcaagcagtcgactccactccccaggagaacagtgatggtatgtataggtgcggtcctgcctctgttcaggctatcaagcatggccatgtatgcttccagtttgacgccccgttcgttttcgctgaagtgaatagtgacctcatatacataacggccaaaaaggacgggacgcacgtagtcgaaaatgtagatgcgacccatattgggaagctcatagtaaccaagcagatcggaggcgatgggatgatggacatcacagacacatataagtttcaagaaggccaagaggaggaacggcttgctcttgaaacagcactgatgtacggagcaaaaaagccactgaacacagaaggagttatgaaaagccggagtaacgtcgatatggactttgaggtggagaacgcggtcttgggtaaagatttcaagctgtctatcaccttcagaaacaactcccacaatagatatacgatcacggcctacctgtccgccaatatcaccttctatactggagtccctaaggcggagtttaaaaaagaaactttcgacgttactctcgagcctctgagcttcaagaaagaagcagtcttaatccaggccggagagtacatgggacagcttcttgaacaggcatctcttcactttttcgtgaccgctcgcattaacgagacacgggacgtcctggccaagcagaagagcactgtgctgactattcccgagattataatcaaggtgcgcggaacccaggtagtgggctccgatatgactgtcacagtgcagtttactaaccctctcaaggagacactgagaaacgtgtgggtgcacctggatggccccggggtcactcgacctatgaaaaagatgtttcgcgaaatcaggccgaattcgaccgtccagtgggaggaggtgtgtagaccatgggtatccggccacagaaaactcattgcgtcaatgagtagtgacagtctacggcatgtatatggcgagctcgacgtgcagatacagagaagaccttcaatg

SEQ ID NO: 9496 - DNA, 2196 bp, Artificial Sequence
  Description of Artificial Sequence: Synthetic coding sequence
atgagcgaaacctcacgaaccgcctttggaggccggagggcagtgcccccaaacaacagcaacgccgcagaagatgatctccctactgtggaactccaaggagtggtcccaagaggagttaacttgcaagaatttctgaatgttacctcagtgcacctgtttaaggaaagatgggacacgaacaaggtggaccatcataccgataagtacgagaacaacaagctcattgtgcgccgcggacaatccttttacgtgcaaattgatttttcgcgtccttacgatccacgaagagatctgtttcgcgtcgagtacgtgatcgggagatatccgcaagagaataaggggacttacatacctgtccctatcgttagcgaactgcaatctgggaagtggggagcaaagatcgtgatgagggaagataggtcggtgaggctttccattcagtcatccccaaaatgcatcgtcggcaagtttcggatgtacgtcgcagtgtggaccccgtacggagtgctccggacttcgagaaatccagaaactgacacgtacattctgttcaacccttggtgtgaggacgatgcagtgtacctggacaatgagaaagaacgggaagaatacgtgctgaatgacatcggtgtgattttctatggtgaagtcaatgacatcaaaaccagatcgtggtcatacggccaatttgaggatggcattctggatacctgtttgtacgtgatggatagagcacaaatggacctgtccggacgcggaaatccaatcaaagtgtcgcgcgtggggagcgcaatggtgaacgcaaaagacgacgaaggggtccttgtgggatcgtgggataacatctatgcctacggtgtcccaccaagcgcgtggaccggatcggtcgatattctgctggaatacagatcatcggagaatcccgtccgctacggccagtgttgggtgttcgccggcgtctttaacactttccttcgttgcttgggcattccggcaagaattgttactaattacttctcggcgcacgacaacgacgccaacctccaaatggacattttcttggaggaagatggtaatgtgaactccaagctgactaaagattccgtgtggaactaccattgttggaacgaagcatggatgacgcggcctgatctcccagtggggtttggaggatggcaggcagtggattcgacgcctcaggaaaattcagatgggatgtacagatgcggccctgctagcgtgcaggcaatcaagcatggacatgtctgttttcagttcgacgccccttttgtctttgcggaagtgaattccgatctgatctacattaccgcgaagaaagatggtactcatgttgtggaaaacgttgacgcgacccatattggtaagctgatcgtgaccaagcaaataggtggggatggtatgatggatatcactgacacttacaagttccaggaaggccaagaggaagaacgactggcacttgaaactgcattgatgtacggcgccaaaaagccattgaacacggagggggtgatgaagagcaggtccaacgtggatatggactttgaagtggaaaatgccgtccttgggaaggactttaaactttccattacctttagaaacaattcacataacaggtatactatcaccgcatacttgtccgcgaacataactttttacaccggagtgcccaaggcggagttcaagaaggaaacttttgatgtgaccctcgaacctctttcgttcaaaaaggaggccgtgcttatccaagcaggggagtatatggggcagctgcttgaacaagcctccctgcacttctttgtgactgctcgaattaacgagactagagatgttcttgccaagcaaaaaagcacggtgctgaccattccggagataatcatcaaggtcagagggactcaggtggtgggtagcgacatgactgtcaccgtgcagtttactaaccctctgaaggaaaccctccggaatgtttgggtccacctggacggccctggagtgaccaggccgatgaaaaagatgttcagagagataaggcctaattcaaccgtgcagtgggaggaggtgtgcagaccttgggtttcgggccaccgcaaacttatagcatccatgagctccgattcccttcggcacgtctacggagaacttgacgtccagattcaaagacgtccatcgatg

SEQ ID NO: 9497 - DNA, 2196 bp, Artificial Sequence
  Description of Artificial Sequence: Synthetic coding sequence
atgtccgaaacctcccgcaccgcattcggcggcaggagagccgtgcctccaaataactccaacgccgcagaagacgatttacctactgtggaacttcaaggggtggtacctcgcggcgttaatttgcaggagtttttgaacgtcacctctgtgcacttgttcaaggagaggtgggacactaacaaggtggatcaccacactgacaaatacgaaaataataagcttatagtcagacggggccagtcgttctacgttcaaatcgactttagtcggccttacgacccgcggagagacttgtttagagtggagtacgtgatcgggaggtatccccaggagaacaaaggcacttacattccagtgccaatcgtatccgaattacagtctgggaaatggggtgccaagatagtaatgagagaggataggtctgtaaggctcagtatacagagctcccccaagtgcattgtcggcaaattcaggatgtatgtggcagtgtggactccctacggtgtgctgcgtacctctagaaaccccgaaaccgatacttacattctcttcaatccctggtgcgaggacgacgccgtctacctggataatgagaaggagagagaggagtatgtactgaatgacattggggtgatattttacggggaagtgaatgatatcaaaactcgatcgtggtcctatgggcaattcgaggacggaattctggatacatgcctatatgtcatggaccgggctcaaatggatctctccggaagaggcaaccccattaaggtgtctagagtaggatcagcaatggtgaacgctaaagatgacgagggtgtcctggtcggttcttgggataatatatatgcctatggagtgcctcccagcgcatggaccggttcagtggacatattattggaataccggtcttcggaaaaccccgtgaggtacggtcagtgttgggtctttgcaggcgtgttcaacacgttcctgcgctgccttggtatccctgcccgtattgtgaccaattatttcagtgctcacgataatgatgcaaacctacagatggacatatttctggaagaagacggcaacgtaaattccaagctgaccaaggactctgtgtggaactaccattgttggaatgaagcctggatgacccgcccggacctgcccgtagggttcggtggatggcaggcagttgacagtactccccaggagaacagcgacgggatgtataggtgcggccctgcctcagtgcaggctatcaaacacggacacgtgtgtttccagtttgatgccccatttgttttcgctgaagtgaattctgaccttatctacatcaccgctaagaaggatggaactcatgtggtggaaaatgtcgatgcaacgcacatcggcaagctcattgtcactaagcaaatcggcggggatggaatgatggatattacggacacttataagttccaagaagggcaggaggaagagcggctggccttggagacagcgcttatgtacggggcaaagaaaccccttaataccgaaggagtgatgaagtctcggagcaacgtggacatggattttgaggtggagaacgccgttttgggcaaggacttcaagctgtccattacctttcgcaacaacagccacaatcggtacaccataactgcctacctgtcggcaaacatcaccttctataccggtgttccaaaggccgagttcaagaaggaaacgttcgatgtcaccctggaacctctctcctttaaaaaggaagctgtgctgatccaggccggggagtatatgggacagcttctggagcaggcttcgttgcacttcttcgtgaccgcgcgtatcaacgagacgagggacgtgctggccaagcagaaaagcacggtgctcacaattcctgagattattattaaggtccgtgggacccaagtggtgggcagtgatatgacggttactgtgcagtttaccaacccactcaaagaaacactgcggaacgtatgggtgcatctcgatggcccaggtgtgacacgtccgatgaagaaaatgttccgtgaaatccggccaaatagcacagtacagtgggaggaagtgtgtaggccttgggtgagtggccaccggaagctgatcgcgtccatgagttcggactcccttcggcatgtatatggagagctggacgttcaaatccagcgcagaccgtctatg

SEQ ID NO: 9498 - DNA, 2196 bp, Artificial Sequence
  Description of Artificial Sequence: Synthetic coding sequence
atgtcggagacttcgaggaccgcctttggaggtagacgtgcagtgcctccgaacaactcgaacgcggcggaggatgatctgcccactgtcgaactgcaaggtgtcgtgccgagaggtgtcaacttgcaggaattccttaacgtgactagcgtccatctctttaaagaacggtgggacactaacaaagtggatcaccataccgacaagtatgaaaacaacaagctcatcgtccgtcgaggccaatccttttacgtgcaaattgatttttcacggccatacgacccaagaagggacctgttcagggtggaatacgtgattgggcggtacccccaggagaataagggtacttacatcccagttcctatcgtgtccgagctgcaatccggaaaatggggcgcaaagatcgtgatgcgtgaagatagatctgttcgccttagcattcaaagctcccctaaatgtatcgtgggcaagttccggatgtacgtcgcagtctggactccatacggagtactgaggaccagccgtaatcctgaaaccgatacttacatccttttcaacccatggtgtgaagatgatgcagtgtacttggataacgaaaaggaaagagaggaatacgtgcttaacgacattggagtcatcttttacggagaagtgaatgatatcaaaaccagatcctggtcctacgggcaatttgaggatggaattctggatacctgtctctacgtgatggatcgtgcccaaatggatctctcaggacgcgggaatcctattaaggtatcgcgtgtgggttccgccatggtgaatgcaaaggacgatgaaggagtccttgtgggatcgtgggataacatatacgcatacggggtgccaccgtctgcctggaccggctccgtggatattcttctggaataccggagcagcgaaaaccctgtgcggtacgggcaatgttgggtctttgcgggagtgttcaatacctttcttaggtgtctgggaattccggcacggatcgtgactaattacttctcggcacatgataacgatgcgaacttgcaaatggacattttcctggaggaagatggcaatgtgaattcgaaacttactaaggatagcgtctggaactaccattgctggaacgaagcctggatgactaggccagatctccctgtgggtttcgggggttggcaagccgtggattcaaccccgcaagagaattcagacggcatgtaccgctgtggccctgcctcagtccaggcaatcaagcacggacatgtctgcttccagtttgatgcacccttcgtgtttgcagaagtcaactcagatttgatttacattaccgccaagaaggatggcacccacgtcgtcgaaaacgtggatgcaactcatatcggaaaacttattgtgacgaaacagattggaggagacggtatgatggatatcacggatacctacaagtttcaagagggccaagaggaggagcggcttgcgctcgaaactgcccttatgtacggagcgaagaagcctctgaacactgagggagttatgaagtcgcgatcgaacgtggatatggattttgaggtggagaacgcagtgcttggtaaagactttaaactttcaataacttttcgcaacaactcgcacaatcgatacactatcaccgcctacctttccgcaaacattactttctacactggggtgccaaaagcggagttcaaaaaggaaacctttgatgtgacccttgaaccactttcatttaagaaggaagctgtgctgatacaggcaggagaatacatgggacagctgctggaacaagcatccttgcacttctttgtcaccgcacggatcaatgagactagagatgtgttggcgaagcagaaatccaccgtgctgaccattccagagatcatcattaaggttcgcgggactcaagttgtcggttcagatatgaccgtgactgtgcagtttactaaccctcttaaggagactctgcggaatgtctgggtccatctggatggcccaggagtgactaggcccatgaagaagatgtttcgcgaaattagaccgaattccaccgtccagtgggaagaagtctgtagaccctgggtgtcgggacatagaaagctgatcgcttccatgtcctccgatagcttgcgccacgtgtacggggagctggatgtccagattcaacgtaggccatccatg

SEQ ID NO: 9499 - DNA, 2196 bp, Artificial Sequence
  Description of Artificial Sequence: Synthetic coding sequence
atgtcagaaacctcccgcactgcgttcggtggtcgacgcgcggtcccgcctaataactcgaacgcggccgaggacgacctgcccacggttgagctccagggcgtcgtcccccgaggcgtgaacctccaggagttcttgaatgttacgtctgttcacttgttcaaggagcgatgggacaccaacaaggtggaccaccatactgacaagtacgagaacaacaagctgatcgtccgccgcggacagagcttctatgtgcagatcgatttttccagaccgtacgaccctcgccgtgatctctttcgcgtggaatatgtgatcggtcggtacccccaggagaacaagggcacctacattcctgtcccgatcgtcagtgagctgcagagtggtaagtggggtgccaagatcgttatgcgtgaggaccgctccgtacggctgagcattcagagcagcccgaagtgtatcgttggcaagttccgaatgtacgtggctgtctggacgccttatggcgtcctgcggaccagtcgtaacccggaaacagatacctacatcttattcaatccttggtgtgaggacgacgccgtgtacttggacaatgaaaaggaacgtgaggagtacgtccttaatgacattggtgttatattctatggcgaagtgaacgacatcaagacccgttcatggtcctatggtcagttcgaggacggcattctggacacttgcctctatgtcatggaccgggcacagatggacctgagtggtcgcggaaatccaatcaaagtctctcgcgtgggatccgcaatggtaaacgccaaggacgacgagggtgttctggtgggctcctgggacaacatctatgcctatggcgttccgcctagcgcgtggaccggtagcgtcgatatcctgctggagtaccgtagctctgagaacccagtccgttacggtcagtgctgggtgttcgccggtgtttttaatacatttctccgctgcctcggtataccggcgcgcattgtgacaaattacttctccgcacacgacaatgatgctaatctgcagatggatatcttcctcgaagaggacggcaacgtgaacagcaagctcactaaggactccgtgtggaactatcactgctggaatgaggcctggatgacgcggccggaccttcctgtcggcttcggcgggtggcaggccgttgatagtaccccgcaggagaactccgacgggatgtacagatgcggccctgcgtcggtccaggctattaagcacggccatgtttgctttcagttcgatgcccctttcgtctttgctgaagttaattccgatttgatctacattaccgctaagaaggacgggacacacgtggtcgagaacgtcgacgccacccatatcggtaagcttatcgtgaccaagcagattggtggcgatggcatgatggatatcaccgatacttacaagttccaggagggccaggaggaggagaggctcgcccttgagactgctctgatgtacggagccaagaagccgctcaacaccgagggtgtgatgaagtcaagatccaacgtcgacatggatttcgaggtcgagaatgccgtcttggggaaggacttcaaattgagcattaccttccgcaacaatagccacaatcgatacacgattaccgcgtacctgtcagctaacatcaccttctacaccggcgtgcctaaagccgagttcaagaaggagaccttcgacgtgactctggagcccctctcctttaagaaggaggctgtcctgatccaggccggcgagtacatgggtcagctgctggaacaggcctccctgcacttctttgtcaccgcacgcattaatgaaactcgcgacgttctcgcaaaacagaagtcgacggtgctgacgatccccgaaatcattatcaaggtgcgcggcacacaggtggtaggctctgacatgaccgttactgtccagttcactaacccgctaaaagagaccttgcgcaatgtctgggtgcatctggacggccccggcgtcacacgtccgatgaagaaaatgttccgcgagatacgtcccaacagcaccgtccaatgggaggaggtttgtcgcccctgggtctcgggccaccgtaagctcattgcttctatgagcagtgacagcttgcggcatgtctatggtgaattggatgttcagattcagcgccgcccctctatg

SEQ ID NO: 9500 - DNA, 2196 bp, Artificial Sequence
  Description of Artificial Sequence: Synthetic coding sequence
atgtcagaaactagcagaactgccttcgggggacggagggccgtgcctcccaataactccaatgcagccgaggatgacctgcccaccgtggagttgcagggagtcgtacctcgcggagtaaacctgcaggagtttttaaatgttacttctgttcatctatttaaggagagatgggatacaaataaagtggaccaccataccgacaagtacgaaaacaacaagttgattgtcagacgcggtcagtccttttatgtccagatcgatttcagtcgtccctatgatcccaggcgcgatttgtttagagttgaatacgtgatcggccggtatcctcaggaaaataaaggcacttacatcccagtgcccatcgtgagcgagcttcagtcgggaaaatggggagccaagatagtgatgagagaggatcgatccgtgcgattaagtatacagtcctctccaaaatgcatcgtggggaagttcagaatgtacgtggctgtgtggacaccctacggggtgctaagaacctcccggaacccagagaccgacacgtacattttattcaacccatggtgtgaagacgatgctgtgtacctggacaacgagaaggagcgcgaagaatacgtgctcaacgatatcggggtcatcttctatggagaggtgaatgacattaaaaccagatcatggagctatgggcagttcgaggacgggattttggatacatgtctttacgttatggatagagcccagatggatttatccgggaggggcaacccgatcaaggtatccagggtcgggtcagccatggtcaacgccaaagacgatgaaggcgtgttagttggatcttgggataatatttatgcttacggagtaccgccatcggcttggacggggtcagtcgatattttgctggagtaccggagctccgagaaccccgtcaggtacggtcagtgttgggttttcgccggcgtattcaatacattcttacgctgcctgggtattcctgcccgcattgtgaccaattatttttccgcccacgataatgacgcaaatttgcagatggatatctttcttgaagaggatggtaacgtgaactctaagctcacaaaagattccgtttggaattaccactgttggaatgaagcctggatgacacgtcccgatctccccgttggcttcggcggttggcaggccgtcgactcgacacctcaggaaaactccgacggcatgtatcgctgtggacccgcttccgttcaggcgatcaagcacggccatgtctgctttcagtttgatgccccctttgtatttgccgaggtgaactctgatctgatatacatcaccgcaaagaaggacggaacccacgtcgtggagaacgtggacgctacccatatcggaaagctgatagttaccaagcagatcgggggcgatggaatgatggacataacagacacttataaattccaggaaggccaggaggaagagcgcctggccctagagacagctctgatgtacggagccaagaagcccctgaatacagagggggttatgaagtctagatccaatgtggacatggatttcgaagtcgaaaacgccgtcctaggtaaagactttaaactcagcataacattccggaacaacagccacaacaggtacactattacagcctatctatccgccaacataacgttctatacaggggtgcccaaggcagaatttaagaaggaaactttcgatgtaacgcttgagcccctatcatttaagaaggaggctgtgctgattcaggctggtgagtatatgggccaattactggaacaggcatctctccatttctttgtaactgctcgcattaatgagacacgggacgtgcttgccaagcagaagtccaccgtactaaccatccccgagatcattattaaagtcagaggaacccaggtggtggggtcagacatgacggtgacagtccagttcaccaatcctctgaaggagacattgcggaatgtctgggttcacttggatggaccgggcgtgacgagacccatgaagaagatgttccgagaaatccgtccaaacagtactgtgcagtgggaggaagtgtgcagaccctgggtctccggccatcggaaactgatcgcttccatgagcagcgactcgctgagacacgtttatggagagctcgacgttcagatccagcggcgaccctctatg

SEQ ID NO: 9501 - DNA, 2196 bp, Artificial Sequence
  Description of Artificial Sequence: Synthetic coding sequence
atgtcggagaccagccgcacggccttcggggggcgcagggcagtgcctcctaacaatagcaatgctgccgaggacgacctacctacagtggagctgcagggcgtagttcctcggggggtgaacctacaagagtttcttaatgtgaccagtgttcacctgtttaaggagcgctgggacaccaacaaggtggatcatcacaccgataagtatgagaataacaagctaatagtccgaaggggtcagtccttttatgtgcagattgacttttctagaccctatgaccctagacgcgatctgttccgcgtcgagtatgttatcgggcgctatccgcaggagaacaagggcacctacatccccgtccctattgtctccgagctgcagtccggaaaatggggggccaagatcgtgatgcgggaagacagaagtgtgcgactgtcaattcagagcagcccgaagtgcatcgttgggaagttccgcatgtatgtggccgtatggaccccgtatggcgtgttacgtacaagccgaaatccagagaccgatacctacatcctgtttaacccctggtgtgaggatgatgccgtgtacctggataatgagaaagagcgcgaagagtatgtgctcaacgacatcggggtgatcttctatggggaggtcaatgacattaaaacgcggagttggagctatggacagtttgaagacggcatactggacacttgtctgtacgttatggatcgagcccaaatggatctttctggccgcggtaatccaatcaaagtttcccgggtgggtagtgccatggtgaacgctaaagatgatgagggggtcctggtgggctcatgggacaatatttacgcctacggcgtgccgccgtccgcctggaccggctcggtggatatcctactggaataccggagctctgaaaatcccgtgcgctatggccaatgttgggtgtttgccggcgtgtttaatacttttctgcgatgcctgggaattccagcccgcatcgtcacaaattatttttccgctcacgacaatgacgcgaacttgcagatggatatcttcctggaggaggatggaaacgtgaattccaaactgactaaggacagtgtatggaactaccattgttggaacgaagcctggatgaccaggcctgatctccccgtgggatttggcggatggcaggccgtggacagcacacctcaagaaaattcggacggaatgtaccgatgcgggcccgcgtcagtgcaagccataaaacacggccacgtatgtttccaattcgatgcgccttttgtgtttgctgaggtcaacagtgacctcatctatatcacagcaaagaaggatggtacacacgtggtcgagaacgtcgacgccactcatatcggaaaactgatcgtgacaaagcagattggtggagacggaatgatggacatcaccgacacttataaatttcaggaaggccaggaggaggaacggttggccctggagacagcactgatgtatggcgccaagaaaccattgaatacagagggcgtgatgaaaagtagaagcaacgtggacatggattttgaggtcgaaaatgccgtgttgggcaaagacttcaaactgtccatcactttccgaaataattcacacaatcggtataccatcactgcgtatctctctgctaatatcaccttctacactggtgtgccaaaggctgaatttaagaaggagacatttgacgtgaccctcgagcctttgtcttttaaaaaagaagccgtgctgatccaagctggtgagtacatgggtcagttgctggagcaagcctccctccacttctttgtcaccgcccgcataaacgagactcgggatgtgctggccaaacagaagtccacagttttgaccatccctgaaattattatcaaggtccgcggcacacaggtcgtgggcagtgatatgaccgtgactgtacagttcaccaatccattgaaagagacgctgcggaacgtatgggtccatcttgatggcccaggtgtgacccggcctatgaaaaagatgtttcgggagattagacctaacagcaccgtccagtgggaggaggtgtgccggccctgggtgagcggccaccgcaaattgatcgcgagcatgtctagtgactccctgcggcatgtgtatggagaactggacgttcagatccaaaggaggccaagtatg

SEQ ID NO: 9502 - DNA, 2196 bp, Artificial Sequence
  Description of Artificial Sequence: Synthetic coding sequence
atgagcgagaccagtagaaccgcgttcgggggacgccgtgccgttcccccaaacaactctaatgctgcagaggacgatttgcctaccgtcgaattgcagggcgtggttccacgcggggttaaccttcaggagttccttaacgttactagcgtccaccttttcaaagaacgctgggatactaacaaggttgatcatcacacagataaatacgaaaacaataagttgatcgtgcggagagggcaaagcttttacgtgcagatcgactttagcagaccttacgaccctagaagagatctttttagggtggagtatgtgatcggtaggtatccccaagaaaacaagggaacctacatccctgtcccaatcgtctccgaactgcaatccggcaaatggggagctaagattgtcatgcgcgaagataggagcgtcagacttagtattcagagctcccctaaatgcatcgtggggaagtttaggatgtatgtggccgtgtggacaccttacggagtgctgcgcacatcgcggaacccagagacagacacctatattttatttaacccgtggtgcgaagatgacgcggtctacctggacaacgagaaagagcgggaagaatacgtgcttaatgatatcggagtcatcttttatggtgaggttaatgatatcaagacgcgatcgtggtcatacggccagttcgaagacgggatcctcgacacatgtttgtatgtcatggaccgtgcacaaatggacctttccggaagaggtaaccccattaaggtcagccgggtgggaagcgctatggtaaatgctaaagatgacgaaggcgtcctcgtgggctcgtgggacaatatctacgcttatggggtccctcccagcgcttggactggcagcgtggacatcctcctggaatatcgctccagtgagaatcccgtgaggtacggtcagtgttgggtttttgcaggggttttcaacacttttctgagatgtctgggaattccagcgcgcatcgttactaactacttcagtgcacatgacaacgacgctaatctgcagatggacattttcctggaggaagatggaaacgttaactctaaactcacaaaggatagcgtttggaactaccactgttggaatgaagcatggatgacgagaccagatctgccggtcgggtttggaggctggcaggccgtcgatagcactccccaggaaaacagcgacggaatgtacagatgcggcccggctagtgttcaggctatcaagcacggacacgtctgcttccaatttgacgccccctttgttttcgccgaagtcaactccgatttgatatatattacagccaaaaaggatggaacccacgttgtcgagaacgtggatgctacgcatatcggtaagctgattgtgaccaaacaaattggaggagatggtatgatggacatcactgacacatacaaatttcaagagggacaggaagaagagaggctcgccttagagactgccttgatgtacggagcaaagaagccacttaatacagaaggagtaatgaaaagcaggagcaatgtagatatggactttgaggttgaaaatgctgtcttgggcaaggacttcaaactcagcatcacattcagaaacaactctcataacagatataccattacggcttacttgagcgccaatatcaccttttacaccggcgttcccaaagctgagtttaaaaaagaaacctttgatgtaacgttggaacctctgagcttcaaaaaagaagccgtcctcattcaagccggcgaatatatgggccaattgctggagcaggcttctcttcacttcttcgtgactgctaggattaacgaaacgcgcgacgttctggctaaacagaagtcaaccgtcctcaccatccccgaaataatcatcaaagtccgtggaacacaggtcgtgggctctgacatgacagttaccgtgcagtttacaaaccccctgaaagaaaccctgcgaaacgtctgggtccacctcgacgggccaggggttacccgtcctatgaagaagatgttccgggagatcagacctaattcgactgtgcagtgggaagaggtgtgccggccttgggtgagcggacataggaagcttatcgcttctatgtcctcggatagcctgcgccacgtctacggcgagctggacgtgcagattcagagaagacctagcatg

SEQ ID NO: 9503 - DNA, 2196 bp, Artificial Sequence
  Description of Artificial Sequence: Synthetic coding sequence
atgtcggaaacttcccggactgctttcggtggccgacgggctgtcccaccgaataactcgaacgccgcagaggacgatctcccaactgttgagttgcagggagtggttccgcgcggcgtgaatctgcaggagttcttgaatgtcaccagcgttcatctgtttaaggaacggtgggacaccaacaaggtcgaccaccataccgacaagtacgagaacaacaagttgatcgtgcggcgcggacagtcgttctacgtccaaatagacttttcgaggccgtacgaccctagacgggatctttttcgggtggagtacgttattgggcgctatccgcaagaaaacaagggaacttacatcccggttccgatcgtgtccgagctgcagagcggaaagtggggagccaagattgtcatgcgcgaagataggtcagtgcgcctgtcgattcaatcgtcacctaagtgcatcgtgggaaaattcagaatgtacgtggccgtctggaccccgtacggtgtgcttcggacttcgagaaacccggaaaccgacacgtatatcctcttcaacccttggtgcgaggacgatgccgtctacctcgataatgagaaggaaagggaggaatacgttctcaatgatatcggcgtgatcttttacggtgaggtcaatgacatcaagaccagatcgtggagctatggtcagttcgaggatggaatcctggacacttgcttgtacgtgatggaccgggcacagatggatctctcgggtcgcggaaaccccattaaagtgtcgcgggtgggaagcgccatggtgaatgcaaaggacgacgaaggggttttggtggggtcatgggacaacatctacgcttatggcgtgccgccgtccgcatggaccgggtctgtggatatcctgctggagtaccgctcctctgagaacccggttcggtacggacagtgttgggtgttcgcaggagtgttcaataccttcttgcggtgcctgggtatcccggccagaatcgtgaccaactacttcagcgcccacgacaacgacgccaacctccagatggacatcttcctggaagaagatggcaatgttaactcgaaactgactaaggattctgtctggaattaccactgttggaacgaagcctggatgaccaggcccgatcttcctgtgggcttcggcggatggcaggcagtcgattcaactccgcaggaaaactccgatggtatgtaccggtgcggccccgcatccgtgcaggccatcaagcacggacacgtttgcttccaatttgacgcgccgttcgtctttgccgaagtgaactccgacctcatttacatcaccgccaagaaggatggaactcacgtggttgaaaacgttgatgctactcatatcggcaagctcatagtgactaaacagatcggaggagacgggatgatggacatcaccgacacttacaaattccaggaaggacaagaagaagagcgcctcgccttggagactgcgctgatgtatggtgctaaaaagcctctgaatactgagggagtgatgaaatcgcgcagcaacgtagacatggacttcgaggtggaaaacgcagtcctcggaaaggactttaagctctccatcaccttccggaacaattcccacaatagatacaccatcaccgcgtacctttcggctaacatcactttctacaccggagtcccgaaggctgagttcaaaaaagagacttttgatgtgaccctcgagcctctgtccttcaagaaggaagccgtgctcatccaagctggggaatacatggggcagctgttggagcaagccagcctgcatttcttcgtgactgcgcggattaacgagactcgagacgtgctggcgaagcagaaatcaactgtgctcactatcccggagattatcatcaaggtgagaggtacccaagtggtcggatccgatatgacggtgaccgtccagttcaccaacccactcaaagagactctgcgcaacgtgtgggtgcacctggacggccctggagtcacgcgccctatgaagaaaatgttccgagagatccgccctaactccacggtgcaatgggaagaagtgtgcaggccgtgggtcagcggccatcgcaagctgattgctagcatgtcgtctgactcactccgccatgtgtacggagaactggacgtgcaaatccagagacggccatcgatg

SEQ ID NO: 9504 - DNA, 2196 bp, Artificial Sequence
  Description of Artificial Sequence: Synthetic coding sequence
atgtcagaaacatccaggaccgcctttgggggacgtagggccgtcccccctaataatagcaatgctgcggaggacgatctcccgaccgttgagcttcagggggtggtcccaaggggggtgaacctccaggagttcctgaacgtgaccagcgtccatctgttcaaggagcggtgggataccaacaaggtggatcaccacaccgacaagtacgaaaataacaaacttattgtgcggaggggtcagtctttttacgttcaaattgacttttcacggccttatgaccctagacgcgacctgttccgagtagagtacgtcattgggcgatatccccaggagaacaagggaacctatatcccagtgcccattgtgagcgagctccaaagtggaaagtggggtgccaaaatagtgatgagagaggacagatcagtccgtctctcaatacagagctcccctaaatgcatcgtggggaaattccggatgtacgttgccgtgtggacaccctatggggtgcttcggacgtctagaaacccggaaacggatacctatatccttttcaatccctggtgcgaagatgacgctgtgtatctggataacgagaaagagcgcgaggaatatgtgttaaatgatatcggagtgatcttctacggtgaagttaacgacatcaagactaggagttggtcatacggacagttcgaggacgggatcctggatacctgcctctatgtgatggatagggcacagatggatctctccggcagaggcaaccccattaaggtgtcacgagtggggtccgcgatggttaacgcgaaagacgatgaaggtgtgctcgtgggatcatgggataacatctatgcgtacggcgtgccccctagcgcatggacaggaagtgtggacatcctccttgagtaccgctcatctgagaacccggtgaggtacgggcagtgctgggtgttcgccggggttttcaacacattcctgcggtgtctcggtatcccagcacggattgtgacgaattatttttccgcccatgacaatgatgccaatctgcagatggacatcttcctggaggaggatgggaacgtaaattcaaaactgactaaggactccgtttggaactaccattgctggaatgaagcctggatgaccagacccgatctgcccgtgggctttggtggctggcaggctgtggattccacaccccaggagaattctgacgggatgtatcggtgtggcccggctagcgtccaggccatcaagcacggccatgtgtgcttccagtttgacgccccgtttgtgttcgctgaggtgaattccgacttgatttacatcaccgcaaaaaaggatggtacccacgtagttgaaaatgtagacgctacacacattgggaaactcatcgtgaccaagcagatcggaggagatggtatgatggacatcaccgacacatataaattccaggagggtcaagaagaggaacggttggccctggagactgccttaatgtatggggctaaaaagcccctaaataccgaaggggtgatgaagtcgcggagtaacgtggatatggatttcgaggtggagaatgcagtgttaggaaaggatttcaagctgtccatcacttttagaaacaactctcacaaccgatataccattactgcctatctaagcgctaacatcaccttttatacaggtgtgcctaaagctgagtttaaaaaggaaacatttgatgtgaccctagagcccctgtcattcaagaaggaggcagtgctgatccaggccggagagtatatgggtcagctcttagagcaggcaagcctccacttctttgtgaccgcaagaattaatgaaacacgcgacgtcttggccaagcagaaaagtacggttttaaccataccagaaattattatcaaagtgagagggacgcaagttgtgggctcagatatgactgtcaccgttcaattcaccaacccacttaaagaaacactcagaaacgtgtgggtgcaccttgatgggcccggggtcacccgcccgatgaagaagatgttccgcgagattcgtccaaactcaaccgttcagtgggaggaggtatgtaggccctgggtgagcggacaccgcaagctgatcgcctccatgagctccgactcactccgccacgtgtatggggagttggacgtgcaaatccagagacgcccctctatg

SEQ ID NO: 9505 - DNA, 2196 bp, Artificial Sequence
  Description of Artificial Sequence: Synthetic coding sequence
atgtcagagacatcgcgtacggccttcggaggccgacgcgctgtgccccccaataacagcaacgccgccgaggacgacttgcccactgtcgagctccagggggtcgtgccacggggagtcaacctgcaggagtttctcaatgttaccagtgtgcacctgttcaaagaacgttgggacactaataaagtggaccaccacaccgataagtacgaaaacaataagctgattgtgcgccgtggacagagcttttatgttcaaatcgacttttcacgaccatacgacccccgccgggatctgttcagagtggagtatgtaatcggtagatatccccaggagaacaaggggacctatatacctgtccccattgtgtctgaactgcagtctggcaagtggggagctaagatagttatgagggaagacaggagcgtgagattgagcattcagagctctcctaaatgtatcgtggggaagtttcgcatgtatgttgccgtctggacgccatacggggtcctacggacatctcgtaacccagagacagacacttacatcctgttcaacccctggtgcgaggacgatgcagtctatcttgacaatgagaaggagcgtgaggagtacgtgctgaacgacatcggtgtgatcttttacggcgaagtgaacgacattaagacgagatcttggagctacggccagttcgaagatggaattctcgacacttgcctgtacgtgatggatagggcgcagatggacctttctggaagaggcaatcccatcaaagtcagccgcgtgggttctgccatggttaatgcgaaagatgatgagggggttttggtcgggtcctgggataacatatacgcatacggagttcccccttctgcctggacaggaagtgtcgatatcctgctcgagtaccggtcatccgaaaatccagtgaggtatggacagtgttgggtgtttgctggcgtattcaacactttcctgagatgtctgggcattccagcccgtatagtgacaaattacttctccgcgcacgacaacgacgcaaacctacagatggacatatttctcgaagaggatggcaatgtgaatagcaagctcacaaaggactcggtgtggaactaccactgttggaatgaagcctggatgactcgtcctgacttgcctgtgggctttggaggctggcaagcagtggattctaccccccaggagaactcagatggcatgtatcgctgtgggcctgcgagcgttcaggccatcaaacacggacacgtctgttttcagttcgacgccccctttgtgttcgcggaagtgaacagcgacttaatctacatcaccgcaaagaaggatggtactcacgttgtcgaaaatgttgacgccactcatattggcaagctcatagttaccaaacagatcggaggcgacgggatgatggatatcacggatacctacaagttccaggagggacaggaggaggagcgactggcccttgagactgcactcatgtacggggctaaaaaacctctgaacactgaaggcgtgatgaagtcccgatcaaacgtcgacatggacttcgaagtggaaaatgctgttttgggtaaggacttcaagctgtcaataacattccgcaacaactctcacaataggtacactataaccgcctacttgagtgccaatatcactttctatactggtgtgccaaaggccgagttcaaaaaggagacttttgacgttacgcttgaacctctgagttttaagaaggaggcagtcttaatccaggcgggagaatacatgggacagctcttggagcaggcatctctgcatttcttcgtcaccgcccgcattaatgaaacacgggacgtattggcaaaacagaaaagcaccgtcttgaccatccccgaaattatcatcaaagtgcgaggcactcaggttgttggctccgacatgacggtgacagtgcagttcacaaacccactgaaggagacactccgcaatgtctgggtgcatcttgatgggcctggggttacccgccctatgaagaagatgtttcgagagattcggcctaattctacagtgcaatgggaggaggtttgccgtccttgggtttccggccatagaaagctgatagcctccatgtccagtgactcactgaggcacgtatatggggagcttgacgtgcagattcagcgacgccctagcatg

SEQ ID NO: 9506 - DNA, 2196 bp, Artificial Sequence
  Description of Artificial Sequence: Synthetic coding sequence
atgagcgaaactagcaggactgcattcgggggacgccgggccgtgcctccgaacaactccaatgctgccgaggatgacctgcctacggtggaactgcagggagtcgttccgcggggagtgaatctgcaggagttcctcaacgtgacttcggttcacctgttcaaggagcgctgggatactaataaggtcgatcaccacaccgacaagtacgaaaacaacaagttgatcgtgagacgcggtcagagcttctacgtgcaaatcgatttctcgcggccatacgaccctcggagggatctgtttagggtcgaatacgtgatcggaagatacccacaggaaaacaagggtacctacatccctgtgccgatcgtctcagagctgcagtctggaaaatggggggcaaagattgtgatgcgggaggacagatcagtgcgcctctcaattcagtccagcccgaagtgcatcgttggaaagtttaggatgtacgtcgccgtgtggactccgtacggcgttctgcgcacctcccgcaacccagagactgacacgtacatcctgttcaatccgtggtgcgaagatgacgcagtgtatctcgataacgaaaaggagcgcgaagaatacgtgctgaatgatattggagtgatcttctacggggaagtgaatgacataaagactcggtcctggtcctacggccagttcgaggatggtatcttggacacgtgcctctacgttatggacagggctcaaatggacctgagcggacgcggcaatccgatcaaggtgtcacgcgtcggctccgctatggtcaacgccaaggatgacgagggagtcctggtgggatcatgggataacatttatgcctacggcgtcccgcctagcgcatggactggatcagtggacatcctgctcgaatacagaagcagcgaaaacccagtgaggtacgggcaatgttgggtgttcgccggagtctttaacaccttcctgcgctgcctgggaatcccagcgcgcatcgtgactaactatttctccgcccatgataatgacgcgaatctgcaaatggacatcttcctggaggaggacggtaatgtgaactcgaagctcactaaagattccgtctggaactatcactgttggaatgaggcatggatgactcggccggacctccctgtcgggttcgggggatggcaggcagtcgattcgaccccgcaagaaaactcagatggaatgtaccggtgtggaccagcatcggtgcaggcaatcaagcatggacatgtgtgtttccagttcgatgcgccgttcgtgttcgcggaggtgaactcagacctcatctatatcaccgcgaaaaaggacggaacccacgtggtggagaacgtggacgcgactcatatcggcaagctcatcgtgaccaagcaaatcggcggtgacggtatgatggacatcactgatacttacaagtttcaggagggtcaggaagaggaacggctggcccttgaaaccgcccttatgtacggagcaaagaagcctctgaacacggagggcgtgatgaagtctcgcagcaatgtggacatggacttcgaagtggaaaacgccgtgctcggcaaagacttcaagctctcgattaccttccgcaacaatagccataatcgctacactattacggcctacctgtccgccaacattacgttctacaccggagtgccgaaggcagagttcaaaaaggagactttcgatgtgaccctcgaaccgttgtcgtttaagaaggaagccgtcctgatccaggccggagagtacatgggacagctgctggaacaggcatccctgcatttcttcgtgaccgcacgcatcaacgagactcgggacgtgctggcgaagcaaaagtcaaccgtgctcactattccagagatcatcatcaaagtgcgcgggactcaggttgtgggatcagatatgactgtcaccgtgcagtttaccaaccctctgaaggagactcttcgcaacgtgtgggtgcacctcgacggtccgggggtcactcgcccgatgaaaaagatgtttcgcgaaatccgcccgaactcaaccgtgcagtgggaagaagtgtgccggccgtgggtgagcggacaccgaaagctgatcgctagcatgtcgtcggattccctcagacacgtgtacggagagctggacgtgcaaatacaacggcggccgagcatg

SEQ ID NO: 9507 - DNA, 2196 bp, Artificial Sequence
  Description of Artificial Sequence: Synthetic coding sequence
atgagtgagacgtcccgtactgcattcggaggccgtcgggcagtgccacctaacaactctaacgcggctgaagatgatctcccaaccgtggaactgcaaggagtcgtgcctcggggggtcaacctccaagaatttctcaatgtgactagtgtgcatctgtttaaggagcgctgggacactaacaaggttgaccaccataccgataagtacgaaaacaacaaattgattgtacggagaggccagtcgttctatgttcagatcgacttttcccgaccatatgaccctaggcgtgatctctttagggtcgagtacgttataggacgctacccacaagagaacaagggaacgtacattccggttcctatcgtgtcggagctgcaatccggaaagtggggagccaaaatcgtgatgcgagaggacaggtccgtgcgcctgtcgatccaatcctcccctaagtgtattgtgggcaagtttcgaatgtacgtcgcagtctggactccgtacggtgtgctgagaacttcgagaaacccagaaaccgacacctacatcctcttcaacccatggtgtgaggacgatgcggtttacttggacaatgagaaagaacgagaggagtacgtgctcaatgacattggggtgatattctacggtgaagtgaatgacattaagaccagatcctggagctatggacaattcgaggatgggattctggacacctgcctgtacgtcatggacagggcccagatggatttgtcaggacggggaaatcctattaaggtgagccgcgttggcagcgctatggtcaatgcaaaagatgatgaaggtgtgctggtgggttcgtgggataacatttacgcctacggagtcccaccctcagcctggaccggctccgtggatatcctcctggaataccgctcctccgaaaatccagtgcgctacggacaatgttgggtctttgcaggggttttcaataccttcctgcgttgtcttggaattcctgcacggatcgtcaccaactacttttcggcccatgataacgatgcaaaccttcaaatggatatctttctggaagaagatgggaacgtgaattccaagctgactaaagattcggtgtggaactaccactgctggaacgaagcgtggatgacgcgcccagaccttcctgtgggatttggaggttggcaggccgtcgacagcacgccacaagaaaactccgatggaatgtaccggtgtggtccagcctccgtgcaagctatcaaacatggtcacgtgtgctttcaatttgatgccccattcgtctttgcggaagtcaactcagatctcatttacatcactgcaaagaaagatggtacccacgtggtggaaaatgtggatgcaacgcatataggcaagttgatcgttactaagcagatcgggggtgatgggatgatggacattactgacacttacaagtttcaagaaggtcaagaagaagaaagacttgctcttgaaaccgcactcatgtacggtgcgaaaaagccgcttaacacggaaggtgtgatgaagtcgagatcaaatgtggatatggacttcgaggtggaaaatgcagtcctcggaaaagatttcaaattgtccatcacctttcggaataactcccataacagatacactattacggcgtatctttcggcaaacattaccttctacaccggtgtcccaaaggccgagtttaagaaggaaacctttgatgtgactctcgagccactttcgtttaagaaagaagcagtgctgatacaagcaggtgaatacatgggtcagctgctggagcaagcgagcctgcatttcttcgtgacggccagaattaacgaaacccgcgacgtgctggcaaaacagaagtccaccgtccttacgatcccggaaatcatcattaaggtgcgtggtacccaggtggtgggatcagatatgaccgtaactgtgcaatttacgaaccctctcaaggaaactctgaggaacgtgtgggttcatcttgacggtcctggggtcaccagaccgatgaaaaagatgtttagagaaatccgccctaatagcaccgtccagtgggaggaagtgtgtagaccatgggtgagcggacatcgaaagctcattgctagcatgtcgtcggattctcttaggcacgtgtacggggaactggatgtccaaattcagaggcgcccttcgatg

SEQ ID NO: 9508 - DNA, 2196 bp, Artificial Sequence
  Description of Artificial Sequence: Synthetic coding sequence
atgtcagaaacaagtcgcactgccttcggcggcaggcgggctgtgcctcccaacaactccaatgccgccgaggatgacctgcctactgtagaactgcagggcgtcgtgcctaggggtgtgaatctgcaagagtttctcaatgtaacgagcgttcacctgttcaaagagaggtgggatacaaataaggtggatcaccacaccgataagtacgagaacaataagcttatcgtcagacgcggacagagcttttatgtgcagattgattttagccggccttatgatcccaggcgagatctgttcagagtggagtacgttatcgggagataccctcaggagaacaagggcacgtacatccctgtaccaattgtgagcgaattgcagtccggaaaatggggtgctaagatagttatgcgcgaggatagatctgttaggctgtctattcagtcttctcccaaatgcatcgtcgggaaattccgcatgtacgttgctgtgtggaccccttacggcgtgctgcgcacctcccgaaacccagagactgatacctacattctttttaacccatggtgcgaagacgacgctgtgtatctggataatgaaaaggagagggaggagtatgtgctgaatgatattggtgtaattttctacggtgaagtgaatgatatcaaaaccagaagttggtcatatggacagtttgaggacgggatcttggacacgtgcctctacgtgatggaccgggctcagatggatttgtctgggcgcggcaatccaatcaaggtgtctagagtaggctcagctatggtaaacgccaaggatgatgaaggggtcctcgtgggctcatgggataatatctatgcgtacggagtgcccccttctgcgtggacaggatccgtggatatactgcttgaatatcgcagcagtgagaaccctgtgcgctacggccaatgttgggtgtttgccggcgtgtttaacacatttctgagatgcctgggaattccagcaaggatcgtaaccaattacttctccgctcacgataacgatgccaacctgcagatggacatattcctggaggaggatgggaatgtgaactctaagctgactaaggactctgtgtggaattatcactgctggaatgaagcttggatgaccaggccggacctgcctgtcggattcggtggatggcaggccgtagacagcactccacaggaaaatagcgatgggatgtacagatgcggtcctgcatctgtgcaagctattaagcacggccacgtgtgtttccagttcgatgcccctttcgtattcgctgaggtgaattcagatctgatttacataacggctaagaaagatggaacccatgtggtagagaacgttgatgccacccatatcggtaaactgatcgtcaccaagcagatcggtggggacgggatgatggacatcaccgacacctacaagtttcaggagggccaagaggaagagaggctggcactcgagactgccttgatgtacggtgctaagaaaccacttaacacagagggtgttatgaagtctcgatccaacgtggacatggatttcgaggtggagaacgcagttctcgggaaagacttcaagctgtctatcacatttaggaacaacagtcacaaccgctatacaatcacggcctatttgtccgctaatattacattctataccggcgtgccgaaggctgagtttaaaaaggagacgtttgacgtgaccctggaacctctctcattcaaaaaggaagcagtcctcatacaggcgggagagtatatgggacagcttctcgagcaagcatccctgcacttttttgtgacagcacggatcaacgagacccgggacgtgttggccaaacaaaagagcacagtactcacaattccggaaattattattaaggtaaggggcacgcaggtggtggggtctgacatgacggttacagtgcagtttaccaaccccttgaaagaaaccctgcggaatgtatgggtgcatctggacggcccaggcgtgacccgccctatgaagaaaatgttcagggagatcaggccaaactctacagtgcagtgggaggaagtctgtagaccctgggtgtctggccaccgaaagttgattgcgtccatgagctccgactccctgaggcatgtgtatggtgaactcgacgtgcaaatccagcgccgcccatccatg

SEQ ID NO: 9509 - DNA, 2196 bp, Artificial Sequence
  Description of Artificial Sequence: Synthetic coding sequence
atgtctgaaacctctcgtacggcattcggtggacgacgagccgtccctcctaacaatagcaacgccgcggaggacgatttgcccactgtcgagttgcagggtgtggtccctcggggcgtcaatttgcaggaatttttaaacgtcacttccgtacatctgtttaaggagcgttgggatacgaacaaagttgatcatcacacagacaagtatgagaacaacaaacttatcgtgcgcaggggtcaaagtttttacgtacagattgattttagtcgaccgtacgacccccggagggatctgtttagagtagagtacgtcattggccgctatccccaggaaaacaaaggcacctacattcctgttccaattgtctcagagctgcagtcaggcaagtggggtgcgaagatcgtcatgagggaggacagaagtgtgcgcctgagcattcagtcttctcctaaatgcatcgtgggaaaattcagaatgtatgtcgctgtttggacaccatacggggtcctccggactagtaggaaccccgaaactgacacatacattctgttcaacccttggtgcgaggacgacgccgtgtacttggacaacgagaaggagagagaggagtatgtcttaaatgatatcggcgtgatattttatggggaagtcaatgacatcaaaaccaggtcctggagttatggccagtttgaagatggaatcctcgatacatgtctctatgtaatggaccgggcacagatggatctcagcgggcgcggcaacccaataaaggtgtcccgagtcggttctgcgatggtgaatgctaaggacgacgaaggggttctggtgggatcttgggacaatatctacgcgtacggggtgccacctagtgcttggacagggtctgtagatattctgttggagtatagaagcagtgagaatcccgtcaggtatggccaatgctgggtgttcgcaggggtgttcaacacatttttaagatgtttgggtattccagcaaggattgtgacaaattatttcagtgctcatgacaatgacgccaacctgcagatggacatttttcttgaggaggacggaaacgtgaatagcaagctcacaaaggatagtgtgtggaactatcactgctggaatgaggcctggatgacccgcccagacttgcccgttgggttcggaggatggcaggcagttgacagcaccccgcaagagaactccgatggtatgtaccgctgcggacccgcgtccgtgcaagccatcaaacacggccacgtgtgtttccagtttgatgccccgtttgttttcgcagaggtcaattccgatcttatttacatcactgcgaaaaaagatggaactcacgtagtggagaacgtagacgctacacacatcggcaagttgattgtaaccaagcagataggtggggacggcatgatggatataactgacacctacaaatttcaagagggtcaggaagaggagcgcttagccttagagacggccctcatgtatggcgcgaagaagcccctgaatacagaaggtgtcatgaagagcagatcaaatgtggatatggattttgaagttgagaatgcggtgctggggaaggatttcaaactcagcattacatttcgaaacaatagccataatagatatacaattaccgcatatctctcggctaacatcactttctataccggggttccgaaggccgaattcaagaaagaaacatttgatgtgacactggaacctctgagtttcaagaaagaagcagtgttgatccaggcaggcgaatacatgggtcagctgttggaacaagccagccttcacttttttgttacagccaggatcaatgaaactcgggatgtcctggctaaacagaagtccaccgtgctgaccatccccgagattatcattaaagtgaggggaacccaggtcgtggggtcggacatgacagtgacagtgcaatttaccaatcctctgaaggagaccctccgcaacgtttgggtgcatctcgacggccctggcgtgacaagaccgatgaaaaagatgttccgggagatccggcccaacagcacagtccagtgggaggaagtttgcagaccttgggtctctggccaccggaaactaatcgcctctatgtcctctgactccctgaggcatgtctatggtgaactggatgtccagattcaaaggcgaccttctatg

SEQ ID NO: 9510 - DNA, 2196 bp, Artificial Sequence
  Description of Artificial Sequence: Synthetic coding sequence
atgtcggaaaccagccgcactgcgttcggcgggagacgtgcagtgccaccaaataactccaatgcagcggaagatgatctgcctacggtggagctccaaggagtcgtgccaaggggggttaacctccaagaatttcttaacgtcaccagcgtccatctgtttaaggaacgctgggacaccaataaggtggatcatcatactgacaagtacgagaacaacaaactgattgtgcgaagaggtcagtccttctacgtacaaattgatttctcaagaccgtacgaccctcggcgtgatctttttcgcgtggaatacgtgatcggacgataccctcaggaaaacaaggggacttacatccctgtccctatcgtgtcggaactgcaatcaggaaagtggggagccaaaatcgtgatgcgagaggaccgcagcgtgcgactttcgattcaatcgtcccctaagtgcatcgtgggaaagtttagaatgtacgtagcagtgtggactccatacggtgtcctccgaaccagccgcaatcccgaaaccgatacctacattttgtttaacccatggtgtgaagatgatgctgtgtacctcgataacgaaaaggaaagagaggagtacgtcctgaacgatatcggtgtgattttctacggtgaggtcaatgatatcaaaacccgatcgtggtcatacggccagtttgaagatgggatcttggatacgtgcctgtacgtcatggatagagcgcaaatggacctgagcggtagggggaatcctatcaaggtgtcccgagtgggctctgcaatggtgaacgccaaagatgacgaaggtgtgctggtgggatcctgggacaacatttacgcttacggagtccctccctccgcctggaccggctcagtggatattctccttgagtatcgttcctccgagaatcccgtgcgctacggacaatgttgggtctttgctggtgtgttcaacacttttcttcggtgtcttggaattcccgcacgcattgtcaccaactacttctcggcacacgataacgacgcaaacttgcaaatggatatctttctcgaagaggatggcaatgtgaacagcaaacttaccaaagactcagtttggaattaccactgttggaacgaagcatggatgacgcggccggatcttccagtgggttttggaggttggcaggccgtggactcgactccccaagagaactccgatggaatgtatagatgtgggccagcatctgtccaagctatcaagcacgggcacgtgtgctttcaattcgacgcaccatttgtttttgccgaggtgaactccgatctgatatacatcactgcaaaaaaggatgggacccatgtcgtggaaaacgtggacgcaactcatattggcaagctgatcgtcactaagcaaataggaggggatggcatgatggacattaccgacacttataagttccaggaaggacaggaagaggaacgtttggcactggaaactgccctgatgtacggagcgaagaagcctctcaataccgagggggttatgaagagccgatctaatgtggacatggacttcgaggtggaaaatgccgttctcggtaaagatttcaaactctccataacttttcgaaataactcccataacagatacaccattaccgcttatctttccgcaaacattactttttacactggggtgccaaaagcagagttcaaaaaggaaacctttgatgtcaccctggaaccccttagctttaagaaggaggcagtgcttattcaagctggagaatacatggggcaacttctggagcaggcgtctctgcatttctttgttacggcccggattaatgagactcgggacgtgctcgccaagcagaagagcacggtgcttacgattccagaaatcatcatcaaggtgcgaggaactcaggtggtgggctccgatatgactgtgactgtgcaatttaccaaccccctgaaagaaaccctcaggaacgtgtgggtgcatctggatggccctggagtcacccgacctatgaagaagatgtttcgagagattcgccccaactccaccgttcagtgggaggaggtgtgtaggccttgggtgtcgggtcacaggaaactgattgcatccatgtcctcggattccttgagacatgtctacggagaacttgacgttcagatacagaggcggccgtccatg

SEQ ID NO: 9511 - DNA, 2196 bp, Artificial Sequence
  Description of Artificial Sequence: Synthetic coding sequence
atgagcgaaactagtcggaccgcattcggtggccggagggcagtccctccgaacaactcaaatgccgctgaggacgacctgccaacggtcgagttgcagggggtggtcccgcgcggcgtaaaccttcaagaattcctcaacgttacgagcgtgcacctcttcaaggagagatgggacaccaataaggtggatcatcacaccgacaaatacgaaaacaataagctgatagtacgcaggggacaatcattttacgtgcagatcgacttctcccggccatacgaccctagacgggacctgttccgggtggagtacgtgatcggaaggtacccgcaggaaaacaaaggaacttacatcccggtcccgattgtgtccgaactccagtctgggaaatggggagccaaaatcgttatgcgcgaggatcgctctgtgagactgtcgatccaatcgagcccgaaatgcatcgtgggaaagtttcggatgtacgtggccgtgtggaccccctacggggtgttgagaacttcaaggaatccggaaacggatacctacatcctgttcaacccatggtgcgaggatgatgcggtgtacctcgataacgaaaaggaaagggaagaatacgtgctcaacgacattggcgtcattttctacggtgaggtgaatgatatcaagaccagatcctggtcatacggccaatttgaggatgggattctggatacttgtctgtatgttatggatcgcgcccaaatggatctcagcgggcgtggaaatccgatcaaggtgtcgcgcgtgggatccgccatggtgaacgctaaggacgacgaaggcgtgcttgtgggatcgtgggacaacatttacgcctacggagtgcctccttcagcgtggactggtagcgtggacattctgctggaataccgctcaagcgagaaccccgtgcgttatggccagtgctgggtctttgcgggggtattcaatacctttctccgatgtctcgggatccctgcacggatcgtaactaattacttttcggcccatgacaacgacgccaacctgcaaatggacatcttcctcgaggaggacgggaatgtgaactcaaaactcaccaaggacagcgtgtggaattaccattgctggaacgaagcatggatgacccggcccgacctgccagtgggtttcggaggatggcaggctgtggattcgactcctcaggaaaactccgacggaatgtaccggtgcgggccggcctcggttcaggcaattaagcacggccatgtgtgtttccaatttgacgcgccattcgtgttcgcagaggttaatagcgatctgatctacatcaccgcgaaaaaagacggaacccacgttgtcgagaatgtggacgccacccatatcgggaagctgatcgtcaccaagcagatcggaggggacggaatgatggacatcaccgatacttacaagttccaggagggacaggaggaggaacgcttggcgctggaaactgcgttgatgtacggagccaagaaacccctgaatactgaaggcgtcatgaagagcagatcgaacgtcgacatggatttcgaggtcgagaatgccgtcctgggcaaggatttcaagctgagcatcactttccgcaacaactcgcacaaccggtatactatcaccgcctatctttcagcaaacattaccttctacaccggtgttccaaaggccgaattcaaaaaagaaacctttgacgtcactctcgaaccactgtcgtttaagaaggaagccgtgcttatccaggctggcgagtacatgggacaactgttggagcaggcttctcttcacttcttcgtcacggctcggatcaacgaaaccagggatgtgctggcgaagcagaaatccactgtcttgactatcccagaaatcatcatcaaggtccgaggaacccaggtggtcggttccgacatgaccgtcactgttcaattcacgaacccgctgaaggaaactttgagaaatgtgtgggtgcatctggacggacccggagtgaccaggcctatgaagaagatgttccgggagatcagaccaaacagcactgtgcaatgggaagaagtgtgccggccgtgggtatcgggacaccggaagctcatagcctcaatgtcatccgattccctgcgccacgtttacggcgagctggatgtgcagatccagcgcagaccgtcgatg

SEQ ID NO: 9512 - DNA, 2196 bp, Artificial Sequence
  Description of Artificial Sequence: Synthetic coding sequence
atgtcagaaacttcgcgcaccgcgttcgggggacgcagagctgtgccacccaacaattcaaatgccgctgaggatgatctgccgacggtggagctgcaaggagtggtgccgcgcggagtgaatctgcaggagttcctcaatgtaactagcgtgcacctctttaaagaaagatgggacactaataaggtggaccaccacactgacaaatacgagaataacaaactgatcgtgcgccggggccaatccttttatgtccaaatcgacttctcccgcccatacgatcctagaagagatttgttccgcgtggagtacgtgatcggtaggtaccctcaagagaataagggtacctacatccctgtgcccatcgtgtcggagctgcaatccggtaagtggggagcaaagatcgtcatgcgcgaggatcggtcagtgcgcttgtccatacaaagctcgccaaagtgtattgtcggtaagttccggatgtacgtggcggtgtggaccccttacggggttttgaggacttcaaggaacccagagactgacacttacatcctgtttaacccgtggtgcgaagatgacgctgtgtacttggacaacgagaaggaacgcgaagaatacgtgcttaacgatattggtgtgatcttctacggagaagtgaacgatatcaagactcgctcgtggtcgtacggacagttcgaggacggaatccttgacacttgcctctacgtgatggatcgcgcccagatggacctttcgggacgtggcaaccctatcaaggtttcccgagtgggatcagccatggtgaacgccaaggacgatgaaggcgtgttggttggatcgtgggacaacatttacgcctacggggtcccgccgtcggcttggaccggatcggtggatatcctgctggaatacagaagctcagaaaatccagtcagatacggacagtgctgggtgttcgctggtgtgttcaacacgtttctgcggtgtttgggaatcccggcccgcatcgtgacgaactacttcagcgctcatgacaatgatgcgaacctgcagatggatatctttctggaagaggacggcaacgtgaattcgaagttgactaaggactccgtgtggaactaccattgttggaacgaggcgtggatgacccggcctgacctcccggtgggcttcggaggatggcaggcagtcgattcaaccccacaggaaaacagcgatggaatgtaccgctgtggacctgctagcgtgcaagcaatcaagcacgggcatgtttgttttcagttcgatgctccctttgtgttcgcagaggtgaattcggatcttatctacatcaccgccaagaaggacggcactcacgtggttgagaacgtcgacgcaactcacatcggaaaactcatcgtgaccaagcagatcggcggagatggaatgatggacatcaccgatacttacaaatttcaggaaggacaggaagaggagaggctggctctcgagactgcgcttatgtacggagccaagaagcccctgaacactgaaggagtgatgaaatcccggagcaacgtcgacatggacttcgaagtggaaaatgcggtccttggaaaggatttcaagctgtcgatcactttccggaacaattcacacaaccgctacactatcaccgcgtatctttccgcgaatatcactttctacaccggagtcccaaaggcggagtttaagaaagaaacctttgacgtcactctggaaccgctttcgttcaaaaaagaggcggtcctgatacaggccggagaatacatgggccaactgctggaacaggcgtcactccactttttcgtcaccgcaagaatcaacgaaactcgcgatgtgctggccaagcagaaaagcaccgtgctcacgatcccggaaatcattatcaaagtgcggggaacccaagtggttggttcagacatgaccgtgaccgtgcagttcaccaatccactgaaggaaacgctgcggaacgtctgggtgcatcttgacggcccgggcgtgacccggccaatgaagaaaatgttccgcgaaatccgcccaaatagcaccgtgcagtgggaggaagtgtgcaggccgtgggtgtccggacataggaagctcatcgcgagcatgtcgtcggactcgctgcggcacgtgtacggggagctggacgttcaaatccagcggaggccgtccatg

SEQ ID NO: 9513 - DNA, 2196 bp, Artificial Sequence
  Description of Artificial Sequence: Synthetic coding sequence
atgagcgagacttcccggaccgcatttggagggcgtcgggcggtccccccgaacaattcgaatgcagctgaggatgatctgccaaccgtggagctccaaggtgttgtgcctcgcggagtgaatctgcaagaatttcttaacgttactagcgtgcatctgtttaaggagcgttgggacaccaataaggtcgaccaccacaccgacaagtacgaaaacaataagctcatcgtccgcagaggacaatcgttttatgtgcagatcgactttagccgcccctacgaccctagaagagatctgttccgtgtggaatacgtcatcggtagatacccccaagagaacaaaggtacttacatacccgtccctattgtgtcagagctgcaatcgggaaagtggggtgcaaagattgttatgcgcgaagatcgcagcgtgaggctctcgatccagtcctcgccaaaatgtatcgtcggcaagttcaggatgtacgtggcagtgtggaccccatacggagtgcttaggacctcccgtaaccctgaaaccgatacgtacatactgtttaatccttggtgtgaggatgatgcagtgtaccttgataacgaaaaagaacgcgaggaatacgtcctcaacgacatcggcgtgattttctatggtgaagtgaacgatatcaaaactaggtcctggtcgtacgggcagttcgaggacggaattctggatacgtgcctgtacgtgatggatcgcgcacaaatggacctctccggaaggggaaaccctataaaggtttctcgagttgggtccgcaatggtgaacgctaaggacgacgaaggtgttttggtcggctcctgggataacatctacgcgtacggagtgccaccttccgcctggaccgggtcggtggacatcctgctcgaatatcgttcctcggagaacccagtgcgttatggtcagtgctgggtgtttgccggtgtgtttaacacgtttcttcggtgtttgggcattcccgctagaattgtcactaattacttctcggcacacgataacgacgcaaatctgcaaatggatatctttctggaggaggacggcaacgtcaattccaaactgaccaaagattcggtgtggaattaccattgctggaatgaggcctggatgactagaccagacttgccagtgggttttggaggatggcaggccgtggattccacgccgcaggaaaattccgatggaatgtaccgttgtggtcctgcgtcggtccaagcaattaagcatggacacgtgtgttttcagtttgatgcaccttttgtgttcgctgaagtgaattcagatctgatttacattacggcgaagaaggatggcacccacgtggtcgaaaacgtggatgccacccatattggcaaactgatagtcacgaagcagattgggggagacggcatgatggatattactgatacttacaaatttcaggaagggcaggaggaagaacggctcgctttggaaaccgcccttatgtacggtgccaagaagcccctgaacactgaaggcgtcatgaaatcaagaagcaatgtcgacatggactttgaggttgagaatgcagtgttgggaaaggatttcaaactgtcgattacctttcggaacaattcacataacagatacaccatcactgcttacctctcagcgaacattaccttttacaccggagtgccgaaggcagaattcaagaaggaaactttcgatgtgactcttgagccgctttctttcaaaaaggaagcagttctgatccaggcaggggagtatatgggacaactcctcgaacaagcatcactgcatttctttgttacggcgcgcatcaacgaaactcgggacgtgcttgcaaagcagaagtccaccgtgctcaccatccccgagattatcataaaagtcagaggaacccaggtcgtgggtagcgatatgaccgtgactgtgcaatttaccaacccactgaaggagacgcttaggaacgtgtgggtgcaccttgatgggccgggagtcactcgccctatgaagaagatgttccgtgaaattcgacctaactctactgtccagtgggaagaagtgtgtcgaccttgggtttccggtcatagaaagttgatcgcatcgatgtctagcgactcgctgagacatgtctacggggaacttgatgtgcaaattcaaaggcgacctagcatg

SEQ ID NO: 9514 - DNA, 2196 bp, Artificial Sequence
  Description of Artificial Sequence: Synthetic coding sequence
atgtcggaaacctccaggactgcgtttggcggacgccgggccgtcccaccaaacaattcaaacgcggcagaggacgacctcccaactgtggagctgcagggcgtggtgccgcggggcgtcaacctgcaagaattcctgaacgtcacctcggttcacttgttcaaggagcggtgggatactaacaaggtggaccaccatacggataagtacgaaaacaacaaacttattgtccggagggggcagagcttctatgtccagatcgacttctcccgtccatacgacccacggagagacttgtttcgcgtggaatacgtgataggaagatatccgcaggagaataagggcacctacataccggtccccatcgtcagcgaactgcagtccggaaagtggggagcgaaaattgtgatgagagaagatcggtcagtgagactctcgattcagtcctcacctaagtgtatcgtgggcaagttccgcatgtacgtcgccgtgtggactccttacggagtgttgaggacgtccaggaatcctgagactgacacttacatcctcttcaacccgtggtgcgaagatgatgcagtgtacctcgacaatgaaaaggaacgcgaggagtacgtgttgaatgatattggcgtcattttctacggggaggtcaacgatatcaagacccggtcctggtcctacggccaatttgaggacggaatccttgacacctgtttgtacgtgatggacagagctcaaatggatctgtcaggccgcggaaacccgattaaggtcagcagagtaggatccgcgatggtgaacgccaaggacgacgaaggagtgttggtcggaagctgggacaacatctacgcgtacggggtcccaccgtcggcctggaccgggtcggtcgatatcctgctggaataccggtcctcggagaatccggtgagatacggacagtgctgggtgttcgcgggagtgtttaacaccttcctgcggtgtctgggtatcccagccaggattgtcaccaactactttagcgctcacgacaacgatgctaacctgcaaatggatatctttctggaagaggatggtaacgtgaacagcaagctgaccaaggactccgtgtggaattaccactgttggaatgaagcctggatgaccagacccgacctgcctgtgggttttgggggatggcaagccgtggactcgacgccgcaagaaaattcggatggaatgtacagatgtggaccggcgtcagtgcaggccatcaaacacggtcatgtgtgcttccaattcgatgctccgtttgtgtttgcagaagttaactccgatctgatctacatcactgccaagaaagacggtacccacgtcgtggagaatgtcgacgcgactcacatcggcaaactgatcgtgaccaagcagatcgggggagatggcatgatggacattaccgacacctataagttccaggaggggcaggaagaagagagactggccctggagactgctctcatgtacggagccaagaaaccactgaacaccgagggcgtcatgaagagcaggtcgaacgtggacatggacttcgaagtggaaaacgccgtgttgggcaaggatttcaaactgagcatcacttttcgcaataactcgcacaatcggtacaccatcaccgcctacctgagcgctaacatcaccttttacaccggtgtcccgaaggccgaattcaagaaggagacttttgacgtgactttggaacccttgagctttaagaaggaagcagtgctgattcaagcgggagagtacatggggcagcttctcgagcaggcatcgctccatttcttcgtgaccgcgcggattaatgaaactcgggacgtgctggccaaacagaagtcgaccgtcctgaccattccggaaatcatcatcaaggtccgcgggacgcaggtcgtcggatcggacatgacggtgacggtgcagttcaccaatcccctgaaggaaacccttcgcaatgtctgggtgcacctggacggaccgggtgtgacccgtccgatgaagaagatgttccgggaaatccggccgaactcaaccgtgcagtgggaggaagtgtgccgcccgtgggtgagcggacaccgcaagctgatcgcatcaatgtcctcagattccctccgccatgtgtacggagagctggacgttcagatccagcgccggccgtcgatg

SEQ ID NO: 9515 - DNA, 2196 bp, Artificial Sequence
  Description of Artificial Sequence: Synthetic coding sequence
atgagtgaaacaagtagaactgcatttgggggaagaagagctgttccaccaaataatagtaatgcagctgaagatgatttgccaactgttgaattacaaggagtagttccaagaggagttaatttacaagaatttcttaatgtaacttctgtacatctttttaaggaaagatgggatacaaacaaagttgatcatcatactgataaatatgaaaataataaacttattgttagaagaggacaatcattttatgtgcaaattgatttttctagaccatacgacccaagacgtgatctttttagagttgaatacgttatagggcgttatcctcaagaaaataaaggaacatatattcctgttccaattgtttctgaattacaatcaggaaagtggggagctaaaattgttatgcgagaagaccgttctgttagattgtcaattcaatcaagtcctaagtgtattgttggtaagttcagaatgtatgtagctgtttggacaccatacggggtattacgaacttctagaaatcctgaaactgacacatatattttgtttaatccatggtgtgaagatgatgcagtttatttagacaatgagaaagagagagaggaatatgttctaaatgatattggtgtaatattctacggtgaagttaatgatattaaaacaagatcatggtcctatggacaatttgaagatggaattttagatacatgtttatatgtaatggatagagcacaaatggatcttagtggaagaggaaatccaataaaagtaagtagagttggttcagcaatggtaaatgctaaagatgatgaaggagttttagttggatcttgggataatatttatgcttatggtgttccaccttctgcatggacaggttcagttgatatacttttagaatatagatcatctgaaaatccagtccgttatggacagtgttgggtttttgctggtgtttttaatacttttcttagatgtcttggaataccagctagaatagttactaattatttttctgctcatgataatgatgcaaatctacaaatggatatttttttagaagaagatggaaatgttaacagtaaacttactaaagatagtgtttggaattatcactgttggaatgaagcctggatgactagacctgatttaccagttggttttggaggatggcaagctgtcgattctactccacaagaaaatagtgatggaatgtatagatgtgggccagcatctgttcaagctattaaacatggtcatgtttgtttccaattcgatgctccttttgtttttgcagaggttaattctgatttaatttatattacagcaaagaaagatggtacacacgtcgttgaaaatgttgacgctactcatattggaaaattgattgtgacaaaacaaattggaggagatggaatgatggatattactgatacatataagtttcaagaaggacaagaagaagaaagacttgcacttgaaactgcacttatgtatggagcaaaaaaaccacttaatactgaaggtgttatgaaatctcgaagtaacgttgatatggattttgaagttgaaaatgcagtattaggaaaagattttaaactttctattacttttagaaataattcacataatagatatactattactgcatacttatcagcaaatataacattttacactggagtgccaaaagcagagtttaaaaaagaaacttttgatgttacattagaaccattatctttcaaaaaagaagcagttttgattcaagccggagaatatatgggtcagttactagaacaagcttctcttcatttttttgttactgctaggatcaatgaaacaagagatgttctagccaaacaaaaatctacagttttaactattcctgaaattattataaaggttagaggaacacaagtggttggttcagatatgactgtaacagttcaatttactaatccattgaaagaaacattacgtaacgtttgggtacatcttgatggaccaggagttactagaccaatgaaaaaaatgtttagagaaataagaccaaatagtacagttcaatgggaagaagtttgtcgaccttgggttagtgggcatagaaaattaattgcatctatgtcatctgatagtttaagacatgtatatggagaattagatgtacagattcaaagacgtccatcgatg

SEQ ID NO: 9516 - DNA, 2196 bp, Artificial Sequence
  Description of Artificial Sequence: Synthetic coding sequence
atgtctgaaactagcaggactgccttcggcggaaggcgcgccgtcccccctaataactccaacgctgccgaagacgacctacccaccgtggaactgcagggtgtggtccccaggggcgttaacctgcaggagttcttgaatgtgaccagtgtccacttatttaaggaaaggtgggatacaaacaaggtagatcaccacaccgacaagtacgaaaacaataaactgattgttagacgcggccaatctttttatgttcagattgatttcagccggccctatgatccccgtcgagatctgttccgcgtggagtacgtgatagggaggtacccacaggaaaacaaaggaacctatatcccggttcccattgtctcagagctgcaatctggcaaatggggcgcgaagatcgtcatgcgggaggatcgcagcgtgaggttgtctatacagagttcccccaaatgcatagtgggcaaatttcggatgtacgttgccgtgtggacgccctatggggtgttgcggacctcccggaatcccgagaccgatacttacattctgtttaacccctggtgcgaagacgatgccgtgtaccttgataacgagaaggaacgcgaggagtacgttctcaacgacatcggggttattttttatggtgaagtgaatgatataaagacgagaagttggtcctacggacagtttgaggatggcatcttagacacttgtctgtacgtcatggacagagcccagatggacctgagcggcagaggcaacccgattaaagtgtccagagtcggaagcgcaatggtaaacgccaaggatgacgagggggtgctggttggcagttgggacaatatttatgcctacggcgtccctcccagtgcttggacaggatctgttgatatactgctggagtatagatccagtgaaaatcctgtgagatacgggcagtgttgggtgttcgctggagtttttaacaccttcctcaggtgcctcggaattcctgccagaattgtcaccaattacttcagcgcccatgacaacgatgccaatctccagatggatatcttcctggaggaggacggaaacgtcaactctaaactgaccaaagattcagtgtggaactatcactgttggaatgaagcttggatgactcgccccgacctgcccgttgggtttggaggttggcaggcagtcgactcgacccctcaggagaattctgacggcatgtaccggtgtggccctgcgtccgtgcaggccattaaacacgggcacgtgtgtttccagttcgacgccccatttgttttcgcggaagtgaatagcgacctcatctacatcactgctaagaaggatggtacgcatgtggtggagaatgtcgacgccactcatattggaaaactgatcgttaccaagcagatcggcggagacggcatgatggatatcactgatacatataaatttcaggaaggccaggaagaggaaagactcgcgctggagacagccttgatgtacggagccaaaaaaccgttgaacaccgagggcgtgatgaagagccggagcaatgtggatatggatttcgaggtcgaaaatgccgttttaggtaaggatttcaagctgagtattactttccgcaacaactcacacaatcgctacactatcacagcctacctatcggccaatataaccttctatacaggagttcccaaggcagagttcaagaaggagacatttgacgtgacgctagaaccacttagcttcaagaaggaggcagtgttaatccaggctggcgaatatatgggtcagctgctcgagcaagcgtctctacattttttcgtgactgctagaataaacgagaccagggatgtgctggctaaacagaagagcacagtgctgacaatccctgagatcatcatcaaggtacgcggaacccaagttgttggatctgatatgaccgtcaccgtgcagttcaccaacccactgaaggaaaccctgaggaatgtgtgggtgcacctggatggccctggggtgacacgccctatgaagaaaatgtttcgggagatacggcccaattcaaccgttcagtgggaagaggtgtgtcgtccctgggtgagcggtcaccgcaaacttatcgcttccatgtcctccgactccttgcggcacgtgtatggagagttggacgtgcagatccaacgtcggcctagcatg

SEQ ID NO: 9517 - DNA, 2196 bp, Artificial Sequence
  Description of Artificial Sequence: Synthetic coding sequence
atgtcagaaacttcacgcaccgcgttcggtggaagaagggccgtcccacccaacaactccaacgccgctgaggacgacctccctacggtggaactccagggcgtcgtgccccgcggagtcaatctgcaggaattcctcaatgtgacgtcagttcacctctttaaggaaagatgggataccaacaaggtcgaccaccacacggacaaatacgaaaacaacaagctcattgtccgtcggggccagtcgttctacgtgcagatcgatttctccagaccctacgaccctagacgggacctgtttcgcgtcgaatacgtgatcggcaggtacccgcaggagaataagggaacttacattccggtgccaatcgtgtcggagctgcagtccggcaagtggggagcaaagatcgtgatgagagaggatagatcggtccggctctccattcaatccagcccgaaatgcatcgtgggaaagtttagaatgtatgttgcagtgtggactccttacggggtgctcagaactagcagaaacccagagactgatacttacatccttttcaatccatggtgcgaggatgatgccgtgtaccttgataatgagaaggaaagggaggaatacgttctgaatgatatcggtgtgatcttctatggagaggtcaatgatatcaagacccggtcctggtcgtacggacaattcgaagatgggatcctcgacacttgcctctatgtgatggatcgagcccagatggacctttcgggacggggaaatccaataaaggtgtccagggttggatcagcaatggtaaatgcgaaagacgatgaaggagttctggtgggctcgtgggacaatatctacgcgtacggagtcccgccgtcagcgtggaccggctccgtggatattctgctcgaataccggtcctcggagaacccggtgcgctacggtcagtgctgggtgttcgccggagttttcaacactttcttgagatgcctgggaattccagctcggatcgtgactaactacttctctgctcatgacaacgatgctaacctgcaaatggacatctttttggaggaagatgggaatgtcaactcgaagttgactaaggactcggtatggaactaccactgttggaatgaagcctggatgaccaggcccgaccttccggtcgggttcggaggctggcaagcagtggactctacccctcaagaaaactcggatgggatgtacagatgtgggccggcctccgtgcaggccatcaagcacggacacgtgtgtttccagtttgacgcgccgttcgtgttcgcagaagtgaatagcgatctgatctacatcaccgccaaaaaagacgggacccatgtcgtcgaaaacgtcgacgcgacccatatcggcaaattgatcgttactaagcagatcggtggagacggtatgatggacataactgacacctacaagttccaggaaggccaggaagaagagcgcctcgccctggaaaccgctctcatgtacggagcgaagaagccgcttaacaccgagggtgtgatgaaatcccgaagcaacgtggacatggacttcgaggtcgagaatgcggtgctcggaaaggactttaagttgtcaataacctttcggaacaacagtcacaatagatacaccatcaccgcgtacttgagcgcgaatatcactttctataccggagtcccaaaggcagaattcaagaaagaaactttcgacgtgaccctggagccgctgtcatttaagaaagaggcggttctgatccaggctggagagtacatggggcaactgctggaacaagcctccctgcatttcttcgtgactgcaaggatcaacgaaacccgcgatgtgctcgccaaacaaaaatccaccgttctgaccatccccgagattatcataaaagtccgcggtacgcaggtggtcgggtcagacatgactgtgactgtgcaattcaccaaccctctgaaggagactctgagaaacgtgtgggtgcatctggatggtccgggagtgacccggccaatgaagaagatgtttcgcgaaatccggcctaacagcaccgtgcaatgggaggaagtgtgccgtccatgggtgagcggacaccgcaaacttatcgcgagcatgtcatccgactcgttgcgtcatgtgtacggagaactcgacgtgcaaatccagaggcgaccgagcatg

SEQ ID NO: 9518 - DNA, 2196 bp, Artificial Sequence
  Description of Artificial Sequence: Synthetic coding sequence
atgtcggagacatcgcggacggcatttgggggtcgtagagcggtgcctcctaataattcaaatgcggccgaagacgatctgccaacagttgaacttcaaggcgttgttcctcgcggcgttaatctgcaggagtttctgaacgtcacatcggtgcacctgttcaaagaacggtgggataccaacaaagtagatcatcatacagataaatacgaaaataataaattaatcgttagaagaggccaaagtttttatgttcagatcgacttttctcgcccttatgatccgagacgtgatttgttccgagtcgagtacgtcattggacggtacccacaagaaaacaaaggtacttatatcccggtcccgattgttagcgaacttcaatcgggcaagtggggagcgaaaatcgtaatgcgcgaagaccggtctgtcaggctctcgattcaaagctcgccaaagtgtattgttgggaaattccgtatgtatgttgctgtctggacaccttatggcgtacttcggacatcgcggaacccagaaacagacacgtatattctgtttaatccatggtgcgaagatgatgctgtatatctcgacaatgagaaggaaagggaagaatatgtattaaacgatatcggagtaatcttctatggagaggtcaacgatatcaagactcgatcctggtcatatggacagtttgaggatggcattctcgatacatgcttatatgtaatggacagggcccagatggatctgagcggccgtgggaatcctattaaagtaagtagggtcggatccgccatggtgaatgcgaaagatgatgaaggggtcttggtcgggagctgggataatatttacgcatacggagtgcctccgagcgcctggacagggtctgtggatatactgttggaataccgaagctcagaaaaccccgtgagatatggccagtgttgggtctttgctggagtttttaatacgtttctacggtgccttggcattccagctagaattgtgaccaattatttttcagcacatgataatgatgcgaacttgcaaatggatatatttttggaggaagatggcaacgtcaactcaaaattgactaaggactcagtctggaattatcactgttggaacgaagcttggatgacacgtcctgatctgcccgtcggttttggtggctggcaagcagtcgactcaactccacaggaaaactcagatggaatgtatcgatgtgggccggcatccgtccaagcaattaaacatggtcatgtctgctttcaatttgacgctccgtttgttttcgcggaggttaattcggatctgatctatatcaccgctaaaaaggatggtacacacgtcgtcgaaaatgtagacgcgactcatataggcaaactcatcgttacaaaacaaattgggggggacggcatgatggatattacagatacgtacaaattccaagaaggccaggaagaagagcgcctggcattagaaacagctcttatgtatggcgcaaaaaaaccgcttaatacggagggcgtgatgaagagccgctcgaatgtcgacatggattttgaagtggagaacgccgtgctgggcaaggactttaaattgagtattacattccgaaataattcacataaccgttatacgattacagcttacttgtccgccaatatcacattttacacaggcgttcctaaagcggaatttaagaaggaaacgtttgacgtgactctggaaccgttatcgtttaaaaaagaggcagtgttgattcaagccggagaatacatgggacaattattagagcaagcatctctccacttttttgttacagctcgtattaatgaaacgcgcgacgtcctggcaaaacagaaatcaaccgtattgacaattcctgaaatcatcattaaagtgcgtggcactcaagtagttggatccgacatgacagttacagtacaatttactaacccgcttaaagaaacgctgcgtaatgtctgggtacacttagacggaccgggagtgacacggccgatgaagaagatgtttcgggagattcgtcctaatagtactgtgcaatgggaagaagtttgccggccgtgggttagcggccatcgaaagctgatagcgtccatgtcttcggatagtcttcgccacgtctatggcgaactagatgtgcagatccaacggagaccgtcgatg

SEQ ID NO: 9519 - DNA, 2196 bp, Artificial Sequence
  Description of Artificial Sequence: Synthetic coding sequence
atgagtgagacaagcagaacggcttttggcggccggcgtgccgtgcctccaaacaattccaatgccgcggaagacgatttacccaccgtcgaactgcagggagtcgtgccccggggggttaatcttcaggaatttctcaatgtaacttcagtacatctgttcaaagaaaggtgggacacaaacaaagtggaccaccatactgacaagtatgagaacaacaagctgattgtgagaaggggccagtccttttacgtccagattgatttctcccggccgtacgatcctcgaagggatctgtttagggtggaatatgttatcggaagatacccacaggaaaacaagggaacatacatccctgtgcccattgtgtctgagctccagagcggcaaatggggtgctaaaatcgtgatgcgagaagatcggtccgtgaggttgtcgatacaaagctcacctaagtgcatcgtgggtaagttccgaatgtacgttgccgtgtggactccgtacggcgtgctcagaacctcaagaaacccggagacagacacttacattctgttcaacccctggtgcgaggatgacgcagtctacctggacaatgagaaagagcgcgaggaatacgtgctgaatgatatcggagtcatcttttatggagaagtgaacgatattaagacacgttcatggagctatgggcaattcgaagacgggatcctagacacttgcctgtatgttatggatcgagcacagatggacctgagcgggagaggtaacccgatcaaggtgtctcgcgtgggatccgctatggtgaacgcaaaagatgacgagggcgtgctcgtgggctcgtgggataatatatatgcatatggagtgccgccgtctgcttggaccggtagcgtggacattctgctcgaataccgcagttctgagaatccagtgaggtatggccaatgctgggtatttgcaggcgtatttaatacattcctgcgctgcctcggcatccccgcccggatcgtaaccaactatttcagcgcgcacgacaacgatgccaatctccaaatggacatctttttggaagaagacgggaatgtaaattctaagttgacaaaagactcagtatggaattaccattgctggaatgaggcctggatgacccgaccggaccttcctgttgggttcgggggttggcaggctgttgactccacaccacaggagaattcggatggaatgtatcgctgtggccctgcctctgtacaggccattaaacacggccacgtctgctttcagttcgacgcacctttcgtcttcgctgaagttaactctgacctgatttacatcacagccaagaaggatggcacccacgtcgtggagaatgtggatgccacacatatcgggaaactgatcgtgaccaagcagatcggcggcgacggaatgatggatataactgacacttacaagttccaggagggacaagaggaagaaagactagcccttgagacagccttaatgtacggcgcgaagaagcctttgaatacagagggggtgatgaaatccagatccaacgtggatatggactttgaggtcgagaacgcggtgctgggtaaagatttcaagctctctatcacattcagaaacaattcacataatcggtacactattacagcatacctgtcagccaacattacattttatacaggggtacccaaagccgagtttaaaaaggaaacatttgacgtcactctggagcccctcagctttaagaaagaagctgtgctgattcaggcaggcgagtacatggggcaactgctggagcaagcctcgttgcatttcttcgttacagctcggataaacgagaccagagatgtgttagcaaagcagaagtccacagtgttgaccattccagagattatcataaaggtgcgaggtacacaggtagtaggctccgatatgacagtgaccgtgcaattcacaaatccactgaaggagaccctcaggaatgtgtgggtgcacctggacggtcctggagtgactaggccgatgaagaaaatgtttagagagataaggcccaactcaaccgtgcagtgggaggaggtatgccgaccatgggtctctgggcacagaaaattgattgcctcaatgtcctcggattccttgcgtcacgtgtacggcgaactagacgttcaaatccagcgccgcccctccatg

SEQ ID NO: 9520 - DNA, 2196 bp, Artificial Sequence
  Description of Artificial Sequence: Synthetic coding sequence
atgtctgaaacttccagaacagcctttggagggaggagggcagtgcctccaaataactcaaatgctgcggaagatgatctgcccactgttgaactccagggggtcgttcccaggggagtaaaccttcaagaatttctgaatgtcacttcagttcacctgttcaaagaaaggtgggatacaaacaaggttgatcaccacactgataaatacgagaacaacaaacttatcgttaggcgggggcagtcattctatgtgcagatagatttctcacgaccctacgacccccggcgggatcttttccgagtggagtacgttatcgggcggtaccctcaagaaaataagggaacttatatccccgtccctatagtgtccgaactacagagtggaaagtggggagccaagatcgtaatgcgcgaagataggtccgtgcggctatctatccagtcctcacctaaatgcatagtgggaaaattcagaatgtatgtggcagtatggacaccgtatggggtgttacggacatcccggaacccagagacagatacatatatactgttcaacccttggtgcgaagatgatgccgtatacttggataacgaaaaagaacgcgaagaatatgtgctgaatgatataggagttattttctatggggaggtcaatgatatcaaaactaggtcttggtcgtatgggcagttcgaagatgggattctcgatacatgcctctacgtcatggatcgcgctcagatggatctttccgggaggggaaaccccatcaaggtgagtcgggtggggagtgccatggtgaatgccaaagatgacgaaggagtcttggtggggtcctgggataatatctatgcttatggagtaccaccatcagcttggactggatcagtggatatactcctagagtaccggtcttccgaaaatccagtacgctacggacagtgttgggtcttcgccggagtgttcaacacttttctccggtgtcttggaatccccgcccggatcgtgacaaattatttctctgcccatgacaatgatgctaatctccagatggatatatttctcgaagaagacgggaatgtcaactccaaactcactaaagattccgtctggaattatcattgttggaacgaagcctggatgacacgccctgatcttcctgttggattcggaggatggcaggccgttgattccacaccacaggaaaattccgatggaatgtacagatgtggacccgcatcggtgcaggccataaaacacggacatgtatgtttccagtttgatgccccattcgtcttcgctgaggttaattccgatcttatatacataacagccaaaaaggacggaacgcacgtggtcgaaaacgtcgatgccactcatatcgggaaattaattgtcactaaacagatcgggggggatgggatgatggatataacagatacttataaatttcaggaaggacaggaagaggaacgtctggcacttgaaacagccttaatgtatggagccaaaaaacccctgaacacagaaggggtgatgaaatctcgctcaaacgtggatatggattttgaagtggaaaatgcagtgttagggaaggattttaaactgtctatcacgtttcgaaacaactcccacaacagatatacaatcactgcttatctgagtgccaacatcactttttatacaggggtgcccaaggcagaatttaaaaaagaaacatttgacgtaactctcgagcccctcagttttaaaaaagaggcagtcctaattcaagccggggaatatatgggacagctcctcgaacaggcatccctgcacttcttcgtgactgctaggataaacgaaacaagagatgtacttgcgaaacagaaatctacagtgctgacaatccctgaaatcatcataaaagtgcgcggaacacaggtggtggggtctgacatgacagtaactgttcagttcacaaatcccctgaaagaaactttgagaaatgtgtgggtgcatttagatgggcctggagtgacacggcccatgaaaaaaatgttcagggaaatccgacctaactctactgtccagtgggaagaagtatgtcggccttgggtgtcaggacatcgtaaactcatcgcctctatgtcctctgactccttaaggcatgtatatggagaactagatgtccagatccagaggcggccctctatg

SEQ ID NO: 9521 - DNA, 2196 bp, Artificial Sequence
  Description of Artificial Sequence: Synthetic coding sequence
atgtcagagacatccaggaccgcattcgggggacggcgtgccgtgcctccaaataactcaaacgcagctgaggacgacctccccacagtcgaactgcaaggtgtggttcccaggggggtgaatctacaggagtttcttaatgtgacctccgtgcacctttttaaagaacgctgggataccaacaaggtagatcaccataccgacaagtacgagaataataagcttatcgtgagaagaggtcagagcttctatgttcagattgactttagccgaccgtatgatcccagaagagacctttttagagtggagtacgtgattggaaggtatccccaagaaaacaagggaacctatatccccgtgcctattgtgtccgagcttcagtccggaaagtggggagcaaaaatcgtgatgagggaggatcgttcagtgagactctccattcagagctcccccaaatgtatcgtcggaaaatttagaatgtacgtagctgtgtggaccccttacggagtgctccggacgtcaaggaacccagagacagacacatacattctgttcaacccatggtgcgaggacgacgcggtctatctcgacaacgaaaaggagcgcgaggaatacgtattaaatgacattggcgtgattttctatggcgaggtgaatgacataaaaacaaggtcttggtcttatggccaatttgaggatggtattttggatacctgcctgtacgtgatggatcgcgcacagatggatctgtccggacgcggtaatcctatcaaagtgtcacgggtcgggagtgccatggtcaatgctaaagatgatgagggtgtgctcgtgggctcttgggataatatctatgcgtatggtgttccgccgtccgcatggactggctcagtcgatatcttgttagagtaccggagctctgagaatcccgtccgctacggccagtgctgggtcttcgctggggtgttcaacacatttcttaggtgcctcgggatccccgcaaggattgttactaactacttttctgcgcatgacaacgacgctaacctccagatggacatctttttggaagaggatggcaatgttaattccaagctcaccaaggattcagtgtggaactaccattgttggaatgaggcatggatgacacggccagacctccccgtaggtttcggagggtggcaggcagtggactccaccccgcaggagaacagcgacggcatgtataggtgcgggcctgcctcggtccaagctatcaagcacggccatgtgtgttttcaattcgacgctccatttgtcttcgctgaggtaaatagtgatctcatttacatcacagccaaaaaggacggcacacacgtggtggaaaacgtcgacgccacgcacatcggtaaattgattgtcaccaaacaaatcggcggtgatggtatgatggacatcaccgatacctataaatttcaggagggccaggaggaagaaaggctggccctggagacggctctcatgtatggggcgaagaaacccctgaacacagagggggttatgaagtctcggtccaacgtcgatatggatttcgaagtcgagaatgccgtgctgggcaaagacttcaagctaagtattacattccggaacaacagtcataataggtacacgataaccgcatatttatcggctaatattacattctatactggggtgccaaaagccgagttcaagaaagaaaccttcgacgtgactctggagcccctatctttcaagaaggaagcagttctcattcaggctggagagtatatgggacaattacttgaacaggccagtttgcacttcttcgtaacagccaggataaatgagacccgtgacgtcctcgcaaagcaaaaatctaccgtcctgactatccccgaaattataataaaagttcgtggcactcaggtcgttggcagcgacatgacggtgacggtgcagtttaccaacccactgaaagagactttgcgcaatgtttgggtgcatctggacggacccggcgtgacacgccctatgaaaaagatgttcagggaaattcggcccaattcgaccgtgcaatgggaggaggtctgccgaccatgggtaagcggacatcgcaaactgatagcctctatgtcgtctgactcattgcggcacgtctatggcgagctagatgtacagatacagagacgcccaagtatg

SEQ ID NO: 9522 - DNA, 2196 bp, Artificial Sequence
  Description of Artificial Sequence: Synthetic coding sequence
atgtcagaaaccagccggaccgccttcggcgggcgccgcgctgtcccgccaaacaacagcaatgcagcggaggacgaccttccaactgtggaattgcagggagtggtgccgcgcggggtcaatttgcaggaatttctcaatgtcaccagcgtgcacctctttaaggaacgctgggataccaataaggttgaccatcataccgacaaatatgagaacaacaagctgattgtgagacgcggacagtccttctacgtgcagatcgattttagccggccttacgatccaagaagagatctgttccgcgtggagtacgtgatcggaaggtacccacaggaaaacaaaggaacttacatccctgtgccaattgtcagcgaactccagagcggcaaatggggcgcaaagattgtgatgcgggaggacaggtcggtccggctctccatccagagctccccgaaatgcatcgtgggcaagtttaggatgtacgtggcagtgtggaccccgtacggagtgctcagaacctcgcgcaaccccgaaaccgatacttacattttgttcaacccctggtgcgaggacgatgctgtgtacctcgataacgaaaaagagcgggaggaatacgtcctcaacgatattggcgtgatcttctacggagaagtgaatgatatcaaaactcgctcgtggtcatacggccagttcgaggacggaatcctcgacacctgtttgtacgtcatggacagagcccagatggacctctctggacggggtaaccctatcaaagtgtcgagggtgggatccgccatggtgaacgccaaagacgatgaaggggtgctggtgggatcgtgggacaacatctacgcctacggcgtgccaccgagcgcctggactgggtccgttgacatcctcctcgaataccgctcctcagaaaacccagttcggtatggtcagtgctgggtctttgcaggagtctttaacactttcctgcggtgcttgggcatcccggcgcggatcgtcaccaactacttctcggcgcacgacaatgacgcgaatctgcaaatggacatctttctggaagaagatggaaatgtgaactcgaagctgaccaaggactccgtgtggaattaccactgctggaacgaagcatggatgaccaggccggacctgcccgtgggctttggcggatggcaggcagtggactccaccccccaggaaaatagcgacggaatgtaccgatgcggccctgcgtcggtgcaggccatcaagcatggacacgtctgcttccaatttgatgcgccgttcgtgttcgctgaagtgaactcagatctgatctatatcaccgccaaaaaagacggaacgcacgtggtggaaaacgtggatgccactcatatcggtaaactcatcgtgaccaaacagatcggaggagacggcatgatggacatcactgatacttacaagttccaagagggacaagaagaggagcgcctggctctggaaaccgcgttgatgtacggcgcaaagaagccactgaatactgagggggtcatgaaaagccggtcgaatgtggacatggacttcgaggtggagaacgctgtcctgggcaaggatttcaaactctcgattaccttccgaaataactcccataatcggtacaccattaccgcgtacctgtcagccaacattaccttctacaccggagtgccgaaagcggaattcaaaaaggaaactttcgacgtcaccctcgagccgctttccttcaagaaagaagccgtgttgatccaggccggcgagtacatgggacaactgttggaacaggcatcgctgcacttcttcgtgaccgcccgtattaacgagactagagacgtgctcgccaaacagaagtcgactgtcctcactatcccggagatcatcatcaaggtgcggggcactcaagtggtgggttccgatatgaccgtcactgtccaattcaccaaccctctgaaggagacgctccgcaacgtgtgggttcacctggacggacccggtgtcactcggcccatgaagaaaatgtttcgcgagatcagaccgaatagcaccgtgcaatgggaagaagtgtgccgcccgtgggtcagcgggcaccgcaaactgattgcttcgatgtcgtccgactcgctccggcacgtctacggagaactcgacgtccaaattcagagacgcccgagcatg

SEQ ID NO: 9523 - DNA, 2196 bp, Artificial Sequence
  Description of Artificial Sequence: Synthetic coding sequence
atgagcgaaacgtcacgcaccgcatttggaggacggagagcagtgcccccgaacaactccaacgccgcagaagatgatcttccgaccgtggaacttcaaggtgtggtgcctagaggcgtcaacctccaagaattcctcaacgtcacttccgtccatctgtttaaagagagatgggataccaacaaggtagatcaccatactgataagtatgaaaacaacaagctcatcgttagacgcggacagtcattttacgtgcaaattgatttttcacgcccgtacgaccccagacgggatttgtttcgggtcgaatatgtcattggtcgctaccctcaagaaaacaagggaacctacatcccagtgccaatcgtgtcggagttgcagagtggtaagtggggagccaagatcgtgatgcgcgaagatcggtccgtcagactgtccattcagagctccccaaagtgcatcgtggggaagtttaggatgtacgttgcggtgtggaccccttacggggtgctgagaacgtcgagaaatccggaaaccgatacgtacattcttttcaatccgtggtgtgaagatgatgccgtgtacctcgataacgaaaaggaacgagaagagtacgtgctgaacgacatcggagtcatattctatggtgaggtcaatgacatcaagactcggtcctggagctacggtcagttcgaagatggaattctcgatacctgtctctacgtaatggatcgggcacaaatggacctttcggggcgcggaaaccctattaaggtttcccgtgttggctcggcaatggtgaatgcaaaggatgacgaaggtgtcctcgtaggaagctgggacaatatctacgcatacggggtgcccccctccgcttggaccggatcggtcgacattcttctggagtacaggtcaagtgagaatccagtccggtatggacaatgttgggtctttgccggggtgtttaacacttttctgcgctgtcttggcatacccgctcgtatagtgaccaactacttttcggcccacgataatgatgccaatctgcagatggacattttccttgaggaggacggcaacgtgaattcaaagctgactaaagactcagtttggaactaccattgctggaatgaagcatggatgactcgccctgaccttcctgttggctttgggggttggcaggcagtggattcgactccgcaggaaaacagcgatgggatgtacagatgtggaccggcatcggtccaagcgataaagcatggccatgtctgcttccaattcgatgcgccttttgtgttcgccgaggtcaactccgatcttatctacataaccgcaaaaaaggatggtactcacgtggtggaaaatgtggatgcgactcatattggtaaacttatagtgactaaacagattggtggggatggcatgatggatatcaccgacacgtacaagttccaggaaggtcaagaagaggaaagattggcactcgagactgcacttatgtacggagcgaagaaaccccttaacaccgaaggcgtgatgaaatcacggtcaaacgtcgacatggatttcgaggtcgaaaatgcggtgctgggaaaggactttaaactgagcattacctttcgcaataacagccataaccggtacaccatcactgcatacttgagcgctaacattacgttttacactggggtgccaaaggcagagttcaaaaaggaaacttttgacgtcaccctggaaccattgtccttcaagaaggaagccgtcctgatccaggccggcgagtacatggggcaacttcttgagcaagcaagcctgcacttttttgtgactgcacgcattaatgaaaccagggacgtgcttgcgaagcaaaaatcgaccgtcctcaccattcctgaaatcatcatcaaagtgcgtggaacccaggtggtgggatcagatatgaccgtgactgtgcagtttactaacccacttaaggaaaccctgcgcaacgtgtgggtacatcttgatggtccaggagtgacccgcccaatgaaaaagatgttccgtgagatacggcctaactcaaccgtgcaatgggaggaggtgtgtcgaccttgggtgtccggacatcgcaagctgatcgcatcgatgagcagcgactccctccgccacgtgtacggcgaacttgatgtccagattcaacgcagaccttcgatg

SEQ ID NO: 9524 - DNA, 2196 bp, Artificial Sequence
  Description of Artificial Sequence: Synthetic coding sequence
atgagtgaaacgtcccgcaccgcctttggaggcaggcgggcagtccctccaaacaattccaacgctgccgaggatgatttacctaccgttgaacttcagggcgtcgttcctcgaggagtaaatctgcaggaattcctgaacgtgacttccgtgcacctgtttaaagagcgctgggacacaaataaagtggaccatcacacagataagtatgagaataacaagctcatcgtgcgtagagggcagtcgttttatgtgcagatcgatttctcaagaccatacgaccctcggcgggacctatttagggttgagtacgttattggccggtatcctcaagagaataaagggacatacatccctgttccgatagttagcgaattgcagagcggaaagtggggcgcaaagattgttatgcgcgaggatagaagtgttcggttgagcatccagtcaagccccaagtgcattgttggaaaattccgtatgtacgtggcggtatggactccatatggagtgttgcgcaccagtcgcaatcccgagacagatacttacattctttttaacccctggtgtgaagacgatgcagtgtacttagacaatgaaaaggagcgcgaggagtatgtgctgaacgacatcggggtgatcttttacggcgaagtgaacgatattaagacccgctcatggtcctatggccagtttgaggacggcatcctggatacctgcctctacgtcatggacagggcacagatggatctgtctggacggggaaaccctataaaggtgtctcgcgtaggaagtgctatggtgaacgctaaggatgatgaaggtgtgttagtggggagctgggacaacatatacgcctatggcgtgccacctagtgcttggacaggctctgtggacatcctgctcgagtatcgatccagcgaaaatcctgttcggtacggtcaatgttgggtcttcgctggtgtgttcaatactttcctgagatgccttggtattcctgcacggatcgtgactaactatttttctgctcatgacaatgacgccaatttacagatggatatatttctcgaagaggacggaaacgtcaattctaaactcaccaaggactccgtgtggaattaccattgctggaacgaggcttggatgacacggcctgatctcccagtgggatttggcggctggcaagctgttgactctacgccccaggagaacagtgacggaatgtatcggtgtggacctgcatctgtgcaggctatcaagcatggccatgtgtgctttcaattcgacgcaccattcgtcttcgcagaggttaactcagacctgatttacattaccgctaaaaaagatggcacgcacgtcgtagagaatgtcgatgctactcatatcggcaaactgattgtgacgaagcagattggaggcgatggaatgatggacattacagacacctacaaatttcaggaagggcaggaagaggagaggctggccctcgagaccgcgctgatgtacggagctaaaaaacccctcaacaccgaaggagtaatgaagtcccggtccaatgtggatatggacttcgaggtcgagaatgccgtcctcgggaaagactttaagttgagtataactttcagaaataattcacataacaggtacacaattacagcatacctgagcgcaaatataaccttttacacgggcgtgccaaaggccgagttcaagaaggagaccttcgacgttactcttgaaccactttctttcaagaaggaagccgtcttgattcaggcaggtgaatacatgggacaactgctggaacaggcttctctacacttctttgtgaccgcacgaatcaacgagaccagggacgtgctggctaaacagaagagtactgtcctgactatccccgagattattatcaaagtccgggggacacaggtggttggcagcgatatgaccgtgaccgtccagttcactaatccattgaaggaaacactgcgtaatgtgtgggtgcatctggacggaccgggcgttacacgccctatgaaaaaaatgtttagagaaatcagacccaattccactgtgcagtgggaggaagtttgcagaccatgggtctccggacataggaaacttatagccagcatgtcatccgacagcctgcggcacgtatatggggagctggacgtacaaatacagcgccgtccaagcatg

SEQ ID NO: 9525 - DNA, 2196 bp, Artificial Sequence
  Description of Artificial Sequence: Synthetic coding sequence
atgtcagaaacaagtcggacagcttttggagggcggcgggctgtgccacccaataatagtaatgcggccgaagacgatctccccacagttgagctccagggagtggtacccaggggggtgaatctgcaggaatttctgaatgtgacaagtgtacacctatttaaagaacgttgggatactaataaagtagatcatcatactgacaaatatgaaaataataaattaattgttcggaggggacaatcattctatgttcagattgatttttccagaccctatgatccaaggcgggacctgtttagggttgaatacgtaatagggagatatccccaggaaaataaaggaacatacatcccagtgccaatagtatccgaattacagagtgggaaatggggagccaaaatcgtgatgagggaagataggtctgtcaggctctccatccaatcttcacccaaatgtatcgtgggaaagtttaggatgtatgtcgcagtctggactccatacggagtactccgcacaagtcggaatccagaaacagatacatacatactatttaatccttggtgcgaagatgatgccgtctatctggataacgaaaaggaacgggaggaatatgtactgaacgacatcggagtaattttttacggagaagtgaacgatattaaaacaaggtcttggagttatggacagtttgaagatggaatactagatacatgtctctacgttatggatcgtgcgcagatggatctcagtggacgggggaaccctataaaggtatcacgggtcggatccgcaatggtcaatgccaaagacgatgaaggggtattggtgggaagttgggacaacatctatgcttacggggtccctccctctgcatggactggatcagtggatatactccttgaatatcgaagttccgaaaaccctgtgcgctatggacagtgttgggtgtttgcaggggtctttaacacattcttgcgctgtctggggattcccgcaaggatagtgacaaactatttttccgcccacgataatgatgccaacttacagatggacatcttcctcgaagaagatgggaacgtgaatagtaaactaacaaaagatagtgtttggaattatcattgttggaacgaagcttggatgactcggcccgatctacctgtcgggtttggagggtggcaggccgttgatagtactccacaggaaaatagtgacgggatgtaccggtgtgggccagcctcagtgcaggctatcaagcacggacatgtttgcttccagtttgatgccccattcgtttttgccgaagtgaactctgatctgatctacatcactgccaagaaagatgggacacatgtagtggaaaatgtagatgcgactcatatcgggaaactcatagttacaaaacagatcggaggagatgggatgatggatataactgatacatacaagttccaagaggggcaggaagaagaaaggcttgccctcgaaactgccctaatgtatggagcaaaaaaacctctcaatactgaaggagttatgaagtcgagaagtaatgtagatatggattttgaagtcgaaaatgccgtgctggggaaagatttcaaacttagtatcacattccggaataactctcataatagatacacaatcacagcctatctcagtgcaaacataacattttatacaggagtacccaaagctgaattcaaaaaagagacgtttgatgtaactttagaacctctctcctttaaaaaagaggccgtgctcatacaggccggagaatacatgggacagctgctagaacaggcttccctacacttctttgtgacagccagaatcaatgaaacacgcgatgttctcgccaaacagaagtccacggtgcttactatacccgaaatcataatcaaagttcggggaactcaggtggtggggagtgatatgactgtgactgtgcagttcacaaacccacttaaagaaacactgcggaatgtttgggtgcatctcgatggacccggggtgactagacccatgaagaaaatgttccgcgaaatccgacccaatagtacagtgcagtgggaagaggtttgtaggccctgggtttccgggcatagaaaattaatcgcatcgatgtccagtgattctctgagacacgtttatggagaactagatgtgcagatccagaggagaccctctatg

SEQ ID NO: 9526 - DNA, 2196 bp, Artificial Sequence
  Description of Artificial Sequence: Synthetic coding sequence
atgagcgaaacctcacgcaccgcctttgggggacggagagcagtccctcctaacaattccaacgcagcagaggacgacctgccgactgtcgaactgcagggagtcgtgccacggggcgtgaaccttcaagaattccttaacgtcacttcagtgcatctgtttaaggagaggtgggatactaacaaggtggatcaccatactgacaagtacgaaaacaacaaactgattgtccgccgcggacagagcttttacgtgcaaatagatttttctaggccttacgatccacgaagagatctttttcgcgtggagtacgtcattggtagatatccccaggaaaacaagggaacttacatccccgtgccaattgtgtccgagcttcagagcggaaagtggggagctaagattgtcatgagggaagatagatccgtgaggctgtcgattcaatcgtcaccaaagtgcattgtggggaaattccgcatgtacgtggcagtctggaccccctacggcgtacttcgaacctcccgtaaccctgagacggacacctacattttgtttaatccttggtgtgaagatgacgccgtgtaccttgataacgaaaaagaacgggaagaatacgtgctcaatgatataggggtgattttctacggagaggtgaacgacattaagaccagatcctggtcttatggccaattcgaggatggtattcttgatacctgtctgtacgttatggatagggctcagatggatctgtcgggaagagggaacccaattaaggtgagccgcgtggggtccgctatggtgaacgcaaaggatgatgaaggagtgctcgtgggatcctgggacaatatctatgcatacggagtgcccccttcggcctggactgggagcgtcgatatactgcttgaatacagatcgtcggaaaaccccgtgcggtacggacaatgctgggtctttgcaggcgttttcaatactttcctgcgttgtttgggaattcctgcgcggatagtgaccaattacttctcggcacacgataacgatgcaaaccttcaaatggacatcttcctcgaagaggatggaaacgtcaactcaaagctgaccaaggattcggtctggaactaccactgttggaacgaggcttggatgacccgccccgacctgcctgtgggatttggggggtggcaagcagtcgattccaccccccaagaaaatagcgatggtatgtaccgttgtggacctgcctcggtgcaagccattaagcatggacacgtgtgttttcagtttgatgcacccttcgtgtttgctgaggtcaacagcgatctgatttacattaccgctaagaaagacggaactcacgtggtcgaaaacgtggatgcaacccatataggaaaacttattgtcaccaaacaaattggcggagatgggatgatggacattactgatacctacaagtttcaggaaggtcaagaggaggagaggctcgcactggaaacggcacttatgtatggtgccaaaaagccactcaataccgagggggtgatgaagtcgcgctcaaacgtggacatggattttgaagtggaaaatgccgtgctgggcaaggactttaaactttcaatcaccttccgtaacaattcacataataggtacactatcacggcgtacctgtcggccaacattactttttacactggggtgcccaaggcagagttcaagaaggagacgttcgatgtgactctcgaacctctgtcctttaagaaggaagccgtgctgattcaagcaggagaatacatgggtcagctgctggaacaagcctcgcttcatttctttgtgaccgcacggataaatgaaacccgcgatgtgttggcaaagcaaaagtcaaccgttcttactattccagagattatcattaaagtgcggggtactcaagtcgtgggttccgatatgaccgttactgtgcaattcaccaatccgcttaaggagactctgaggaatgtgtgggtgcatctcgacggaccaggggtgaccaggccaatgaaaaagatgttcagagaaattaggcccaatagcactgtgcagtgggaagaagtgtgtcggccctgggtgtctggccatagaaaactgattgcatcgatgtcgtcggattcgctgaggcatgtctacggtgaactcgatgtgcaaatccaacggcgcccaagcatg

SEQ ID NO: 9527 - DNA, 2196 bp, Artificial Sequence
  Description of Artificial Sequence: Synthetic coding sequence
atgtcggaaacgtcgcgaacggcgtttggtggtcgtcgtgcggtaccgccgaataattcgaatgcggcggaagatgatctaccgacggtagaattacaaggtgtagttccgcgaggtgttaatttacaagaatttttaaatgtaacgtcggttcatttatttaaagaacgttgggatacgaataaagttgatcatcatacggataaatatgaaaataataaactaatagttcgtcgaggtcaatcgttttatgtacaaatagatttttcgcgaccgtatgatccgcgtcgagatctatttcgtgttgaatatgttataggtcgttatccgcaagaaaataaaggtacgtatataccggtaccgatagtttcggaattacaatcgggtaaatggggtgcgaaaatagtaatgcgtgaagatcgatcggtacgattatcgatacaatcgtcgccgaaatgtatagtaggtaaatttcgaatgtatgttgcggtttggacgccgtatggtgtactacgaacgtcgcgtaatccggaaacggatacgtatatattatttaatccgtggtgtgaagatgatgcggtttatctagataatgaaaaagaacgtgaagaatatgttttaaatgatataggtgtaatattttatggtgaagttaatgatataaaaacgcgatcgtggtcgtatggtcaatttgaagatggtatactagatacgtgtctatatgtaatggatcgtgcgcaaatggatctatcgggtcgtggtaatccgataaaagtatcgcgagttggttcggcgatggtaaatgcgaaagatgatgaaggtgttttagttggttcgtgggataatatatatgcgtatggtgtaccgccgtcggcgtggacgggttcggttgatatattactagaatatcgatcgtcggaaaatccggtacgatatggtcaatgttgggtttttgcgggtgtatttaatacgtttctacgttgtttaggtataccggcgcgtatagttacgaattatttttcggcgcatgataatgatgcgaatttacaaatggatatatttttagaagaagatggtaatgttaattcgaaattaacgaaagattcggtttggaattatcattgttggaatgaagcgtggatgacgcgaccggatctaccggttggttttggtggttggcaagcggttgattcgacgccgcaagaaaattcggatggtatgtatcgttgtggtccggcgtcggttcaagcgataaaacatggtcatgtttgttttcaatttgatgcgccgtttgtttttgcggaagtaaattcggatttaatatatataacggcgaaaaaagatggtacgcatgtagttgaaaatgtagatgcgacgcatataggtaaattaatagtaacgaaacaaataggtggtgatggtatgatggatataacggatacgtataaatttcaagaaggtcaagaagaagaacgtttagcgctagaaacggcgttaatgtatggtgcgaaaaaaccgttaaatacggaaggtgtaatgaaatcgcgttcgaatgtagatatggattttgaagtagaaaatgcggtattaggtaaagattttaaactatcgataacgtttcgtaataattcgcataatcgatatacgataacggcgtatttatcggcgaatataacgttttatacgggtgttccgaaagcggaatttaaaaaagaaacgtttgatgttacgttagaaccgttatcgtttaaaaaagaagcggttttaatacaagcgggtgaatatatgggtcaattattagaacaagcgtcgttacatttttttgttacggcgcgtataaatgaaacgcgagatgtattagcgaaacaaaaatcgacggttttaacgataccggaaataataataaaagttcgtggtacgcaagtagttggttcggatatgacggttacggttcaatttacgaatccgctaaaagaaacgttacgtaatgtatgggttcatctagatggtccgggtgttacgcgtccgatgaaaaaaatgtttcgtgaaatacgaccgaattcgacggtacaatgggaagaagtttgtcgtccgtgggtttcgggtcatcgtaaactaatagcgtcgatgtcgtcggattcgttacgtcatgtatatggtgaattagatgttcaaatacaacgtcgaccgtcgatg

SEQ ID NO: 9528 - DNA, 2196 bp, Artificial Sequence
  Description of Artificial Sequence: Synthetic coding sequence
atgtctgagacctccagaaccgcgttcggaggtaggagagctgtgcctccgaataatagtaacgctgccgaggatgatcttccgaccgttgagttgcagggggtagtccctcggggtgtgaatttacaggagtttctcaatgttacttcagttcatctctttaaggaaaggtgggacacaaataaggtggaccaccacaccgataaatatgagaataacaagttaatagtcagacgagggcaatccttctacgtccaaatcgatttctctagaccatatgatccaaggagggatctttttagagttgaatatgttattggtaggtatcctcaagaaaacaagggtacttacatcccggttcctattgtttcggagttgcagtcggggaaatggggtgctaaaattgttatgagagaggatagatccgtccgactgtccattcagtcatctcctaagtgcattgtgggcaagttccgcatgtatgtggctgtctggacaccttatggagttttgagaacctctagaaacccggagacagatacttacattctatttaatccttggtgcgaggacgatgctgtttacttagataatgagaaagaaagagaggaatatgttctaaacgacattggggttattttttatggcgaggtcaatgatattaagactcgttcatggagctacggtcagtttgaagatggtatacttgatacatgtttatacgtgatggaccgagctcaaatggatttaagtggaaggggtaatcccatcaaggtgtccagggtgggctctgcaatggttaacgctaaagatgatgaaggagtgttggtcggatcttgggataacatatatgcttatggtgtgcctccaagcgcatggacaggaagtgttgatatcttacttgagtataggtcctctgagaatcctgttaggtacggtcaatgttgggtgttcgccggagtcttcaacacttttttgagatgtctcggaatcccggcccggatcgttaccaactattttagcgcacacgataatgatgcaaacctccagatggacatatttttggaggaagacggaaacgttaactcgaaacttactaaagattcagtatggaattatcattgctggaatgaggcttggatgactaggcctgatttgccagtcggtttcggcggctggcaagctgtagattccacaccgcaagagaacagtgacggaatgtaccgatgcggtcctgccagcgttcaagcaattaagcatgggcacgtgtgtttccagtttgacgctcctttcgttttcgcggaggtcaatagcgatctgatttacattacagccaaaaaggatggaactcatgttgtggagaacgtcgacgctactcatattggaaaactgatcgtaactaaacagataggtggtgatggtatgatggatatcaccgacacatacaagttccaagagggacaggaggaagaacggcttgctcttgagactgcacttatgtatggggccaaaaaaccactgaacactgagggagttatgaagagtcggtcgaacgtggatatggactttgaggttgagaatgccgttttgggtaaagatttcaagcttagtattactttccgtaataattctcataacagatatacgatcactgcttatctttctgccaatataaccttttatactggagtgccaaaggcagagttcaagaaagaaacgtttgatgtgactctggagcccctgtcttttaaaaaggaggccgttctaatccaggctggtgaatatatgggtcagcttttggaacaagcaagtttgcatttcttcgtcaccgctcgcattaatgagacccgggatgttctggctaagcaaaagagtacagtccttacaattcctgaaatcatcatcaaggtgagaggtacacaagtcgtgggttctgacatgaccgtgacagttcagttcactaatccattaaaggagaccttgaggaacgtttgggtgcacctggatggaccgggtgtcacaaggccgatgaaaaaaatgtttagagaaattagacctaatagtaccgtccaatgggaggaagtttgccggccttgggtctccggacatcgtaagcttattgccagcatgtccagtgactcgttaaggcacgtctatggtgagcttgatgttcagattcagaggagaccttcgatg

SEQ ID NO: 9529 - DNA, 2196 bp, Artificial Sequence
  Description of Artificial Sequence: Synthetic coding sequence
atgtccgaaacttcaaggaccgcattcggtggccgcagagcagtcccccctaacaactccaacgccgcggaggacgatctcccaaccgtggagttgcaaggagtcgtgccaagaggcgtgaatttgcaagaatttctgaacgtgacgtccgtgcacctcttcaaggaacgctgggacaccaacaaggtggaccaccatactgacaagtacgagaataacaaattgattgtgcgccggggacagtcattttacgtccaaatcgacttctctaggccgtacgatccgcggagagatctgtttcgggtggaatatgtgatcggacgctaccctcaagagaacaaaggaacctacatcccggtgccgatcgtttcggagctgcagagcggaaagtggggggcaaagatcgtgatgcgcgaggaccgcagcgtgcggctttcgatccagtcgtccccgaagtgtatcgtgggaaagttccgcatgtacgtggcagtgtggaccccgtacggagttctgcggactagcagaaatcccgaaactgacacctacattctcttcaatccgtggtgtgaggacgatgccgtgtacctcgacaatgagaaggagagagaggagtacgtgttgaacgatatcggggtgatcttttacggcgaggtcaacgacatcaaaacgcgctcctggtcctacgggcaatttgaggacggtatcctggacacgtgtctgtacgtgatggaccgggctcagatggacctctcgggcagaggaaaccctatcaaggtgtcacgcgtgggatcggctatggtgaatgcaaaggacgatgagggggtcctcgtggggtcctgggataacatttatgcctacggagtgccgccttccgcctggacgggtagcgtcgatatcctcctggagtaccggtcctctgagaatccagtgcgatacggacaatgttgggtctttgccggagtgttcaacacgttcctgcgctgcctgggcatcccggcccgaatcgtgaccaattacttctccgcacacgataatgatgcgaatcttcaaatggacattttcttggaagaggacggaaatgtcaactccaagctcacgaaagactcggtctggaattaccactgctggaacgaagcatggatgactcggcctgatctccccgtgggcttcggaggatggcaagccgtggatagcaccccacaagaaaacagcgatggaatgtaccgctgcggcccagctagcgtccaagccatcaagcacgggcatgtgtgcttccagttcgacgcgccgtttgtctttgctgaggtcaattccgaccttatctatatcactgcgaagaaggacggaactcatgtcgtcgagaacgtggatgccacccatatcggcaagctcatcgtgactaagcagatcggaggagacggcatgatggacattaccgatacttacaaatttcaagaaggacaagaggaagagcgcttggcccttgaaaccgcgctgatgtacggcgccaaaaagccactgaacactgaaggagtcatgaaatcccggtccaatgtggatatggattttgaagtcgaaaacgcggtcctcggaaaggactttaagctgtccatcactttccgtaacaatagccacaatcgctatactatcacggcttacctgtcggctaacatcaccttctacaccggggtccccaaagccgaattcaaaaaggaaaccttcgatgtgactctggagcctctgtcattcaagaaggaagccgtgctgatccaggctggcgaatacatgggccagctgcttgagcaggcgtccctgcatttcttcgtgacggcccgcatcaacgaaacccgggacgtgctcgccaaacagaagtccactgtcctcactatcccagagatcatcatcaaggtccgggggactcaggtggttggtagcgacatgacggtgaccgtccagtttaccaatcccctcaaagaaacccttaggaacgtctgggtgcatctcgatggcccaggggtgacccgcccgatgaagaaaatgttccgcgagatccggccaaactcaactgttcaatgggaagaagtgtgccggccgtgggtgtcaggacaccggaagctgatcgcctcaatgtcctcagacagcctccgccacgtctacggcgagctggatgtccagatccagagacgtccatcgatg

SEQ ID NO: 9530 - DNA, 2196 bp, Artificial Sequence
  Description of Artificial Sequence: Synthetic coding sequence
atgtcggaaacctcccggactgcttttgggggtcgacgcgcagtcccgccgaacaactcgaatgccgccgaggatgacctcccaaccgtcgaacttcagggagtggtccctagaggagtgaacctgcaggaattcctcaacgtcacttcagtgcaccttttcaaggaaaggtgggacacgaataaggttgatcaccacaccgataaatacgaaaacaataagctcatagtccggcggggtcaatcgttctacgtgcagatcgacttcagccgcccgtacgatccgcggcgcgatctgttccgcgtggaatacgtgatcggacggtacccgcaggagaataagggcacctacattccggtgccaatcgtgtccgagttgcagtcagggaagtggggagctaagatcgtgatgagagaagatcggagcgtccggctcagcatccagtcgtcccctaagtgcatcgtgggcaagttcaggatgtacgtggctgtgtggacgccctacggcgtacttaggacgtccaggaatccggaaactgatacctacatcctgttcaacccgtggtgcgaagacgatgcagtgtacctggataacgaaaaagaacgcgaagagtacgtgctgaatgatatcggcgtgatcttctacggagaagtgaacgatatcaagaccaggtcctggagctacggacagttcgaagacggaatcttggatacttgtctgtacgtgatggatcgcgcccagatggacttgtcgggaagaggaaacccgatcaaggtgtcccgggtcggatcggccatggtgaatgccaaggacgatgagggagtcctggtgggctcgtgggataacatctacgcttacggagtgcccccaagtgcgtggaccggaagcgtggacatcctgctcgaatatcggagctcagagaatccggtcagatacggacaatgctgggtgttcgctggtgtgtttaacacttttctccgctgcctgggaattccagcccggatcgtgaccaattacttctcagcccatgataacgacgccaatctgcagatggacatcttcctcgaagaagacggaaacgtcaactcgaagctgactaaagattcagtgtggaactaccactgctggaatgaggcctggatgacccgtcccgacctgccggtcggcttcggaggatggcaagcggtggattccaccccacaggagaactccgatggcatgtaccggtgcggcccagccagcgtgcaagccatcaagcatggacatgtctgcttccaatttgatgctccatttgtattcgcggaagtcaacagcgacctgatctacataaccgcgaaaaaggacggaacgcacgttgtggagaacgtggacgcgacgcacatcggaaagctcatcgtcaccaagcagatcggaggtgatgggatgatggacattaccgacacgtataagttccaggaaggccaagaggaggaacgcctggccctcgaaaccgcactcatgtacggggccaaaaagccactgaacacggagggagtgatgaaatcgaggtcaaacgtcgacatggacttcgaagttgagaacgcagtgctgggaaaggatttcaagctgtccatcacctttaggaataattcccataataggtacaccatcaccgcctacctgtccgccaacatcaccttctacaccggagtgcccaaagccgagttcaagaaggaaacttttgatgttactctcgaaccactctcctttaagaaagaagccgttctcatccaggccggtgaatacatgggccaactcctggagcaagcatctctgcacttctttgtcaccgcgaggatcaacgaaaccagagacgtgctggcgaagcagaaatcaactgtgttgaccattccggagattatcatcaaggtgcggggaacccaggtggtcggaagcgacatgaccgtgaccgtgcagtttaccaaccctctcaaggaaactttgcgcaacgtgtgggtccatctggatggtcccggcgtgacccgccctatgaaaaagatgttccgggaaatcaggccgaactctactgttcagtgggaagaagtgtgtcgaccatgggtttccggacaccgcaagctgatcgcaagcatgtcatccgactcgctcagacacgtgtacggagagctcgatgtgcagatccaaagacggccgagcatg

SEQ ID NO: 9531 - DNA, 2196 bp, Artificial Sequence
  Description of Artificial Sequence: Synthetic coding sequence
atgtccgaaacctcccggactgcctttggtggaaggcgggcggtgcctccgaacaactcgaacgctgccgaagatgatctgcctactgtcgagctgcagggagtggtacccagaggggtcaacctccaagagtttcttaacgtgacgagcgtgcatctgtttaaggaacgctgggataccaataaggtcgatcatcatactgacaaatacgagaacaacaaactgattgtgcggcgagggcaatcattctacgtccaaatagatttctcgcggccctacgaccctagacgggatctgtttcgagtggaatacgttattggcaggtacccccaggaaaacaagggtacttacattcctgtgcctatagtgtccgaactccaaagcggaaagtggggtgcaaagattgtgatgcgcgaggatcgttcggtgagactctcaatccagtcctcccctaagtgtatcgtcggaaagtttcggatgtacgtggcagtgtggaccccctacggggtccttcgaacctcaaggaaccccgaaactgatacttacattctcttcaatccatggtgcgaggacgatgcagtgtacctggacaatgaaaaggaaagagaagagtacgtgctgaacgatattggagtgatcttttacggtgaggtgaatgatatcaagacgagatcctggtcgtacggacaattcgaggatggaattcttgatacctgtctttacgtgatggaccgcgctcaaatggatctcagcggtcgaggcaaccctatcaaggtgtcgcgggtgggaagcgccatggtgaacgcaaaggacgatgaaggagtgctggtcggttcgtgggacaatatctacgcatacggcgtccctccctccgcctggaccggttcagtcgacatcctgcttgaataccgcagctccgaaaatcccgtgcggtacggacagtgttgggtgtttgcaggggtgttcaatactttcctccgttgtctgggaattcctgccagaattgtgaccaactacttttcagcacatgataatgacgcaaaccttcaaatggatatctttctggaagaggacggaaacgtgaattccaagctcaccaaggattcggtgtggaattaccattgctggaatgaggcatggatgactcgcccagatctccctgtcgggtttggtggttggcaagccgtggacagcacgccccaggagaatagtgacgggatgtaccgctgtggaccagcgtcggtgcaagcgataaaacacggacatgtgtgttttcagtttgatgcaccctttgtctttgccgaagtgaactcggatctgatttacattacggcaaaaaaggatggtactcatgtggtggaaaacgtggatgccacccatatcgggaagctcattgtgaccaaacaaattggaggcgacggtatgatggacatcaccgacacttacaagttccaggaaggtcaagaagaagaaagacttgcgcttgaaaccgcacttatgtacggagcaaaaaagcctctgaacactgagggcgtgatgaagagcagatccaacgtcgatatggattttgaagtggaaaatgcggtgctgggcaaagactttaagttgtcgattacctttcgcaacaatagccacaaccgctacactattactgcctacctctccgccaatatcactttttacactggagtccctaaagcagaattcaagaaagaaacttttgacgtgacgcttgaacccctgtcattcaaaaaggaggcagtcctcatacaggccggagaatacatgggacaattgcttgaacaggcatcgctccatttcttcgtgaccgccaggattaatgaaaccagagatgtcctggccaagcagaagagcaccgtgcttaccatccccgagatcatcattaaggtccgggggacccaagtcgtcggttccgacatgaccgtgacggtgcagttcacgaaccctttgaaggagactcttcggaacgtctgggtccacctggatggtccgggggtgactcggcctatgaaaaagatgtttagagagatccggcctaatagcactgtccagtgggaggaagtgtgccggccatgggtgagcggacatcgtaaacttatcgcctcaatgtcgagcgattccctgcgacatgtgtacggagagcttgacgtccagatacagcgtagacccagcatg

SEQ ID NO: 9532 - DNA, 2196 bp, Artificial Sequence
  Description of Artificial Sequence: Synthetic coding sequence
atgagcgagactagccgcacggcattcggcggccggcgggcagtccccccgaataatagcaatgccgccgaggacgacctgccaaccgtggagctgcagggcgtagtgcctcgcggagtgaatctccaggaattccttaacgttacgagtgtacacctgttcaaggagaggtgggatacaaacaaggtggaccatcacacagacaagtatgagaacaataagctgatagtacgccggggccaaagcttctatgtgcagatcgatttcagcaggccttatgatccccgccgcgacctgttcagggtagagtacgtcatcgggcgctatcctcaagaaaataaaggaacatatatccccgtgcccatcgtgagcgagctgcagtccggcaagtggggcgctaagatcgtgatgagagaggacagatccgtccgactctctatacaatctagcccaaagtgtatcgtgggcaagtttagaatgtacgtggcagtatggacaccatatggtgttctgcggacctcccgcaatcccgagacagacacctatattttgttcaacccgtggtgcgaggatgatgctgtttatctcgacaatgagaaggaaagggaagaatacgtcttgaatgacatcggggtgatcttttacggcgaggtaaacgacatcaagaccagatcttggtcctatgggcaatttgaggacggaattcttgacacatgtctgtacgtgatggaccgggcacagatggatctgtccggtaggggaaatccaatcaaagtctcccgggtgggctctgcaatggtgaacgccaaagacgacgagggcgtgcttgtcgggtcttgggacaacatttacgcgtatggtgtgcccccttctgcttggactggctccgttgacattctgctggaatatagaagctctgagaaccccgtgaggtacggacagtgttgggtgttcgccggggtgtttaacactttcttgcggtgtctgggtatcccggctcgaatcgtaactaactacttcagcgcccacgataacgacgctaacctccagatggatattttcttggaagaggacggcaatgtaaattccaaactgaccaaggatagcgtgtggaactatcactgttggaacgaagcctggatgactcggcccgacctgcccgtaggatttggcggctggcaggctgttgactccaccccgcaggagaacagtgacgggatgtaccggtgtggcccagcttctgtacaggccattaagcatggccacgtttgtttccagttcgacgcaccgtttgtgtttgcagaagtgaatagcgacctcatatacattacagcgaagaaggatggcacccatgtagtggagaacgtggacgcaactcatatcggtaaattgatcgtgaccaaacagatcggcggtgacggcatgatggatattacagacacctacaagtttcaggaggggcaagaggaagaacggctggccctcgagaccgcactgatgtatggggcaaaaaaaccgctgaacacagaaggggtgatgaaatctagatcaaacgtcgacatggattttgaagtggagaacgctgtgctggggaaggacttcaaacttagcatcaccttccgaaataattcccacaacagatatactataaccgcgtatcttagcgccaacatcaccttttacaccggagtaccgaaagcagagtttaaaaaagaaacattcgacgtaactctcgaaccgctgagttttaagaaagaggccgtccttattcaggccggtgaatacatgggccagctcctggagcaggcttccctgcacttttttgtgaccgccaggataaacgagacccgggatgttctcgctaagcagaagagtacagtgttgaccatcccggagatcattataaaggtcaggggaacgcaggttgtggggtccgatatgacggtgaccgtgcagtttaccaatcctcttaaagagacgctgagaaatgtctgggtacacttggacgggcccggggtgacacggcccatgaaaaagatgtttcgagaaataaggccgaattctactgtccagtgggaagaggtctgcagaccttgggtatctggccatagaaagttgatcgcctccatgtcttccgattccctgagacacgtgtatggagagctcgatgtgcagattcaacgaagaccatccatg

SEQ ID NO: 9533 - DNA, 2196 bp, Artificial Sequence
  Description of Artificial Sequence: Synthetic coding sequence
atgtcagaaacttcccgaactgcctttggagggagaagggccgtgcctcccaacaattcgaacgccgccgaagatgatctcccgactgtcgagctccaaggagtggtgcctcggggtgtgaaccttcaggaatttcttaacgtgaccagcgtccatctctttaaggagaggtgggacaccaacaaggtggatcaccacactgataagtacgaaaacaacaagttgatcgtgcgccgtgggcaatctttctatgtgcagattgatttttcccgcccttacgatccacgcagagatctgtttagggtggagtacgtgatcggaaggtacccccaagagaataagggaacttacatacctgtgcctattgtgtccgaacttcagtcggggaagtggggtgctaagattgtcatgcgagaggataggtctgtgaggctctcaatccaaagctcgccgaagtgtatcgtcggaaaattcagaatgtacgtggccgtttggactccctacggagtcctgcggacctcgagaaaccctgaaaccgatacctatatcttgtttaatccttggtgtgaggacgatgccgtctaccttgataacgaaaaagaacgggaagagtacgtgcttaacgatattggtgtgattttctacggtgaggtcaacgacattaagacgagatcgtggtcatacggtcaatttgaagatggtatcctggatacctgcctctacgtcatggacagagcgcaaatggacctgtcggggagaggtaaccccatcaaggtatctagggtcggcagcgcaatggtcaatgctaaagacgacgaaggtgtgctggtggggtcctgggacaacatttacgcatacggagtgccgcccagcgcatggaccggatcagtcgacatcctcctggaatacaggtcgagcgagaaccctgtgcggtacggtcagtgctgggtctttgcaggagtgtttaacaccttcctgagatgcctgggaattcctgcaagaattgtgactaactacttttcagcacatgacaatgacgcaaaccttcagatggacatctttttggaggaagatggaaatgtgaatagcaaacttaccaaggattccgtctggaactaccattgttggaacgaggcctggatgacccggcccgatctccctgtcggatttggtggatggcaggccgtggattccaccccgcaggagaactcagatggtatgtaccgttgtggacctgcatcggtgcaggcaatcaagcacggacacgtgtgctttcaatttgatgccccttttgtgttcgcggaggtgaacagtgatctgatttacatcaccgcgaaaaaggatggtacccacgttgtggaaaacgtcgatgccacccacattggaaagctcatcgtgacgaaacaaattgggggagacggcatgatggatatcactgatacttataagtttcaggaaggccaggaagaagagcgtctggcgctcgaaactgcgctgatgtacggcgcgaaaaagccattgaacacggaaggcgtcatgaagtcgcgctccaacgtggacatggactttgaggtggagaatgctgtgctggggaaggactttaaacttagcatcacgtttcggaacaactcccataaccgctacaccataacggcatacctgtcggcaaacataaccttttacaccggagtgcctaaggccgagtttaagaaggaaactttcgacgtgactcttgaacccctgagcttcaagaaagaagcggtgctgattcaagcaggagaatacatggggcaactgctggaacaggcatcgctgcatttctttgtcactgcccgcattaacgaaaccagggacgtcctcgcgaagcaaaagagcactgtcctcacgattcctgaaatcataatcaaagtccggggcacccaagtggtgggaagcgacatgaccgtgactgtgcaattcactaaccctctgaaggagacgctgcggaatgtgtgggtacatctggatggtcctggtgtgactagacccatgaagaaaatgtttcgtgagatccgaccaaattccaccgtgcaatgggaggaagtctgcaggccatgggtgtcgggacataggaagctcattgcatcaatgtcatcggactcccttcgccacgtgtacggtgagcttgatgtgcaaattcagagacggcccagcatg

SEQ ID NO: 9534 - DNA, 2196 bp, Artificial Sequence
  Description of Artificial Sequence: Synthetic coding sequence
atgagcgaaacttcgcggactgcgttcgggggaaggcgagcagttcctccaaacaacagcaatgcggctgaggacgatctgcctaccgtggaactgcagggagtggtgcctcgaggcgtgaatctgcaggaattcctcaacgtgacttcagtccacctcttcaaggagcggtgggacactaacaaggtggaccatcataccgataagtacgagaacaataagctgatcgtcaggcgggggcagtccttttacgtccaaatcgatttctcccgcccgtacgacccaagaagagacttgttcagagtggaatacgtgatcggccgctacccacaagaaaacaagggcacctacatacccgtgcctattgtcagcgagctgcagtccggaaagtggggagccaagattgtcatgagggaggatcggtcagtgcggctcagtatccagtcatcaccaaagtgcattgtcggaaagttcagaatgtacgtggctgtgtggaccccgtacggagtgctgcggacttccagaaacccagagactgatacctacatcctcttcaacccatggtgtgaggatgacgcggtgtacctcgataacgagaaggaacgcgaagaatacgtcctcaatgacatcggagtgattttctacggagaggtgaacgatatcaagacccgctcttggtcatatggacagttcgaagatggaatcctggacacttgcctgtatgtaatggaccgcgcgcaaatggacctgagcggccggggaaaccctatcaaagtctcaagagtcggttccgccatggtcaacgcaaaggatgacgaaggcgtgctcgtcggatcctgggataacatctacgcctacggagtccccccatccgcgtggacgggatctgtggatatccttctggaataccggtcctcggaaaacccggtgcgatacgggcagtgttgggtgttcgcaggggtgttcaacaccttcttgcgctgcctcggaatcccggcacggatcgtgaccaattacttctcagcccatgacaatgacgcgaatctccagatggacatcttcctggaggaagatggaaatgtcaactccaagctcacgaaggacagcgtgtggaattaccattgctggaacgaggcgtggatgactcggccggacctcccggtgggatttggcggatggcaggctgtggattcgaccccacaggagaatagcgacgggatgtatcgctgcggaccggcgtcggtccaagctatcaaacatggacacgtgtgtttccaattcgatgcgccatttgtgtttgccgaagtgaacagcgacctgatctacatcaccgcgaaaaaggatggaacccatgtcgtcgaaaacgtggatgccacccacatcggcaagctgatcgttaccaagcagataggaggagatgggatgatggatatcactgacacctacaaattccaagaaggacaggaagaggagcgccttgctctggaaacggctcttatgtatggagccaaaaagcccctgaacaccgaaggagtcatgaagtcgaggtcgaacgtggacatggattttgaagttgaaaacgccgtcctgggcaaagacttcaagctgtcgatcactttcagaaacaacagccacaatagatacaccattaccgcatacctgagtgccaatatcacgttttacactggcgtgccgaaggcagagtttaagaaggaaaccttcgacgtcaccctggagcccctgtcattcaagaaggaggcggtgctgattcaggctggagagtacatgggacaactcctcgagcaggcaagcctgcacttcttcgtgaccgcaagaatcaacgagactcgcgatgtgctggcaaaacagaaatcgaccgtcctgactatccctgagatcatcatcaaggtgagaggaacccaggtggtcggatcggatatgacggtgactgtgcaatttaccaacccgctgaaagagactcttcgcaacgtgtgggttcatctggacggtccgggcgtgactagaccgatgaaaaagatgttccgcgaaatccgcccgaacagcaccgtgcagtgggaagaagtgtgccgcccttgggtcagtggccatcgcaagctcatcgcgtccatgtcatccgactccctgcggcatgtctacggagagctggatgtccaaatccagcgccggccttcgatg

SEQ ID NO: 9535 - DNA, 2196 bp, Artificial Sequence
  Description of Artificial Sequence: Synthetic coding sequence
atgagcgaaacctcgcgcactgcatttggaggaagaagggcggtgccaccgaacaattcaaacgccgcggaagatgacctgcctaccgtggaactccagggagtcgtgccacggggggtcaacctgcaggagtttctgaacgtgacctcagtccacctgttcaaggagcggtgggacactaacaaggtcgaccaccatactgacaagtacgaaaacaataagctgatcgtgagacgggggcagtctttttacgtgcagatcgatttcagcaggccatacgacccgagacgcgatctgttccgcgtcgagtatgtcatcggaagatacccgcaagaaaacaagggaacctatatccctgtgccaattgtgagcgaactgcaatcgggaaagtggggagccaaaatcgttatgagagaggaccgctcggtccgcttgagcatccaatcctcccctaaatgtatcgtcgggaagttcagaatgtacgttgcggtctggactccgtacggtgtcctgagaacgtccagaaatccggagactgacacgtacatccttttcaacccttggtgcgaagatgacgcagtgtacctggataacgaaaaggaacgcgaggagtacgttctgaacgatatcggtgtgattttctacggagaagtgaatgacattaagactcgctcatggtcctacggacaattcgaagatggcatcctggatacctgtctctacgtcatggatcgcgcacagatggacctgtcggggagaggaaacccgattaaagtgtcacgcgtgggctccgctatggtcaatgcaaaagatgatgagggagttctggtgggctcctgggacaacatctacgcctacggcgtcccgccttcggcttggaccggctccgtggacattctgctggaataccgcagcagcgaaaatccagtgagatatggacagtgttgggtgtttgcgggagtgttcaataccttcctgcggtgtctgggtatccctgcacggattgtgactaactacttttcggcccatgataatgacgccaacctccagatggacatcttcctcgaggaggacggaaatgtgaactcaaaactcactaaggactcggtctggaactaccactgctggaacgaggcgtggatgacccggccagacttgcctgtgggattcggaggctggcaggccgtggactccactccacaagagaattccgacgggatgtaccgctgtggaccggcatcagtgcaggctattaagcatgggcacgtgtgcttccagttcgatgcgccgtttgtgttcgcagaagtcaattctgacctcatctatatcaccgcaaagaaagacgggacgcacgtggtagagaacgtggacgcaactcatatcggaaaactcatcgtgaccaagcagatcggaggggacggtatgatggatatcaccgacacttacaagttccaggaaggacaggaagaggaacgacttgcactcgagactgccctgatgtacggtgctaaaaagccactgaataccgagggggtcatgaagtcccgcagcaatgtggacatggattttgaggtggagaacgccgtgctcggcaaggatttcaagctctcaattactttccggaataactctcacaacagatacaccatcaccgcgtacctttcagccaacatcaccttctacactggagtgccgaaggctgagttcaaaaaagagacgttcgacgtaacccttgaaccactgagcttcaagaaggaagcggtgcttatacaggcgggggaatacatgggtcaattgctggagcaagcctcgttgcacttctttgtcacggcacgcattaacgaaacccgcgatgtgctggccaaacaaaaaagcaccgtgctgaccattccagagatcatcattaaagtgagaggcactcaggtggtgggatcagacatgaccgttacggtccaatttactaacccactgaaagaaaccctgcgcaacgtgtgggtgcacctggacggacccggagtgacccggccgatgaagaaaatgttcagggaaatccgcccaaactccactgtccaatgggaggaagtgtgccggccatgggtgtccggtcatcgcaagctgatcgcctccatgtctagcgactcgttgcgccatgtctatggagagctcgatgtgcagatccagaggcgcccatccatg

SEQ ID NO: 9536 - DNA, 2196 bp, Artificial Sequence
  Description of Artificial Sequence: Synthetic coding sequence
atgtcggaaacctcgagaaccgcgtttggaggccgtcgagcagtgccacctaacaactcgaacgcagcagaagatgacctccccactgtcgagctgcagggtgtcgtgccccggggagtcaaccttcaggagtttctgaacgtgacttccgtgcatttgtttaaggaacgttgggataccaataaggtcgaccaccatactgacaaatatgagaacaacaaacttattgtgcgtcgaggacaatcgttctatgtccagatcgacttctccaggccatacgatcctcggagagatctctttagggtggagtacgttattgggcgttatcctcaagaaaacaaaggtacctacatacccgtccccatcgtctccgagctccaatcaggaaagtggggcgccaaaattgtcatgcgcgaagatagatcagtgaggttgtctattcagagctcacctaagtgcattgtgggtaagtttcgcatgtacgtcgcagtgtggacgccgtacggtgtgcttcgcacctccagaaaccctgaaaccgatacttacattctgttcaatccttggtgtgaagatgacgcagtgtatctcgacaacgaaaaggaaagagaagaatacgtgctgaacgacattggagtgatcttctacggtgaagtgaatgacatcaagactaggtcatggtcatacgggcagtttgaagatgggattcttgatacctgcctgtacgtgatggacagagcacaaatggatctgtcgggccgtggtaaccctatcaaggtgtccagagtgggatcggcaatggtgaatgcaaaggatgatgaaggtgtccttgtgggctcctgggataacatctacgcatacggggtccctccttcggcatggactggatccgtcgacattttgctggaataccgctcgtcagaaaacccggtgcgctacggtcagtgctgggtctttgcgggagtctttaacaccttccttagatgtcttggtattcccgcccggatcgtgacgaattacttctcagcacatgataacgacgcaaaccttcagatggacatctttcttgaggaggacggtaacgtcaactccaagctcactaaggactcggtgtggaactaccattgctggaacgaagcatggatgacccgcccagacctgcccgtgggattcggagggtggcaagcagtggatagcaccccacaagagaactcagatggtatgtacagatgcggtccagcatccgtgcaggcgatcaagcatgggcatgtgtgttttcaatttgatgcccctttcgttttcgccgaggttaactcagatctgatttacattaccgcaaagaaagatggtacgcacgtcgtcgaaaatgtggatgcaacccatattggtaaactgattgtgactaagcagattggaggagacggtatgatggacatcaccgatacctacaagttccaggagggacaagaagaggaacgactggcactggaaactgcactcatgtacggggcaaagaaacctcttaatacggaaggcgtgatgaagtccaggagcaacgtggatatggactttgaagtggaaaacgccgtgcttgggaaggacttcaaactttcgattacttttaggaacaatagccataaccgctacactattaccgcctacctgtcggcaaatatcactttttacaccggagtccctaaggcagaattcaagaaggaaacgttcgatgtgacgcttgaacctctcagctttaagaaggaggcagtgcttattcaggccggagaatacatggggcaactgttggaacaggcatcgcttcatttcttcgtgaccgcaaggatcaacgagactagggatgtgttggctaagcaaaaatcgaccgtgctgactattcctgaaatcatcatcaaggtcagaggtactcaagtggtgggaagcgacatgactgtgaccgtgcagtttaccaacccactgaaggagactcttcgtaatgtgtgggtgcaccttgatggccccggggtgacccgtcccatgaagaagatgtttcgggaaatccgcccaaacagcaccgtgcagtgggaagaagtgtgtagaccatgggtgtccggtcatcgaaagctgattgcatccatgtcgtcagattctctccggcacgtgtacggcgagctggacgtgcaaattcaacgacgaccaagcatg

SEQ ID NO: 9537 - DNA, 2196 bp, Artificial Sequence
  Description of Artificial Sequence: Synthetic coding sequence
atgtccgaaacttctcgcactgcctttggaggtagacgcgctgtccctccaaacaattccaacgcagcagaggatgacctgcccacggtggaactccagggagtggtgcctcgcggcgtgaacctccaggagtttctgaacgtgacctccgtccacctgtttaaggaaaggtgggataccaacaaggtggatcatcacacggataagtacgaaaacaacaagctcatcgtgagaaggggccaatcgttctacgtccagatcgatttctcccggccttacgaccctaggcgcgacttgtttcgggtggaatacgttattgggcggtacccccaagagaataagggcacttacattcccgttccgatcgtgtcggaactccagtccgggaaatggggcgcaaagatcgtgatgcgtgaggatagatccgtcaggctttcgatacagtcgagccccaagtgtatcgtcggaaagtttcgcatgtacgtggcagtctggaccccttacggcgtgttgcggacctcaaggaaccctgaaaccgatacctacattttgtttaacccatggtgtgaggatgatgcggtgtacctcgataacgaaaaagaacgcgaggaatacgtcctgaatgatataggagtgatcttttacggggaggtgaacgatatcaaaacccgctcatggtcatacggtcagtttgaggacggtattctggatacctgtctttacgtcatggatcgagctcagatggatctgagtggccgcggaaacccgattaaggtgtcaagggtggggtcagctatggtgaatgcaaaagacgatgaaggggtcctggtcggctcatgggataacatttacgcctacggagtccctccctcagcatggactggatcggtggacattttgctggaatacagatcgtcagaaaatcccgtcagatacggccagtgttgggtgttcgccggtgtgtttaacaccttcctgagatgcctcgggatcccagcacgtattgtgacgaattacttctccgcacatgacaatgacgcaaacctgcaaatggacatttttcttgaggaggatggtaatgtgaactcaaaactcactaaggattcggtctggaattaccattgttggaacgaagcatggatgacccgccccgacctgccagtcggattcggaggttggcaggccgtcgactcgactcctcaggagaacagcgacgggatgtatcgctgtggacctgcaagcgtgcaagctattaagcatggacacgtctgttttcaatttgacgcgccattcgtctttgcagaagttaattcggatctgatttacattactgccaagaaggatggtacccatgtcgtcgagaacgtggatgcaactcatattggaaagctgattgtcaccaaacagattggcggagacggtatgatggatattactgatacttacaagtttcaggaaggacaggaagaagaacggcttgcgctggaaaccgcactcatgtacggagcgaagaagcccctgaacactgaaggagtgatgaaatcgcgttcgaatgtggacatggatttcgaggtggaaaatgccgtcctcggaaaggactttaagctgagcatcaccttcaggaacaattcccataaccgatacactatcaccgcatatctttcagcgaacattactttttacactggagttcccaaggcagagtttaagaaagaaactttcgatgtgactctggaaccactttcatttaagaaagaggcggtgctgatccaggcaggggagtacatgggacaacttttggagcaagcatcccttcactttttcgtgaccgcaagaattaacgaaactcgggacgtgctggcaaagcaaaaatctaccgtgctcaccatacctgaaatcatcatcaaggtgcggggaacgcaggtggtgggtagcgatatgaccgtgaccgtgcagtttactaaccctctgaaggagactctgcgaaacgtgtgggtgcatcttgatggacccggcgtgaccagacctatgaagaagatgtttcgcgaaatcaggccaaattccaccgtgcagtgggaagaagtctgtcgcccatgggtcagcggacatagaaagctcattgcatcaatgtcgtcggactcgcttagacatgtgtacggggaacttgatgtgcaaatacagcgacggccctcaatg

SEQ ID NO: 9538 - DNA, 2196 bp, Artificial Sequence
  Description of Artificial Sequence: Synthetic coding sequence
atgtctgaaacttctcggactgccttcgggggacggcgcgccgtacctcccaataattccaatgcagccgaagatgacctcccaacagtcgagcttcagggagttgtacctcggggcgtgaacctccaggagtttctgaatgtgacttccgtgcaccttttcaaggagcgatgggacacaaacaaggttgaccatcacacagataagtacgagaataacaaactcatagtcagacgagggcagagcttctatgtacagatcgacttctcaagaccctacgatccacggcgagatctgttcagagtagagtatgtaatcggacgctatcctcaggaaaacaagggcacttatatcccagtcccgatcgtgagtgaactccagtccggcaagtggggagctaaaattgtgatgagagaagataggtctgttcgattgagcatccaatcttcgcccaaatgtatagtgggcaaattccggatgtatgtggctgtgtggacaccttatggggtcctacgtacctcacgcaaccccgaaacagatacctacatactgtttaacccctggtgtgaggacgacgccgtatacctggataacgagaaagagagagaggaatacgtgctgaacgatatcggcgtgatattctacggagaagtcaatgatatcaagacaaggagctggagttacggacagtttgaagatggaatcctggatacctgcctctatgtcatggacagagcacaaatggatctgtctgggagaggcaatccaattaaagtgagtcgcgtgggatcagcaatggtgaatgccaaagatgacgagggcgttctggtcggctcttgggataatatctacgcatatggggtgccaccgtcagcgtggacaggttctgtcgacattctactagaataccggtcatctgagaaccccgtgcggtacggccagtgctgggtgtttgctggagtgtttaacacatttctccggtgcttaggaatccccgcaagaatcgtgacaaactatttctctgcccacgacaatgacgctaatttacagatggatatcttcctggaggaggacgggaacgtaaacagcaagttaacgaaagactcggtttggaattaccattgctggaacgaggcctggatgacccgccctgacctgcccgttggatttggggggtggcaagcagtggactctacgcctcaagaaaactcggacggcatgtaccggtgcggccccgcatcagtccaggccataaagcacggccacgtatgctttcagttcgacgcaccatttgtcttcgcggaggtgaattctgacctcatctacatcaccgcaaaaaaagacggaacccatgtcgtagaaaacgtggacgccacccacatcgggaaactaatcgttactaaacagattggaggagatggaatgatggacattacggacacttacaaattccaggagggtcaagaggaagagagattggccctggagacagctctgatgtatggagcgaaaaaacctttgaacactgaaggcgttatgaagagtagaagcaacgtggatatggactttgaagtggagaacgctgtgctgggaaaagatttcaagttgtcaataaccttccgcaacaattctcataaccggtacactatcactgcttacctgagtgccaatatcactttttatacaggcgttcccaaagcagagttcaagaaggaaacctttgacgtgacactcgagcccctctcctttaagaaagaggctgtgctaattcaagctggggaatacatgggccaactcctggaacaggcatctctgcattttttcgtgactgcgcggattaatgaaactagagacgtgttggcaaagcagaagtccaccgtgttgacaattcccgaaattataataaaagtccgtggaacacaagtggttggatcagatatgaccgttacagtccagtttacgaacccactgaaggaaaccctccgaaatgtttgggtgcaccttgatggcccaggcgtgacgagacccatgaagaagatgttccgggagatccgacccaatagcactgtacaatgggaagaagtgtgcaggccgtgggtgtcaggtcacagaaaattgattgcctcgatgtcgtctgacagccttcggcatgtgtacggggaacttgatgtgcagatccaacgcaggccaagtatg

SEQ ID NO: 9539 - DNA, 2196 bp, Artificial Sequence
  Description of Artificial Sequence: Synthetic coding sequence
atgtccgaaaccagccggaccgccttcggcgggcgccgcgcggtgcctccaaataactcgaacgccgcggaggacgacctgccaaccgtggaactgcagggtgtggtgcccagaggcgtcaacctgcaggagttcctcaacgtgacctccgtgcatctgttcaaggaacgctgggataccaacaaggtggatcaccataccgataagtatgaaaacaacaaacttattgtgagaaggggacaatcgttttacgtgcaaatagacttttcgcgcccctacgatccacgtagagatctgtttcgggtggaatacgtcatcggaaggtacccacaagaaaacaagggcacttacattccagtccctattgtgtcggaactccagtcgggaaagtggggggcgaagattgtgatgcgagaagatcgttctgtccgcctctcaattcaatccagtccgaagtgtatcgttggtaagtttcgaatgtacgtggcagtgtggaccccttacggtgtgcttcgaacctccagaaacccagagactgacacttacattctcttcaacccttggtgtgaggacgacgcggtgtacttggacaacgaaaaggaaagagaagaatatgtgctcaatgatatcggtgtcatcttttacggagaggtgaacgacattaagactaggagctggagctacggtcaatttgaagatggaattcttgatacttgtctgtacgtcatggatagagcgcagatggacctttcgggtagaggaaatcccattaaagtgtcaagagtcggatcagcaatggtaaatgcaaaggacgacgaaggcgtcctcgtgggatcatgggacaacatttacgcttacggcgttccaccatccgcatggaccggatccgtggatatcctcttggaataccggtcctcggagaatccagtgcggtacggccaatgctgggtgtttgcaggggtgtttaacacgtttctgcggtgtctgggtattcctgcaagaattgtgactaactacttctcagcacatgataatgatgccaacctgcaaatggatatctttcttgaagaggatggaaacgtgaattcgaagctgaccaaagattccgtgtggaactaccattgttggaatgaagcctggatgactaggcctgacctccctgtgggattcggaggatggcaggcagtcgacagcacgccgcaggagaactcagatggaatgtatcgctgcggtccagcgagcgtgcaagcgattaagcatggacatgtctgctttcaatttgatgccccatttgtgtttgccgaagtcaactcggatcttatctacataaccgcaaaaaaggacggaactcatgtggtggaaaacgtggacgcaactcatattggaaaattgattgtgacgaagcaaatcggaggagacggtatgatggacattaccgacacttacaaattccaagaaggtcaggaggaagaaaggctcgcacttgaaaccgcgctcatgtacggtgccaaaaagccactgaacacggaaggtgtgatgaagtcaagaagcaatgtcgacatggacttcgaggtcgaaaatgctgttctgggaaaggactttaaactctcgatcacttttcgcaataactcacacaacaggtacaccatcactgcatacctgagcgcgaacataactttttacaccggagtgcccaaggcggagttcaagaaagaaacttttgacgtgactctcgaaccactttcctttaagaaggaggcagtgctgatccaggctggcgagtacatgggacaacttcttgaacaggcctcgctgcatttcttcgtgacggctcggattaacgaaaccagggacgtgctggcaaaacagaaaagtactgtgctcaccatacctgagattatcattaaagtccggggaacgcaagtggtcggtagcgatatgactgtcaccgtccagttcactaaccctctcaaagagactctgcggaacgtgtgggtgcacctggacgggcctggcgtgactcgccctatgaagaagatgttcagagaaattcggccaaactccactgtgcaatgggaggaagtgtgccggccatgggtttcaggacatcggaagttgatcgcatcaatgtcgtccgattccttgagacatgtgtacggtgagcttgacgtccagattcaacggcggcctagcatg

SEQ ID NO: 9540 - DNA, 2196 bp, Artificial Sequence
  Description of Artificial Sequence: Synthetic coding sequence
atgtccgaaacttcccgcaccgcatttggaggtcggagagcagtgccacccaacaattcaaatgcagccgaagatgacctcccgactgtggaactgcagggggtggtgcccagaggagtgaatctccaggaatttctcaacgtgacctccgtgcatctgttcaaggaacgatgggacaccaataaggtggatcatcatactgataagtacgagaacaacaaacttatagtgcgtcgtggacaatctttctacgtccaaatcgacttctcccgcccttacgatccacgccgtgatctgtttagggtggagtacgtgatcggcagataccctcaggaaaacaaaggaacctacattcccgtgcctattgtgagcgagctgcagtccgggaaatggggggcaaagattgtgatgagggaggaccggtccgtgagactctcaattcagtcctcaccaaagtgcatagtgggcaagttcagaatgtacgtcgccgtgtggaccccctacggtgtgctgcgaacctcccggaatccagaaaccgatacctacattcttttcaatccttggtgtgaagatgatgcagtgtacctcgataatgaaaaggagagagaagaatacgtgctgaatgacataggggtgatcttttacggagaagtgaacgacattaagaccagatcgtggtcctacgggcagttcgaggacgggatcttggatacgtgcttgtatgtgatggatcgcgcccaaatggatcttagcggacggggtaatcctatcaaagtctcaagagtcggatcggcaatggtgaacgcaaaagacgatgagggcgtacttgtgggcagctgggataacatttacgcatacggtgtgccaccttcagcctggactggttcagtggatatactgcttgagtacagatcctccgaaaatcctgtgagatacggacagtgttgggtgttcgcgggcgtctttaacacctttcttcggtgtctgggtatacccgcgagaattgtcaccaattacttttccgcacatgataacgacgctaatctccagatggacattttcctggaggaggatggcaacgtgaactccaagctgactaaggactcggtgtggaattaccattgctggaacgaagcgtggatgacgcggcctgacctgcctgtcggatttggcggatggcaggctgtcgattcaaccccacaggaaaattcggatggtatgtaccgatgtggcccagctagcgtccaagccatcaagcatggacatgtgtgtttccaatttgatgctcctttcgtgtttgcggaagtcaactcggacttgatttacatcaccgcaaagaaagacggtacccacgtggtggaaaacgttgacgcgacccatattggaaagctgattgtgactaaacaaattggtggtgatggtatgatggatatcactgatacctacaaatttcaagaaggccaagaagaagagagactggcactggaaaccgcccttatgtatggtgcaaaaaagcctctgaacactgaaggagtgatgaagagcaggtcaaacgtcgatatggattttgaagtggagaacgccgtgctgggaaaggactttaagctgagcattaccttcaggaacaattcccataaccggtacaccataactgcatacctgtcggccaatatcacgttttacaccggagtgcctaaagccgagtttaagaaagagacttttgacgtgacgctggagccgcttagcttcaagaaggaagcagtgctgattcaggccggcgaatacatgggacaacttctggaacaggcatcccttcatttctttgtcaccgcacggatcaacgaaacgagggatgtccttgccaaacagaagagcacggtgctgactattccagaaatcataatcaaagttcgtggtacgcaggtggtcggatcagacatgaccgtgactgttcagttcactaatcctcttaaggagactctgcgcaacgtgtgggttcaccttgatggtcctggagtcactcgccctatgaagaagatgtttcgtgagatcaggcccaattcaaccgtccaatgggaggaagtatgtcgaccttgggtcagcgggcatagaaaacttattgcctccatgtcatccgatagcctcaggcacgtgtacggtgaactggatgtgcagatccaacggcggccatccatg

SEQ ID NO: 9541 - DNA, 2196 bp, Artificial Sequence
  Description of Artificial Sequence: Synthetic coding sequence
atgtccgaaacttcacggactgcctttggggggcgaagggcagtgccccctaacaactccaatgcagcagaagatgatctgccaaccgtcgagcttcaaggggtcgtgccgcggggtgtgaacctccaagaatttcttaatgtgacttcagtgcaccttttcaaggaacggtgggacaccaacaaggtcgatcatcacaccgataagtacgagaacaacaagttgatcgtgcggagagggcagagcttttacgtgcaaattgacttctcccgtccatacgatccgcgaagagatctgtttagagtggaatacgtgattggtcgatacccccaggagaataagggcacttacattccagtgcccatcgtgtctgaacttcagtcaggaaagtggggagcaaagattgtgatgagagaagatcggtcggtgcggctgtccatccaatcctcccccaagtgcattgtcggtaaattcagaatgtacgtcgcagtgtggacgccatacggcgtgctccggaccagcagaaatccagaaactgatacttacatcttgtttaacccttggtgtgaagatgatgcagtttacctggataatgaaaaggaaagagaagaatacgtgcttaatgatattggtgtgattttctacggggaggtgaacgacattaagactagatcgtggagctacggacagtttgaggacggaatactggatacttgcttgtacgttatggacagggcgcaaatggacttgtcgggccgcggaaatccgataaaggtgtccagagtgggtagcgcaatggtgaacgccaaggatgacgagggagtgcttgtcggtagctgggataacatctacgcctatggagtccctccaagcgcatggaccggatccgtggatatccttttggagtaccgctcatcggaaaaccctgtgcgatacggtcaatgttgggtgtttgctggggttttcaatacttttctgaggtgtcttggcatccctgcacgcatcgtgactaattacttctccgcccatgataacgacgcaaatctgcaaatggacatctttttggaggaagatggcaacgtgaactccaagctgaccaaggactctgtctggaattaccactgctggaatgaagcctggatgacccgaccagatctgcctgttggatttggaggatggcaagcagtcgatagcactcctcaggagaactccgatgggatgtaccggtgcggtcctgcgagcgtgcaagcgattaaacatggccacgtctgttttcaatttgatgcgccatttgtgtttgcagaggtgaactcggatttgatttacattaccgccaaaaaggatgggacccatgtcgtcgagaatgtggatgcaactcacatcggaaagctgattgtcaccaagcaaattggtggagacgggatgatggatattaccgatacttataagttccaagagggacaggaggaagaacgcttggccctggaaaccgcgctgatgtacggggctaagaagcccctcaacactgagggagtgatgaagtcacgaagcaacgtggatatggattttgaagtggaaaatgcagtgctcggaaaggatttcaagctgtccattacctttcggaacaacagccacaaccgctacactattaccgcatatctgtcggcaaatatcactttttacaccggggtgcctaaggcagaattcaagaaagaaacctttgatgtgaccctggaaccgctctcatttaagaaggaggcagtcctcattcaagcaggagaatacatgggtcagctgcttgaacaggcgtcacttcatttcttcgtgactgccaggattaatgaaactcgggatgtgcttgccaaacagaagtcgactgtcctgactatacctgagatcatcattaaggtcagaggtactcaggtggtgggctcggatatgactgtgaccgtgcagtttactaatccacttaaggaaactctccgcaacgtgtgggtgcatctggacggaccaggtgtgactagacccatgaagaaaatgttccgcgaaattcgcccaaattccactgtccagtgggaagaagtctgtcgtccatgggtgagcggacatcggaaacttatagcatcgatgtcgtcggatagccttaggcatgtgtacggggagctggacgtccaaatccagagacgtccctccatg

SEQ ID NO: 9542 - DNA, 2196 bp, Artificial Sequence
  Description of Artificial Sequence: Synthetic coding sequence
atgagcgaaacgagtagaacagcatttggcggtcgacgagcagtgccgccaaacaacagcaatgcagcagaagatgatctacctacggttgagttacagggcgttgttccaagaggtgtgaacctgcaagaattcctgaacgtcacaagtgttcacctgttcaaggagagatgggatactaacaaggtagaccaccacaccgataaatatgaaaacaacaaactcatcgtaagaaggggccagagtttttatgttcagatcgatttttccagaccctatgacccacggagagatttatttcgagttgagtacgtcataggacggtaccctcaggagaacaagggcacctacatccctgtcccaattgtctcagaattacagtctgggaagtggggcgccaagatcgttatgcgagaggacagaagtgtgagactgtctatccagagttcacccaaatgcatcgtcggcaagttcaggatgtacgtcgcagtttggactccctacggggtgctgcgaacctctcgaaatccggagacagatacctacatcttattcaatccctggtgcgaggacgatgctgtgtacctggacaatgagaaggaaagagaggaatacgtgctgaatgacataggcgtaattttttatggtgaggttaatgacatcaagacaagatcctggtcttacggccagtttgaggacgggattctggatacatgtctctatgtgatggacagagcgcagatggacttgtccggcagaggcaaccctatcaaggtctctcgagtgggtagtgccatggttaacgcgaaagatgatgaaggggttctggtgggctcctgggataatatttatgcttacggtgtgcctccaagtgcttggactggctccgtggacattctactggagtacaggtctagtgagaacccagttcgatacggtcagtgttgggtgtttgctggggtgttcaatacttttctcagatgcctcggtatcccagctcgcatagtcactaattatttttctgcgcacgataatgatgccaacctccagatggacatcttcttggaggaagatggaaatgttaactccaagctaactaaagacagcgtgtggaactatcactgctggaatgaagcttggatgaccaggccagacctacccgtgggctttggcggctggcaggctgtcgactctactccccaagagaattccgacggcatgtatagatgtggaccggcctctgtgcaggccatcaaacatggccatgtgtgctttcagttcgacgccccctttgtctttgctgaggttaattccgacctgatctacatcaccgctaagaaagatggaacacacgtcgttgaaaatgtggacgccactcacattgggaagctgatcgtcaccaagcaaatcgggggcgacgggatgatggacataactgacacctacaagtttcaagaggggcaggaagaagaaagacttgctctagagaccgctctgatgtatggcgccaagaagccgctgaataccgaaggcgtcatgaagtctcgtagtaacgtagacatggattttgaggtggaaaatgctgtgctgggcaaggactttaagctgagcataaccttcagaaacaactctcacaataggtataccatcaccgcatacctcagcgctaatatcactttctataccggagtccctaaggcagaattcaagaaggaaactttcgacgtgacgctcgagcctcttagcttcaaaaaagaagcggtgctgatccaggctggggagtatatgggacagctgctcgagcaggcctctttgcatttttttgttaccgccaggataaatgagacaagggacgtgctggctaagcagaaatcaacagtgcttaccatccccgaaatcattataaaggtgaggggcacccaggttgtgggttcggacatgaccgtaacagtccaatttaccaatcctctgaaggaaactttgagaaacgtttgggtgcacctggatgggcccggggttacacggccaatgaaaaaaatgttcagggagattaggcctaatagtacggtgcagtgggaagaagtgtgtcgaccctgggtcagtggccaccgaaaactcatagccagcatgagttctgattccctaagacatgtatacggggaacttgacgtgcagatacaaagaagacctagtatg

SEQ ID NO: 9543 - DNA, 2196 bp, Artificial Sequence
  Description of Artificial Sequence: Synthetic coding sequence
atgtccgaaacctcgcgcaccgctttcggaggaaggcgcgctgttccgcccaacaattccaacgccgccgaggacgaccttcctaccgttgagcttcaaggagtggtgccacgcggagtcaacctgcaagaattcctgaatgtgaccagcgtgcacctcttcaaggagcgatgggataccaataaagtcgaccatcacactgacaagtacgagaacaataaactcatcgtccgccggggccagtcgttttacgtgcagatagacttctcccggccgtacgacccgcggcgggacctcttccgtgtcgagtacgtcatcggaagatacccgcaagagaacaagggaacttacatcccggtgccgatcgtgtcggagctgcaatcaggaaagtggggagcaaagattgtgatgagagaggaccgctcagtcagattgtcgattcaatcctctccgaagtgtatcgtcggaaagtttcgcatgtacgtggcggtctggacgccatacggagtgctgcgcacttccagaaaccccgagactgacacgtacatccttttcaacccgtggtgcgaggacgacgccgtctacctggataacgaaaaagagagagaggaatacgtcctgaacgacatcggagtgatcttctacggagaggtgaatgacatcaagaccagatcatggagctacggacaattcgaagatggcatcctggatacttgcctgtatgtcatggaccgcgcccaaatggacctgagcggcaggggcaacccaatcaaagtgagccgcgtgggctctgctatggtcaacgccaaggacgatgaaggtgttcttgtcgggtcctgggacaacatctacgcctacggagtgccaccatcagcctggacgggatcggtcgatatcctgctggaataccggagctctgagaatcctgtgcgctatgggcaatgctgggttttcgctggagtgttcaacacctttcttcgctgcctgggcatcccggctcgcatcgtgaccaactacttctcagcccacgataatgatgcaaatctccagatggatatcttcttggaggaagatgggaacgtgaatagcaagctcacgaaggactcagtgtggaactaccattgctggaatgaagcgtggatgacgcggccggatctcccggtgggattcggtggatggcaggccgtggattcgactccgcaagaaaacagcgatggtatgtacaggtgcggccctgcgtcagttcaggcgatcaagcacgggcacgtgtgcttccagttcgacgctccatttgtgttcgcggaagtgaatagcgaccttatctacattaccgccaagaaagacggtacccatgtggtggaaaatgttgatgcgacccatatcggtaaactgattgtgaccaagcagatcggcggagacgggatgatggacatcaccgatacttacaagttccaggaaggacaggaagaagagcgcctggccttggaaaccgccctgatgtacggagcgaagaaaccgctgaatactgaaggtgtgatgaagtcgcggagcaacgtggatatggattttgaggttgaaaacgctgtgctgggaaaggatttcaaattgagcatcactttccgcaacaattcgcataatcgctacactatcaccgcctacctttcggccaacatcactttctacactggcgtccccaaagctgaattcaaaaaagaaacttttgacgttactctggaaccgttgtcgttcaagaaggaagcggtgctgatccaggccggagaatacatggggcagcttctggagcaggcctccttgcacttcttcgtgactgcacgcatcaacgagactcgggatgtcctggccaagcagaagagcacggtgctgacgatcccggaaatcatcatcaaagtccgcggcacccaagttgtgggatccgatatgacggtgactgtgcaattcactaaccctctcaaggaaaccctccggaacgtgtgggttcatttggacggaccaggcgtgacccggcctatgaagaagatgttcagagaaattcgcccgaactcgactgtgcagtgggaggaagtgtgccgcccatgggtgtcgggacaccggaaactgatcgcttccatgagctcggattcgcttcgtcatgtgtacggagaactcgatgtgcaaatccagagacggccgtcgatg

SEQ ID NO: 9544 - DNA, 2196 bp, Artificial Sequence
  Description of Artificial Sequence: Synthetic coding sequence
atgagcgaaacgtcccggacagcattcggggggaggcgggcagtaccccccaacaatagtaacgccgccgaagatgacctgcccaccgttgaactgcaaggagtggttccaagaggagtgaacctgcaggagtttcttaacgtcacgtccgtgcatttgttcaaagagcggtgggacacaaataaagtggatcatcacacggacaagtacgagaacaataaactgattgtgcgcagaggtcaatcattctatgttcagattgatttcagcaggccatacgacccccgtagagatctattccgggtggaatacgttataggacgatatcctcaggaaaacaagggaacctacattcccgtgcctatcgttagcgagctccagagcgggaagtggggcgcaaagattgtgatgcgcgaggatcggtccgtgcgcctaagcatacagtccagccccaagtgtattgtgggtaaattcagaatgtacgtggccgtctggaccccttatggagtcctacggacatcacgtaatcctgagaccgacacttatatcctgtttaatccttggtgcgaagacgacgcagtgtatctcgacaatgagaaggagcgggaggaatacgtgctcaatgatataggcgtgatattctatggggaggtcaatgacataaaaacgcgatcttggtcttatgggcaattcgaggacggcattcttgacacgtgcctatacgtgatggaccgggctcagatggatttgtccggccgcggaaatcctatcaaggtgtctagggtggggagcgcaatggtaaacgccaaggacgatgagggagtcctggtgggatcctgggataacatatatgcctatggggtgcctccttcagcctggaccggctccgttgacatcctgctcgaataccgctcttcagagaatcccgtgcggtacggtcaatgctgggtgttcgcgggggtatttaacaccttccttcggtgcctaggcatcccagcccgaattgttacaaactacttttcagcccacgacaatgacgccaacctccagatggatatttttttagaggaggatggtaatgtcaatagcaagttgacgaaagactctgtatggaactatcactgctggaacgaggcatggatgacccgtcccgacttgcctgtcggattcggagggtggcaggccgtcgattcaacaccccaggaaaatagcgatggaatgtataggtgcgggccggcaagcgtccaagctattaaacatggacacgtttgcttccagtttgatgctcctttcgtatttgccgaggttaatagcgacttgatctatattactgccaagaaggacggcacgcatgtcgtcgagaacgtggacgcaacccacatcggtaaactcatcgttactaaacagataggaggcgatggtatgatggacattaccgacacttacaaatttcaagaaggccaggaggaagagaggctagccctcgagactgccctcatgtacggtgccaaaaaacctttaaacactgagggagttatgaagtcacgcagcaacgtggatatggacttcgaggtcgagaacgcagtacttggaaaggatttcaagttgagtataacattcaggaacaacagccacaatcgatacacgataaccgcctaccttagcgctaatatcaccttctacaccggagtgccgaaggctgagtttaaaaaggagacttttgacgtgaccctcgaaccactgagtttcaagaaagaggccgtcctcatccaagccggggaatatatgggccagctgctggagcaggcatccttacatttcttcgtcactgcgaggattaatgaaacgagggatgttctggccaagcaaaaaagcacagtgctcaccattccagagatcatcatcaaagtgcgcgggacgcaggttgtcggttcggacatgactgtgacagtccagtttaccaatcccctgaaggagacgctacgaaatgtctgggtgcatctagatggacccggcgtcactcgacctatgaagaagatgttccgtgagatccgccctaattcaacggtccagtgggaagaggtttgccggccatgggtcagtggccacagaaagctgatcgccagtatgtctagtgattccctccggcatgtctacggggagttggacgtacagatccagcgacgacccagcatg

SEQ ID NO: 9545 - DNA, 2196 bp, Artificial Sequence
  Description of Artificial Sequence: Synthetic coding sequence
atgtcggaaacatccaggaccgccttcggcggccgtcgcgccgtacctccaaacaactcaaacgctgctgaagatgacctccccaccgtggagctgcagggagtggtgcctaggggggtgaacttgcaggaatttttgaatgtgacatctgtacacctgtttaaagaaagatgggatacaaataaggttgatcaccacacagacaaatatgagaataataaactaatagtccgccgcggacagtcattctatgtacagattgatttctcccggccttacgatccaagacgcgatctgtttcgtgtagaatacgttattggacgctaccctcaagagaataaagggacgtacataccagtaccaatcgtgtcagaactccagtccggaaagtggggggctaaaatcgtgatgcgggaggatcggtcggtgaggctgagcattcaatcctctcccaagtgcatagtggggaagttcaggatgtatgttgccgtgtggacaccatatggagtcttgcgcacaagccggaatcccgagaccgacacttacatcctgttcaacccttggtgcgaagacgacgcagtctaccttgacaacgaaaaagagcgagaagaatacgtactgaacgatatcggggtcatattttacggagaagtgaacgacatcaagaccaggagctggtcctatggccagttcgaggacggtattctggatacctgtctgtacgtcatggaccgcgcccagatggatttgtctggaagaggtaacccaattaaggtgagtcgtgtgggctcagcaatggtgaatgctaaagatgacgagggcgtgctagtcgggtcttgggacaacatatatgcctacggagtcccaccgtctgcatggaccggcagcgtggatatcctgctggagtatcgttcttcagagaatcctgttcgatacggacagtgttgggtcttcgccggcgttttcaatacgtttcttagatgcctgggtattccagctcgcatcgtgacaaattacttcagtgctcacgacaatgatgccaatctccagatggacatctttctggaagaggatggcaacgtgaatagcaagcttacaaaggactctgtgtggaactatcactgctggaacgaggcttggatgaccaggcctgatctgcctgtgggattcggaggctggcaggcagtagattcaacgcctcaagaaaatagtgacgggatgtaccgttgtgggcccgcgagcgtacaagcaatcaagcacggccatgtgtgttttcagttcgatgctcccttcgtgttcgctgaagtgaattccgacctgatttatataacagctaagaaagatggcacccacgtggtggagaatgtggacgctacccatataggcaaattgatcgtgacaaagcaaattggtggggacggaatgatggacatcaccgatacctataagtttcaggagggccaagaggaggaacgcttggcactcgaaacggccctcatgtacggggcgaagaagcccttgaatactgagggagtgatgaaatctcgctcaaacgtcgatatggacttcgaggtggagaatgcggtgctgggcaaggactttaagctatctattactttccggaacaactctcataacaggtacaccatcacggcatacttgagtgcaaatataacgttttatacaggagtgcctaaggcggagttcaagaaggaaaccttcgacgttacactcgaaccactgtccttcaaaaaggaagcggtgctgattcaggctggggagtacatgggccagctgctagagcaagcatccctgcatttttttgttacagctcggatcaacgagacacgcgacgtgttggccaagcagaaatcaactgttctgacaatcccagagataattatcaaggtgcgaggcacccaagtagtcggaagcgacatgacagtgactgtacaatttactaacccgctgaaggagacactgcggaacgtgtgggtgcatctcgatgggccaggcgtaaccagacccatgaagaagatgtttagggagatccggccaaacagcacggtacaatgggaggaggtttgccgaccgtgggtcagcggccaccgtaagctgattgccagtatgtccagtgacagtcttcgccacgtctacggggagctggatgtgcagattcagaggcggccctcgatg

SEQ ID NO: 9546 - DNA, 2196 bp, Artificial Sequence
  Description of Artificial Sequence: Synthetic coding sequence
atgagcgaaacttcaaggaccgcctttggcggaagaagggccgtccccccaaataactcaaatgctgctgaggatgatctgcccaccgtggagcttcagggtgttgtgccacgcggggtcaacctccaggaatttctcaacgtgacgtcagtgcacctgtttaaagaaagatgggacaccaacaaagttgaccatcacaccgataagtacgaaaacaacaaactgatcgttaggcggggacaaagcttttatgtgcagatcgatttttctagaccatacgatccaagacgagatctcttccgcgtggaatacgttatagggagataccctcaggagaataaaggaacatacatcccagtgcccatagtttcagaactgcagtctggaaaatggggcgctaaaatcgtcatgagagaggatcggagtgtgcggctgagcatccagtccagccccaaatgtatagtggggaagtttcgcatgtacgtcgcggtctggactccttacggcgtcctgagaacatcgcgaaatcctgagactgacacctacatcctctttaacccctggtgcgaggatgacgctgtctaccttgacaatgaaaaggagagggaggaatacgtactgaacgacatcggcgtcatcttctacggcgaagtcaacgatatcaagacgagatcttggagctacgggcaatttgaagacggtatcctggatacttgcctgtatgtgatggatagggcacaaatggatctgagcggtcgcggaaacccaataaaggtgagtagagtcggctcagccatggtgaatgctaaagacgacgagggggtgctggtgggaagttgggacaacatttatgcttatggggtacctccttcagcttggacgggcagcgtcgatattctgctggagtacaggagctctgagaaccccgtgaggtacggccagtgctgggtattcgccggcgtgttcaacactttcctgcgatgcttggggatacccgcaagaatcgtgacgaattatttttctgcgcacgacaacgacgccaacttgcagatggatatcttccttgaagaagacggcaatgtgaatagcaagctgaccaaagactctgtatggaactatcattgttggaatgaggcttggatgactaggccagaccttccagttggtttcggcggttggcaggcagttgatagcacaccacaagaaaactctgacggcatgtaccggtgcggaccagcatccgtacaagcgatcaagcacggtcacgtatgctttcagttcgacgcccctttcgtgttcgcagaagtgaacagtgacttgatttatatcactgcaaaaaaggatggcacccacgttgtggaaaacgtcgatgctacccatatcggaaagctgatagtcactaaacagatcggaggagatgggatgatggatattacagacacatacaagttccaggaaggacaggaggaagagcgcctggccctggaaaccgcacttatgtacggagctaaaaagccgctgaacactgagggcgtcatgaaatctagaagcaacgttgatatggatttcgaggttgaaaacgctgtgcttgggaaggactttaagctgagcatcacttttagaaataactcccacaataggtatactataaccgcttacctttcggccaatatcaccttctatacaggggttcctaaggctgaatttaaaaaagaaacctttgacgtgaccctggagccattatcatttaaaaaggaagccgtgctgatacaggcgggggagtacatgggacaactcctggagcaggctagcctgcactttttcgtgactgcacgcatcaacgagacaagagacgtgctggctaagcagaagtctaccgttctgaccatccctgaaattatcatcaaagttcgcggaactcaggtcgtgggatctgacatgacggtcaccgtccagtttacaaatcctctgaaagagacattgcgcaacgtgtgggtccatctcgacggacctggggtcactcgccctatgaaaaaaatgttcagggagatcagacctaatagtaccgtgcagtgggaggaagtctgccggccttgggtatcaggccataggaagctgatcgcctctatgagtagcgattctctgagacacgtgtacggggaacttgacgttcaaattcaacgaagaccgtctatg

SEQ ID NO: 9547 - DNA, 2196 bp, Artificial Sequence
  Description of Artificial Sequence: Synthetic coding sequence
atgagtgaaacatccagaacagcttttggtggcagacgcgctgtgccccccaacaactctaatgcggcagaggacgatctgcctacagtggagttacaaggagtcgtgccaaggggtgtgaacctacaggagttcttgaatgtgacctcagtgcacctgttcaaggaacggtgggacaccaacaaagtagatcaccacactgacaaatacgaaaataacaaattgatagtaaggaggggccaaagcttctatgtgcagattgacttttctcgaccctacgatcctaggagggatctgttccgcgtagagtatgtcatcgggagatatccccaggagaataagggcacatacattcctgttcccattgtgagcgagttacaatctggaaagtggggggccaagatcgtgatgcgtgaagacagaagcgtgcgactaagcatccagagctctcccaagtgcatcgtggggaagtttcgaatgtatgttgcagtgtggaccccttacggcgtgctccgcacatctaggaacccggagaccgatacatatatcctctttaatccctggtgtgaggacgacgccgtttacctcgacaacgaaaaagaaagggaagagtacgttctcaatgatattggagtgattttctacggggaagtcaacgacatcaagacccgtagttggagctacggccaatttgaggatggtatcctcgatacctgcctgtatgtaatggaccgcgcacaaatggaccttagcggccgtggcaacccaatcaaagtttcgcgcgtcggcagcgccatggttaatgcaaaggatgacgagggtgttctggtgggcagttgggacaatatatatgcttacggggtacccccttccgcctggacaggcagcgtcgacatcctcttagagtatcgctcatccgaaaaccctgtcagatacggacagtgttgggtgttcgctggagttttcaatacttttctgaggtgtctggggatccccgctagaattgttacaaattattttagcgcccacgacaacgacgcaaacttgcagatggacatctttctagaagaagacgggaacgtgaatagcaagctgaccaaagacagcgtgtggaattaccactgctggaacgaggcatggatgactcgaccggatcttccagtgggatttggcgggtggcaggctgtggactctacacctcaggaaaattccgatggcatgtatcggtgcgggccagcttctgtgcaagcgattaagcacggccacgtctgttttcaattcgatgctcccttcgtattcgctgaggtgaatagtgacttgatctacattaccgccaagaaggatggcacccacgttgtggagaatgtggacgcaactcacattggcaaactaattgtgaccaagcagattggcggcgatggaatgatggacatcactgatacttataagtttcaggaaggccaggaggaagagagactggctctagagactgcactgatgtacggagctaagaaacccctgaatactgagggggtgatgaagtcaaggtcgaacgtggatatggactttgaagtggaaaacgcagtactcgggaaggatttcaaactgagtataaccttcaggaacaatagccacaatagatatactataacagcttacctgagcgcaaatataacattctataccggagtcccgaaagcagaattcaaaaaggagaccttcgacgtgacattggagcccctgtctttcaaaaaagaagcagtccttatacaagccggcgaatacatggggcagttgctggaacaggcctctttgcatttttttgtcaccgctagaataaacgaaacgagagatgtgttggcaaagcaaaagtcgactgtgctcacaattcccgagataattatcaaggtgcgcgggacacaagttgtaggaagtgacatgactgtgacggtacagttcaccaaccctttaaaggaaacactgcgcaacgtctgggtgcatctggacggacccggggttacccgaccaatgaagaagatgttcagggagatcaggcctaattcaacagtgcagtgggaggaagtgtgtcgaccttgggtttccggacatcggaagctgattgcctcgatgagttccgacagcctgcggcacgtgtacggggaactggatgtacaaatccaacggcgaccatcgatg

SEQ ID NO: 9548 - DNA, 2196 bp, Artificial Sequence
  Description of Artificial Sequence: Synthetic coding sequence
atgtccgagacaagtcgcaccgcctttggcggtcgcagggcagtgccacctaataactcaaacgccgcggaagacgatctgcccacagtggaactccaaggcgtcgtccctagaggtgtgaaccttcaggagtttctgaacgtgacctccgtccacttgtttaaagagagatgggacaccaacaaagtcgatcaccatacggataagtacgaaaataataagctgattgtcaggagaggtcagtccttctacgtccagatcgacttctcccgtccctacgacccacgtagggatttattcagggtagagtacgtaatcggtcgatatccccaggaaaataagggaacatatatccctgtccccatcgtgtccgaactgcagtccggaaaatggggagctaaaattgtgatgcgagaggacagatctgtgagactgtccattcagtctagtccaaagtgcatcgttgggaagttccgaatgtacgttgccgtatggacaccatacggagtactgagaaccagcagaaatccagagactgacacctatatcctgttcaatccgtggtgcgaagatgacgcggtgtaccttgataatgagaaagaaagagaggagtatgtgctgaatgatataggagtcatattctatggggaagtcaacgacatcaaaactcgatcttggtcttacggtcagtttgaggatgggatactcgatacctgtctgtatgtaatggaccgagcacaaatggatctgtctggaagggggaacccgatcaaggtctcccgagtgggctctgctatggtgaacgccaaagatgacgaaggcgttctggttggctcctgggacaacatctacgcttacggcgtgcctccgagcgcctggacaggatccgtggatattctgctcgagtaccgatccagtgaaaaccccgtgaggtatgggcaatgctgggtgttcgcaggtgtcttcaatactttcctgaggtgcctgggcatcccggctaggatcgtcaccaactacttcagcgcccatgacaacgatgccaatctccaaatggacatcttccttgaggaagatgggaacgtaaattctaagcttacaaaggattccgtctggaactaccactgctggaatgaggcatggatgactcgtcccgatctacctgtggggttcgggggttggcaggccgtcgactcgacgccgcaagagaatagtgacgggatgtatcgatgcggcccggcctctgtgcaggcaatcaagcatggccacgtatgcttccagtttgacgcccccttcgtgttcgctgaggtgaactccgatctcatctacattaccgccaaaaaggacggcacacacgttgtcgaaaatgtagacgccacacatataggtaaactaattgtgactaagcagattggcggtgatgggatgatggacatcaccgatacatacaaatttcaggagggccaggaggaagaaaggctggccctggaaacagccctcatgtacggtgccaagaaaccgctgaacactgaaggcgtgatgaagagcagaagtaatgtcgatatggattttgaggtggaaaacgcagtgttgggtaaggattttaagctgtctatcacttttcgaaataatagccataatcgctacacgatcacagcgtatctttcagcgaacatcacattttacactggtgttcccaaagctgagttcaagaaggagacctttgatgtgactttggagccactatctttcaagaaggaggccgtgctgatccaagctggagaatacatgggccaattactggaacaggcaagcttgcatttctttgtgactgctcgtatcaatgaaaccagggatgtgctggccaagcagaaatccaccgtcctgaccatccctgagatcatcatcaaagttcgaggaacccaagtcgtcggctcagatatgacagtgactgtacaattcacaaatcccctgaaagaaacactgaggaacgtgtgggtgcatttggatggccccggcgtgaccaggccaatgaaaaagatgtttagggagataagacccaattcaaccgtccagtgggaggaagtttgtcgaccttgggtgtctggccaccgtaagctgatcgcctcaatgtcatccgactcactgagacatgtatacggtgaactcgacgtgcagatacagcgaagaccatcaatg

SEQ ID NO: 9549 - DNA, 2196 bp, Artificial Sequence
  Description of Artificial Sequence: Synthetic coding sequence
atgtctgaaacttctcggacagccttcggtggtcggcgagcagtgcctcctaacaatagcaatgctgcagaagacgatctgcctaccgtggaactccagggcgtggtgccccgcggcgttaacttgcaggaattcctcaatgtgaccagtgtgcacctgttcaaggaaagatgggacacgaataaggtggatcatcacacagataagtacgaaaacaacaagctgattgtgaggcgcggacagtcattctatgtgcagatcgactttagtcgaccctacgaccccaggcgggacctgtttcgggtcgaatatgtgattgggcgatacccacaggaaaataaagggacttacataccagtcccaattgtgtccgagctgcagtccggaaagtggggagccaagatcgtgatgcgagaagaccggtctgttagactttcgatacagtcgtctccaaagtgcatcgtggggaaattcagaatgtacgtggcagtttggacgccgtatggcgttctgcggacgagtagaaaccccgagaccgatacgtacatcttgtttaatccatggtgcgaagatgacgctgtgtacttagataacgagaaagagcgggaggagtacgtcttgaatgatattggggtaatcttttacggcgaggtaaatgacatcaaaacgaggagttggtcatatggacagttcgaggacgggatcttggatacctgcctgtacgtgatggatcgcgcacagatggacttgagtggtcgcggtaaccccatcaaagtgtctcgcgttggttctgctatggtgaacgcaaaggacgacgaaggcgtgcttgtaggatcctgggacaacatttacgcttatggcgttccacctagcgcatggacagggagtgtagacatcctcctcgaataccgctccagcgagaatcccgtcaggtacggccagtgttgggtttttgcaggggtgtttaacacattcctaagatgtctggggatccccgcccgaattgtgacaaattacttcagcgcacacgacaatgacgccaacctccaaatggatattttcctcgaggaagatgggaatgttaacagtaaacttaccaaggactccgtgtggaactaccactgttggaatgaggcctggatgacaaggcccgacctgccagtgggttttggaggatggcaagccgttgactccactccccaggaaaactcagacggaatgtatcgatgtggacctgcgtccgtgcaggcaattaaacatggacatgtctgttttcagtttgacgcaccgttcgtttttgccgaagttaactccgaccttatctacattacggccaagaaggatgggactcacgtcgtggaaaatgtggatgcaacccacattggtaagttgatcgttaccaagcagataggaggtgatggcatgatggatatcaccgatacatataagttccaagaaggtcaggaggaggaacggctggctctggaaacggccctaatgtacggagccaagaaaccgttgaatacagagggcgtgatgaaaagccgatctaacgtggacatggactttgaggtggagaacgctgtcttggggaaggactttaaactgagcattacattcagaaacaactctcataacaggtacactattactgcctatttaagcgcaaatattacattctatacaggggtgccgaaggccgaattcaaaaaggaaacattcgatgtgacactggagcccctgtcatttaagaaggaagcagtactgattcaagctggagagtatatgggtcaattactggagcaagcatctttgcattttttcgtgacagcaaggatcaacgagactagagacgtcttagcgaaacagaaatccactgtcttaaccatcccagaaattattatcaaggtgagaggcacccaagtggtgggcagcgatatgactgtgactgtgcaattcacaaacccacttaaggaaaccctaaggaacgtgtgggtacacctggatggcccaggagtgacgcgcccaatgaaaaaaatgtttcgggaaatccgtcctaactcaacagtccaatgggaggaggtgtgcagaccttgggtctctggccatcggaagctcatagcctctatgagctctgatagtttacggcacgtttacggtgaacttgatgtccagattcagcggcggccctccatg

SEQ ID NO: 9550 - DNA, 2196 bp, Artificial Sequence
  Description of Artificial Sequence: Synthetic coding sequence
atgtctgagacttctaggacagcctttggtggcagaagggcagttccccccaataatagcaacgccgctgaggacgatctgccaacagtggaattgcagggcgtggtgccgcgaggagtgaacctgcaggaatttctgaacgtgacatccgtccatctgtttaaggagagatgggacacaaacaaagtggaccaccatactgataagtacgagaacaacaagttgattgtccgccgcgggcagagtttttatgtccagatcgacttttctaggccctacgacccaaggcgggacctgtttcgggtggaatatgtgatcggacggtacccccaagagaacaaggggacgtacatccctgttcctatagtctctgagttgcagtcgggtaaatggggggctaaaatagtgatgcgggaagatcgcagcgtgaggctaagcatccagtcctcaccaaagtgcatcgtgggaaagtttcgaatgtacgtggcagtctggacgccctacggggttctccgtaccagtagaaaccccgagacagatacttatatcttgttcaacccgtggtgcgaagacgatgccgtttatttagacaatgagaaggagcgagaagaatacgttcttaacgacataggcgttattttctacggcgaggtgaacgacataaagactaggtcctggagttacggccagtttgaggacggcatactggacacctgtttgtatgtcatggatcgggcacagatggacttgtccggcagaggaaacccaatcaaggtatctcgggtcggcagcgccatggtgaacgctaaagacgacgagggcgtgctcgtcggcagctgggataatatctacgcttacggggtacccccgtctgcttggacagggagtgtggacatcctgcttgagtatcgctcaagcgaaaaccctgttagatatgggcagtgctgggtcttcgcaggagtgttcaatacgttcctgagatgccttggaattccagcccgcatcgtcacaaattacttttccgctcacgacaatgacgctaatttgcagatggacattttcctggaggaggacggaaatgtcaattccaagctgaccaaggactcagtgtggaattaccactgctggaatgaggcctggatgacaaggcccgatctgccagttggatttggcggctggcaggccgtggactccaccccccaagagaattccgacggcatgtatcgctgcggaccagcctctgtgcaggctatcaaacatggacatgtgtgcttccagtttgacgcaccgtttgtttttgccgaagtcaactctgacttgatttatatcacggccaaaaaagatggcacccatgttgttgaaaatgtggacgccacgcatatcggcaaattaatcgtcaccaaacagattggaggagacggcatgatggacatcaccgacacttataaattccaggagggacaggaagaagagcgcctcgctctcgagaccgctttgatgtatggagccaagaaacctctgaataccgagggggtaatgaagtcaaggagtaatgtagatatggattttgaggttgaaaatgctgtgctgggtaaggacttcaagctctccatcacatttcgaaacaactcccacaatagatataccattaccgcctatcttagcgcaaatatcaccttttatacgggcgtgcccaaggctgagtttaagaaggagacttttgatgtcactctggagcccttatctttcaaaaaagaagccgtcctgattcaggctggcgaatatatggggcagctactcgagcaggcctccctccacttcttcgtgacagcccgtataaatgagactcgcgacgtgttggctaaacagaagtccacagtcttgacaattccggagataattatcaaggtccgcggcacccaggttgtgggctccgacatgactgtcacagtgcagttcacgaaccctctcaaagagacactgcggaacgtgtgggtgcaccttgatgggcccggcgtcacccgcccaatgaagaaaatgttcagagaaattaggcctaatagtaccgttcagtgggaagaagtgtgtcggccttgggtgtctgggcatcgcaaactcattgcctcaatgtcctcagatagcttgcggcacgtctacggcgagctggatgtgcaaatccagagacgcccaagtatg

SEQ ID NO: 9551 - DNA, 2196 bp, Artificial Sequence
  Description of Artificial Sequence: Synthetic coding sequence
atgtccgaaacatcccgcacggcttttggcgggaggcgagccgtccctcctaataactcaaacgccgccgaagacgatctcccaaccgttgagctgcagggtgttgtgccccgcggcgtgaacctgcaagagtttctgaatgtgaccagtgtgcacctgtttaaggagcggtgggacaccaataaggtggaccatcacactgataaatacgaaaacaataaacttatcgtccggcgcggtcagtcattttacgtacaaattgacttttctaggccgtacgatccacgcagagacttgttcagagtggagtatgtgattggacgctacccccaagagaacaaaggcacatacatcccagtgcccatcgtatcagagctccagagcgggaagtggggagcaaagatcgtgatgagagaggatagatcggttcgtctctccatccaaagttctcccaagtgtatagtgggcaaattcagaatgtacgtggcggtctggaccccctatggggtcctccgaacgagtaggaaccccgagacagacacttacattctgttcaacccctggtgtgaggatgacgccgtgtacttggacaatgaaaaggagcgggaggagtacgtactgaatgacattggcgtgatcttctacggagaagttaatgacatcaagacgcgttcttggagctatgggcagtttgaggacggcattttggatacttgcttgtatgtgatggacagggcccaaatggatctttcaggcaggggtaacccaatcaaagtcagtcgcgtcggatctgcaatggtaaatgccaaagacgatgagggtgtgcttgtgggcagttgggataatatctatgcttatggcgtgcccccaagcgcatggacagggagtgttgatatacttctggagtatcgctcaagcgagaacccagtccggtacgggcaatgttgggtattcgcgggcgtgtttaacacctttctgcgctgcctaggtataccagcacggatcgttaccaattatttttcagcacatgataatgatgccaacctgcaaatggatatctttctcgaagaagacgggaacgtcaattccaaactgactaaggactccgtatggaattaccattgctggaatgaggcatggatgactcgccctgatctgcctgtgggctttggcgggtggcaagcagtggactcaactccccaggaaaacagcgacggtatgtataggtgtggcccagcctccgtgcaggctatcaagcatggtcacgtgtgctttcagtttgacgctcccttcgtgtttgcagaggtaaacagtgatctgatctacatcactgctaagaaagatgggacacacgtggtggaaaacgtggacgccactcacatcggcaagctgatagtgaccaagcagattggcggggacggcatgatggacataactgacacatacaagttccaggaagggcaagaggaagagcggctggctcttgagaccgcactgatgtacggtgcgaagaagccgttaaatacagaaggggtcatgaagtctcgtagcaacgttgatatggattttgaagtagagaacgcagtgctcgggaaagacttcaaactcagcattacattccgcaataattcccacaataggtacactattacagcctacctgtcagctaacatcacattttacaccggcgttcccaaggctgaatttaaaaaggagacttttgatgtaacattggaaccattgtccttcaaaaaagaggctgtgttgattcaagctggtgagtacatggggcagctcctggagcaagcttccctacattttttcgtcaccgcccgcataaatgagaccagggatgtgctcgcaaagcagaaaagtacggtcctcaccatacccgagatcataataaaagtgagaggcacccaagtggtcggcagtgatatgaccgtgacggttcagttcaccaaccccttaaaagagacacttcggaacgtttgggtgcacctcgacggcccaggagtgacccggcctatgaaaaagatgtttcgagaaatacgtccaaacagtaccgtgcagtgggaggaggtgtgtagaccttgggtaagtggacatcggaagctgatagcatccatgtcctccgactctctgagacacgtgtacggcgagctggatgttcagattcagcggcggcccagcatg

SEQ ID NO: 9552 - DNA, 2196 bp, Artificial Sequence
  Description of Artificial Sequence: Synthetic coding sequence
atgagcgaaacctccagaactgcattcggagggagacgcgcagttccaccaaacaatagtaacgcggccgaggacgatcttcctacagttgaacttcaaggagtggtgccacgtggggttaacttgcaagaatttcttaacgtcacgagtgtacacctgtttaaagagcgatgggacaccaacaaggttgatcatcatacggataaatatgagaataacaaattgattgttagacgaggacagtcattctacgtccaaatcgacttttctagaccctacgatccgcgacgagatctgtttagggttgagtacgtaattggtcgttacccacaggaaaataaaggaacatatattcctgtccccatcgtgtccgaacttcaatcgggtaagtggggcgccaagattgtgatgcgggaggatcgttcagtgagattatcgatccaaagcagccctaaatgcattgtaggaaagttccgaatgtacgtagcggtttggacaccttatggtgttttacgtacttctagaaacccagagacagatacatatattttatttaatccatggtgtgaggatgacgccgtgtatctggacaatgagaaagaacgggaagaatatgtcctcaatgatattggagttatattctatggtgaagttaacgatattaagacccgttcatggtcttatggccagtttgaagacggaattttggatacatgtctgtacgtcatggacagagctcaaatggatttaagcggacggggtaatccaattaaagtatcacgagttggttctgctatggttaacgcaaaagacgatgaaggcgttctggttggatcatgggataatatttatgcttatggagttccacctagtgcgtggacaggaagcgtggatatcttgttggaatacagatcttcagagaacccagttcggtacggacaatgttgggtcttcgctggagtatttaacacgtttttgcgctgcttgggaattccggcacgaatcgttacgaattatttttccgcccatgataatgacgcaaaccttcagatggacattttcttggaggaagacggaaacgttaactccaaattaacaaaggattcagtgtggaattaccactgctggaatgaagcgtggatgacccgtccagatctaccagtgggattcggaggctggcaggcagtcgactcaacgccacaagagaactctgatggaatgtatcgttgtggaccagctagtgtccaggccataaagcatggacatgtttgcttccaatttgacgcgcccttcgtgtttgccgaagtgaattcagatttgatttatattacggctaaaaaagacggaactcacgtagttgagaatgtcgatgctacacatatcggaaagttgatcgttactaagcagattggtggcgacgggatgatggatataacagatacttataagtttcaagaaggacaggaagaagaaagattggcgcttgaaacagcactaatgtacggagctaaaaagcccttgaacacggagggagtcatgaaaagccggagtaatgtagatatggatttcgaggttgaaaatgctgtactaggtaaagatttcaaactcagtattacctttcggaataattcacataaccggtatacgattacagcgtacttgtcggcaaacattacattctatacaggagtccccaaggcagagtttaagaaagagacttttgatgtaactcttgaaccactatcgttcaaaaaagaagctgtattgattcaggctggagagtatatgggtcaattgctagaacaagcgtctctccatttctttgtcacggctcgaatcaacgagacacgagacgttctcgcaaagcagaagagcactgttctcaccatcccggagatcataattaaagtacgtggaacgcaagttgtcggatccgacatgactgtaacagttcagttcactaacccactgaaagaaactttgcgcaacgtctgggttcaccttgatggaccaggagtcacaagaccaatgaaaaagatgtttagagaaattagacctaattcaactgtacaatgggaagaggtttgtagaccatgggtgtctggacatcgcaagctaattgctagtatgtcttccgattcactacgccatgtatatggtgagctcgatgtacaaatacaacgtcgaccatcgatg

SEQ ID NO: 9553 - DNA, 2196 bp, Artificial Sequence
  Description of Artificial Sequence: Synthetic coding sequence
atgagtgagacttctcgcacagccttcggcggccgtagggcagtacctccaaacaacagcaatgcggcagaggacgatttgcccactgtggaattgcagggagtcgttccgcgaggtgttaacctgcaggaatttctgaacgtcacgtctgtgcatctctttaaagagaggtgggataccaataaagtagatcatcataccgacaaatatgagaacaacaagctcattgttaggagaggtcaaagcttttatgtgcagatagacttttcacggccgtacgatcccaggagggatctgtttcgagtcgagtacgtcatcgggcggtacccccaggagaacaaaggcacttacatccctgttcccattgtgtctgagctgcaaagcggtaagtggggggccaagatcgtgatgcgagaagatcgtagcgttagactgagtatccagagctcgcccaaatgcatcgttgggaagtttagaatgtacgtggctgtttggacgccctatggagtgctcaggacttccaggaaccccgagacagatacttacatcctcttcaatccatggtgtgaggatgacgctgtgtatctggacaacgagaaggagcgcgaggagtacgttctgaacgatataggtgtaatcttttacggagaagtgaatgacattaaaactagatcatggtcctatggccagttcgaagatggaatactggatacttgtttgtacgttatggacagagcgcagatggacttgagcggaagaggtaatcccatcaaggtgtcacgcgttggcagtgcaatggtcaacgctaaggacgacgaaggagtgttagtcggctcctgggacaacatctacgcctatggtgtgcctcctagcgcgtggaccggaagcgtggatatcctattggaataccggagctcagagaaccctgtaaggtatggacagtgttgggttttcgctggagtgttcaacacattcctgcggtgtctgggaatccccgctcgcattgttaccaactacttcagtgctcacgacaacgatgcaaatctgcagatggatatcttcctggaggaggacggcaatgtgaatagcaaattgaccaaagatagtgtctggaattaccattgttggaacgaggcttggatgacgcgtccagacctgcccgttggatttgggggctggcaggctgtcgattctaccccacaggaaaacagcgacggaatgtacagatgcggccctgcctccgtccaggctattaagcatggacacgtatgcttccagttcgacgctcccttcgtcttcgccgaagtgaattccgatctcatttacattactgcgaaaaaggatggcacccatgtcgtcgaaaatgtggatgcgacccatatcggcaagctgatcgtgaccaaacaaattgggggagatggcatgatggacataaccgatacttacaagttccaggaggggcaagaggaggagcgtctagctttggagactgcactcatgtatggggcaaagaagcccctgaataccgaaggcgtgatgaagagccggagcaatgtggacatggacttcgaagtcgagaacgcagtgctcggcaaagatttcaaactgtctatcacattccggaacaactcccacaaccgatatactataactgcttacctgtccgccaacatcactttttacacaggcgtacccaaggccgagttcaaaaaagaaactttcgatgtgaccttagagccattgtcatttaaaaaagaagcggtactgatccaggccggcgagtatatgggccagcttttggagcaggctagcctccactttttcgtaaccgcacgcattaacgagaccagagacgtgctcgccaagcagaagtcaacagtgctcaccatacccgaaattataatcaaggtgcggggtacacaggttgttgggtctgacatgacagtgactgtacagtttactaatcccttgaaggagaccctgaggaacgtgtgggtccatctagacggaccaggcgtaacgcgtcccatgaaaaaaatgtttcgtgaaattcgaccaaacagcaccgtgcagtgggaggaggtgtgccgaccatgggtgagcggtcatcgaaagctgatcgcctccatgtcctctgactcactgagacacgtgtacggtgagctggatgtgcagatccaaagacgaccctccatg

SEQ ID NO: 9554 - DNA, 2196 bp, Artificial Sequence
  Description of Artificial Sequence: Synthetic coding sequence
atgtccgagaccagccgtactgcctttggaggtaggcgcgccgtgccacccaataacagtaatgcagcggaggatgatctccccacagtggagcttcagggagtggtgcctagaggtgtcaaccttcaggagttcttgaatgtgacatcagtgcacttatttaaggagcgttgggacaccaataaggtggatcaccacactgataaatatgagaataataagctcatcgtgaggagaggccagtccttttacgtgcagatcgatttctcaagaccctacgatccccggagagacctctttcgcgtcgagtatgtgattggccgataccctcaggaaaataaaggcacctatatccctgtgcctattgtctccgagctccagtctggaaagtggggcgccaaaattgtgatgagagaggacagaagtgtaaggctctcaattcagtcctcaccaaagtgcattgtcggaaaattccggatgtacgtggctgtgtggacaccatatggagtcctcaggacatccagaaaccctgagactgatacctatatcttgtttaatccatggtgcgaagacgacgctgtttacctggataatgaaaaagagcgcgaagagtatgtactgaacgacataggagtgattttttacggcgaagtcaacgatattaagacccggtcgtggtcctacggccagtttgaagacggaatcctggacacctgtctgtatgttatggatcgggcgcagatggacctgtcaggtcggggcaatcctattaaggtgtctagagtgggaagtgctatggtcaacgcaaaagatgacgagggcgtgttagtggggagctgggataatatctacgcctacggtgtgcctccgtccgcttggacgggttccgtggatatattgctcgagtaccggtcatcagaaaatccagtccgctacggacagtgttgggtgttcgctggggtgttcaacacatttctccgttgtctgggtatccccgccagaattgttactaattacttcagcgctcatgacaacgacgccaatctgcagatggatatttttctagaggaggacggcaacgtgaactcaaagctgacaaaagattccgtgtggaattatcactgctggaatgaagcctggatgactcgccccgacctccccgtcggctttggcgggtggcaggctgtggacagtaccccccaggagaactctgacggaatgtatagatgcgggccagcttctgttcaggccatcaaacatggtcatgtgtgtttccaatttgacgctccgttcgtgtttgccgaagtgaattctgacttgatctacatcactgctaagaaggacggcacccatgtggtcgaaaacgtggacgccacccacattggaaagcttatcgtaactaaacagatcggcggggatggaatgatggatatcaccgacacctacaagttccaggaaggccaagaagaagagaggttggccctcgagaccgccctgatgtacggggcgaaaaaacctcttaacactgagggtgtcatgaaatcaaggtcaaacgtcgacatggattttgaggtagaaaacgctgtgctagggaaggactttaaactgtcaatcaccttcaggaataacagccataatcgctacacaataaccgcctacttgtctgccaatattaccttttacacgggtgtacctaaggccgagtttaagaaggaaacctttgacgtcacgttggagccgctttcttttaagaaggaagctgtgcttatccaggccggcgagtacatgggccaacttctcgaacaggctagcttacactttttcgttaccgctcggattaacgagaccagagatgtcttggccaagcaaaagtctacagtactgaccattcccgaaattataataaaggtccgcggtacgcaggtggtcgggagcgacatgacagtcaccgtccagtttactaatcctttgaaagaaaccctgaggaatgtgtgggtgcatctagacggccctggcgtcacccggcccatgaagaagatgttccgggagatccggccgaatagcactgtgcagtgggaagaagtgtgcagaccatgggtttctggccaccgaaagctgatagcctcaatgtcatccgattcccttcgccacgtctatggggaactggacgtccagattcagcgccgaccctcaatg

SEQ ID NO: 9555 - DNA, 2196 bp, Artificial Sequence
  Description of Artificial Sequence: Synthetic coding sequence
atgagcgagacttcgcgcaccgccttcggcggacggagggccgtcccgccgaacaattccaacgccgccgaggatgacctgccgaccgtggagctgcaaggagtcgttccacggggagtcaacctgcaggagttcctgaacgtcacctccgtgcacctcttcaaagaacgctgggacaccaataaggtggatcaccatactgataagtatgaaaataataaacttatcgtacgaagaggtcagtcattctacgttcagatcgacttctcgcgaccgtacgatccacgcagagatcttttcagggtggagtacgtaatcggacgctacccgcaagaaaataagggaacttacatcccagtccctatcgtctcggaactccaatccggtaagtggggtgccaaaatcgtgatgcgcgaggatcgctcggtcagactgtcgatccaatcttccccaaagtgcatcgtggggaagttccggatgtacgtggcagtctggaccccttacggcgtgctccggacgtcgaggaacccggaaactgacacgtacattctgttcaatccgtggtgtgaagatgacgcggtctacctggataatgagaaggaaagagaagagtacgtgctgaacgacatcggcgtgatcttttacggagaggtgaacgatattaagacccggtcatggtcatacggacaattcgaagatgggatcctcgacacctgcctgtacgtcatggaccgtgcacagatggacctgagcgggcgcggaaacccgatcaaggtgtcccgcgtgggttcagcaatggtgaacgcgaaagacgacgagggagtgctggtcggctcgtgggataatatctatgcgtacggagttccgcctagcgcctggactgggagtgtggacatcctgctcgaataccgctcgtccgaaaacccggtccgctacggccaatgttgggtttttgctggtgtgttcaacacttttctccgctgcctgggaattccagccagaatcgtgactaactacttctctgctcacgacaacgatgcgaacctgcaaatggatatttttctcgaagaggacggaaacgtgaatagcaaactgaccaaggactccgtgtggaattatcattgttggaacgaagcgtggatgacccgccccgatcttccagtgggattcggaggatggcaggctgtggactcgaccccgcaggaaaactcagatggaatgtacaggtgcgggcctgcaagcgtccaggcaatcaagcacggccatgtgtgcttccagttcgacgcccctttcgtgttcgcggaagtcaattcagacttgatttacatcaccgccaagaaggacggaacgcacgtcgtcgagaatgtggatgccactcatatcggcaagctcattgtgaccaagcaaatcggaggggacggaatgatggatatcaccgacacttacaagtttcaggaggggcaggaagaggagcggctggctctcgaaaccgctctgatgtacggagccaaaaagccactgaacactgaaggcgtgatgaagtcacggtccaacgtggacatggactttgaggtggagaatgcggtcctgggcaaagacttcaaactgtccatcaccttccgcaacaattcacacaaccgctacacgattactgcatacttgagcgctaacatcaccttttacactggagtccccaaagcggagttcaagaaggaaacttttgacgtgactctcgaaccgctctcgtttaagaaggaagccgtgttgatccaggccggcgaatacatgggacaactgctggaacaggcgtccctccacttcttcgtgactgcccggatcaatgaaactcgggacgtgctcgcaaaacagaagtccacggtgcttaccatccccgaaatcatcatcaaggtcagaggtacccaggtggtgggcagcgatatgaccgtgaccgtgcagttcaccaaccctctcaaggagactctgagaaacgtgtgggtgcatttggacggaccgggcgtgacccggccaatgaagaaaatgttcagagaaattcggcccaactcgactgtgcagtgggaggaggtctgccggccgtgggtttccgggcataggaaattgatcgcctcgatgagcagcgacagccttagacacgtctacggagagctggatgtgcagatacaacggcgaccttcgatg

SEQ ID NO: 9556 - DNA, 8832 bp, Artificial Sequence
  Description of Artificial Sequence: Synthetic coding sequence
atgacgcttcgcctccttgtggccgcactgtgtgccggaattctggcagaagcacctagagtgagagcccaacatagggaacgggtgacctgcactcgcctctatgccgcagatatagtgttcctcctcgacggctcgtcatcgattggccgctccaatttccgtgaagtcagatccttccttgagggacttgtccttcccttttcaggagcagcatcggcgcagggggtgcggtttgcaaccgtccagtactcagatgacccgaggactgaatttggcctggatgccctgggatcgggaggcgatgtcattcgcgcaattcgggaactctcgtacaaaggaggcaacacccgcactggcgcagcaattcttcacgtggcagatcatgtctttctccctcagctggcaaggcccggagtgccgaaggtctgtatactgatcaccgacggaaagtcgcaggatcttgtggacacggccgcccagcggctgaaaggacaaggcgtcaagctgtttgcggtggggattaagaacgctgaccctgaagaacttaagcgagtggcctcccaaccgaccagcgatttcttcttttttgtgaacgatttttccatcctgcgtacgctcctgcctcttgtgtcgaggagagtgtgtaccactgccggaggtgtccctgtgaccaggcctccagatgatagcacctcggcgcctcgcgaccttgtgctgagcgaaccttcctcccaaagcctgagagtgcaatggactgcagcatccgggcctgtgactggttacaaggtccagtatactcctcttaccggtcttggacagcctcttccatccgaacggcaggaagtcaatgtcccagccggagaaacgtccgtgcgccttagagggctccgccctctgaccgaataccaagtgactgtgattgcattgtacgcaaattccattggagaagctgtgtctggtactgcacggaccactgcgctggaaggccccgaactgactatccagaataccactgcacattcacttcttgtggcctggagatccgttccaggagccacgggttaccgagtcacgtggcgcgtgctgagcggagggcctactcaacagcaagaacttggacctggacagggatcagtgctgctccgtgaccttgaacctggaaccgattatgaagtgaccgtgtcgactctgtttggcaggagtgtcgggccagccacctcccttatggcgcgaactgatgcctctgttgaacagactcttaggcctgtcatccttggtcctacctcgattcttctgtcatggaaccttgtgccagaagctcgagggtacagactggaatggagacgcgaaaccggactggagccaccacagaaagtggtgctgccgagcgacgtcactcggtaccaactcgatggactccagccaggtactgagtaccggctgactctgtacactctcctcgagggacatgaagtcgcaaccccggcaacggttgtgccgacgggaccggagctgccagtgtcacccgtcaccgatcttcaggcaactgaactccctggacagcgcgtgagagtatcgtggtcgccagtccctggtgcaacccagtacaggatcattgtccgctcaactcaaggagtggagcgtaccctggtgttgccaggaagccaaactgcatttgacctcgatgatgtccaagcaggactgtcctacacggtgcgagtgagcgcacgcgtcggaccccgggaaggatcggcctcagtgctcaccgtgcgtagagagcccgaaacgccccttgccgtgcctggacttagagtggttgtgagcgacgcaacccgtgtgagagtggcatggggccctgtgcctggagcctcgggatttcggatctcgtggtcgactggtagcggacctgaatcctcgcaaactctgccaccagattcaaccgcaaccgacattactggacttcaacctggtaccacctaccaagtggcggtgtcggtgcttagaggccgggaagaggggccagcagctgtgattgtggccagaaccgatccacttggtcccgtccgcaccgtgcacgtcacccaagctagctcctcaagcgtcactattacctggaccagagtgcccggtgctaccggataccgtgtatcctggcattccgcacatgggccagagaagtcacagctcgtctctggagaggcaactgtcgctgaacttgatggtcttgaaccggacactgaatacactgtgcatgtaagagcacacgtcgctggcgtggatggtcccccagcatcagtggtggtccggactgcgcccgagccagtgggtagagtcagccgtctccagattttgaacgcatcgtcagacgtccttcgtataacctgggtgggggtgactggcgcaaccgcttaccgcctcgcctggggtagatcagaaggaggtcctatgcggcatcagattctgcccggaaatacggattcggcagaaatccgaggtcttgaggggggagtgtcatacagcgtccgagtgaccgcactggtgggggacagagaaggaaccccagtgtcgattgtggtgaccaccccacctgaagcgcctccagcactcggcaccctccatgtggtgcagagaggggaacactcactccgcctccgttgggagccagtccccagagcacaaggctttctgctgcactggcagcccgagggtggccaggaacagtcgcgagtgctgggtcccgagttgtcatcgtaccatcttgacggattggaacctgccacgcaataccgggtgagattgtcggtgctgggtccagcaggtgaaggtcccagcgccgaagttaccgctcggactgagagtccgcgcgtgccttccattgaacttagggtcgtggacaccagtattgattccgtcacccttgcgtggaccccagtttcgcgggcatcgtcgtacatcctgtcctggcgccccctccgcggcccaggtcaggaagtgcctggatcgccacaaactctcccgggtatttcgagctcccaacgggtgactggtcttgagcctggagtgtcatacattttctcactgaccccagtgcttgacggagtgaggggccctgaggcgagcgtcactcaaacccctgtgtgtcctagaggactggccgatgtggtctttcttcctcatgccacccaggacaacgcacatagagccgaggcaacgcgtcgggtgctcgagcggcttgtgttggcactgggaccattggggccacaagcagtgcaggtgggtttgctctcctactctcatagaccgagcccactgtttccactgaacggtagccacgatctcggtataatcctccagcgcatcagagatatgccgtacatggacccatccggtaacaaccttggaaccgcagttgtcactgcccaccgatacatgctggcaccagatgcgcctggacgccgtcaacacgtcccgggagtgatggtgcttctcgtggacgagccacttagaggcgacatcttttcacctatcagagaggcacaggcgagcggactgaacgtcgtgatgctggggatggcgggagccgatcctgaacaattgaggaggcttgcacctggaatggatagcgtacaaactttctttgcggtggatgatggtccaagcctggatcaagcagtctccggcctggcaaccgcactgtgtcaagcgagcttcaccacccaaccacgacccgaaccttgccctgtgtattgtcctaagggacagaagggggaaccaggtgaaatggggctgagaggacaagtggggccgcccggagatcccggcttgcccggtaggaccggtgcgccaggacctcagggacctcctggctcagcaactgccaagggggaaaggggttttcctggagccgatgggcgccccggtagtccgggtagagcaggaaacccgggaactcccggggcacccgggctcaaggggtccccgggtttgcctggaccaagaggcgaccctggggagcgcggtcctcgaggccctaaaggcgaacccggagcaccaggccaagtgattgggggcgaaggccctggactgcccggacgaaagggtgatccaggcccttcaggaccaccagggcctagaggcccgcttggagatcctggcccgagaggtcctcctggcctgccgggtactgcaatgaagggagataaaggtgatcggggtgaaagaggaccccctggccctggtgagggcggcatcgcacccggtgaacctgggctgcctggactgcccggaagtccaggtccgcagggccccgtcggcccgcctggtaagaaaggagaaaagggcgattccgaggacggagctccggggcttcccggacaacctggaagcccaggtgagcagggtcccagaggacctcccggtgctattgggccaaagggtgatagaggatttcctggtcctttgggtgaagctggagagaaaggcgagcgaggccctcccggcccagcggggtccagaggactgcccggggtggccggccgccccggagcaaaagggcctgaaggcccgccaggtcctactggccggcaaggagagaagggtgaaccagggaggcctggtgaccctgcagtcgtgggtcccgcagtggccggacccaaaggcgaaaagggagatgttggtcccgctggccctcgcggagcaaccggagtgcagggtgaaagaggacctccgggtttggtgctccccggcgaccctggtcctaagggtgaccctggggaccggggaccaattgggctgactggcagagcaggacctccgggcgattccgggccacccggagaaaagggcgacccaggtagaccagggcctccaggcccagtgggacctcgtggaagagatggtgaagttggtgaaaaaggagatgaaggtccgcctggggacccaggcttgccggggaaagctggcgaacgaggactccgtggagcacctggggtgcgaggtcctgtgggcgagaaaggtgaccaaggcgaccccggagaagatggacgcaatggttcgccgggatcatccgggcccaagggagataggggcgagccgggaccgcctggccctcctgggcggctcgtcgatactgggcccggcgcaagagaaaaaggagaacctggtgacagaggacaagaaggacctcgaggacctaagggagatccagggctgcccggcgcgcctggagaacgcggtatagagggatttagagggccgcctggaccccaaggagatcctggagtacggggtcccgcaggcgaaaaaggggaccggggtcccccaggattggatggccggagcggtcttgatggaaaacctggggcagccggaccatccgggcctaacggtgcagcaggaaaggctggtgacccgggtcgtgacggactccctggtctgcggggcgaacaaggcctccctggaccttcaggtcctccaggattgcctggcaagccaggtgaggatggtaagcccggactgaatggtaaaaacggtgaaccgggtgacccaggggaggacggacgaaagggggagaagggcgatagcggtgcgtcgggtagggaaggccgggatggaccaaaaggtgaaaggggtgcaccgggaatcctcgggcctcaaggtccgcctgggctgcccggaccagtgggccctccaggacagggttttcctggagtgcccggtggaaccggtccaaagggcgacagaggtgagactggaagcaaaggggaacaaggactccccggtgagcggggacttcgcggagagcctggtagcgtgcctaacgtcgacaggctgcttgaaactgcaggaatcaaggcatcagcgttgcgggagattgtggaaacctgggatgaatcatcggggagcttcctgccagtgccagagaggcggcggggtcctaaaggtgatagcggcgagcagggtcctccgggtaaggaaggccctattggtttcccaggggaaagaggacttaagggggaccgaggtgatccggggccccaaggcccacccggcctggccctgggggagaggggccctcccgggccttcgggtctggcaggtgaacccggtaaaccaggtatccctggcctgccagggcgagccggaggtgtgggagaggcaggacgacccggcgaacggggagaacgaggggagaaaggggaacgaggtgagcagggaagggacggaccccctgggctgccgggcacccctggtccaccgggcccaccaggtccgaaggtgtcagtggacgaacctggtccaggactctctggcgagcagggccctcctggtcttaagggcgctaaaggtgaacccggatccaacggagatcaaggaccaaagggggatagaggcgtcccaggaatcaagggggatagaggagagccgggtcctcgcggacaggacggcaatccaggtttgcccggggaacgcgggatggccggaccagagggaaagccgggcctccaagggcccagaggtccaccaggtcctgtcggaggacatggggatccgggtcctcctggggccccaggtcttgccggtccagcgggaccacagggcccatcaggactgaagggagaaccaggagaaactgggccacctggcaggggacttaccggaccaactggcgcggtgggtctgcctggaccccccggaccttcggggttggtcggacctcagggatcccctggcctgccaggccaagtcggcgaaacgggcaaaccaggagcgcccggacgtgatggagcctccggaaaggatggggataggggctcgccaggtgtaccgggaagccccggactgcctgggccagtcggacccaaaggcgagcctggaccaaccggtgcccctggacaagcggtggtggggcttcctggagcaaagggtgagaagggggctccgggaggactggccggagatcttgtgggtgaaccgggggcaaagggcgaccgcgggctgcccggaccgcgcggagagaagggtgaggctggtagggcaggcgaacctggggacccaggagaagatggccaaaagggagcacctggacctaaaggattcaaaggtgatcccggcgtgggggtcccgggatccccaggtccgcctggaccaccaggtgttaagggagatttgggattgccgggacttcctggtgcccctggggtggttgggtttccggggcagaccggcccaagaggcgaaatgggacaacctggaccatccggagaacgtggactggccggcccgcccgggagagaggggatacctggtcctttgggacctccaggaccaccaggatcggttggaccgcccggcgcatcgggacttaagggggataagggggatcccggtgttggacttcccggtccacgcggggagagaggggaaccaggtattcgcggagaggatgggcggcccgggcaggaaggtccccgcggtctgaccggtcctccgggatccagaggagaacgcggagaaaaaggtgatgtcggctcagcaggactgaaaggcgacaagggtgattccgcggtgatcctgggaccaccgggacccagaggtgcaaagggagatatgggcgagaggggtccccgggggctggacggggataagggtcctcgtggagacaacggcgacccgggggataagggtagcaagggagaacccggcgataagggctcggcaggcttgcctggtcttagaggacttcttggcccacagggtcaaccaggtgcagccgggatacccggggatccaggttctccaggaaaagatggggtgccgggtataagaggtgaaaaaggagacgtgggatttatggggcccaggggtctgaagggtgagcgtggcgtcaagggtgcctgtggtttggacggagaaaagggtgataagggagaggctggcccaccagggcgacctggactggcgggtcacaagggagaaatgggcgaaccaggtgtgccaggtcagtcgggggcacccggaaaggaaggactgatcggcccaaagggggaccgcggttttgacggacaaccaggacctaagggggatcaaggagaaaagggagagcgcggcacgcctggcattggaggttttcctgggccttccggcaacgatggaagcgcgggccctccgggtccgcccgggtcagtcggacctcggggtcctgaaggacttcaagggcagaagggggaacgtggaccacccggagagcgagtagtgggcgcaccgggagtgccgggcgctcctggagagaggggggaacagggacgcccaggccccgcaggccccagaggggaaaagggagaagcggcgctgaccgaggatgatattaggggattcgtccggcaagaaatgtcgcaacattgtgcttgccaaggtcaattcatcgcctctggcagtagaccacttccttcctacgcagctgataccgcaggttcgcagctgcatgccgtccccgtgctgcgcgtgtcacacgcggaagaggaggaaagagttccaccagaggacgacgaatacagcgagtactcggagtactcggtggaagaataccaagatccagaagccccatgggattccgatgacccttgtagcctccctttggacgaaggatcctgcactgcctacactctccgctggtaccatcgtgcagtcactggatccactgaagcatgccacccattcgtctacgggggctgcggaggtaatgcaaataggttcggcacccgggaggcatgtgagcgccgatgtccaccccgggtggttcaatcgcaaggtaccggcactgcacaggat

SEQ ID NO: 9557 - DNA, 8832 bp, Artificial Sequence
  Description of Artificial Sequence: Synthetic coding sequence
atgactcttcggctgctagtggccgcactttgcgccgggatcttggctgaagccccaagggttagggcccagcacagggagcgggttacctgtactcgcctgtatgccgcggacatcgtgtttctacttgatggaagctcaagtatagggcgatccaactttagagaggtccgcagcttcttagagggtctggttcttccattcagcggcgccgcaagtgcacaaggtgtgcgtttcgcaacggtccagtattccgacgatccgcgtactgagttcggacttgatgcactcggttccggtggcgatgtcatacgggccattcgagagttaagctataaaggaggcaacacacgaaccggcgctgcgatcctgcatgtggctgaccacgtgtttcttccacagttggccagaccaggagttccaaaggtgtgcatcctaataactgatgggaagagccaggacctcgttgacacggccgcccagcgcctgaagggccagggggtgaagctgttcgctgttggcataaagaatgctgaccccgaagagctcaaaagagttgcctcccaacccaccagtgacttctttttttttgtcaatgactttagtatcctgaggacgcttctccccctggtgagtcggagagtctgtacaacggccgggggcgtacctgtgactaggccccctgacgatagcacttccgcccctcgggacttggtgctgagcgagccctctagccagtcccttagggtgcaatggaccgctgcctcaggccccgtgactggctataaagtacagtacacacctctgaccggactgggtcagccgctgccctctgagcggcaggaggtgaacgtgcccgcaggggagactagtgtgcgtttgcgtggccttagaccactgacggagtaccaggtcacagtgattgctctctacgccaactctattggtgaggcagtctcgggcacagccaggacaaccgcgctcgaaggccctgagctcacaatccagaacaccaccgcccactctctcttggtggcttggcggagtgtgccgggcgcgacgggatatcgcgtgacctggagagtgctgtctggcggcccgacccagcagcaggaactgggcccagggcagggtagcgtgttactgagagacttggagccagggaccgactacgaggtcaccgtttcaactctttttggacggtctgtggggccagccacatcacttatggccaggacagacgcctcagtggaacagactcttcgccctgtgatactggggcctaccagtatcttactatcatggaatctcgtccccgaagctcgagggtatcgacttgaatggcgacgcgagacaggccttgagccgcctcagaaagtggttcttccttccgatgttacaagataccagcttgatgggctgcaaccgggcaccgaataccgactgactctatacacactcttagaggggcacgaagttgctacgcctgccacagttgtgccaaccgggcccgaactgccagtctcgcctgtgacggaccttcaggccaccgaactgccaggtcagagagtgcgtgtatcctggtctcccgtgcctggcgctactcaatacagaattatagtgaggtccacccagggggtggaacgtactcttgtcctccccggatcacagactgcgtttgatcttgacgacgtgcaggctggattatcctacacggttagagtctctgcacgcgtgggtccccgggagggaagcgctagcgtcctgactgtccgtagagaaccggagaccccactggctgtccccggacttcgagttgttgtgtccgacgctactcgggtgagagttgcctgggggcctgtccctggtgcctcgggcttccgcattagctggtccacaggctcagggccagagagcagtcaaaccctgccccccgacagtactgccacagacattacggggctacagcctggcacgacataccaggtcgcagtgtctgtgctcagagggagggaggaaggacccgcagctgtgatcgtggcaagaaccgaccccctgggtcctgtgcgcaccgttcacgtgacccaggccagctcctccagtgtgaccattacttggacgcgcgtcccaggggccacagggtacagggtctcctggcactctgctcatgggccggaaaagtcccaattagtgagtggcgaggcaacagtggcggagctagatggtttggaaccagatactgagtacacagtgcacgtgagggctcatgtcgcaggcgtagatggcccgcccgccagcgtggtggttagaaccgcgccagagccggtaggaagggtctcacgccttcagattctgaacgcttcgtccgacgtgcttcggattacatgggtgggggtgaccggcgccacggcctatcggttggcctgggggaggtcagaaggaggccctatgaggcaccagatcctcccaggcaataccgactccgcagagatcagaggactcgagggtggtgtttcatactctgtcagagtcaccgccctggtgggcgatcgagaggggacaccggtaagcatcgtggtgacaaccccacctgaggcaccacctgccctgggcacccttcatgttgttcagcgcggcgaacactctctgcggttgcgctgggaaccagtgccaagggctcaaggttttttgctacactggcaacccgagggaggtcaagaacagtcgcgtgtgctgggaccagaactgagcagttaccacctcgacggactcgagccagcaacccagtatcgcgtcagattatccgttctaggtcctgccggagaaggaccctcagctgaggtaacagccagaacggaatctcctagggtgccaagtattgagctcagggtggtggatacatccatcgattcagtaactctggcctggacacctgtgtcccgcgcaagtagctacatactgtcttggagaccactccgcggaccagggcaggaggtcccaggctctcctcaaacactgcctggtatatccagttcgcagcgtgtcacaggtctggagccaggggtgtcttatatcttttcgcttactccagtcctcgacggcgtgcgcggcccagaagcctctgttactcaaactcctgtttgtcctcggggcctggctgacgtggtgtttctaccacatgcaacgcaagacaatgctcacagggcagaagccactcgaagagtgttggagcgtctggttttggctctcggacctctcgggccccaggccgttcaagtggggctgctttcgtactcacatcgaccgagtcctttgttccccctaaatggtagccacgacctcgggattatcctccagcggataagagacatgccctacatggatcctagcggcaacaatttgggcactgctgtagtcactgcccaccgctacatgctagcgcccgacgcccccggccggagacagcatgtaccaggcgtgatggtgttgctggtggacgagcccttaaggggcgatattttctccccaatccgggaggcccaggcctcaggcttaaacgtcgtcatgctaggaatggcaggagccgacccggaacagctccgtcggctcgcacctgggatggatagcgtgcagacgttcttcgcagtggacgacgggccttccttagatcaggccgtgtctggcctggccaccgcactatgtcaggcttccttcacaacccagccgcgacctgaaccgtgccctgtatactgtcccaagggtcagaagggcgaaccaggcgagatgggattgcggggtcaggtaggcccgcctggtgacccaggtcttccaggccggaccggcgcccctggccctcagggacccccggggtcagcaacagctaaaggcgaacgggggttcccaggagctgatgggcgaccagggagtccaggacgagccggaaaccctggtactccaggcgcccctggcctaaagggaagcccaggcctccccggccccaggggggatccaggggagaggggcccgcggggtccaaagggagaaccaggggcccctggccaggtgattggcggtgagggcccgggattacctgggagaaagggtgatccagggcccagtggtcctcccggccccagaggcccactgggggatccgggccccagaggtcctccagggctccctggaactgctatgaaaggcgacaagggagaccgcggagaacggggaccacccgggcccggcgagggggggatagcccctggcgagccaggtctccctggcctgcccggttccccgggtccccagggacccgttgggcctcccggcaaaaaaggagaaaagggagacagtgaagatggcgcccccgggcttccagggcagccaggatcaccaggggaacagggcccccgtggccctccaggggccatcggaccgaagggagacagggggttccccggaccgctgggggaagccggcgagaagggagagcgaggccccccggggcctgctgggtcccgcggtctccctggcgtggccggcaggcccggagccaaagggcccgaaggtccgccagggcccacaggacgccagggtgagaagggggagcctggaaggccaggcgatcccgccgtggttgggccggccgtggccggtccgaaaggtgagaagggtgatgttggccctgccggaccccgcggggccaccggagtccagggagaaaggggccctcccgggctagtgctgccaggagaccccggccctaaaggggaccccggggatagggggccgattggcctgacgggccgcgctgggcctccgggagactctgggccacccggcgaaaagggagacccaggcagaccaggaccgccaggtcccgttggcccacgagggagagacggcgaggtgggcgagaaaggagatgaagggccacccggcgatcccggattgcccggaaaagcgggcgagagaggtttgcggggggctcctggggttcgcggtcctgtgggggagaagggagaccaaggagatcctggggaagacggccggaatggatcaccagggtcttccggtccaaagggagaccggggagaacctggcccacccgggcccccaggacgactggtggacaccgggcctggtgctagagagaaaggcgagccgggagataggggtcaggaaggtcccagaggccctaagggcgatcccggacttccgggagccccgggtgaacggggcatagagggcttccggggaccaccaggcccccagggagacccaggcgtcagaggccctgccggagaaaagggtgatcgggggccgcccggcctcgacggtaggagcgggctcgacggtaaaccaggggctgccgggccatccggacccaatggtgctgccggtaaagctggtgatcccgggcgagatggcctgcctggactccgtggcgagcaaggtctgcctgggcccagtggcccgcctggcctccctggaaaacctggggaggacggcaaaccgggacttaacggaaagaacggtgaaccgggagatcccggagaagacgggcggaagggtgagaaaggcgactctggagccagtggaagagaaggtagggacggacccaagggagagaggggcgctcccggaattcttggacctcaaggcccacccggcctgccgggacctgttgggcctccgggccagggcttccccggagtgcctgggggaaccggacccaaaggcgaccgaggggagacagggtccaagggagagcagggactcccaggggaaaggggacttcggggcgaacccggatctgtcccaaatgtggaccgactcttagagaccgcagggatcaaagcaagcgctctgcgagaaatcgtggagacctgggatgagagctccggctcgttcctaccagtcccggaaagaaggcgcggcccaaaaggtgacagcggggagcagggcccgcccggaaaagaagggcccataggatttccaggggagcgggggctaaagggggatcggggcgacccggggccacaaggcccacctggcctcgcactcggcgaacgcgggccgcctggcccctctggcctcgcgggggagcccgggaaacccggtatccccggacttcccgggcgcgcagggggtgtgggagaggccggtcgccccggagagcggggcgaacgaggcgagaagggagagagaggcgaacaaggaagggatggacctcctgggttgcccggaacacctggcccacctggccctcccgggccaaaggtatccgtcgacgagcctggtccaggcttgagcggtgagcaggggccccccgggttaaagggggccaaaggtgaacccggttccaacggggaccagggtccgaaaggagaccgtggagtgccggggataaagggggatagaggggaaccagggccaaggggtcaggacgggaaccccggattgcctggcgagcgcggtatggctggacccgaaggaaaaccaggcttacaagggcccaggggaccaccagggccagtggggggtcacggggacccaggtccacccggtgctccgggacttgctggaccagcaggccctcaagggccgagtggcttaaaaggggagccaggcgagacgggcccccccggacgaggactcactgggcctacaggagccgtcggtctccccggccctccaggcccctccgggctggtgggccctcagggcagcccggggcttccaggccaggtaggagagactggtaagccaggcgcaccagggcgcgacggtgcttcaggcaaagacggcgatcgcggtagtcccggggttcccgggagcccaggcttacccggacctgtggggcccaaaggagaacctggcccgactggggcacccggacaagcggtagtgggcctacccggtgccaaaggtgagaagggggcgcccgggggactcgcaggcgacctggtaggagaacctggggccaagggggacagagggctgccggggccccgcggtgagaaaggtgaggccggcagagcaggggagccaggcgacccgggtgaggacgggcagaagggcgcgcccgggcctaagggatttaagggagatcccggagtcggcgtcccgggaagtccgggtccccctggccccccaggggttaagggcgatcttggtctcccaggcctgccaggggcccccggtgtggtggggtttcctggccagactggacctcgcggtgaaatgggtcagcccggtcccagcggcgagcgcggattagccggcccgcctggccgtgagggcatccctgggcctctaggcccaccaggaccaccgggaagcgtcggaccccctggcgcttccgggctgaagggcgacaaaggggaccctggagttgggctccctggaccaaggggagagaggggagagcctgggattcgcggcgaagacggacgtcccgggcaggaagggcctcgtgggctaaccggaccaccgggttctcggggggagcgcggagagaagggtgacgtgggctccgccggcttgaaaggcgataaaggtgactctgcagttatcctcggcccaccaggccctaggggtgccaagggagacatgggggagcgtggccccaggggcctggacggagacaagggcccaagaggggataacggagaccctggagacaaagggtcaaagggagagccaggagataaaggcagtgcaggccttccggggcttagaggactgctgggccctcagggccagcccggtgctgctggcatccctggcgatcctggaagccctggaaaggatggtgttcccggaattcgaggcgagaagggcgatgtggggtttatgggacccagaggtctcaaaggagaacggggggtgaagggggcctgtgggctcgatggagagaagggtgacaaaggggaggctggacctcccggaagacctggcttagccggccacaagggcgagatgggtgaaccgggtgtaccaggccaatctggagcgccggggaaggagggattaattggaccaaagggcgatcgtggattcgatggacagcctggtcctaaaggggaccagggagaaaagggcgaaaggggcactcccggaattggcggatttcccggcccctccggaaatgatggctcagccggccctccagggcctcctggctctgttggacctaggggacctgaggggctgcagggtcagaagggcgaaaggggcccccccggcgaaagggtcgtaggagcacccggagtgccgggcgctcccggcgagcgcggcgaacaagggcgcccgggaccggcggggccaaggggcgagaagggtgaggctgctctcactgaagatgatattagagggttcgttcgccaggaaatgagccagcactgtgcttgccaagggcagtttattgctagtggctcccgcccactgccctcgtacgccgccgacactgcagggtcacagctgcatgccgtccctgttctgagagtctctcacgctgaagaggaagaacgcgttcctcccgaggacgacgagtattctgagtactccgaatattcagtggaagagtatcaagaccccgaagccccctgggacagtgacgatccatgctcgttgcccttagatgaagggagttgtaccgcttatacacttaggtggtatcacagagctgtgaccggtagtacagaagcttgtcatcccttcgtgtacggcggatgtgggggcaacgccaacagatttggaacaagagaggcgtgcgagcgcaggtgcccaccgcgagttgtgcagtcccagggtactggcacagctcaggat

SEQ ID NO: 9558 - DNA, 8832 bp, Artificial Sequence
  Description of Artificial Sequence: Synthetic coding sequence
atgaccctgcggcttctggtagccgccctctgcgcgggaatcctcgctgaggctcctcgcgtgcgggcgcagcaccgggaacgggtgacctgcactagactgtacgccgccgacatcgttttcctcctggatgggtcgtcatccatcgggcggtcgaactttagggaggtgcggtcgtttttggaaggccttgtgctgcctttctcaggagcggcatccgcacaaggagtccggtttgctaccgtccagtactcagacgacccaaggaccgagttcggactggacgccctcgggtccggaggagatgttatccgggcgatccgggagctgtcgtacaaaggagggaacactaggacgggagcggcgatcctccatgtggcagaccatgtgttcctgccacaactggctcgccccggagtcccgaaggtgtgtatcctgatcactgacggcaagtcacaggatctggtggataccgccgcacaacggctcaagggacaaggagtgaaactctttgcagtgggaattaagaatgcggatcccgaggaactcaagagagtcgcgtcgcagccaacctcagatttcttcttcttcgtgaatgacttcagcatcctgcgcacgctcctgccactcgtctcgcgccgggtgtgcactactgctgggggcgtgcctgtgacccgcccgccagacgattcaacctcagcacctagggacctggtcctgtcggagccaagctcccagtcgcttagagtgcaatggaccgcagcaagcgggcccgtgactggctataaagtgcaatacaccccgctcacggggctggggcagccactcccgtcggaacggcaagaggtgaacgtgcccgccggagaaaccagcgtgaggctccggggactccgcccactgactgaataccaggtgaccgtgatcgcgctctacgctaattcgattggggaagcggtatcaggaactgccagaaccactgcgttggaaggaccggaattgactatccagaatactactgctcactccctgctggtcgcctggcgcagcgtgcccggtgctactggatacagagtgacttggcgcgtcctttcaggtggccccactcaacagcaggagctgggacccggtcagggatctgtgcttttgcgggatctcgagccgggtaccgactacgaagtcacggtgtcaactctgtttggacgctccgtgggacccgcaacctcgcttatggcacggaccgacgcgtcggtggaacagacccttagaccagttatcttgggcccgacttcaatccttctgtcctggaacctggtgcctgaagcaagggggtaccggctggaatggaggcgcgagactgggctcgaacccccgcagaaagtcgtgctgccgagcgatgtcaccagataccaattggacggactgcagccggggacggagtaccgcctgaccctgtacactctcctggaaggacatgaagttgcaaccccagcgactgttgttcccactggaccagagctcccggtgtcgccggtgactgacctgcaagctactgaattgccgggacagagggttagagtgagctggagccctgtgccaggagccacccaataccgcattatcgtgaggagcacccagggggtggagcgcactctggtgctgccgggctcgcagacggcatttgacctggatgacgtgcaagcaggactctcgtacaccgtcagagtgagcgcgagagtgggccctcgggagggaagcgcgtctgtcctgactgtgcggcgggagcccgaaaccccgctcgccgtgccgggactgcgcgtggtggtcagcgacgcaacgcgggtccgggtggcctggggaccggtgcctggagcctccggattcagaatttcgtggagcaccggctccggacctgagtccagccagaccctccctccggactcaacggccaccgatatcacgggactgcaacccggcaccacgtaccaggtggcggtgtccgtactgcgaggtagagaagaaggaccggcggcagtgatcgtggctcgcaccgacccgctgggaccggtgcgcaccgtccatgtgacccaagcctcgtcgtcatccgtgacgatcacttggacgcgggtgccgggcgcgaccggatatcgggtgtcctggcattcggctcacggtccagagaagagccagctcgtgagcggtgaggccaccgttgccgaactggatggcttggagccagatactgagtatactgttcatgtgagagcccacgtggctggcgtggatgggcctccggctagtgtggtggtgcgcaccgcaccagagccggtaggccgcgtgtcaaggctgcaaatactgaacgcgtcctccgacgtccttcggattacttgggtcggagtgactggagcgaccgcctaccggctggcttgggggcgctcggaggggggccctatgagacatcaaatactgccgggaaacaccgatagcgcagaaatccgcggcttggagggcggcgtgtcgtacagcgtgcgggtcaccgcgctcgtgggagatcgcgaggggactccagtctcgatcgtggtgacgactccacccgaggccccgccagccctgggcactctgcatgttgtgcagcgcggtgagcactcgctgcgcctgagatgggagcccgtcccgagagctcagggatttctgttgcattggcagcctgaaggaggccaggaacaatccagagtcctgggtcctgagctgtcatcgtaccacctggacggcctggaaccggcgacccagtatcgggtgaggctgtcagtgctgggcccggcgggagagggacctagcgccgaggtgaccgcccgaacggagagccctcgggtgccctcaatcgaactgagagtcgtcgatacctcaatcgatagcgtcactctggcatggactcctgtgtcaagagcaagctcctacatcttgtcctggcgcccgctgcgcggaccaggacaggaagtgcccggatcgccacaaacgctgccaggaatttcctcctcacaacgggttactgggctggagccaggagtgtcatacatcttctcgttgaccccggtgctcgacggcgtcaggggccccgaggcatcagtgacccagaccccggtctgccctcgcggccttgcggacgtggtgttcctcccgcatgcgactcaagacaacgcccaccgcgccgaggcgaccagaagagtgctggagaggcttgtgttggcgctgggcccacttggcccacaggcagtgcaagttggactgctctcgtactcccatagaccttcgcctctgttcccactgaacggatcgcacgatctcggaatcatcctgcaacggatccgcgacatgccctatatggatccttccggaaacaaccttggtactgcggtggtgaccgctcatcggtacatgctcgcacctgatgctcctgggcggcgccaacatgtcccgggagtcatggtgctgctcgtggacgaaccgctcagaggcgatatcttcagcccgatccgagaagcccaggccagcggtctgaacgtggtgatgttgggaatggcgggtgccgatccggaacagctccgcagactggccccaggaatggactccgtgcaaaccttttttgccgtggatgatgggccttcactggatcaagccgtctcgggcttggcgaccgcgctctgccaggcttctttcacgacccagccacggcctgagccgtgccctgtgtactgccccaagggccagaaaggagaaccgggggagatgggcctcagaggccaagtgggaccgcctggagatccaggcctgccaggacggaccggcgcgccaggtcctcaggggcctccgggttcggcgactgccaagggagaacggggattccccggagcagatggccgcccgggatcaccagggagagctggaaacccgggaactccgggcgccccagggctcaagggctcaccggggcttccaggtccgcgtggtgaccccggtgaacggggaccaagagggcccaagggagaaccgggagcaccaggccaggtcatcggaggggagggacccgggctgccgggacggaagggtgacccaggaccgtcgggcccgcctggaccgcgaggacctttgggagatccaggaccgcggggcccgcccggattgccggggactgcaatgaagggtgacaagggggaccgcggagaacgcgggcctccgggacctggagagggagggatcgccccaggagaacctggactgccgggactgccgggaagcccgggtccgcagggcccggtgggaccgccaggaaagaagggagaaaagggcgattcagaagatggggccccagggctgccgggacaacccggctccccgggagaacagggaccacgcggaccccccggtgcgatcggacctaagggggatcggggattccccggaccgttgggagaggcgggagagaagggggaaagagggccgccgggccctgcgggaagcaggggactgccgggagtcgccggcaggccgggggcgaagggcccggagggacctccgggacctaccggacggcaaggcgaaaagggcgaaccggggcggccgggggaccccgccgtggtcggccctgcggtggctggcccgaagggcgaaaagggagatgtcggaccggccggcccaaggggggcgaccggcgtgcagggcgaacgcgggcctccggggctggtcctgccgggagatccaggaccgaaaggagatccgggcgaccgggggccaattggactgaccggacgggccggacctccgggagattccggcccaccgggagagaaaggggacccggggaggccgggccctccaggccctgtgggaccacgcggacgggacggggaggtcggcgagaagggcgacgaggggcctccaggggatccgggtctgcctggaaaggctggagaacggggcctgaggggcgctcctggagtccggggtccagtgggtgagaagggagatcagggggacccgggcgaagatggcagaaacggatcgcctggctcctcaggaccgaagggagatcgcggagagccggggccaccaggaccaccgggcagactcgtggacactggcccgggcgctcgggaaaagggagagcctggagatcggggacaagagggacctcggggacccaagggggacccgggactccctggggctccgggtgagcggggaattgaaggattcagaggaccacccggacctcagggcgatccaggagtgagaggaccggctggagaaaagggcgaccggggaccgccggggctcgacggccgctcaggactcgatgggaagcctggagcggccggcccgagcggcccaaatggtgcggctggaaaggcgggggaccctgggcgggacggtctgccgggattgagaggagaacagggcttgcctggtccgtcgggccctcccggtctgccgggcaaaccgggagaggatgggaagcccgggctcaatggaaagaacggcgagccaggtgaccctggcgaggacggacgcaagggtgaaaaaggagactccggtgcctccgggcgggagggtcgcgatggccccaaaggagaacgcggagcacctgggatcctgggcccacagggccctccaggtctgccaggtccggtcggccccccaggacaggggttccctggagttccgggagggaccggtccgaagggagataggggcgagactggctccaagggagagcagggactgcccggcgagcgcggtctgcgcggtgagccaggatcagtcccgaatgtggacagactcctcgaaaccgccggaatcaaggcatcagcgttgcgcgagatcgtcgagacgtgggatgagtcctcgggatcctttctcccggtcccggaacggcgccgagggccaaagggtgactctggagaacaggggccgccgggcaaagaaggaccgatcgggttccccggtgagcgcggcctgaagggtgaccggggagatcccggaccgcagggcccaccgggactcgccctgggagagagaggacctcccggaccgagcggactcgcaggggaaccgggaaagccaggaattcctggtctgcctggccgcgcgggaggagttggcgaagctggcaggccgggagaacggggagaacgaggcgagaagggtgagcgcggtgaacaaggacgcgacggaccgccaggcctccccggcaccccagggccacccggaccaccgggaccgaaggtgtctgtggacgaaccgggtccaggactgtccggagagcaaggtccgccgggactgaagggcgccaagggtgaacctggaagcaacggagatcagggccccaaaggagatcggggagtcccgggaatcaagggtgaccggggcgaaccaggcccacgggggcaggatggaaaccccggtctgccgggtgaaagagggatggccgggcctgaaggcaaaccgggactgcagggaccacggggccccccaggccctgtcgggggtcatggagatccagggcctccgggcgccccgggactcgcaggaccagctgggccccagggtcctagcggactcaagggcgagcccggagaaaccggaccaccgggccgcgggctcactggcccgaccggagcggtgggacttcccggaccgccgggaccgtccggactggtgggaccgcagggatcccccggactcccgggacaggtcggtgaaaccggaaagccaggagctcctggacgggacggagcttcaggaaaggacggtgaccgcggatccccgggcgtccctggaagcccaggattgcctggacccgtggggccgaagggcgaaccgggacccactggcgcgccgggccaggcggtcgtcggcctcccaggagccaagggagagaaaggagcgccgggcggactggccggggacctggtgggcgaaccgggcgctaagggagatcgcggcctcccaggtccgaggggagagaaaggagaagcaggacgcgcaggcgaaccgggcgaccctggagaggacggccagaaaggagcaccgggtccgaaaggtttcaaaggggacccaggtgtgggagtcccagggtcaccgggcccccctggaccgccaggagtcaagggggatctgggactgccaggcctgccgggagcgcccggagtggtgggtttcccgggacagactggccctagaggagaaatgggccagccgggcccatccggagaacgcggactggccggccctccaggacgcgaaggaattccaggaccgctcggtcctcctggcccacctggatcagtcggcccgccgggagcttcaggtcttaagggggataagggagatccaggggtgggcctcccgggaccgagaggagaaaggggcgagcctgggattcgcggcgaggacggccgccccgggcaggagggtcctagaggactgactggcccaccgggatcccgcggagaacgcggagagaaaggcgacgtgggatcggccggactgaaaggggacaaaggcgactcggccgtcatcttgggtcctccaggtccgcgcggggccaaaggagacatgggggaaagaggtccacgcggtctggacggagacaagggccccagaggagataacggggacccgggagataagggatcgaagggagagcctggggacaagggctccgccggactgccaggactccgaggactgctgggacctcagggccagccgggagccgccggaatcccaggagatcccggttccccgggcaaggacggagtccctggaatcagaggtgagaagggagacgtgggctttatgggcccacggggcctgaagggagaacgcggagtgaagggtgcgtgcggacttgatggcgaaaaaggagacaagggagaagccgggccgcctggacgcccgggactcgctgggcacaaaggcgaaatgggagagccaggcgtgccgggtcagtccggagctccgggtaaggaaggcttgatcggacccaagggagacagaggcttcgatggccagcccggacccaagggggatcagggagaaaagggagagagaggaactcccggaatcggaggatttcccggtccatctgggaatgacggctcggctggaccgcccggaccgcctggttccgtggggccgcgtgggccggaaggactgcagggacaaaagggcgaaagagggccgccgggagaaagagtggtgggagctccgggggtgccgggagcccctggagaacgcggggaacagggacggccaggcccagcgggcccacggggcgaaaaaggagaggcagcgctgactgaagatgacattcgcgggtttgtcagacaagaaatgtcacaacattgcgcatgccaagggcaattcatcgcctccggctcgcgcccgctgccgtcctacgcggcggacaccgcaggatcgcagcttcacgcagtgccggtgcttagagtctcgcatgctgaggaagaagagcgtgtgcctccagaggacgacgagtattccgaatactcagaatactcagtggaggagtaccaagatcctgaggcgccgtgggattccgacgacccatgcagcctgcccctggatgaaggatcgtgtaccgcgtacaccctccggtggtatcacagagccgtgaccggatcgacggaggcgtgccatccctttgtgtacgggggttgtggcggtaacgcaaatcgttttggtaccagagaggcgtgcgaaagacgctgccccccaagagtggtccagtcgcagggaactggaacggcacaagat

SEQ ID NO: 9559 - DNA, 8832 bp, Artificial Sequence
  Description of Artificial Sequence: Synthetic coding sequence
atgacactacgactactcgtcgcagctctgtgcgccgggatactggccgaggctcctagggttagagcacagcaccgagaaagagtaacatgtacccgactgtacgccgctgacattgtgttcctcctagatggctctagctcaattgggagatctaattttcgagaggtgcgcagcttccttgagggcctggtattaccttttagcggagcagcctccgctcagggagtgcggttcgccactgtgcagtattctgatgaccctaggactgaatttggcctcgacgcactgggctctggcggagacgtgatccgggcaattcgcgagctgtcatataaggggggcaatacacgaaccggggccgccatcctgcatgtagccgatcatgtgttcttacctcagcttgcccgtccaggggtgccaaaagtgtgcatactaatcacagacgggaaaagccaggatctggtggacacagctgcacagcgcctcaaggggcagggcgtaaagctgttcgcagttgggataaagaacgccgaccctgaggagctcaagcgcgtcgccagccagcccacctctgactttttcttcttcgttaacgacttctccattttgcggactttactccctctggtgtcacggagggtgtgcacaacagcaggcggcgtccccgtgacccgacccccagacgattccactagtgcccctagagacctagtgctcagcgaaccctcctctcagtctttgcgagtgcaatggactgctgctagtggccctgtgacagggtacaaagttcagtacacccccttaactggcctgggacaacctctgccatcagagagacaagaggtcaacgtccccgccggcgaaacctcagtgcgactgcgaggcctgcgacccctgacagagtaccaggtgaccgtgatcgctctttacgccaactccataggtgaggccgtgtctggcaccgccaggactactgctctcgaagggcccgaactgactatccagaatactaccgcacattctctgctggtagcatggcgctctgttcctggcgccacaggttatagagtgacctggcgcgtcctgtccggcggacccacccagcagcaggagctggggcctggccagggttctgtcctgctgcgtgatctagagcctgggaccgattacgaagtgacagttagtaccctgttcggacggtccgtcggacctgcaacctctctcatggcccggactgacgcatccgtggaacaaaccctgcgcccagtgatcctgggcccaacttccatcctcctgagttggaacctcgtgcctgaagcccgcggataccggttagagtggaggcgcgaaaccgggctcgagccaccacagaaggtcgtgctcccatctgatgttaccaggtaccagctggatggactccagccagggacagagtaccgactgaccctgtacactttgctagaggggcacgaggttgcaacccctgcaaccgtagtgccaactggacccgaactgcctgtttctccagtgactgatttacaggctacagagctcccaggccagcgcgtccgggtcagctggagtcccgttccaggggccactcaatatcggataatcgtaaggtccacccagggtgtggagagaacactcgttctgcctggcagccagaccgcttttgacctggacgatgtgcaggccggcttaagttataccgttagggtgtccgctcgggtgggacctagggaaggcagtgcttccgtgctgactgtgaggcgcgagcctgagacccctctggccgtgccaggtttacgagtggttgtttccgacgccaccagagtgagggtggcctgggggccagtgcctggcgcttccgggttccgaatcagttggtccaccggctccgggcctgaaagctctcaaaccctgcctcctgatagtactgctaccgatattacaggcctgcaacccggcacaacttaccaggttgctgttagcgtgctgcgtggtcgcgaagagggaccagccgcagtgatcgtggcacgcaccgaccctttggggcccgtcagaaccgtacacgtgactcaggcaagttcaagttctgtcaccatcacatggactagggtgccaggagccactgggtacagagtctcatggcatagcgctcatgggcccgagaaatcccagctcgtgtccggcgaagctacagtggctgaactcgacggattagaaccagacaccgagtataccgtgcacgtccgagcccacgtcgctggagtcgatggcccccctgcctctgtggttgtcagaactgctcccgagcctgtgggcagagttagccgcctgcagattctcaacgccagctccgatgtgctgcgcatcacatgggtgggcgtcactggcgctaccgcatatcgcttggcatgggggcgttccgagggaggacctatgcgacatcagatactgccaggcaatactgattccgcagaaataagaggtctagaaggcggcgtatcttactctgttcgagtgaccgctctcgttggagatagagaaggaactcccgtgtctattgtggtgaccaccccacccgaagctccaccagcactcggcactctgcatgtcgtccagcggggcgagcacagcctgcgtttacgctgggaacccgtgccaagagcccagggcttcctgcttcactggcagcctgagggcgggcaggaacaatcacgcgtcctgggacccgaactttcttcctaccatttggacggtctggagcccgccacccagtacagggttaggctgtccgtgctggggccagccggcgaaggcccatccgccgaggttacagcccgcacagaatcccccagggtcccctcaattgaactgcgtgtcgtcgacacaagtattgacagcgtcaccctcgcatggactccagtgagcagggcatctagctatatcctgagttggaggcccctccgtgggcccggacaagaggtgccaggcagccctcaaaccctgccaggaatatccagcagtcagcgggttacaggtctggagccaggggtgagctacatcttctccctgacccctgttctggatggtgtgaggggacccgaggccagcgtgacccagactcctgtttgtccacgcggtctagctgacgtggtgttcctgccccacgccactcaagataacgcacaccgagctgaggcaactagaagggttctagagagactcgtgctggctttgggaccacttggcccacaggctgttcaggtcggcttactgtcctattcccatagacctagcccactgtttccactcaatggctctcacgatctgggcataatccttcagcgcattagggatatgccctatatggatccaagcgggaacaaccttggaacagctgttgtgaccgctcaccggtacatgcttgcccccgatgctcccgggcgccgtcagcacgtccctggtgttatggtgcttctggtagacgagcctctccgcggagatattttttcacccatccgggaggctcaagcaagcggtctgaatgtggtcatgctgggcatggctggtgccgatcctgaacaactgcggcgactggcccccggaatggattccgttcagaccttcttcgccgtggacgacggcccatctctagaccaggcagtcagcggcctggccaccgctctctgtcaggcaagctttacaacacagccacggccagagccttgccctgtgtattgtccaaaagggcagaagggcgagcctggagaaatgggccttcggggccaggtgggcccccccggcgatcccggcctgccaggccgcactggtgccccgggcccacagggcccccccggaagcgctacagccaaaggtgagcggggctttcccggggcagacggaagaccagggtcccccggccgcgctggtaatcctggaacacccggtgctcccgggctaaaaggctcccctggactgcctggcccacggggagatcccggagaacggggacctcgcggccctaaaggggagcccggcgcacctggccaggtgattggcggggagggccccggcttgccaggccgcaagggagatcctgggccttctggtccccccggccccagaggcccactgggtgatccagggcctagaggaccacccggtcttcctggaactgccatgaagggagacaagggggacagaggcgagagaggcccaccaggccctggagagggcggaatcgctcctggggagcctggccttcctggattacccggatctccagggccccaggggcctgtggggccacctgggaagaaaggagagaagggagactccgaggacggcgctcccgggctgcctggccagccagggtccccaggcgagcagggtccacggggcccacctggagcaattgggccaaagggagatagaggtttcccagggccactgggcgaggccggtgaaaaaggcgaacgtgggcccccaggccccgctggttctagaggccttcccggggtagccgggaggccaggggccaagggtcctgagggcccacccggccctaccggcaggcagggcgagaagggggaacccgggcgacccggagacccagccgtggtgggccctgcagtggcaggcccaaagggtgagaagggcgacgtggggcccgctggacctcgaggagctaccggcgtgcaaggggaaaggggacctcccggcttagttttacccggggatccaggccccaaaggagacccaggcgacaggggcccaatcggtctgaccggcagggctggcccacctggcgatagtggaccaccaggggagaagggggacccaggtcgccctgggcccccaggccccgttggccctcggggacgggacggggaagtcggcgagaagggcgacgaaggcccccctggcgaccccggtctgccaggtaaggccggcgagcgcggtttgcgaggggctcccggtgtacggggacctgttggggaaaaaggggaccagggtgaccccggcgaggacggacgcaatggcagccctggctcatctggcccaaaaggggacagaggggagccaggccctccaggcccaccagggcgtctggtcgatacaggcccaggcgcccgggagaagggagaacctggggataggggacaggaaggacctaggggccctaagggcgatcctggcctccctggggctcctggggagaggggcatcgaggggttcaggggccctcctggcccccaaggcgacccaggcgtgcgaggccctgccggagagaagggcgacaggggccctcccggcctagacggccggtctggattggatggtaaacccggcgccgccggccccagtggacctaacggcgcagctgggaaggcaggcgatcccgggcgagacgggcttcctggcctgcggggcgaacaggggctaccaggcccatctggtccccccggtctgcccggcaaaccaggggaggacggcaagcctggtttaaatggcaaaaatggagagcctggcgatcctggagaggacggtcgcaagggggaaaagggcgatagcggggcctctggaagagaaggccgagacgggcccaaaggcgaacgcggcgcccctggaatcttaggtcctcagggcccacccggcctcccaggcccagtggggccacctggtcagggatttccaggcgtgcctggcggaacagggcccaagggtgacagaggtgagaccggctctaagggcgagcagggtttgcccggggaacgaggattgcgtggcgagcctggttctgtccctaatgtggatagactcctagagaccgccgggatcaaggccagcgccctaagagagatcgtagaaacatgggatgaaagtagcggttcctttctgcccgtgcctgaacggagacgagggcccaaaggggactccggggaacagggaccccctggaaaggagggtcccataggattccctggagagagagggctaaagggggatcgaggggatcccggccctcaaggaccacccgggttggctctgggcgagagaggcccaccaggccccagtgggctcgctggagagcctggcaagcctgggattcctgggcttccaggacgtgcagggggtgtcggcgaagccgggcgtcctggcgagaggggagagaggggagagaaaggagagagaggcgagcagggccgggacgggcctccaggcctccctgggacacccgggccccctggaccacctggcccaaaagtgtccgtggatgagcctgggcccggtctcagcggggagcagggcccacctggcctgaaaggggccaagggtgagcccggctctaacggagaccagggccctaaaggcgaccggggcgtgccaggcattaagggagacaggggcgaaccaggaccccgcggtcaggacggcaaccccggcctgcccggtgagagagggatggcagggccagagggaaaacctggcctgcaagggccccgtggccctcccggccccgtcgggggtcatggggacccaggccccccaggggcccccgggctcgctgggccagccggaccacaggggccaagcggcctgaagggcgaacctggtgagactggaccacccggccggggcttaaccggaccaacaggcgcagttggtctgccaggccccccaggcccctctgggctggtgggtccacagggatcacctggcctgcccggccaggtgggagaaactggaaagccaggcgctccagggcgggacggggctagtggcaaagatggcgatagaggctctcctggcgtccctggctctcccggcctgccaggaccggtcggcccaaaaggagaacccggccctactggggcaccaggccaggccgtggttggattacctggagctaagggagagaagggcgcacccggcggcctggccggcgacctggtgggagagccaggcgcaaagggcgacaggggattgccaggcccacgcggcgagaagggagaagctgggcgcgccggggagcccggggaccctggcgaggacggacagaagggcgccccaggacccaagggattcaagggtgatcccggcgttggcgtgccaggttccccaggcccaccaggccctcccggcgttaagggcgatctgggactgcccgggctgcccggcgcccccggggtggttggcttcccaggccaaacaggcccccgcggtgagatgggacagccagggccttctggggagcgtggcctagccgggccaccaggcagagaggggataccaggccccctcggccccccaggtcctccagggtccgttgggcctccaggggccagcgggctcaaaggagacaagggcgatccaggggtaggactgcctggtcctcgcggcgagaggggcgaacctggaatcaggggcgaggacggcaggcccggccaggagggccctaggggcttgactgggccccccggctctaggggggagcgtggcgagaaaggggacgtcgggtcagctggattaaaaggagacaaaggggactccgcagtcatcctgggtccccctggaccacggggggccaagggcgacatgggagagagaggcccaagaggcttagatggcgacaagggacccagaggggacaacggggacccaggtgataaaggttccaagggcgaacccggcgataagggatcagctggcctacctggcctccgagggctgctggggccccagggccagccgggagctgccgggatacccggcgacccagggtctcctgggaaagatggggtgcctggtattagaggcgagaagggcgacgttggtttcatgggtcccaggggattgaagggagaaaggggcgttaagggagcctgtggactggatggcgaaaagggagataaaggggaggcaggccctcccggcaggcctggtcttgccggacataaaggggaaatgggggaacctggggtgcctgggcaaagcggggctcctggaaaagagggcctcattggccccaaaggggacaggggctttgatgggcagcccggcccaaagggggaccagggtgagaaaggtgaacggggcacacccgggatcggtgggtttccagggccttctggtaatgatggcagtgctggtcctccaggcccccccgggtcagtgggcccacgtggacccgagggcctccagggacagaagggagagcggggacctcccggcgagagagtggtgggggctcctggggttccaggcgcccccggcgagcgcggcgaacagggccgacctggaccagctggtcccaggggcgagaaaggagaagccgctctcaccgaagatgacattaggggcttcgtgcgccaggagatgagccagcattgcgcctgtcagggccagttcatcgccagcgggtctaggcctctgccctcttacgccgccgatactgccggctctcaactgcacgcagtgcctgtgctccgcgtgtctcacgcagaagaagaagagagggtgccccctgaggacgatgagtattctgaatatagcgagtatagcgtggaggagtatcaagatcccgaggcaccctgggattcagacgacccctgttctctgcctctggatgaaggctcttgtaccgcatacacactgaggtggtaccacagagccgtgactggttcaactgaggcctgccatccatttgtgtatggagggtgcggtggtaatgcaaaccgtttcggaactagggaggcctgtgagcgccgttgtccccctagggtcgtacagtcccagggtaccggcaccgcccaggat

SEQ ID NO: 9560 - DNA, 8832 bp, Artificial Sequence
  Description of Artificial Sequence: Synthetic coding sequence
atgaccctgcgattgctagtcgccgccctctgtgcaggtatcctagccgaggcaccgcgtgttcgggctcaacacagggagagagtgacgtgtacgagactctacgctgctgacatcgttttcctcctggatgggagcagttccattggccgtagtaattttagagaggtgcgaagcttcttagaaggtctcgttcttccattcagcggagctgcctctgctcagggagtgagatttgctactgtccagtattccgacgatccccggacggagttcggactagatgccctaggttcaggcggcgacgtgattagggctatccgggagttgagttacaagggaggaaacactcgcaccggagccgcgatattacatgtggccgaccacgtctttctcccacaactagcccggccaggcgttcccaaggtttgcattctcatcaccgacgggaagtctcaggaccttgtggataccgccgcacagcgcctgaaaggacaaggtgtgaaactgtttgccgtcggcattaagaacgccgacccagaagagttaaaacgagttgcaagccagccgacttccgacttttttttttttgttaacgatttttcgattctcaggacactcctcccattggtgagtaggagagtgtgcactactgccggcggtgtccccgtaaccagaccccccgatgatagtacaagcgccccccgagatctcgtactgtctgagccctcaagccaatccttgagagtgcaatggaccgccgcatcagggcccgtgacaggttacaaggtccagtacactccactgaccggcttgggacagcctctcccctcagagcgccaggaggtgaatgtccccgcaggggaaacatctgttcgcctgagaggccttcggcccctcacagaatatcaggtgacagtgatcgctttgtatgccaactccatcggcgaggcagtcagcggcacggctcgaacaactgctctcgagggtccggagttgacaattcagaacactacagctcattcccttctggtcgcctggagatctgtgccaggagctactggttatcgggtgacctggagagtcctttctggcggacccacacagcagcaggagttggggccaggccaggggtccgtgctcctgcgcgacctggaaccagggactgattatgaggtcaccgtctccaccttgtttggcaggtccgttggtccagccacctctttaatggccagaacagacgctagtgtggaacagaccctccgaccagtgattctaggcccaacctcaatcctgctcagctggaacctcgttcccgaagcaagaggatacaggttagaatggcggagggagacagggttggaaccgccccagaaggtggtccttccttcagacgtcacacggtatcagctggatggactgcagccggggactgaatataggcttactttgtacactctgctggagggccacgaagtagctacaccggccactgtcgtgccaactggccccgaattaccagtgagtcccgtcaccgatctccaggctactgagctgccaggccagcgagtccgggtgtcctggagccctgtacccggggccacacagtatcgcataatcgtacggagtacacagggcgttgaacggaccctggtactccctgggtcgcagacagcttttgatctggacgatgtgcaggccggccttagctatactgttcgcgtatccgctcgcgtagggccgagggaaggctcagcttccgtgctaacggtcagacgagaacccgaaacacccctcgcagtgcctggactgcgcgtggttgtgagtgatgctacccgagtccgagtggcatggggaccagtgcctggcgcatccggctttagaatatcatggtccactggatctggcccagagagcagtcagactcttcctcccgacagcaccgccacagatattactgggctgcagcccggaacaacctatcaggtcgcagtgtcagttctccgtggccgagaagagggaccagcagcagtgattgtagcgcgtacagacccgctgggtcctgtacggactgtccacgtgacccaggccagttcatcctccgtcaccatcacatggacacgcgtgccaggggcgacaggttatagagtctcatggcactccgcacacggccctgaaaaatctcaactggttagtggcgaagccacagtcgctgagctcgacgggctggagcccgacacggagtacactgttcacgttcgcgcacatgtggcaggagttgatggcccacctgcgtctgttgtcgtgagaacggcgccagaacccgtggggagggtatctcggctgcagatcctgaacgcttcctccgatgttctgcggattacctgggtaggcgtgacgggagcaactgcttatcgactggcctggggtcgctcagagggcggcccaatgcggcatcagattttgccaggcaacacagatagcgcggagatccggggcttggagggcggcgtgtcttacagtgtgcgggtgacagcactggtgggcgaccgcgagggcacaccagttagcatagtagtgaccacgccccctgaagcccccccagccctaggcacgttacacgtcgtgcagaggggcgaacactccctgcgcttacggtgggagccagtgcctagagcccaaggcttcctgctccattggcagccagagggagggcaagaacagtcgcgcgttctgggaccagagctcagctcttatcacctggacggcttggagcctgcaactcagtatcgggttaggttgtccgtactggggcctgctggcgagggaccctctgcagaggtgactgctaggacggagtctcccagggtcccatctatcgaactccgagtcgtggacacatccatagattccgtgactctggcatggactccggtgtctcgcgcaagctcttacattttgtcctggcgaccattgagaggcccgggccaggaggtacccggatctccacagactctgcccgggatatcaagctcccagcgtgtgaccggtttggagccaggtgtaagttatatcttctctctgactcccgtccttgatggcgttcgagggcccgaggctagcgtgacacagaccccggtgtgccctagggggctggccgacgtagtgttcctgccccacgccactcaagacaatgcccatcgcgccgaagccacacgaagggtgctggaacggctggttttggctttaggacccttaggtccacaggcagtccaggtggggttgttgagctacagccaccgcccttccccgttgtttcccctcaacgggagccatgatctcgggattattctgcagagaatacgggacatgccttatatggatccttctggcaacaatctcggaacggccgtcgtgactgcccaccgatacatgctggctcctgacgctcctggaaggcgccagcacgtccctggcgtaatggtcttactggtggatgagcctcttcgcggcgatatcttttcccccattagggaagcgcaggcctcagggctgaacgtggtgatgttgggcatggctggggcagatccagagcagctgcgcagactcgcccccgggatggacagcgttcagaccttcttcgctgtcgatgacggaccttcccttgaccaggctgtcagtggcttagccaccgctctgtgtcaagcatcatttactacgcagccgcggcccgaaccgtgtccagtatattgccccaaaggacagaaaggcgaacccggtgagatggggctgagaggacaagtcggtcctcccggcgatcccggattgcctggtagaactggggctcccggaccccagggacctccagggagcgcaacagctaaaggtgaacgaggcttccccggggccgacggcagaccaggcagccctggacgagcaggcaatcctggtacacccggcgcccccggcttgaaagggagccctggtctgccgggaccgagaggtgacccgggtgagaggggcccacggggccccaaaggggagcccggcgcccctgggcaggttattggcggcgaaggacccggcctgcctggaagaaaaggggatcccggcccgagcggccctcccggaccccgggggcccctcggtgatcctggccctaggggaccgccgggactgccagggaccgcaatgaagggggataaaggagataggggagaacgcgggcctcccggtcccggggagggcggcattgcccctggtgaacctggactgcctggcctgccaggctcccccggaccacagggccccgtgggcccccctggcaaaaaaggcgaaaagggcgatagtgaagatggcgctccaggactccccggccagcccgggtcgcctggcgaacagggcccacgaggaccccccggcgctattggcccaaagggcgatcgcgggtttccaggcccactcggcgaggccggcgagaagggtgagcggggtccacccggccctgcaggatcccggggattgccgggcgtggccggccgacctggggctaaaggcccagaggggccccctggccccaccgggcggcagggtgagaagggggagcctggacggcccggtgatcccgcggttgtcgggccggccgtcgccggaccaaagggagaaaagggagacgtcggacctgccggtcctagaggcgctaccggcgtgcaaggagaaagaggaccaccgggcctagtcctgcccggtgatcctggacccaaaggagatccaggggatagaggccccataggcctcaccggcagagctggcccaccaggggattcgggtcccccaggggaaaagggggaccccggccggcctggacctcctggtcctgtaggtccccgtgggcgcgatggagaagtcggcgaaaaaggcgacgaaggtccacccggtgacccgggccttcctggaaaagcgggcgaaagagggctgaggggagcccccggtgtacgaggaccagtgggggaaaaaggagaccagggagacccaggcgaggacgggcggaatgggtcacctggttcctctggccccaaaggagatcgtggtgagccaggaccacccggtccacccggccggttggtggacacaggccccggagctcgagagaagggcgaacccggcgataggggacaggaaggtccccgtgggcccaaaggcgatcccggccttcctggggcccctggggagcgtggtatcgaaggattccgcggcccccctggcccacagggcgatccaggcgtccgggggcctgctggcgaaaaaggcgaccggggccctccagggcttgacggtcgctcggggctggacggcaagcccggagccgcggggccctcaggaccaaatggcgccgcaggtaaggccggcgatcccggcagggatggactgccaggtctgcgaggagagcaggggctgccagggccttctggtccgcctgggctcccaggcaagcccggggaagacgggaagcctggcctgaacggcaaaaacggggagccgggcgaccccggagaagatggcagaaagggcgagaagggagattccggagctagtggccgagagggaagggatggcccgaaaggggaacgaggcgcacctgggattcttggcccacaggggccaccgggattgcccggacccgtaggcccacccgggcagggttttccaggcgtcccagggggcaccggacctaagggggacagaggggaaacaggctctaagggtgaacagggcttacccggcgagaggggacttagaggagaaccaggatctgtccccaacgtcgaccgcctgcttgagaccgcggggattaaggctagcgccctcagagaaattgtggaaacatgggacgagtcttctggcagtttcctgcccgtccccgaacgccgaagaggccctaaaggggattcgggcgagcagggccctcccggaaaggaagggccaattggcttccccggggagagaggactcaaaggagaccggggtgatcccggcccccaaggcccccctgggctggcactcggtgaacggggcccacccggaccctcagggctcgccggcgaacccggaaagcccggtatacctggcctgccagggcgggccggtggagtgggcgaagctgggaggcccggagaaagaggggagagaggcgagaagggggaacgcggggagcagggccgggacgggccgccaggactgccaggaacaccaggacctccagggcctccagggccaaaagtctccgtcgacgaacccggaccaggattgtccggagagcagggccccccagggttaaagggggcaaaaggagagcccgggagcaatggggaccaagggccgaagggggataggggcgttccaggcatcaaaggggacaggggggagccaggtccccgcgggcaggatgggaaccctggcctgcccggcgaacgggggatggcaggaccggaaggcaaacctggccttcagggtcctcgtggaccacctggacccgtgggagggcacggcgaccccggaccgcctggagcccctggactggccggccccgctggtccacaggggccgtccggcttgaaaggagagcctggtgaaacgggaccgcctggccgtggactgaccggtccaaccggggctgttggactgcctggacccccgggaccctcgggacttgtcggccctcagggctccccgggtctgcctggtcaggttggagagacaggcaagccaggggcccctggtagagacggggccagcggtaaagatggggacagagggtcacctggggttccaggctcccctggcttaccggggcccgttggccctaagggagaacccggcccaacaggagcaccggggcaggctgttgtaggccttcccggcgcaaaaggggagaaaggcgcccccgggggacttgccggagacttggtgggagaacctggcgcaaagggagatcgcggtctgcccggcccacggggcgagaaaggcgaggctggccgagcaggggaacccggggatccaggggaggatggtcagaagggtgcgccaggcccgaagggatttaaaggggatccaggagtaggagtgcccggaagcccaggaccaccagggccgcccggcgtgaaaggggacctcggtctccccggccttcccggagcccctggggtcgtgggttttcccggacagactggccccagaggggaaatgggtcagcctggtcccagcggcgagagaggcctggccggaccaccgggacgagaggggatcccaggccctcttggacccccaggcccacctggtagcgtcggcccgcctggcgcttctgggctgaagggagacaagggggatcccggcgtggggttgccaggcccccgcggcgagcgaggcgagcctgggattcgcggcgaagacgggcgacctggccaagaaggacctcgtggactcactggacccccgggtagcaggggagaacggggggaaaagggcgatgtggggagcgctgggctgaagggtgataaaggcgacagcgctgtcattctgggaccaccggggcccaggggcgctaagggcgacatgggggagagaggcccgcgcggtctggatggtgataaaggaccgaggggcgataatggcgaccctggcgacaaaggaagtaagggtgaaccaggcgacaagggatctgcgggtttacccggtcttcgtggcttgttagggcctcaagggcagcctggtgccgccggcatccctggcgatcctggatcccctggtaaggacggtgtgccgggcattaggggagagaagggagatgttgggttcatgggcccccggggcctgaagggggaaaggggcgtgaagggagcctgtggcctggatggcgagaaaggcgataagggagaggcaggcccgccaggtcgtcctgggctcgcgggccataaaggagaaatgggagaaccaggcgtccccggccagtcaggagcaccaggcaaggagggcttgataggccctaaaggggaccgcgggtttgatggacagcccgggccaaagggcgaccaaggggagaagggtgagagaggtactccagggatcggtggctttccaggacccagcgggaatgatggatccgctggcccccccggccctccgggctccgtgggccccaggggacctgaaggtctgcagggacagaagggggagaggggcccgccaggcgaacgggttgtcggagctccaggagtgcccggagcccccggagagcgtggcgagcaggggcggcctggcccagccggaccccggggggaaaagggggaagcagctctgactgaagacgatatcaggggttttgtgcgccaggagatgtcccagcactgcgcatgccagggacagttcatcgcaagcggctcccgccctctgcccagctacgctgccgataccgcaggatcccaactccacgccgtccccgtgctccgggtttcccacgcagaggaggaggagagagtgcccccagaggatgacgaatattcagagtatagcgagtactcagtcgaagagtatcaagacccggaagccccttgggactccgacgatccctgcagtctgcccctcgatgaagggtcctgtaccgcatataccctgcgctggtatcaccgggctgtcactgggtcgactgaggcatgccaccccttcgtttatggaggatgcgggggaaatgcaaatcggttcgggacccgtgaggcatgtgaacggcggtgccctcccagagtcgtccagtcccagggcactggcacagcacaggac

SEQ ID NO: 9561 - DNA, 8832 bp, Artificial Sequence
  Description of Artificial Sequence: Synthetic coding sequence
atgactctcaggttgttggtggcagccctttgcgccggaatcctggctgaggcaccgcgcgtcagggctcaacatcgcgaacgcgtcacctgtaccaggctctacgccgcggatattgtattcctgctggatggcagctcgtctatcggcagatcgaacttcagggaagtgagatctttcctggaaggattggtcctgccgttcagcggagctgcctcggcccagggggtccggtttgctactgtgcagtacagcgacgaccctcgcactgaattcggcctggatgcgctcggctcaggaggtgacgtgatacgcgcgattcgcgaacttagttacaagggaggcaataccaggaccggcgcagcgattctgcacgtcgccgatcatgtgtttcttccgcaactggcccgacccggtgtcccgaaagtgtgcatcttgattaccgatgggaagtcacaagacctggtggacaccgccgcccagaggctgaaaggtcagggagtcaagctgttcgcggtgggcattaagaacgcagatccggaagaactcaagcgggtggcgtcgcagcccacgtccgacttcttcttcttcgtgaacgacttttcgatccttcggactctcctcccactggtgtcgcgtagagtgtgcactactgccggaggcgttcctgtgacccggccgcctgacgactcgactagcgcacctcgggacctcgtcctgtccgagccgtcgtcccaatccctgcgcgtgcaatggactgcagcgtcaggtccggtgaccggatacaaggtgcaatacacgccgctgactggactgggacaaccactgccgagcgaacgccaggaggtgaatgtcccagccggagagactagtgtgagactgaggggacttcggccactgactgaataccaagtcactgtgatcgccctgtacgcgaactccattggagaggcggtttccggaactgcacggaccaccgctctggagggcccagagctgactatccaaaatactaccgcccactccctcctggtggcttggcggtcggtcccaggagccacgggttaccgcgtcacctggcgggtgctgtcgggtggtcctacccagcagcaagagttgggaccaggccagggctcagtgctcttgcgggatctggagccgggaacggattacgaagtgactgtttcaactctcttcgggaggtccgtgggaccggctacttccctcatggcaagaaccgacgcctcggtggagcagaccctgcggccagtgattctgggaccgacttcgattcttttgagctggaatctcgtgcccgaagccagaggctaccgcctggaatggagacgagagactggccttgagccgccccaaaaggtcgtgttgcctagcgatgtgactaggtaccagctcgacggactgcaaccgggcactgaataccgccttactctctacaccctcctggaaggacatgaagtggccacccccgcaactgtggtgccgaccggcccggaactgcccgtctctcccgtcaccgatctgcaggctaccgaactcccagggcagagggtgcgcgtctcatggtcgcctgtgccaggcgccacccaatatcgcatcatcgtccggtccactcaaggggtggagcgcactcttgtgctgcctggctcacaaaccgcatttgacctcgatgatgtgcaggctgggctctcgtacaccgtgcgcgtgagcgcgcgagtgggaccaagagaaggttcggccagcgtccttactgtgaggagagaaccggaaaccccgctggccgtgcctggccttagagtggtggtgtctgatgccacccgggtgagggtcgcctggggacccgtgcctggagcctcgggcttcagaatctcatggtcaactggtagcggtccagagtcgagccagacgctgccgccagactcaactgcaaccgacatcactgggctgcagcctggaacgacctaccaggtggccgtctccgttctgcgcggcagagaagagggcccagcagctgtgatcgttgcccgcaccgacccactgggaccagtgcggaccgtacatgtgacccaggcgtcatcgtcgtcggtgacgatcacttggacccgcgtaccgggcgccacgggttaccgggtatcatggcactcagcccatggtcctgagaagtcgcaactggtatcaggagaagcgaccgtcgcagagctggacggcctggaaccagacactgagtacaccgtgcatgtgcgggcccacgtggcgggtgtggatgggccgccggcgtccgtcgtggtgcgcactgcacccgaaccggtcggacgggtgtccaggctgcagatcctgaacgcctccagcgacgtcctgcgcatcacctgggtgggcgtcaccggtgccactgcctacaggctggcatggggaagaagcgagggtggaccaatgagacatcaaatcctcccgggaaacacggactcggcagaaatccggggactggaaggcggagtgagctactcggtccgggtgaccgcgctggtgggtgaccgggagggaactccggtgagcatcgtggtaactacccctccggaagcgccgcctgcactgggaaccctccacgtggtccagcgaggagagcattctctcaggttgcgctgggagcccgtccctcgggcacagggatttctcctgcactggcagcctgaaggcggccaggagcagtcacgggtcctgggacctgaactctcctcgtaccaccttgacggactcgaacctgcgactcagtacagagtgcgcctgtcggtgttggggccggccggagagggtccgtcagccgaagtgacggcgcggaccgagtcgccacgggtgccttcgatcgagctgcgggtcgtggatacttcgatcgactccgtcaccctggcgtggactccggtttccagggcaagctcctacatcctctcgtggcggcctctgaggggcccgggccaggaggtccctgggtcgcctcagactctccctggaatctcctccagccagcgggtgactggacttgaaccgggagtctcttacatcttctccctgacgcctgttctcgacggagtgcgcggaccggaagcgagcgtgacgcaaactccggtctgcccaagaggacttgcggacgttgtattcctcccgcacgccacccaggataacgctcatcgcgccgaggccacccgtagggtcctcgaacgcctcgtcctggccctcggaccactggggccgcaagcagtgcaagtgggtttgctctcatactcacaccgcccttcaccacttttcccattgaatgggtcacacgacttgggaattatcctgcaacgcatcagagatatgccttacatggacccaagcggaaacaatttgggaaccgctgtggtgacggcccacaggtacatgttggctcccgatgcgccgggccgccgacagcatgtgccaggggtgatggtgctcctggtggacgagccactgagaggcgacatcttctcaccgatccgcgaggctcaagcctcgggccttaacgtggtgatgctcggaatggcaggggccgacccggagcagctccgtaggctggcgcctggtatggattcggttcagaccttcttcgctgtggatgatggtcccagcttggaccaggccgtgtccggactggcaaccgcgctctgtcaggcctcctttaccactcaaccgcgcccggagccctgtccggtgtactgccccaaaggacagaagggagaacccggcgagatgggattgcggggacaggtgggaccgccgggcgacccgggcctccccggccgcaccggagcaccaggacctcaagggcccccggggtctgctaccgcgaaaggagaacggggattcccaggcgccgacggacggcccggaagcccgggaagagccggtaacccaggaactcctggcgcgccgggactcaagggaagcccgggactcccgggaccacgaggggacccgggagagcgcggaccgcgcggacctaagggagagccaggagccccagggcaggtgatcggcggagaaggacctggactcccaggaagaaaaggcgacccagggccctcgggtccaccgggaccgcgcggaccacttggcgatccgggaccacggggacctccgggactcccgggcactgcaatgaagggagataaaggggaccgcggcgaaagggggcctccgggaccaggagagggaggtatcgcgccgggagagccgggcctccctggattgcctggatcgcctggaccacagggaccggtgggcccgccgggaaagaagggagaaaagggagactcggaggatggggccccagggctcccaggtcagcctggttccccaggtgagcagggcccgcgcggacccccaggtgctatcggaccgaagggagacaggggattccccgggcctctcggcgaggccggagagaaaggtgaacggggaccaccgggccctgccggttcgagaggcctgcctggcgtggccggccggccgggggcaaagggtcctgaaggcccgcccggcccaacgggccggcaaggcgaaaagggcgaaccgggtcgcccgggggatcctgccgtcgtcggtccggcagttgccgggcccaaaggggagaagggggacgtcggaccggctggaccacgcggagctaccggggtccagggtgagaggggaccaccgggattggtgctgcctggggatccggggcccaaaggcgacccgggagatcgcggtcctatcggactgactggacgggctggcccaccaggtgactcgggcccgccaggtgagaagggagatccgggccggcccggaccgccaggtccggtcgggccacggggccgcgacggagaggtgggagagaaaggggacgaaggacccccgggggatccaggcctgcctggaaaggccggggaacgcggacttcggggtgcaccgggagtgcggggaccggtcggagaaaaaggggaccaaggagatccgggggaagatgggaggaacggaagccctggaagcagcggaccaaagggcgacagaggagagccgggacctccgggcccaccagggcgcctcgtggacactggaccgggcgcgcgcgaaaagggtgagccaggtgacagaggacaggaaggacccagagggccgaaaggagatccgggacttcccggagccccaggagaacgcggcattgaaggatttaggggaccccccggcccccagggcgatccaggcgtgcgcggccctgctggagaaaagggggatcgcggtccgccagggctcgatggcaggagcggactggatgggaagccgggggccgcgggcccgagcggcccgaacggcgccgccggcaaggcaggagatcctggacgagatggcctgccgggcctccgaggagaacagggactccctggcccgtccggcccgcccggcctccccggaaaacctggcgaggacggaaagcctggactgaatggtaaaaacggcgagcccggcgatcccggcgaagatgggcgaaagggcgagaagggggacagcggcgcctcgggacgggaaggacgcgacggccccaagggagaacgcggcgcgccaggaatcttgggaccccaagggccgccgggcctccctggaccagtgggaccgcctggccagggattcccgggggtgccaggaggcaccggaccgaagggtgacagaggagaaactggaagcaagggcgaacagggtttgcctggagaaaggggactccggggagaaccaggatccgtcccgaacgtggatcgcctgttggagactgcaggtatcaaagccagcgcactcagagaaatcgtggaaacctgggacgaatcgagcggcagcttcctcccggtcccagagagacggagagggccgaagggtgactccggtgagcagggacctccgggcaaggaaggtccaatcgggttccctggagaacgcggattgaaaggcgatagaggagatccaggaccacaaggcccgcctgggctggccctcggagaacgcggaccgccggggccgtcagggctggctggggagcccggaaagccgggaatcccgggactgcctggacgcgcaggaggagtgggggaagcgggcagaccgggtgagcggggagagcggggcgaaaaaggcgagcggggcgagcagggaagggatggaccaccaggacttcctggcactccgggtcctccgggaccgcccgggccgaaagtctccgtggacgaaccgggacccggactgtccggggagcaaggaccgccggggcttaagggagccaagggcgaacctgggtcaaacggagatcagggacccaagggcgaccggggagtcccaggcattaagggggaccgcggtgaaccaggcccgagaggccaggatggaaacccaggattgccgggagaacgggggatggctgggcctgaaggaaagccaggcctgcagggaccacgcggcccaccgggacccgtgggcgggcatggggatccgggaccgcccggagcgccgggtcttgcgggacctgccggcccacaggggccatccggactgaagggggagccgggcgaaaccggaccaccgggacgcgggctgactggccccaccggcgcagtgggactccccggtcctccggggccgtctgggctggttggaccacagggaagccccgggttgcctggacaggtgggtgagacgggaaaacctggagccccgggcagggacggcgcgtccggcaaggacggagatcggggctcccccggggtgccaggctccccaggactgccgggaccagtcggaccaaagggagaaccgggccccactggagcccctggacaagccgtggtgggacttcccggggccaagggagaaaaaggagcccctggaggactggctggagatctggtcggcgaaccgggagctaagggcgatcgcggattgccgggtccccggggggaaaagggcgaagcgggccgggccggcgaaccaggcgaccctggagaagatggacagaaaggtgcgccgggacctaaaggatttaagggtgaccctggtgtcggcgtcccaggatcgccgggcccgcccggcccaccgggtgtgaagggcgacctcggacttccgggattgccaggagcgccgggcgtcgtgggttttccgggtcagaccggaccgcgcggtgaaatgggacagccgggcccatctggcgagaggggcctcgctggcccacctggtcgcgaaggaattccaggaccgctcgggccgccgggcccacctggatctgttggacccccaggggcatcaggcctgaaaggagataagggcgaccccggagtcggactgccgggaccgcggggcgaacgcggagagccgggcatcagaggcgaagatggtcggccaggacaggaaggaccaagaggccttactggtccgccgggatccagaggagaacgcggagagaagggggatgtgggatcagcgggtctgaaaggcgacaagggggactccgccgtgatcctcggtccaccaggaccgcggggagcgaaaggtgatatgggggagcgcggaccaaggggtctggacggggacaagggaccacgcggggataatggtgatccgggggacaagggctcaaaaggagaaccgggagacaagggctccgcaggactcccgggtctgcgggggctgctgggaccgcaaggccagccgggagctgcgggtatccccggtgacccgggatccccgggaaaagatggggtccctggcatccggggtgagaagggagacgtggggttcatgggaccgaggggacttaagggagaacgcggagtgaagggggcgtgcggactggacggggaaaagggcgacaagggagaggctggtccacccggacggcctggactggctggacacaaaggtgagatgggagaaccgggagtgccgggacaaagtggtgcaccaggcaaggaaggcctgataggacctaagggtgatcgggggttcgacggtcaaccgggacccaagggtgatcagggggaaaagggcgagcgagggaccccgggaatcggaggtttcccaggtccttccggcaatgatggcagcgcaggccctcctggaccccctgggtccgtgggcccacgcggcccggagggactccaggggcagaagggtgagcgggggccgcctggagagcgcgttgtaggagcaccgggggtgccgggagcgccaggagaacggggagagcaagggaggccaggaccggcgggaccgagaggcgaaaaaggcgaggcagcgctgaccgaggacgacatcaggggctttgtccgccaagagatgtcgcagcactgcgcctgccaggggcaattcatcgcgagcggatctcgcccgctgccttcgtatgcggccgatactgcaggctctcaactgcacgctgttccagtgctgagggtgtcacacgccgaagaagaagagcgtgtccctccggaagatgacgaatatagcgagtacagcgaatacagcgtggaagaataccaagatccggaggcaccctgggattcggacgatccgtgcagcctgccgctcgatgagggatcatgcaccgcatacaccctccgctggtaccatagagccgtcactggatcgaccgaggcatgtcatccattcgtgtatggaggttgtggaggaaacgccaatagattcggaactagagaagcgtgcgagaggcgctgcccgccgcgcgtggttcagtcacaaggaaccggaaccgcccaggat

SEQ ID NO: 9562 - DNA, 8832 bp, Artificial Sequence
  Description of Artificial Sequence: Synthetic coding sequence
atgacccttcggctgctggtggccgcactgtgcgctggcatcctggccgaagcccccagagttcgagcccagcatcgcgagcgtgtcacatgcacaaggttgtacgcggcggacatcgtgttcctgctcgatgggtccagctccatcgggcggtcgaacttccgggaagtgcgtagttttctggaaggtctggtactgccattcagtggcgctgcgagtgcccagggcgtgaggttcgctaccgttcagtattctgacgatccgaggacagagtttgggctcgatgccctgggctctggtggcgacgtgattagggccatccgagagcttagttataaaggggggaacacccggacaggtgcagccatcctgcacgtagctgatcacgttttcctcccgcagctggcccggcctggcgtacccaaggtctgcatcctgataaccgatggaaagtctcaggatctggttgacacagcagcacagcgcctgaagggacagggggtcaaactctttgcagtggggatcaagaatgcagatcccgaggagttaaagcgggtcgccagccagccaacaagcgatttcttttttttcgtaaatgatttttccattttgaggacacttttgccgctggtgagcaggagggtctgtaccacagcaggcggggtccctgtcactcgtccacctgatgacagcacaagcgcgccccgcgacttggtgctctctgagccatcttctcagagtctgcgtgttcagtggaccgccgcatccggccctgtgacaggatacaaggttcagtacacacctttgactggcctggggcagcccttgccttcagaacggcaggaggtgaacgtgcccgctggtgaaacatccgtgaggttaagaggattgcgtcccctgaccgagtaccaggtcacagtgatcgctttatacgctaattccatcggcgaggctgtgagtggtacagcccggactaccgcactggagggccccgagctgacaattcagaacaccacagctcacagcctcctggtggcttggcggagcgtacccggcgctacagggtatcgcgtcacctggagggtactttctggaggaccgacccagcaacaagagctgggtcctggacagggctctgttctcctgcgggacctggagccaggcaccgattatgaagttaccgtcagtactctcttcggcagatcggtcggaccagcaacatcgttgatggccaggactgacgcgtccgtagaacaaactctgaggcccgttatcttgggacccacgtcgattcttctttcatggaatcttgtgccagaagctcgtggctaccgactggagtggcggagggagaccggtctggagcctcctcaaaaagtcgtcctgccttccgatgtgaccaggtaccaactagatggacttcagcctggaacagagtaccgcctcacattatataccttgctggagggtcatgaggtggccacgcctgccaccgtcgtgcctaccggacctgagctgcctgtgtcccccgttacagatctgcaggccacggaattgcccggccagagagttcgggtgagttggtcccccgtcccaggggctactcaatacaggattatcgttagaagcacgcagggagttgaacgcacgttggtactgcctggttcccagactgcgttcgatctcgatgacgtccaggcaggcctgagctacacagttcgagttagcgctagggtgggaccaagggaaggttcggcgagtgtgctgacggtgaggcgggagcctgagacaccgttagctgtgccaggcctgcgcgtggtagtatctgacgccacacgcgtaagggtggcatggggacccgttcctggcgccagcggtttcaggatttcctggagtactggttcaggccctgaatccagccaaacactgcctccagatagcactgcaacagacataacggggttgcagccaggaacaacctaccaggtagcagtctcggtcctgcgcggcagggaggaaggtcccgctgcggtgattgtggcaagaacagatcctctgggtcccgtgaggaccgtacacgtgacacaggccagtagctcctccgtaacgatcacgtggacgcgagtgccaggggcgaccggctacagggtgagttggcattcagcccacggccccgagaaaagccaactcgtctccggggaggctactgtcgcagaactggacgggctcgagcctgataccgagtacactgtacatgtgcgggcccatgtggcaggagtggatggacctccagcgagcgttgtggtgcgaaccgcgcctgagcctgtgggtagggtgtcaaggctgcagattctaaacgcgtctagtgacgtgctgcggatcacatgggtgggggtgaccggagccacggcttatcgactcgcctggggacggagcgaagggggcccaatgcgacaccagatcttgcctggaaacaccgactctgcagaaatcaggggcttagagggcggagtctcttatagcgtgcgcgtcaccgctcttgtcggggaccgcgaaggcacccccgtgtcgattgtagtcaccacacccccagaagcccccccagccctcggtaccttgcatgtcgttcagagaggggagcacagcctgcgcttgcgttgggagcccgtgccgcgggctcaaggcttcctgcttcattggcagcccgaggggggacaggagcaatcccgtgtcctcgggccagagctgtccagttatcatctggacggtctcgaacccgctactcagtacagggtgcgcctgtccgtcctcggtccggcaggggagggcccatctgcggaggtcacggcccgtacagagtcacctcgagtgccaagtattgaactccgtgtcgttgatacctcaatagattcagtgacacttgcatggacccctgtcagccgagcatcctcttatatcctgtcctggcggcctctgaggggtcctggccaagaagtcccaggctccccccagaccctgcctggtatatcatcttcccagcgtgtgactggacttgagcccggcgtctcatatatattttctttgacgcctgtgctagatggggtgaggggcccagaggcaagcgtaacacagacaccggtgtgtccacgaggcctggccgacgtggtcttcctcccacacgccacccaggacaacgcgcacagggctgaagctactcgcagggtgctggaacgcctggtgttggctctggggcccctgggcccgcaagctgtacaggtggggttgctttcttacagccaccgccccagtccattattcccgctgaatgggtctcacgatttgggtataattctgcagcgaatcagggacatgccctacatggatccgtcgggtaataatctggggacagcagtggtcaccgcacataggtacatgcttgcgcccgatgcccccgggaggcgccagcacgtgcccggagttatggtcttgcttgtggatgagcctctaaggggcgatattttttctcctatccgggaagctcaagcatcgggcttgaacgtggtgatgctgggcatggcaggcgcagacccagagcagcttcgacggctggctcccgggatggactctgtacagaccttctttgcggtggacgatggtccctcactggatcaggctgtgtccggtctggccaccgcgctgtgtcaggcgtccttcacaacccagccccgaccagaaccctgtccagtttattgccccaaaggtcaaaagggtgagcccggagagatgggactgcgagggcaagtgggccctccaggagaccccggactcccgggacggacaggggccccgggaccacagggtccccctgggtcagccacagcgaaaggggaaagagggtttccaggagcagatggaagacctggcagtccaggtcgggccgggaatcctggcacacctggcgcaccaggattgaagggatctccaggcctcccaggaccaagaggtgacccaggtgagcgtggccctagaggacccaaaggtgaacctggcgcacccgggcaggtgatcggtggggaagggcccgggctgcccggcagaaagggggatccgggcccctccggtccccccgggcctcggggtcccttgggcgatccaggcccacgtggaccccctgggctgccaggcacagcgatgaagggtgacaagggagaccgaggggaacgcgggcccccaggccccggggagggcgggattgcacccggtgagcctgggcttcctgggctgcccgggagccccggtccacagggtccggtcggtccgcctggtaaaaagggtgaaaagggagattccgaagacggggcacctggattgcctggccagcccggcagtcccggcgaacagggtccacgtggaccccccggcgcgatcggtccaaagggcgataggggcttcccaggacccctcggcgaggccggcgagaaaggagagcgtggaccacctgggccagccggatctcgcggactcccaggtgtggccggcagacccggcgcgaagggccctgaggggccgcccggaccaacagggcggcagggcgagaagggcgagcctggacggccaggcgatcctgctgtggtgggccccgccgtagcgggccctaagggggaaaaaggagacgttggcccagcgggaccccggggagccactggtgtgcagggcgaaagggggccacccggtctggtgttgcccggagacccaggtcccaagggggacccgggcgatcgcgggcccatcggactgacaggacgcgccggtcctcccggcgattctgggcctcccggtgagaaaggagacccgggtcgtccaggaccacctggccccgtgggtcccagggggcgggacggcgaagtgggcgagaagggggacgaggggcccccaggcgatccaggtttgcctgggaaggcaggcgaaagaggtctacgcggcgccccaggggtgagaggaccagtcggcgagaagggagatcagggggatccaggggaggatgggaggaatgggagtccgggctcaagcggtcctaagggggataggggggagccagggcccccaggaccgcctggtcgactggtcgatacagggcctggggcccgggagaagggggagcccggagacagagggcaggagggccccaggggccccaagggcgacccgggactcccaggggccccgggagaaagggggatcgagggctttcggggacctcccggtcctcaaggtgacccaggagtccgcggacctgctggggaaaaaggagacagaggacccccgggccttgacgggagaagcggcctggacggcaagcccggagcagcaggcccaagcggtccgaatggagccgcaggcaaggctggagatcccggccgggacggactgcctggactcaggggtgaacagggcctgccagggccatctggacctcccgggcttcccggaaagcccggcgaagacgggaagcccggactgaatggaaaaaacggagagccgggtgaccccggggaagacggacgcaagggggagaagggggacagcggagcctccggacgggaggggcgggacgggcctaaaggcgaacgtggtgcaccaggcatcttgggtccgcagggcccgccaggactgccaggaccagtgggcccacccggccagggcttcccaggagtgccgggcgggaccggtccgaaaggcgatcgcggcgagacaggaagcaagggggagcaggggctgcccggagaacgcgggctgcgaggggaaccgggctccgtgcccaacgttgatcggctcttggaaactgctggaattaaggcaagtgcactccgagaaattgtggagacctgggatgagtcatctggctcctttctgcctgttccagagaggagacgtggcccgaaaggcgattcgggggaacaagggccccctggaaaagaaggccccattggcttccccggggagaggggactcaagggcgatcgaggggatccgggccctcagggccccccgggactggctctgggcgaaagggggccccccgggcccagtgggctggccggggaacctggtaagcccggcattcctggtctgcccggacgcgccggaggggtgggcgaggcaggtcgacctggtgagcggggagagcgtggagaaaaaggtgagaggggtgagcagggccgtgatgggccccctggtctgccgggcacacctggtccacccggtcctcctggacctaaggtcagcgtggatgagccgggccctggtctgagcggcgaacaggggccaccgggtctcaaaggcgcaaagggagaacctggcagcaacggagaccagggtcccaaaggtgatagaggggtgcccggcattaagggagatagaggcgaaccaggtccaaggggtcaggacggaaaccccggtctccctggcgaaagaggcatggcgggccccgagggaaaaccgggtcttcagggcccccggggaccacccggccctgtgggcggccatggcgacccaggccctcctggcgcccccgggctggctgggccagcggggccacagggtcctagtggtctcaagggggagcccggggaaaccgggccacccggccgcggtttgacaggaccaacaggtgccgtcggtctgcccggtccccccggacctagcggattggtaggaccacagggctcacccggtctccccggtcaggttggtgagacaggaaagcccggtgctcccggcagggatggagcgtctgggaaggacggcgacagaggatcccctggggttcctgggagcccaggcctgccgggccccgtcggccctaagggggagccaggaccaacaggggctccagggcaggcagtggtcggcttgccaggcgccaagggcgagaagggcgctcccggcgggcttgccggcgacctggtgggtgagccgggcgccaagggggacaggggccttcccggccctagaggagagaagggggaggcaggacgagctggcgagcccggagatcctggcgaggacggacagaaaggggcccctggcccaaaaggttttaaaggtgacccaggcgttggagtgccaggcagccccgggccaccagggccccccggggtgaagggtgatctgggcctccccggattgcccggcgctcccggcgttgttgggtttccaggacagactggaccacgaggtgagatgggtcagcccgggccctccggtgaacgggggcttgcgggcccaccagggcgggagggcattccaggccctctgggcccacctgggccccccggctcagtgggaccaccaggtgcctccggcttgaagggggataagggtgacccgggcgtcgggcttcctgggccaagaggcgaaagaggagaacccggaatcagaggagaggacggaagacccggccaggaaggaccccgcggcctgacagggccaccaggatcccggggcgaacggggcgaaaaaggggacgttgggtctgctggattaaaaggggataagggcgactctgctgtcattcttggacctcccggcccaagaggcgcgaagggtgatatgggggagcggggtcctaggggcttagacggtgacaaggggccccgcggcgacaacggagatccaggagataaggggtccaagggcgaacctggcgataaggggagcgccgggctccctggtttgagaggacttctagggcctcagggccagccaggcgctgccggtattcccggcgaccctgggagtcccgggaaagacggggtgcctggcattcggggtgagaagggagatgtaggattcatgggaccacggggcctgaaaggcgaaagaggtgttaaaggagcctgcggactcgacggggaaaaaggggacaaaggcgaagccggaccccccggacgccctgggctggccggccataagggcgaaatgggagagcccggcgtgcccggccagagcggggccccaggcaaggaggggttaatcggccccaagggcgataggggatttgatggccagccaggcccaaagggcgatcagggggagaaaggggaaagaggcactcctggaatcggaggctttcccggaccaagcggaaacgacggttctgctggtcctcccgggccacctggctctgtgggcccaagaggacccgagggcctgcaggggcagaagggtgaacgcggacctcctggtgagagggtggttggcgcccccggtgtccctggcgctcctggtgagcgaggagagcaggggcggcccggacctgcgggccctcggggtgagaagggggaagctgcactgaccgaagatgacattagaggatttgtgagacaggagatgtcccagcattgtgcctgccaggggcagttcatcgccagcggctcccgcccacttccgtcttacgcagccgacaccgctggcagccagcttcacgctgtgccagtgctccgcgtgagtcacgctgaagaagaggagagagtgccccctgaggacgatgaatattctgagtactccgaatattctgttgaggaatatcaggatcccgaagccccatgggactccgatgacccatgcagtctgccgttagacgaagggagctgcaccgcttacacccttaggtggtatcatagagcagttaccggatcgacggaggcatgccacccttttgtatacgggggctgcggtggcaacgcaaacaggttcggtacacgcgaggcctgtgagcgcagatgccccccacgggtggtacagtcccagggaaccggcactgcccaggac

SEQ ID NO: 9563 - DNA, 8832 bp, Artificial Sequence
  Description of Artificial Sequence: Synthetic coding sequence
atgaccctgcgtctccttgttgcagccctttgtgccggcatcctcgcagaggcaccacgcgtgcgcgctcagcacagagagagggtcacttgtaccagactctacgcagcagacattgtgttcctgctcgacgggtcctcgtccatcgggagatcgaacttcagagaagtgcgttcatttcttgaaggcctcgtccttccgttttctggagcagcaagcgcgcagggagtgcgatttgcgaccgtgcagtactcagatgacccccggaccgaatttggactggacgccctggggtcaggaggtgacgtgattcgggcgatccgggaactcagttataagggcggtaatactagaaccggagcagcaattcttcatgtggcggatcacgtgtttctcccacaactggcacggcctggagtgcccaaagtgtgtattttgattactgatgggaaatcccaggatctcgtggacaccgcggcacaaagacttaaagggcaaggtgtgaagctctttgcagtcggaataaagaatgcagaccctgaagaacttaagcgcgtcgcctcgcaaccgacgtccgatttcttcttctttgtgaacgatttttccattcttagaactcttctgcctctggtcagcagaagagtgtgcaccactgcgggcggggttccagtcactaggccccccgatgattcgacctcggcaccacgagatcttgtgctgagcgagccttcgtcccaatcactgagagtccaatggactgcagcatcaggtcctgtgaccggatacaaggtccaatacactcccttgaccggtttgggccagccgcttccatcagagcggcaagaggtgaacgtcccggcaggtgagacgtccgtgcggctgagaggcctgcgtccacttactgaataccaggtgactgtgatagccctttatgcaaactctatcggtgaagccgtgtcgggaactgcccgcactaccgccctggagggcccagagctcaccattcaaaacactaccgcacattcacttctggtggcatggcgctcggtccctggagctactggctacagagtcacttggcgggtgctgtcaggagggccgactcagcaacaagaactgggaccaggtcagggttcggtgcttcttagagatctggagcctgggactgattacgaggtgaccgtgtcgacgctttttgggaggtctgttggaccggccaccagcctcatggcccgtaccgatgcatccgtcgaacaaactcttagacctgtgattctgggacctaccagcatactcctttcctggaatctcgtccctgaggcacgcggatacagacttgagtggcgccgtgaaaccggtttggagccacctcagaaggtcgtgctgccttccgatgtcacgcggtaccaactggatggtctgcagcctggaaccgaataccgcctgaccctgtacactctccttgaagggcatgaggtggccacccccgctactgtggtgccgactggtcccgagctgcctgtctcgccggttaccgacttgcaggcaaccgagcttcctgggcagcgcgtcagggtgtcctggtcccctgtgcccggtgcgactcaataccgaatcattgtgcgctcgactcaaggcgtggaacgcaccctggtgctgccgggatcacagactgcgttcgatcttgatgatgttcaggccgggctttcgtacaccgtcagggtttcggcccgagttggaccaagagaaggcagcgccagcgtgctcaccgtgcgaagagaacctgagactccgttggcagttcctggccttcgggttgtggtatcagatgcaacgagggtgcgggtggcctgggggccagtccctggtgcatccggctttagaatctcgtggtctaccgggtcgggaccagaaagctcgcagactctgcctccagattcaaccgctaccgatattactggactgcaaccaggaaccacttaccaagtggcagtgtccgtgcttcgtggtagggaggaagggcccgcggccgtgatcgtggcaagaaccgatcccttgggaccagtgaggaccgtgcatgtgactcaggcgtcctccagctcggtgactatcacttggacccgagtgccaggtgcgaccgggtacagagtctcgtggcattccgcccatggtcctgaaaagtcccagctggtgtcaggagaagcgacggtggcagaactcgatggattggaacccgataccgaatacactgtgcacgtgagggcacatgtcgcaggtgtcgatggtccgcccgccagcgtggtggtccgcaccgcgccagaacccgtgggaagagtttcaagactgcagatattgaatgcgagctctgacgtccttcgcataacttgggtgggtgtgactggcgcaaccgcgtaccgtcttgcatggggacggtcggagggtgggcctatgcgacaccagatccttcccggaaacacggatagcgcagagattcgcgggctggaaggtggtgtttcatattcagtgagagtcaccgcattggtgggtgaccgggaaggcacccccgtgtccattgtggtcacgacgccaccagaggcccctccagcgcttggaacgctccacgtggtccaaaggggtgagcattccttgcgactgcgatgggagcctgtgccacgcgcacaaggcttcctgcttcactggcagccagagggaggacaggagcagagccgggtgctgggtccggaactgtcatcctaccatttggacggcctggagccagccactcagtacagggtcagacttagcgtgttgggacctgcaggagaagggccttcagctgaagtgacggcccggaccgagagccctagggtcccttcgattgagctccgcgtggttgatacttcgattgattccgtgacccttgcatggactcctgtctcgagagcttcctcatacattttgtcctggcgtccgctgagagggcccggacaagaagtccctggctctcctcaaacgctgcctggaatctcgtcatcgcagagagtcaccgggcttgaaccaggcgtgtcatatatcttctcgcttacgcctgtgctggatggtgtgagagggccagaagcctcggtgacgcaaaccccagtgtgtccccgaggactggcagatgtggtgttccttccacatgccactcaggacaacgcgcatagggctgaggcaaccaggcgggtgcttgaacggctcgtcttggcacttgggcctttgggaccacaggcagtccaggttggactgctctcgtactctcatagacccagcccgctgtttcctctgaacggatcacacgatttgggaattatcctgcaacgtatcagagatatgccttacatggacccgtccggaaataacctcgggaccgcagtggtgaccgcacatagatacatgctggccccagatgcacctggtcgcagacagcacgtcccaggagttatggtgctgctggtggatgaacctctcagaggtgacatattcagccccatcagggaagcacaggccagcggacttaacgtggtgatgcttggaatggccggagccgatccagaacaacttagacggctcgcgccaggaatggattcggtgcagacgttctttgcggtggatgatggcccatcactcgatcaagcagtgagcggcctggcaaccgcactctgtcaagcctccttcactacgcagcccaggccggaaccctgtccagtgtactgtcctaagggtcaaaagggagagcctggcgagatgggactccgggggcaggtgggtccccccggcgaccccgggcttcctggaagaaccggagccccaggtcctcagggccctccaggaagcgccactgccaagggtgaacgtggttttcctggtgcggatggtcgaccagggtcaccgggcagagcaggaaacccggggacccctggagcccccggtctgaagggatcccctggactgcctgggccaaggggagatcctggcgaaagagggcctaggggaccaaaaggagaacccggtgcacctggccaggtcattggaggtgaaggtccgggactgcctgggaggaagggagatcctgggccatcgggaccgcccggacctagaggtcctctcggagatcctggcccccgcgggcctcctggccttccaggtaccgccatgaaaggtgataagggggaccgcggcgaacggggaccccctggcccaggggaaggagggatcgcaccaggggaacctggactgcccggactccctggatccccaggacctcaaggaccggtgggcccccctgggaaaaaaggagaaaagggtgactcggaggacggtgcaccaggcctgccaggccagccaggcagccctggtgaacagggacccagaggtccccccggtgcaattggacccaaaggtgataggggttttccaggacctctcggggaggcaggggagaaaggagagagagggccacctgggcctgccggctcaagaggactccctggagtcgctggtagaccgggtgcaaaggggcccgagggaccacctggaccaactggacggcagggagaaaagggagaacctggtcgccccggtgatccggcagtcgtggggcccgcagtggcaggtcccaagggcgagaagggtgacgtgggacccgcaggcccaagaggagctactggagtgcaaggggaaaggggaccgcccggactggtgcttccaggggatccaggacctaagggcgatccaggagatagaggccctatcggtcttaccgggcgagccggacctcctggggacagcggcccacctggagaaaaaggagatcctggcagacctggcccaccaggacctgtggggccccggggtcgtgatggagaggtcggcgaaaagggggacgagggaccacctggtgaccccggactgccaggtaaggcaggcgaacgtgggctgcggggcgcacccggagtgcgaggacctgtgggtgagaaaggggatcaaggagatcctggagaagatgggcgcaatggttcgcctggaagctcgggccctaagggtgatcggggggagcccgggcctccaggtccgcctggtcgccttgtcgatactggtccaggggcaagagagaagggggaaccaggagatcgcgggcaggagggcccaagaggtcctaagggagatcccggcctccctggggcgcctggagaacggggaattgaagggtttagagggcctccggggccgcaaggagatcccggagtgcgcggccccgcgggagagaaaggcgatcgtggaccaccaggacttgatggtcggtcgggtctggatggaaagcctggcgcagctggaccatccggtccaaatggcgctgcagggaaggccggagatccaggaagagacgggctgccaggtctgagaggtgagcaaggacttccaggaccgtccggcccgccagggcttcctggcaagcccggtgaagatggcaagcctggactcaacgggaagaacggagagcccggtgaccctggtgaggacggacgtaagggagaaaaaggggatagcggtgctagcggacgcgaaggacgagatggtccaaagggcgagcggggagcacctggtattctgggaccccagggacctcctgggcttccgggtcccgtcgggccgccagggcagggattcccgggcgtccccggggggaccggaccgaaaggagatagaggtgaaactgggtccaaaggagaacaaggtctgcccggtgagcgtggacttcggggagagccaggttccgtcccaaacgtcgaccgactgcttgaaactgccggaatcaaggcctccgcattgcgggaaattgtggaaacctgggacgaaagcagcgggtcgttcctcccagtccctgaacggaggaggggacctaagggagactcgggtgagcaaggcccacctggcaaagaaggacctataggatttcctggtgaacggggcctcaagggagatcgaggagatccggggccgcaaggtcctcctggactggccctcggagaacggggccctccaggaccatcgggtcttgccggtgagcctgggaagcctggaatccctggcctgcctggtagggccggaggagtgggggaagcaggtagaccgggcgaaagaggagagcggggggaaaagggagaacgtggagaacaaggacgtgacggtccccctggactgcctggcactcctggcccacctggacctccaggccctaaggtgtcggtggacgagcctgggcccggtctgtcgggagaacaaggacccccaggtctgaagggcgcaaagggagaacctggttcgaacggcgaccagggaccaaagggggaccgtggagtgcccgggatcaaaggggataggggtgagcctggacctcggggccaagatggaaaccctggattgcctggagaacgcggcatggctggaccggaaggaaagcctggccttcaggggcctcgtggtccccctggaccagtcggtggacacggagatcctggacctcctggcgcaccaggtctggcaggacctgcaggccctcaaggaccttcaggtttgaagggagaacctggcgaaaccggcccacccggacgtggactgacgggaccaaccggagcagtcggacttcccgggcctccgggacctagcggactggtggggccacagggaagtcctggattgccaggacaggtgggagagactggtaagcctggtgcaccaggacgggatggggcgtcgggaaaggacggcgatcgtggatcgccaggagtgcctggatccccaggactgcccggccctgtcggtcccaagggagaacccggccctactggagctcctggacaagccgtggtgggtttgccaggtgccaaaggagaaaagggagcaccaggagggctggccggtgaccttgtcggggagcctggagccaaaggagatagagggctcccagggcccagaggagaaaaaggtgaggcaggaagagcaggtgagccaggagatcccggtgaagatggtcaaaagggggcacctggacctaagggatttaagggcgaccctggtgtgggcgtgcctggtagccctggcccgccaggtccaccgggagtgaagggggatctgggtctgcctggactgcctggtgccccaggtgtggtgggattcccgggtcagaccggacctagaggagagatgggacaacctggaccgagcggagaaagaggtctggccggaccccctggtagagaaggtatcccgggtccattgggaccacctggacctcctggtagcgtgggaccaccaggtgcatcaggcctcaaaggggacaaaggagatcctggagtgggtctgcctggacctcgcggcgaacgcggagaacccggtatccgtggagaagatggacggcccggacaggaaggcccgaggggtttgacgggtccacctggatcccgaggagaaagaggtgaaaaaggggatgtcggcagcgcaggtctgaagggagataaaggagactccgcagtgatccttggtcccccaggacctaggggtgctaagggagacatgggagaacgcggtcctcggggacttgatggagataagggccctaggggtgacaacggggatcctggagataaaggatccaagggagaacctggggataaaggaagcgcaggacttccaggactgaggggcctgctcggacctcagggacagcccggagcagcggggattccaggtgatccgggatccccaggcaaggacggagttccagggattagaggagagaagggtgatgtcggattcatgggaccacgcggcttgaaaggcgaacgtggagtgaagggagcttgtggcctggatggagaaaagggtgataagggtgaagccggtccacccgggcggcccggcctggcgggtcacaagggggagatgggcgaaccaggcgtccctggacaatcaggggctcctggtaaggaaggcctgatcggtcctaaaggcgaccgtggcttcgacggacaacccggacctaaaggagatcaaggagaaaagggagaacgaggtaccccagggattggcggttttcccggcccttcgggcaacgatgggtcggcagggcctcctggaccgcctgggagcgtgggacctcgtggtcccgagggccttcaaggtcaaaagggtgaacgcggacccccgggcgaacgagtggttggtgcacctggtgtgcctggggcaccaggagagagaggagaacagggccgcccaggacctgcgggaccacgcggcgaaaaaggtgaagcagcacttaccgaggacgatatccgcggctttgtcagacaggaaatgtcccagcattgcgcctgtcagggtcagtttattgcaagcgggtcccgtccattgccatcttacgctgcagacactgctggcagtcaacttcatgccgtgcctgtgttgcgagtgtcccatgcagaagaggaagagagagtgccgccagaagatgacgaatactcggaatactccgagtacagcgtggaagagtaccaggaccctgaagcaccctgggattccgatgatccttgcagtctcccactggatgaaggatcgtgtactgcatacactttgcggtggtaccatagagcagtgaccggttcgactgaggcatgccatccattcgtgtacgggggatgtggaggaaacgcaaatagattcggtacgcgagaggcgtgcgaaaggaggtgcccaccgagagtggtgcagagccagggcaccggaaccgcgcaggat

SEQ ID NO: 9564 - DNA, 8832 bp, Artificial Sequence
  Description of Artificial Sequence: Synthetic coding sequence
atgaccctgaggctccttgtcgcggccctatgtgccgggattttggccgaagcacctagagtgagggcccagcatagagagagagtaacctgtacccgactgtatgcagcggatatcgtgtttctcctggacgggagttcttctattggccgttctaacttcagagaagtgcgttcatttctggagggacttgtgttgccgttctctggggcagccagcgctcaaggcgtgcgctttgccaccgtccagtattctgacgaccccaggaccgaattcggtctagacgcattggggtccggcggtgacgtcattcgtgcaatcagggagctaagttataaggggggtaataccaggactggagctgcgatactgcacgtggccgaccatgtgttcctccctcaactagcacgacccggcgtccccaaagtgtgcattttgattactgatgggaagagccaggatttggtggatacggctgctcagaggttaaaggggcagggcgtgaaactgttcgcagtgggtattaagaacgccgatccagaggagctcaagcgcgttgcgtcccagcctaccagcgactttttcttcttcgtgaatgattttagcatattgagaacactcctaccactcgtctcccgacgggtgtgtactacagctggaggagtgcccgtgacccggcctcccgatgactcgacatccgctcctagagatctcgttctgtcagaaccaagcagtcaatccctgcgggtgcagtggacagctgccagcgggcccgtaactggctataaagtgcagtataccccattgactgggctgggtcagccccttccatcagaacgacaggaggtgaatgtgccagccggagaaactagcgttcgactgagaggtctccgaccactgaccgaatatcaggtgactgtgatcgccttgtatgctaatagcattggagaagccgtctccggcactgccagaactacagctttagaaggacctgagctgaccattcagaatacaaccgcgcacagcctactggtggcatggagatctgtccctggagccactggttatagggtaacttggcgagttctgagtggcggtccaacacagcagcaggagctcggaccgggacaggggtctgtcctgcttagagacttagagcccgggacggactacgaggtaaccgttagcactctctttggcaggtccgtagggcctgccactagcctcatggccaggactgacgccagcgttgagcagacccttaggcccgttatcttggggcctaccagcattctgctgtcctggaaccttgtacctgaggccagggggtatagactggagtggagacgtgagaccgggctggaaccaccgcagaaggtggttctcccatctgacgtcacacgataccagctggacggcttacaacccggcactgaataccgactgaccctttataccttgctggagggtcacgaggtggctacccctgccaccgtggttcccacagggccagaacttccagtctccccggttaccgacttgcaggcaactgagctgccaggtcagagagtcagagtgagttggtcccccgtccctggagccacacagtatcgaatcatcgtgagaagcactcagggcgtagaaaggactttggtgctaccagggtcccaaaccgcctttgacctggatgacgtccaagctggtcttagctatacggttcgcgtatcagctcgagtaggccctcgagagggatccgcgtctgtcctcactgtgcgtcgagaaccggagacccctctcgccgtgccgggcctgagagtggttgtgagcgatgctaccagggtgcgagtggcttggggcccagttcctggtgcctcgggttttcgaatttcgtggtctaccggaagcggaccagagtcctctcaaaccctgcccccggactcgaccgcgactgacatcacaggtctgcagcctggaacaacatatcaggtggcagtgtccgtattgcgaggacgggaagagggccctgcggccgtgatcgtagcaaggacagatccactagggccggtgcgtacggtgcacgtgacgcaggcttcgtctagctccgtgacaattacctggacacgggtccccggtgccactggatacagagtgtcatggcactccgcccacggacccgaaaagagtcaattggtgtctggtgaagccacagtcgccgagctcgatgggttggagccagacaccgagtacaccgtgcatgtgcgcgcccatgtggctggcgttgatggcccccctgcgagcgtggtcgtgcgaaccgccccggaacccgttggacgtgtgtcaaggctgcagatcctcaacgccagtagtgacgtgcttaggatcacttgggtgggtgtgactggcgctacggcttatcgactggcatggggccgatccgagggtggaccaatgcgacatcaaatcttacccgggaataccgattcagccgagatccgagggcttgaaggaggcgtgtcatatagcgtgagggtaaccgccttagttggagaccgagaaggaacgccagtctctattgtcgtgacgacaccccccgaggccccgccagccctcgggacactacatgtggtccagcgtggcgaacactccctgagattgaggtgggaacccgttccacgcgctcagggattccttctgcactggcagccagaaggagggcaggaacagtctcgagtgctcggcccagagctctccagttaccacttggacggactggagccggctacgcaatacagagtccgactcagcgttctcggacctgccggcgaagggccttctgctgaagtaaccgccaggacagaatccccccgtgttccctctatagagcttcgagtggtcgataccagtatagattctgtcaccctggcctggacccccgtttccagggcctcgagctatattttgtcttggagacccctgcgggggcctgggcaagaggtccccgggtcgccacagacgctccccggtatttcatcctcccaaagagttaccggtctggagcccggtgtgtcatatatcttctcgctgacgccagtactggacggtgtgagaggcccggaagcttccgttactcagacaccggtctgtccccgtgggcttgctgatgtagtcttcctgccgcacgcaactcaggataatgcacaccgagcagaggccacacggagggtattggaaaggttggtgctagctctggggccactgggcccacaagcggtgcaggtgggtcttctttcatactcgcatagaccttcgccactgtttccattaaatgggagccatgacttaggcatcatcctccagagaattcgagatatgccctacatggacccatccggtaataatctgggcacagcagtagtgacagctcacagatatatgctcgccccggatgcccccggcaggaggcaacacgtccccggcgtcatggtcctgctcgtagacgagcctttgagaggagacatattctcccctataagggaggcacaggcttcggggctcaatgtggtcatgctcgggatggctggggcggaccccgagcagctgcgaaggctggctcctggcatggattccgtacagacctttttcgctgtcgacgatggccctagcctggatcaggcagtcagtgggctggctacggccctgtgtcaggcgtcctttaccactcagccgcgccctgagccatgcccagtctactgcccaaaggggcagaagggggagccgggcgagatggggctacgaggccaggttggtccacctggagaccccggactgccgggacgaactggggcccccggtccccaggggccccccggatcggcaaccgctaagggcgaaagaggatttcccggcgccgacggtaggccgggctcccccggtcgcgcaggtaaccccggcactcccggtgcacctggtctaaagggaagtcctggccttccgggacccagaggcgacccaggagaaagaggtccacggggtcctaagggagaacctggagccccagggcaagtgattggtggcgaaggccctggtctccctggtagaaaaggcgaccctggccccagcggaccacctggcccacgaggaccactgggagatcctggtccgcgcgggccacctggcctacccggcactgccatgaagggcgataaaggggatcgaggagaacgaggaccaccgggacccggtgagggcggcattgccccgggcgagccagggctgcccggtttgcccggcagccccgggcctcaggggcctgtgggtccccccggcaaaaagggcgaaaagggcgactccgaagacggtgcccccggtctgcccggccagccgggcagccctggggaacaaggcccgcgagggcctccaggcgcgatcgggcccaagggagacaggggatttcccggcccgctgggagaggccggagagaaaggggaaagaggtccccctggacccgctggcagcagaggactgccaggggtcgccgggcgaccaggcgccaaagggcccgaggggcctcctggcccaacaggcagacagggcgaaaaaggggagcccggcagacccggggaccctgcggtggttgggcctgctgtggctggacctaaaggcgaaaaaggcgatgtcggcccagccggaccacgtggtgccacgggtgttcagggagagcgaggccctcctggtctcgtactgcccggggaccctggaccaaagggcgatcccggagatcgtggccctatcggcctgaccgggagagccggcccaccaggagactccggaccaccaggcgaaaaaggagacccgggccgacctggaccccctggcccggtgggacctaggggacgggacggagaagtcggggagaagggcgacgaaggccctccaggcgaccccggtctgccaggtaaggcaggtgaacgaggactccgaggagcaccgggcgtgagggggcccgtgggcgagaagggggaccagggcgacccaggcgaagacggaaggaacggatcacccggatcatcaggcccgaaaggagatcgtggagaacccggccccccaggccctccggggaggctggtggacaccggaccaggtgcccgcgagaaaggagagcctggcgatcgagggcaagagggtccaagggggcctaagggcgatccaggtctacccggagcgcccggcgagcgagggatagaaggcttccggggcccccccggccctcagggggaccctggtgtgaggggaccagccggggaaaagggtgaccgcgggcctccgggcctagacggccgatccggcttggatggaaagcccggcgcagccggcccaagcggacccaacggggcagcaggcaaagccggcgaccccgggagggatggtctgcctggcctgaggggtgagcaggggttacccggaccctccggccctcccggactgcccggaaaacccggagaggacgggaagccaggcctgaacggtaaaaatggcgaacccggagaccccggcgaagatggaaggaaaggcgagaagggcgactcaggagcctctggccgtgaggggcgagatggaccaaaaggggaaagaggcgccccaggaattctcgggccccagggccctccagggttacctggccccgtgggccctcctggccaaggttttccaggcgtacccgggggtacagggcctaagggagataggggagaaacaggctccaaaggcgaacaaggactgccaggtgagagaggcctgaggggtgaacccggttcggtgccaaacgtcgataggctcttagaaacagccggaatcaaggcctccgccctgagggaaattgttgaaacctgggatgaaagctccggcagtttccttccagtcccagagcggcgccgaggccctaaaggggatagcggagaacagggtccccccggcaaggagggaccaattggctttccgggcgaacgaggattaaaaggagacaggggtgaccccgggccccaggggccacccggactcgcattgggcgagcgagggccccctgggccttctgggctcgccggagagcctggcaaacctgggatcccgggattacctggtcgtgctggtggtgtgggcgaggccgggaggccaggcgaacgaggggaacggggggagaagggtgaacgaggggagcagggtagggacggcccacccggcctgcccggtacacccggtccccccggccctcctggaccaaaggtgagtgtggacgagccaggccccggtctgtcaggcgaacaggggcctccaggtctgaagggggcgaaaggagagccgggctctaacggagaccaagggcccaaaggggaccgaggggttcccgggataaagggggatcgaggcgagcccgggcctcgaggccaggacgggaacccagggctaccaggagaacgtggtatggccggtcccgaaggcaagcccgggctgcaaggacctcgcggtccccccggtcctgtaggaggccacggagatcctgggcccccaggagcccccgggctggcgggcccagccgggcctcagggccccagcggtctgaagggagagcctggggaaacaggccccccgggcagaggactcacgggccccacaggcgccgttggcctcccaggccctccagggccctcaggcttggtagggccacagggaagccctgggcttccaggacaggttggggaaaccggcaagcctggagcacctggtcgagacggtgcctctggcaaggatggggataggggcagcccaggcgtgccaggatctccagggctcccaggccctgttggtcctaaaggggaaccaggtccgaccggcgcacctgggcaggccgttgtcggcctgccgggagctaagggagaaaagggtgctcccggtggcctagcaggggacctggtcggcgaaccgggcgccaagggagatcgcggactgccaggcccacgaggagaaaagggagaagccggacgggctggcgaacccggcgaccccggcgaagatggccagaaaggggcacccgggcccaagggctttaagggcgatcccggagtcggtgtgcctggcagcccagggccccccggccctcccggcgtaaagggcgacctaggcctgccgggacttcctggcgcacctggagtcgtaggatttcctgggcagacagggcctcgtggggaaatggggcagcccggaccatctggcgagagaggactggccggccctcctggcagggaagggatcccagggcctctcggacctcctggcccccctgggtccgtcgggccaccgggagcctcaggactgaaaggcgacaagggggatccgggtgtgggcttgcctggcccaaggggtgagagaggtgagcctggaattaggggggaagatggacggccggggcaggaaggacccaggggcctcacaggccctcccggctcacgtggagaaaggggcgagaagggagatgtgggcagcgccggcttgaagggggacaagggggattcagcagttattctagggccgcctggacctcgcggggcgaagggagacatgggtgaaagagggcctcgcggcctagatggtgacaaggggccccgcggagacaatggcgatccgggtgataagggcagcaagggcgagcctggcgacaaggggtctgccggcctgcctgggctgaggggactgctgggaccccaaggccagccgggcgcggccgggatccccggcgaccctggatcccccggtaaagacggagtccccgggattaggggggaaaagggcgatgttgggttcatggggcccagaggccttaagggggaaaggggggtgaagggtgcctgcggcctagatggcgagaagggagacaagggggaggctgggcccccgggccgaccgggacttgcagggcataagggagaaatgggggaacccggcgtgcccgggcaatctggagctcccggcaaggaggggctaatcggccctaagggagatcgaggattcgatgggcaaccaggccccaagggcgatcagggggaaaaaggggagcgcggcaccccgggcatagggggttttcctgggcctagcggaaacgacggttccgccggtccgcctggccctccgggcagtgtaggaccaagagggcctgaagggctccagggccaaaagggcgaaaggggccctccaggggaacgcgtggttggcgctcccggagttcccggagcccccggcgagcgaggagaacagggccgacccggccccgcgggacccaggggagaaaagggggaagcagccttaaccgaggacgatattagaggattcgtccgccaagaaatgtcccaacactgtgcttgtcaggggcagttcattgccagtgggtcacgacctctgcccagctatgctgccgacaccgctggttctcagctacatgccgttccagtgctgcgagtgagccatgcagaagaagaggagcgagtcccccctgaggacgatgagtacagcgaatattccgagtactccgtcgaagaatatcaggacccggaagctccatgggactcggatgatccctgtagcctccctctggacgagggttcctgcacggcgtacaccttgcggtggtatcatagagcagtgaccgggtccaccgaggcatgtcatccctttgtgtatgggggctgcggaggcaatgccaaccgattcggtactagagaggcttgcgaaagaaggtgcccaccaagagtggtccagtcccagggcaccggaacagctcaggac

SEQ ID NO: 9565 - DNA, 8832 bp, Artificial Sequence
  Description of Artificial Sequence: Synthetic coding sequence
atgactcttagactgctggtggcagcactgtgcgcaggaattctggccgaagcaccccgcgtgagggcccaacatcgggagagagtgacttgtactaggctttatgcagccgacattgttttcctgcttgatggttcctcgtcaattggacggagcaattttcgcgaggtgcggtcctttctggagggacttgtcttgccattttccggagcagccagcgcgcaaggtgtccggttcgctaccgttcaatacagcgatgacccacggaccgagttcggtcttgacgcgctgggaagcggtggagatgtgatacgggccatcagagaattgtcgtataagggcggaaatacgcgcaccggcgctgccattctgcatgtggcagatcatgtctttctgcctcaactcgccagacctggggttcctaaggtgtgtatcctcattaccgatggtaagagccaagatctggtggatactgctgcacagagactgaagggacaaggtgtcaagctgtttgccgtaggtatcaagaacgcagatcctgaggagctgaagcgagtggccagccaacctacgtcggatttctttttcttcgtgaatgacttctcgatactgcgcactctgctgcctcttgtgtcacggcgcgtgtgtactaccgccggcggagtgcctgtgactcggccccctgatgactcaacctccgccccgagagatttggtgcttagcgaaccgagctcacagtcgctgcgagtgcagtggacggcagcatcgggaccggtcactggctataaggtgcagtacacccctttgaccggactcggtcaaccactcccttccgagaggcaagaagttaacgtgccagctggcgagacttccgtgcgcctgagagggcttcgtcctcttaccgaataccaagtcaccgtgattgcactttatgcaaattccattggggaggcagtgtccggtaccgcacgaaccactgcattggagggaccggaactcactatacagaacacgactgcacattcgctgctggtggcctggagatcggtgcctggagctaccggttaccgtgtcacttggcgcgtcctttcgggaggtccaacccaacagcaagagcttggacccggtcaaggtagcgtgttgcttagagatcttgagcctggaaccgactacgaggtgaccgtctcgacgctgttcggccgctcagtggggcctgctacttccctgatggcaagaactgatgcatccgtggaacagacgcttagacccgtcattctcggtcctacctcgattctgttgagctggaaccttgtccctgaagccagaggatacagactggagtggaggcgtgaaaccggtcttgaacctccgcaaaaagtcgtgctgccatcagatgtgacgagataccagctggacggacttcaaccgggtaccgagtaccgactcaccctgtacaccctcctcgaaggacacgaggtggcgacccctgctactgtggtgccgaccggtccagagcttcctgtgtcgcccgtgaccgacctgcaagcaactgagcttcctgggcagcgcgtgagggtttcgtggtcccctgtgccaggggcaacccagtacagaatcattgtgcggagcactcaaggagtcgaaaggaccctggttctccctgggtcccagactgcctttgacctggacgatgtccaggctggtctttcgtacacggtgagggtatctgcacgggtaggccctagagagggctccgcaagcgtgctcactgtgaggcgggaacccgaaacccctctcgcagtgccaggtctgcgagtggtcgtgtcagatgcaacccgtgtccgtgtggcctggggacctgtgcccggagcgtccggcttccggatctcttggtcaactgggtccggacctgaatcatcgcaaactctccctcccgatagcactgcaaccgatattaccgggctccaaccgggaactacgtaccaggtggctgtgtcggtgctccgaggacgagaagaaggtcctgcagccgtcatcgttgcgcgtactgatccacttggtcctgtacgaactgtgcatgtgacgcaggcctcctcctcctcggtgactataacttggacgagagtcccaggcgcgaccggttacagggtgtcatggcacagcgcacacggtccggagaaatcccaacttgtcagcggtgaggcaaccgtggcggagttggatgggctggaaccagacaccgaatacactgtccatgtgagagcacatgtggccggtgtggatggccccccagcctccgttgtggtgagaactgcccctgaaccggtggggagggtatcccgactgcaaattcttaacgcctcgtctgatgtgcttcgcattacctgggtgggagtgaccggtgcgactgcataccgccttgcctggggacgctccgaaggaggacctatgaggcatcagattcttcctgggaacaccgattcggcagagatccgcgggcttgaaggaggggtgtcatactcggtccgggtgaccgcactggtgggtgatagagagggaactccggtcagcatagtcgtcaccactcctccagaggcacctcccgcactggggactcttcacgtcgttcagaggggagaacattcccttcgcctgcggtgggaacccgtgcccagggcgcaaggatttcttctccattggcagcctgaggggggacaggaacaatcacgggtgctcggtccagaactgtcgtcctaccatctggatggactcgaacctgcaactcagtatagagtgcgtctgtcggtgctcggccctgcaggtgaaggccctagcgcagaagtcaccgctagaactgagtcacccagagtgccttcgatcgaacttcgcgtcgtggatacttctatcgattccgtgaccctggcatggacgccggtgtcaagggcgtcgtcctacattctctcttggcgtccgctgcgaggccctggtcaggaagtgcctggatccccgcagacgttgcctggcatctcatcgtcccagagggtgaccggcttggaacccggtgtgtcttacatcttttcacttaccccagtccttgatggagtccgaggtcctgaggcgtcggtcactcagacccccgtctgcccacgcggacttgcagatgtggtgtttctgccgcatgcaacccaagataacgcccatcgcgcagaagctactcgccgcgtgctggaacgtctggtgcttgccctggggcctctgggaccacaggcggtgcaggtggggctcctgtcctattcccaccgcccctcccctctctttcctcttaacgggtcgcacgatctgggcatcatcctgcagcgcatcagggatatgccatacatggacccgtccggaaacaacctcggaaccgcagtggtcacggcacatcgttacatgttggcaccagatgcaccaggacgtagacaacacgtccccggagtcatggtcctgctggtggacgagcctttgagaggcgacatctttagcccaatccgggaggcccaagcatccggactgaacgtggtgatgctgggcatggcaggggcagacccggagcagctgcggcgccttgcaccaggtatggactcagtgcaaactttctttgcagtcgatgatggtccttcacttgatcaagcagtgtctgggttggccaccgcgctctgtcaggcatcgtttactacccagccacgaccagaaccttgccctgtgtactgtccaaagggtcaaaagggagaaccgggagaaatgggacttagaggacaggtaggacctccgggggatcctggcctgccaggcagaactggagcccctggtcctcaaggaccaccgggatccgcaaccgcaaaaggtgaacgaggtttccccggtgcagacgggcgaccagggagccctgggagagcagggaatcctgggacgcctggtgcgcctgggctcaaaggttcacccggattgccggggcccagaggtgacccgggtgaaagaggtccacgcggaccaaagggcgaacccggggctccgggtcaggtgattggcggagagggaccaggactgccaggtcgaaaaggggatcccggaccctccggaccgccagggccacgcgggcccttgggagatccaggccctaggggtccaccaggcctgcctggtaccgcaatgaaaggcgacaaaggagataggggagagcgtggacctccaggaccaggagaaggtgggatagcccccggtgagccaggactgcccggtctgccaggttcgccgggaccccaaggtcctgtcggaccgccgggcaagaagggagaaaagggagattcggaagatggcgccccgggacttcctggacaacctggcagcccaggagaacagggtccaaggggaccacccggtgcaatcggccccaaaggagatcggggatttcctggacctctcggtgaagctggggaaaagggggaacgaggacctcctgggcccgccggctcccgtggactccctggggttgccggaaggcctggtgcgaagggaccagaggggcctccaggaccaactgggcgccagggagagaaaggagaaccaggcagacccggtgatcctgccgtggtggggcctgctgtggcaggtccaaaaggagagaaaggggatgtggggccggcgggaccccgaggagcaaccggggtccagggtgaacgggggccacctgggctggtgctgcccggtgaccccggtcccaaaggtgaccctggagatagaggtccaatcgggcttaccggcagagcaggacctcctggagactccgggccgcctggagaaaaaggtgaccctggacgtcctggaccacccggcccagtcgggcccagaggtcgggatggtgaagtgggcgaaaaaggcgatgaaggacctcccggcgatcctggccttcctggaaaggcaggcgaaagagggctgcgtggcgcgcctggggtgagaggacccgtcggagagaagggtgaccaaggagatcccggtgaggatggtcgaaatggatcccctggctcaagcggtccaaagggagatcgtggagaacctggtcctccgggtcctcctggcaggcttgtggatactggaccaggagccagggagaagggggaaccgggtgaccgaggtcaagaaggacctcggggtcctaagggagatcctggactccccggtgcgcccggtgaaagaggaattgaaggctttcgtgggcctccaggccctcagggagatcccggggtccgcgggccagcaggtgagaagggagacagaggacctccgggactggacggtcgctcgggacttgatggtaagccaggtgcagcgggcccatcaggtccaaatggtgcggcaggcaaagctggagatcctggtagagatggactgcctgggctccgcggagaacagggcctgccagggccgtcaggacctccagggcttcctggtaaacctggtgaggacggtaagcccggcctgaacggaaagaacggcgaaccaggagatcccggagaagatggaagaaagggtgagaaaggggattccggagcatcgggacgggaggggcgggacggaccgaagggagaacggggcgccccgggtattctcggaccacaaggacccccaggactccccggacctgtcggacctcctggacaaggattcccaggagtgcctggaggtaccggcccgaagggcgaccgcggagaaaccggtagcaagggcgaacaaggcctcccaggggaacgcggtttgcgcggcgagcctggttcagtgccaaacgtggatagactccttgaaactgcaggcattaaagcaagcgcactgcgggagattgtggaaacgtgggacgagagcagcgggagctttctccctgtgcctgagaggcgcagaggacccaagggtgattccggcgaacaagggccgccaggaaaggaagggccaataggtttcccaggcgaacggggcctgaagggtgacagaggcgacccgggaccgcagggtccacccggactggcactgggggagagaggtccacctgggccttcgggcctcgccggagaacctggaaagcctggaatcccaggtttgcccggtagggccggtggtgtcggagaggcaggtcgaccgggggaacggggcgaacggggtgaaaagggcgaaagaggtgagcaaggcagggacggaccccctggactgccaggcacccccggaccgcccggcccaccaggtcctaaagtctcggtcgatgagccgggtcctggcctcagcggagagcagggaccgccaggcctgaagggcgctaagggggagcccgggagcaatggcgatcaaggtcccaaaggggaccgcggcgtgccaggtattaagggagatagaggggaacccggccccagaggacaagacggcaatcctggtttgccaggagaaaggggtatggcaggtccagaaggtaagcccggactccaaggaccaagaggacctcccggaccagtcggaggccacggagatcctggacctccaggagcacccggccttgcaggtcccgcagggccccaaggcccatctggtcttaagggggaacctggggaaaccgggccaccaggtagaggtcttaccggaccaaccggggccgtggggctgcccggtccgccaggcccgtctggtctggtgggaccacaaggtagtcctggattgcctggccaggtgggagaaactggaaagcctggagcgcctgggagagacggtgcaagcggaaaagatggtgacaggggttcaccaggagtcccaggttctcccgggctgcctggaccagtgggcccaaagggagagcctggacccactggagcacccggacaagcagtagtgggacttccgggggccaagggtgagaagggagcccctggtggactcgccggtgaccttgtgggggaacctggcgcaaaaggagatcgagggcttcccggaccccgtggagaaaagggggaggctggacgtgccggagaacctggagatcctggtgaagatggacaaaagggagcacctggcccaaaaggatttaagggggatcccggcgttggcgtgccggggtcgcctggtcccccaggccctccaggagtcaagggtgacctgggcctgcccggccttcccggcgcaccgggagttgtggggtttcctggtcaaaccggccctcggggtgaaatggggcagcctggccccagcggtgaacgtggtcttgcgggacctcctggccgggaaggtatccctggcccacttggccctccgggtccgcctggatcagtcggacccccaggtgcctcaggcctcaagggggataaaggggaccctggcgttgggctccctggacctcgtggtgaaaggggcgagcctggaatacgtggagaagatgggcgtccgggacaggaaggtccccgcggactgactggccctcctgggtcacgcggtgaacgcggggagaagggtgacgtcggcagcgcaggactgaagggagacaaaggtgatagtgctgtgattcttggcccgccgggacccagaggggcaaagggtgatatgggagaacgggggcctagaggtttggatggagacaaggggccgcggggcgataacggcgacccaggggacaaaggttccaagggtgagccgggtgacaagggaagtgctggacttcctgggctgagaggacttcttgggccccagggccaaccaggggcagccgggattccaggtgatccaggatccccaggaaaggatggcgtgcctgggattagaggagagaagggcgacgtcggattcatgggtccacgcggcctcaagggcgaacgcggtgtcaagggtgcctgtggactcgatggagagaaaggagataaaggagaagctggcccacccgggcggccaggactggcaggccataaaggggaaatgggcgaacccggggtgcccggtcaaagcggcgcaccaggcaaagaaggtctgattgggcccaagggagatagggggtttgatggtcagccagggcctaaaggagatcagggcgagaaaggcgagcgcggaaccccaggaattggtggctttccaggtccctccggtaacgatggttcggcgggtcctccagggccacctggttcagtcgggcctcgcggacccgaaggcttgcaaggacagaaaggggagcggggtccaccaggcgagagggtggtcggagcgcctggtgtccctggtgcacctggagaacgtggtgaacaaggtaggccgggaccagccggacctagaggagaaaaaggtgaagccgctcttaccgaagatgacattcgtggtttcgtgcggcaagaaatgtctcaacactgtgcctgccaaggtcagtttatcgcaagcggatcgcgccctctcccatcatacgccgcggataccgccggatcccaactgcacgcggtgcctgtgttgagagtgtcgcatgctgaggaagaagaacgtgtgccacctgaggacgacgaatacagcgaatactccgaatactcggtcgaggagtaccaggatcctgaagcgccgtgggacagcgacgatccatgttccctgccacttgacgaaggctcgtgcaccgcatacactcttcggtggtaccacagagcagtgactggctcaaccgaggcgtgtcatccgtttgtgtacgggggttgcggaggaaacgcaaataggtttggtactcgtgaagcatgcgaacggcgttgcccccctcgagttgtccagtcccagggtaccggaaccgctcaagac

SEQ ID NO: 9566 - DNA, 8832 bp, Artificial Sequence
  Description of Artificial Sequence: Synthetic coding sequence
atgaccctgaggctgttggtggccgcactgtgcgcggggattctggcagaagctccaagggtgagggcccagcaccgggaaagggtgacttgtacaaggctctatgcagccgatatagtgttccttctggatggaagctcttccatcggtaggtccaactttcgtgaggtcaggtcattcctagagggcctcgtgctgcctttctctggtgccgcatccgcgcagggcgtgagatttgccactgtacagtactccgacgaccctcgaaccgaattcggactcgacgctctgggctccggtggagacgtgatcagagctattcgcgaacttagttacaaaggaggaaacactcgcacaggtgccgctatccttcacgtggctgaccatgtgtttctgccccaacttgcgagaccgggtgttcccaaagtgtgcattctgatcaccgatggaaagtcccaggatcttgtggacaccgcagcacaacgcctcaagggtcagggtgtgaagctcttcgctgtgggcatcaagaacgctgaccccgaagaactcaaaagagtggcaagtcaacctactagtgactttttttttttcgtgaacgattttagcatcctcaggaccctgctgcctcttgtaagcagacgcgtctgcactacagccgggggagtgccggtgacaaggccgccagacgactctactagtgccccacgggacctcgtcctatctgaaccttcctctcagagcctccgggtgcaatggacagctgcctcgggaccagttaccggatacaaggtgcagtacacgccacttactggcctcgggcagcccctgccttctgaacggcaagaggtgaatgtaccagcgggcgaaacctccgttaggctgaggggcctgcgccccctgactgaataccaggtgactgtgatcgccttatacgctaattctataggggaagccgtatccggaactgccagaacaaccgccctagaaggcccagaattgacgatacagaatactacagcccacagtctgttagttgcttggaggagtgtgccaggggcaactggttatcgcgtgacctggcgtgtgctttctggcggccctactcagcagcaggagttaggacccgggcaggggtccgtcctgttacgggacctcgaaccaggaacagattatgaagtgacagtgtcgactctgtttggcagatcagtcggtcctgcaacgtcactgatggcccggactgacgcctctgtggagcagaccctgcgaccagttatcctaggacctacctcgatattgctctcatggaatctcgtgccggaggctagaggctaccgccttgagtggcgccgcgagaccggactagaacccccccaaaaagtcgttcttccttcagatgtgacccggtatcaactggacggactgcagcccggaacagagtatagacttacattatatactttgttagaagggcacgaggtggctacaccagctactgtagttccaacggggccggaattgcccgtttcaccagtgactgatctacaagctaccgaattacccggccagagggttcgcgttagctggtcacccgtcccaggtgctacccagtaccgaatcattgtgcggtctacacagggagtagaaagaacgttggtcctgcctggaagccaaacggcgttcgacctggacgacgtgcaggccggcctgtcatacactgtccgggtgagtgccagagtcggaccacgagagggctccgcctctgtgctgactgtacgcagagagcccgaaacacctctggccgtgcccggactgagggtggttgtctcagatgcaaccagggtaagagtggcatggggtccagtgcccggcgcctcagggttccgcatctcttggagtaccggatccggtcccgagagttcccagactcttcctccagactctaccgccacagatatcaccgggttgcagcctggaaccacctaccaggttgccgtgtcggtgttgaggggtcgcgaggaagggcctgccgctgttatcgtggctcgtaccgatccacttgggcctgtacgaacagttcacgtgacgcaggcaagtagcagctcggtcactatcacctggaccagagtccccggagcaaccgggtatcgagtttcctggcattccgcccatgggcccgagaagagtcagctggtgtcaggggaggcaaccgttgccgaacttgatggattggaacctgacacagagtacaccgtgcacgtcagagcccacgtagccggcgtagacggacctcccgctagtgtcgtggtccgaaccgccccggagcctgtgggtagagtgagcaggttgcaaatcctgaacgccagttctgacgtgctgaggatcacttgggtgggggtaacaggcgcgacggcatatcgactcgcgtggggacgttcagagggaggacccatgaggcaccaaattctgccaggtaacaccgactctgccgaaattcgcggactggaaggaggagtctcatatagcgtccgggtgacagcgctagtgggtgaccgtgagggtacccccgtgtcaatcgttgtgaccacccccccagaggccccgccggcactggggacacttcatgttgtccagagaggagagcatagcctgaggctccggtgggagcctgtcccgcgtgcccagggctttcttctgcattggcagcccgagggcggtcaggagcagagccgggtgctgggcccagaactgagctcatatcacctcgacggactcgagcctgccactcagtaccgcgtccgcttgagcgtgttaggtcccgcgggcgaaggcccatcggccgaagtaacagccagaacagagagcccccgagtgccctcaatcgaattacgggtcgtcgatacttcgatcgatagcgtcacactggcttggacccccgtctccagagctagttcatatattctgtcttggcgacccctgcggggtcctggccaggaggtacctgggtcacctcagacactacctggcatatcaagttctcaacgggttacaggcctcgaaccgggcgtgtcttatatcttttccctcacccccgttctggatggcgttcggggccctgaagcctcagtcacccagactcccgtgtgcccacggggactggcggacgtggttttcttgccacacgcgacgcaggataatgcacatcgagccgaagccacccgaagggttcttgagcggctagtcctggccttgggacctcttgggccccaagcagtgcaggttggcctcttgagttactcccacaggccttcacctctgttcccactaaacggctcgcatgaccttggtatcattctacagaggatccgagatatgccatatatggacccatccggtaacaaccttggaaccgctgttgtcaccgcccaccggtacatgttagcccctgacgctccagggcgcaggcagcacgtccccggagttatggttcttttggtggacgagccactgagaggagatatctttagtccaattagagaggcccaggcgtccgggctgaatgttgtgatgctaggcatggcgggcgccgacccagaacagctgcgtcgtctagccccaggcatggatagcgtgcagactttcttcgcggtcgatgacggaccaagcctagatcaggcggtttctggtctcgcaacagctttatgccaagcctctttcacgacccagcccaggcccgagccatgccctgtttactgccctaaggggcagaagggggagccgggagagatgggccttagggggcaagtcgggccacccggagatcccgggctaccagggcgcactggtgctcccggcccccagggcccgcccggctccgcaaccgcgaaaggtgagcgcggctttcctggagcagatggacgcccgggctctccaggtagggccgggaaccctggaaccccaggcgctcccgggttaaaaggctccccggggctgccgggtccgcgtggcgaccctggggaacggggaccaagaggtcctaaaggggaaccaggtgcgccgggacaggtgattggaggagagggccccggtcttcctggcaggaagggagacccaggcccctcaggaccccctgggccacgtggcccactaggtgacccagggcctcgagggccgccagggctgccaggcactgccatgaagggtgacaaaggagaccggggagaaagggggccacctgggcctggcgagggaggcatagccccaggcgaacccggcttaccaggtcttcccggttcccccgggcctcagggcccagttggtcctccgggtaaaaagggggaaaagggcgacagcgaagatggagcacccggcctgcccggtcagccaggtagccccggtgagcagggtccccggggtcctccgggtgccatagggcctaagggcgataggggatttcctggtcccctgggcgaggcgggcgagaagggggagaggggcccaccagggccagctgggtctaggggactgcccggagtggcaggcaggcctggagctaagggacctgagggcccccctggccccactggaaggcagggcgagaagggggagccagggaggccaggggatccagctgtggtagggcccgccgtggccggccccaaaggagagaagggggatgtggggcctgccgggccacgcggagctacaggagtgcagggcgaacggggtccgcccggcttggtgctgccaggcgatcctggaccaaaaggggaccccggggatcgtgggccaattggattgacagggcgcgctggaccacccggagattccggtccaccaggagagaagggggatcctggacggccaggtccccctggccctgtggggccgagaggccgagacggagaagtcggcgagaagggggacgagggccctccaggagacccgggtctgcccggcaaggccggcgagaggggactgaggggagctccgggcgttaggggacccgttggcgaaaagggggaccaaggcgacccaggtgaggacgggcgaaacggcagcccaggatccagcgggcccaagggtgatcgcggcgagcccgggcccccaggccccccggggcgactggtggacacaggccccggtgctcgcgaaaagggagaacctggtgaccgcggccaggaggggccgcgggggcccaagggcgatccaggtttgcccggagcaccaggggagagaggcatcgaagggttccggggaccacccggcccgcagggagacccaggcgtgcgaggccctgcaggtgagaagggggatcgggggcctccaggactggacggacgtagcgggctcgacgggaagcccggagccgcggggccatcaggccccaatggagccgctggaaaagccggtgaccccggacgcgatggtctccctggtctgcggggagagcaagggctgccagggccttccgggccacctggcctgcctgggaagcccggggaagatggaaagcccggtctgaatggaaaaaatggtgagccaggcgaccccggggaagatggcaggaagggtgagaagggagatagtggcgcatctggccgagaggggagggacggtcccaagggcgaacgtggcgcaccgggcatcctcggcccccaagggccgccgggactccctggccccgtggggccgccgggtcagggtttcccaggggtgcccggtggaaccggccccaagggggaccgtggcgagacaggcagcaagggagagcagggcctgccaggcgaacgtggcctgagaggcgagcctggatctgtgcccaacgttgaccggctgcttgagacggcgggcatcaaggctagcgcactgagggagattgtggagacgtgggacgagagtagcgggagcttcctacctgtgcccgaacgccgcaggggccccaaaggtgattcaggagagcaggggccccccggcaaggagggacccatcggatttccaggggagcgaggcctgaagggagaccgcggtgatccaggcccccagggacccccaggtctcgccctaggagaacggggccctcctggtccgagcggtcttgcaggtgagccagggaaacccggcatccctggccttccaggaagggcagggggtgttggtgaagccggccgaccaggggagagaggcgagcgcggggagaagggagagcgcggggagcaaggcagagacggcccacctgggcttccagggactccaggaccaccgggacctccaggtccgaaagtgagcgtcgacgagcctggacccggcctcagtggcgaacaggggcctcccgggctgaaaggcgctaaaggcgagccaggctctaatggagatcaaggtccgaagggtgatagaggcgttccaggaattaaaggagaccgtggggaaccaggaccccgcggccaggatggaaatccaggtctgccaggcgaacgcggtatggccggacccgaagggaaacctggtctgcagggcccccgcggcccacctggcccagtgggaggtcacggcgaccccgggcctccaggggcccctgggctggccggacccgctggtccccagggtccttctgggttgaaaggcgagcccggcgagacgggtccccccggcagaggtttaacgggcccaacgggggcagttggactccccggaccccccgggccctccggactcgttggacctcagggctcacccggcctgcctggccaggtaggcgagacaggcaaaccaggcgcccccggccgggacggagcaagtggtaaggacggagaccggggatctcccggagtgccgggtagtccgggattgcccggcccagtggggcccaaaggggaaccaggacccacaggtgctcccggccaggctgttgtcggattgccaggagccaaaggagagaaaggtgcacctgggggactggccggcgacctcgtgggcgaacccggcgccaagggtgaccgaggcctccctggaccacgtggggagaagggtgaggccggccgagccggagagcccggggaccccggcgaggacggccagaagggagccccagggcctaagggatttaagggagacccaggcgtgggcgtgccaggttctcctggtcccccaggtcctccgggcgtgaagggagatctggggctgccaggccttcccggggcccctggggtcgtgggcttcccaggtcagacgggcccacggggggagatggggcagcccggaccctctggggagcggggactggcaggacccccaggacgggaaggcatccccggtccactgggcccccctggtcccccgggctctgtcggaccgcccggagcaagcggtctcaaaggggataagggagatcctggcgtgggcttgcccggacctcgcggcgaaaggggagagcccgggatccggggagaggatggccgaccaggccaggaaggcccccgaggtctgactggcccccctggatcaaggggtgagcgcggagaaaaaggcgatgtgggttcagctggactgaagggggataaaggagacagcgctgtgatcctcggcccacctgggcctaggggagcaaaaggcgatatgggggagcgaggccccagaggactcgacggagataaaggcccccgaggcgacaacggagaccctggcgataagggttcaaagggggagccgggggacaagggctctgcgggactgcctggactgcggggactgctggggccccaaggacagccgggagcagcaggcatcccgggcgatcctgggtccccgggcaaagatggagtccccggtatccggggcgagaagggcgacgtcggttttatgggacctagggggctgaagggggagcgcggcgtgaaaggagcctgcgggcttgacggggagaagggtgacaagggggaggctggcccccctggcaggccaggcctggccggacataaaggagagatgggtgagccgggcgtccccggccaatctggggcacccgggaaagagggacttatcggaccaaagggggacagaggctttgatggacaaccgggcccgaagggggaccaaggggaaaagggcgagcggggcactccgggcatcggaggatttcctggtccttccggaaacgacggctccgccggccccccggggcctccaggaagcgtcgggcctagagggccggagggcctgcaggggcagaagggagagcggggcccaccgggcgagagagtggtaggggcgccaggcgtcccaggcgcgcctggtgaacgcggcgagcaggggagaccagggcctgccggccccaggggggagaagggtgaagccgcactgaccgaagatgacattcgtggcttcgttagacaggaaatgagtcaacactgtgcttgccaaggtcagttcatcgcatccggctcaaggcctctcccgagctatgctgcagataccgcgggaagccagctgcatgctgtgccagtgctgagagtaagtcacgctgaggaggaggaaagagtgccccctgaagatgacgaatacagtgaatactctgagtactcagtggaagaataccaagaccctgaggccccttgggattcggacgacccatgtagcctgccattagatgagggctcctgtactgcctacacgctacggtggtaccaccgcgctgtgacgggaagtactgaggcgtgtcaccccttcgtgtacgggggatgtgggggcaatgcgaaccggtttggcacacgtgaggcctgtgagcgccgttgtccaccccgtgttgtccagagtcagggaaccggaactgcccaggac

SEQ ID NO: 9567 - DNA, 8832 bp, Artificial Sequence
  Description of Artificial Sequence: Synthetic coding sequence
atgacgctgagacttttagtggctgctctatgtgcgggtattctggcagaggctccacgcgtgcgagcgcagcatcgtgagcgggtcacctgtactcgtctttatgctgcagatatagttttcctccttgatggatctagttcaatcggaagatctaattttcgtgaagtaagaagttttctagaaggtctagtactaccgtttagtggagctgctagcgcccagggtgtgagatttgccacagtgcaatatagcgatgatccgaggacagagttcggattggatgcgcttggaagcggtggagacgttattcgggccatcagggagttgtcatataagggagggaatacgagaacaggagcagctattctacacgttgccgatcatgtctttttaccacaactggcccgtccgggagttccaaaggtgtgcattttgatcaccgatggcaagtctcaagatttagtggatacagctgcacagagattaaaaggacaaggagttaagctttttgcagttggaattaaaaacgccgatccagaggagcttaaacgcgttgcttcgcaaccaacctcggatttcttcttttttgttaacgatttctccattctacggaccttgcttccgcttgtgtctcggagagtatgcacgactgctggaggtgtcccagtgacacggccgccggatgattcaacatctgctccacgtgatctagtgctatcagagccatcatcccagtcccttcgggtgcagtggacagcagcttcaggtccagttaccggatacaaagtgcagtacactccgctcacgggtctcggccaacctctcccaagcgaaagacaagaagtaaatgtcccagctggagaaaccagtgtacgattgcgtggtctcagaccacttacggaataccaagttacagtgatcgcattgtatgccaattcgattggagaggctgtttcgggaaccgctaggacaacagcactagaaggaccagaacttacaatccagaacactactgcccattctttgttggtggcttggcggtctgttccaggagccacgggatatcgggttacttggagagttctcagtggggggccaactcagcaacaggagcttggtccaggacaaggctcggtgttattaagagatctcgaacctggaacggattacgaagttacagtctcaactcttttcgggcgatcagttggacctgctacttcgctcatggctcgcactgatgctagcgttgagcaaacacttcgaccagtaattttaggaccgacatcgattctactgtcttggaacttggtgccagaggctcgagggtatcggcttgaatggcgacgggaaacaggtctagagccacctcaaaaggttgtcctgccaagtgatgttacaagataccagctagacgggctacagccaggaaccgaatataggttaactctttatacacttctcgaaggacatgaggtggcaaccccagctacagttgtgccgactggaccagaactgccagtctctccggtgacagacctacaagctacagagctaccagggcagcgagtccgggtttcgtggtcaccagttccaggagcaacccagtatcgaattatagtgcgttcgactcagggagtggagcgtacattggttctaccaggcagccaaactgcttttgacctcgatgatgtccaggctggactctcgtatacagtgcgagttagtgctcgagtgggaccacgagagggtagcgcatctgtacttacagtccgcagagaacccgaaacacctttggctgttcctggattgcgtgtggtagtttcggatgcaactagagtacgtgttgcttggggaccagttccaggagcttcaggattccgaatctcatggagtaccggatctggaccagagtcatcacagactttgccacccgattcaaccgccacagatatcactgggttgcaaccaggaacgacttatcaagtcgctgtaagtgtgcttcgagggagggaggagggtcctgcagctgtcattgtcgctcgaactgaccctttaggaccagttagaactgtacatgtgacgcaggcgtcctcgtcatccgtgacaattacttggacaagagttccgggtgctactggttatagagtgtcgtggcattcagcacatggtcctgaaaaaagtcaattggtcagtggcgaggcgacagtcgccgagcttgatggattggagccagacaccgaatatacggttcatgtacgagcccacgttgctggagttgacggacccccagcatctgttgtggtaaggaccgcccctgaaccagtcggacgtgtttcaagactccagattctaaatgcttcgtccgatgttttgcgtattacttgggtcggagtaactggagctactgcttatagactagcttggggaagatcagaaggagggccgatgagacatcaaattttgccagggaatactgactccgctgagattagaggactggaaggtggtgtatcatattccgttcgggtcaccgcacttgtgggagacagagagggaacgccagttagcatcgttgtgacgacgccaccagaggcaccaccggcactgggaacattgcatgttgtgcaacggggggagcattcgttgagactcagatgggaaccagtgccaagagcccaagggtttttgcttcattggcaaccagagggtggccaagagcagtctcgtgttctcggaccagaactgtccagttaccacctggatggtcttgaaccggcaacgcaatatcgagtccggctttcggtcctcggaccagcgggcgaaggaccaagtgcagaggtaactgctagaacagagtctccgcgggttccaagcattgaactgcgtgttgtggatacaagtattgatagcgtaactctagcttggacgccggtctctagagcgtcgtcatatattttgagctggcggcctcttagaggtccaggacaggaagtgcctggatcaccacagactctcccgggaatctcaagttcacaacgtgttacaggactggaaccaggagtgtcttacattttttcccttacgcctgtgttagatggcgttcgtggacctgaagccagcgttacacagacgcctgtatgtccgcgaggtttagcagatgtcgtgttcttgcctcatgccacgcaagataatgctcatagagcggaggcgacgaggagggtattggagaggcttgttctagcacttggacctcttggaccccaggcagtccaagttggattactaagttattcacaccgcccatcaccactatttccacttaacggtagccacgatttgggaataatcctccagcgtatccgtgatatgccatacatggacccatcggggaataacttgggaactgcagtggtgactgcacatcgttacatgctggcaccagatgcaccgggacgtcgtcaacacgtacctggagtgatggtattgttggttgatgaacctttgcgaggagatattttctccccgattagagaggcccaagctagtggacttaatgtggtcatgttgggaatggcaggggcagatccagagcaacttcgtagattggcccccggaatggatagtgtccagactttcttcgcggttgacgacggaccctcgttggaccaagctgtgtcgggtctggcaacagctctctgtcaggcctcttttacaacacagccacgaccagaaccttgcccagtatattgtccaaaaggtcaaaaaggagagccgggagaaatgggacttcggggccaagtgggacctccaggggatcccggacttccaggcaggacaggcgcgcctgggccacagggaccaccaggcagcgcaactgcgaaaggagagcgaggatttccgggtgctgatggtcgaccaggttcgcctggacgtgcaggaaatccgggtacaccgggagctccaggtctcaaaggcagcccaggtttgccagggccacgaggcgatccaggagagcggggtccaagaggcccaaaaggagagccaggcgcacctggacaggttatcggcggtgaaggaccaggactgccagggcgtaaaggagaccctggtccatctggtccacctggacctaggggaccattgggagatccaggtcctcgcggaccgccagggctgccaggaacagctatgaaaggagataaaggtgaccgtggagaaagaggaccacctggacctggtgaaggaggaattgcgccgggagagccagggcttccaggattgcccggctcgccagggcctcaaggacccgttggtcccccaggaaaaaaaggagagaaaggagactcagaagacggagccccaggactcccaggacaaccgggttctccaggtgagcaaggcccacgaggacctcctggggctattggtccgaaaggagacagaggatttccaggtcctcttggagaagctggagaaaagggagaaagaggaccaccaggtcctgctggatcacgaggactcccaggtgttgcaggaagacctggagcgaaaggaccagagggtcctccaggacctaccggacgtcaaggtgaaaagggagaaccaggaagacctggagatccggcagttgtaggacctgcagttgccggtccaaagggagagaaaggagacgtgggaccggcaggtccacgtggcgctacaggagttcaaggagagagaggaccaccgggattggttctacccggagatccaggaccaaaaggagacccaggagatcgtggaccaatcggcctgaccggacgagccgggccaccaggtgattctggaccaccaggagaaaaaggagatccaggccgcccaggcccaccaggaccagtgggacctagaggaagggacggcgaggtgggagagaagggagatgagggaccaccaggtgacccagggcttcctggaaaggcaggagaaagaggactcagaggtgcgccaggcgtgagaggaccagttggagaaaaaggtgaccaaggggatcctggcgaagacggacgaaatggatcgccaggatcatctggaccaaaaggtgatagaggagagccaggaccgccaggaccaccggggcgattagttgacacagggccaggcgcgcgcgaaaaaggagaaccaggtgatagaggacaagaaggaccaagaggaccaaaaggagatccgggcttaccaggagcccctggagagcggggaattgaaggattccgtggcccacctgggccacaaggtgatccaggggtccgtggtcctgcaggagaaaagggcgatagaggaccaccgggactagacggacgttcaggattggatggaaagccaggcgcggctggaccatctggacctaatggggccgcgggcaaagctggagatccaggtcgcgatggattaccggggttgcgcggggaacaaggtctaccgggtccttcaggaccaccagggcttccaggaaagccgggagaagatggaaagccaggattaaatggaaagaacggagaaccgggtgacccaggcgaggatggaagaaaaggagaaaaaggagattcaggagcctcgggaagagaaggacgagatggacccaaaggagagcgaggtgctcccggaattttgggacctcaaggacctccaggactgcctggaccagtcggaccaccaggtcaaggattcccgggagttccaggaggaacaggtccaaaaggggataggggagagacagggagtaagggagagcaaggtctaccgggcgagagaggtcttagaggtgagccaggctctgtaccaaatgttgatcgtctgttggaaactgcaggaattaaggcatcagctttaagggaaatcgtggaaacatgggacgaatcttctggatcgtttctaccagtcccagaacgtcgtcgaggacctaaaggagattcaggtgaacaaggccctccgggaaaagagggaccaattggattcccaggagaaagaggtctaaagggtgatcgcggtgaccccggtcctcaaggacctccgggtctcgcactaggagaacgagggccgcctggacctagcggacttgcaggagaaccgggtaaacctggaattccaggactgccaggtcgcgcaggaggggtcggagaggccggtagaccaggcgaacgaggggagcgcggagaaaaaggagaacggggagagcaaggaagagacggaccgccgggcttgccagggactccgggacctcccggacctccaggaccgaaagtaagtgtcgacgagccaggacctggcctcagtggtgaacaaggaccacctggtctcaaaggtgctaagggagagccagggagcaacggagatcagggaccaaagggtgataggggagttccaggaattaaaggggaccgtggagaaccagggccgcggggacaagatggaaatcccggattgcctggtgaacgcggaatggctggaccggaaggaaaaccaggattgcaaggccctagaggaccaccgggaccagtggggggacatggagatccaggaccacccggagcgccaggcctggcgggaccagctggaccacaaggacccagtggtttgaaaggagaacctggagagacgggaccacctggacgtggattgaccggaccgaccggagccgttggacttccaggcccgccagggccttcgggactggtcggaccgcaaggttctccgggactcccgggccaggttggagaaacagggaagccgggagcgccagggagagacggtgcttccggaaaggacggagaccgaggatcaccaggagtccctgggtcgcctggtctccctgggccggtagggcctaaaggagaaccaggaccaacaggggctccgggacaggcggtagtaggattaccaggagccaaaggcgagaaaggtgccccgggaggcctcgctggagacttagtgggagagccgggagctaaaggagatagaggattgccaggaccaagaggagagaaaggagaggccggaagagccggagagccaggagatccaggagaagacggacaaaaaggtgctccgggccctaaaggatttaaaggggacccaggagttggggtcccaggatctccaggcccaccgggaccaccaggagtaaaaggagatctgggtctgccaggactgccaggagctccaggagtggtgggttttccgggacaaacgggaccacgaggcgaaatgggacaacctggacccagtggagagcgtggtctggctggaccaccgggcagggaaggaataccggggcctttggggccaccaggtccaccgggatcagtggggccaccaggagcttctggattaaaaggagataagggtgatccaggagtcggtcttccgggcccaagaggagagcgaggagagccaggtatccgtggggaggatgggcggccaggccaggaaggacctagagggcttacagggcctccgggatcccgaggagaacggggagagaaaggtgatgtcgggtctgcaggcctaaaaggagataaaggcgattcagcagttattttaggaccaccaggaccacgtggtgccaagggagatatgggagaaagaggacctcgaggacttgacggagataaagggccacgaggagataatggagatccaggagacaaaggctcaaaaggcgaacccggtgacaaaggctccgctggtttgccaggtcttagaggacttttaggaccacaaggacagcctggagctgccggaattcctggagacccaggatcaccagggaaagatggagtgccaggtattcgcggagaaaagggagacgttggattcatgggaccacgtgggctgaaaggagagcgcggagttaagggagcatgtggattggatggcgagaaaggagataaaggagaagctggaccgccgggacgtccgggtttggctggacacaaaggagaaatgggagaacccggtgttccaggtcaatcgggtgctccgggaaaggaagggttgataggaccaaagggagatcgaggatttgatggtcaacctggaccaaaaggtgatcaaggagagaagggtgagcgcggaactccaggaattggtggattcccgggcccatcaggtaatgacggctctgctggacctccagggccaccaggttcggtcggaccacgcggacctgaaggcttgcagggccaaaaaggtgagcgtggaccaccgggagaacgtgttgttggagctccaggagtaccaggagctccaggtgaacgtggagaacaaggtcgaccagggcccgctggaccaagaggagagaaaggagaagcagctctaacagaggatgatattcgaggctttgtacgacaagaaatgagccaacactgcgcctgtcaagggcaatttattgccagtggatcccgacctcttcctagttacgctgctgatacagctgggtcgcagttacatgccgtcccagtccttagagtcagtcatgcagaagaagaagaacgggttccgccagaggatgatgaatattctgaatattcggaatactccgttgaagaataccaagatccagaggcgccatgggattcagatgatccttgctcccttccactcgatgaaggatcctgtacggcttatacactcaggtggtatcatagggcagtaactgggtctaccgaagcttgtcaccctttcgtctatggaggatgtggaggtaatgcaaatcgctttggaacacgtgaggcctgcgagcgtcgatgtcctcctagggtggttcagtcacaaggaactggaactgcccaagat

SEQ ID NO: 9568 - DNA, 8832 bp, Artificial Sequence
  Description of Artificial Sequence: Synthetic coding sequence
atgacccttagactcttggtggctgcactttgtgcaggtattttggcagaagctccacgggtgcgggcccagcatagggagcgtgtgacctgtactcgattgtacgccgcagacatagtgttcctccttgatggttcctctagcattggaagatcgaactttcgcgaagtgcgatcgtttcttgaaggtctggtgctgccttttagcggtgcggcgtccgcacaaggagtgagatttgctactgtgcaatacagcgatgaccctcggacggaatttggactggatgcactcgggtcgggtggtgacgtgatacgtgcaatcagagaactctcctacaaaggaggaaacactcgcactggagcggcaattcttcatgtggcagaccatgtgttcctgccacaactggcaagaccgggtgtgccaaaggtgtgcattcttataactgatggcaaatcgcaagatctggtcgataccgcagcgcagcgccttaagggtcaaggagtgaagctctttgcagtcggtatcaaaaatgcagaccccgaagaactgaagcgtgtcgcatcgcaacctacctcggatttcttcttttttgtgaacgatttttcgatcttgagaactcttctgccacttgtgtcaagacgcgtttgcactaccgcgggtggtgtgcctgtgacccgaccaccagacgatagcacttccgcaccacgcgatcttgtgctcagcgagccttcgtcacagtcccttagagtgcaatggacggcagcctcgggcccagtgaccggatataaggtgcagtacacccccctcaccggacttggacagcctcttccgtcggagcgccaggaagtgaacgtccccgcgggtgaaaccagtgtgcggctgcgcgggctgcgcccactgacggagtaccaagtcacggtgatcgcactttacgccaactccattggagaagcagtgtccggaactgcgaggactactgctctcgaaggacctgaactcactattcaaaacactaccgcacactcgctgcttgtggcctggagatccgtgccaggagcaacgggttaccgggtgacttggcgcgtgctgagcggcggtcctacccagcaacaggaattgggtcctggtcaaggatcggtgctcctgcgagatctcgaacctggaactgattacgaagtgaccgtgagcactctcttcggccgctcggtcggtcctgcgacctcccttatggccagaacggatgcctcggtggaacaaactctgcgaccagtcattcttggccctacttcaatcttgctgtcgtggaaccttgtccctgaagcgcgcggttatcgcctggaatggcggcgagaaaccggcctcgagcctcctcaaaaggtcgtgctgccgtctgacgtgaccagataccaacttgatggtctgcaaccaggcaccgaatacagactcactctctacactcttcttgagggacatgaagtggcaacccctgccactgtcgtgcccactggacctgagctcccagtgtcgcccgtcacggatctccaggcgacggagctgcctggtcagcgagtgcgggtcagctggtcccctgtgcctggagcaacccagtacagaatcatagtgcgtagcactcagggagtggaaaggaccctcgtgttgcccggttcacaaactgcctttgatctggatgacgttcaagcgggcctgtcctacactgtcagggtttcggctagagtgggtcctcgagaggggtcggcatccgtgcttaccgtgaggcgcgagcctgaaacccctctggctgtgcctggactgcgtgtcgttgtctcggatgcaactcgtgtgagggttgcatgggggcccgtgcccggtgcctccggctttcgcatatcatggtccactggatcgggacccgaaagctcgcaaactctccctccagattcaactgccaccgacatcaccggccttcaacccggtacgacttatcaggtcgcagtgtcggtgctgcggggaagagaggaaggtcctgcagcagtgattgtggcacggaccgacccacttgggccagtgcgcaccgtgcacgtcactcaagcctcgtcgtcgagcgttactataacttggacccgcgtgcctggggcaaccggttacagagtgagttggcactcggcacatggtcctgaaaaatcgcaactggtgtcgggagaggcaaccgtcgctgaactggatggcctggagcccgacactgagtataccgtgcacgtccgagcacatgtggcaggcgtggacggacccccagcatccgtcgtcgtgcgcaccgcccctgagcctgtgggtcgggtcagtcgcctgcaaatccttaatgcgtcaagcgatgtgctccgcatcacctgggtcggcgtcactggcgcgacggcataccgactggcatggggtcggagcgagggaggacctatgagacaccaaatcctgcctggcaacaccgattcggccgagattcgtggactggaagggggtgtgtcatacagcgtgcgggtgactgctctcgtcggggatcgcgaagggaccccggtgtcgattgtggtcaccactccgcctgaagcacccccggcactgggtactctgcacgtggtgcagcgcggagaacactcgctccgactcagatgggagcctgtccctagggcccagggtttcctcctgcattggcaaccagaaggcggacaggagcaaagcagagtgcttggacctgagctttcctcctaccatctggatggacttgaaccagccacccagtacagagtgcgcctgtcagtccttggcccagcaggagaagggccatcggccgaagtgactgcgagaaccgaatcccctagggtccctagcatcgagctccgagtcgtggacacttcaattgattctgtgactctggcgtggacccccgtctcacgggcatcatcgtacattctgtcctggaggcccctcagagggcctggacaagaagtgccgggaagcccacaaactctcccaggtatctcatccagtcaaagagtcaccgggcttgagcctggagtgtcctacatcttttcccttacccctgtgcttgacggcgtgcgggggcctgaagccagcgtgacgcaaaccccagtctgtccccgcggccttgcagatgtggtgtttcttccgcatgcgactcaggacaacgcccaccgcgccgaggctacccgacgcgtcctcgaaagacttgtgcttgcactggggccactgggaccccaagcagtgcaagtggggcttctctcatatagccatcgcccttccccgctgtttccacttaacggctcgcatgaccttgggattattcttcaacgaattcgagatatgccatatatggatccttccggaaacaacctcgggactgcagtggtcactgcccatagatacatgctcgcaccagacgcccccggacgtagacaacatgtgccaggggtgatggtgctccttgttgatgaacctttgcgcggtgacatctttagccccatacgcgaagcccaagcctcaggactcaacgtggtgatgcttgggatggccggggccgacccagaacagctgagacgcctggcacctggcatggactcggtccagacctttttcgccgtggacgacggaccgtcactcgaccaggcggtcagcggccttgcaaccgccctttgtcaggccagcttcaccacccagccacgacctgagccttgtccggtgtactgtcctaaaggtcagaaaggagagcccggagaaatgggactcagagggcaagtgggacctcctggggacccaggactgcccggacgaaccggcgctcctgggccgcagggccccccgggttcggccactgctaagggagaaaggggctttcccggagcggatggccgtccgggatcccctgggcgtgcaggtaacccaggaactccaggggcacccgggctcaagggatcacctggtttgcctggaccaagaggtgacccgggagaaagaggacctaggggacctaaaggcgaacccggagcaccaggccaagtcattggaggagagggtcctggactcccaggacgcaagggcgatcctgggcccagtgggcctcctggtcctagaggccctctcggagatccgggtccacgcggtccacctgggcttcccggtactgccatgaagggagataaaggtgacagaggcgaacgaggcccgccgggcccgggcgagggaggtattgcaccaggagaacctggtctgccaggtttgccgggatcgccaggaccgcagggtcccgttggtccaccaggtaaaaagggtgaaaagggtgacagcgaggatggcgcacccggcctgccaggacaacctggatcacccggggagcagggaccacgggggccccctggggcaattggacctaagggagatagaggctttcctggccctcttggtgaggcaggagaaaagggagagcgcggtccaccaggacctgcgggttcaagaggtctgcctggggtcgcaggccgacctggtgcaaaaggtcccgagggtccccctggacccactggtagacagggggaaaagggagaacccggacggccaggcgatccagctgtggtgggtccagcagttgcaggccctaagggagaaaaaggtgatgtgggccccgcaggaccacggggtgctaccggcgtgcaaggagaaagaggtccgccaggactggtgctgcccggagatcccgggcctaagggggatcctggtgatagaggacctatcggactgactggccgtgcaggtccccccggagactcaggtccccctggggagaaaggggaccccgggcggccaggcccacctggcccggtgggtccaagaggacgcgacggagaagtgggagaaaagggcgatgaaggtccacctggagatccagggcttccgggtaaagccggagaacggggtctgcgtggtgcccccggagtccggggtcctgtgggcgagaagggagatcaaggtgacccaggtgaagatggacgcaacggttcgccgggtagcagcggacccaagggtgaccgaggtgagcctggaccacctggtccgccaggccgcctcgtcgatacgggtcctggagccagagaaaagggtgagccaggagatagaggtcaagagggcccacgtggtccaaagggagatcctggactgcctggagcaccaggggaaagaggaatcgagggattcagggggccaccagggccccagggagatcctggagtgaggggtccagcaggcgagaagggagatcgggggccaccaggtctggacggtagatcaggactggatggtaagccaggtgcagcggggccatcgggacccaacggagcagctggtaaagctggtgatccaggaagagacgggcttcctggactgagaggagaacaaggtctgcccggaccatcgggtccgcctggcctgcctggtaagccaggggaagatgggaagccaggtcttaacggaaagaatggtgaacccggagatcccggcgaagatggacggaagggcgagaagggagattcgggagcctcgggaagagaaggacgtgacgggcctaagggcgagcgcggcgccccgggaattctcggaccacagggacctccaggacttcctggacccgtggggccgccaggccaagggtttcccggagtgccaggcgggaccggtcctaagggtgaccgcggagaaaccggatccaagggtgaacagggcttgcctggagagcgaggcctgaggggagaaccaggatccgtgccaaacgtcgacaggctgctcgaaaccgcaggtattaaggcctccgcacttagagaaattgttgaaacctgggacgaatcctcgggtagctttcttcctgtccctgaaagacgccgaggccctaagggagatagcggcgaacaaggtccacctggcaaggagggaccgataggttttcctggtgaacggggtcttaaaggggaccggggagatccaggacctcagggacccccggggctcgcacttggagaaaggggacctccaggaccttcgggacttgcgggcgaacctggcaagccaggcattcccggactccctggaagggccggaggggtgggagaagcaggtagacctggagagcggggagaaaggggcgaaaagggtgaaagaggtgaacaaggacgcgatggaccaccgggcctcccagggacccctggcccaccaggcccacctgggccaaaagtgtccgtggacgaacctggtccaggcctctccggtgaacaaggacctccgggacttaagggtgccaagggagaacctggatctaacggtgatcagggtcccaagggcgacagaggtgtgcctggtatcaagggggataggggagagccaggacctcgtggacaagatggcaatccaggtctgcccggagaacgtggaatggcgggaccagagggtaagcccggtctgcagggtcctcggggtccgccaggacctgtgggtggccatggggacccagggcctcctggtgcaccgggccttgcaggaccagccggaccgcaaggaccctccgggcttaagggtgagcctggagaaaccggcccccctggaagaggacttaccggtccaactggcgcagtgggactccctggaccccccggccccagcggacttgtcggcccacagggatccccaggattgccaggtcaagtcggagaaactgggaaacctggagcacccggaagggatggggcaagcggaaaggatggggatcgtggatctcccggtgtgccaggatcaccgggtctgcctggacccgtcggtcctaagggtgaacctggtccaactggcgcaccaggccaagccgtggttggacttcctggagcaaaaggtgaaaagggtgcccctggaggactcgctggtgatcttgtcggagaacctggggcaaaaggggatcggggactgcccgggccgagaggagagaagggagaggccggtcgggctggggagccaggtgacccaggagaggacggacagaagggtgccccgggaccaaaaggttttaagggtgaccccggagtgggtgtgcctggatcccctggcccgcctggacctccaggggtgaagggagatctgggactgccagggcttccaggagccccgggtgtggtgggcttccccggtcaaaccgggccccgcggtgaaatgggacagcctggtccttcgggtgaacgcggacttgcagggccgcctggtcgtgaaggaattccaggccccctcggtcctccaggtcctcccggatcggtgggtccccccggagcatcaggtttgaagggtgataagggcgatcctggggtcggtttgccaggcccccgtggagagcgaggtgaacccggaatacgcggagaagatggtcgaccagggcaagaaggacctagagggttgaccgggcctccgggatcgcgtggagaacgcggggagaagggcgacgtcggatcggcaggccttaaaggcgacaagggagattccgcagttatcctgggtccccctggtcctagaggtgcaaagggcgatatgggggagaggggacctcgcggtctggacggtgacaaaggtccgcgtggagataatggtgatccaggagacaaggggagcaaaggggaaccaggtgataagggaagcgcgggattgcccggactgagaggattgctgggccctcaaggtcaacctggagcagcaggaataccgggggatccaggaagcccaggcaaggacggcgtccctggtatacgtggcgaaaaaggggatgtgggatttatgggccctaggggtctgaagggagaacgcggagtcaagggggcatgcggtctggatggtgaaaagggtgacaagggagaggcaggaccccctggacgaccaggactggccggacacaaaggggagatgggcgaaccgggggtgccggggcaatcaggcgcacccggcaaggaaggacttattggaccaaagggcgatcgaggttttgatggccagcccggaccgaaaggtgatcaaggagaaaaaggggaacgcggtactcccggcattggtggatttcctgggccgtccggaaatgacggctctgccgggcctcctggaccaccaggttcagtcggtccccggggacctgaaggtctgcaaggacaaaagggtgaaagaggtccaccaggggaaagagtggtgggggcacctggggtgcctggggcacccggagaacggggggaacagggacggccggggcccgctggaccaagaggagaaaagggcgaagcagcactcactgaagatgatattcgcggatttgtgcgtcaggaaatgagccaacattgtgcctgtcaggggcagtttattgcatcggggtcacggcctctgccatcatacgcagcagatactgcaggatcccaacttcatgccgtgccagtcttgagggtcagccatgcagaggaagaagagcgagtgccgcctgaggacgatgaatactcggagtattcggagtactccgtggaagagtaccaggaccccgaagcaccatgggattcggacgatccatgctcactgcctcttgatgaggggtcctgcactgcatacactcttagatggtaccatagagctgttactggctcgactgaagcatgtcatccattcgtgtacggtgggtgcggcggtaacgccaaccgctttggtacccgagaagcctgtgaaaggaggtgtccaccaagagtcgttcaatctcaaggtacgggaaccgcacaggat

SEQ ID NO: 9569 - DNA, 8832 bp, Artificial Sequence
  Description of Artificial Sequence: Synthetic coding sequence
atgacgctgcgactgctggtcgctgccttgtgcgctggcattctggcagaggcaccgcgagtccgtgcacaacaccgagagagggttacttgtactcgtctatatgcggcggacattgtgttcttgcttgacgggtcctcatcaatagggcgaagtaacttccgagaggtgagatcattcctggaggggctcgtccttccattctccggcgcggcctcagcccagggtgtaaggttcgcaaccgtacaatacagtgacgatcctcgaacggaatttggactggacgcgcttggatccgggggcgacgtgatccgcgccattagagagctgtcttataaaggggggaacactcggaccggagcagccattctacatgtggcagaccatgtcttcttgccacaactcgccagaccaggcgtgccaaaggtctgtattctgattactgacggtaaatctcaggatttagtcgacactgctgcccagaggctaaagggtcaaggggtaaagcttttcgccgtgggcatcaagaacgccgaccccgaagaactgaagagagtagctagtcagccaacaagcgatttctttttctttgtcaatgatttcagcatcttaaggaccctgttgccactggtcagtaggagggtgtgtaccactgcgggaggagtgcccgtaacacgaccccctgatgatagcacctcggccccaagggacctggtcttgagtgagcctagttcacagtcccttagagtgcagtggaccgctgctagcggccctgtaaccgggtataaggtgcagtacactcctctaaccgggttaggacagccactgcccagtgagagacaggaggtaaacgtcccggcaggagaaacttcagtgagactgaggggattacgcccacttactgaataccaggtaaccgttatcgcactttacgctaatagtatcggagaagccgtctcaggcaccgccagaactacggctctcgaaggacccgagctgactattcagaacacgaccgctcacagtctgctggttgcttggcgatctgtgcccggagccacaggatacagagtgacttggcgcgtgttatccgggggcccaacgcaacaacaggaactgggtcccggacaggggtccgtactgttaagggacctggagcctggtactgactacgaggtgacagtctctactttatttggccgaagcgtgggaccagcgacctccctgatggcaagaacggatgctagcgttgaacaaactttgagacctgtcatcctgggtcctacatctatccttctgtcatggaatctggtgcccgaggctcgtggctatcgcctcgaatggaggagggaaactggactggaaccacctcagaaggtcgtccttccatcagacgtaacgcgataccaactggacggcttgcagcctggcaccgagtataggctgacactgtacactttgctggagggccatgaagtggcaactccggcaactgtggtgccaacgggccccgaattacccgtctcccctgtcactgaccttcaggccactgaacttcccggccagagggtaagagtgagctggtcccccgtgcccggagcaacccaatacaggatcattgtgagatccacccagggggtggaaagaaccctcgtgcttcctggctcccagacggcgttcgacctggacgacgtgcaggccggcctcagttacacagtacgggtgtccgctcgggtcggaccacgtgaaggatctgcatctgtgctcacagtcaggagagagcctgaaactcctcttgctgtgcccgggctccgagtggtggtttcggatgccactagagtaagggtggcgtgggggcccgtgcctggagcttcggggttccggatctcttggagcaccgggtcaggcccagagagctctcagactctgcctcctgatagcaccgccaccgacataacaggactgcagccgggtacgacttatcaggttgcagtcagcgtcctccgtggtagagaagaaggccctgccgcagtcatagtcgcgcgcacagaccccctgggaccagtgagaacggtgcacgtcacacaggccagcagttctagtgtgaccatcacatggacccgagtacccggcgccaccgggtacagagtttcatggcacagcgcccacgggcccgagaaaagtcaactggtttctggagaggcgaccgtggccgagcttgacggactggagccagacacggagtacaccgttcacgtgcgagcccatgtagcaggagtggatggaccacccgcctctgtggtggtgcgaaccgcccctgagcccgtcgggagagtgagcagattgcagattctcaatgcttcctctgacgtactcagaatcacatgggtgggcgtcaccggggcaaccgcctaccgacttgcctggggccgaagtgagggggggcccatgcgccaccaaatcctacccggcaataccgatagtgcggaaatcagaggtttagagggcggtgtctcatattcggtgagggtaacagccctggtcggagatcgagagggaacacctgtcagcattgtcgttaccacgccacccgaggccccgcctgcacttgggacattgcatgtcgtgcagagaggggagcatagcctgaggctgcgatgggagccagtgcccagggcccaaggctttttactccactggcagcccgagggaggccaagagcagtcccgtgtcctgggcccggaactgtcatcatatcatcttgacggactagagccggctactcagtacagggtgagactgagcgtgcttggccctgcaggtgaaggcccatccgcagaagtcactgctagaacagagtcccccagggttccatctattgagctgcgtgtggtggatacctccattgactccgtaacactagcctggaccccagtgtccagagccagcagttatatcctgtcttggcgacccttacgtggcccaggtcaggaagtgcccggcagtcctcagaccctcccggggatctctagttcccagagagttacgggactggaacccggtgtgagctatattttttcacttacgccggtgctcgacggagtgaggggccccgaggcctcagtaacgcagactccagtgtgccctcgaggcctggctgacgtggtattccttccacacgcgacccaggataacgcacacagagccgaggccactcggagggtgctagagcgactagtccttgctcttggacccctgggtccccaggctgtccaggttggccttctgtcctattctcaccgacccagcccactatttcccctgaacggctcccatgacttaggcatcatcttgcagcggatccgcgacatgccttacatggacccctcagggaataaccttggaactgcagtggtgaccgcacaccgttatatgcttgcgccggatgcacccggtagaaggcagcatgtgcctggcgttatggtgctcctcgtggacgagccactgaggggcgacatcttctcccccatcagggaagcgcaggcgagtggtctgaacgtcgtcatgctgggtatggctggcgcagatccggagcagttgcgcagattagccccagggatggacagcgtgcaaaccttttttgccgtggatgatggtccttcactagaccaagcggtatctggccttgcaactgccctgtgccaagcctcttttacaacccaaccaaggccagaaccgtgtcccgtgtattgcccaaagggtcagaagggcgaacctggtgagatggggctaaggggtcaagtggggcctcccggcgatcccgggctgccgggacgcaccggtgcgcccggaccacaggggccgccaggctcagctactgccaaaggcgaacgtggatttccgggtgcagatgggcgacccgggtcacctgggagagcgggtaaccctggaacacctggagcccccggcctgaaaggttcgcccgggctgcccgggccccggggagacccaggggaacgaggaccccgtggccccaagggggaaccaggggcccctgggcaagtgattggcggcgaaggccccggactcccaggccggaagggggatcctgggccgagtggccctccaggtccacgaggccctctgggtgacccaggaccccgtggccccccaggcctccctggaaccgctatgaagggcgataagggagatagaggagagcgagggcctcctgggcccggggaaggtggaattgcaccaggagaacccggtctgccggggctgccaggctcacccggcccccagggtcccgtaggcccccctggaaagaaaggggaaaaaggggattctgaagacggagcccctggcctccctgggcagcctgggtctcctggggaacagggcccaagagggcccccaggcgccataggcccaaaaggcgataggggattccctggccccctgggcgaagccggcgagaaaggcgagcgtgggcccccaggtccagctgggagcagggggcttcccggagtggctgggagacccggagctaagggacccgaggggcctcctggccccactggaaggcagggtgagaaaggagagccaggacgccctggagatcccgcggtcgtgggtccagctgttgcgggacctaaaggcgagaagggagatgtgggacctgcaggaccacgaggcgcaacaggagtgcaaggtgaacgagggccaccaggcctggtgctgcccggagacccgggtccaaaaggagatcccggggacagaggtccgattggtctgaccggccgagccggcccaccaggagactctggtccacctggcgaaaagggtgacccaggcaggcccgggcccccaggaccggtcggcccccgaggcagggacggagaagtgggtgaaaagggcgatgaagggccacccggggacccaggccttcctggtaaggccggggaacgcgggctgcgcggggcgccgggggtgagagggccagttggtgaaaaaggcgaccagggagacccaggcgaagacgggcggaacggatccccgggttcaagcggtccaaagggagatcgaggcgaaccaggcccacctggcccgcctgggcgcctagtagatacagggcctggagcccgcgaaaagggtgagcccggcgatagaggccaggaggggccgcgaggaccaaagggcgatcctgggctgcctggagcacccggcgagcgcggaatagaagggtttaggggaccgcccggacctcagggcgatcccggggtacgcggaccagccggagagaagggagatagaggtccaccagggctggatggaagaagcggcttagatgggaagccgggcgcggccgggccttctggacccaatggcgcagcaggcaaagcaggtgaccctggccgagatgggctaccaggactaaggggagaacagggtctgcctggaccatctggcccaccagggctaccaggcaagcccggcgaagatggaaaaccaggactgaacggcaaaaatggtgagccgggggatccgggcgaggacggtcgaaagggggagaagggagactccggagcttccgggagggagggcagggacgggccgaaaggcgagagaggtgcccccgggatactgggaccacaaggaccacccgggctccctggaccagtgggccctcccggtcagggatttcctggcgttccaggtggaactgggccaaagggcgacagaggcgagactggttctaaaggggagcagggactcccgggggagagaggtctccgcggtgaaccagggtcagtgcccaacgtcgataggcttctggagacagccggaatcaaggcgtctgccttacgagaaattgttgagacctgggatgagagcagcggtagctttttaccagtccctgagcgacgccggggccccaaaggcgacagcggcgagcagggcccacctggcaaggagggacccattggctttcccggcgagcgcggactgaaaggggaccgaggcgacccaggcccacaagggccccccggccttgccctgggagagcggggtccaccaggaccatccgggttggctggggaaccaggaaaaccgggaattcccggtcttcccggtcgggcagggggggtgggcgaagccggccgacccggcgaaagaggcgagagaggtgagaaaggcgaacgaggtgaacagggcagggatggcccccctgggctgcctggcacccccggaccacccggacctcctggcccaaaggtgagcgtggatgagcctggccctggactctccggggagcagggccccccagggttaaaaggggctaagggcgaacccgggtcaaatggcgatcaaggacccaaaggtgacaggggagtccccgggattaaaggggatcgtggtgagcctggaccgcgaggccaggacgggaatcccggtctgcctggagaacggggaatggccggtccggagggtaaacctggcctgcaggggccccgagggcctcctggccctgttggcggccacggggaccctggccctccgggtgcgcctgggttggctggacctgccggcccacaagggccaagcggcctgaaaggggaacccggcgagaccggccctccgggccggggactgaccggtcccacgggtgccgtgggtctgccaggccctcctgggcccagcgggctggttggaccccagggctctcccggactgcctggacaggtgggtgagactggaaagccaggcgcaccagggcgagacggagcaagcggaaaggatggggatcgagggagtccgggagttccgggctctccaggtcttcccggaccagtgggccctaaaggcgagcccgggcctactggggcgcctggccaagcagttgtcggtctccccggagccaagggcgaaaaaggtgctcccgggggcctggcaggcgatctggtgggagagcccggcgcaaagggggatcggggactgccgggccccaggggcgaaaaaggcgaagctggcagggccggcgaacccggtgatcctggcgaagacggacaaaaaggcgctcccgggcctaagggatttaaaggagatcctggggtcggagtgcctggttcgcccggccctcccggcccgccaggagtcaagggcgatctggggcttccagggttaccgggcgcacccggagtggtggggttccccggccagacaggtcctaggggggagatggggcaacccggaccttctggcgagcgggggttggccgggccgcctgggagagagggcatccctggcccccttggacctccaggtcctccaggtagtgtggggcctcctggtgcatctgggcttaaaggcgataaaggcgaccctggggtagggttacctggtccacgaggggagcgtggcgagccaggaatccgaggggaagacggacgacccggtcaggagggacctagaggcttgaccggacctcctggatccaggggggaacgcggagaaaagggggacgtggggagcgctggactaaaaggagacaaaggggactcagctgttatccttggcccaccaggccctagaggtgctaaaggggacatgggcgaaagaggccctaggggtctggatggagataagggccctagaggcgataatggggaccctggcgacaaaggcagcaagggagaaccgggggataaggggtccgctgggctgcctgggctgcgaggactactcggaccccaaggccagccaggagccgcaggtattccgggcgacccaggctctcccggcaaggacggtgtcccaggtattaggggggaaaagggggatgtggggtttatgggtccaaggggattgaaaggcgagcgtggggtgaagggggcctgcggccttgacggtgagaaaggcgataagggagaagcgggcccacccggcaggcctgggctggcaggccataaaggagagatgggcgagccgggggtgcctggccagagtggggcaccgggtaaggagggtttaatcggcccaaagggtgacagaggatttgacggccagcccggaccaaaaggggaccaaggggagaaaggcgagcgcgggacccccgggataggcggtttccccggacctagcggcaatgacggttctgctgggcctccaggcccaccagggagcgttgggcctcgaggcccggaagggttacagggccagaaaggagagaggggaccccctggggagagggtagtgggcgctccgggtgtgcccggcgcacccggagaacgaggcgagcaaggccgccctggtcccgccgggccaaggggcgagaagggggaagccgccctgactgaagatgatattagggggttcgtgcgtcaagaaatgtcacagcactgtgcctgccaggggcagttcatagcctccggatcaaggcccctgcccagttatgccgctgatactgcggggtctcaactacatgcagtgcctgtgctgagggtgtcacacgccgaagaagaagagcgagttccgcccgaagacgacgaatattctgagtattctgagtactccgtggaggaataccaggacccagaggcgccctgggatagcgacgacccatgttcactgccccttgatgaggggtcctgcaccgcttacacgctgagatggtaccatcgggcggtaacaggaagtacagaagcatgtcacccatttgtctatggagggtgtggcggtaatgccaatcgctttggcacgagggaagcctgcgagagaagatgccccccacgagtggttcagagtcaaggaaccggaactgctcaggat

SEQ ID NO: 9570 - DNA, 8832 bp, Artificial Sequence
  Description of Artificial Sequence: Synthetic coding sequence
atgactctgagactgctcgtggctgcactgtgtgctggcatcctcgctgaggcccccagagtcagggcccaacaccgcgaaagggtaacttgcacaaggttatacgctgccgacatcgtcttcctgctcgatgggagctctagtatcggcagaagcaatttccgtgaggtcaggtctttcctagaaggacttgttctaccattcagcggtgcagcatctgcacagggcgtacgcttcgctaccgtacaatattccgacgatcccagaacagaattcggcctggacgcgttggggagcggcggagacgtaatcagggccatacgggaactgagctataaggggggcaacactcggacaggcgctgcgatcctacacgtggccgaccacgtgttcctaccccagcttgctcggcccggtgttcccaaagtatgtatactgattacagatggcaagagccaggacctcgtggatactgctgctcagcgactgaagggccagggcgtgaaactgtttgccgttgggataaaaaacgccgaccctgaagagcttaaacgtgtagcttctcagcccacttccgacttcttcttttttgttaatgatttcagtatcctcagaacactgctgccacttgtatcacggcgggtctgtaccactgctggaggtgtgccggttacacggccaccagacgattctacatctgctcccagagatctagtgctctcagagcccagttcccagtcactccgggtccagtggaccgccgcctccggacccgtgacaggttataaggtccagtatactccccttaccggactgggacagcctttaccctcagagcgtcaagaggtgaatgtcccggctggggaaactagtgtgcggcttcgcggactgaggcccctgaccgagtatcaggttacagtgattgccctgtacgctaattccattggtgaggccgtgagcggtacggcccgaactactgccttggaaggccccgagctgacaatccagaatacaaccgcacactcgctgctcgtcgcatggcgctctgtaccaggagccacgggataccgcgttacctggcgggtgctgtccggaggacccacacaacagcaggagctcgggcccggtcagggcagcgtattattaagagatctcgagcccggcactgattacgaagttaccgtgtccaccctgttcggcagaagtgtgggcccagccacttcccttatggcacgcacagacgcgtcggtggaacagacattgcgacctgttattttagggcctacttctattctgctctcttggaacctcgtgcctgaggcgagaggctacaggctggaatggaggagagaaaccggtctcgaaccaccacagaaggtagtgttgccaagcgatgtcacacggtatcagttggacggtctgcagccaggcactgagtaccggctgaccctctacaccctcctggaaggtcacgaggtcgctacacccgctaccgttgtgcctactggccctgagttgcccgtgtcccccgtgactgatttgcaggccacggagctgccggggcaacgcgtgcgtgtttcctggtctcccgttcctggggccacccagtatcggatcatagtgcgaagcacgcagggtgtggagagaacgctggtactccccgggagccaaaccgcgttcgatctggacgacgtccaggctggactgtcatatactgtgagggtatctgctcgcgtcggccctcgggaaggctccgccagcgtgctgacagtacggagggaaccggaaactccactcgccgttcctgggttgcgtgtggtcgtaagcgatgcgacacgtgtcagagtcgcctggggcccagtgcccggtgcttcaggcttccgcatttcttggagtactggatcaggacccgaatcaagccaaaccttacctcccgacagtactgcgaccgacataaccggcctacagccaggcacaacttaccaagtggccgtgtctgtcctaagagggagggaggagggtcccgctgccgtgatcgtggcccgaactgaccccctggggcccgtccggactgtgcacgttacccaggctagttcttcatcagtcacgattacttggactagagtgccaggcgctacaggatatcgagtgtcctggcactccgcacacggacctgaaaagtctcagctggtgtcgggcgaagcaaccgtggcagagctggatggtcttgagcccgataccgagtatactgtgcacgtaagggctcacgtggccggcgtggatggccccccagcctccgtggttgttcgcacggcgccagagccagtcggacgcgtcagcaggctccaaatactgaatgccagttcagacgtgctgcgaatcacgtgggttggggtgacaggggctaccgcctatcgcttagcatgggggaggtcggagggcggccccatgcgtcatcagatcctgccaggcaatacagactcagctgagatcagggggctggaagggggggtgtcttatagcgtgcgggttaccgctctggtgggagatagagagggcactccagtaagtattgtggttacaaccccgcctgaagcaccgcccgcactgggcacactgcatgtggttcaaaggggggaacacagcctccgactccgctgggaaccggtcccaagagctcaaggctttttgctccattggcagcctgagggcgggcaggagcagtctagggtgctaggcccagagctgtcatcgtaccatctggatggcttggagccggcgacccagtacagggtgcgtctctctgtgctagggcctgcgggagagggccccagtgcagaggtcactgctcgcacagagagtcctagggtgccctctattgaactcagagtggtagatacatccatcgatagcgttacactagcctggactcccgtgtcacgagccagctcttacatactatcttggcggccgctccgtggtccaggccaggaagtcccgggatccccacagactctgcctggaatctctagttcacagcgagtgactggtctagagcctggggtcagctatatttttagtcttacacctgtcctcgacggcgtgcgggggcctgaggcatccgtgacgcagacaccggtatgcccccgggggctagctgatgtggtgttcctgccccacgctacacaggacaatgcccaccgcgcagaagcgacgcgccgggtgctggagcggctggtgctcgctttgggcccactgggtcctcaggcagtgcaagtgggcctgctctcttattcacaccgtccgtccccattgtttccgctcaacggaagccacgatctgggcatcattctccagcgcataagagatatgccttatatggacccatctggaaataacctggggacagccgtcgtgaccgcgcatcgctatatgctcgcccctgacgctccgggtcggagacaacacgtgccaggcgtgatggtactacttgtggatgaacctctgcgcggcgacatcttctcacccataagagaagcccaggcttctggtttgaatgtagtcatgctggggatggctggcgcggatccagagcagttgcgacgtctggcaccgggcatggactctgtgcagacgttcttcgcggtggatgatggcccctccctcgaccaggcggttagcgggttagctactgccctgtgccaggcctctttcacgacccagcctaggcccgaaccttgcccagtttactgtcccaagggccagaagggggagccaggcgaaatgggtcttaggggacaggtcggccctcccggcgaccccggactaccagggcgcacaggtgctcccgggccgcagggaccacccggcagcgccacggctaagggggagaggggttttccaggggcggatggacggcctggcagcccaggccgagccggtaatccaggcacacctggagcgcccggacttaaggggagcccaggattgcccggaccccggggagaccccggagagcggggacctagggggccaaagggcgaacccggcgcaccagggcaggtgatcgggggcgagggcccagggctgccgggtcgtaaaggcgaccccggtcctagcgggcctccgggacccagaggtcctctgggcgaccccggaccacgcggccctcctggcctgcccggaaccgcaatgaaaggcgacaaaggcgatcgtggagagaggggaccaccaggtccaggcgagggaggtattgcaccaggggaacccggattgcccgggctcccaggcagtcccggcccccaaggccctgtggggcctcctggtaaaaaaggtgaaaagggagatagcgaagatggggctcctggactgcccggccagcccggatccccaggtgaacaggggcccagagggcccccaggggctataggccccaaaggagatcgagggtttcccgggcctttgggcgaggccggggaaaagggcgaacgcggaccccctgggcctgctgggtcacgcggactgcccggggtcgcggggagacctggcgcaaagggtccagagggaccacctggccccaccgggaggcagggagagaaaggggagccagggaggccaggcgacccggcggtggtggggcccgcagtggcagggccaaagggtgaaaagggcgatgtaggccccgccggtcccaggggtgccacaggcgtccaaggagagcgcggccctccaggactggtgcttccaggcgaccctgggcccaagggtgacccaggggacagggggcccattggactaaccggccgcgccggccctcccggcgatagcggccccccaggcgaaaaaggagacccaggccggcccggccccccgggtcctgtaggccccagaggaagagatggggaagtcggagaaaaaggcgatgaagggcccccaggagaccccggactccctggcaaagctggcgaaaggggtctgcgtggtgcccctggggtcagaggtcctgtcggcgagaagggagaccaaggcgatccgggagaggacggcagaaacggaagcccagggtcatccggacctaaaggagacaggggagaaccagggcccccagggcctcccgggcgactcgtggatacaggacccggtgcaagggagaagggcgagccgggggacagaggccaggagggaccaagagggccaaaaggcgatcctgggcttcctggggctccaggcgagcgcggcatcgagggtttcagaggtccccctggccctcagggggatcccggcgtgcgagggccagccggggagaagggggatcgtggacctcccgggctggacggcaggtccgggctagacgggaaacccggcgcagctggacctagcggccctaatggggccgcaggcaaagccggcgatcctggccgagatggcctgcctggcctgcgtggtgaacagggcttgcctggtcctagcggtccccctgggctccctggtaaaccgggcgaagacggtaaaccaggtctcaatggcaaaaatggcgagcctggcgacccaggcgaagacgggagaaagggggaaaagggagactccggcgctagtgggagagaaggacgtgacggacctaaaggtgagcggggcgcaccaggtattttgggaccccaaggaccgccagggctgccaggcccagttggacctcccggacagggcttccccggagttccagggggaacagggcccaaaggcgatagaggagagactggatccaagggtgaacaggggttgccaggtgagaggggcttaagaggggagcccggctcagtgcccaatgtagacaggctcctggagactgcaggaattaaagcctcagccctgcgtgaaatcgtagaaacctgggatgaatcatctggaagttttcttcctgtgcccgagcgacggagaggccctaagggcgatagcggcgagcaaggcccacctggaaaggagggtccaattgggttcccaggagagagaggcctcaaaggcgacaggggcgaccccggcccgcaggggccgcctgggctggcgttgggtgaaagaggcccacccggcccttcaggcttagccggagagcctgggaaaccggggattcctggcctccccggaagggccggaggcgtgggagaagctgggcggcccggtgaacggggggagcggggggaaaagggtgaaaggggtgaacagggtcgtgatggaccacccggtctcccaggcacacccggcccgcccggtccaccagggccaaaagtgtctgtggatgaacctggcccaggtctgtctggagagcagggaccccctggcctgaagggagccaaaggtgagcccgggtcaaatggggaccagggccctaagggggacagaggggtgcctgggatcaagggcgatcggggggagcccggcccccgcggccaagatggcaaccccgggctgcccggggaaagaggaatggccggtcccgagggtaaacccggtctacagggtcccaggggcccaccaggccccgtcggaggacacggtgaccctggcccacccggagccccaggactcgctggccccgctggaccccagggcccaagcgggctaaaaggagagcccggagaaactggacctcccggtcgcggactgactggacccacaggtgccgtgggcctgcccggaccgcccggcccgtcagggctggtgggcccacaaggatccccgggactaccaggacaggtgggcgagaccggcaaacctggcgctccaggccgtgatggggcctcgggaaaagacggagaccggggatcacccggggtgcccgggtctccaggactgccaggtcccgtcggtccaaaaggggagcccgggccaacaggagccccaggccaggcagtcgtaggcctcccgggtgcgaagggcgagaaaggagcaccaggtgggttggccggggatctcgttggtgagccaggcgcaaaaggggacagagggctcccggggccccgcggggagaagggagaggcaggcagggccggcgagcctggagatccaggtgaagatgggcaaaaaggggctcccggaccaaagggctttaaaggcgacccaggagtgggcgtgcccgggtcaccgggccctcctgggcctccgggggtaaagggggatttgggtcttcccgggctgccgggggctccaggcgtcgtcggatttcctggccagaccggcccacggggagagatgggccagccgggcccgtcgggtgaacggggactggccgggccccccggccgggaggggatacccggccccctgggcccgccgggtcccccgggctcagttggaccccccggcgcaagcgggcttaaaggggacaaaggtgatcccggggtggggctgccgggccctcggggggagaggggcgaaccaggcattcgcggggaggatggcaggccaggccaggaaggaccgcggggccttacagggcctcctggctccagaggcgagcgtggggagaagggagacgtgggatcagccgggctcaaaggggacaagggggactcggctgtaatactcggccctcccggaccaaggggagcaaagggagatatgggagagaggggaccgcgcggattagatggggataagggccccagaggggataacggggaccccggcgacaagggcagtaagggcgaacccggagacaaagggtccgctggtctgccagggctcagaggactgctggggcctcagggccaacctggggccgccgggatccccggggatcctggatctccagggaaagacggcgtccctgggatacgcggggaaaagggggacgtgggctttatgggacctcgtgggctaaagggcgagagaggagtcaagggagcatgtggacttgatggggagaaaggcgacaaaggggaggctggccccccagggaggcccggcctcgctgggcacaaaggagaaatgggggagcctggagtgccaggacagtcaggtgctccaggaaaggaaggactgataggccctaagggagatagaggcttcgacggacagcccggcccaaaaggagatcagggagagaaaggagaacgcggaacacccggaattggcggattccccggtccgtctggcaacgatggctccgctgggcccccaggccctcctggaagcgtgggacctaggggtcccgaggggctgcagggccaaaagggggagcgcgggccccctggggagagagtagtgggggcccctggggttccaggagcacctggagaaagaggcgaacagggacggcccgggcccgccggtcctcgcggagaaaagggggaggctgcactgacggaggatgacattagaggattcgtgcgccaggagatgtctcaacactgcgcctgtcagggccagttcatcgccagtggtagcaggcctctacccagctacgctgctgataccgccgggtctcagctgcacgcggttccagtgctcagggtgtcccatgccgaggaagaagagagagtgccaccggaggatgatgagtacagcgagtacagtgagtatagcgtcgaggagtatcaggacccagaagccccatgggactcagacgatccttgttctctgccactcgacgaagggtcttgtacagcatataccttgaggtggtatcatcgtgcggtgaccggctctaccgaagcttgtcacccgtttgtgtatggcgggtgtggcggaaatgcaaacaggttcggcactagagaggcctgtgaacgcaggtgtcctccaagagttgtccagtcccagggcaccggcaccgcacaggat

SEQ ID NO: 9571 - DNA, 8832 bp, Artificial Sequence
  Description of Artificial Sequence: Synthetic coding sequence
atgacgctgaggcttcttgtggcagcactgtgtgccggtattctggcagaagccccaagagttcgagcacaacatcgggagagagtcacttgtaccaggctgtacgcggcagatattgtattccttctggatggtagctcatcaatagggaggtcgaactttcgtgaagtgcggagctttctggaaggacttgtcctgccgttctccggggcagcgagcgcgcagggtgtccgctttgcaacggtccaatactcagacgatccgagaactgaatttggtctggacgccctgggttccggtggagacgtgatcagagcaattagagaactttcatacaagggtgggaatactcgtaccggtgcggcaattctccatgtggcggaccatgtgttcctgcctcaacttgcacgaccgggtgtgcccaaggtgtgtattcttatcaccgatggcaagtctcaagaccttgtggataccgccgcccaacgcctcaagggccaaggagtgaaactgtttgcagtggggatcaagaacgcagaccccgaggagttgaagcgcgtggcatcgcaaccaaccagtgactttttcttttttgtcaacgatttctcgatccttcgcactcttctccctctcgtcagcagaagagtctgcaccactgcaggaggggtgcccgtgacccgtccccccgatgattctacctcggcaccgagagacttggtgctctcagaaccgtcgtctcagtctctcagagtgcagtggaccgcagcatccggacccgtgacgggctacaaggtgcaatacacccctcttaccggactgggccagcctctgcctagcgaacgacaagaagtcaacgttcctgcaggggaaacttccgtcagactccggggactgcgtcccttgactgaataccaagtgaccgtgattgccctgtacgcaaactctatcggggaagctgtgagcggaacggcacgaaccactgcactggagggtcctgagcttaccattcaaaataccaccgcccattccctgcttgtcgcttggagatccgtcccaggagccaccggatacagagtgacctggagagtgctgagtggagggccaacccaacagcaagaactgggaccgggacaaggatccgtgcttcttcgcgaccttgagcctggcacggactacgaagtgaccgtctcaaccctgttcggacgcagcgtcggccctgcaacgtcactcatggcccggactgatgcgtctgtggaacagactcttcggccagttatcctcggtccaacttccattcttttgtcttggaacctcgtccctgaagctcgaggctacaggcttgaatggcggcgagaaaccggactggagcctccacaaaaggtggtgctgccttccgatgtcacgcgctaccagctggacggcctccaaccaggaactgagtaccggttgaccctctacactcttctcgaggggcatgaggtcgcaactcccgcaactgtggtcccaacgggtcctgaactcccagtgtcccctgtgaccgatcttcaggcaactgaattgcctggacagcgcgttcgcgtgtcctggtcgccagtgcctggtgccacccagtaccgaataatcgtccgcagcactcagggtgtggagagaaccctggtgctccccggatcccagacggcatttgatttggatgatgtgcaagctggactttcctacaccgtgcgggtgagcgccagagtggggcctagagaaggatcagcatcggtgcttaccgtccgcagagaaccagagactcctttggccgtccctggactgcgagtcgtggtgtcagatgcaactagagtgagagtcgcctggggaccagtgcccggcgcatcgggttttcgaataagctggtcgacgggttccgggccagaatcctcccaaacccttccgccagatagcactgcaaccgatattactggactgcaacctggaaccacctaccaggtcgccgtgagcgtgctcagaggtagggaagaaggccccgcagcagtgatcgtcgcacgtactgatcccctcggtcctgtgagaactgtgcatgtgactcaggcatcgtcgtcctcggtgaccataacgtggacccgagtgcctggggccactggctacagagtctcgtggcactcggcgcacggcccggagaaatcgcaactggtgtccggagaagcgaccgtggcggaactcgatggacttgaaccagacaccgaatacaccgttcatgtgagagctcacgtcgccggagtggatggaccgcctgcatcagttgtcgtccggaccgctcctgagcctgtgggaagggtttcccgcctccaaattcttaatgccagctcagatgtccttcgcattacttgggtgggagtcaccggcgcaactgcatataggttggcctgggggagatcggaaggaggtcctatgcggcatcaaattcttcccgggaacaccgattcggccgaaattagaggactggagggaggagtgtcgtactcggtgagagtcactgccctggtgggagacagggaggggacgcctgtctccatcgtggtcaccaccccacccgaagcaccaccggctctgggaactttgcacgttgtccaacggggtgaacattccttgcgactgcgttgggaacccgtccccagagcacaaggtttcctgctgcattggcaacctgaaggcgggcaggaacagtcgagggtgctgggacctgaactctcatcctaccatcttgatgggttggaacctgcaacccagtacagggtgagactgagcgtcctcggtcctgcaggtgaaggaccttctgccgaggtgactgccagaactgagagcccaagagtcccttccatagaactgagagttgtcgatacctccattgattcggtgacgctggcgtggacgccagtgtcgcgggcatcgtcttacatcctctcgtggcgaccgctgcgaggtccaggccaggaagtcccaggtagcccccaaaccctccctggaatctcgtcaagccagcgcgtcactggacttgaacctggtgtctcatacatattcagtctgaccccagtcttggacggtgtacgcggacccgaagcgagcgtgacccagactccagtttgtccgcgaggtctggcagatgtggtgtttctccctcacgcaactcaagataacgcacatagagcagaagcaactcggcgggtgcttgaacgtcttgtgcttgcactggggcctctcggccctcaagcagtgcaagtgggacttcttagctattcacataggccttcccccctttttcctctgaacggatcccatgatctcggcattattcttcagagaattcgcgacatgccatatatggatccgtccggcaataatcttgggaccgcagtggtcaccgcacaccggtacatgctcgcaccagacgcaccggggcgtcggcaacacgtgcctggggtgatggtgcttctggtcgacgagccgctgcgcggcgacattttctccccgattcgcgaggcgcaggcctcgggactcaacgtggtgatgctcggtatggccggtgcggatcccgaacaactccggcggcttgcacctggaatggattcagtgcagactttctttgcggtggacgatggcccatcgctggaccaggcagtgagcggacttgccaccgcactttgtcaggcctcgtttactacccagccgaggcctgaaccgtgtcctgtgtattgtccaaaaggacaaaaaggagaacccggtgagatgggtcttagggggcaggtcgggccaccaggggaccccgggcttcccggaagaaccggtgcacctggtccacaaggaccccccgggagcgcaacggccaagggagagcgcggttttcccggtgcggatggacgtcctgggtcgcctgggagagcaggtaaccctgggactccaggggccccgggactgaagggatcccccggactcccaggacccagaggggaccccggagaacgaggaccgcgcgggcccaaaggtgaaccaggtgcccctggacaagtgatcggtggggaaggtcccgggctccctgggagaaaaggagatccaggaccgtcggggcccccgggtccgagaggtcctcttggcgaccctggtccaagaggaccgccaggcttgcccgggactgcaatgaagggcgacaagggcgaccgcggtgagagggggcccccaggacccggagaagggggcatcgcacccggtgagccgggcctccctggattgccaggatcccccggacctcagggacccgtaggtccgcccgggaaaaagggcgaaaagggagactcagaagatggtgcaccagggctgccaggtcaacccggatcccctggagagcagggtcctagaggaccccctggagccataggtcctaagggcgaccggggcttcccaggtcctctcggcgaggccggagagaagggagagcgaggacctccaggcccagcaggtagccgcggactgccgggtgtggcggggcgcccgggggccaagggacctgaaggaccgcctggacccaccggcagacagggggaaaagggagaacccggtcggccaggtgatcccgcagtcgtgggtcctgcggtggcaggacctaaaggcgagaagggagacgttggacccgctggccctcgcggggcaactggcgtgcaaggcgagcggggtccacccggactcgtccttcctggtgacccaggccccaaaggtgatccaggcgacaggggaccaatcggtttgaccggtcgggccgggccgcctggggactcgggtccgccaggagagaaaggtgacccgggtagacccggtccccctggaccggtgggaccgcggggcagggatggagaagtcggagaaaagggagatgaaggcccacccggtgatcccggtctgccaggaaaggcaggagagcgtggcctgcgcggagcaccaggagtccgtggtcctgtgggagagaaaggggaccagggggatcctggagaagatggccgcaatggatcaccgggttcatcgggcccgaagggtgatcggggtgaaccgggccctcccggacctcccgggagactggtggatactggcccgggtgcccgggaaaagggcgagcccggtgacaggggacaggaaggtccccgcggtccaaagggagatccggggttgccaggagcgcctggtgaacgaggaattgagggttttcggggaccgcctgggcctcagggagatccaggagtgagagggcccgcgggagaaaagggggatcggggaccgccaggacttgatgggagaagcgggctggacggcaagccaggtgctgcgggaccttctggccctaatggagcggccggaaaggcaggggaccccggcagagacgggctgcccggcctgcgcggagaacaaggactgcccggtccttcggggcctcctggcctgcccggtaagcctggcgaagatggtaagccaggccttaatggaaaaaacggtgagccgggggatcccggtgaggatggaagaaaaggcgaaaaaggcgacagcggtgcatccggtagagaaggccgtgacggcccaaagggggaacgcggtgctccgggaattctcggaccccagggcccgccagggcttcccggacccgttggaccccctggccaaggctttcctggtgtcccaggggggacgggccctaaaggtgatagaggagaaactggatcaaagggagaacaggggcttcccggggagcgggggctgagaggagaaccaggatcggtgccaaacgtggataggcttcttgaaaccgcaggcattaaggccagcgcgcttagagaaattgtcgaaacgtgggatgagtcgtcgggatcctttctccccgtccctgagcgaaggcgcggtcccaagggtgattctggtgaacaaggtcctcccggaaaggaaggtcctatcggatttcctggagaacgcggcctcaaaggagacaggggtgaccccggcccacaagggcctccaggcctcgcacttggggagcgtgggccaccaggcccatccggcctcgcaggtgaaccgggtaagccaggcattcctggccttccaggcagggccggaggagtcggagaagcaggacggccaggcgaacggggggagcgaggggaaaagggcgaacgaggtgagcagggacgggatggcccaccaggccttcccggaactccaggcccgccaggtcctccggggcctaaggtgtcggtggatgagcctggaccaggactgagcggtgagcagggcccccctggacttaaaggcgctaagggcgaacctggttcaaacggtgatcaaggacccaagggtgataggggcgtccctggcatcaagggggatagaggtgagcctggtcccaggggccaggatgggaatccgggattgccaggggagagaggtatggcgggcccggaaggtaagccaggattgcagggacctcgtggtcctccaggcccagtaggcggacatggtgacccaggcccgccaggagcaccaggtcttgccggaccagctgggcctcaagggccatcgggactcaagggagagcctggcgaaactggacctccgggtagaggacttaccggtccaactggtgccgtgggactgccaggtccccccggcccttcgggactggtcggaccacagggaagccctggacttccaggccaagtgggcgaaactggtaagcctggagcacctggacgggatggggcgtcaggaaaggatggagatcgaggtagcccaggtgtgccagggtcacccggactccccgggcctgtggggcccaagggggaacccggtccgaccggagcacctggacaggctgtggtcggacttcctggcgcaaagggcgaaaagggcgcaccaggaggcctggcaggggatttggttggtgaacctggcgctaaaggcgaccggggcctcccaggaccgagaggagaaaaaggagaggcaggacgcgcgggagaacccggggatccaggagaagatggacaaaagggcgcacctggccctaagggtttcaagggtgatcccggagtgggagtccctggtagccctggaccgccgggaccacctggtgtgaagggggacctcggtctgcctgggctgcctggagctcccggagtggtggggttcccaggtcaaaccggcccgaggggcgaaatgggtcaaccaggaccatcaggagagcgcgggttggctgggcctccaggtcgagaaggtatcccaggtcctcttgggcccccaggccctccagggtcagtaggaccgccgggcgcgagcggactgaagggggataagggcgatccaggcgttggcctgcctggacctcgtggggagcgaggggagccaggcattagaggtgaagatggccgacctggacaagaagggccaaggggactgactggtccaccaggaagcagaggcgaaagaggagaaaaaggggacgttggaagtgctggactgaagggagataagggtgactccgccgtcatactgggtccgccagggccacgcggcgccaagggcgacatgggtgaacggggtcctagggggctggatggagataaaggcccacgcggagacaacggagatccgggagataagggttcaaagggtgaacccggcgacaagggatcagcaggacttcctggactgagaggacttctgggacctcaagggcaacctggagccgccgggattcctggtgatccgggtagccccggtaaggatggtgtgcccggtatccgcggagaaaaaggggatgttggatttatggggccaagagggctgaaaggagagagaggtgtgaagggtgcctgcgggcttgatggggaaaagggagacaagggtgaggctgggccacctggcaggcctggccttgcaggacacaagggtgagatgggggagcctggagtgccaggtcaatccggagcgcccggaaaagagggtctgattggtcctaaaggggatcgaggatttgatggccaacctggccccaaaggggaccaaggtgagaaaggagaaagaggcactcccggtatcggtgggtttccgggcccatcgggcaacgacggatccgccggaccacccggacctcccggttcagtgggtccccggggtccagagggtctgcaagggcagaaaggggaacgcggaccacctggagaacgtgtggttggtgcacctggcgtgcctggtgcaccgggggaacgaggcgaacaggggcgtcctggtcctgctggtcctcgcggagaaaaaggtgaagcagcactcactgaggatgacatccgcggattcgtccggcaagaaatgtcccaacactgtgcctgccaagggcagtttatcgcttcgggctcgcggcctcttccttcctacgccgcagacactgcaggtagccagctgcatgcagtgcccgttctgagagtgtcgcacgccgaggaggaggaaagggtgccaccggaggacgatgaatacagcgagtactccgagtacagcgtcgaggaataccaggaccctgaggcgccatgggatagcgatgatccgtgcagcctgccacttgatgaaggctcgtgtaccgcgtacaccctgcgttggtaccatcgggctgtgacgggatccactgaggcgtgtcaccctttcgtgtacgggggctgtggaggtaatgcaaacaggtttggaaccagggaggcctgcgaacgcaggtgcccgccaagagtggtccagagccaaggcactggaactgcgcaggat

SEQ ID NO: 9572 - DNA, 8832 bp, Artificial Sequence
  Description of Artificial Sequence: Synthetic coding sequence
atgaccctgagacttctcgtggcagcactctgcgctggtattcttgcggaggcaccgcgagtccgcgcgcaacatagggaacgtgtgacctgtaccagactctacgcagcagatatcgtgtttctgctggatggatcctcctcgattggtagatcgaattttcgcgaagtgcgatcctttctcgaaggcttggtgctgcctttctctggtgccgcctcagcacagggagtccgctttgcaaccgtccagtacagcgacgatcctaggaccgaatttggactggatgcccttggctccggaggagacgtcatccgagcaatccgggaactctcatacaaaggcggaaacaccagaaccggtgccgccatcctgcatgtggcagatcatgtctttctgccacaactggcaaggccgggtgtgcctaaggtgtgcattctcataactgacggaaagtcgcaagacctggtggataccgcagcacaaagactcaaaggtcaaggggtgaagctgttcgcagtgggaatcaagaacgcagatcctgaagagctcaaaagagtggcaagccaaccgacttcagatttcttctttttcgtgaacgatttttccatcctccgtacccttctgcctctggtgtcgcgaagagtgtgtaccactgcaggcggagtcccagtcaccagacccccagatgatagcacgtcggccccacgggatcttgtgctctcggagccttcatctcaatccctcagggtgcaatggactgcggcgagcgggcccgtgactggatataaggttcagtacactcctcttaccggcctcggacaaccccttccaagcgaacgccaggaagtgaatgtgcctgcaggagaaacgtccgtgcggctccggggactgcgacctcttaccgaataccaagtcactgtgatcgcgctgtacgccaactccattggcgaagccgtgtccggaaccgcccgtaccaccgcactcgagggacctgagctgactatacaaaataccaccgcacattccctgcttgtcgcatggcgcagcgtgcctggggctaccggttacagagtcacctggagagtcctttccggaggacctacccaacagcaagaactcggtcctgggcaaggatcagttcttttgagagatcttgaaccaggaaccgattacgaagtgaccgtgtcgactttgtttggacgctccgtcggtcctgcaaccagccttatggcaagaactgacgcatcagtggaacaaacccttcgcccagtcattcttggtcctaccagcattcttctgtcctggaacctcgtgcctgaagcacgcggataccggcttgaatggcgtcgggaaactggcctggagcctcctcaaaaggtggtgcttccatccgatgtgacccgttaccaactcgatggactccagcctggtactgaatataggcttactctctacaccctgcttgagggccacgaagtggcaaccccggccactgtggtgcctactggaccggaactgcctgtgtcacctgtcaccgaccttcaggcaaccgagctgcctggccagagagtccgcgtctcgtggtccccagtgccaggagccacccaatatcgaataatcgtgagatccacccagggagtggaaagaactcttgtgctgccaggatcccaaacggccttcgacctggatgacgtccaagccggcctgtcatacaccgtcagggtttcggccagagttggtcctagggaagggagtgcatcagtgctgaccgtgcggcgcgaaccagaaaccccacttgcggtcccaggactgagagtcgttgtgtcagatgcaacgcgcgtgagagtggcatggggaccagtgcctggagcaagcggatttagaatctcctggtctactggctccggaccagaaagctcacagactctccccccagatagcactgccaccgacatcaccggccttcaacccggcactacttaccaagtcgccgtgtcagtgctgcggggtcgcgaagaagggcctgcagcagtgatcgttgcgcgtactgatccgcttggacctgtcaggacggtccatgtgactcaagcctcctcgtcgagcgtgaccatcacttggaccagagtgcctggcgctactggttaccgcgtctcgtggcattctgcacacggcccagaaaagagccagttggtgtcgggagaagcgactgtggcagagcttgatgggcttgaacctgataccgagtacactgtgcacgtgcgggcacatgtcgcaggagttgacggaccacccgcctcggtggtggtgagaactgctcccgagcctgttggtagagtctccagactgcagatccttaacgccagctcggacgtcctgcgcatcacttgggtcggcgtgactggggccactgcataccgtctggcttggggacgttcagagggaggccctatgagacatcaaattcttccaggcaatacggattcagcagaaatacgaggacttgagggtggtgtcagctactccgtcagagtgactgcactcgtgggtgatcgggaaggtactcctgtgtccattgtcgtcaccactcccccggaagcaccaccagcactgggaactcttcatgtggtgcagaggggggaacactctcttagacttcggtgggagcctgtgcctagagcgcagggattccttcttcactggcaacctgaaggaggacaagaacagagccgcgtcctcgggcctgagctgtcctcgtaccatttggatggtctggagcctgccacccagtaccgggtccgcctcagcgtgctggggcccgccggcgaaggtccatcggcagaagtaacggcacggactgaatcacctcgggtgccgtcgatcgagctcagagtggtggacactagcatcgattcagtgaccctcgcgtggaccccggtgtctcgggcatcgagctacatactgtcgtggcgtccacttaggggtcccggtcaagaggtcccgggtagcccacagaccctccctggtatctcgtcgtcacaaagagtgaccggacttgaaccaggggtcagctacattttctcgcttacgccagtgttggatggagtcaggggaccagaagcaagcgtgacccagactcctgtgtgcccaagaggcctggcagatgtggtgttcctgccccatgcaactcaagataacgcccacagagctgaggcaactcggcgggtgctggaacgtttggtgctcgcccttggccccctgggtccccaggctgtccaggttggacttctgagctactcccacagaccatcccctctgtttccactgaacggatcccatgatctgggaattatcctgcagagaataagagatatgccttacatggacccttcgggaaacaatcttgggactgcagtcgtgacggcgcatagatacatgctggccccggatgcacccggccgtcgccagcatgtccctggagttatggtccttctggttgatgaacccctccgcggcgacattttcagtccaatacgggaagcgcaagcatccggtctgaatgtggtgatgctgggcatggctggcgccgatccggagcagcttcggcggctggcaccaggcatggattccgtgcaaacctttttcgcagtggacgacggaccttcccttgatcaggcagtgagcggactggccaccgctctttgtcaggctagcttcactacccaaccacgaccagaaccttgtcctgtttactgtccaaagggacaaaagggggagccgggagaaatgggactgcgaggccaggtgggccctccaggcgacccgggactgcctggccgaaccggtgccccgggtccacaagggccgcctgggagcgcaaccgcaaagggtgaacgcggctttcccggtgcagacgggcgacccggttcgccgggacgcgcaggaaatcccggtacccccggtgcacctggactcaagggtagcccaggtctgccaggaccaaggggtgacccgggggagagaggtcctcggggtccaaaaggagagccaggggctccaggacaagtgatcggcggcgaagggcctggcttgccgggtaggaaaggggatccggggccttcgggcccacctggaccgcgcggcccgttgggagatcccggacctagaggaccgccagggctgcccggtaccgcaatgaagggcgataagggggatcgtggtgaacggggacccccaggtccaggagagggaggtattgcgcccggagaaccaggcctgcctggactgccagggtcaccaggacctcaaggtcccgtgggtcccccgggcaagaagggagagaagggagatagcgaagatggggcgcctggcctgcccggtcagcccggttcccctggcgagcagggtcccagaggaccaccgggtgctattggaccgaagggagatcgcggatttccggggccacttggcgaagcaggcgaaaagggagagaggggtccccctggcccggcaggttcccggggtttgccaggggtggcaggacgccccggagcgaagggtccagagggcccacctggtcccaccggtcggcaaggtgaaaagggggagcccggacgcccaggggatcccgctgtcgttgggcctgcagtagcaggccctaaaggtgaaaagggagacgtcggtcctgcagggcctcgaggcgctactggtgtgcaaggagaaaggggtcctcctgggctcgtgctccccggagatcctgggccaaagggagatccaggagatcgtggccctattgggcttactggcagagcgggaccacccggggactccgggccgcctggggagaaaggcgatcccggaaggccagggcctcccggcccagtaggtccgcgcggacgtgacggtgaggtgggagagaaaggagatgagggacctccaggtgaccccggtctgcccggaaaggccggtgagcggggacttaggggtgcgccaggcgtccgtgggcccgtgggcgagaagggcgaccaaggggatccaggcgaggatggacgaaacggatcgcctgggtcgtccggtccaaaaggtgataggggagagccagggccacctggaccacccggtaggctcgtcgacactggtccaggagcaagggaaaagggggaacccggtgatcgcggacaggagggtccacgggggccgaagggtgaccctggacttccaggagccccaggggagagaggaattgaaggatttcgaggaccacctggcccccagggagatccgggtgtccgaggtcccgcaggagagaaaggggatcgagggcctccaggactggacggtcgctcgggactcgacgggaaacccggtgcagcaggtccctcgggtcctaacggtgctgcaggaaaggcaggggacccgggacgtgatggtttgcctggtctgaggggggaacaggggcttccaggtccatcaggaccccctggacttcctggtaagccgggtgaggatgggaagccgggcctgaatggaaagaatggagagccaggcgatcctggcgaagatggacggaaaggtgaaaagggagattccggcgcatcaggtcgggaaggaagagatggacctaagggagaacggggtgcaccaggcattttgggcccacagggacctccgggacttccaggccccgtgggacctcctggacagggctttcccggagtccctggcggcactggtcctaagggggaccgaggagagactggatctaaaggcgagcagggtttgccaggtgagcgaggacttcgcggagagccgggatcagtgcctaacgtggatagactgctggagactgccggaattaaggcctcggcactccgggagatcgtggaaacctgggatgaaagcagcggatcatttctgcctgttcctgagcgtcgccggggacctaagggcgattcgggggagcaaggtcccccgggtaaggaaggtcccattggtttcccgggagaacgtggcctcaaaggcgacagaggagatccaggtcctcaaggtccacctggattggcactgggcgaaagagggcctccgggtcctagcggtcttgcgggtgagccggggaaaccgggaattccggggcttcctggtcgcgcaggtggagttggggaagcaggacggccaggcgaaaggggagaacgaggggaaaaaggtgaacgaggagagcagggcagagacggtccccctggactccctggcacccctgggccaccaggccctccgggaccaaaagtgtcagtggatgaaccaggtcctggactgtctggcgagcagggccccccaggacttaagggtgcaaaaggagaacctggatccaacggagatcagggtcctaagggagatagaggagtgcctggaattaagggggacagaggagaaccagggcctaggggtcaagatggtaaccccggccttcctggggagcgcggaatggccggccctgaagggaaaccaggacttcagggtcctagagggccccctggccccgtggggggacacggagatcctggtcctcccggagcaccgggccttgcaggcccggctgggccacaagggccttcgggtctgaagggagaaccaggagaaactggtccacctgggcgcggacttacgggcccgactggcgctgtgggactgcccggacctcccgggccaagcggtcttgtcggtccgcaaggctcgccgggacttcctggccaagtgggagaaaccggtaaacctggggcacccggtagagacggggcatcgggtaaggatggtgacagaggttcgccaggagtacccggctcccccggacttcctgggcccgtggggccgaagggcgaaccgggacctacgggagcaccgggtcaggctgtggtgggtttgcccggagcaaagggagagaagggtgccccgggagggctggcaggtgacctggtaggtgaaccaggcgccaagggtgaccgtgggctccccgggccgcggggagaaaagggcgaagccggtcgtgcaggagaaccgggtgatccaggagaagatggtcagaaaggagctcctgggcctaagggcttcaagggcgatcctggtgtgggagtcccaggatctccgggtccgcctgggcctcctggagtgaaaggggacctgggcctgccgggcttgccgggggcacctggtgtggtcggatttcctggccaaactggacccagaggggaaatgggacagcccggaccaagcggagagcgcggacttgcagggcctccgggaagagagggtatccctgggcccctcggaccccctggtccacccggttccgtgggacctccaggcgcatccggtcttaagggagacaagggggatcccggtgtcggcctgcctgggcccagaggtgagagaggggagcccggtatcagaggcgaggacggtcggcctggacaggaaggtcctaggggtctgacgggacctcctggctctcggggagaaagaggagaaaaaggagacgtggggtccgccggactgaagggcgataagggagattcagcggtcattttggggccaccagggccaagaggagcaaagggcgacatgggcgagagaggacctaggggactcgatggagataaaggacctagaggtgacaacggtgacccaggcgacaaaggatcgaaaggtgaacccggagataaaggttccgcgggccttcccgggctgcggggccttcttgggcctcagggtcaacctggggcggctgggattcccggggacccagggtcaccgggaaaagatggtgtgcctggtattcggggagaaaagggagatgtgggatttatgggacctcggggccttaagggtgaacgaggagtgaagggagcatgtggcctcgatggcgaaaaaggggacaaaggcgaggcaggaccgccgggtcgtcccggcctggcaggacataaaggcgagatgggcgagcccggggtgcctggacaatccggagccccaggcaaggaagggctgattggccctaagggtgatagaggatttgacggccaaccaggacccaagggggaccaaggagagaaaggcgaacgggggacgccagggatcgggggcttcccaggaccgtcgggaaatgatggtagcgcagggcctcctggaccccctggttcagtgggaccgaggggccccgaagggctccaggggcagaagggcgagcggggcccccctggtgaacgggtggtgggagcacctggtgtccctggagccccaggtgagagaggggagcagggacgccccgggcccgcaggtccaagaggtgaaaagggcgaagcagcgcttactgaggacgacattcgtggcttcgtccgacaagagatgtcgcaacactgtgcgtgtcagggccagtttattgcctcgggttcgcgaccgctgccaagttacgcagccgatactgcgggctcccaactccacgcagtgccagtgctccgggtgtcccatgcagaagaagaagaacgagtgccacctgaggatgatgagtattcagagtattccgaatactctgtcgaggaataccaggatcccgaggcaccatgggattccgatgatccttgttcgcttccccttgacgagggttcgtgtaccgcttacaccctccggtggtaccatcgcgctgtgaccggttcaaccgaggcttgtcatccatttgtgtacggcggttgcggcggaaatgcgaatcgctttggtaccagggaggcgtgtgaaagaagatgtccaccaagagtggttcaaagccagggtaccggaactgcacaggat

SEQ ID NO: 9573 - DNA, 8832 bp, Artificial Sequence
  Description of Artificial Sequence: Synthetic coding sequence
atgacattgaggctattggtcgccgccctgtgcgcaggtatattggccgaggctccaagagtaagagctcaacacagggagcgggtgacctgtacacgcctgtatgcggcagatatcgtgttcctgctggacggatccagttcaattggccgaagtaattttcgggaggtgagatcctttcttgagggcttggtgctgcctttctccggggctgcctccgcccagggggtgaggttcgcaaccgtacagtactctgatgatccgcgcacagagttcggcctagacgccttgggctctggcggcgacgtgattagggccataagggaactgagctataagggcgggaacactaggactggcgctgcgattttgcacgtggccgaccacgtcttccttcctcaactggccaggcctggggtgcccaaagtctgcatattaatcaccgacggaaagtcccaagatctcgtggacaccgcagctcaaaggctgaaaggacagggggtcaaactcttcgcggttggaataaagaacgccgatcccgaggagctgaagcgggtagcaagtcagcctacgagcgacttttttttttttgtgaatgatttcagcatccttaggactctcctccccttggtgagtagaagggtatgcactaccgcggggggtgttcctgtgacacgtcccccagatgactcaaccagcgccccccgggatctggttttgagtgagccgtctagtcaaagccttcgagtgcagtggactgcagcctctggccccgtcaccggctacaaggtgcagtataccccactcacgggactgggccaaccccttccctccgaaaggcaggaggtcaacgtcccagccggcgagacatcagttaggctgcgcggcctgagacctctcaccgaataccaggttacggtgatagccctctatgccaattccattggggaggccgtctctggtacagctcgtacaaccgctcttgagggccctgagctgaccatccagaatacgacagctcactcactcctagtcgcctggagatctgtgccgggagcgaccggctatagggtgacatggagggtgctgagcggcggacctactcagcaacaagaattagggccaggacagggatctgtgctgttgagagacttggaaccagggacagactatgaagttacagtgtcaacacttttcgggcgctctgtggggccagctacttccctgatggctcgaaccgatgcttctgtggagcagaccctcagacccgttatcctcggccccaccagtatactgttaagctggaaccttgtccctgaggctcgcggataccgcttggagtggcgaagagagactggactggaacctccacagaaagtcgtgctgccaagcgatgtaactcgctatcagctggacggccttcaacccggcaccgagtacagattgacattatacacattgctggagggccatgaagtggctacccccgctactgtagtgccaacgggtcccgaattgccagtctcccccgtgaccgacctacaagccacagaactccctgggcagcgcgtgcgggtgtcctggagtcccgtcccaggcgccacacagtaccggatcattgtacgtagcacacagggagtggaaaggacgctggttctacccggctcacagacagcgttcgatctggacgacgtacaggctgggctgtcatatacagtgagagtcagtgcaagggtaggtccaagggagggttcagcttctgtgctgaccgtaagacgcgagccagaaacccccctggccgtgcccggactgcgtgtagtggtgtccgacgctacccgtgtgagagtggcctgggggccagtgcccggcgcttctggatttagaatttcatggagcacgggctctggtcccgagagttcccagacactgcccccagattcgaccgctactgacatcactggactgcagcccggcaccacataccaggtcgcagtgagcgttctgaggggccgggaagagggcccggcagccgttatcgtcgctaggacagatcccctggggcccgtgagaacagtccatgtaactcaagcaagttcaagcagcgtgaccattacctggaccagggtgcctggagctaccgggtaccgcgtgagttggcatagcgcccacggaccagagaagagtcaattggtcagcggtgaggcaacagtggctgagctcgacggccttgaacctgatactgagtatactgtgcatgtgcgggctcacgtcgccggtgtagacggccccccggctagtgtggtagtgagaactgcccctgaacctgttggaagagtcagtagactccagattctaaacgccagctcagacgtgctcaggatcacttgggtgggggtcacaggggctactgcctatagattggcgtggggccgctctgaggggggacccatgcgtcaccagatactgcccgggaacacagattctgctgaaattaggggcctggaaggaggggtctcctattccgttcgggtcaccgcgttggtcggcgaccgggaagggacgcctgtctcgattgtcgttacaactcctccagaagcccccccggcattgggtactttgcatgtggtgcaaagaggcgagcacagcctaaggctccggtgggagcctgtcccgcgggcacaaggcttcctgttgcattggcagcccgaaggcgggcaggaacagagcagggtcctggggcctgagttgagctcctaccacctggacggactggagccagctacccagtaccgggtaaggctctctgtcctggggccagcgggtgagggccctagcgcagaagtgaccgctaggacagagtcacctcgcgttcctagcattgagctgcgcgtcgtagacactagtatagactctgtgacactagcttggacacctgtctcacgggcttctagctatatcctgtcatggagaccgttaaggggtccgggccaggaagtacctggtagccctcagacactccctggaatttctagtagccagcgcgtcacagggctggaacccggcgtgagttacattttctccttgactccagtgttagacggtgttaggggacccgaagccagtgtgacccagaccccagtgtgtccccgaggactcgccgacgtggtgtttctgccacacgcgactcaggacaacgctcatagagcggaagccactcggagagtgttggaacggctggtgcttgccctcggccccctagggccgcaagccgtacaggtcggcctgctctcttattcacacaggcctagtccactcttccctttgaatggtagtcacgacttgggaatcattctacagcggattagggacatgccttacatggatccctcaggtaataacctgggtacagccgtggtcaccgcccacaggtatatgctggcccctgacgcgcctgggcgcaggcaacatgtgcctggggtgatggtgctcctggtagacgagccactgaggggcgatatattcagtccgatcagagaggcgcaggctagcgggctcaacgttgtgatgctggggatggcaggtgcagatcccgaacagctaaggaggcttgctcccggcatggattcagtgcaaacgtttttcgccgtcgatgacggcccctcgctagaccaggccgttagcgggctggccacagccttgtgccaggcttcatttaccacacagcccaggccggaaccctgcccagtgtattgtcccaagggccagaagggtgagcctggggagatgggccttcgcggccaggtcgggcccccaggtgaccctggtctacctggccgtacgggggcaccaggaccgcaaggacctcccggatccgccacagctaaaggtgagagggggttccccggagcagacggtcggccagggtccccagggagagccgggaacccgggcaccccaggggcaccagggctgaagggttcgcctggactaccaggacccagaggtgaccctggggagcggggcccccgtggcccaaaaggtgaacccggcgccccggggcaggtcatcggtggtgaaggccccgggctgcccggccggaaaggtgatccagggccctccggtccccccgggccgcgaggccctctgggggacccgggaccgaggggtcccccaggacttcctggaacggcgatgaaaggcgataaaggagacagaggtgagagaggaccacctgggcctggcgaaggcgggatagccccgggtgagcccggcctcccaggcttgcctggcagccccggtccgcagggccccgttggccctccaggaaaaaaaggggagaagggcgattctgaggatggcgctccaggccttccaggacaacccggctcccctggtgaacaaggacctcggggaccccctggcgccattggcccaaagggggataggggattccctggaccccttggtgaggccggtgaaaaaggcgagcggggccccccaggccccgctgggtctcgcggtctgcctggagtagctggacgacccggagccaaaggacccgaaggtccaccaggtcccacagggcgccagggggagaagggagaacccggcaggccaggcgatcctgctgtggtggggcctgccgtggcggggcctaaaggggaaaagggggatgtggggcccgctgggcctagaggagccacaggcgttcaaggagaaaggggaccaccggggcttgtgctgccgggtgaccctggcccaaaaggcgaccctggcgaccgcggcccgattggtttgaccgggcgggcggggccccccggggattctggtccaccaggtgagaaaggcgatccaggacggccagggccccctgggcctgtgggcccccgcggccgggacggtgaggtgggagaaaaaggcgatgagggcccgccaggagatccaggactgcctgggaaggcgggtgagcgcgggttgcggggtgctcccggtgtgagaggcccagtgggtgaaaagggtgaccagggagatccaggggaggatggccgcaatgggtctccaggctcctcagggcccaaaggcgaccgcggcgagcccggaccccctggcccacccgggcgtctggtggacacaggccctggagccagggagaaaggagaacctggggatagaggacaagaagggccacgtggcccaaaaggagatcctggccttcctggtgcccccggcgaaagagggatcgaggggttcagaggacctcctggaccccagggggacccaggcgttagggggccagccggcgagaaaggagacagaggccccccaggattagacggcagaagtggtctggatggcaagccaggcgcagcaggtccaagcgggccaaatggcgcagccggcaaagcaggcgatcctggtcgggatggtctgcccggcttacgtggggagcagggtcttcccggtccctccgggccgcccggtcttcccggcaagccaggcgaggacgggaagccgggactcaacgggaagaacggggaacccggagacccaggcgaagacggcagaaaaggagagaagggggactccggagcatcaggtagggaaggcagagacgggcccaagggggaaagaggagcacccgggatattgggaccccagggacctcccggactgccaggtcccgtaggccccccaggccagggattcccaggcgtacccggaggtacaggccccaagggtgatcggggagagacaggtagtaaaggggaacagggactacccggggagcgagggctcaggggagagcccggctctgttccaaacgtagataggctgctcgagacggctggaataaaggcaagtgccctgcgggagatcgtggaaacctgggacgaaagcagcgggagcttcctcccggtgcctgagcggcgcagaggtcccaaaggcgattcgggcgagcaaggacctcccggcaaggaagggcccataggattcccaggggagcgcgggctcaagggtgatagaggcgaccctggcccacaaggcccaccaggattagcacttggggagcgtggaccgcctggtccatcagggctggccggcgaaccgggtaaacccggaattccaggcctcccaggccgtgctggcggagtgggtgaagcaggacgccctggcgagcgtggcgagcggggcgagaagggcgaacgcggcgagcagggacgagatggcccacccgggcttcctggaaccccaggcccgccggggccccccgggccgaaagtatctgttgatgagccgggaccaggccttagcggggaacagggacctccaggtttgaaaggggccaagggtgaacccggttctaacggcgatcagggccctaagggcgacaggggtgtgccaggcatcaaaggagatagaggtgagcccggcccacgaggacaggacggcaacccaggcttgcccggcgagcgggggatggcagggccagaaggcaaacctggactccagggcccgagagggcctccaggcccagtcggcggccatggggatcccgggccacccggcgcacctgggctagccgggcctgctggtcctcagggtccctctggattgaaaggcgagcccggcgaaaccggcccgcctggaaggggattgactgggcctactggcgcagtgggcctaccagggccgcctggcccttctggacttgtgggtcctcagggcagtccaggacttccaggacaggtgggcgagaccggcaagccgggtgcacccggacgcgatggagctagcgggaaagatggagaccgcggtagtcccggggtgccagggagtccagggctgccaggcccggtcggcccaaagggtgaaccggggcctaccggggctccgggccaagctgtggtagggttgcccggggcgaaaggtgaaaagggagcccctggcggcctcgccggtgacctagttggcgagcccggagctaaaggcgatagaggcctgcctggtcctcgtggtgagaagggggaagccggcagagccggcgaaccgggcgacccaggagaggatggacagaagggagctcctgggccgaagggcttcaaaggtgaccccggcgtgggcgtgcccggcagtcccgggccaccgggccccccgggcgtgaagggggacctcggtctgcctgggctgcccggggcccccggggtagttggcttccctggacaaacgggccctaggggtgagatgggtcagcccggcccctccggagaacgcggactcgccggtcctccaggcagagaggggattccaggtcccctcgggcctcctggtccacctgggtcggtgggaccaccaggagcctccggcctaaagggagacaagggggaccccggagtgggactccccgggccacgaggggagagaggagagccaggcatccggggggaggatgggcgtccaggtcaggagggccctcgcgggctgacgggcccacctggaagcaggggcgagcggggagagaagggagacgtgggaagcgcgggtttgaagggggataagggggactcagccgtgattttaggcccgccgggcccgagaggcgccaaaggtgacatgggcgagaggggcccaaggggactggacggggacaaaggaccccggggcgataacggtgatccaggagacaagggctcaaagggcgagccaggggataaaggttctgctggcctcccgggcctgcgaggactgctgggccctcagggacagcccggcgccgccggtatccctggcgacccaggcagtccaggcaaggacggtgtccccgggatccgtggcgaaaagggagacgtaggctttatgggccctaggggcctgaagggggaacgcggagtgaagggcgcatgcgggctagatggtgagaagggtgacaagggcgaagccggccctcctggcagacctgggctagccgggcacaagggtgagatgggagaacctggagtccccggccagtcgggcgctccaggtaaggaaggcttaatcggccctaagggggatcggggatttgacggacagcctggaccaaagggagatcagggagaaaagggcgagagaggaaccccgggtataggcggctttcctggaccttccggaaatgacggatcagcaggcccaccggggccgcccggctctgtgggaccaaggggacccgaaggcctgcagggccagaagggtgaaaggggtccccccggcgaacgggttgtgggcgccccaggggtccccggagcccccggcgagcgaggcgagcaggggagacccgggccggctggacctaggggtgagaaaggagaggccgcgctaaccgaagatgacatccggggattcgtgcggcaggagatgtcacagcattgtgcctgtcaggggcagttcatcgcaagcggatcacggccacttccttcgtacgcagcagataccgcaggatcccaactccacgccgtcccagtcttgagagtttcccacgcggaggaagaggagagggtgccacctgaagacgacgagtacagtgaatacagcgaatactccgtggaggaataccaggatccggaggccccatgggatagcgacgatccgtgtagccttccactggacgaggggagttgtaccgcctacactttaagatggtaccaccgagctgtcaccggcagtaccgaggcatgccatcccttcgtgtatggtggctgtggcggtaatgctaatagatttgggacacgtgaggcatgtgagcgccgttgtcctccacgcgtggtccagagccaagggaccggtacagcccaagac

SEQ ID NO: 9574 - DNA, 8832 bp, Artificial Sequence
  Description of Artificial Sequence: Synthetic coding sequence
atgaccctgcgattgctggtggccgctctgtgtgcaggaatattagcggaagccccccgggttagagcacagcacagagagcgtgtgacatgtaccagattatacgccgcggatatagtgtttctattggatggttcgtcttcaataggtcgttcaaacttccgggaagttaggtccttcctcgaaggcctcgtgctgcctttttcaggggcagctagcgcacaaggggtgcggtttgccacggttcagtatagtgacgatcctcggacggagtttggactggacgccctcggcagcggaggcgacgtgatcagagccatacgcgagttaagttataagggcgggaacactcggacaggcgcagccatcctgcatgtggctgaccacgtgttcctccctcagctggcacgcccaggtgttcctaaagtgtgtattctaattaccgacggcaagtcccaggatcttgtcgacacagccgcacagagactgaaaggtcagggcgtgaagctcttcgccgtgggaatcaaaaacgccgatcccgaagaacttaaacgtgtagcttcccaacctacctccgatttctttttcttcgtcaacgacttctcaattttaaggactcttctgcccctcgtctcccgtcgggtgtgcactacggctggcggcgtgccggtgaccaggcctccggacgatagcacatctgccccccgcgacctcgtactgtccgaaccctcttctcagagcctgcgagtccagtggaccgctgcctcaggacctgtgacaggttacaaagtacagtacactcctctgactggactcgggcaacccttgccctcagagaggcaggaggttaacgtgcccgcaggagaaactagcgtaagactgcgggggttaaggccgctgactgagtatcaggtaactgtgatcgcactctacgcaaatagcatcggggaggcagtcagtggtactgcgcgcacaaccgctttagaggggcctgagctaactatccaaaataccacagcacactctctgctggtggcgtggagaagtgtccccggcgcgacaggctacagagttacttggagagttctttccggaggaccaacccagcagcaggagctgggtccaggacaggggagcgtgttactgcgagatctcgagccaggtacggactacgaagtgacggtgtccacactttttggacgctcagtgggccctgcgacgagtctgatggccagaactgacgcgtctgtggagcagaccctgcgccccgtgatccttggacccacctccatcctgctgagctggaacctggtgccagaggcccgcggataccgcttggagtggcgacgcgagacaggcctggaacccccccaaaaggttgtcctcccgtccgacgtcactagataccagctggacggtctgcagcccggaacagaataccggctgactttgtacactctgctggagggccacgaagtggccactccagccaccgtggtccctactggcccagagttgcccgtttctcccgtcacagatcttcaggctaccgaacttccaggccagcgagtccgtgtgagctggagccctgtaccaggggccactcagtataggataatcgtgcggtccactcagggggtggaacggaccttggtcctgcccggtagccagaccgctttcgatctcgacgacgtacaggctggcttgtcttacacagtgcgcgtgagcgctcgggtcggtcccagagaggggagcgcctccgtcctcacggtaagacgcgagcccgaaacaccgttagccgtcccaggtctgcgcgtggttgtttcagatgctacgcgggttagggttgcctggggacctgttccaggtgcaagtggcttcagaatcagctggtctacagggtcaggccctgagtctagtcagaccttgccgccggacagtaccgcgactgatataaccggactccaacctggcaccacctaccaggtagcagtgtcagtgctgcgcggtagggaggaaggccccgccgcagtgatagttgctcgcactgatcctctgggccctgttaggacagtgcatgtgacacaggccagtagcagttcagtgacaatcacttggacgcgagtcccgggagccaccggctatagagtgtcctggcactctgcccacggtccagaaaaatcccaactggtctcaggagaagcaaccgtggccgagctagacggcctggaaccagataccgaatacacagtacatgtcagggcccatgttgctggcgttgacgggccacctgccagcgtggtcgtgaggactgcccctgagcctgtagggcgcgtgtctcgacttcagattcttaacgcttcatcagacgttctgcgaattacatgggtgggagtcacaggtgcaactgcataccggctcgcctggggcagatctgagggcggcccaatgcgccatcagatcctgcccggtaatactgactctgcagagatccggggtctggagggaggagtatcttatagcgtgagggtgaccgcactggtcggggatagggaaggtacgccagtctctatagtggttacaaccccccctgaggcgcctccagctttgggcaccctgcacgtagtacagcggggcgaacacagcttgaggctgcgatgggagcccgtacctcgtgcgcagggattcctcttgcattggcagcccgagggggggcaagagcagtcgcgtgttttgggaccggaactgtcctcataccatctagacggactggaacccgcaacacagtaccgggttcgcctcagcgttctgggacccgcaggagagggacctagtgcggaggtaaccgcacgcaccgaaagtccccgagttccctccattgagttacgggtggtggatactagcatagactcagtcactctggcgtggacccctgtaagccgagcctcttcatacatcttgagctggagacccctacgggggcctggacaagaggtgcccggttccccccagacactgcctgggatttcttcctctcagcgcgttaccgggctggagcctggcgtcagttacattttcagtctgaccccggtcctggatggtgttcggggtccagaagcatcagtgacccagactccagtttgcccgcgggggcttgctgatgtggtgttcctccctcatgccacccaggataacgcacaccgtgccgaagccacgagaagagtactcgagcgtctggtgctcgcactaggcccactgggtccccaggcggtccaagtgggacttcttagctattctcaccggcctagtcccttattcccattgaacgggtcgcatgacctgggaattattctccagcggatccgagatatgccatacatggaccccagcggaaacaacctggggaccgcagtggttaccgcacatcgttacatgcttgcccccgatgccccaggtagacgtcaacacgtgccaggggtgatggttctccttgtagatgagcctctgaggggggacatcttttcacctatccgcgaggctcaggcctcaggcctcaatgtcgtcatgttaggcatggcgggagcagacccggagcagctccgccgattggcgccaggtatggactcggtacaaacatttttcgccgtcgacgacggcccatcgctagaccaggccgtcagcggactcgctacggccttatgccaggcctccttcacaacccagcccagacctgagccctgccctgtctactgtccgaaggggcagaaaggggaacctggagagatgggactcagagggcaggttggaccaccaggcgatccaggccttccaggacgaacgggcgctcccggccctcagggccctccaggaagcgccaccgccaagggcgaacggggctttccaggcgcagacggtagacccggctccccgggacgggcagggaatcccgggaccccgggggctccaggactgaaaggaagccctgggctgccaggtccgcggggtgacccaggcgagagaggacctagaggacccaaaggcgaacccggggcgcccggtcaggtgattggaggcgagggacctggcctgccgggtaggaaaggcgaccctgggccgtcaggccctccaggaccccgggggcccttaggcgatcccggaccgagggggccacctggactccccggaacagctatgaagggcgataaaggagacagaggggaacgcgggccccctggacccggtgaaggcggcattgctccaggggagcccgggttaccagggttgcccggcagtccagggcctcaagggccggtgggcccccctggaaagaaaggcgagaagggggatagtgaagatggcgcccccggcttacctggtcaaccaggaagccctggagagcaaggaccccgcgggccacctggcgcgatcggaccaaagggggataggggattccccgggcctcttggtgaggctggcgaaaagggcgagagggggccacctggaccagccggatccaggggcctcccgggcgtcgccgggagaccaggggctaagggcccagagggtccaccgggccccactggccggcagggcgagaaaggagagcctggcaggccaggcgatcccgccgtcgtgggaccggccgtcgcggggcccaaaggcgagaagggtgacgtggggccagccgggcctcgtggcgctactggcgtgcagggagaaaggggtcccccgggtctggtgctgccaggagatccagggcctaaaggtgatcctggtgaccgcggacccatcggtctcactgggagagctggtcctcctggcgacagtggtccaccaggcgagaagggcgaccctggacgcccaggaccgccaggacctgtgggccctcgcggacgggacggggaagtgggcgaaaagggcgatgaaggaccacccggggatccaggcctgcccgggaaagctggtgagaggggactgagaggtgcccctggtgtccgcgggcccgtgggggaaaagggagaccagggggacccaggcgaggacggccggaacggctctcctggatcgtccgggcctaagggcgacaggggcgagcctggaccccctggaccgccaggcaggttagttgacactggccctggagcacgcgagaagggcgagccgggtgatcgcgggcaggagggtcctagagggcccaagggcgatcccggtttacctggcgcccccggggagaggggaatcgagggttttagaggacctcccggaccacagggcgaccccggagttcgcgggccagccggggaaaagggagaccgtgggcctcccggtctagacggtaggtccggactcgatggaaaaccaggcgcggccgggccatctggtcccaacggggcggccggcaaagctggtgacccaggacgagacggcctgccagggctgcggggcgagcaaggactgccaggcccatccgggcccccgggcctacccggcaaaccaggggaggatggcaaacctggactaaatggcaagaatggggagcccggggatcccggggaggacggtaggaaaggcgaaaaaggtgactctggagctagcggccgcgaaggtcgcgacggacccaagggtgaacgtggtgcccccggcatcctcggaccacagggcccacctggactcccagggccagtcggtcccccaggccaggggttcccaggggtgcccgggggcactgggcctaagggcgacagaggagagacggggtcgaaaggcgagcaagggctccccggtgagagagggctgcggggtgaacctggatccgtgcccaacgtggacaggttgctggagactgcgggcatcaaggcctcagccctgagagagatagtggaaacttgggacgagagcagcgggagttttcttcccgtccctgaacgaaggaggggccccaagggagactcaggtgagcagggtccacccggcaaagaggggccaatcggattcccaggtgaaaggggtttgaaaggtgaccggggcgatccaggtccacagggcccccctggtctggcactcggggaaagaggtcctcctggcccatccgggctagccggtgagcctgggaagcctggcattccaggactgccagggagggccgggggtgtaggggaagccgggcggccaggcgagcggggtgagaggggtgagaaaggcgagaggggcgagcaagggagggatggcccaccgggtcttcccggaacacctggtcctcccgggcccccaggacctaaggtgagcgtggatgagcccggccccggattgagcggggaacaggggccaccaggccttaagggcgcgaagggtgagccgggcagtaatggcgatcagggaccaaagggtgaccggggagtgccaggcataaagggagaccgcggcgaacccgggccccggggccaggatgggaatcccgggctgccgggagagaggggtatggcgggccccgagggcaagccaggtttacaggggccgcgcggacctcccgggcccgtcggaggacatggggacccaggccctcccggtgcccccggattagccgggcctgccgggccccagggccccagcggtctcaagggtgaacccggtgaaaccggacccccaggaagagggctaactggccccaccggcgccgtagggttgcccggaccacctggcccatctggcctggttggtccgcaggggtctcccggactccccggacaggtaggagagacggggaaaccgggagctccaggccgagacggagcgagcggaaaggacggcgaccgcggctcacccggcgttcctgggtcgcccggtttacctgggcccgtcgggcccaaaggggaacccggccctacaggtgcccctggacaggcggtggtcggactgcctggcgcaaaaggagagaagggcgcccccggtggactcgctggagacctggtcggcgagccaggagctaaaggtgaccgtggtctgccggggcctcggggggagaaaggtgaggcaggacgggccggcgagcccggtgatcctggcgaagatgggcagaagggagctcctggaccaaagggtttcaaaggcgaccccggtgtgggagtccctggttcaccgggcccccccggcccccccggagtcaagggcgacctcggccttccgggtttacccggagcccccggggtagtggggttcccaggacagaccggccctcgtggcgagatgggccagccagggcctagcggcgagagagggctggctggccctcccggtagggaaggtatcccgggcccactagggccaccaggccccccaggatcagtcgggcccccgggagccagcggcctcaaaggggacaagggagatccaggagtgggacttcccggccctcgtggggaacgtggagagcctggcattaggggggaagatggtcggcccggccaggagggcccacggggcttgaccggcccaccaggttcccggggggagaggggggagaagggagacgtgggcagcgccggactcaagggcgacaaaggggatagcgccgttattctggggcctcctggcccacgaggggctaagggtgatatgggggaacgggggcctaggggcttagatggagataaggggccccgcggagataatggggaccctggtgacaagggctctaagggggagcccggtgacaagggctcagcgggacttccaggcctacgcggattattgggcccgcaaggccagcccggcgccgcaggcattcccggtgatcccggctctcctggcaaagatggcgttccgggaatccgaggcgagaaaggcgacgtaggctttatggggcccagagggctgaagggtgagcgcggagtgaagggtgcttgcggtcttgatggtgagaagggggataaaggcgaagctggtcctcccggacgcccaggtcttgccggccacaaaggcgagatgggcgagccgggcgtgcctggacaatctggggccccagggaaggaggggcttattgggcccaaaggtgaccgtgggttcgatgggcagcctggacctaagggcgatcagggggaaaagggagaacgcgggacccctggcataggcggattccctggaccaagtgggaatgacggcagcgccgggccgccggggccaccagggagcgtggggcctagaggtcctgaaggtcttcaggggcagaagggcgaaagaggaccccccggagaacgagtagtgggagcgccaggagtaccgggcgcccctggggaaagaggcgagcaagggcgccctggaccagctggcccacgcggggaaaagggggaagccgctctgacagaggatgacattagaggtttcgtgcggcaggagatgtcccaacactgcgcctgtcagggtcaattcattgcgtctggttctcgcccactgccaagttatgccgctgacacagcaggctcccaactgcatgccgtgcccgtcctcagagtgtctcatgccgaggaagaagagagagtgccacccgaggatgatgaatattctgagtatagtgaatactccgtggaagaatatcaggacccagaagcaccctgggattcggatgacccatgttcactgccccttgacgagggatcttgtaccgcttacaccctcagatggtaccaccgcgctgttaccggctcgacggaagcatgccaccccttcgtgtacgggggttgtggtggaaatgccaacagattcggcactagagaagcttgcgagagacggtgtccacctcgcgtggtccagtcacagggtaccggcaccgcccaagat

SEQ ID NO: 9575 - DNA, 8832 bp, Artificial Sequence
  Description of Artificial Sequence: Synthetic coding sequence
atgacccttaggttgttggtcgccgcactgtgcgcaggaatactcgctgaggcccctcgggtgcgcgcgcaacatcgtgagcgggtgacttgtacccgcttatatgcagctgacattgtgttcctgctcgatggctctagctccatcgggaggagcaacttccgggaggtacgctcctttctcgaagggttggtccttcccttcagtggagccgcaagcgcgcagggcgttcggttcgccaccgtgcagtacagcgatgaccctagaaccgagttcggcctggacgcactggggtctggcggagatgtcattagggcaatacgcgagctgtcatacaaaggcggcaacacccgcaccggcgccgccattcttcacgtggctgatcatgtgttcttgccccagctcgcccgaccgggagttccaaaagtgtgtatcctgattaccgatggaaaatcacaggacctggtcgacaccgcagctcagcggttgaagggtcaaggtgttaagttgttcgccgtcggcattaagaacgccgacccagaggagctgaagagggtagcctcacagcctacgtctgattttttcttttttgtgaacgacttctctatcctcaggacactgctacccttagtgtccaggagggtgtgtaccacagcggggggagtgcccgtaactaggccgcccgatgactctacctcagcccctcgggatctcgttctctccgagcccagcagtcaatccctaagagtccagtggaccgcggctagcggaccggttacggggtacaaagtccagtatacacctcttaccgggctggggcagccattaccaagcgagaggcaggaagtcaatgttccagccggagaaacttccgtgcgcctccgcggactgcgtccattaacggagtatcaggtgaccgtgatcgccctgtatgcaaattccatcggcgaagccgtcagcggcacagcaagaacaactgccctggaggggcctgaactaacaatccagaacaccaccgctcatagtctgctagttgcatggcgttccgtgcctggtgctaccgggtatcgggtgacatggagagtcctcagtggtggccctactcagcaacaagagttgggcccgggccagggctcagtacttctgcgggacctggaacctgggacagattatgaggtcacagtgtccaccctctttggtcggtcagtcggccccgctacctcattgatggccagaacggacgctagtgtggagcagaccctcagacccgtgatcctggggcccacaagcattctgttaagttggaatttggtgcctgaggcccgcggttatcgcctggaatggcgtcgggagaccggcctcgagccaccccaaaaagtagtactgccatcggacgtaacccggtaccagcttgacggcctgcagcctggaacggagtatcgcctgacattgtacactctacttgagggacacgaggtcgcaacccccgccaccgtcgttcccaccggacccgagcttcccgtcagtccagtgacggatctgcaggctacagagctgcccgggcagcgtgtgcgggtgtcatggtctcctgtgcccggagcaactcagtacaggattatcgtaaggtccacgcagggggtggagcgcactctggtccttcctggcagtcagacagcgtttgacttagatgacgttcaggcaggcctctcttatactgttagggtcagcgctagggtgggccccagggaaggctccgcaagcgtactgactgtaagaagggagcctgagacgcccctggccgttccaggcttgcgagtcgtggttagcgatgccacaagagtgcgagtggcctggggaccagttccgggcgccagtggctttagaatctcctggtctacaggatctggccccgagtcttctcagacgttaccccctgactccacggccactgacattactggattgcagcccggaacgacctaccaggtcgctgtgtccgtcttgagaggaagagaggagggtcctgctgctgtgatagttgcgcggacagaccctcttggccctgtgcgcacagtgcatgtgactcaggccagttcctcctccgttactatcacctggacccgcgtccctggggccacaggctatagagtgagctggcactccgcacacggacctgagaaaagtcaattagtaagcggggaggccaccgtcgccgagctcgacggacttgagcccgacaccgagtatacagtgcacgtgcgggcccatgtggcaggggtggacgggccccctgcaagcgtcgtcgtaaggaccgcccctgaacctgttggaagggtgtctaggctccagatcttgaacgcatctagcgatgtgcttagaatcacttgggtcggggtcactggagcaaccgcctatcgcttagcctgggggcggtcagagggtggccctatgcggcatcagatactacccggaaatacagactcagcagagattcgaggattagagggaggggttagctatagcgtccgcgtaaccgcactggttggcgacagagaagggactcctgtcagcattgtagtaacgacacctcctgaggcaccgcccgcacttggcacactccacgtagtgcaacgcggagagcattccctgaggctgcggtgggagcctgtgcccagagcccaagggtttttgctgcactggcaaccagagggcggacaagaacagtcccgggttctgggtccggagctctcttcgtatcacttggatggtctcgagcccgccacacagtatagggtaagactcagtgtgctcggccccgcaggcgagggccccagcgccgaggttactgcccgcacagaatctccacgcgtgccgtcaattgagctgagggtcgtcgacacttccattgacagtgtgacattggcatggactccggtgtcgagggcgagctcatacatactcagttggcgacctctgaggggccccgggcaagaggtgccagggtcacctcagacattgccaggtatcagctcttcccagagagttactggcctggagcctggagtatcgtacatttttagcttaacgccagtcctggatggagttagaggccctgaggcatcagttacccagacccccgtgtgtccaagggggttggcagatgtggtgttcttgccgcatgcgacacaggataatgctcatcgggcagaagctactagaagagtgcttgagaggttagtgctggcactcggcccactcggcccccaggctgttcaggtaggactgctgtcctactcccatcgaccaagccctctgtttccactgaacggctcccatgatcttggcatcatccttcagcgcattcgagacatgccatatatggatcctagcgggaataacctggggacggccgtcgtcaccgcccatagatatatgcttgcccccgacgcgcctgggcgaaggcagcacgtccccggggtaatggtattgctcgttgatgagcctctcaggggcgatatcttttcccccatcagagaagcccaggcctccggcctcaacgtggtaatgctgggaatggccggcgccgatcccgaacagctgcgccgcttagccccaggcatggactctgtacaaactttctttgccgttgacgacggtccctcactagatcaggcagtgagcggattggccacagcgctgtgtcaagcgtctttcactacgcagccacgtccagagccctgtcccgtgtactgcccgaaaggtcaaaaaggagagccaggagagatgggcctccgaggccaggtggggccccccggcgatcccggcttgccagggagaactggcgcaccgggaccacaaggcccaccggggtctgccacagcgaaaggtgaacggggctttcctggtgcagacggaaggcccgggagccccggacgcgccggtaacccaggcacccctggggcccctggcctgaagggttcaccaggccttcccggccctcgaggcgaccctggtgagcggggccctcggggcccgaaaggcgagcccggtgcacccggacaggtaattggcggagagggccctggattacctggtaggaagggagatccaggacctagcgggcctcccggtccacgcgggcccctcggtgatcccggaccccgcgggcccccagggctgcccggcaccgccatgaagggcgataaaggcgaccgaggcgaacgcgggccgccaggtcccggtgaggggggcatagccccaggtgagccaggactcccgggtcttcccggaagccccggtccgcaaggccctgtggggccacctggaaagaaaggggagaaaggcgactctgaagacggagcccccggcttgccaggtcagcccggttcacccggcgaacagggcccacgaggtccccccggggccatcggacctaagggagatcgggggtttcccggacctctaggcgaggccggcgagaaaggcgaacggggccccccggggcccgcaggtagccgcggattgccaggggtcgcaggtaggcctggggccaagggcccagaaggtcctcctggacctaccggaagacagggcgagaaaggcgaacctgggcggcctggagaccctgcagttgtgggccctgccgtggccggccctaaaggggagaaaggggatgtaggcccagcgggaccccggggggcaaccggagtccagggtgagcgaggtcctcccgggttagtgctgccaggcgatccagggcccaaaggggaccccggtgaccgcggacccataggcttgacaggccgggctgggccaccaggggactcgggaccgcccggggagaaaggagaccctgggcgacccggaccacccgggcctgtgggtccaagagggagagacggggaggtgggagaaaagggagatgaaggccctccaggggatcctggactcccgggcaaggctggcgagcgcggtctcaggggagcacctggtgtgcgcggaccggttggggagaagggggatcagggcgatcccggagaggacggcagaaacggttctcctggtagttcagggcctaaaggggaccggggggaaccaggccctccagggcctccggggagactcgtagatacaggtcccggtgcgagggagaaaggggagccaggcgataggggacaggagggccccagaggccctaaaggcgatcccggtctgccgggtgcgcctggcgagagaggaatcgaaggctttcgtggaccgccaggacctcagggagacccgggggtgcggggccccgcaggggagaaaggcgaccgtgggccgcccggactggacggaaggtcgggattagacggcaaacctggagcagcaggcccaagcggccccaacggcgccgccggaaaggcaggcgacccaggccgagatgggcttccggggttaaggggggaacagggcctgcccggacccagcggtcctccaggcctccctgggaaacccggggaggacggtaagccaggcctgaacggtaagaatggcgaaccaggtgatcctggcgaagacggccggaaaggggaaaaaggagattcaggcgcctccggacgggagggccgcgacggacccaagggagaacggggggcccccgggatcctcggaccccagggcccacctggcctccccgggcccgtaggcccccctggtcaggggttccctggcgtgccaggaggcactggacccaagggggaccgaggagaaactggatcaaaaggcgaacaggggttacctggggagcggggcttaaggggcgagcccggcagcgtgcctaacgtggaccgcctgcttgaaaccgccggaatcaaagccagtgcccttcgggagattgtcgaaacttgggatgagtcaagcggctcattcctgcctgttcctgaaaggcgtcgaggccccaaaggcgatagcggtgaacagggacctcccggaaaggaggggcccatcgggttccctggggaaagagggctgaaaggcgatcgcggagaccccggtcctcaaggcccaccaggtctggctctgggtgagagagggcccccaggcccttccggcctggccggagaacctggcaaacctgggattccggggctgccaggcagggcaggcggtgttggagaagctggaagaccaggagagcgcggagagagaggggagaagggtgagaggggcgagcagggacgagacggccccccaggcttgcctggcacgcccggtccgcctggacctcccggtccgaaagtgtccgtggacgagcctggaccaggactgtccggagaacaggggccacctgggcttaagggggcaaagggtgagccaggtagcaacggcgaccaggggcctaagggcgacagaggagtgcccggcattaaaggagaccgcggcgagccaggcccccgggggcaggatggaaacccagggctacccggggagcggggaatggctggtcccgaaggcaagcctggattacaggggcctagggggcccccgggccctgttggagggcatggagaccctgggccacctggcgcacccggactggccggtcctgctggaccccaggggccctccggcctgaaaggcgaaccaggcgagacgggccccccaggcagaggacttacgggccccactggagctgtgggccttcccggcccacccggtccttcaggtcttgtcgggccccagggttcccctgggctccctggccaggtgggggagaccggaaaacccggcgcccctggcagagatggagcaagcgggaaggacggggatagagggtctccaggcgtaccaggatcacccgggttacccggtcccgtcggcccaaaaggcgaacctggacccaccggcgccccgggtcaggcggtagtaggcttgcctggagcaaaaggagaaaagggcgcccccggaggcctagcaggcgacctggtaggcgaaccaggggccaagggagatcgaggtctgcctggaccaaggggagagaaaggagaagccgggcgcgctggcgagccaggcgaccctggtgaagatggccagaaaggagcccctgggcccaaggggtttaaaggtgaccccggagtgggtgtccctgggtccccaggtcctcctggaccaccaggagtgaaaggagacctcgggctgcctggcttgccgggtgcgccaggtgtcgtgggattccctggacagacgggacccagaggggagatggggcagcctgggccatcgggcgagcggggactggccggaccacctggaagggagggtattccgggccccctcggaccaccgggtccccctggctccgttggcccccctggtgctagcgggctcaagggagataagggagaccccggtgtgggactgccagggcccagaggggaacgcggcgagccgggcatcaggggtgaggacggtaggccgggacaggaaggacctagaggcctaacgggaccaccggggagcagaggcgaaagaggcgaaaagggcgatgtaggcagtgctggactgaagggtgacaagggagacagcgccgtgatactaggcccaccaggaccgagaggggcgaaaggagatatgggagagcggggccctcgggggctggatggggacaaggggccacgtggagataacggcgatccaggtgataaaggatcaaagggggaacctggcgacaaaggaagtgccggcctacccggcctgcggggcctgctcgggccacaggggcagcccggcgcagctggcatcccgggagatcccgggtctccagggaaggatggagttcctggaatcaggggagagaagggagatgtcgggtttatgggcccccgggggctgaaaggtgagcggggcgttaagggggcatgcggcttggacggtgagaaaggtgataagggagaggccggccctcccggtcggcccggactcgctggacataagggagaaatgggcgagcctggagttcccgggcaatccggggctcctgggaaggaggggcttatcggccctaagggagaccgtggtttcgacgggcaaccgggacctaaaggggatcagggcgagaaaggtgaaagggggacccccggcatcggcggcttccctgggccatccggcaacgatggctctgctggccctccaggcccaccggggagtgttgggccccgtgggcctgagggactccaaggccagaaaggtgaacgcggtcccccaggagaacgcgttgttggggctccaggcgtgcctggggcaccgggagaacggggcgagcaggggcggccaggtcccgccggtccaagaggggagaagggcgaggcagctttgaccgaggacgatatcagaggcttcgtaagacaggagatgtctcagcactgcgcttgtcagggacagttcatcgcctccggcagcagacccctaccatcatatgccgcagataccgctggatcccaattgcacgcagtgccggtgctgcgcgtgagtcacgcagaggaggaagagcgcgtgcctcccgaggacgacgaatattccgagtatagtgaatactctgttgaggagtatcaagatccagaggccccttgggacagcgacgacccatgttctctgccattggatgaaggctcttgtacggcatataccctgcggtggtatcatcgagcagtgacggggagcaccgaggcgtgccacccttttgtgtacggtggctgtggtgggaatgctaatcgattcggaacacgagaagcctgcgaaagacggtgtccccctcgtgtcgtgcagagccagggtaccgggactgctcaggat

SEQ ID NO: 9576 - DNA, 8832 bp, Artificial Sequence
  Description of Artificial Sequence: Synthetic coding sequence
atgactttgcgcctgcttgtcgccgccctgtgcgcaggaattctcgcagaggctccacgcgtgcgcgcccaacacagagagagagtcacctgcacacgactctatgctgccgacatagtctttcttctcgacgggtcctcatccatcggtcggtccaacttccgggaagtccggtctttcttagagggtctcgtgctcccattcagtggcgctgctagtgctcaaggtgtgcgctttgccacagttcagtacagcgatgacccacgcactgagttcgggctcgatgccctgggctctggtggcgacgtgatcagagccatacgggaactcagctacaagggaggaaacacccgaactggtgctgccatccttcatgttgcagaccacgtgttcctgccacagctggctcggcctggagttcccaaagtgtgtattctgataaccgacggaaagtctcaggacttggtggacaccgcggcccagagactgaaaggacagggcgtaaaactcttcgccgttgggatcaagaatgctgacccggaagagctgaagagagtggcgtcgcagcccacatcagactttttcttcttcgtaaacgatttctccatactaagaacattacttcccctggtcagtagaagagtgtgtacgactgcagggggagttccagtgactcgaccccccgacgacagtacgtccgcccctcgggatctcgtgctgtccgagcctagctctcagagcctcagagttcaatggacggccgcctctggtcccgtgactggctacaaggtccagtatactccattgacaggactagggcagccgctccctagtgagcgccaggaggtgaacgtccctgctggggaaacaagcgtcaggctgcgtggactgcgccctctgacagagtatcaggtgactgtcattgccctatatgctaactctatcggagaggccgtgagcgggacagccaggacaaccgccctggagggaccggaactcaccatccagaacaccacagcgcattcactgttggtcgcatggcggtccgttcctggcgctacagggtacagggtgacctggcgcgtgctgtcaggcgggcccactcagcaacaggagcttggcccgggccaaggtagcgtgttactccgggacctggaacccggcacggattatgaggttaccgtctctactctgttcggaaggtccgtcgggccagcgaccagcctaatggccaggaccgatgctagtgttgaacagacactgcggccagtgatcctcgggccaacatcgatccttctgagttggaacctggttcctgaagcccgcggatatcgccttgagtggcgacgcgaaacaggcctcgagcccccgcagaaggttgttctcccttccgatgtgactaggtaccagctggatggcctgcagcctggtacagaatatcggctgaccttgtataccctattggagggtcacgaggtagcaacccctgctactgtggtcccaaccggccccgagctacccgtttctcccgtgaccgaccttcaggcgacggagttacccggtcagcgcgttagagtgagctggagtcctgtgcctggagcaacccagtacaggataatcgttcgatcaacacagggcgtggagcgaactcttgtgcttcccggttctcaaaccgctttcgacctggacgacgtgcaggccggtctgagttacacagtgagggtctccgctcgggtaggtccacgagagggatcagcatccgtgctgaccgtgaggagagaacccgagacacctctcgcagtacctgggctgagagtggtagtttcagatgccacccgggtgagagtggcttggggccccgtccccggcgcctcaggtttccggattagttggagtacaggttcaggacccgaaagctcgcagacacttccgcctgatagcaccgccacggacattaccgggctgcagcccggcaccacctaccaggtggcagtgtctgtgctccggggaagggaggagggccccgccgcggtgatagttgctagaactgatccccttggccctgtccgcactgtgcacgtaacccaggccagctcatcctccgtcactataacatggaccagggtgcccggggccacaggatatcgggtctcatggcacagcgcccacggcccggaaaaaagccaactagtatctggcgaggcgacagtggccgaactggacggcctcgagcccgacaccgagtacacggtgcatgtgcgagcccacgtcgccggcgttgacggcccccctgcatctgtagtggtccgcaccgcccctgaacccgtggggcgggtgtcccggttgcagattctcaatgcaagcagtgacgtcctgcggatcacctgggttggcgttacaggcgcaacagcttaccggcttgcctgggggaggagtgaagggggaccaatgagacaccagatcttgccgggaaacactgattccgccgagatccggggcctggagggcggcgtgtcatatagcgtgagagtgacagcccttgtgggtgaccgtgaaggcactccggtttccatagttgttacaacaccacccgaagcacctcctgctctaggaactctgcatgttgtccaaaggggcgagcatagtcttagactcagatgggagcctgtaccccgcgcacagggcttcctacttcactggcagccggaaggaggtcaagagcagtctagagtcctgggcccagaactgtcctcgtatcacctcgacgggttggagccagccacccagtatcgcgtgagactgtctgtgttgggtccagccggggagggtccttcggcggaggtcaccgcgaggacagagagccccagagtgccctccatcgagctcagggtggtcgatactagtattgactctgtcaccctcgcttggaccccagtaagtcgtgcaagtagctacatcctctcatggaggccgttgcgggggcctggacaggaggtaccagggtcaccgcagacgcttcctggcattagcagttcacagcgcgtgactggcttggaaccaggagtgagttatatattttcactgacacccgtgctggacggtgtcagggggcccgaggcttcggtcacacaaacaccagtctgccctcgtggacttgcagacgttgtttttctcccccatgcaacacaggataatgctcaccgcgccgaggcaactaggcgtgtcctcgagagactggtattagccttgggccccctggggccacaggccgtgcaagtcggtctcctaagctattcgcatagaccctcaccactgtttccattaaacgggtcccatgatttaggtatcatactccagaggatcagggatatgccttacatggaccctagtggtaataatttgggtacggccgtcgtgactgcacacaggtacatgttggcccccgacgctcctggacggagacagcatgtgccgggtgtgatggtcctattggtcgacgaaccactcagaggcgacatcttctcaccaatacgcgaagctcaggcgtctgggctgaacgtggtgatgctcggcatggcgggggcggatccagagcagctcaggcggctggcgcccggaatggattcggtgcagacttttttcgccgtcgacgacgggccaagcctggatcaggcagtatccggcctcgccacggcgctgtgtcaagcgtcttttactacccagcccaggcctgagccatgtcctgtatactgcccgaaggggcagaagggcgaaccgggcgagatgggattgcgggggcaggtgggacctcctggggaccccgggttaccaggacgaactggcgcccccgggccacaaggacctcctgggagcgcaactgcaaagggagagagagggttcccaggagcagacgggcggcccggctcaccggggagagctggtaatccaggtaccccgggggctccagggttgaaagggtctcctgggctgcctggacccagaggagacccaggcgagcgaggcccaagggggccaaaaggtgaacctggggcaccaggacaggtcatcggaggcgaaggcccaggcttgcctgggaggaagggagacccaggtccaagtggcccccctggcccgagaggaccactgggcgaccccggcccccgggggcctcccgggttgcctgggacagcaatgaagggtgacaagggagataggggggagcggggccccccgggacccggggaagggggaatcgcacctggagagcctgggctgcccggtcttcctggtagcccaggtccacagggcccagtgggtccaccgggcaagaaaggcgaaaagggtgactccgaagacggagccccaggattgccaggccagccggggtctcctggagagcagggaccgagaggtccccctggggctattgggccaaagggagatcgaggatttcctggtcccctgggtgaagcgggcgaaaaaggtgagaggggaccccccggacctgccgggtccaggggcctgcccggcgtggcaggtcgacccggagctaagggtcctgaaggacccccaggacccacaggtcgtcaaggcgagaaaggcgagccaggcagacctggcgacccagccgtggtaggcccagccgtggccggaccaaagggcgaaaaaggcgacgtgggcccagctggtccacggggagccaccggggtgcagggagaacgcggaccccccgggctggtgcttcctggtgaccccggcccaaagggggatccgggagatagaggcccgatcggcctgaccggccgggcagggccacccggggattccggacctcctggagaaaaaggggaccccggacgccccggaccccccggacccgtgggaccccgtggaagggacggggaggtgggggagaagggggacgaaggacctcctggagatcctggacttccaggaaaggcgggggagcgaggccttcgcggcgcgcctggggtccgggggccagtaggagagaaaggcgatcagggtgatccaggggaagacggaaggaatggtagcccgggctccagcggcccaaagggtgaccgtggagagcctggtccacctggccctcctggccggttggttgatactggccctggagcaagagagaaaggtgagcccggagatcgcggccaagagggacccagaggaccgaaaggggaccccggactccccggagcaccaggcgaacgcggaattgagggttttaggggcccacctggccctcagggcgacccaggtgtccggggaccagctggggaaaaaggcgatcgtggtcctcccggactggatggacgatctggactggacggcaaaccaggtgccgccgggccgtccggacctaacggggctgctggcaaggctggtgaccccggaagggacgggctgcctggcttgcgtggggaacaaggcctgccaggtcctagtggtccacccggtctaccaggtaaacccggcgaagacggaaagccagggctcaacggcaagaacggtgagccaggtgatcccggggaggacggccggaagggagagaaaggggactccggtgccagtggacgtgagggccgggatggacctaagggggaaagaggggcgcccgggatcctcggtccccagggcccgcccgggttacccgggcctgtgggaccgccggggcagggattccctggcgtgccgggaggcactggacctaagggtgacaggggggaaacagggtcgaagggggagcagggcctcccgggagaacgggggttacgtggcgagcctggctcagtacccaacgttgaccgccttttggaaaccgcaggtatcaaagccagtgcgctgcgtgagattgtggagacatgggatgagtcttcagggtccttcctccccgtaccagaacgaaggcgcggacctaagggagattccggcgagcaggggcctccgggaaaggaaggacctatagggtttccgggagagcgtggactgaagggtgatcgtggtgacccagggcctcaaggaccccctgggctggctttgggcgagcgcggacctcccgggccttcggggctggctggcgagccaggaaaaccagggatcccgggcctgcctggtcgcgccggaggagtcggagaggccggacgcccgggggagcggggagaacggggcgaaaagggcgagagaggcgagcaagggagggacggccctcctggcctgcccgggacaccaggcccccccggccctccaggcccaaaggtaagtgtggacgagccaggtcccggcttgtctggggaacaggggcctcctggcttgaaaggtgccaaaggggagccaggctcaaacggcgaccagggcccaaaaggcgataggggagtccctggaatcaaaggcgacagaggcgaaccaggcccccgcggacaggatggaaatccagggctgcctggagaacggggaatggctgggcccgagggaaagcctgggctgcagggtcctaggggaccaccaggcccagtggggggacatggggacccaggccctcccggagcccccggactcgcagggcccgccgggccccaggggcctagcggactgaagggcgaacccggagaaacagggccacccggccgcggcctgacagggccgaccggcgcagtgggtctccccggaccacccgggcctagcgggctggtggggccccaggggtccccggggctcccgggccaggtgggggaaacgggaaagccaggggcacccggaagggacggtgcgagtggaaaggacggagataggggatcgccaggtgttcccggatcgccaggcctccctgggcctgtcgggccgaagggggagccgggccctacaggagcccctggccaggccgtggtgggtctgcctggcgccaaaggagagaagggtgccccagggggcctagctggcgacctggttggcgaacctggcgctaagggggataggggtctgcctggaccccggggagagaagggagaagcaggccgtgctggagagccgggagacccaggcgaggacggccagaagggtgcgcctgggccgaaaggcttcaagggcgacccaggcgtcggcgtgccgggtagccccggacccccgggtcctccaggcgtgaaaggcgatctcggccttcccggcctgccaggggctcccggggtggtaggtttcccgggtcagaccgggccgcgaggggagatgggacagccaggcccgtccggcgagcgagggctggcaggaccaccaggccgagaggggattcctggaccgctaggtccccctggacctccaggatctgtgggcccacccggcgcttccggcttgaagggcgacaagggggacccaggggtggggttacctggaccaaggggagagcgtggcgagccaggcataagaggggaggatggaaggcctggacaggagggacctcgcggattgacaggccctcccgggtcccgaggtgagagaggggaaaaaggcgacgtcggttccgcgggtctaaagggggacaagggagacagcgctgtgatcttgggtccaccaggccctcgaggtgcaaagggagatatgggggagcgtggcccccgtggcctcgacggggacaaaggaccacggggcgataacggcgatccaggcgataagggctcaaagggagagccgggcgacaaagggagtgcgggacttccgggcttgagagggctgcttggcccacaggggcagccaggagctgctggaattccaggggacccaggcagcccaggtaaagacggcgtcccaggaatccgaggagagaagggggacgttggattcatgggtccacgcggcttaaagggagagcggggcgtgaagggggcctgcggactggatggcgaaaaaggcgacaagggggaggccgggccgccgggacgccccgggctggcaggccacaagggtgagatgggtgagcccggagtgccagggcagtctggagcccccggcaaggaaggtcttattgggccaaagggggaccggggattcgatggtcagcctggtcccaaaggggaccagggggagaaaggtgagcgcgggactcctggcattggaggcttccctggtcctagcggtaatgacggatctgccggaccaccagggcccccggggtccgtcggcccaagaggcccggaaggtttacaaggccaaaaaggcgagagagggcctcctggcgagcgtgtagtgggagccccaggagtccccggcgctccgggggagagaggcgaacagggccgccccggccctgcgggcccccgcggcgaaaagggcgaagccgccttaaccgaggacgatatccgggggttcgtgcggcaggagatgtctcagcactgtgcgtgccaaggtcaattcatcgcatccgggtctaggcccctgccttcctatgcagcagacacagcgggcagtcagctgcatgccgttcccgtgctgcgcgtgtcacacgcagaggaagaagaaagggtaccccccgaggatgacgagtactcagagtattctgagtattcagtagaagagtaccaggatcccgaggcaccctgggactccgacgatccttgcagcctgccactggatgagggcagttgcaccgcttataccctccggtggtatcatagagctgtgaccggtagcactgaggcctgccatccttttgtgtacggagggtgtggggggaacgctaatcgcttcggaactcgggaagcctgcgagcgcagatgcccaccacgggtcgtgcagtcccagggcacaggcactgcccaggat

SEQ ID NO: 9577 - DNA, 8832 bp, Artificial Sequence
  Description of Artificial Sequence: Synthetic coding sequence
atgaccctgcgtctgctggtagctgccctgtgcgccgggatcttggctgaagctccccgtgtcagggcccagcatcgggaacgagtcacatgtacacgactgtacgccgcagatattgtctttctattagacggttcatcttccatcggccggtcaaattttcgggaggtacggtccttcttggagggcctggtcttgcctttctcgggcgccgctagcgctcagggtgtgcgcttcgctaccgtccagtattcagacgaccccagaactgagttcgggcttgatgccctcggctccggcggggatgtcattagggcgattagagagctgtcttataaaggcggcaatacgagaaccggtgcagcaatcctgcatgtggctgaccatgtgttccttccacagctggctcgcccaggggtgccgaaggtctgtatcttgataaccgacggtaagtcccaggacctggtcgacacagccgcacagcgcctgaagggtcaaggagtcaagcttttcgctgtggggataaagaatgctgacccagaggagttgaagagagtggcttcccagccgacatctgacttttttttttttgtcaatgacttttcaatactgaggactctattacccctggtctctcgcagagtctgcacgacagccggcggagtgcctgtgactcgccccccagatgacagcactagtgctcctcgggatctagtgctgtcggagccatcttcccaatctttgagggtccagtggacagctgccagcggcccagtaaccggctacaaggtgcagtatacccccctgaccggactggggcagcctttgccatccgagcgtcaggaggtcaacgttccagccggggagacctccgtgcgcctaagaggccttcggcctttaacagagtatcaggtgaccgtaatcgcgctgtatgccaatagcattggggaggccgttagtggaaccgccagaacaaccgccttggaagggccagagttgacgatccagaacactacagcccatagcctcctagtggcgtggcgttctgtacccggggcgactggttaccgagtcacctggagggtgctgagtggagggccaacccagcagcaggaactcgggcccgggcagggctcagttcttctgcgagacctggagccggggactgactatgaagtgactgtgtccacactgtttggtcgtagtgttggccctgccacaagcttgatggcccggacagatgcttctgtcgaacagacgctgaggcccgtgatcctcgggcctacgtccattctgctgtcatggaacttagtgccagaggccagaggctaccggctggaatggcggcgcgagaccggacttgagcctcctcaaaaagtggtgcttccttctgacgtgacacgctaccagcttgatggcctgcaacctggtacagagtacagacttaccctgtataccctattagaaggccacgaggtggctacacccgccaccgtggttcctacgggtccggagctgccagtgtctccggtgacggaccttcaagcgacggagttaccggggcagagggtcagggtctcgtggtctccagtgcccggcgccactcagtaccggataatcgttagaagcactcaaggcgtcgaacggacactggttcttcctgggtcccagacggcttttgatctggatgacgtgcaggcaggacttagctacactgtgagagttagcgctcgggtcggcccacgcgaggggtcagccagcgtgctgaccgtgaggcgcgagcctgagacaccactggccgtgcctggcctgcgcgtcgttgtcagtgacgcaactcgagtgcgtgtggcatggggaccagtaccaggagccagcggcttccgcatcagctggagtacgggcagcgggccagaatcctcacagaccctacccccagattcgaccgctactgatatcaccgggctgcaaccaggaacaacataccaagtggcagtctcagtgctgcgcggacgtgaggaagggcctgcagcagtgattgtcgcacgtaccgacccgctcggccccgtgagaaccgttcatgtcacccaggcttcctccagctcggtgacaataacatggactagagtgcctggcgctacaggataccgcgtttcttggcacagtgcacacggacctgagaagagtcagctcgtcagcggagaggccactgtagcagagctagacggactggagcccgacacggaatacaccgttcacgtgcgggcacacgtcgctggagttgatggaccccctgcctctgttgtggtgagaactgctcctgagcccgtcgggcgagtctccagacttcaaatcctgaacgcgtcgtccgatgtcctgaggatcacttgggtcggagtcactggggcgaccgcctatcgcctggcttgggggaggtcagaaggaggacccatgcgccaccagatactacccggcaacacagactcggccgagatccgaggcctggagggcggagtatcatattctgttagggtaacagcgcttgtgggggaccgtgagggaacaccggtgagcattgtggttacgaccccgccggaggcacccccagcactggggacactccacgtcgtacaacgaggggagcattccctgcgcttgcgctgggagcctgtgcctcgggcgcaggggtttctgctccattggcagcccgaggggggacaggaacagagcagggtgcttggcccagaattaagcagttatcatctggacgggctggagcccgccactcagtatcgggtcagactgagtgttctgggacctgccggggaggggccttccgcagaagtgacagctcggacggaatctcctagggtgccatcaatcgaattacgggtggtcgatacatctatagactccgtgactctggcctggaccccagtgagcagggccagctcctatatattgtcttggcgacccctcaggggaccgggtcaggaggtaccaggttctccccaaaccctgccaggcatctcctccagccagcgagtcactggacttgagcctggagtctcgtatatcttctctctgacgccagtacttgatggcgtcaggggccccgaggctagtgtgacccagactccagtgtgcccccgcggcctcgcagacgtggtgtttcttcctcatgccacacaggataacgcccacagagccgaggctacaagaagggtgctggaacgtctcgttctggctctcggaccactaggcccgcaggctgtgcaggttggactgttgtcctattctcaccggccatctcctctattccctctcaacggaagccacgacctcggaattattttgcaacgtattcgcgatatgccctatatggatccgagcggcaacaatctcgggacggccgttgtcacagctcatagatatatgctagcccccgatgcaccaggccggcgccagcatgttccaggcgtgatggtattgctggtggatgaaccactgcgaggcgacatcttttccccaatcagggaggcacaggcctctggtctaaacgtcgtgatgttgggtatggctggcgctgaccctgagcagctcagaagactggccccaggcatggacagtgttcagacattttttgctgtcgacgacggacctagtctagatcaggcagtaagcggcctagccacagctctgtgtcaggccagtttcaccacccaaccgaggcccgagccatgccctgtgtattgtcctaagggccagaaaggtgagcctggagagatgggtcttcgcggacaggtgggaccacctggtgatcccgggcttccgggtcgaacaggagcacccggtccacaaggtccacccgggtctgcgactgcaaaaggcgaaaggggttttcccggcgcggatggaagacccggcagtccagggagagccggcaacccgggaaccccaggcgcaccaggacttaagggctcccctggtttaccaggtccccggggagaccccggcgaacgaggaccgcgaggtccaaaaggcgagccgggcgctcccggacaggtgattggcggtgaaggtcccgggctgccaggtcgcaaaggagacccagggccatctggaccccccgggccccgtggaccgcttggcgaccccggtccccgtgggcctcccgggttacctgggactgccatgaagggggataagggagacaggggcgaacgtggccctccgggacctggtgagggagggattgcgcctggagagcctggcctccccggcctgcccggatcaccagggccccaagggcccgtagggccgccaggtaaaaaaggagaaaagggtgacagcgaagacggtgccccaggacttccagggcagccaggctcccccggcgagcagggtccaaggggacccccaggagccatagggccaaaaggcgatcgcggtttccccggcccgctgggggaagcgggcgagaagggagagcgcggcccaccggggcctgcaggttctcggggtctgccaggagtcgcaggccggcccggagctaagggccctgaaggccctccaggacccactggaaggcagggggaaaagggagagcctggccgacctggggacccagccgtggtaggtcccgcagtcgctggaccaaagggggaaaagggggacgtgggaccagctggaccacgcggggcaacaggtgtgcagggtgaacgaggtcccccgggactggtgctcccgggcgatcctggaccaaagggggaccccggggatagaggtcctattggcctaaccggaagggccggtccccccggtgactccgggccgcctggggagaagggggatcctggccgccccggcccgccgggacccgttggaccccgggggcgggacggagaggttggagagaagggcgacgagggacctcccggtgatcccggtctccccggtaaagccggcgagcggggactccgcggcgcccccggggtccgagggcctgtgggagaaaagggggaccaaggtgatcccggcgaagacggacgaaatggaagcccgggatcaagtggccctaagggggacaggggagaacctggcccccccggccctccaggccgcctcgttgacacaggtcccggggctagagaaaaaggagaaccaggggaccgggggcaagagggaccgagagggcccaaaggggaccctggacttccgggtgcacctggtgaacgaggcatcgaagggtttagaggccctcctgggccccagggagatccaggcgttaggggcccagccggtgagaagggtgatcggggccctcctggccttgacggtcggtctggacttgacggcaagcctggagctgcaggcccctcagggcccaacggcgccgctggcaaggctggtgacccaggtcgcgacggattacccggacttcgcggagagcaggggctgccagggccatcaggtccacccggattgccaggaaagcctggagaggatggtaagcccgggctaaatgggaagaacggggagccaggggaccccggagaggatggcagaaaaggagaaaagggagacagcggggcttctggaagggaaggccgagatgggcctaagggcgaaagaggggcgccggggattttaggccctcagggacctcctggccttccggggcccgtgggaccacctggccagggtttccctggagtgcctggaggtaccgggcctaagggggataggggggagactggcagtaagggggaacaggggttgcctggtgagcgcggcctgcggggagaaccaggctcagttccaaacgtggacagactgctcgaaactgctggtattaaagcttctgctctgcgggaaatcgtagaaacctgggacgaaagtagcggctccttcctccctgtgcccgagcggcgccgaggcccaaaaggtgattccggagagcagggccccccaggaaaggaaggaccaattggatttccgggagagcgtggcctcaagggcgatcggggtgatcctgggccacaaggaccaccagggctggccctgggggagcgcggcccccccgggccctcaggactcgccggagaacctggtaagcctggtattcccggtctcccagggcgtgccggcggtgtcggagaggcgggccgccccggagagcgcggagagaggggagagaaaggggagcgtggagagcaaggccgcgatggaccccctggcctccctggtactccgggcccccctggacctccaggacccaaggtctcagtcgacgaacctggccccggcttgagtggcgagcaaggccccccaggtctgaaaggcgctaaaggcgagcccggatcaaacggcgaccaaggacccaaaggcgaccgaggcgtgcccgggatcaaaggcgaccgcggggagcccgggccccgcggccaggacggaaacccaggccttcctggcgagagaggaatggccggtccagaggggaaaccaggacttcaaggtccccgaggtccaccaggacccgtgggaggacacggggatcccggtcctcctggcgccccagggctggcaggccccgccggcccacagggcccatcggggctcaagggtgagccaggtgagacaggacctcccggcagaggtctgacgggtcccacgggagccgtgggtctacccgggccacccggccccagcggcctggttggaccgcagggctctcctgggctgccaggacaggtgggcgagaccggaaagcctggcgctccagggcgtgacggcgcttctgggaaggatggtgaccgcggcagccccggcgtgccggggtcccccgggctgccaggccctgtcggaccaaagggagagccagggcccactggcgcccctgggcaagcagtggtgggtctacccggagctaagggggagaaaggcgctcctggagggcttgcgggtgaccttgtgggagagcccggagccaagggtgaccgcggtttacctgggcccagaggagagaagggcgaggctggacgagcgggagaaccgggtgatccaggcgaggacggccagaaaggagcgccgggccctaaaggattcaagggagaccctggagtgggagttccaggttctccaggaccccccggcccccccggtgtcaaaggcgatcttgggctccctggcttgccaggcgccccaggagttgtgggctttcccggccagactggaccacgcggagagatgggtcaacccgggccctctggagagcgagggttggccggaccgcctggaagggagggcatccccggaccactgggaccacctggacctccgggaagtgtaggtccgcccggtgcatccggcctgaagggggacaaaggggaccccggggtggggctgcctggcccacgaggtgagcgaggcgagcccggaatccggggagaggacgggcgaccaggccaagaagggcctcgagggctgactggcccgcctgggtctcggggcgagagaggcgagaagggcgacgtgggttccgctggcctcaagggggacaaaggcgactcagcagtcatccttggccccccaggaccacggggagcaaaaggtgatatgggggagagaggccctcgagggctggatggcgataagggccctaggggggataatggtgaccccggcgataagggctctaaaggagaacctggggacaagggctcagctggtctgccggggctgcggggcctgctcggcccccagggacagcctggggccgccgggattccaggggatcctgggagcccaggaaaggatggcgtgccaggcatccgcggtgaaaagggagatgtgggctttatggggcccagagggttaaagggtgagaggggcgtcaagggtgcttgcggcctggatggagaaaaaggagacaaaggagaggcaggtccaccaggacgtcccggactcgctggccacaagggtgagatgggcgaaccaggtgttcccggtcagtctggcgccccgggaaaggaaggcttgatcggaccaaaaggcgatagaggctttgacggccaacccggaccaaaaggggaccaaggggagaaaggggagagggggactccagggattggggggtttccagggcccagtgggaacgacggttccgcaggccctcccggaccacccggtagtgtgggccctcgaggccccgagggattgcagggccagaagggtgagagaggtccgcctggcgaacgggttgtgggagctcccggggtgccgggcgcccctggagaacgtggcgagcagggacgcccggggccagccgggcctaggggggagaaaggggaggccgccctcacagaagatgacattcgggggttcgtgcgtcaagaaatgagtcaacactgtgcttgccagggtcagtttatagcctcaggctcccggccactgcctagctatgccgctgataccgccggctctcagttgcacgcagtgccagtcctccgcgtcagccacgccgaagaggaggaaagggttccccctgaagacgatgagtattctgagtacagtgagtatagcgtggaagaatatcaggaccccgaagcaccttgggatagtgatgacccctgttctctgcccctggacgaaggatcatgtacagcttacactcttcgctggtaccatcgggcggtcactggctcaactgaagcttgtcaccccttcgtttacggtgggtgcggcggtaacgctaacagatttggaaccagagaagcatgtgaacgcaggtgtcctccccgcgtcgtgcaatcccagggaaccggcaccgctcaggac

SEQ ID NO: 9578 - DNA, 8832 bp, Artificial Sequence
  Description of Artificial Sequence: Synthetic coding sequence
atgacgctgaggctgctggtggcggccctgtgcgcgggcatcctggccgaagcaccacgcgtacgcgctcaacatagggaacgcgtgacctgcaccagactctacgcggcagacattgtctttctgctggatggctcgagttcgattggaagaagcaacttcagagaggtccgctctttcctggaggggctcgtcctgccattctcaggagctgcctcggcgcagggtgtccggttcgccacggtgcagtactcagacgatccgcgaaccgaattcggcctggacgctctgggatcggggggagacgtgattagagccatcagggaactctcctacaaggggggaaacactagaaccggagccgccatcctgcatgtcgccgatcacgtgttcctgccgcagctggctagacctggtgtgcccaaggtgtgcattctgatcactgacgggaagtcccaggatctggtggatactgccgcccaacgcctcaagggacagggagtgaagctcttcgcggtgggaatcaaaaatgcggatccggaagagctgaaaagggtggcttcgcaaccgacttcggatttctttttctttgtgaatgacttctccatcctgagaaccctgctgcctttggtgtcaagacgggtgtgcaccactgcgggaggagtcccggtcactcgaccgccggacgacagcacgtccgctcctcgcgatctggtgctgtccgagccttcatcccagtcgctccgtgtgcagtggactgccgcctcgggtccggtgaccggatataaggtacaatacactcccctgaccggactcggacagcccctcccgtccgaacggcaggaggtgaacgtcccagccggagaaacgtccgtgcgcctgaggggactcaggccgctgacggaataccaagtgaccgtgatagcactctacgccaactcaatcggagaagcggtgtccggaaccgcgagaactaccgccttggagggcccggagttgacgattcagaacactaccgcacactccctcttggtggcatggcgctcggtgcccggcgctactgggtaccgcgtcacctggcgtgtgctgtcaggaggccctacccaacaacaggaactggggccggggcagggcagcgtgctcctccgcgatctcgagcctgggaccgactacgaagtgaccgtctcgacgctgttcgggaggtcggtcggccccgccacctctctgatggcgcgcaccgacgcatccgtggaacagactcttagacctgtgatccttggaccgaccagcatcctcttgtcgtggaacctcgtgccggaagcgcgcgggtaccggctggaatggagaagggagactggtcttgaaccgccacaaaaggtcgtgcttccgagcgatgtgacgcggtaccaactggatgggctccaaccaggcacggagtacagactgaccctgtacactcttcttgagggacacgaagtggcaaccccggccactgtcgtccctacgggacctgagctcccagtctccccggttactgacctgcaggccactgaactgccgggacaacgagtgagggtgtcgtggtcaccggtgccgggtgccactcaataccggatcatcgtccgctcgacccagggcgtggaacgcactctcgtgctcccgggctcccagactgccttcgacctggacgacgtgcaggcaggtctgtcctacaccgtgcgcgtttcagccagagtcggcccgagagaagggtccgcatcagtgctgaccgtgaggcgggagccagaaaccccactcgcggtccctgggctccgcgtggtggtgtccgatgccactcgggtgagggtggcatgggggccagtaccaggagcgtccgggttcaggatctcatggtcgactggatccggaccggagtcatcccagactcttcctccggattcgaccgcaacggacattactgggctccaacctgggaccacctaccaggtcgctgtgtcggtgctcagagggcgggaggaaggaccagccgctgttattgtcgcccggacggatcccttgggaccagtgcgcaccgtgcacgtgactcaggcctcatcctcaagcgtgactatcacctggactcgcgtcccgggagcaaccggataccgggtcagctggcactccgcgcatggaccggagaaatcgcagctcgtctcgggagaggcaactgtggccgaactggacggattggagcctgacaccgaatacaccgtccatgtgcgagcccatgtggcgggcgtggatgggccgccggcgagcgtcgttgtgcgcaccgctccggaacctgtcggaagagtgagcagactgcagatcctgaacgcttcgagcgatgtgctcaggatcacttgggtgggagtcaccggggccaccgcctaccggcttgcctggggacgcagcgagggcggcccgatgcgacaccagattctgccgggaaacactgactcagccgaaatacggggcttggaggggggcgtgagttactcagtgagagtcaccgccctggtgggagatcgcgaaggtacccccgtttctatcgtggtgaccaccccgcccgaggcgcctccggcactcggaactttgcacgtggtgcaacgcggtgagcactcgcttaggctccgctgggaaccggtgccgagggcgcaaggcttcctcctgcactggcagccagaaggaggccaggagcagtcacgcgtgctcggtccggagctgtcctcctaccaccttgatggccttgaacccgccacccagtaccgggtcaggctctcagtgcttggacctgcgggcgaaggaccctcagcagaggtgaccgcacggaccgagagcccacgcgttccatcaatcgaattgcgggtcgtcgacacttcgatcgactcggtgacgctcgcatggaccccagtgagccgcgcgtccagctatatcctgtcctggcggcctttgcgcggcccaggccaggaagtcccgggaagcccccagaccctccctggcatctcttcctcgcagagggtcaccggcctggaaccgggagtgtcttacatcttctctttgacccctgtgctggatggtgtcagaggtcctgaggctagcgtgactcaaactccagtgtgcccaaggggcctggccgatgtggtgttccttccccatgccactcaagacaatgcacaccgggcggaagcgacccggcgggtgctggagcgcctggtgctggcactcgggcctctgggaccacaggcggtgcaggtgggtctgttgtcgtactcccacagaccaagcccgttgttccctctgaacggttcgcacgaccttggtatcatcctgcagagaatccgcgacatgccatacatggacccgtcggggaataatctgggaaccgccgtggtgactgcgcatcgctacatgcttgccccagatgcaccagggcgcagacaacacgtacccggcgtgatggtgctcctcgtggatgaaccgctgagaggggacatcttttcacccattcgggaggcgcaagcctccggcctcaatgttgttatgctgggtatggccggtgctgaccccgaacagctccggcggctggccccgggcatggacagcgtccagacgttcttcgcggtcgacgatggaccgagccttgatcaagcggtgtctggactggctactgcactttgccaggcttccttcaccactcaacctaggcctgaaccttgcccagtgtactgcccaaagggacagaagggagaaccgggtgagatgggcctgagaggtcaggtgggtccgccaggcgatccgggactgccaggccggaccggcgccccaggaccccagggccctccggggtctgctactgcaaagggagagcggggatttcccggcgcagacggtcggccggggagtcctggccgggcgggaaacccaggaacccccggagcgcccgggctcaagggttcgccgggactcccgggaccacggggtgaccccggggaacggggtccacggggaccgaaaggcgagcccggggccccagggcaggtcatcggcggtgagggaccagggctccctggcagaaagggggaccccggaccatcgggcccaccaggaccgcggggaccgctgggagatccgggaccaagagggccacccggattgccaggaactgcgatgaaaggagataagggggatcgcggagagcggggacctccggggccaggagaaggcggtatcgccccaggagaacccggactcccgggcttgccggggtccccagggccgcaagggccagtgggacccccaggtaagaaaggcgaaaagggtgacagtgaagatggagccccggggctcccgggacagcctgggtcgccgggagaacaaggaccccgcggaccgccgggcgccatcggccctaagggagatcgcggcttcccgggaccgctgggcgaagccggagaaaagggagaaagagggccgcccggacctgcgggttcccgcggactgccaggggtggccggcaggccaggagccaaagggccggagggaccaccagggccgaccggccggcagggagagaagggagagccgggacgcccaggtgaccccgcggtcgtgggccctgctgtcgcaggacctaagggagaaaagggcgatgtgggcccggctggaccacgcggagccactggagttcagggggaacgcggtccgcctggactggtcctgcccggagatccgggaccgaagggagatccaggcgatagaggcccgattggactcactggccgcgcgggcccgccgggagattcaggaccaccgggagaaaagggagatcctggtcggccggggccgccaggtccggtgggtccgcggggcagggacggagaagttggggaaaagggtgacgaaggtccgccgggagatcccggactccccggaaaggctggagagagaggactgagaggtgccccgggcgttaggggtcctgtgggagagaaaggagatcagggcgaccctggagaagatggccggaacggctcgccgggctccagcggcccgaagggtgaccgaggtgagcctggaccgccgggtccgccggggcgcctcgtggacactggaccgggggcccgcgaaaaaggcgaaccgggcgaccgcggccaggaggggccgcgcggacctaaaggagatcctggactgccgggtgcgccgggagaacgtggaatcgagggatttcggggacctcctggaccccagggagatcctggagtgcgaggaccggcaggcgaaaaaggggatcgggggccgccaggactggacggacggtccgggctggacggcaaacctggggccgctggaccatccggcccaaacggcgctgcaggaaaagctggagatccgggacgggatggactcccggggctgagaggagagcaaggccttccgggaccgtccggacctcccggactgccgggaaaaccgggagaggacggcaaacctggactgaacggaaagaacggagagccaggggatcctggcgaggacggacgcaagggcgaaaagggagactccggcgcctccggacgcgagggccgagatggcccgaagggcgagcggggcgctccaggaattctggggccccaaggcccgcctggactgcccggtccagttgggccgccaggacaagggtttccgggagtccctggaggcactggtccaaagggtgatcgcggagagactggatcgaagggagagcagggactgccgggagaacgagggctgagaggtgaaccgggatcggtgccaaacgttgaccggctgctggagactgccggaatcaaggcatcagcgctccgagaaatcgtcgaaacctgggacgaatcgtcgggctcgtttctccctgtaccggagcggaggcgggggccgaagggggactcgggcgagcagggaccgccaggaaaagaaggaccaatcggattcccgggtgaaagaggacttaaaggcgatcggggagatcccggcccccagggccccccggggctggccctcggcgaacgcggaccccccggtccgtccggactggccggagagcctggcaagccgggcatccccgggctcccgggtagagccggaggtgtgggagaagcgggacgtcctggggaacggggagagcgcggggagaagggcgaaaggggtgagcagggacgggacggaccaccgggactgccgggaacccccggcccgccggggccaccaggccctaaggtgtccgtggatgaaccgggaccgggactctcaggagagcagggaccaccaggactgaagggggcaaagggagaaccaggatccaatggcgatcaaggtccaaagggagatcggggagtccctggcatcaagggggaccggggtgaaccgggaccgagaggccaagatggaaatcctggactgccgggagagcggggcatggctggccccgaaggtaaacctggacttcaggggccaagagggccaccaggcccggtgggaggacacggagatcctggcccaccaggcgcgccaggcctcgccggcccagcaggaccacagggaccttctggcctgaaaggggagccgggagaaacgggaccgcctgggcggggattgaccggcccgacgggtgcggtgggactgccaggacctccaggaccgtcaggactggtgggcccacagggaagcccgggacttccagggcaggtcggagaaaccggaaaaccgggtgcgccgggtcgcgacggtgcctcgggcaaagacggggaccgtggatcgccaggagtccccggatcgccagggctgccgggtcccgtgggaccgaagggtgaacccggacccactggcgctccgggccaggctgtggtcggattgccgggagcaaagggagagaagggcgctccgggtggattggcaggggatcttgtgggagagcctggcgccaagggtgacaggggtttgcccggccctcggggagaaaagggcgaggccggtagagcgggcgaaccgggagatccgggagaagatggccaaaagggcgctccgggtccgaagggctttaagggggacccaggtgtcggggtaccaggttcaccaggaccgccgggcccgccaggggtcaagggggatttgggcctgccgggcctgccaggagcccccggtgtggtcggatttccaggtcaaactggaccccgcggagaaatgggacaaccaggtccaagcggggagagaggtttggcggggcccccagggcgcgagggcatcccggggcctctgggaccgccaggcccccctggcagcgtggggccaccaggagcctccggactgaagggtgataaaggcgatcctggagtcggactgccgggccctcggggcgagcggggcgaacccggtatccggggggaagatggtagacctggacaagaaggaccgcgggggcttaccggacccccaggatccagaggggaacgcggggagaagggagacgtggggtcggcagggctgaagggcgacaagggagacagcgccgttatcctgggcccgccaggtccacgcggagccaagggagatatgggcgaacgcggcccacggggactcgacggagacaagggccctcgcggagataacggggaccccggtgacaagggatctaagggtgaaccgggagacaagggctccgctggcttgccggggttgcgcgggctgctggggccacaagggcagcccggcgccgcagggatccccggagatccgggctcgccgggaaaagatggcgtgccagggatcagaggagagaaaggagacgtcggatttatgggcccccgcggactgaagggagaacggggtgtgaaaggagcttgcggcctggacggagagaagggcgataaaggagaggcaggcccccctggccgcccgggcctggcaggacacaagggagagatgggagagccgggggtcccgggacagtccggcgcaccagggaaagaaggactcatcgggccaaagggtgaccgaggcttcgatggtcagcccggaccaaaaggggatcagggcgagaagggagaacgcgggacccccggaattggaggattcccagggccaagcgggaatgacggctccgcgggaccgccgggaccccccggatcagtcggaccgcggggaccggagggcctccaaggacagaaaggcgaaagagggcccccgggagaacgcgtcgtgggagccccgggagtgcctggagctcctggagaaagaggagaacagggccggccaggcccggctgggcctcggggagagaaaggcgaggcagcccttaccgaagatgacatccggggatttgtgcggcaggaaatgtcccagcactgcgcttgccaaggccagtttatcgcgtctggatcgcggccgctcccatcgtatgccgctgatacggcgggttcccagcttcacgcagtcccagtgttgcgtgtgtcccatgccgaagaggaagagcgcgtgccccctgaagatgatgagtactcggaatacagcgaatacagcgtcgaggagtaccaagatccagaggcgccctgggactcggacgacccttgcagcttgccgctggatgagggatcatgtactgcttacactctccggtggtatcaccgggccgtgactggctcaactgaggcctgtcatccgttcgtgtacggcggctgtggtggaaacgctaatcggttcgggacgagggaggcctgtgaaagaagatgtccaccaagggtcgtgcaatcgcaaggcaccggaaccgcccaagat

SEQ ID NO: 9579 - DNA, 8832 bp, Artificial Sequence
  Description of Artificial Sequence: Synthetic coding sequence
atgactctcaggcttttagtcgctgcattatgtgctggcatactggccgaggcccccagagtgcgggcgcaacaccgagaacgggtaacttgcactagactgtacgctgctgacatcgtgttcctgctggatggttcgtcctctatcggaagaagcaatttccgagaggtaaggagtttcctcgagggtctggtgctgcctttttccggcgccgccagtgcacaaggcgtgcggttcgccacggtccagtattccgacgatccccgcacagaatttggattagacgctcttggttccggaggtgacgttatcagggccattcgcgaacttagttacaaaggtggtaatacaaggacaggagccgccattctccacgtggcggaccatgtatttctgccccagttggcccgtcccggggttccaaaggtgtgcatcctgataaccgatggaaagtctcaggacctggtggatacagctgctcagagattgaaaggccagggagtgaagctgttcgctgttgggatcaagaatgctgaccctgaggagttgaagcgagtggcttcccagcctaccagtgatttctttttcttcgtgaatgacttttccatccttaggaccctgttgccacttgtgtcacgcagggtgtgcactaccgccggtggggtgcccgtcacccggccccccgatgatagcacctctgccccccgcgacctcgtcttgagcgagccctcatcccagagcctccgggtacagtggaccgccgcttctggtcccgtgacaggatataaggtgcagtatacgccattgaccggtttagggcagccattgccaagcgagagacaggaggtcaacgtgccggctggggaaacctcagtccgcctgcgcggcttacggccgctcactgagtatcaggtgacagtgatcgcgttgtacgctaacagcataggcgaggccgtgagcggcaccgctcgaaccaccgccttggagggcccagagctaactatacagaatactactgctcactcactcctggtggcctggaggtccgttcctggggcaactggctatcgcgtcacctggcgggtactgtcggggggcccaacccaacagcaggagctggggcccgggcagggaagcgttctgctgcgcgatctggaacccggtacggactacgaggtaacagtgtcaaccctgtttgggcgcagtgtgggacctgcaacctctttgatggcgcgcacggacgcgtccgtagagcaaacactgcgccccgtcattttaggaccgacctcaattctcttaagctggaacctggtgccagaggctagagggtaccggctggaatggagaagggaaacaggcctcgaacccccccagaaagtggttctgccatccgacgtgactcgataccagttagacgggctgcagcccgggaccgagtatagacttacactctatacactgcttgagggacacgaagtggcaactccggcaaccgtggtgcccacggggcctgaattacctgtgagcccagtcaccgatctacaggcaaccgagctgccagggcagagagtgcgggtcagctggtcccctgtccccggcgccacccagtaccgcatcattgtccgctccacgcagggggtagagcggacgctcgtgctcccgggctcccagacagcctttgacctagacgacgtccaagcgggcttgagctacacggtgagggtgtccgcgcgcgttggaccaagggaagggtctgccagcgtcttgaccgtgagacgcgagcccgaaaccccactggccgtacctggtttgcgtgtggtggtttctgacgcaactcgcgtccgtgtcgcttggggcccagtcccaggcgctagcggattccggatttcgtggtccactggatctggccccgaaagttctcagaccctaccacccgattctacagcgactgacatcactggccttcagcccgggacaacttaccaagtggccgtgtctgtgcttcgcggtagggaagagggtccggcggctgtcatcgtggcaagaaccgacccactgggtcctgtgcggaccgtccacgtaactcaagcgtcctcctcatctgtgacaataacttggactagagtgccgggagcaaccggctacagagtgtcttggcacagcgcacacggtcctgaaaaaagccagctcgtctctggagaggccaccgtggccgaactggacggcctggaacctgacactgagtacaccgttcacgtccgcgcccatgtcgccggcgtagacgggcccccagcgtctgttgtggtacgtaccgctcctgagcccgttggccgcgtgagcaggctacagatcctaaatgcgtcatctgatgtcctgcgcataacctgggtcggcgtaactggggcaacagcttacagactggcttggggccgatcagagggcggtccaatgagacaccagatcttgccagggaatacggactccgccgaaattaggggactggaaggaggagtgagctactcggttagggtcaccgctctggtaggcgacagagaaggaactcctgtttcaatcgtggttaccacccctccagaagctccaccggcgctggggacactccacgtggtccaacggggagagcactctctcagattgaggtgggaaccggtcccacgtgcccagggatttctcctccattggcagccagagggtggtcaggagcagagtcgcgttctcgggcctgagctgagttcataccatctcgacggactggagccagcaactcagtacagagtgcgactctcagtattgggcccggccggtgaaggcccatccgctgaagtcaccgccagaaccgagagtccacgtgtaccctccatcgaactacgcgtggttgacacctcgatcgattccgtaactcttgcatggaccccagtatccagagccagttcctatattctttcctggagaccgttgagggggcccgggcaggaagtgccagggtcaccgcagacccttcccggaataagctcttcacaacgggtcactggtctcgaaccaggagtgagttatatcttcagtcttacccctgttctggatggagtgcggggaccagaggcttcagtgacccagacccccgtgtgtcctagaggtctggccgatgtggtctttctaccccacgcaactcaggataatgcccatcgggcagaagcgacccggcgggtgctggaaagattagttctcgcactgggacccctggggccccaggcggttcaggtgggcttactgtcctactctcaccgacccagcccgttgttccccctcaatggctctcatgatcttgggataattctgcagcgcattcgggacatgccatacatggatccaagtggaaataaccttgggacagcagtggtgacggcccatcgttacatgctagcccccgatgccccggggcgaaggcagcacgttccgggtgtaatggtccttttggtggacgagcccctccggggcgacattttctctcctatccgagaagcacaagcgagtggtttgaacgtggtgatgcttggaatggctggggcagatcccgagcagctgcgcaggctggcccccggcatggattctgtgcaaaccttctttgccgttgatgatggtcctagcctggaccaagcagtaagtgggctggcgacagcgctatgccaggcgtctttcacgacacagccaagacccgagccgtgcccagtctactgccccaaagggcagaagggcgagcccggcgagatgggccttagaggccaagtcggcccgccgggtgatcccggcctgcccggcaggacaggcgcacccgggccgcagggaccgcccgggtcggccacagccaagggcgagcgaggatttccaggagcggacggaagaccaggcagccccggacgagccggtaaccctggcactccgggcgcacccggactaaaggggagccctggtctgcccggtcctcggggcgatccgggcgagcggggccctcggggccctaagggcgaacccggggcccccggacaggttattgggggcgaggggcccggacttcctggccgcaagggggaccctgggccaagcggccccccaggcccacgaggtcctttgggcgacccgggccccagaggccccccaggcctgcccggaacagccatgaaaggtgacaagggcgacaggggcgaacgagggcccccaggccccggcgagggcggcatagcccctggggaacctggcctgcctggcctaccgggtagtccaggtcctcagggtccggtgggcccacccggaaagaagggcgaaaagggtgatagcgaagacggcgctcccgggcttcctggtcagcccggaagcccaggagagcagggccccaggggccccccgggggccattggtccaaagggagaccgcggatttcctggccccctgggggaggccggcgagaaaggagagcgagggccgccaggaccagccggtagcagagggttaccaggagttgcaggccggcctggcgctaagggacccgaggggcctcccgggccaaccggaagacagggagaaaagggtgaaccaggccggccaggcgaccccgccgtcgtgggccccgccgtggccggtcccaaaggtgaaaagggagacgtcggacccgccggccccaggggcgccacgggtgtccagggtgaacggggccctcctggcctcgtgctgccgggcgaccccggccccaagggagaccctggggacaggggccctattggcttaacaggtcgggctggcccccctggggactctggaccgcctggcgagaaaggcgaccccggccggcccgggccccctggcccggtgggtccgcgtgggcgtgacggcgaggttggggaaaagggcgatgagggaccccccggcgatcctggtctgccaggaaaagccggggagcgaggactgagaggagcccctggcgtccgcgggcccgtcggcgaaaagggcgatcagggtgacccgggggaagacggtcgtaacgggtcgccgggtagctccgggccaaagggggataggggcgagccgggtcctccagggcctcccgggaggcttgtggacactgggccgggtgccagagagaagggagaaccaggcgatagggggcaagagggtccccggggtccgaaaggggatccgggcctgccgggcgctcccggtgagcgtggaattgagggcttccgcggtcctccagggcctcagggagaccccggcgtgcgcggccctgctggggagaagggcgaccgaggccctccggggcttgatggcagatctgggttggatgggaaaccaggagccgctggtcctagcggcccaaatggagccgccggcaaggccggagacccaggaagagatggactcccgggacttaggggagagcagggcttgcccggtccatccggccctccaggcttacccggcaaacctggggaggacggaaagcctggtttaaatggaaagaacggcgaaccgggcgatcctggcgaagacggtcggaagggcgaaaaaggggattctggcgcgagtggtcgcgaaggacgcgatgggccaaagggagagcggggggctcccggaattcttggaccccaaggtccacctggcctgcctggcccagtggggccccctgggcagggttttccaggagtacccggcggaactggcccaaaaggggaccggggcgaaactggaagtaaaggggagcagggattgccgggggagcggggtctcagaggtgagcccgggtctgtgcctaatgttgatagattgctcgaaactgcgggtatcaaggccagcgctctgcgagaaatcgtcgaaacttgggacgagtcgtcagggtccttcttacctgttccggagcgacgtcgcggccccaagggggacagtggtgagcaaggcccccctggaaaagagggacctatcggctttcctggtgaaagaggattgaaaggcgaccgcggtgaccctggcccccagggccctccaggcctggcgctgggggagcggggacctcctgggccttcggggcttgccggagagcctggtaagcctggcatcccaggccttcccggccgagccggaggtgtcggggaggctggccggccaggcgaaagaggcgagcgaggagaaaagggtgagaggggagaacaaggtagagacggaccaccgggcctgcctggcactcctgggccacccgggccacccggacctaaagtcagtgtggacgagcccggaccaggactgagtggtgagcagggcccgcccggtctgaagggggccaagggcgagccaggaagcaacggtgaccaaggcccgaagggggatcggggggtccctgggatcaaaggcgatcgcggggagcccggaccgcggggacaggacggtaaccccgggctgccgggggagcggggcatggctggacctgagggcaaaccagggctccagggaccccgcggtccccccggcccagtggggggtcatggcgacccgggccctcccggagcaccaggcttggccggtcccgccggaccccagggtccctctggcctcaagggtgaaccaggggagacgggcccaccaggcagaggtttgaccggtcccaccggtgcagttggattgcctgggcccccaggccccagcggcctggtaggaccccaaggcagcccgggattaccaggacaggttggcgagacgggcaagccgggtgcccctggtagggatggcgcttcaggaaaagatggtgacaggggcagcccaggcgttccaggatcgcccgggctcccaggccctgtgggccccaagggtgagcccggccccactggagcgccaggccaggctgtggtgggtttaccgggggccaaaggtgagaagggcgcccccgggggtctggcgggcgaccttgtgggtgagccaggtgccaagggcgacaggggacttccaggcccccgcggcgagaaaggtgaggctggcagggccggggagcctggggatcccggcgaagatggtcagaagggcgcaccgggtccaaagggcttcaagggcgacccaggtgtcggggtgcctggatcccccggtccccctggacccccgggtgttaagggcgatttgggtctcccaggcctgcctggggccccaggggtggtcggtttcccgggccagacaggcccacggggcgaaatgggccagcccggcccgtctggggagagaggactcgcaggaccgccaggtcgggagggaattccaggacctctggggccccccggtcctcccggtagtgtcggaccgcccggagccagcggactgaagggcgacaagggtgaccccggggtgggtctccccgggccgcgcggagagcggggcgaacccggcattaggggggaggacgggagaccagggcaggaaggtcctcgaggactgaccgggcctccaggcagccggggggagcgaggcgaaaaaggcgacgtgggttcagcggggctgaagggcgacaagggggattcagcagtgatactggggccacccggacccaggggcgccaagggcgacatgggcgagaggggtcctcgagggctagacggcgacaaagggcccaggggagacaacggcgatccaggcgacaaaggcagtaaaggggaacctggggacaagggatctgctggcctcccaggcttaagaggcctcctgggcccccaaggacaacccggtgcggcggggatccctggggaccctggctcccccggaaaggatggagtgccaggcattcgaggtgagaagggcgacgtggggttcatgggaccccgcggtctaaaaggtgagagaggagtaaagggggcctgcggactcgatggcgagaagggcgacaaaggcgaagccggaccgcccggacggccgggtcttgctggccacaaaggggaaatgggggaacctggcgtgcccggacagtccggagcccctggaaaggagggtctgattgggccaaaaggcgacagaggattcgatggacagcccggcccgaagggggatcaaggcgagaagggtgaacgcggaacgcccggtatcggcggatttcccgggcctagtggtaacgatggttctgccgggccccccggccctccaggttctgttggtccccgtggaccagaaggtttgcaaggccagaagggagaacgcggtccccccggagagcgagtggtaggcgctccaggagtccccggtgcacccggggagaggggtgaacaggggaggcccggtccagcaggacctaggggagagaaaggggaagctgccttgacagaggacgacatacgcggcttcgtcagacaagagatgagtcagcactgcgcctgtcaaggacaattcatcgcctcaggttctaggccactgccttcatacgccgccgatactgccggaagccaactgcacgcagtgcccgtcctgcgagtgagccatgcagaggaggaagagcgggtccctccggaggatgacgagtacagcgaatactccgaatactccgtggaagaataccaggatcccgaggccccttgggactctgatgacccctgctctctgccactggatgaggggagctgcacagcttacaccttacgttggtaccacagagccgtcactggctccactgaggcctgccaccccttcgtgtatgggggatgcggtggaaacgccaaccggttcggaacacgcgaggcatgcgagagacgctgccccccgagggtggtgcaaagccagggaacaggcacggcccaagat

SEQ ID NO: 9580 - DNA, 8832 bp, Artificial Sequence
  Description of Artificial Sequence: Synthetic coding sequence
atgaccctcaggctgctggtcgctgcactctgcgcgggtatccttgctgaggcgcctcgcgtgcgggcacagcatagggaaagagtcacctgcacccgcctctacgctgctgacatcgtatttcttctggatggaagttccagtatcggccggagtaactttcgggaagtcaggtccttcttagaggggctggtgttaccatttagtggagccgcttccgctcagggtgtccgctttgccactgtccagtacagtgatgaccctcgcacagagttcggacttgacgccctagggagcggaggagatgtgataagagctattcgagagttatcatataaggggggaaacaccaggactggggccgctatacttcacgtcgcagatcacgtgttccttcctcaactcgcacgccccggagttcccaaggtatgtatcttgatcacagacggaaagagccaggaccttgtggatacggctgcacagagactcaaaggtcaaggagtcaaactgtttgcggtgggaattaaaaacgctgatccagaagagctcaaacgggtcgcttctcagccaacgagcgatttttttttctttgtgaacgacttctctattctgaggaccctgctccctctggtgagccgtagggtgtgtactactgctggtggagtgcctgtcacacgtccacctgatgatagcaccagtgcacctagggaccttgtgctgagcgaacctagctcccaatccctgcgggtccagtggacagcagcttccggaccagtgaccgggtacaaggtgcagtacacacctctgacgggattaggacaaccactgccctctgagcggcaggaggtgaatgttcccgccggcgaaaccagcgtgcgccttcggggcctgaggccactcaccgaatatcaggtaaccgtcatcgcgctttacgcaaacagcatcggagaggccgtgtctggaacggctagaaccaccgcactcgaagggcctgaactgactatccagaatactaccgcccatagcctcctcgtggcatggcggagtgtccccggtgccaccggctaccgagttacctggagagtgctgtccggaggcccaacgcagcagcaggaactcggacctggacagggcagcgtgctgctgagagacctggagcccggaactgattacgaagtgacagtaagcaccctctttggaagatctgtcggccctgcaacgtctctgatggccagaaccgatgcttctgtggagcagacactgagacccgttattctcggccccacgtcgatcttgctgagctggaacctggtgccggaagcacgcggctaccgcctcgagtggcgccgtgagacagggctggagccacctcagaaggtggtgttgccgtctgatgtgactagataccaactggacggccttcaacctggtaccgagtacagactgacactgtacacactgcttgagggtcatgaagtggccacccctgctaccgtggtgcccactggacctgaattgcctgtcagcccggtcaccgatctacaagcaactgagctccccgggcagagggttagagtgtcatggagcccagtgccgggcgctacccagtatcgcatcattgttagaagcactcagggagtggaaagaacgctagtgctgccaggatcccagactgcttttgatttagatgacgttcaagcgggactgagctacactgtgcgtgtctcagctagggtgggacctagggagggcagcgcatctgtgttgaccgtgagacgggaacccgagacacccttagctgttccagggttgcgtgtggtcgtgagcgatgccacaagagtgcgtgtggcatggggacctgtcccaggagcttctgggtttcgcatttcatggagtacaggtagtggtccagaaagcagccaaactctgccccccgattccacagctacagatatcacaggcctgcagcccggaaccacctaccaggtggcagtcagcgtgttaaggggaagagaagaaggcccagcagccgtgatcgtcgcaaggaccgatccactggggccagtgcgaaccgttcacgtcacacaagctagtagctcctccgtcaccatcacctggacccgtgtgccgggagctacaggctacagagtgagctggcacagcgctcacggccccgaaaagtctcagctcgtgagtggtgaagcaaccgttgctgagctggacggcttggaacctgatactgaatataccgtccacgtgagagcccacgttgccggcgtcgacgggccgcctgcatcggtcgtggtgagaactgctcctgagcccgtcgggcgggtatctcgactgcagatcctcaatgcaagctcagacgtgctcaggattacttgggtgggggtcacaggggccaccgcttatcgactcgcttggggcagaagcgagggtggccccatgcgccaccaaatcctgccaggcaacacagacagcgctgagattcggggtctagaaggcggggtgagctatagtgtgcgcgtgaccgctctcgtgggcgatcgcgagggaacaccggtctccattgtcgttactactcctcctgaagctcccccagctcttggcaccttgcacgtggtccagcggggagagcacagcctgcgtctgcgctgggaacccgtccctagggcccagggattcctcctgcattggcaacccgaaggcggccaggagcagtctcgcgtgttgggtccggaactgagcagctatcatctggatggactcgagcccgctactcagtatagagtgcggctttcagtcctggggccggctggcgagggtccatccgctgaggtgacagctcgcaccgagagccctcgcgtcccatcaatagaactcagagtcgtggataccagcatcgattctgttacactggcctggacacctgtgtcacgtgcgagcagctatatcctcagctggaggccactgagaggacccggacaggaagtcccaggctccccacagacactgccaggcatctcatcttcacagcgcgtcactggtcttgagccaggcgttagttacattttttccctgacccccgtcttggacggtgtcagaggtccagaggcgagcgtgacccagacaccggtgtgcccaaggggtctcgcagatgttgtgttcttgccccatgccacccaggataatgcccatagggcagaggcaacacgaagggtgcttgagagacttgtgcttgctttaggcccattgggaccacaagctgtccaggtgggattgctgtcttacagccatcgcccttcccccctttttcctctgaacggatcccatgaccttggaatcatcctgcagcgtatcagagatatgccatatatggacccaagtggaaataacctcggaaccgccgtggtcacagcccaccgctatatgttggccccagatgcaccaggccggcgccaacatgtgccaggggtgatggttctgctggttgatgagccgctgcgcggagatattttttctcctatccgggaagcacaggctagcggcctgaacgtcgtcatgctgggaatggctggagcagatccggaacagctgcgaaggttggcaccggggatggacagcgtgcagacatttttcgctgtggacgatgggccaagcctggatcaggccgtatcaggccttgccacagcactttgtcaggccagtttcacgacacagcctaggccagagccttgccccgtgtattgccctaaaggtcagaagggcgagccgggcgagatgggactgagaggtcaggtgggccctcccggcgacccaggcctgccaggtagaacaggagctccaggtccgcaaggtccacccggatctgcaacagccaaaggtgaaaggggattccctggcgctgatggcagaccaggatcccctggaagagccggcaacccaggcacccccggcgcccctggactgaaggggtcccctggacttcctggacctcgcggagatcccggcgagaggggccctaggggcccaaaaggcgaaccaggggcccccgggcaagtgatcggcggagaaggacctggattgcctggacgcaagggtgaccccggccccagcgggcctccagggccccgcggtcccctcggtgacccagggccgagaggccccccaggactgcctggcacagcaatgaaaggtgacaaaggggaccgcggggagagagggccccccggacctggagagggaggcatagctcctggcgagcccggcctgcccggactgcctggctccccaggacctcagggcccagtgggcccccctggaaagaaaggggaaaaaggggactctgaagatggcgcacctggactgcccggacagcctggatcccccggggagcaaggcccaagggggccgcctggcgcgataggacccaagggagataggggattccccggcccactcggcgaagctggcgaaaaaggcgagagggggcctcccgggccagccggcagcagaggcctgcccggagtagcaggcaggccgggcgctaagggccctgagggccctcccggtccaactggcagacagggagagaagggagagcctggtcgcccgggagatccagccgtagtaggtcctgcagtggcaggcccaaaaggtgaaaagggagatgtcggacccgccgggcctcgcggggcaactggtgtgcaaggcgagaggggccctcccgggctggttctgcctggagacccaggacctaaaggagaccctggcgacagaggaccaatcggactgaccgggagggccggtcctccaggagactcagggccacctggagaaaagggagatcctggaagaccaggcccaccaggcccagtggggccgagaggaagagatggcgaagttggtgagaaaggcgacgaaggtccgccaggtgatcctggattgcccggaaaagccggcgagcggggactcagaggcgcaccaggggtgcgaggccccgtcggtgagaaaggtgaccaaggagatcccggagaggatggccgcaacggatctcccggaagttccgggccaaagggagatagaggggaacctggcccaccaggcccacccgggagattggtggacacggggcccggagcccgcgaaaaaggcgagcctggagatagagggcaggagggcccgcgcggaccaaaaggtgaccccggcttgccaggagccccaggagaacgcggaatcgaaggatttagaggcccaccaggccctcaaggagaccccggcgttaggggacctgctggcgagaagggcgacagggggcctccaggactggacgggaggtccggccttgacggcaagcctggtgcagccggaccgagcggacccaacggagccgcaggcaaggctggcgacccaggacgagacggtctccccggattgagaggggaacagggattgcccggaccttccggaccccctggattacccggcaagccaggagaggatggaaaaccaggcctcaacggaaaaaatggcgagccgggggaccctggggaggatggcagaaaaggagagaaaggagatagcggagcgtccggccgggagggcagggacggcccaaagggggagagaggcgctccagggattcttggcccccagggccctcctggcctccccgggccagtgggtcccccaggacaagggtttccaggagtccctggaggtaccggacctaaaggagaccgaggggaaaccgggagcaagggggagcagggtctgcccggggaacggggactgcgaggtgaaccaggcagcgtgccaaacgtcgatcggctgctggaaactgcgggcatcaaagccagcgcgcttagggagatcgtcgagacctgggacgagtcatccggttcattcctacccgtgcccgagaggaggagaggtcccaagggagatagcggtgagcagggaccgcctggtaaagaaggaccgataggttttcctggtgaacgcggccttaaaggagataggggcgacccgggcccccagggccctcctggcttggcactcggggaacggggcccacctggcccgtccggcctggcaggcgagcctgggaagccaggaatacccgggctccctggtagagccgggggggtgggagaggcaggaaggcctggagagaggggagagcggggagagaaaggtgagcgtggagaacaggggcgggatggaccccctggtctgcctggtacccccggcccccctggtcctccaggcccaaaggtgagcgttgatgagccaggacctggtctttcaggagagcagggcccaccaggactaaaaggagcaaagggcgagcctggcagtaacggagatcaaggccccaaaggcgaccggggggttccaggcatcaaaggcgatcggggcgaaccaggcccacgcggtcaggatggaaacccagggttgcccggcgaaaggggcatggcaggcccagaaggaaaaccgggattgcagggaccaagaggccccccgggacctgtgggcggtcatggcgaccctgggcctcccggcgctcccggactggccggaccagccggaccacagggccctagcggtttaaagggcgaacccggcgaaaccggacctcctggcaggggcctcaccgggccaaccggggctgtaggtcttccaggcccccccggaccaagcgggcttgttggaccacaggggtccccgggcctgccggggcaggtgggcgagacaggtaagcctggagccccaggacgcgacggtgcctcgggaaaggatggggacagaggatctccaggcgtgcctggaagccctggtctgcccggcccggtcgggccaaaaggcgagcctgggcccacaggcgctcccggacaggccgttgtggggctgccaggagccaaaggagaaaaaggcgctccggggggtcttgccggcgatctggtcggagagcctggtgccaagggcgacagaggtctgcctggaccccgtggggaaaaaggggaggctgggagagctggcgaaccaggcgaccccggggaagacgggcagaaaggcgctcctggcccaaagggattcaagggggacccaggcgtcggagtccctggcagccctggccccccagggcctcccggcgtcaaaggggatctgggattacctggactgccaggagctcctggagttgttggcttccctggacagaccggcccaagaggcgaaatgggacaacctgggccttctggagaacgcggacttgccggaccgcccggtagggagggtatccccggccccctgggcccacccggacctcccggatccgtgggccccccgggagcttccggcctgaagggtgataaaggagacccgggcgtcggactgcctggccctcgcggcgagcgcggagagcctggcattcgtggggaggacggaaggcccgggcaggagggtcctcgcggcctgactggaccccctggatcaagaggtgagcgtggagagaaaggagatgtgggctctgccggcctgaagggggataaaggggatagcgcggttatactgggccccccaggaccaagaggcgctaaaggggacatgggtgaaaggggccctcggggcctggatggagacaagggccccaggggcgataacggagatcccggcgacaaaggcagtaagggggaacctggggacaaagggagtgctggtctcccaggacttcgtggactgcttggccctcagggtcagccaggagcagcgggcattcccggcgatcccggctcacctgggaaggatggggtccctggtattaggggtgagaaaggcgacgtcggtttcatgggcccacggggattaaaaggcgagcgcggggtcaagggcgcgtgcggtctggatggcgagaaaggcgacaaaggagaagccggtccacctggccggcccggtctggcggggcacaagggagaaatgggagagcctggtgtgccgggccaaagtggtgctcctggtaaggaagggttgattggtccaaaaggagataggggcttcgatggacagcccggacctaaaggagatcagggagaaaagggcgagcgaggaacacccggcatcggaggcttccccggccctagcggaaacgatgggtccgcaggcccacctggaccacccgggagcgtgggcccccgcggccctgagggccttcagggccagaagggggagaggggccctcccggagagcgtgtcgtcggagcgccgggcgtccccggcgcacctggggaaagaggtgaacaagggcgacccggccccgcaggcccacggggcgagaagggggaggctgcgttaactgaggatgatatccgcggctttgtgcgccaggagatgtcccaacactgtgcctgccagggccagttcatcgcctctggctcccggcccctgccgagctacgccgcagataccgcaggaagtcagctgcacgcagtccctgttctcagggtgagccacgctgaagaggaggaaagagtgccacccgaggacgacgaatacagcgaatatagcgaatactcggtcgaggagtaccaggacccggaggccccatgggactcagatgacccttgctctctgccactggacgagggctcttgcacagcttacaccctgaggtggtaccacagagccgttactgggtctactgaagcctgccatcctttcgtttacggcgggtgcggcggaaatgccaacagattcggaacacgggaagcatgcgaacggagatgcccaccaagggttgtgcagtcacaagggaccggaactgcacaggat

SEQ ID NO: 9581 - DNA, 8832 bp, Artificial Sequence
  Description of Artificial Sequence: Synthetic coding sequence
atgaccttgcggcttctggtcgccgctctttgcgctgggatactcgcagaggcgccccgtgtcagagcccagcatagagaacgggtcacttgcacacggctctatgctgccgacattgtgttcctgctggacgggtcatcaagcatcggcagaagtaacttccgagaagttcgcagctttctcgaggggctggttttgccatttagtggggcagcttccgctcaaggtgtcaggttcgcaactgtccagtattccgatgatccccgaaccgagtttggcctggatgccctggggtcaggtggtgacgtcatccgagccatccgagagctgagctacaaaggtgggaacacacgtaccggagccgccattctgcatgtagccgaccatgtttttcttccccagctggcaagacccggcgtacctaaagtgtgtattctgatcactgatggcaagtcccaggatctggtggacactgccgcgcaacggctaaagggccaaggagtgaagctgtttgcggtggggatcaagaacgccgatccagaagaactcaagagggtggcgtcccagccaaccagtgatttcttcttctttgtgaatgactttagcattctgcgaacgttgctacccctggtgtcaagaagggtgtgtactactgccggtggtgtacctgtgacacggccacctgatgactctaccagtgctcctcgcgacttagtgctaagtgagccctcttcccagtccctcagggtccagtggacagctgcgtccggaccagtgacgggatacaaggtacagtacaccccgctgaccgggctaggccaacctctgccttcagagaggcaggaggtgaatgtccctgctggcgagacctcggtgaggctgcgtggacttcgccccctcacagagtatcaggttactgttatcgccttgtacgcaaattcaataggcgaagctgtgagcggcacagctcgcactacggcactggaggggccagagctgactatacagaatacaacagctcacagcctgctggtcgcgtggcggagcgtgccaggcgctacaggataccgcgttacatggagggtgctatctggtggtcccactcagcagcaggagctggggcccgggcagggctccgtgctcctccgtgacctggaacccggcaccgactacgaggtgacggtcagtacgctgtttggccggtccgtgggccctgccacatctctcatggctagaaccgatgcaagcgtggagcaaaccctgcgccctgtgatcctgggtcctacttccatactgttatcatggaacctagtcccagaggccagaggttataggctggagtggcgtagagagaccggcttggagcccccccagaaggtggtactcccctccgacgtgacacgctatcagctggatggcctgcagcccgggaccgaatacaggctgaccctctacacactgttggaaggacatgaggttgctacccctgccaccgttgtgcccacgggccccgagctgcccgtctcgcctgtgacagatctgcaagccactgaactgcccggccagcgggtccgtgtttcttggagcccagtacccggcgcaacacaatacagaatcatcgtgcgatctacgcagggcgtggaaagaacactcgtcctgcctggatctcagacagctttcgacctggacgatgtccaggcaggactcagctatacagtgagagtcagcgctagggtggggccccgcgagggaagcgcttctgtattgaccgtccgtagagagcccgagaccccactggcagtacctggcctccgggtggtggtctcagacgcaacgcgtgtgcgggtggcctgggggcctgtcccgggggctagcggctttaggatttcttggtcaacgggatccgggcctgaaagctctcaaaccctccctcctgactcgaccgcaacagacatcactgggctgcaaccaggtacaacttatcaggttgccgtgagtgtgctccgggggcgcgaggagggtcctgctgcggtcattgtggctagaaccgaccctctgggacctgtgcggacagtgcacgtgacgcaggctagtagctccagcgtgaccatcacctggacacgagtgccgggcgctactggctatcgcgtgtcctggcacagcgcccatggtccagagaagagtcagcttgtttctggcgaggcgacggttgcagaactggacgggttggagcctgataccgagtatacagttcatgtaagggcgcacgttgcaggcgttgatggcccaccggctagtgtcgtggtgcgcacagcacccgagcctgtcggcagagtgtccaggctacagatcctgaacgcctccagcgacgtcctacggatcacgtgggtgggagtgaccggagccacggcctaccgcttggcgtggggtcggtccgagggaggcccgatgcgccatcagatcctgcctgggaatacggactctgctgaaattaggggattggagggcggagtgtcctactctgtgcgggtgacagcgctcgtgggcgacagagaaggcaccccagtgagcatcgtcgttaccactccccccgaagcgccaccagctctgggcacactccacgttgtccaacgaggcgagcacagcctccgactgcgatgggaaccagttccacgggctcagggttttctgctgcactggcaacccgagggcggacaagagcagtccagggtattaggcccagagctgagctcttatcacctagacgggctagagcccgccacccagtatagggtccgattaagtgttctcgggcccgctggagagggcccaagtgccgaagtaacagctaggactgaaagcccgcgcgtgccctctatcgagctcagagtggtggacactagtatagactccgtcaccctggcctggacacccgtgagccgtgcaagctcatatatcttgagttggcgaccactgcgtggcccgggccaggaggtgcccggcagccctcagacactgcctggcatatccagttctcagcgggtgacgggcctggagcctggggtgagttatatctttagcttgactcccgtactcgatggggtcagagggcctgaagcctccgttacccagaccccagtgtgcccacgagggctcgcagatgttgttttcctgccccacgctacacaggacaatgcgcaccgtgctgaggcgacgcggcgggtcctggagagactcgtcctcgccctaggcccgctgggcccccaggccgtacaagtggggctgctgtcttactcccatcgcccatccccgttattcccactcaatggctcacacgatctgggcatcatcttgcagagaatccgagacatgccatatatggatccctcaggcaacaacctggggacagccgtggtgactgcccatcgctacatgctggcgcccgacgcgccaggcaggcgccagcacgtcccaggcgtgatggtcttattagtggacgagcccctgcggggtgatatcttctcacctattcgggaggcacaggcaagcggactcaatgtggtaatgctgggtatggccggggccgatccagaacaactgagaagactagcacccgggatggactccgtccaaacattcttcgcggtggacgacgggccttccttggatcaagccgtcagtggacttgcaaccgcactgtgtcaagcaagtttcacaacccagcctcgcccggaaccttgccccgtctattgccccaaaggtcagaaaggcgaacctggcgagatgggcttgcgggggcaagtgggccctccaggcgaccccgggcttccaggccggacaggagcacctgggccccagggtccccccgggtctgctaccgcgaagggggagaggggctttccgggagctgacggcaggcccggcagtccgggccgggcaggcaaccctggcacccccggcgcgccaggattgaaaggatcgcctggcttgcctggaccgcgcggggaccctggcgagcgggggcccagggggcctaagggcgaaccaggagctccaggccaggtgatcggcggagagggcccgggccttcccggtcgcaagggagacccggggccaagcggccccccgggtcctcgggggccactgggcgaccctggccctcgcggtccaccggggctccctggtacagccatgaaaggagataagggcgataggggcgaacgcggaccaccgggtcctggcgagggcgggatagccccgggtgaaccaggactgcccggccttccaggctcaccaggcccccagggccccgtggggcctccgggcaagaagggagaaaagggagactctgaagacggagcgcctgggcttcctggccagcccgggtctcctggagagcagggaccaagaggcccccctggagctatcggaccaaaaggggaccgcggctttccaggtcccttgggtgaggctggcgaaaaaggcgaacgggggccgccaggaccagctgggtctcggggcctgcccggtgtagccggtcggcccggggccaaaggccctgagggaccgcccggccctaccggtaggcagggcgagaagggtgaacccggccgccctggggatccggctgtggtaggtccagccgtcgcgggacccaaaggggaaaaaggagatgtgggaccagccggacccagaggcgcaacgggagtacagggcgagagaggccccccgggtctggtgctgcccggagaccctgggccgaaaggagatcccggtgatcgcgggcccattggcctaactggaagggccgggcccccgggcgattccggacctcccggcgaaaagggggacccgggcagacccggaccaccaggacctgtgggacccaggggcagggatggcgaggttggggaaaagggtgacgagggcccacctggcgatccaggccttccaggaaaggccggtgagcggggcctcagaggagcccccggtgtgaggggccccgtgggcgaaaaaggcgaccagggcgaccccggcgaagacggccgtaatggaagcccaggatcatctggccccaagggggacagaggagagcctggtccacccggccctcctggacggctcgtcgacaccggccccggcgcccgcgagaaaggcgagccaggggatcgcgggcaggaggggcccagagggccaaagggggaccctgggttgccaggcgcacccggtgagagaggaatagaagggtttcgtggaccgccaggacctcagggggatcctggagtacggggcccagccggagagaagggcgaccgggggccaccaggactagatggcagatctgggttagatggaaaacccggggctgccggcccctccggtcccaatggcgcggccggaaaagctggagatccgggcagagatggtctgcctggattgagaggggaacagggcttgcctggtccgtccggtcctcccgggttacccggcaaacccggtgaagatggcaaaccagggctcaacggtaagaatggggaacctggagaccctggcgaagatgggagaaagggggagaagggagacagcggtgcatcaggcagggaaggacgggacggccccaagggtgagcgaggcgcacctggcatcttaggcccccaagggccacccgggctccccgggcccgtgggcccgcccggtcagggcttccccggtgtgcccggggggaccggccctaagggtgaccgtggtgaaacgggctccaagggtgaacaaggattaccgggagagagaggattgaggggggaaccaggatccgtccctaatgtggacagactgttagaaacagcaggcataaaggcatcagctctgcgggaaattgtggagacctgggatgagagttcaggatcatttttgcctgtgcctgagagacgtcgcggaccgaaaggagattcaggggagcaggggccccctggaaaggagggcccgataggtttccctggcgaaaggggcctcaaaggggacagaggcgatcctgggcctcaaggacctccaggattagcgcttggtgagagggggccccctggaccctctggcttggccggagagccgggtaaaccaggcatcccagggcttcccggacgggccggtggggtgggcgaggcgggcagaccgggggagaggggtgaaagaggggagaaaggcgaaaggggtgaacagggccgggatggcccgccagggctccctggcactccaggaccccctgggccgcccggcccgaaggtctccgtagatgaaccaggccctggcctaagtggagaacaaggaccaccgggactaaagggagccaaaggggagcccggttccaatggggatcagggcccgaagggtgatcgcggtgtgccaggcattaaaggggaccgaggcgagcccgggccccgtgggcaagatggaaaccctggcttgccaggcgaaagaggaatggccgggcctgaggggaaacctggcttgcagggtcccagaggcccgccgggccccgtgggtggccatggcgacccaggccctccaggggcacctggcttggctggccccgctggtccgcaggggccatcaggtttgaaaggggagcccggcgaaaccggtcccccgggtcgggggctcacaggcccaaccggggctgtgggcctgccaggccccccaggccccagcgggttagtggggccgcagggcagccccggtcttcctggacaagtgggggagacaggcaagccgggagcacctgggagagatggcgccagtggaaaagacggggacagaggcagccctggcgtgccaggttctcccggactgcctggccccgtcggtcctaagggtgagcccggccccaccggtgctccagggcaagccgtcgtaggcttgccaggtgccaaaggcgagaagggagcaccaggtggactcgcaggagatctggtgggagagccgggggccaagggggatagggggctacccggaccgaggggggaaaaaggcgaggctgggagggccggagaaccaggggaccctggagaagatggccagaaaggtgcccctggaccgaaagggtttaagggagatcctggcgtaggagtgccggggtcaccggggccccccggcccccccggggtaaagggcgacctcggtcttccgggtctccccggcgcgccaggtgtagtcggttttcctggccaaaccgggccgcgcggcgaaatgggccagcctggtcccagcggcgagagaggactcgccggcccccctggccgggagggtatacctggacctctgggtcctccaggtccccccggctcagttgggccaccgggcgcctctggactcaaaggcgataagggtgatcccggcgtggggctacctggtcctaggggggagagaggcgagccaggcatccgtggcgaggatggccggcctggtcaggaaggaccaagaggactgacagggccccctgggtccaggggagagcgaggcgaaaaaggagacgtaggtagcgctggtctcaaaggagataaaggggattctgcagtgatcctcggtcctcccggccctaggggggccaaaggtgatatgggggagcgcggtcctaggggtttggacggcgataagggtcctagaggcgacaacggcgatccgggcgataaaggaagcaaaggtgagcccggagacaaggggtcagccggactccccgggctgagggggctcctggggccccagggccagcctggcgccgcaggtatacccggagatccaggaagcccaggaaaggatggggtaccgggtatccgaggagaaaaaggtgacgtgggttttatggggcccagaggactgaaaggcgagcggggggttaagggcgcctgtggcctagacggcgagaaaggagacaagggggaggcaggccctcctgggaggcccggtctggccggtcataaaggcgagatgggggagccaggtgttccaggccaaagcggcgctcctggtaaggaaggactgatcggacccaagggggataggggatttgacgggcagcccgggccgaaaggggatcaaggtgaaaaaggcgaacgcggcacccctggcattggtgggtttcctggtccatccggcaatgacggctcggccggtcccccaggccccccaggttccgtgggccctagaggcccagaagggttgcagggacaaaagggagagagaggccctcccggagaacgagttgttggagcgcctggtgtgcccggcgcaccgggcgagcgcggcgagcagggaaggccaggacctgccggcccccgcggagaaaaaggtgaagccgccctgaccgaagatgacatacggggatttgtacggcaggagatgagtcagcattgtgcatgtcagggtcaatttatagcctctggatctcggccgttaccgtcgtacgccgccgatacagccgggtcccaattacacgcagtgccggtgttgcgagtttctcatgccgaggaagaggagcgggtaccaccagaagatgatgagtactccgagtatagcgaatattccgtcgaagagtatcaggatccggaggcaccttgggacagcgacgacccctgctcattgccactggacgaaggaagctgcaccgcgtacacactgcggtggtaccaccgggccgtgactggctccactgaggcctgccacccctttgtctatggtgggtgcggcggcaacgccaaccgctttggtactcgtgaagcatgtgaaaggagatgcccaccccgcgtggttcaaagccagggcaccggaacagcgcaagac

SEQ ID NO: 9582 - DNA, 8832 bp, Artificial Sequence
  Description of Artificial Sequence: Synthetic coding sequence
atgactctccgtttgctcgtggctgccctctgcgctggcattttggccgaagctcccagggtaagggctcagcacagagagcgtgtgacctgcaccagattgtatgccgcagacatagtgttcctcctggacggctcttcaagcatcggccgttccaattttagagaagtcagatcattcctcgagggtctggttttgcctttcagcggcgctgcctccgcccagggcgttcgctttgctactgtccaatacagcgacgatcctcgcaccgaatttggcctggatgctctcggaagtggcggcgacgtgatccgtgctattcgcgaattgtcttataagggaggtaacacacgtacaggagctgcaatactgcacgttgccgaccacgtcttcctgcctcagctcgcaaggcctggagtgcctaaggtgtgcatcttgatcactgatggtaaatctcaagacctggtcgacacagcagctcagcgtctcaaaggccagggcgtaaaactgttcgctgtgggaattaaaaatgcagacccagaagagctgaagagggtggctagtcagcctacttccgactttttttttttcgtgaatgatttcagtatcctccgtactctgctcccacttgttagcaggagggtgtgtaccacagcaggcggtgtacctgtcactcgccccccagacgacagtacatctgcccctagggatctcgtactgtcagaaccttccagtcagtctctccgcgtgcagtggaccgcagccagtggacccgttaccggatataaggtacagtacactcctctgaccggtttgggtcaacccctcccctcagagaggcaggaggtcaatgtgccagcaggcgagacctctgtgcgcttgcgcggtctgagacctttgaccgaataccaggtgaccgtcatcgcattgtacgccaattccataggcgaagccgtgtcaggcactgcccgtaccactgctctggaaggcccagaactgactatccagaacacaacagcccactcactcctcgttgcatggcgctctgtgccaggtgctactggttatagggttacttggcgtgtgctctccggcggcccaacacagcaacaagagctgggccccggtcaaggttccgtcctgttgagggacttggaaccaggcaccgattacgaggtcaccgtgtcaacccttttcggaagaagcgtcggacctgccacctctttgatggctaggaccgatgcctctgtggagcagacactgaggccagtgatacttggccccactagcattctgctgagttggaaccttgtaccagaggcccgtggatatcgcctggagtggcgcagggaaacaggtctggagcccccccagaaagtggttttgcctagtgacgtgactcgctatcagttggatggcctgcaaccaggcaccgaatacaggctgaccctgtacactttgcttgaaggccatgaagtcgctacccccgctaccgttgtgcccaccggcccagagctgcctgtgagtccagttaccgacctgcaggcaactgagctccccggccagagagtgagagtgagctggtctcctgtgcctggcgcaacccagtatagaattatcgtaaggtctacacagggagtagaaagaacactcgtgctccccggaagccaaaccgctttcgatctcgacgacgtgcaagcaggtctctcctataccgtgagggtgtcagctcgcgtgggacctagagagggcagcgcttctgtcctcactgtgcgtagagagcccgagactccccttgctgtgcctggcctgcgtgtggtcgtgtccgacgctaccagagtaagggtcgcatggggccccgtgccaggtgctagtggttttagaatcagttggagcacaggctccggaccagaaagttcccagaccctgccaccagactctaccgcaacagatattactggactccaacccggaacaacctatcaagtggccgtgtcagtgttgcgcggccgcgaggaaggtccagcagcagttatagtcgctcgcaccgaccctctgggacctgtaaggacagtacatgtgacccaagctagtagtagcagcgttaccatcacctggactagagtgccaggagccacaggataccgcgtgtcctggcattccgctcatggccctgagaagtcacagctggtcagcggcgaggctactgtagctgagctcgatggcctggaacccgacacagaatacacagtgcacgtgagagctcacgtagctggagtggacggacctcctgcctctgtggtggtgcgcacagctcccgagccagtaggaagggtctcacgcctccagatccttaacgcctcctccgatgtcctcaggatcacttgggtcggcgttaccggagccaccgcctatcgcctcgcctggggtagatcagaaggaggtcccatgaggcatcagattttgccaggaaacactgattcagctgagatcagaggcctggaaggaggtgtttcctattctgttagagtcactgctctggtgggagaccgcgaaggcactcctgtgtctattgttgtaactacacctccagaagccccaccagcacttggtaccctgcacgtagttcagcgtggtgagcattcactcaggctgcgctgggagcccgtcccccgcgcacagggattcctgttgcactggcagcccgagggcggtcaggagcagtccagggtgttgggtccagagctgtcatcctaccatctggatggtcttgaacccgctacccaatacagagtgcgtctcagcgtgcttggacctgccggtgaaggaccctcagcagaagtgaccgcccgtacagaatctcctcgtgtgccctccatcgagcttcgcgtagttgacacctccatcgactccgtcacattggcttggacccccgtttctcgtgcaagcagttacatcctgtcttggcgtcccttgaggggtccaggtcaggaggttccaggaagccctcaaactctccctggtatctccagcagccagagagttactggcctggagcctggtgtgtcatacatattcagcctgactcctgtactcgacggagtgcgcggccctgaggcttccgtcactcaaactcctgtgtgtccccgcggacttgctgacgtcgtgtttcttcctcacgctacacaagataatgcccaccgtgctgaagctacacgtcgcgtgctcgagcgtctcgtcctcgcacttggccccttgggtcctcaggctgttcaggttggcctgctttcctactctcacaggcccagccccctgttccctctgaatggctctcacgacttgggtatcatcctgcaacgtatcagggacatgccttacatggacccttcaggaaataatttgggtactgccgtggtgacagcacaccgttacatgcttgcccctgacgcccccggacgccgtcagcacgtgccaggcgtgatggtgctgctggtagatgagcctttgaggggagacattttcagtccaatccgcgaagcccaggcttccggcttgaacgtcgtgatgcttggaatggctggtgccgaccctgaacagttgcgtcgtctggcacctggtatggatagtgttcaaactttcttcgccgttgatgatggccccagtctggaccaggctgtctcaggcctggccaccgctctgtgtcaggcatctttcaccacacaacctcgcccagaaccatgccccgtctactgccccaagggccagaaaggagagcctggtgagatgggtctgaggggacaggtgggaccacccggtgatccaggcctccccggcagaactggagctccaggcccacagggccccccaggctccgccaccgctaagggcgaaagaggctttccaggcgctgatggacgtcctggttctcccggaagggctggaaaccccggtactcctggtgctccaggattgaagggatcccccggcttgcctggacctagaggcgaccccggcgagaggggaccccgcggtccaaaaggtgagccaggagcacctggacaggtgatcggcggagagggccctggcctgccaggtaggaaaggtgatcccggcccctccggacctccaggacctcgcggaccccttggcgatcccggtccacgcggtccacctggcctgcccggaaccgctatgaagggcgacaagggcgaccgtggagagaggggtcctccaggaccaggtgagggcggaattgctccaggcgagcccggtctgccaggtctgcccggaagcccaggccctcagggacctgtcggacctccaggcaagaagggtgagaagggagattctgaagacggtgctccaggtctcccaggccagcccggatctccaggcgagcagggtcctaggggcccccccggtgcaatcggcccaaagggagataggggcttccccggtcctctgggcgaggccggtgaaaaaggcgagaggggaccacccggtcccgctggcagtaggggtctgcccggtgttgccggacgccctggcgctaaaggacctgaaggtcccccaggccccacaggcaggcaaggcgagaagggagaacccggccgtccaggcgaccccgctgtagttggccctgcagtcgcaggaccaaagggtgagaaaggagacgtaggaccagctggaccccgcggagccaccggtgttcagggcgaaaggggacctcctggattggtgctgcctggcgatcctggccctaaaggagatcctggtgataggggtcccatcggcctgactggacgcgcaggtcctcctggcgactccggtcccccaggcgagaaaggagaccccggtcgtcctggacctcccggacccgtcggccccaggggcagggatggagaggtcggcgaaaagggcgacgaaggtccccctggtgaccctggcctgcccggcaaagcaggtgagcgtggtcttagaggcgccccaggcgtgaggggaccagtgggcgaaaagggtgaccagggcgatcccggagaggacggaaggaatggatctcctggcagcagcggcccaaagggagacaggggcgaaccaggtcccccaggcccccctggtcgtctggttgacaccggccctggtgcacgcgagaagggcgaaccaggcgatagaggccaagaaggacctcgtggtcccaagggcgatcctggccttcctggcgctcccggcgaacgtggaatcgagggcttcaggggcccaccaggacctcaaggtgaccctggtgttcgtggacccgccggtgagaaaggtgatcgcggaccacccggtctcgatggaagatctggacttgatggcaagcctggcgctgcaggaccttcaggaccaaatggtgctgcaggcaaagctggtgatcccggcagggacggactgccaggcttgaggggcgagcagggcctgcccggcccctctggtccccctggtctcccaggcaagcccggtgaagacggcaagccaggactgaatggaaagaacggtgagccaggcgacccaggcgaggacggccgtaagggcgagaaaggcgattccggtgcttctggccgcgaaggtcgtgacggtcccaagggtgagagaggagcccccggaatcctcggaccacagggtcccccaggtctccccggccctgtcggcccacctggccagggcttccccggtgtgcccggaggcactggcccaaaaggcgatcgtggagaaactggctctaagggagagcaaggattgcccggagagaggggcctcaggggagagccaggtagcgtccctaacgtggaccgcttgctggaaaccgccggaattaaggcaagcgctctgagggagatcgtggagacttgggacgaaagcagtggcagttttcttcccgtccctgaacgcagacgtggtcccaagggtgactccggagaacaaggaccacccggcaaggagggccccattggctttcctggtgagaggggcctgaagggtgaccgtggagaccccggaccacagggtccccccggtctggccctgggagagcgcggtcccccaggcccatctggtctggcaggcgagcccggaaagccaggcatccccggtctgcctggccgcgcaggaggagtcggcgaggcaggcaggcccggcgagcgcggagagagaggcgagaaaggagagcgtggtgaacagggccgtgatggtcctcctggcttgccaggtacaccaggacctccaggcccccccggtcccaaggtatccgtggatgaacctggccctggcttgtcaggagagcaaggccctcctggtcttaaaggagctaaaggagaaccaggctccaacggcgatcagggtccaaagggtgatagaggcgtgccaggaatcaagggagacaggggtgagcccggtcccagaggtcaggacggcaatccaggtctgcccggtgagagaggaatggccggacccgaaggaaagcctggtctccagggtccacgtggtccacctggccccgtgggaggccacggagatcccggcccacctggtgccccaggccttgccggccccgctggaccccaaggaccctccggtctgaagggagagccaggtgagaccggcccacctggccgcggcttgaccggccctactggtgccgtgggcctgccaggacccccaggtccatccggcttggtgggacctcagggcagtcctggtctgcctggccaggttggtgagactggaaaacccggtgctccaggcagggatggcgcctcaggaaaagacggcgacagaggttctcccggagtgccaggttctccaggactgcccggaccagtaggtcccaaaggcgagccaggaccaactggcgctccaggacaggccgtggtgggtctcccaggcgccaagggcgaaaagggagcccccggtggcctcgctggagacttggttggcgaacccggagccaagggagatcgtggcttgcctggccctcgtggcgagaagggtgaggcaggtagggccggtgaacctggcgaccctggcgaagatggccagaagggagctccaggccctaagggtttcaagggcgacccaggagtcggcgtccctggcagccctggaccaccaggacctcccggagtcaagggcgacctcggcctgcctggacttcccggagctcccggagtcgtcggctttcccggccaaaccggcccccgtggcgagatgggtcagccaggaccaagtggcgagcgcggactcgctggacccccaggtcgcgaaggtattcctggtcccttgggtccccctggacctccaggttctgtgggaccccccggcgcatccggtttgaaaggtgataagggcgaccccggtgtgggcctgccaggtccaaggggagagcgtggagaacctggaatccgcggtgaggacggtcgccccggacaagaaggccctaggggcctgacaggtccaccaggatcccgtggtgaacgtggtgagaagggcgacgttggcagcgctggcctcaaaggcgataagggcgactcagcagtgatcctcggccctccaggccctaggggtgccaaaggtgacatgggcgagagaggtcctcgtggcctggatggcgataagggcccacgtggagacaatggtgaccccggagacaaaggatcaaagggagaaccaggagataagggctcagccggtctgcccggactgcgcggtttgcttggcccacaaggccagccaggcgctgcaggcatccctggtgaccccggatctcccggcaaggatggagtccccggcattaggggagagaaaggcgacgtaggtttcatgggccccagaggtttgaagggcgaaaggggcgtcaagggcgcttgtggtctggacggcgaaaaaggcgataagggcgaggcaggtcctcctggtcgccctggattggctggacataaaggcgaaatgggtgaacccggtgtgccaggccagagcggagctccaggaaaggaaggattgattggacctaaaggcgacagaggtttcgacggacaacccggtcccaagggagaccaaggtgagaagggtgagaggggcacccccggtataggcggttttccaggaccatccggtaacgacggatcagcaggccccccaggtccacccggttccgtgggacctcgtggtccagaaggcttgcaaggtcagaaaggcgaacgcggaccaccaggtgaacgtgtcgttggtgctcctggagtgcctggagctcccggagagcgtggcgagcagggacgtccaggtccagccggtcccaggggagagaagggagaggcagccttgacagaagacgatatcaggggtttcgtgcgccaagaaatgtcacagcattgcgcatgccagggtcaattcatcgctagtggttcccgccctctccccagttacgcagctgacacagctggatcccagctgcacgccgtgcctgtcctgagagttagccatgcagaagaagaagagagggttccacccgaggatgatgagtactctgaatactcagaatactctgttgaagagtaccaggaccctgaagctccctgggacagcgacgacccatgctcactgccacttgatgaaggtagttgtactgcatacaccctgcgctggtatcacagggctgtgacaggctccactgaagcctgtcatccattcgtgtacggcggatgtggaggaaacgctaacaggttcggcacacgcgaggcttgtgaaagaagatgtcctccaagagttgttcagtcccagggaaccggcaccgcacaggat

SEQ ID NO: 9583 - DNA, 8832 bp, Artificial Sequence
  Description of Artificial Sequence: Synthetic coding sequence
atgacccttagattgttggtggcggcattatgtgccggcatcctcgccgaagcaccccgtgtgcgtgcccagcatagagagagagtcacatgcacacgtctatacgccgcggacattgtgtttctcttggatgggtcctccagcattgggcgcagcaatttccgggaagttaggagctttctggaggggcttgtcttgccattctccggggctgcctctgcgcagggcgttcgatttgccactgtgcaatatagcgacgacccccgcaccgagttcggtctagatgccctgggctctggtggcgatgtgatcagagcgataagagaattgagctataagggcggcaacacacgtaccggcgctgccattcttcacgtggccgaccatgtttttctgccacagctggcgaggcctggcgtgccgaaagtttgtatattgatcacagatgggaaaagccaggatctggtcgatacggccgcccagagactcaaaggacaaggcgtgaaactgttcgctgtgggaattaagaacgcggacccagaggagcttaagagggtcgcgtcccagccgacctctgacttcttcttcttcgtcaacgattttagtatcctcagaacactcctgcctctggtctcccgtcgtgtgtgtacaacagcaggaggcgtacctgtgactcggcctcccgatgatagtacttccgcgcccagagacctggtgctgtccgaaccaagctcacaatcattacgtgtgcagtggaccgcagcctcaggccctgtgaccggctataaagtccagtacactccccttaccggtctcggtcagccgctgccatccgagcggcaggaagttaatgtgccagccggcgagacatccgttcggctacgtggacttcgccccctcactgaataccaggttacagtgatcgcactgtacgctaactccatcggggaagccgtttccggaactgcgcgaacaactgccctggagggcccagagttgaccattcagaacaccacagcccattcgttattagtcgcatggagatccgtccccggggctaccggctatcgagtgacttggagagtactctccggaggcccaacgcagcagcaggaactcggacctggtcagggcagtgtgctactcagggaccttgagcccggtacagattatgaagtgacagttagcactctgtttggacggagtgtcgggccagccacaagcctgatggcccgtactgacgccagcgtcgagcaaaccttgcggccggttatcctgggtcccacttccatcctgctgtcctggaatcttgtgcccgaagcgcggggatatagactagagtggagacgggaaaccggtttagaaccgccgcaaaaagtggtattgccatccgacgtcacacggtaccaattggacggtctgcagcctggaactgaataccggcttaccctatacaccctacttgaaggccacgaagtcgccacacccgctacggtcgtgccgacaggacctgaactgcctgtctcacccgttacagacctgcaggccaccgagctgccggggcagcgggtgcgagtgagctggtcccctgtgccaggagccacccagtaccggatcatcgtgagatccacccaaggcgtggagcgcactctcgtcctccctggtagtcaaacagcctttgacctagatgacgtgcaggcaggcctttcttacacggttcgcgtctccgcccgagtgggaccccgagagggctctgcctctgtgctcaccgttcgcagagagcctgaaaccccgctggcggtaccaggtctccgggtcgttgtgagcgatgcaacaagggttagggtggcctggggtcccgtccccggagcttccggcttccgcatatcctggtctacgggatcaggcccagaatcaagccagaccctaccgccggattccactgccaccgacatcacaggcctgcagcccgggaccacctaccaagtggccgtgagtgtattgagggggagggaagagggccctgctgcagttatcgtggcccgcacagatcccctcgggcccgtgcgcaccgttcatgtgacccaggcttccagctcgtccgtaactattacatggacccgagtgcctggagcgactgggtacagagttagctggcactccgcacacggccccgaaaagtctcaattggtctctggtgaggccacagtcgcagaactcgacggactcgagcccgacactgagtataccgtccacgtgagagcacacgtggccggggtcgacggacctcctgcaagtgtggtggtgaggacggctcccgaacccgtgggacgggtgagccgactgcagattctcaatgcaagctccgatgttctaagaatcacatgggttggggtcaccggtgctactgcctaccgtttggcctggggccgttcggaagggggacctatgcgacaccaaatcttaccgggaaacacagactcagccgagattcgggggctagaagggggggtcagttactctgtgagggttactgcattagtcggcgatagggagggcaccccggtgtctattgtggtgacgaccccacccgaggccccgcccgctctgggaacgttgcacgtggttcagcggggggaacattccttaaggttgcggtgggagcccgtgccacgtgcgcaaggatttctcctccattggcagcctgagggaggccaggaacaatcacgcgtgctgggccctgagctgagttcttaccatcttgacggactcgagcccgcaacccagtaccgcgtcaggttgtctgtactgggcccagccggagagggccccagcgccgaagtcaccgcccgaacggaatctcccagggtgccttcgattgaactgagagtggtggacaccagtatagactccgtgaccttagcctggacacccgtgtctagagcgagctcatatattctatcttggcggcccttacgtggccctggccaggaggttcctggaagcccccagacgctgccgggcattagtagctcccagcgggtgactgggttggaacccggagtttcttacatcttttctcttacacccgtgctggacggcgtgagagggccggaggccagtgtgacccagacacccgtgtgcccaaggggacttgctgatgtggtatttctgccccatgctactcaagacaatgcgcatagggcagaagcgacccgaagggtgttggaacgactggtcctggccttagggccgctgggcccacaagctgtgcaggtggggctgctgagctactctcatagaccttcaccattgttccccttaaacggatcccatgaccttgggataatcttgcagcgtatccgggatatgccttatatggacccttctggcaacaacctgggcactgctgttgttactgctcaccgctatatgctggcacctgatgcacccggacgcaggcagcacgtgcctggcgtcatggtcttacttgtggatgaaccactgcggggggatattttctctcctatccgtgaagcacaggcatctggcctgaatgtagttatgttaggcatggccggagctgatccagaacaattacggcggctggccccgggcatggactcggtacagaccttttttgccgttgacgacggacccagcttggaccaggccgttagtgggctcgccacagcgctgtgccaagccagcttcacgacccagccccgccccgaaccctgccccgtttattgtccaaaagggcagaagggggaacctggcgaaatgggtttgcgcggacaggtgggacctcctggcgatccaggactgcccggtcgtacaggggcccctggaccacaggggccacctggatctgcgaccgccaaaggggagcggggctttcccggtgccgatgggaggccaggctcgccaggtcgggctggaaacccaggcactcccggggcccctggactgaaaggaagccccggtctgcccggtccgcgcggggatcccggtgaaagaggaccaaggggccctaaaggtgagccgggggctccaggtcaggtgatcggaggtgagggccccggtctgcccgggagaaaaggagacccgggcccaagtggccctcccgggccacggggcccacttggtgacccaggaccacggggcccaccgggcttgcccgggaccgccatgaagggtgataaaggagataggggggagcgggggcctccaggccctggtgagggcggaatcgctccaggggagcctggtttgcccgggcttcctggatctcccggcccccaggggccggtgggcccacctggtaaaaagggagagaaaggagatagcgaagacggggcgcctggactgcccgggcagcccggctcacccggcgaacagggcccaaggggaccacccggggcaatagggcctaagggtgaccgtggattccccgggcccttaggagaagccggcgagaaaggagagcgaggtccacctggtccagccgggtccaggggcctgccaggtgttgctgggcggcccggagcgaagggaccagaggggccaccaggaccgaccggacggcagggtgagaagggcgagcccggtcggccaggcgaccccgccgttgtcgggccagccgtagccggacccaagggagaaaaaggggacgtggggcccgccgggcctagaggcgcaaccggagttcaaggagaacgaggccctcctgggttagtcctgcccggagaccctggccctaagggcgaccccggagatcgcggacctatcgggttgacaggccgggccggaccacctggtgattcgggtccgccgggcgagaagggagaccccggtaggcccgggccccctgggccagtggggccgagaggccgtgatggtgaagtcggcgagaaaggggacgaggggccaccgggcgatcccggactaccggggaaggctggggagcgcgggctcaggggtgcacctggtgttaggggacctgttggcgaaaagggagaccaaggcgatccaggcgaggatgggcgaaacggctcgccaggttcaagtggacctaaaggggataggggcgagcccggaccccctgggccgcctggacggctggtggataccgggcctggggcccgtgagaagggagagcctggcgacaggggacaggaaggtccgaggggaccaaaaggagatccgggcttacccggggcccctggggagaggggcattgagggtttcaggggccctcctggaccccagggggatcccggcgtgagaggaccagcaggcgagaaaggcgataggggaccccctgggctagatggcagaagcggcctggatggtaagcccggtgccgccggcccttctggaccgaacggcgccgccggcaaggctggagatccaggtcgtgacggactgcccggcctgcggggtgagcaaggcctgccagggccatccggccccccgggcctgcctgggaaacccggcgaagacgggaaacccggcctcaatgggaagaatggcgaacccggcgatccaggagaggatggtcgaaagggggaaaaaggagatagcggcgcatcggggcgagagggccgggacggccccaagggggaacggggtgctccggggatactgggaccacaagggcctccaggcctgcctggccctgttggtcccccgggacaggggttcccaggagtgcccggtggcacaggccctaagggagatcgaggcgagacagggagtaaaggagaacaagggttgccaggcgagaggggcttgcgaggcgaaccaggatccgttcctaatgtggaccggctacttgagaccgctggcattaaggcaagcgctctacgggagattgtggagacctgggacgaatcaagtggcagcttccttcctgtgcctgagcgcaggagaggcccaaagggcgattctggagagcagggtccccctggtaaggaggggcctattggcttccctggcgagcgcggtctcaagggagatagaggcgatcccggacctcaggggcccccagggctggcgctgggagaaaggggcccacctggccccagcgggctggccggggagcctggaaagccaggaatccctggcttgcctggaagggctggaggcgtgggggaagccggcagacctggggagcgcggggagcgcggtgaaaaaggcgagcggggtgaacaagggcgagacggacctcctggcctgcccggtacacctgggcctcccgggcccccaggtcccaaagtgagtgtggacgagccgggtcccgggctgtctggagagcagggccctcccggcctgaagggggctaagggagagcctggatccaacggtgaccagggtccgaagggggatcggggtgtccctggaataaagggggatcgcggagagcctgggcctagaggccaggatggaaatccagggctcccaggagaacgggggatggccggccctgagggcaagcccgggctgcaaggacccaggggccctcctggccccgtgggtgggcatggagacccaggcccaccaggggcccctgggctggccggccctgccggtcctcagggcccgagcgggttgaagggcgagccaggtgaaacagggccccctggtcggggcctgacgggccccacaggggccgtgggactccctggccctcccgggccgagcggacttgttgggcctcaaggatcccctgggctccccgggcaggttggggagacaggcaaaccaggagcgcccggacgcgacggcgcatctggcaaagatggtgatcgcggtagccccggggtgccaggttcccccgggctcccaggcccagtggggccgaagggggagcctggacccacaggggctccgggacaggcagtggtcgggctgccaggagcaaaaggcgaaaagggagccccggggggtctggctggcgaccttgtcggcgaaccaggtgcgaaaggcgatagggggctcccagggccacgcggagaaaagggcgaagcaggacgggccggagagcccggcgatcctggggaggatggtcagaagggggcaccaggaccaaagggctttaagggggatccaggagtaggtgtaccggggagccccggaccccccggaccacctggggtaaaaggtgacctggggctaccgggccttcctggagcccccggagtggtgggcttccctggtcagacgggcccccgcggagagatggggcagccaggaccatcgggggagagaggtctggccggcccgcccggaagggaggggatacccggacccctaggaccccccgggcctcccgggagcgtgggaccgccgggtgcctctggtttgaagggtgacaagggagaccccggtgtagggctgcctggtccccgaggcgagcggggcgaacctgggattcggggagaggacgggcgtcccggccaggagggacccagagggctgacagggccccctggtagtcggggcgagaggggcgagaagggggatgtggggtcagcgggcctgaaaggagacaagggggactccgccgtgatcctgggtccacccggacctaggggggccaagggcgacatgggggagagaggaccgcgaggactggacggggataaaggacctcggggggacaacggtgatcctggcgacaaaggctcaaagggagaaccaggcgacaaaggttctgccggtttacctggcctgcgcggactgctggggcctcaggggcagcccggcgccgctggaataccaggcgatccaggctcacctggaaaggatggtgtccccggaatacggggtgagaaaggagacgtggggttcatggggcctagaggcctgaaaggggagaggggggtgaaaggtgcctgcgggctggatggagaaaaaggggataaaggcgaggcaggacctccagggcgcccagggttagcgggccacaagggcgagatgggcgaacctggagtgcctggccaaagtggcgcaccaggaaaggagggcctgattggccccaagggagatcgaggatttgacggtcagcctggaccaaaaggagatcagggcgagaaaggggagaggggaacccccgggattggagggtttcctgggcccagtggcaacgatggaagcgctggcccacccgggccaccaggctcggtgggccccagagggccagaaggactccaaggacagaagggggagcggggacccccaggtgagcgggtggtgggcgcaccaggggttccaggagctcccggagagcggggcgagcaggggcggcccggccccgcgggacccagaggggagaagggggaggccgctcttactgaggacgatatccgcggtttcgtcaggcaagagatgtctcagcattgtgcctgtcagggacagtttattgcgtcagggtctcgtcctctccccagctacgccgcagacactgcgggttcacaactacacgccgtccctgttcttcgggtatcccacgctgaggaggaagagcgagtgcctccagaggatgacgaatatagcgaatactccgagtattcggtagaagagtatcaggaccctgaggcaccctgggattcagatgatccctgctccctaccgttggatgaaggttcttgcacggcgtacaccctccggtggtaccaccgtgccgtgaccggctctactgaagcatgtcacccatttgtgtacggcggctgcggcggcaacgcgaatcgttttggcacaagagaagcgtgtgagcggaggtgtcctcctcgggtggtgcagagtcagggcaccggtaccgctcaggac

SEQ ID NO: 9584 - DNA, 8832 bp, Artificial Sequence
  Description of Artificial Sequence: Synthetic coding sequence
atgacgttacgactattagtagcggcgttatgtgcgggtatattagcggaagcgccgcgtgtacgagcgcaacatcgagaacgtgttacgtgtacgcgtctatatgcggcggatatagtatttttattagatggttcgtcgtcgataggtcgatcgaattttcgtgaagttcgttcgtttttagaaggtttagtactaccgttttcgggtgcggcgtcggcgcaaggtgtacgatttgcgacggtacaatattcggatgatccgcgtacggaatttggtttagatgcgctaggttcgggtggtgatgtaatacgtgcgatacgagaactatcgtataaaggtggtaatacgcgtacgggtgcggcgatattacatgtagcggatcatgtttttttaccgcaattagcgcgaccgggtgtaccgaaagtatgtatactaataacggatggtaaatcgcaagatttagttgatacggcggcgcaacgtttaaaaggtcaaggtgtaaaactatttgcggtaggtataaaaaatgcggatccggaagaattaaaacgtgtagcgtcgcaaccgacgtcggatttttttttttttgtaaatgatttttcgatattacgtacgctactaccgttagtttcgcgtcgagtatgtacgacggcgggtggtgtaccggttacgcgaccgccggatgattcgacgtcggcgccgcgagatctagttttatcggaaccgtcgtcgcaatcgctacgtgttcaatggacggcggcgtcgggtccggtaacgggttataaagttcaatatacgccgttaacgggtttaggtcaaccgctaccgtcggaacgtcaagaagtaaatgtaccggcgggtgaaacgtcggttcgtctacgtggtttacgtccgctaacggaatatcaagtaacggtaatagcgctatatgcgaattcgataggtgaagcggtatcgggtacggcgcgtacgacggcgctagaaggtccggaattaacgatacaaaatacgacggcgcattcgttactagttgcgtggcgttcggtaccgggtgcgacgggttatcgtgtaacgtggcgtgttctatcgggtggtccgacgcaacaacaagaactaggtccgggtcaaggttcggttttactacgagatctagaaccgggtacggattatgaagtaacggtttcgacgctatttggtcgttcggtaggtccggcgacgtcgctaatggcgcgaacggatgcgtcggtagaacaaacgctacgtccggttatactaggtccgacgtcgatattattatcgtggaatctagtaccggaagcgcgtggttatcgattagaatggcgtcgtgaaacgggtttagaaccgccgcaaaaagtagtattaccgtcggatgtaacgcgttatcaactagatggtctacaaccgggtacggaatatcgactaacgttatatacgctattagaaggtcatgaagtagcgacgccggcgacggttgttccgacgggtccggaattaccggtttcgccggttacggatttacaagcgacggaactaccgggtcaacgtgtacgtgtatcgtggtcgccggtaccgggtgcgacgcaatatcgtataatagttcgttcgacgcaaggtgtagaacgaacgttagtactaccgggttcgcaaacggcgtttgatttagatgatgttcaagcgggtctatcgtatacggtacgtgtatcggcgcgtgttggtccgcgtgaaggttcggcgtcggtattaacggtacgtcgagaaccggaaacgccgttagcggtaccgggtctacgtgtagtagtatcggatgcgacgcgtgtacgtgttgcgtggggtccggtaccgggtgcgtcgggttttcgtatatcgtggtcgacgggttcgggtccggaatcgtcgcaaacgctaccgccggattcgacggcgacggatataacgggtttacaaccgggtacgacgtatcaagttgcggtatcggttttacgaggtcgagaagaaggtccggcggcggtaatagttgcgcgtacggatccgctaggtccggtacgtacggtacatgtaacgcaagcgtcgtcgtcgtcggtaacgataacgtggacgcgagtaccgggtgcgacgggttatcgagtatcgtggcattcggcgcatggtccggaaaaatcgcaattagtttcgggtgaagcgacggtagcggaattagatggtttagaaccggatacggaatatacggttcatgttcgagcgcatgtagcgggtgtagatggtccgccggcgtcggtagttgttcgaacggcgccggaaccggtaggtcgtgtatcgcgtttacaaatattaaatgcgtcgtcggatgtactacgtataacgtgggttggtgtaacgggtgcgacggcgtatcgactagcgtggggtcgttcggaaggtggtccgatgcgacatcaaatattaccgggtaatacggattcggcggaaatacgtggtttagaaggtggtgtatcgtattcggtacgtgtaacggcgctagtaggtgatcgtgaaggtacgccggtatcgatagtagtaacgacgccgccggaagcgccgccggcgctaggtacgctacatgtagtacaacgtggtgaacattcgttacgactacgttgggaaccggtaccgcgtgcgcaaggttttctattacattggcaaccggaaggtggtcaagaacaatcgcgtgttctaggtccggaattatcgtcgtatcatttagatggtctagaaccggcgacgcaatatcgagttcgactatcggtattaggtccggcgggtgaaggtccgtcggcggaagtaacggcgcgaacggaatcgccgcgtgtaccgtcgatagaactacgagtagtagatacgtcgatagattcggttacgctagcgtggacgccggtatcgcgagcgtcgtcgtatatattatcgtggcgaccgctacgtggtccgggtcaagaagtaccgggttcgccgcaaacgctaccgggtatatcgtcgtcgcaacgtgtaacgggtctagaaccgggtgtatcgtatatattttcgctaacgccggtactagatggtgttcgaggtccggaagcgtcggttacgcaaacgccggtatgtccgcgtggtctagcggatgtagtttttttaccgcatgcgacgcaagataatgcgcatcgtgcggaagcgacgcgacgagttctagaacgtttagttctagcgctaggtccgttaggtccgcaagcggttcaagttggtttactatcgtattcgcatcgaccgtcgccgctatttccgttaaatggttcgcatgatttaggtataatattacaacgaatacgtgatatgccgtatatggatccgtcgggtaataatctaggtacggcggtagtaacggcgcatcgatatatgttagcgccggatgcgccgggtcgtcgtcaacatgtaccgggtgtaatggtactattagtagatgaaccgctacgtggtgatatattttcgccgatacgtgaagcgcaagcgtcgggtctaaatgtagtaatgctaggtatggcgggtgcggatccggaacaactacgtcgattagcgccgggtatggattcggttcaaacgttttttgcggtagatgatggtccgtcgctagatcaagcggtatcgggtctagcgacggcgttatgtcaagcgtcgtttacgacgcaaccgcgaccggaaccgtgtccggtttattgtccgaaaggtcaaaaaggtgaaccgggtgaaatgggtctacgaggtcaagttggtccgccgggtgatccgggtttaccgggtcgtacgggtgcgccgggtccgcaaggtccgccgggttcggcgacggcgaaaggtgaacgaggttttccgggtgcggatggtcgaccgggttcgccgggtcgtgcgggtaatccgggtacgccgggtgcgccgggtctaaaaggttcgccgggtctaccgggtccgcgtggtgatccgggtgaacgtggtccgcgtggtccgaaaggtgaaccgggtgcgccgggtcaagtaataggtggtgaaggtccgggtttaccgggtcgaaaaggtgatccgggtccgtcgggtccgccgggtccgcgtggtccgctaggtgatccgggtccgcgtggtccgccgggtttaccgggtacggcgatgaaaggtgataaaggtgatcgtggtgaacgaggtccgccgggtccgggtgaaggtggtatagcgccgggtgaaccgggtttaccgggtctaccgggttcgccgggtccgcaaggtccggtaggtccgccgggtaaaaaaggtgaaaaaggtgattcggaagatggtgcgccgggtctaccgggtcaaccgggttcgccgggtgaacaaggtccgcgtggtccgccgggtgcgataggtccgaaaggtgatcgtggttttccgggtccgttaggtgaagcgggtgaaaaaggtgaacgtggtccgccgggtccggcgggttcgcgaggtctaccgggtgtagcgggtcgtccgggtgcgaaaggtccggaaggtccgccgggtccgacgggtcgacaaggtgaaaaaggtgaaccgggtcgaccgggtgatccggcggtagtaggtccggcggttgcgggtccgaaaggtgaaaaaggtgatgtaggtccggcgggtccgcgtggtgcgacgggtgttcaaggtgaacgaggtccgccgggtctagtactaccgggtgatccgggtccgaaaggtgatccgggtgatcgaggtccgataggtctaacgggtcgagcgggtccgccgggtgattcgggtccgccgggtgaaaaaggtgatccgggtcgtccgggtccgccgggtccggtaggtccgcgtggtcgagatggtgaagtaggtgaaaaaggtgatgaaggtccgccgggtgatccgggtctaccgggtaaagcgggtgaacgtggtctacgtggtgcgccgggtgtacgtggtccggttggtgaaaaaggtgatcaaggtgatccgggtgaagatggtcgtaatggttcgccgggttcgtcgggtccgaaaggtgatcgaggtgaaccgggtccgccgggtccgccgggtcgattagttgatacgggtccgggtgcgcgtgaaaaaggtgaaccgggtgatcgtggtcaagaaggtccgcgaggtccgaaaggtgatccgggtttaccgggtgcgccgggtgaacgtggtatagaaggttttcgaggtccgccgggtccgcaaggtgatccgggtgtacgtggtccggcgggtgaaaaaggtgatcgtggtccgccgggtttagatggtcgatcgggtttagatggtaaaccgggtgcggcgggtccgtcgggtccgaatggtgcggcgggtaaagcgggtgatccgggtcgtgatggtttaccgggtttacgaggtgaacaaggtttaccgggtccgtcgggtccgccgggtttaccgggtaaaccgggtgaagatggtaaaccgggtctaaatggtaaaaatggtgaaccgggtgatccgggtgaagatggtcgtaaaggtgaaaaaggtgattcgggtgcgtcgggtcgagaaggtcgtgatggtccgaaaggtgaacgaggtgcgccgggtatattaggtccgcaaggtccgccgggtttaccgggtccggtaggtccgccgggtcaaggttttccgggtgtaccgggtggtacgggtccgaaaggtgatcgtggtgaaacgggttcgaaaggtgaacaaggtctaccgggtgaacgtggtctacgtggtgaaccgggttcggtaccgaatgtagatcgtttattagaaacggcgggtataaaagcgtcggcgctacgtgaaatagtagaaacgtgggatgaatcgtcgggttcgtttctaccggtaccggaacgtcgacgtggtccgaaaggtgattcgggtgaacaaggtccgccgggtaaagaaggtccgataggttttccgggtgaacgtggtttaaaaggtgatcgtggtgatccgggtccgcaaggtccgccgggtttagcgctaggtgaacgaggtccgccgggtccgtcgggtctagcgggtgaaccgggtaaaccgggtataccgggtctaccgggtcgtgcgggtggtgtaggtgaagcgggtcgaccgggtgaacgtggtgaacgaggtgaaaaaggtgaacgaggtgaacaaggtcgagatggtccgccgggtctaccgggtacgccgggtccgccgggtccgccgggtccgaaagtatcggtagatgaaccgggtccgggtttatcgggtgaacaaggtccgccgggtctaaaaggtgcgaaaggtgaaccgggttcgaatggtgatcaaggtccgaaaggtgatcgtggtgtaccgggtataaaaggtgatcgtggtgaaccgggtccgcgtggtcaagatggtaatccgggtttaccgggtgaacgtggtatggcgggtccggaaggtaaaccgggtttacaaggtccgcgtggtccgccgggtccggtaggtggtcatggtgatccgggtccgccgggtgcgccgggtctagcgggtccggcgggtccgcaaggtccgtcgggtctaaaaggtgaaccgggtgaaacgggtccgccgggtcgtggtctaacgggtccgacgggtgcggtaggtctaccgggtccgccgggtccgtcgggtttagtaggtccgcaaggttcgccgggtctaccgggtcaagttggtgaaacgggtaaaccgggtgcgccgggtcgtgatggtgcgtcgggtaaagatggtgatcgtggttcgccgggtgtaccgggttcgccgggtctaccgggtccggttggtccgaaaggtgaaccgggtccgacgggtgcgccgggtcaagcggttgttggtttaccgggtgcgaaaggtgaaaaaggtgcgccgggtggtttagcgggtgatctagtaggtgaaccgggtgcgaaaggtgatcgaggtttaccgggtccgcgtggtgaaaaaggtgaagcgggtcgagcgggtgaaccgggtgatccgggtgaagatggtcaaaaaggtgcgccgggtccgaaaggttttaaaggtgatccgggtgtaggtgttccgggttcgccgggtccgccgggtccgccgggtgttaaaggtgatttaggtctaccgggtttaccgggtgcgccgggtgttgtaggttttccgggtcaaacgggtccgcgtggtgaaatgggtcaaccgggtccgtcgggtgaacgaggtttagcgggtccgccgggtcgtgaaggtataccgggtccgctaggtccgccgggtccgccgggttcggtaggtccgccgggtgcgtcgggtttaaaaggtgataaaggtgatccgggtgttggtttaccgggtccgcgaggtgaacgaggtgaaccgggtatacgtggtgaagatggtcgtccgggtcaagaaggtccgcgaggtttaacgggtccgccgggttcgcgaggtgaacgtggtgaaaaaggtgatgtaggttcggcgggtctaaaaggtgataaaggtgattcggcggtaatactaggtccgccgggtccgcgaggtgcgaaaggtgatatgggtgaacgaggtccgcgtggtttagatggtgataaaggtccgcgtggtgataatggtgatccgggtgataaaggttcgaaaggtgaaccgggtgataaaggttcggcgggtttaccgggtttacgaggtctattaggtccgcaaggtcaaccgggtgcggcgggtataccgggtgatccgggttcgccgggtaaagatggtgtaccgggtatacgaggtgaaaaaggtgatgtaggttttatgggtccgcgaggtttaaaaggtgaacgaggtgttaaaggtgcgtgtggtttagatggtgaaaaaggtgataaaggtgaagcgggtccgccgggtcgaccgggtctagcgggtcataaaggtgaaatgggtgaaccgggtgttccgggtcaatcgggtgcgccgggtaaagaaggtctaataggtccgaaaggtgatcgtggttttgatggtcaaccgggtccgaaaggtgatcaaggtgaaaaaggtgaacgaggtacgccgggtataggtggttttccgggtccgtcgggtaatgatggttcggcgggtccgccgggtccgccgggttcggtaggtccgcgtggtccggaaggtctacaaggtcaaaaaggtgaacgtggtccgccgggtgaacgtgtagtaggtgcgccgggtgtaccgggtgcgccgggtgaacgaggtgaacaaggtcgtccgggtccggcgggtccgcgaggtgaaaaaggtgaagcggcgttaacggaagatgatatacgtggttttgttcgacaagaaatgtcgcaacattgtgcgtgtcaaggtcaatttatagcgtcgggttcgcgaccgttaccgtcgtatgcggcggatacggcgggttcgcaattacatgcggttccggttctacgagtatcgcatgcggaagaagaagaacgtgttccgccggaagatgatgaatattcggaatattcggaatattcggttgaagaatatcaagatccggaagcgccgtgggattcggatgatccgtgttcgctaccgttagatgaaggttcgtgtacggcgtatacgttacgttggtatcatcgtgcggttacgggttcgacggaagcgtgtcatccgtttgtttatggtggttgtggtggtaatgcgaatcgatttggtacgcgtgaagcgtgtgaacgtcgttgtccgccgcgtgttgttcaatcgcaaggtacgggtacggcgcaagat

SEQ ID NO: 9585 - DNA, 8832 bp, Artificial Sequence
  Description of Artificial Sequence: Synthetic coding sequence
atgaccctgagactgctggtggctgcgctgtgcgcaggaatcctcgccgaagccccgcgggtcagagcgcagcatcgagagcgggtcacctgcacccgtctttacgcggccgacatcgttttcctgctggatggcagctccagcatcggtaggtcaaacttccgcgaagtgcgctcgttcttggaaggactcgtccttccgttttccggagccgcttctgctcagggagtccgtttcgcaactgtccaatactcggacgacccacggaccgaattcggccttgatgcgctcggatccggcggcgacgtgatccgcgctatcagggagctgtcctacaagggaggaaacaccagaactggagccgcgatcctccacgtcgcggatcacgtgtttctgccgcaactggctcggcccggagtcccaaaggtgtgcattctgatcacggacggaaagtcacaggatttggtcgatactgcagctcaaaggctgaaagggcagggggtgaagctgtttgcggttgggattaagaatgctgacccggaagaactgaagagggtagcgagccaaccaacctcggacttcttcttcttcgtcaacgacttcagtattctgcgtaccttgctcccgctggtgtcgcgcagggtgtgtaccacggccggaggagtgcctgtgactcgcccgccggatgattcgactagcgcgccgagggacctcgtcctgtcggagccaagtagccagtccctgagagttcagtggactgctgcctccggtccggtgaccggatacaaggtccaatatactccgctcaccggactcggccaaccgcttccgtccgagcgtcaagaagtgaacgtgccggccggagagacttcagtccgccttagaggactccggccgctgaccgaataccaggtgactgtgatcgcgctgtacgccaattcaatcggagaggcggtatcaggaactgcgagaaccaccgcacttgagggtcccgaactgactatccagaatacgaccgcccactcactcctcgtcgcctggcgctccgttcctggcgcgactgggtacagagttacttggcgcgtcctcagtggaggaccgacccaacaacaagagctggggccaggtcagggttccgtgctcttgagggacctggaaccgggcaccgattacgaggtgaccgtgtcaactctgttcggccgctcagtcgggccggccacctcgctcatggcgcggaccgatgcctccgtggaacaaaccctcagaccggtgatcctggggcccacttcgattcttctgtcctggaatcttgtgccggaagctcggggctaccggctcgagtggcgccgagaaacgggattggagccgccacagaaagtggtgctgccgtcggatgtgactcgctaccagctggacggcctgcagccaggaactgaatatagactgaccctctatacgttgctggaggggcacgaggtggcaactcctgctactgtcgtgccaactgggcccgagctcccggtgagtcccgtcactgaccttcaggctaccgagttgcctggccagagagtgagagtgtcgtggtccccggtgcccggagcgactcagtacagaatcatcgtccgcagcacccagggagtggaacgcaccctggtgctccccgggagccaaaccgcgttcgacttggatgacgtgcaggcgggactttcctacactgtgcgggtatccgcaagagtgggcccgcgggaaggttcggcttcagtgctcactgtccgccgggagccagaaacgccgctcgcagtgccgggtctgcgcgttgtggtgagcgacgcgactagagttcgagtggcttggggcccggtgccgggggcatcaggattccggatctcgtggtcgactggaagtggtccggaatcaagccagactctgccaccagactcgacggccactgatattacgggtctgcaaccgggaactacctaccaagtcgctgtgtccgtcttgcgcggtcgcgaggaaggacccgccgcggtgatcgtggcacgcaccgaccctctggggcctgtccgcaccgtccacgtgacccaagcctcgtccagcagcgtgaccatcacctggacgagagtgcctggcgcaaccggttaccgcgtctcctggcactcagcccacggccccgagaagagccagctggtttcaggggaggccactgtggccgaacttgatggtctggagcctgacactgaatacactgtgcacgtgcgcgcgcacgtcgccggagtcgacggtccaccagcttcggtggtcgtgaggaccgcgccggaacccgtggggcgcgtgtcccgactgcagatcctcaatgcgtccagcgacgttctgcgcattacctgggtgggagtgaccggtgcaaccgcctaccggctggcttggggacgcagcgaaggcggaccaatgcggcaccagatcctccctggaaataccgactcagccgaaatccgcggtctggaaggaggagtgtcctactcggtgcgcgtcaccgccctggtgggagatagggagggaacgccagtgtcaatcgtggtgactacccctccggaagctccgcctgcgctcggtaccctgcatgtggtgcaacggggcgagcattccctgcggctgaggtgggaaccagtcccgagagcccagggctttctgctgcattggcagccggaaggcgggcaggagcagtcccgcgtcctcggacctgagctgtcgtcctaccatctggacggactggaaccagccacccagtaccgggtgcggttgtcagtgctcggcccagcgggcgaaggaccgtcggctgaggtgaccgcccgcactgaatcaccgcgggtgccttccattgaactgcgggtggtggatacgtcaatcgactccgtgaccctggcttggaccccggtgagccgggccagcagctacatcctgtcgtggcgcccactgagggggcctggacaggaggtcccaggatcaccacaaacgctgcccggaatctctagctcgcaaagggtgacgggtctggaaccgggagtgtcgtacatctttagcctgacccccgtgttggatggagtccggggaccagaagcatccgttacccagaccccggtctgcccaagaggcctggctgacgtcgtgttcttgcctcatgccactcaggacaatgctcacagagccgaagccactcggcgggtcctggaacgcctggtgctggccctcggaccactcggacctcaagccgtgcaggttggactgctctcatactctcaccggcctagccccttgtttccactgaacggatcccacgacctcgggatcatcctgcagaggatccgcgacatgccgtacatggacccaagcgggaacaatctgggaaccgcggtggtgactgcacaccggtacatgctggccccagatgcgccaggacggcggcagcacgtgccaggcgttatggtgttgttggtggatgagcccctgcggggcgacatcttcagcccaatccgcgaagcccaggcctcaggattgaatgtcgtcatgctgggaatggccggcgcagatccggagcagctgaggcggctggccccggggatggactccgtgcagaccttctttgccgtggacgatggcccgagcctcgaccaagccgtgtcaggactcgcgaccgcgttgtgccaggcgtccttcacgactcagcccagaccggaaccgtgcccagtgtactgccctaaaggacagaagggagaaccgggtgaaatgggactccggggccaagtgggacccccgggcgacccaggattgcctggaagaacgggcgcacctggaccacagggacctcctggttccgccaccgcaaagggagagcgcggtttccccggagcagacggacgaccgggctcgccggggcgcgcaggaaaccctggaaccccgggagcccctggactcaaaggctcgccgggactgcctgggccgcgcggggatccaggagaacgaggacctagaggaccgaaaggagagcccggagccccggggcaggttattggaggggaaggaccgggactgccgggacgcaagggagatccggggccgtcgggtcctccggggccgcgcggtcctttgggagatcccggaccgcgcggcccaccgggactgccgggaaccgccatgaagggcgacaagggagatagaggtgagcggggaccaccggggcctggagaagggggcatagcaccgggcgagccaggccttccaggactgcctggatccccgggcccacaggggcccgtgggaccgcctggcaagaagggagaaaaaggcgattcggaggacggcgccccagggctcccgggccagcccggaagcccgggcgagcagggaccccgggggccgccaggggcgatcggaccgaagggagatcgggggttcccgggcccgctgggagaagctggagagaagggagaacgcggaccaccgggacctgcgggatccaggggcctgccgggagtcgccggtcggccgggcgccaaagggccggaaggaccgccgggaccgaccggacgacaaggagagaaaggagaaccgggtcggcctggagatcctgcggtggtcggacctgcagtggccggaccgaaaggagaaaagggggacgtggggcctgcgggcccccgcggtgccactggcgtgcagggcgagcgcggaccgccgggcctcgtgcttcctggagatccgggaccaaagggggacccaggcgatcggggcccgatcggcctgaccgggcgggccgggccgccgggagattcaggcccgcctggagagaagggtgatcctggacgccctggtccaccgggaccagtaggccctagaggcagggacggagaggtcggagagaagggggacgaaggaccgccgggagatcctggcctgcccggaaaggcaggagagaggggattgagaggtgctccgggggtccgcggtcctgtcggagaaaagggagatcagggcgacccgggagaggatggtcgcaacggatcgcctgggtcatcggggccgaagggggaccgcggagagccgggaccaccgggtccgcctggaaggctggtggataccgggccaggggcacgggagaaaggagaaccgggagatcgcggacaggaaggcccacggggaccgaagggagatccgggcttgccgggagcgccgggagagagaggaatagaaggttttcggggtcctccaggtccacagggagatcctggtgtccgcggaccggcgggagaaaaaggtgatcgcggaccgccgggcctggacggaagatccggactggacggaaagccgggggcagctgggccttcgggcccaaatggggccgcaggaaaggccggcgaccccggaagggacgggctgccaggattgcgaggtgaacagggcctgcctggaccaagcggtcctccgggtttgcccggaaaacctggggaggacggaaagcctggcctgaacggaaaaaacggggaacccggcgaccccggagaagatggtagaaagggtgagaaaggcgactcgggcgcttcggggcgggaaggccgcgatggaccaaagggagagcgaggagccccaggaattctggggccacagggaccgccgggcctgccgggtccggtaggtccacctggtcagggcttcccaggagtgccgggagggacgggcccaaagggcgacagaggcgaaactggtagcaagggcgaacagggactgccgggagagcgcggactgagaggcgagcctggaagcgtgccgaacgtcgacagactgttggaaactgcagggattaaggcttcggcacttcgggaaatcgtggagacttgggacgaatcatcagggtcgtttctccccgtccccgaaagacgacggggaccgaaaggcgattcaggagaacagggacctccagggaaagaagggccaatcggcttcccgggagaacggggtctgaagggtgaccgcggtgaccctggtccgcaaggaccaccgggcctcgccctcggtgaacgggggccgcctggcccgtcggggttggccggcgagccgggcaagccaggaatccccggacttcctggacgcgcaggaggcgtgggcgaagcaggacggccaggagaaagaggggaaagaggagaaaagggggagcggggcgaacaaggtagagacgggccgcctggcctgccaggaactccggggcctccgggaccccctggaccaaaggtcagcgtggacgaaccgggcccggggctctcgggcgagcagggcccgcctgggttgaagggcgccaaaggcgaaccaggatcaaatggagatcagggacccaaaggagatcgtggtgtcccgggaatcaaaggcgacagaggagaaccaggacctcggggccaggatggcaaccccggactgcctggagagcggggcatggctggaccagaggggaaaccaggactgcagggaccgcgcggaccgccgggcccagtgggcgggcatggcgacccgggacccccaggcgccccggggctcgccgggccggccggcccgcagggaccatcgggtctgaagggcgagccgggagaaaccggacccccagggcgcggcctgactggtccaactggagctgtcggactcccaggtcctccgggaccatccgggctggtgggaccgcaaggatccccaggactgccgggtcaggttggggagactggaaagccaggcgccccaggaagggacggcgcaagcgggaaggatggggaccgcggcagccccggcgtgccaggatcgcctggattgccgggacctgtcggacctaagggtgagccaggaccaaccggcgcccctggacaggccgtggtggggcttccaggagctaaaggagaaaaaggcgcgcccggaggattggcaggcgacctggtgggggagccgggagccaagggggaccgcggattgccgggaccgcggggcgagaaaggcgaggcgggccgggcaggtgaaccgggggaccccggcgaagatggacagaagggcgcccctggacctaagggattcaaaggagatcccggagtcggggtgccaggctcaccaggcccgccaggaccaccgggagtcaagggagatctcggtctgccgggccttccaggggcgcctggcgtggtcgggttcccgggccaaaccggcccaaggggagagatgggacaaccaggaccgagtggggagcgggggttggccggtccacccggaagagaaggtatcccaggaccgcttggtccgccgggtccgccgggttcggtgggcccacctggcgcatcagggttgaagggcgacaagggtgacccgggggtcggactgccgggaccacggggagagcggggagaacctggaatcaggggagaagatggacggcctggccaagaaggtccgcgcggcctcactgggccgccgggatcgagaggtgagcgtggcgaaaaaggagacgtgggcagcgctggcctgaagggagacaagggggacagcgcagtcatcctcggaccaccgggaccgcggggagcaaagggagacatgggcgaacgcggaccgcgtgggctcgacggggacaagggcccgcgcggagataacggggatccgggcgacaagggtagcaagggcgagccgggcgacaagggctcggccggcctcccgggcctgcgcggactgttgggtccacaaggccagccgggcgcagcgggaattccgggtgacccgggatcaccgggcaaagacggagtgccgggcatccgaggagagaagggcgatgtgggattcatggggcctaggggattgaaaggcgagcggggagtcaagggcgcgtgtgggcttgacggagaaaagggcgataagggagaggcaggtccaccaggcaggccgggtttggccgggcacaagggagagatgggtgaaccgggggtgccaggacagtccggagcgccaggaaaggagggcttgatcggcccgaagggggaccgcggcttcgatggtcaaccgggaccgaaaggggaccagggggaaaagggggagcggggtactcccggaatcggcggctttcctggcccatccggaaatgacgggagcgccgggccaccagggcccccaggttccgtgggcccgcgcggaccggaaggcctgcaaggtcagaaaggggagcgggggccgccaggggaacgggtggtcggtgcccccggggtgccaggagcaccgggtgagcgcggagagcaaggccgaccggggcctgctggacctcgcggcgaaaagggagaggcggctctcactgaagatgacatcaggggcttcgtgcggcaggaaatgtcccaacactgcgcctgtcagggccaattcatcgcatccgggtcacgcccactgcctagctacgctgcggacactgcaggttcccaactccatgcagtgccagtcctgcgtgtgtcgcatgccgaggaggaagagcgcgtgcccccggaagatgacgaatacagcgagtactcggagtactctgtcgaagaatatcaagacccggaggccccttgggattccgacgacccttgctccctgcctcttgacgaaggctcgtgcactgcttacaccctgcggtggtaccatcgggcagtgaccggatccaccgaagcatgccatccgttcgtgtatggtgggtgcggagggaatgccaatagatttggaactcgggaggcctgtgaaaggcgctgtccgcccagggtggtgcaatcccagggaaccgggactgcgcaagat

SEQ ID NO: 9586 - DNA, 8832 bp, Artificial Sequence
  Description of Artificial Sequence: Synthetic coding sequence
atgaccctgaggctgcttgtcgcggccctctgtgcaggaatactggcggaagccccccgggtccgcgcccagcatagagagcgcgtgacctgcactcgcctgtacgccgccgacatcgtctttctcctcgacggaagctcttccatcggccgctcgaacttcagagaagtgcgttcgtttctggaggggctcgtcttgccattctctggagccgccagcgcgcagggcgtgcgcttcgcaaccgtgcaatactccgacgacccgaggactgagttcgggctggacgcgttgggatccggcggcgacgtgatccgggcgatccgcgaactgagctataagggtggcaacacccggaccggagctgcaattctgcacgtggcggaccacgtgttcctgccacagcttgctcgcccaggagtcccgaaggtgtgtattcttattactgacggaaagtcacaagatctggttgataccgcagcacagagactgaaaggacagggagttaagttgttcgccgtcggaatcaaaaatgcggacccagaagagctgaagcgcgtggcatcgcagccgacctcggacttcttcttttttgtgaatgacttcagcatactgcggaccctcctgccgcttgtgagccggcgggtctgtaccaccgcaggaggagtgcccgtcacccggccgcctgatgattctaccagcgctccgcgcgatctggtgctgtcggagccgtcatcacaatcgctgcgcgtgcagtggactgcagcatctgggcccgtgactggttacaaagtccagtacacgccgctcaccggacttggacagcctctgccaagcgagcgccaggaggtgaacgtgccagcaggggaaacgagcgttcggttgcggggacttagacccctgactgagtaccaggtgactgtcatcgcgctctacgcgaattctatcggagaagccgtgagcgggaccgctcgcaccaccgcactggaaggcccggagcttacgattcagaacacgacggcacactccctcctcgtggcctggcgttcagttcccggcgcaactggatatcgggtgacttggagagtcctgtcaggtggaccaacccaacaacaagaactcggcccaggtcagggcagcgtcctgctgcgcgaccttgaacctggaaccgactacgaagtcactgtctccaccctgttcgggcggagcgtcggacctgccacgtcactgatggctcgcaccgacgcctcagtggaacagaccctgcgcccggtgatcctggggccgacctccattctgttgtcctggaacctcgtcccggaagcaagggggtatcggctggaatggcgccgcgagactggactggagcccccacaaaaagtcgtgctgccttctgacgtgacccgataccagctggatggactccagccaggcactgagtaccgcctgaccctctacactctgcttgaaggacatgaagtggccactccagccactgtggtcccgactggaccagagctcccagtgtcacctgtgaccgacctccaagcgaccgaactgccaggacaaagagttcgggtgtcgtggtcaccagtccctggagccacgcaatacaggattatcgtcagatccactcaaggagtcgagagaacgctggttctgcctggttcgcaaaccgctttcgacttggacgacgtgcaggctggactgagctacaccgtccgcgtctcggcccgcgtggggccgcgggagggatccgcgtccgtgctgactgtgcgtagagagccggaaactccgttggcggtgcctggacttcgggtggtcgtgtcggacgccacccgggtccgcgtcgcttggggaccggtgcctggcgcctctggattcaggatctcctggtcaactggaagcggaccagaatcctctcagactctgccaccggactccactgcaactgatatcactggtttgcagcctgggactacctaccaggtggctgtgtccgtgctccggggaagagaagaggggcctgctgcggtcatcgtcgcccggactgaccccctgggcccggtgcgcaccgtgcacgtgactcaagcctcctcgtcctccgtgaccatcacctggaccagagtccccggcgctactggctaccgggtcagctggcattccgcacacgggccggaaaaatcacaactggtgagcggagaagccactgtggcggagctcgatggactcgaacctgacaccgagtacactgtgcacgtccgtgctcacgtggccggagtcgatggaccaccggcctcagtggtggtccggaccgctccggaaccggtggggcgcgtgtcccggctccagatcttgaatgcatcaagcgatgtgctcagaatcacttgggtgggagttacgggagccactgcgtatcggttggcctggggccggagcgagggtggtcccatgagacatcaaatcctgccgggaaacaccgacagcgccgagatccgcggcctcgaggggggagtgtcatactcggtgagggtgacggcactggtcggtgacagagaaggaactcctgtgtcaatcgtcgtgactaccccacctgaggctcccccggcactggggacccttcatgtggtccaacgcggagaacatagcctcagactgcggtgggaacctgtgccgcgggcacagggattcctgctgcactggcagccagaaggtgggcaggagcagtcccgcgtcctcgggccagaactgtcgtcctaccatctggatggacttgaacctgcaactcaataccgcgtgaggctgtcggtccttggaccggcaggagaaggcccttcagccgaggtgaccgcacggaccgaatcgcctagagtgccttccatcgagctgcgggtcgtggacactagcatcgactccgttaccctcgcctggactccggtgtcccgggcttcgtcgtacatcctgtcctggcggccactccgcggaccgggccaggaagttccaggatcgcctcaaacccttccgggaatcagcagctcccaacgggtgactggactcgagccgggggtgtcctacatcttcagcctgaccccagtcttggatggcgtgagaggtccggaagctagcgttacccagacccccgtttgtccccgcggcctggccgacgttgtctttctgcctcatgccacgcaggacaatgcacatcgcgccgaagcaactaggagggtgcttgaacgcctggtgcttgccctcgggcccctgggcccgcaagctgtgcaggtcggcctgctctcgtactcccatagaccgtcgccgttgttcccactgaatggatcccacgacctcggcattattctccaaagaatccgggacatgccgtacatggaccccagcggaaacaatctcgggaccgcagtggtcactgctcaccgctacatgctcgccccagacgctccgggccggcgtcagcacgtgcctggcgttatggtgctgttggtggacgagcctctgagaggggatatcttttcgccgattcgagaagcacaagcgtccggactcaacgtggtgatgcttggcatggctggcgctgatccggaacagttgagacgactggcccccggaatggattccgtccaaacgtttttcgccgtggacgatgggccatccctggaccaagctgtctcgggactcgcaaccgcactctgccaggccagcttcaccacccagcctcggccagaaccttgcccggtgtactgccctaagggccagaagggcgagccaggagaaatgggactgcgcgggcaggtcgggccaccaggagatcccgggctgcctggcagaactggggccccgggaccacaggggccaccaggctcggcgacggccaaaggggaaaggggctttcctggtgctgacggccggcccggctcgccaggaagagccggcaaccctggaaccccgggcgcgccaggactgaaaggaagcccgggcctgccgggaccgcggggagatccgggcgaaagaggcccacgcggcccgaagggcgaaccaggggctcctggtcaggtcattggaggagagggacccggccttcccggtaggaagggtgatcccggaccatccggacccccgggacctcggggaccactgggggacccgggccctagaggtcccccgggcctgccgggcaccgcgatgaaaggggataagggggacagaggggaacgcggaccgccaggaccgggagaggggggaatcgccccgggagaacccgggctcccgggtctgccgggaagcccgggtccgcaagggccggtgggaccgccgggaaagaagggtgaaaagggagattcggaggacggcgcaccgggactcccgggtcagccgggatcgcctggtgagcaaggacctcgcggaccgcctggagctatcgggccgaagggggacagaggcttcccgggaccgctgggtgaagcaggtgaaaagggcgaacgcggcccacccggaccggccggctcgcgcgggctcccgggcgtggcaggtagaccaggagcgaagggcccggaaggcccgccaggaccaactggtagacaaggtgagaagggggagccaggcagaccgggcgaccccgccgtcgtcggcccagcggtggccggcccaaagggggaaaagggagatgtgggaccagccgggccccggggagcaaccggagtgcagggagaacggggacctccgggcctggtcctgccgggggacccaggaccgaagggtgacccgggagacagaggaccgatcggtctgaccggacgggctggaccgccgggcgactcgggtcctcccggggagaaaggagatcctgggcgccctgggccgccggggcccgtgggcccgaggggacgcgacggggaagtgggagagaagggcgacgaggggccccctggcgacccggggctgccgggtaaagctggagagagaggactgcggggagcaccgggcgtgcggggacccgtgggagagaagggcgatcagggagatcctggcgaggacggcagaaacgggtcaccgggtagctcaggcccgaaaggagacaggggagaaccaggaccaccgggaccgccaggtagactggtcgacaccggccccggagcgcgggagaagggagaaccaggagatcggggacaggagggcccgcgcggaccgaagggcgaccctggcctgccaggtgctccaggtgagcggggaatcgaaggatttagagggccaccaggaccgcaaggagatccgggtgtgaggggacctgccggcgaaaagggggaccggggaccaccgggactcgacggccgatccggattggacgggaaaccgggagccgcaggtccatccggacctaatggagccgcagggaaggccggtgatccaggacgagatggcctgccagggctccgcggagaacagggactgcctggcccttcggggccccccgggctccctggtaagccaggagaggatggaaaaccaggactcaacggcaagaacggagagccaggagatccaggcgaagatggaaggaagggcgagaagggtgactcaggtgcatcaggacgcgaaggacgggatggccctaagggcgaaaggggcgctccaggcatcctggggcctcagggaccaccgggattgccgggtccagtgggccctccggggcagggcttccccggagtgccgggcggaaccggaccaaagggagatcggggtgagactggaagcaagggagagcagggactgccgggagagagaggcttgaggggtgagccgggttcggtgcctaacgtggaccgactgctggaaactgccggcatcaaagccagcgccctccgagaaatcgtcgaaacctgggatgagtcatcaggatcctttctcccagtcccagaacgccggagaggaccaaagggagatagcggcgaacagggaccaccgggcaaagaaggaccgatcggtttccctggcgagcgggggctgaaaggcgatcgcggcgaccctggaccgcaggggccacctggactcgccctcggggaacgcggaccgccgggaccctccggtttggcaggtgaacctggtaagccgggaatcccaggcctcccgggaagagccggaggtgtgggagaagctggccggcctggtgaacggggggaacgaggcgaaaagggggagcgtggtgaacaaggccgcgacggacctccggggctgccgggaaccccgggaccacccggacctccggggccgaaagtgtcggtggatgaaccaggacctggcctgtccggagaacaggggccgccgggcctcaagggagctaaaggggaacccggatccaatggcgatcagggaccgaagggggaccgaggcgtcccaggcatcaagggagatcgcggtgaacctggaccgcgcggacaggatggaaatccaggactgccgggagagcgcggtatggcgggaccggagggtaagccgggactgcagggcccgcggggcccgccggggccggtcggcgggcacggtgacccgggaccgccgggcgcccctggactcgctggaccggccggaccgcaaggaccttctggccttaagggcgagccgggtgaaacgggcccgccgggacgggggctcactggcccgaccggagccgtcggactgccgggacctcccggtccttcgggactggtcggaccgcaagggagcccaggattgccgggacaggtgggagagacgggcaagccaggagccccgggacgggatggagcttctgggaaggacggagatcggggtagcccgggagtgccaggctccccgggcctgccaggccccgtcggcccgaaaggcgaaccaggaccaactggggccccgggacaggccgtggtggggctgccgggagcaaagggagaaaagggtgcaccggggggtcttgcgggcgacctcgtgggagagcctggtgcgaaaggcgatcgcggacttccgggtcctaggggcgagaagggagaggccggccgcgctggagagcccggcgacccaggagaggacggacaaaagggagctcctggcccaaaggggtttaaaggcgacccgggtgtgggagtcccgggtagcccggggccgcctggaccgccgggcgtgaaaggggacttgggcctgccgggcctcccgggagccccaggagtggtggggttccctggacaaactggaccaaggggtgaaatgggccagccaggaccatcaggcgaaagaggactcgccggaccgccgggacgcgaaggaatcccggggcccctgggccccccgggaccaccaggttccgtgggcccgccaggagcttcgggcttgaaaggtgataaaggagatccgggggtggggctgccgggcccgcgcggagaacgcggggaaccgggaatacgcggggaagatggacggccgggtcaggaaggacctaggggactcactggaccacccggatcccggggtgagagaggtgagaagggggacgtcggatcagccggtctgaagggagataaaggggattcggcggtgatccttggaccgccaggaccacggggagcaaaaggtgacatgggtgaaagaggaccgaggggactggacggagataagggaccaaggggagataacggagatcccggagataagggtagcaagggtgagcccggagacaagggatcggctggactccctggccttcgtggacttctgggaccgcagggtcaaccgggagctgcaggtattccgggcgacccgggatcaccgggtaaggatggcgtcccgggaatccggggagagaaaggcgatgtgggtttcatgggtccgcggggactgaaaggtgaacgcggtgtgaagggcgcctgcggcctcgatggagaaaagggcgataagggggaggccgggcctcccggaaggccaggactggcagggcacaaaggagagatgggcgagccgggagtcccgggccagtccggagcgccgggaaaggaaggactgatcggaccaaagggagacagaggattcgacggacagcccggacccaagggcgaccagggggaaaagggtgagagaggaaccccgggcatcggaggattccctggaccatccggaaatgacggatccgcgggcccgcctggccctccgggcagcgtgggcccgaggggccccgagggactgcagggccaaaaaggagagcgcgggccgccaggcgaacgcgtcgttggggcccctggcgtgccgggagcccccggagaacggggagagcaaggtcgccccggacccgctgggccgcgcggagaaaagggggaggcagcccttactgaggacgacatcaggggattcgtgagacaggagatgagccagcattgtgcttgccaaggccaattcatcgcatccgggtcacgcccgctcccgtcatacgccgcggacaccgccggatctcagctccacgctgtgcctgtgttgagagtgtcacacgccgaagaagaagaacgcgtgcctccggaggatgatgaatactcggagtacagcgaatactccgtcgaagaataccaggacccggaggccccgtgggactccgacgacccgtgcagcctcccgcttgatgagggttcgtgcaccgcctacactctgcggtggtaccaccgcgccgtcacgggatcgaccgaagcctgccacccgttcgtctacggcgggtgtggaggcaatgccaatcgcttcggcacccgggaagcatgcgagcgccggtgcccgcccagagtggtgcagtcacagggtacgggtactgcccaagat

SEQ ID NO: 9587 - DNA, 8832 bp, Artificial Sequence
  Description of Artificial Sequence: Synthetic coding sequence
atgacgctccgactgctggttgctgccctctgtgccgggattttggccgaggctccccgtgtccgagcccagcaccgggaacgcgtcacgtgcacccgtctctacgccgcggatattgtcttcctcctggatggatccagctccattggacgtagcaacttccgcgaagtgcgcagtttcttggagggtctcgtccttccattctccggagccgcgagcgcgcagggcgtccggtttgccaccgttcagtatagtgacgatcccaggaccgagttcggccttgacgccttgggcagcggaggcgacgttattcgcgctataagggaactgtcttacaagggcggtaatacccggacgggagctgcgatcctacacgtggctgatcatgtctttttgccacagctcgcccggcccggtgtcccgaaggtctgcatccttatcaccgacggcaagtcgcaggacctcgttgacaccgctgcacagcgtctgaagggacaaggcgtgaaactcttcgctgtcggcatcaaaaacgccgaccccgaggaactcaagcgtgtggcctctcagcccactagtgatttcttcttcttcgtgaacgacttttcgattcttcgcacattgctgcctctcgtatcccgtcgtgtgtgcacaaccgcgggcggagtgcctgtcacccgtcctccggacgattccacctccgcccctcgcgacctagttctcagcgagccgtccagccagtccctccgcgtccagtggacggctgcgtctggtcccgtcaccggctacaaggttcagtacacccccctgactggactcggacaacctctcccctctgaaaggcaggaggttaacgttcctgccggtgagactagtgtccgcctcaggggattaagacctttgactgagtaccaagttaccgtcatagccttgtacgctaactccattggggaagctgtgtccggtactgcccggacgaccgccttggagggcccggagctgacaatccagaacactacagcacactccctgttggtcgcctggagatccgtgcccggcgctaccggttaccgtgtcacttggcgggtcttaagcggcggacctacgcaacagcaagagctcgggcccggccaaggttccgttcttttgagggacctcgagcccggcactgactacgaggttaccgtgtcaaccttgttcggccgttccgtcggtccggccaccagtcttatggctcgcaccgatgcctccgtcgagcaaactctgaggccggtgatactcggccccacctctattctcctttcttggaaccttgtccccgaggcccgcggttatcgtctggaatggcgccgagagacaggtttggagcccccacagaaggttgtccttcctagcgacgtcacccgttaccaactcgatggtcttcagccgggtaccgagtaccgcctgacattgtatactctgctcgagggtcatgaagtggctacgccggccaccgtcgtgccgaccgggcccgagctgcctgtctcccccgtgactgatctccaggccaccgagctccccgggcaaagggttcgcgtgagctggtcgcccgtacccggagctacccagtatcggatcattgtacgcagcacccaaggtgtcgaacgtacccttgttctgcctggttcgcagaccgccttcgatctagatgatgtccaggccggcctctcctataccgtaagagtttccgctcgtgtgggtccgcgcgagggctctgcctccgtcctcacggtcagacgtgagcctgagaccccgctggccgttccaggattgcgtgtcgtggtctctgatgcaacccgcgtccgcgttgcttggggacctgtccccggcgcctcaggattcaggatcagctggtccaccggaagcggcccggagagttcccagaccctgcctccggacagcaccgctaccgacattactggcctgcagcctggcactacatatcaggtcgccgtctctgtcctgcgtggacgcgaagagggccccgccgccgtgattgttgcacgtacggatccattgggacccgttcgcacagtgcatgtgacccaggccagttcatcgtccgtgacgattacgtggacgagggtccctggtgctaccggctaccgcgtctcctggcattcggcccatgggcctgagaagagtcagctggtcagcggcgaggccacggttgcagagctggacggtctggaacccgataccgagtatacggtccacgtccgtgcgcatgtcgccggagtcgacggcccccctgcgtcggtcgtagttcgtaccgctcctgagccggttggccgcgtctcgcgcctccagatccttaacgcttcaagtgatgttctgcgtatcacttgggtgggagtgactggcgccaccgcttaccgcctggcttggggccgctccgaaggaggcccgatgcggcatcagatccttcccggcaacacagactctgccgagatccgtggcctggagggaggggtctcctactccgttcgtgtgacagctcttgttggcgaccgagagggaacaccggtgagtattgtcgtaacgaccccgccggaggccccgcccgctctggggacccttcacgtcgtccagcgaggggagcacagccttcgtctgcgttgggaacctgtcccccgtgcccaaggattcctcttgcactggcagcctgagggcgggcaagagcagtctcgagtgctggggcccgaactctctagctaccacctcgacgggctggagcctgcgacccaatatcgtgtccgtctgtccgtgctcggacccgccggcgagggtccgtctgccgaggtcactgcacgcactgagagcccccgggtgccttctattgagcttcgagttgtcgatacatcgatcgactccgtcacccttgcttggacccccgtctcccgtgcaagctcatacattctgtcctggaggccgcttcgtggccccggacaggaagtccccggtagccctcagactctgcccggcatctcttcatctcagcgagtcaccggcctggagcctggtgtgagttacatcttctctctgacccccgtactcgacggtgttcgcggtccggaggccagcgtcacccagacccccgtttgcccccggggattggctgacgtcgttttcctcccccatgctacccaagacaacgctcatcgtgccgaggctacacgccgggtgttggaacggcttgtcctggccttaggtcccctcggtcctcaagccgtgcaggttgggctcctgagttattcgcatcgacctagtcccttattccccctcaacggatctcacgatctaggtattatcttgcagcggatccgcgacatgccctacatggatccctcgggcaataatctcggcaccgcggtcgttaccgctcaccgctacatgctggctccagacgcacccgggcgacgtcagcatgtccccggcgtgatggtcctcctggtcgacgagcccctgcgtggtgatatctttagccccatccgcgaagcgcaggctagcggtctgaacgttgtgatgcttggcatggcaggcgccgatccagagcagttgcgtaggctcgccccggggatggattcggttcagaccttcttcgccgtagacgacggaccctctctggatcaggcggtgagtggcctcgctaccgcgttgtgccaggcttctttcactacgcagccccgcccggagccttgcccagtgtactgccccaaaggacagaagggcgagcctggcgagatgggccttcggggccaggtcggccctcccggagatcctggtttgccgggccgcactggcgcccccggtcctcagggaccaccggggtcggcgaccgccaagggagagcgcggcttcccgggcgccgacggacgtcccgggtcccccggtcgggcgggaaaccccggtactcctggcgcgccgggtctgaagggtagcccaggtctcccaggcccccgcggggatccgggtgagagaggcccgagagggcctaagggggagccgggcgcccccggacaagttatcggtggcgagggacctggcctgccgggtcgtaagggtgaccccggcccaagcggacctcccggccctcgcggcccactgggagaccctggaccgcgtggccccccgggcctgcccggaaccgctatgaagggtgacaagggtgatcgcggcgagcgtggcccgcccggtccgggggagggtggtatcgcccccggcgagcccggtcttcctggtctgcccggatcacctggtccccagggacctgtcggtcctcctggaaagaagggggagaaaggcgattccgaggatggggcccccggcctcccgggccaaccaggctccccgggtgagcaaggcccccgtggtccgcccggagctatcggccctaagggagaccgggggttcccgggcccacttggagaggccggggagaagggcgagcggggacctcctggtcccgccggctcacgcggcctccctggagtggccggccgtcccggggccaaggggcccgaaggtcccccgggccccactggccgccagggcgagaagggagagcccggtcggcctggggatcccgcggtggtcggaccagcggtggcgggtcctaagggagagaagggggatgtcggcccggccggaccccgaggcgctactggtgtccagggcgagaggggtccacctggtctggttttgcccggggaccccggccccaagggagaccccggagaccgcggcccgatcggcctgaccggtcgcgcgggtccacccggcgattcaggtcctcccggcgagaagggagacccgggcagaccgggacccccaggcccggtgggcccgcggggtagggacggtgaggtgggcgagaagggagatgagggtccgccaggtgaccccggcctcccaggtaaggctggggagcgtggcctgcgtggggcccctggtgttcgcggccccgttggtgagaaaggtgaccagggcgaccccggcgaggacggtcgtaatggatcccctggttcttcgggtcccaagggtgaccgcggcgagcctggccctcctggtccccccggccgtctggtcgatacagggccaggcgcccgcgagaagggagaacccggagacaggggccaggagggcccccgcggtcctaagggcgatcccgggttgcctggtgcgccgggcgagcgaggcatcgagggcttccgtggcccgcctggcccgcagggagacccgggagttcgtggcccggctggggagaagggcgaccgtgggccccccggactcgacggacgtagcggcttagatggcaagcccggtgcagctggtccgtccggccccaacggtgctgcgggaaaggcgggtgacccgggtagagacggcctgccgggtctgcgtggagagcagggcctgcccggtcccagcggcccacccggcctccctggaaagccgggcgaggatgggaagccgggtctcaacggcaagaacggtgagccgggtgatcctggcgaggatggacgtaagggcgagaagggtgactccggcgcctcaggccgtgaaggtagggacggtcccaagggtgagaggggcgctcccggcattcttggtccccaaggtccacctggcctacccggtcccgttggcccaccgggccagggcttccctggagtgcctggtggaactggacctaagggcgatcgcggcgagacgggctccaagggggaacagggtctgcccggcgagcgtggtttgcgcggagagcccggtagtgttccgaatgtggatcgtttacttgagaccgcaggcattaaggcttcggcgttgcgcgagattgtcgaaacctgggacgagtcttctggatcctttctccccgtccctgagcgtcgtcgcggaccaaagggtgacagcggtgagcaagggccccccggtaaggagggtcccatcggttttccgggtgaacgcggcttgaagggcgaccggggtgaccctggcccgcagggcccccccggtctggctctaggtgagcgcggtcccccgggtccgtctgggttggccggagaaccgggaaagccaggcatccccggccttcccggcagagctggaggcgtgggagaagccggccgtcctggtgaacgcggcgaacgcggtgaaaagggagagcgcggcgagcagggccgggatgggcctcctggattgcctgggacccctggcccccccggtcctcccggtcctaaagtcagtgttgacgagcccggccccgggctgtccggtgagcagggacctcctggcctgaagggtgccaagggtgagccgggatccaacggtgatcagggccccaaaggggaccgtggtgtgcccggcatcaagggcgaccgcggcgagcccggtccccgcgggcaggacggtaacccgggtcttcccggtgaaagggggatggccgggccagagggaaagcccggtttgcaagggccccggggcccccccggtccggtcggtggtcacggcgaccctgggccgcctggcgctcccggcctggcaggccctgccgggccgcaaggtccttccggactaaagggcgagccgggtgagactggtcccccaggccgtggattgacaggtcccacaggagctgtcggtctgccgggaccgccggggccctccggcctggtcgggccgcaaggctcgcccggcttacccggccaggtgggtgagacagggaagccgggcgcacccggtcgcgacggagcctctgggaaggacggtgataggggaagccccggtgtgcccggttcgcccggtcttccgggtccggtgggcccgaagggcgagcccggaccgacgggtgctcctgggcaggctgtggtcggcctccctggtgctaagggcgagaagggcgcgccgggtggcctggctggagacctggttggtgaaccaggagccaagggcgaccgtggactgccgggtccccgcggtgagaagggcgaggcggggagagccggcgagcctggcgaccccggagaggacggacagaagggtgccccaggaccaaagggtttcaagggcgatcccggtgtcggtgtccccggcagcccgggccccccaggcccccccggcgttaagggcgatcttggcctcccgggcttgcctggcgctccaggtgtggtgggtttccccggccaaacgggacctcggggcgagatggggcagcccggtcctagcggcgaacgtggcttggcaggtccccccggccgcgagggcattcccggtccactgggtccccccggtccccctggtagcgtcggcccgcccggagcgagcggcctgaagggagacaagggtgatccgggtgttggcctgcctggcccgcggggtgagcgtggtgagcctggcatccggggcgaagatggccgtcccggccaagaaggtccccgtggtcttactggccctccaggatctcggggtgagcgtggagagaagggggacgttggctccgctggtctgaagggcgataagggcgactctgcagtcatcttgggccctcctggtccccgcggagcgaagggagacatgggcgaacgcggaccgcgcggtctggacggggacaagggccctaggggtgacaacggagatcctggtgataagggttctaagggtgaaccgggcgataaaggtagcgccgggcttcccggactgcggggtcttttggggccgcaaggacagcctggcgcagctggtatccccggcgacccgggttctccggggaaggatggcgtccctggtattcgcggcgagaagggcgacgtcggctttatgggaccgcgtggtctgaagggcgagcgcggcgttaagggcgcttgtggtttggacggggagaaaggcgacaaaggcgaggccggtccgccaggtcgtcctggtctcgccggtcacaagggagagatgggtgagccgggggttcctggacagtcgggggcacccggtaaggagggcctcattggccctaagggcgaccggggctttgacggccaacctggtcccaagggtgaccagggcgagaagggcgagcggggtactcccggtataggtggctttcccgggccctccggcaacgatgggagcgccggcccgcctggtccgcctggttccgtcgggccccgcggtcctgaaggtcttcaagggcagaagggagagcgtggcccgcccggtgagagagtggtcggagctcccggcgtgcctggggcccctggggagcgcggcgagcaagggcgtcctggtcctgccggcccgcgcggtgagaagggtgaggctgctctgaccgaggatgatatccgtggtttcgtgagacaggaaatgtcccagcactgcgcttgccagggtcagtttatcgcctcgggttcccgtcccttgccctcgtacgccgctgataccgcaggcagccagctgcacgctgtccctgttctccgtgttagtcacgccgaagaggaggagcgggttcctccggaggacgatgaatacagcgagtactcggagtacagtgtcgaggaatatcaagacccggaggccccctgggactcagacgacccctgcagcctgccgctcgatgagggctcgtgcaccgcctatactttgcgctggtatcatcgagctgttaccggttcaacggaggcatgccatccgttcgtttacggtggttgtggtggtaacgctaacagatttggaacccgagaggcatgtgaacgacgttgccctccgcgcgttgtccagtcgcaaggtaccggcacggcacaagat

SEQ ID NO: 9588 - DNA, 8832 bp, Artificial Sequence
  Description of Artificial Sequence: Synthetic coding sequence
atgaccctgcgattgctggtggcagcactttgcgcgggaattcttgcagaggccccaagagtcagagcacagcatagggaaagagtgacctgtaccagactttatgcggcggacatcgtctttcttcttgacgggtcgagctccatcggtagaagcaactttcgggaggtccggtcgtttctcgaaggtcttgtcttgcccttctccggcgctgcttcagctcagggggtgcggttcgccaccgtgcagtactcggacgatcccagaacggaatttggactggacgcactcggtagcggcggggacgtcattagggccatccgggaactttcctataagggtggcaacactagaaccggagcggcgatcctccatgtggcagatcacgtgtttcttccacagctggcaagaccaggggtgcctaaagtgtgtatccttatcactgacggtaagtcgcaagatctggtcgataccgcagcacaaagattgaagggtcagggagtcaagctctttgcagtggggattaagaatgcggatccagaagaacttaagcgcgtggcaagccagccgacttcagatttcttctttttcgtgaacgatttttcaatcctgcgtactctgctgcctctggtgagcagaagggtgtgtaccaccgcaggaggagtgccggtgaccagacctccagatgattccacctcagccccaagagatctggtgctttccgaaccaagctcacagtctcttagggtgcagtggaccgcagccagcggtcccgtcaccggctacaaggtccaatacactcctttgactggccttggacaaccgctgcctagcgagcggcaggaggtgaacgtgccagcaggggaaacttccgtccgccttaggggcctccgacctctgaccgaataccaagtcacggtgatcgcactttacgcaaactcgatcggcgaggcggtgtcagggaccgctagaaccactgccctcgaaggaccagaacttacgattcaaaacaccactgcgcactccctgctggtggcttggaggtcagtgccaggcgccaccggctacagagtgacctggagagtcctttctggtggacctactcagcagcaagaattggggccaggtcaaggatccgtgctccttcgcgatttggagccaggtactgattacgaagtgaccgtctccactctctttggtcgctcagtgggtccagccacctctctcatggcaagaaccgacgcatcggtggaacaaaccttgcgtcctgtcatactgggtcctacctcgattctcctgtcgtggaatcttgtgcctgaggccagaggataccgccttgaatggcgtcgcgaaactggattggagcctccacaaaaggtcgtgctcccaagcgacgtgactaggtaccaactggacggtctgcagcctggaaccgaataccggctgactttgtataccctgctggagggtcatgaagtcgccacgcctgcgaccgtggtcccaaccggacccgagctgcccgtgtcaccagtgactgatctgcaggcgacggaacttccgggtcaacgagtgcgagtgtcttggagccccgtcccgggcgcaactcaatacaggatcatcgtgcgctccactcaaggagtggaacgtactctggtcctccctggatcgcagaccgctttcgatttggacgacgtgcaggccggactgtcctacacggtgcgcgtgtccgcacgggtgggaccccgtgaaggttcggcatcagtcctgaccgtccgacgtgaacccgaaaccccgctggccgtgcctggacttcgggtcgtcgtgtcggacgctactagagtgcgagtggcgtggggtcctgtccccggcgcttccggattccggatctcgtggtcaaccggctctggccccgaatcatcacagacgctgccaccagactccacggcaaccgatattaccgggttgcagccaggaaccacttaccaagtggctgtgagcgtgctgaggggtcgcgaggaaggacctgcggcagtgatcgttgcccgtactgacccactcggacctgtccgcactgtgcacgtgacgcaggcctcgtcatcctcggtgactataacttggacccgcgtcccgggagcaactggttaccgggtcagctggcattcagcgcatggtcctgagaagtcccaactggtgtctggagaagcgacggtcgcagaactggatggattggaacccgataccgaatataccgtccatgtccgggcccacgtggcaggagttgatggtcctccagcgtcggtggtggtgcgcactgcccctgaacccgtcggtcgcgtttcgcgactgcagattcttaatgctagctccgatgtgttgcggattacctgggttggtgtcacgggtgccactgcctaccgacttgcatggggtcggtcggagggaggcccgatgcgccatcaaattctgcctggaaatactgactcggcggagattcggggtctggaagggggtgtgtcctactcggtgagagttaccgcactcgtcggcgatcgtgaaggtactcctgtgtcgattgtggtgactactcctccagaggcaccacctgcactgggaaccctgcacgtggtgcaaagaggagaacattcgctcaggctccgctgggagcccgtgcccagagcgcaaggatttcttctgcattggcagccagaaggaggacaggaacaatcaagagtgcttggacctgaattgtcctcgtaccacctggacggcctcgagccagcgacccaatacagagtcaggctctcggtgcttggacctgcaggggagggcccctcagccgaggtgacggccaggacggaatcgccacgtgttccgtcaatcgaattgagagtcgtggatacctccatcgattccgtgacgcttgcctggacgcctgtgtcgagagcgagctcctatatcctctcgtggcgccctctgaggggcccaggacaagaagtgccggggagccctcagactctcccaggcatctcgtcctcccaaagagtgactggactcgaaccaggtgtgtcatacatctttagccttacccccgtcctggatggagtcagaggacctgaagcctccgtgactcagaccccggtctgtccaagaggcctggcagatgtggtgtttctcccgcatgcaacccaagataatgcgcatagagccgaagcaaccagacgggtccttgaacgccttgtgcttgctcttggacctctggggcctcaggcagtccaggtcggactcttgagctactcccacaggccctcgcctcttttcccccttaatggcagccatgatctgggaattatccttcagagaattagagatatgccttacatggatccatcaggaaacaaccttggaaccgcggtggtgacggcacatcggtacatgcttgcaccagatgcacccggccgtcggcagcatgtgcctggagtgatggtgctgttggtggatgaacctctccggggcgatatcttcagccccattagagaagcacaggcgtcgggacttaacgtcgtgatgctgggtatggcaggagcagaccctgagcagctgcgcagacttgcgcctggaatggacagcgtgcaaaccttttttgcagtcgatgatggaccaagccttgatcaggcagtgagcggtctggcaactgcgctgtgtcaagcatcattcactactcaacctaggccagaaccatgcccagtgtattgtcctaaaggtcagaaaggagagccaggagaaatgggcctgcgcgggcaggtggggcctccaggggatcctggcctgccaggacgaactggagcgcctggaccgcaaggtcctcctgggtcggcaacggcaaagggtgaacggggttttccgggcgcagatggccggcctgggtcgccaggacgagcagggaatccagggacccctggagcgccaggacttaaaggctcgcccggtctgccagggccccggggcgacccaggtgaaaggggaccccgcggtcctaagggagagccaggggcccctggacaggttatcgggggagagggacccgggctccctggacggaagggcgatcctggaccatcaggacctcctgggccgcgcggacctctgggagatccaggaccacggggaccacccggtttgccaggaactgccatgaagggtgataagggggatagaggcgaacgtggacccccaggacctggcgaaggtggtattgccccaggagagccaggccttcctgggcttcctggttcgcctggcccccagggacccgtggggcctccgggaaaaaagggagaaaaaggagactccgaagatggagcccctggactcccggggcagcccggcagtccgggggagcaaggaccgaggggccctccaggagcgataggaccgaagggcgacaggggatttcccggcccacttggtgaggcaggagaaaagggcgaacggggcccaccaggacccgcggggtcgagaggactgccaggagtggcaggtcgtccaggagcaaaggggccagaaggtcctcctggacctaccggccggcaaggtgaaaaaggtgaacccggacggcctggcgatccagccgtggtgggacccgcagtggcaggacccaagggagagaagggagacgtcggtcctgcaggaccaaggggcgccaccggagtccagggcgagcgcggacctcctggactggtgctgccaggagatccaggtccaaagggagatcccggagatagaggaccaattggactcaccggaagagctgggccccccggagactccgggcctccaggcgaaaagggcgatcctggtagacctgggccacccggtcccgtgggcccgcgtggtagagatggtgaagttggagagaagggagatgagggccctccaggagatccaggcctcccgggaaaggccggcgagagggggctccgcggtgccccaggagttcgcggacctgtgggtgagaagggagatcaaggggacccaggcgaggacggacgcaatggttcgccaggttcctcgggtcctaagggtgatcgaggcgaacccggtccaccaggtccgcccggacgtctcgtggataccggccctggagcccgggaaaagggagaaccaggcgatagaggacaggaaggacctcggggaccaaagggcgacccaggcctccccggagcgcctggtgaacgcggaattgaaggattccgaggtccccccggacctcagggagatccaggtgttcgaggccctgctggggaaaaaggagatagagggccaccaggcctggatggtaggtccggccttgatggaaaaccaggagctgcaggtccttccggtcccaacggcgccgcgggcaaggcaggcgatcctggccgcgacggtctgccagggctccggggagaacagggacttcctgggcccagcggaccccccggcctgccaggtaagcctggtgaagatggaaagccagggctcaacgggaagaacggagaacctggtgatcccggtgaagatggacgaaagggagaaaagggtgattcaggagcaagcggcagggagggccgtgatggtccaaagggagagcgcggcgccccaggaattcttgggccccagggcccgcccgggctgccagggccagtcggccccccaggacaaggctttcctggagtccctggagggaccgggccaaaaggggatcggggagaaaccggtagcaagggggaacaaggtttgcccggtgaaagaggtcttagaggagagccggggtccgtgccgaatgtggacagactcctcgaaaccgcaggaattaaggcaagcgcacttcgagaaatcgtagaaacttgggatgaatcttcgggaagtttcctgccggtcccggaacgccggcgcggtcctaagggggatagcggcgaacagggacctcctggaaaggagggccccataggtttccccggagaacgcggactgaaaggcgatcgcggggatcctggaccccaaggtcctcccggactggcactgggcgaacggggccctccgggtcccagcggactggcaggtgaaccagggaagcctggtatcccaggccttccaggacgcgcaggtggagtgggagaggcaggcaggccaggggaacggggggagcggggagaaaaaggtgagcgtggggaacaaggccgggacggacctcctggactgccaggcaccccaggaccgccgggtcctcctgggccaaaggtgtcagtggacgagccaggtcccggtctgtcgggtgagcagggtccaccgggactgaagggtgctaagggagaacctggatcaaacggtgaccaaggacccaagggagatcggggagtgcctgggattaaaggcgaccggggagaacctggaccacgcgggcaggatgggaacccaggtttgcctggggaaagaggcatggccggtccagaaggtaagcctggactccaaggaccccgaggaccacctggccctgtcggggggcatggtgaccccggaccgcctggtgctcccggtcttgccggccctgcaggtccacaaggaccttcaggactgaagggagagccgggcgagactggtcctcccggccggggtcttaccggtccaaccggagcagtgggacttcccggtccgccgggaccttcgggactggtcggcccgcaaggttcccctggacttccgggtcaagtgggagaaaccgggaagccaggcgcacccggcagagatggcgcatcgggaaaggatggagacagggggtcgcccggagtcccaggatcacctggcctgcccggccctgtgggaccaaaaggagaaccaggtccaaccggagcccccggtcaggccgtggttggcctgcccggagcaaaaggtgaaaagggcgcacctggaggactggctggggacttggttggcgaacctggcgcgaagggtgatagaggtctgcctgggccgcgaggcgaaaagggcgaggcgggacgggcaggagaaccgggagatcccggtgaagatggtcaaaagggtgccccagggcctaagggttttaagggtgacccgggtgtgggcgtgcctggctcgccagggcctcctggacctcctggagtgaagggcgacctcggacttcccgggctgccaggagcccccggtgtggtgggattccccggtcaaactgggcctcgcggagagatgggtcagcccggcccatccggtgagcgcggtcttgcaggacctccaggcagagaaggaattccggggccactgggacctcctggaccgccaggatccgtgggcccccctggggcatcgggacttaaaggggacaagggcgacccgggagtggggttgccaggtccacgtggtgaacgaggagaaccaggtattagaggggaggacggaaggccaggtcaagaaggacccagagggctgactggtcctccggggtccaggggggaacgaggagagaaaggagatgtgggttcggcaggtcttaagggtgataagggagattccgcggtgattctgggaccccctggaccacggggggccaagggagacatgggtgaacgtggtcctagaggactggacggagataaagggcctcgcggagacaacggtgatcctggcgacaagggctcgaagggagaaccaggtgataaaggctcagcagggctccctggccttcgaggtttgttgggaccacaaggtcagcctggagcagccggcattcctggtgatcccggaagcccgggaaaggatggtgtccctggaatccgaggtgaaaagggagatgtgggcttcatgggtcccagaggactgaagggtgaacgcggggtgaagggagcgtgcgggctggatggagagaaaggagacaaaggtgaagcaggtcctcccgggcgcccaggattggcaggtcataagggggaaatgggcgaacctggtgtgcccggccagtcgggcgcccctggtaaggaggggctgattggacctaagggcgaccggggtttcgacggccagcccggacccaagggagatcagggtgagaaaggagaacggggtaccccaggtatcgggggctttcccggccctagcggcaacgatggtagcgcaggccctcctggtccccctggctccgtgggtccacgtggacccgaaggactgcaaggccaaaagggggagagaggccctccgggggagagagtggtcggagcacctggtgtgcccggagcacctggagaacggggggagcaaggaaggccagggcctgcaggaccccggggtgaaaagggagaggcagcgctcactgaagatgacattcgcggattcgtgcgacaggagatgtcacaacattgtgcatgtcagggacaattcatagcctcaggtagccggccacttcctagctatgcagccgataccgcgggttcacagctgcatgccgtccctgtacttcgggtgtcccacgcggaagaagaagaaagagttccccccgaggacgatgaatacagcgaatattcggaatactccgtcgaggagtaccaagatccagaagcgccatgggactcagatgatccgtgttcactgcctcttgatgaaggatcatgtaccgcctacactttgagatggtaccatagagcagttactggttcgaccgaggcatgccaccctttcgtgtacggtgggtgcgggggaaatgcaaatagattcggaacgcgggaagcatgtgagcggcggtgtccccctagagtggttcaatcacagggcactggaactgcgcaggac

SEQ ID NO: 9589 - DNA, 8832 bp, Artificial Sequence
  Description of Artificial Sequence: Synthetic coding sequence
atgacccttcgcctgttagtcgccgcgctgtgcgccggtatccttgccgaggcaccgcgtgtccgagcgcaacaccgcgagcgagttacgtgcacccggttgtacgcagctgacattgtgtttttattggatggcagctcttccatcggtcgtagcaactttcgcgaggtacgtagcttcctggaggggttggtcctgcctttttcgggtgcagcgagcgcccagggcgtgcgcttcgctaccgtccaatacagcgacgacccgcgcactgagtttggcctggacgccctgggctcaggcggtgatgtgattcgcgcgatccgcgagctctcttataaggggggcaatactcgaactggggcggccattctgcatgtggccgaccatgtgttcttgcctcagctggcgcgcccgggcgtgcctaaagtctgcattcttatcaccgatggtaaaagtcaggacctggtcgatactgcggcccagaggctgaagggtcagggcgtgaaattgtttgcagtggggattaagaatgcggacccggaggaacttaagcgcgtggccagccaacctacgagcgactttttctttttcgtcaatgacttcagcattctgcgtactcttctgcctctggtgtcacgcagggtctgcaccaccgcagggggcgtgcccgttacccgtccacctgatgatagcaccagcgctcctagggacctggtccttagtgaacctagcagtcagagtctgcgagtgcagtggaccgccgctagcggccccgtgaccggctacaaggtgcagtacacgccgctgacgggcctggggcagccactgccaagcgagagacaagaggtgaatgttccggccggggagacgagcgttaggcttcgtggcctgcgcccgttgacggagtatcaggtgactgtgattgccctgtatgccaattccatcggcgaagcggtgagcggcactgctcgcacgactgctctggagggcccagagctcaccattcagaacaccaccgcgcactccctgctcgtggcatggcgctctgtgccgggcgccactggttatcgcgttacttggcgggtactgtccggaggcccaacccagcagcaggagctcggtccgggtcagggtagcgttttgttacgcgacctggagcccggcaccgattacgaggtcaccgtttctacactcttcgggcggagcgttggtccggccacctcgctcatggcacgcacagacgccagcgttgaacagaccctcaggccggtcatcctgggcccaacctctattctgctgagctggaatctggttccagaagcgcgcggttatcgcctggaatggcgccgagagactggtctggagccgcctcagaaggtggtgctgccctctgacgtcacccggtatcaactggatggtctgcagccaggtaccgagtatcgactgaccctgtacaccctgctggaaggtcacgaagttgcaacccctgcgactgttgtgcctacggggccggaactgccggtcagccccgtgacggatctgcaggccaccgaactgccgggccagagggtgcgtgtgagctggagccctgtaccaggtgcgacccagtacaggattattgtgcgttccacacagggcgtggagaggaccctggtgctgccggggagccagacggcgttcgacctggacgacgttcaagcgggattgtcttatacggtccgtgttagcgctcgggtgggcccgcgcgagggttcagccagcgttctgaccgtaaggcgggagcctgagacccctttggccgttccagggctgcgggtggtagtgagcgatgcgacccgagtcagggtagcttggggcccggtgcctggcgcgtcgggcttccgcatttcatggtcaaccggttctggaccggagagcagccagaccctcccacctgattccactgccacggacattacgggtctgcagccgggcactacttatcaggttgcggtgtcagtgctgcgaggtagagaagagggccctgccgctgttattgtggcacgcacagacccgcttggcccggtgcgtaccgtccatgtgacccaagcatccagcagcagcgtgaccataacttggactcgtgtcccgggtgcaactggctaccgcgtgtcatggcacagcgcacacggacccgagaagtcacagctggttagcggagaggcaaccgtcgcagaattggatggactggaacctgatacggaatataccgtgcatgtgcgggctcacgtggccggggttgacggtccaccggcgagcgttgtggttcgtacagctccagagccggttgggagggtgtcccgcctgcaaattctgaatgcatcttccgacgtgctgcgcattacctgggtcggtgtgacaggtgcaactgcatatcgcttggcatggggtcgcagcgagggtggtcctatgcggcaccaaattctgcctggaaacaccgatagcgcagagattcgcggcctggaaggtggtgtgagctactcagtgcgcgtgaccgcattggtgggcgatagagagggaaccccagttagcatcgtcgttacaacccccccggaggcgcctcctgcgctaggtaccctgcacgtggtccaacggggagaacacagcctgaggctgcgttgggagccggtgccacgcgcccagggcttcctccttcactggcaaccagaaggtgggcaggagcaaagccgcgttctgggcccagagctgagctcctatcatttggatggtctggaacctgctacgcagtaccgcgtgcgcctgagcgtgcttggtccagccggagaggggccatccgcagaagtaaccgcgcgaaccgagtccccgcgtgtccctagcattgagctccgtgtggtcgatacatctattgacagcgtgaccttggcatggacgcccgttagccgagctagctcttacattttgagctggcgcccgctgcggggcccaggtcaagaggtgccggggtcaccacagaccctgccgggaatcagctctagccaacgtgtgacgggtctggagccgggtgtcagctacatctttagcctgaccccggtcctagatggcgtacgcggaccggaggcaagcgttacccaaacccctgtttgtccgcgaggcctggcagacgtagtttttctcccacacgctacgcaggataatgcgcaccgcgcggaagcgacccgccgagtcctggagcgtctggtgctagcgctggggcctctgggcccacaggcggtgcaagtgggtctgctgagctatagccatcgcccctcaccgctgttcccactaaatggtagccacgatctgggtattattttgcaacgcatccgcgatatgccgtatatggatccgagcggcaataatctgggaaccgccgtggtgaccgctcaccggtatatgttggctccggacgcgccaggtcgacgccagcatgttccgggcgtgatggtgctgcttgttgacgaaccgctgcgaggagacattttttccccgatcagggaagcacaggcttcaggcctgaacgtcgtcatgttgggtatggctggagcggaccccgaacaactccgtcgcttggcaccgggtatggacagcgttcagacgttcttcgcggtggacgatggacctagcctggaccaggctgttagcggccttgcgaccgctttgtgtcaggccagcttcactacccaaccacgaccggaaccttgcccggtctactgtccaaagggtcagaagggtgagccgggcgagatgggtctgcgcgggcaggttgggccgccgggggatccgggtctgccgggtcgcaccggcgcccccggtccgcaaggcccaccgggaagcgccaccgccaaaggtgagcgcggcttcccgggcgccgacgggcgcccaggcagccctggccgcgctggtaatccaggtactcctggtgctcctggcctgaaaggcagccccggcctgcctggccctcgaggagacccgggtgaacgcggtccgcgtgggccaaaaggggaaccgggagcccctgggcaagtcatcggcggcgagggaccgggtctgccgggccgcaagggcgaccccgggcccagcggaccgccaggtcctagaggccctctcggtgacccaggccctcgcggcccgccaggtctgcctgggaccgccatgaaaggtgacaagggcgaccgtggagaacgcgggccgcctggtccaggcgaaggtggcatcgccccgggtgagccagggctgccaggcctccccggtagtcctggcccacagggtccagtaggcccccctggaaagaaaggcgagaagggcgactctgaggacggcgctcccggtctgcccggccaaccgggcagcccaggggaacaggggccaaggggtcctccaggcgcaataggaccgaagggagatcgcggtttccccggcccactgggcgaagctggagagaagggcgaaaggggtccaccaggaccagcgggatctcgcgggctcccgggcgttgcagggcgccctggggccaaagggcctgagggcccaccgggtccaaccggacgccagggcgagaagggagaaccaggccgccctggggaccctgcagtggtgggtcccgcggtggcaggacctaagggcgaaaagggtgacgtggggcctgcgggccctcgcggggcaaccggggtgcaaggtgaacgcggcccaccgggtctggtcctgcccggcgacccgggaccaaaaggtgatccgggtgatagaggacctatcggactcaccgggcgggccggtccaccaggagattcaggccccccgggtgagaaaggtgacccgggtcggccgggtccacccggtccagttggtccgcgtggccgtgacggtgaggttggtgaaaagggggatgaaggtccaccgggtgaccctggtctcccgggtaaagccggcgaaagaggtctgcgtggcgcaccgggcgtccgcggtcctgttggtgagaaaggcgaccaaggagatcctggcgaggacggtagaaatggtagccctggtagttccggccccaaaggggatcgcggggagccagggcctccgggtcccccgggacgcctggttgacacgggcccaggtgcccgagagaaaggtgagccaggggaccgcggccaggaaggtccacgaggcccaaagggtgatcctggtttgccgggtgcacctggcgaacgcgggatcgagggttttcgcggcccgccgggtcctcaaggcgacccaggcgttcgcggcccagcgggtgagaagggtgatcgcggcccaccaggtctggacggccgctctggcctggatggtaagcccggcgcggcgggcccaagcggtccgaatggcgcagcaggcaaagcaggggacccgggccgtgacggcctgccgggattaaggggcgagcaaggcctgcctggtccctctggtccaccaggactgccagggaagccgggcgaagatgggaaaccaggcctgaatggcaaaaatggcgagcccggtgatcctggcgaagacggtcgaaagggggagaagggcgattccggggcaagtggccgtgaagggcgtgacggccctaagggtgagcgcggcgcgccaggtatcttgggccctcagggtcccccgggtctgccgggtccagtcggtccccctggccaaggctttcccggtgttcctggtgggaccggtccaaagggagaccgcggtgagaccggttcgaagggcgaacagggcttgccaggggaacgcggcttgcgtggcgagccgggtagcgtcccaaacgtggataggctgctggaaacagcaggtatcaaggcgagcgcactccgcgagattgtggagacttgggacgagtcttctggtagcttcctgccagtgccagaacggcgccgaggcccaaagggtgacagcggcgagcagggaccaccgggaaaagagggtccgataggttttccaggtgaacgcggtctgaaaggtgaccgtggtgacccagggccacagggtccaccaggcctagccctcggggagagaggcccaccgggcccaagcgggctcgccggtgagccaggtaagcctggcatccctggtctcccaggccgtgccggcggcgtgggtgaggctggccgcccaggtgaaaggggcgagagaggggaaaagggcgaaagaggtgagcaaggcagagatgggcctcctggtttaccgggtacacctggcccgccgggtcctcctggtcctaaagtgtccgtggatgagccagggcctggactgagcggggagcagggaccccctggcctgaaaggtgctaaaggtgaaccgggcagcaatggcgatcaaggaccgaaaggtgaccggggagtcccaggaatcaaaggtgacaggggtgaaccgggcccgcgcggtcaggacggtaacccaggtctgccaggagagcgcggcatggctggcccggagggcaaaccaggactgcagggtccgcgtgggcctccgggcccggtgggtggtcacggtgatccgggcccccctggagctccggggctggcgggcccagcgggccctcaagggccgtctggcctgaagggtgagccgggagagaccgggccaccaggccgcgggctgaccggccccaccggtgcggtgggtttgccaggacctccaggcccaagtggtctggtcggtccacaaggtagtccaggcctccccggccaggtgggtgagacgggcaaacctggtgcgcccggtagagacggagcttccggtaaagatggcgacaggggctctcctggggtgcccggctcaccagggctgccgggtccagttggtccgaaaggagaacctggtccgactggagcaccaggccaggcggtggtcggtttaccgggagcgaagggcgaaaaaggtgcaccaggcggcctggcaggcgacctggttggtgaaccaggtgccaaaggggacagaggcctgcccgggccgcgaggggaaaagggtgaggcgggcagggccggtgagccgggggatcctggagaagatggtcagaaaggcgcccctggtccaaaaggatttaagggggatccgggtgtgggcgtcccaggcagccctggccctccgggtccgcctggagtcaaaggagatctgggtctgccgggcctcccaggcgcccctggagttgtgggctttccgggccagactggccctcgtggcgagatgggccagccgggcccatcaggcgaacgcggactagcaggccctccaggtcgtgagggcatcccaggaccactgggcccaccaggacctcccggttcagtgggaccaccaggtgcatccggactaaagggcgacaaaggtgatccaggagtggggctgccaggcccgcggggcgagcgtggcgagccgggcatccgcggtgaagacggtcgaccgggccaggagggtcctcggggtctgactggtcccccaggtagccgcggcgaacgcggagagaagggtgacgtaggcagtgccggcctcaaaggtgataaaggagacagtgccgtgattctgggaccgcctggtccgagaggcgcgaagggtgacatgggtgaacgcggcccacgtggacttgacggcgataagggtccacggggcgacaatggtgaccctggtgataagggaagcaagggtgaacctggagacaagggtagcgctggtcttccgggcctgagaggtctgctgggtccgcaaggccagccgggagcagcggggatcccaggcgaccctggctccccgggaaaggatggcgtgccgggtatacggggcgagaaaggagacgtgggatttatgggccccagaggtctgaagggcgaacgcggcgtgaagggtgcgtgcgggcttgatggtgagaaaggtgacaaaggcgaagccggcccaccgggccgtccgggtttggctgggcacaaaggcgaaatgggtgaaccgggcgtccctggtcagtcaggagcaccaggtaaagagggtctcattgggccgaagggtgatcgcggttttgacggtcagcctgggcctaaaggcgatcaaggcgagaaaggtgagcgcggcaccccggggatcggtggctttcctggtccgagtgggaacgatggcagcgctgggcctccaggtccacctggtagcgttggtccccgcggcccagaaggtctgcagggccagaaaggtgagcgcggccctccgggcgagcgcgtggtgggcgccccaggggttccaggtgcgccgggcgagcgcggtgaacagggacgcccaggcccagctggcccacgcggcgaaaagggcgaagcagcgctgaccgaagatgatatccggggttttgtgcggcaagagatgagccaacattgtgcgtgccagggccagttcatcgcaagcgggtcacgccctctgccatcctacgcggcggatacggcagggtcgcagctgcacgcagtgccagtcctgagggtgtcacacgccgaggaggaggaacgggtcccaccagaagatgatgaatactcggagtatagcgagtacagcgtcgaagagtaccaggatccggaggcgccatgggacagcgacgatccttgcagcctgccattggacgagggcagctgcaccgcgtacactctgcgatggtaccaccgagcagtgacgggcagcacggaagcatgccacccttttgtctacggtggctgtggcggcaacgcaaaccggttcggtactcgcgaagcttgcgaacgccgctgcccacccagagttgtgcagtctcaggggaccggaaccgcccaggat

SEQ ID NO: 9590 - DNA, 8832 bp, Artificial Sequence
  Description of Artificial Sequence: Synthetic coding sequence
atgactctgcgcctcttggtggctgccctgtgcgcaggaatcttggccgaagctccgcgcgtgcgggcccaacacagggaacgggtgacctgtacccgcctgtacgccgcagacatcgtctttctgttggacggttcgagctcgatcggaagatcgaacttccgcgaagtgcgctcgtttcttgaggggctggtgctcccattctcgggagctgcctccgcccaaggagtgcgctttgccaccgtccaatattcggacgacccgcgaactgagttcggattggacgcactcggaagtggaggcgacgttattcgcgcgatccgcgagctcagctataaggggggcaatacccgcaccggcgccgctattctgcatgtggccgaccacgtgtttctgccgcaactggcacgacctggcgttccgaaggtgtgtatcctgattaccgacggaaagagccaggatctggtcgataccgccgcgcaaagactgaagggacagggtgtcaagctgttcgccgtgggaatcaagaacgccgacccagaagaattgaaacgggtggcttcccagccgacgtccgacttctttttctttgtgaacgatttctccatactgagaacgctcctgccgctcgtctcacggcgcgtgtgtactacggcgggaggagtcccggtcacccggccgccggacgactcaacttcagcaccgcgcgatctcgtcctgtccgaaccatcgtcgcagagcttgcgggtccagtggactgcggcgtccggaccggtgactggctacaaggtccaatacacccctctcaccggactcgggcaacctctgccgtcggaaagacaggaggtgaatgtgccggcaggagagacttccgtgcggcttaggggtctgcggccgctgaccgaataccaggtgactgtgatcgcgctgtacgccaatagcatcggagaagcggtgagcggaactgctcgcactaccgccctggaaggccccgagctgactatccaaaatactaccgctcatagcctgctcgtggcatggcgctccgtgccaggcgcaaccgggtaccgcgtgacctggcgcgtgctttctggaggacctactcagcagcaagagctgggccctggacagggatccgtgctgctccgggatctcgagccgggtactgactatgaagtgaccgtgtccactctcttcggtagatcagtgggaccggccacctccctcatggcgcggaccgacgcaagcgtggaacagaccctgaggccagtcatactcggcccaacttcgatcctgctgtcctggaatctcgtgccagaggcccgcggatacaggctggagtggagacgcgagactggtcttgaacctcctcagaaggtggtactgccatcagatgtcacccgctaccagctggacggactccaaccgggcaccgaataccgcctgacgctgtacacccttctggagggccacgaggtggcgactcccgcaacggtggtccctactggaccggaactgccggtcagcccggtgaccgaccttcaggccactgaactcccgggccaacgtgtgcgcgtgtcatggtccccggtgccgggagccactcaataccgcatcatcgtgcggtccacgcaaggagtcgaacggaccctggttctgcctggaagccaaactgcctttgacttggacgacgtccaggccggtctgtcatacactgtcagagtatcggcccgcgtgggaccgcgcgagggatcagctagcgtgcttactgtccgcagagaaccagaaacgccactcgccgtgccaggattgcgggtggtcgtctctgacgcaaccagagtccgggtggcttggggaccagtgcccggagcatcgggattcaggatcagttggtcgaccgggtctggacctgaatcgtcccagactttgccaccagattcgactgcgaccgacatcaccggccttcagccaggaaccacctaccaggtggcagtctctgtgctccgcggccgtgaagagggcccggcagccgtcattgtggcccggaccgaccctctggggccggtccgcaccgtccacgttacccaggcttcctccagctccgttactatcacctggacgcgggtccctggtgccaccggttaccgcgtcagctggcattcggcgcacggacctgagaagtcccagctggtgtcaggggaagccaccgtggccgagctggatggcctggaaccagacaccgaatacactgtgcatgttagggcacatgtggccggagtggacggaccgccggcgtcggtggtcgttagaaccgccccggaaccggtaggaagggtatcgagactgcagatccttaacgctagctcagatgtccttcggatcacgtgggtcggagtgacgggagctacggcctacagactcgcgtggggcagatcggaaggtgggccgatgcggcaccagatcctgcctggcaacactgatagtgccgagatccggggtctggagggtggtgtgtcctactcagtccgggtgactgcgctggtgggagacagagaaggaaccccagtctcaatcgtggtgactactcctccggaggcgccaccagctctgggaaccctgcatgttgtgcaacgcggggaacactcgctccgactgcggtgggagcctgtccctcgggctcagggatttcttttgcactggcaacctgagggcggacaggagcagtcgcgggtcctcggacctgaactgagctcgtaccacctggacggcctcgaaccggccacccaataccgagtgcgcctttcggtgctcggtccggcgggagaaggaccgtccgcagaggtgactgccaggacggaatccccgcgggtgccgtccatcgagctgcgcgtggtggacacttcgatcgactccgtgactctggcctggaccccagtctcgcgcgcctcatcctacatcctctcctggcgtcctctgcgcggccccggtcaggaggtgccgggaagcccccaaactctgccgggaatttcgtcaagtcagcgcgttactgggctcgaacctggtgtcagttacattttctccctcacgccggttctggatggggtgcgcgggcccgaagccagcgtcacccagacccccgtgtgcccgcggggactggccgacgtcgtgttcctcccgcatgccacccaagacaacgcgcacagagcggaggccacccgccgcgtcctggaacggctggtgttggcgctggggccgctcggaccgcaagccgtgcaggtcgggttgctgtcctactcgcaccgcccctccccgctcttcccgctcaacggatcccacgacctgggcattattctgcagcgcatccgcgacatgccgtacatggacccgagcggcaacaacctcggtactgcagtggtgactgctcatagatacatgctggccccggatgctcctggacgacgacagcatgtgccgggagtcatggtgttgctggtggacgagccgctgagaggagacatcttctcaccgatcagagaagcgcaagcctcgggactgaatgtggtgatgctcgggatggccggagccgacccagagcagctcagacggctggcgcccggcatggactccgttcagactttctttgccgtggacgacggaccatcactcgaccaggccgtgtcaggcctggctaccgctctttgccaagcgtcgttcaccacccagccgcggccggagccgtgccctgtctactgcccgaagggacagaaaggagaaccaggagagatgggacttagaggacaagtgggcccgccgggtgaccccggacttcctggaagaactggagcgccggggccacagggcccgccaggcagcgcgaccgctaaaggcgaacgcggattcccaggagcagatggaaggcctgggagcccaggcagagcaggaaatccgggaaccccgggcgcacccgggctcaagggctcgcctggactgccaggcccaagaggggaccctggagaaagggggcctcgcggcccaaagggagaacctggggcccctggacaggtgatcggaggagaaggtcctggactcccaggcaggaagggagatccaggaccgagcggtcccccgggcccacgcggaccgctgggtgaccctggacccaggggcccgcctgggttgccgggaactgctatgaaaggagataagggggaccggggagaacgcggaccgccggggcctggagaaggaggcatcgccccgggcgaacccggacttccaggactcccgggttctccgggaccgcaagggccggtcggaccccctgggaagaaaggcgaaaagggtgactctgaggatggtgcgccgggcttgcctggacagccaggatctcctggtgaacaaggaccgcgtggaccacctggagccatcggccctaagggcgaccgcgggttcccaggacccctgggggaagctggcgagaaaggagagcgcggtccccccggccccgctggatcgagaggcttgccgggcgtcgcgggtagaccgggcgcgaagggaccggagggacctccaggccctactggtagacaaggagagaagggcgagcctggtagacctggcgacccagcagtggtgggtcccgccgtcgccggtccgaagggagagaagggggacgtcggaccggcgggaccgcggggcgctactggggtgcagggcgaacggggcccacccggtcttgtccttccaggcgatccggggccgaagggggacccaggtgaccgggggccaatcggcctgactggccgggctggcccgcccggagacagcggaccgcctggggagaagggcgatccgggcagaccgggaccacccggaccagtgggacctcgcggccgggatggcgaagtgggagaaaaaggcgacgaaggtccaccaggtgatccgggcctccctggaaaggccggagaacgcgggctgagaggcgcacccggagttcgcggcccagtgggcgaaaagggagatcaaggtgacccaggagaggacggacgaaacggaagcccgggctcttcaggtcccaagggtgatcggggggagcctggaccccctggaccgcccggtcgcctggtggatactggcccaggagcgcgggaaaaaggtgagccgggcgaccggggccaggaaggacccagggggcctaagggtgacccgggtctgccgggcgcccctggtgaacgaggtatcgagggattcaggggaccgccgggacctcaaggagatccgggtgtgcgcggacccgcaggggaaaaaggagatcgcggtccaccaggactggatggtagatcgggactcgacggcaagccgggcgccgcgggaccgtcgggaccgaacggtgccgccggaaaggctggagatcctgggcgagatgggctgcccgggctccgaggtgagcaaggtctgcctgggccatcgggacctccggggctgccggggaaaccgggcgaagatggcaagccaggacttaacggaaagaatggagaaccgggagatccgggagaagatggacgcaaaggagaaaagggcgattcgggagcgtcaggacgggagggccgcgacgggccaaaaggagagaggggtgccccggggatcctgggaccccaaggccctccagggctcccggggccggtgggacccccaggacagggattcccgggtgtgccaggagggacgggtccaaagggggatcgcggagaaactggctccaagggagagcagggtctgcccggggagaggggactgcgcggcgaaccgggaagcgtgccaaatgtggatcgcctgctggaaaccgccggaatcaaggcttcagccctgcgggagatcgtcgaaacctgggacgaatcatccggatcattcctccccgtgccggagcgcagacggggaccgaagggagacagcggcgagcaagggcctccggggaaggaaggaccgatcggtttcccaggcgagcgcggattgaagggcgataggggcgacccggggcctcaaggacctccaggactcgcccttggagaacgggggccccccggcccttccggactcgccggtgagcccggaaagcccggaatccctggcctgcctggaagagccggaggagttggagaagctggacggcccggggagcgtggagagaggggggagaagggtgagagaggggaacagggcagagacgggccccctggattgcctgggacccccggaccaccgggtcccccaggccctaaagtgagcgtggacgaaccgggtccgggactgtcgggcgaacagggcccacctggactcaagggcgctaagggtgaaccaggcagcaatggagatcagggaccaaagggtgatagaggggtgccggggattaaaggagacagaggtgaacctggccctcgggggcaagacggaaacccggggttgccaggagaacggggcatggctggaccagagggaaagccaggtctgcagggtcctcggggtcctccgggccctgtcggaggacatggggatccaggtccgcctggtgccccaggcctggcgggaccagcaggcccccaaggaccatcgggactgaagggtgaaccgggtgaaactggccctccggggagaggactgaccgggccgaccggcgcggtgggacttccgggtccaccgggcccctctggcttggtggggcctcaggggtcgccggggctgcccggccaagtgggggagactgggaagcccggagccccgggacgggacggggcgtcgggaaaagatggcgacaggggatcgcccggggtcccgggtagccccggcctcccaggaccagtggggccaaaaggcgaacctggcccaacgggagcgccaggacaggcagtggttggactgcctggggccaaaggggagaagggggccccgggagggctggcgggagatttggtaggcgaaccaggtgccaagggagatcgcggacttcccggcccacgaggtgaaaagggagaggcgggacgagcaggagagcccggagatcccggggaggatggacagaaaggcgctccgggacctaaaggtttcaaaggcgaccctggcgtaggagtccctggttccccaggaccgccgggtccgcccggggtgaagggggatctggggcttcctggtctgcctggcgcaccgggggtggtcggttttcccggacagacgggaccgagaggcgaaatgggccagccggggccatccggagagcgtggactcgcagggccgccgggtcgcgaaggaatcccgggaccgctgggaccgccaggaccaccgggctcagtgggcccaccgggagcatcaggcttgaagggagacaaaggcgatccaggcgtcggcctgccgggcccgagaggggaacgtggggagccaggaatccgcggggaggacggcagaccgggtcaggagggcccgcgcggattgaccggacccccggggagccgcggcgaaagaggagagaaaggagacgtgggttccgcgggcctgaaaggggacaagggtgactcggccgttatcctcggtccaccgggtccaaggggagcaaagggagacatgggagagcgaggaccacggggtctggacggggataagggtcccagaggcgataacggggaccctggtgataagggatcaaagggggaaccgggcgacaaaggaagcgcgggactgccggggctgcgtggtctgctgggtccacaaggccagcccggggcggccgggatccctggtgacccaggtagccccggaaaggatggcgtcccggggatccgaggcgagaagggagacgtcggcttcatgggtccgcgtggcctcaaaggtgagcggggcgtgaagggagcatgcggactcgacggtgaaaagggcgacaagggggaagccgggcctccaggacggcctggcctcgctggacacaagggtgagatgggcgagccgggcgtgccaggacaatcaggggcgccgggcaaagagggactcatcggcccaaaaggcgatcgggggttcgatgggcagccgggaccgaaaggtgatcagggggaaaagggtgaacgcgggactccgggtattggaggatttcccggcccatccggcaacgatggttcagcaggcccaccaggcccgccggggtccgtgggacctcggggaccagaaggactgcagggccagaagggagaaagaggacccccgggcgagcgggtggtcggagcacctggtgttccaggagccccaggagaacgaggtgagcagggtagacctggacctgccggccctaggggtgaaaaaggagaagcagcactcaccgaggatgacattagagggttcgtgcggcaggaaatgtcgcagcactgcgcctgccagggccagttcatcgccagcggatcgcggccgttgccgagctacgcagctgacaccgctggctcgcagctgcacgcggtgccagtgctccgggtgtcccatgctgaggaagaagaacgggtgcctccagaggatgacgaatattctgagtactccgaatacagcgtggaagagtaccaggatcccgaggcgccatgggattcagacgacccatgctctctcccactcgacgaaggatcctgcaccgcctacacgctgcggtggtaccacagggcggtcaccgggagcactgaggcatgtcaccccttcgtgtacggaggatgtgggggaaacgccaaccggttcggaacgcgggaggcatgcgaaagaagatgcccgcccagagtcgtccagtcccaaggaaccgggactgcgcaggat

SEQ ID NO: 9591 - DNA, 8832 bp, Artificial Sequence
  Description of Artificial Sequence: Synthetic coding sequence
atgacgctgaggctcctggtggctgccctctgcgccggcattctggccgaagcgccgcgcgtgcgcgcccagcaccgggagcgcgtcacctgcactcgcctgtacgccgcagatattgtctttctgctggacggttcctccagcatcggacggtctaactttcgcgaagtgagatcgttcctcgagggtctggtgctgccattctccggagccgcatccgcccaaggagtgcgattcgcaactgtccaatactcagacgacccgcgcactgagttcggactggacgccctgggatcgggcggagacgtgatccgggccatccgcgaactgagctacaagggaggaaacactcggactggcgcggctatcctccacgtcgcagatcatgtgtttttgccgcagctcgctagacctggagtcccaaaggtgtgcatcctgatcaccgatggaaagtcccaagatctggtggataccgcggcgcagcgcctgaagggtcagggagttaagctcttcgcggtgggaatcaagaacgcggaccctgaggagctgaagcgcgtcgcgtcgcaaccgaccagcgatttcttctttttcgtgaacgatttctcaatcctccggactttgctgccgctggtgtcccggcgggtctgcaccactgctggaggtgtgccggtgactcgaccgccggacgactcgaccagcgcgccccgggacctggtgctctcagaaccttcctcgcaaagtctgagggtgcagtggaccgccgcatcggggccggtgaccgggtacaaggtgcagtacaccccgctcactggtttgggccagcccctgccgtccgaacggcaagaagtgaacgtcccagctggagaaacctccgttagactgcgcggactccgcccactgaccgaataccaggtaaccgtgattgcgctgtacgccaacagcatcggcgaggccgtctccggcactgcgaggactaccgccctggaaggcccagaactgaccattcagaacaccactgcccacagcctcttggtcgcttggagatcggtccctggcgccactggatacagagtgacctggcgggtgctctctgggggacctactcaacaacaagaactcggaccgggccagggttccgtgctgctgcgcgacctcgaaccggggacggactacgaagttactgtctcgacccttttcggcaggagcgtgggacctgcaacgtcactgatggccagaacggatgcgtccgtggaacagaccctccggccggtcatcctgggccccacctccatcttgctcagctggaacctcgttcccgaggcacgcggatacagactggagtggaggcgggaaaccggccttgaacctccacagaaggtggtcctgccgagtgacgtgacgagatatcaactggacgggctgcagccggggaccgaataccgcctcaccctgtacactctgctggaaggacatgaagtcgcgacccctgcaactgtggtgccgactggcccagaattgcctgtaagcccagtcactgacttgcaggctaccgaactgcccggacagcgggtgcgggtcagctggtcaccggtgccaggggccacgcagtaccgcattattgtgagatccactcagggagtggaacgcactctcgtgctgcctgggtcccagactgcattcgacctcgatgacgtgcaggccggattgagctacaccgtgagagtgagcgcaagagtgggcccgcgggaaggatcggcctcggtgcttaccgtgcgtcgcgaaccagaaactccgcttgcagtccctggcctccgggtcgtcgtgtccgacgccacgagggtgcgggtggcttgggggccggtgcccggggcgagcggattccggatctcctggtcaaccgggtcgggcccggagtccagccagactctcccgccggactcgactgctactgacatcaccggactgcaaccgggaaccacctaccaggtggcggtgtcggtgctcagaggacgcgaggagggccctgctgccgtcatcgtcgcacggacggatcctctgggaccggtgaggaccgtgcacgttacccaagcctcatcatcatcggtgaccatcacctggactcgggtgcccggtgccactggctatcgggtgagctggcactccgctcatggcccggagaagtcgcagctggtcagcggagaggctacggtcgccgagctggatggcctggagccggacactgagtacaccgtgcacgtcagagcacatgtcgcaggcgtggatggaccacctgcttctgtggtggtgcggaccgctcccgagccggtcgggagagtgtcacgcctgcagatcctgaatgcttcgtccgatgtgttgaggattacctgggtgggcgtgaccggggccactgcttaccggctcgcatggggcaggtcggagggaggcccaatgaggcaccaaatcctgcctgggaataccgatagcgccgaaatccgcggtctggagggaggtgtctcgtatagcgtccgcgtcaccgcgcttgtgggagatagagagggaaccccagtgtcgatagtcgttactaccccaccggaagccccgccggcgcttggaaccctgcacgtggtccagcgcggagaacactcgctgcgcctcaggtgggagccggttccgagagcccaaggattcctgctgcattggcagcctgagggaggacaggaacagtcacgggtgctgggcccggaactgtcgtcgtaccatttggacggactggaaccggcaacccagtatagagtgcgcttgagcgtgttggggccggctggcgagggaccctcggcggaggtcacggctcgcaccgaatcccctcgagtgccgtccatcgagctccgcgtggtggacacgtccattgactcagttaccctggcgtggacccccgtctccagagcgtcgagctacatcctgtcatggcgccccctcagaggcccaggacaagaggtcccaggaagccctcaaaccctcccgggcatctcctcgagccagcgggtgaccgggctggagcctggtgtctcctacatcttctctctgactcctgtgctggacggagtgagggggccggaggcgtcggtgacccagaccccggtctgtcctaggggattggctgacgtggtgttcctcccgcacgccacgcaggacaacgcccatagagcagaggccaccaggcgcgtcctggaacggctggtgctggcactcggcccgctcggaccacaggcggtgcaagtgggacttctgtcctacagccaccggccgtcgcctctctttccgcttaacggaagtcacgacctcggaatcattctgcagcgcattagagatatgccgtacatggacccgtcaggaaacaacctcggtaccgccgtcgtgactgcgcaccggtacatgctggccccggacgcacccggacgccgccaacatgtgcccggagtcatggtcctgttggtggacgaacctctgcgcggagacatcttctccccgatccgcgaggcccaagcgtccggcctgaatgtggtgatgctgggaatggcaggcgccgatccggaacagctccggcggctggcgccgggaatggactctgtgcagactttcttcgccgtcgacgatggaccgtcgctcgaccaggcggtgtccggactcgcaactgctctctgccaggcatccttcaccacccagccgcggccggaaccatgtccggtgtactgccccaaggggcaaaagggagaacccggagagatgggccttcgcggacaagttggtcctccaggggatccgggcctgcctggaagaactggagcccctggacctcaggggccgccgggatcagcgaccgcaaagggcgagagaggattcccgggagccgacgggcgtccgggtagtccgggccgcgccggaaatccaggaaccccgggcgcccccgggctcaagggttcgccaggactcccaggaccacgaggcgaccctggtgaacgcgggccacgcggacccaaaggcgaaccaggagccccaggacaagtgatcggaggtgaaggccctggtctgccaggccgcaagggagatcctggtccatcaggtccacctggaccccgagggccgcttggtgaccctgggccgcggggccccccaggactgcctggtacggccatgaagggtgataagggcgaccgcggagagcgggggcccccaggaccaggcgaagggggaatcgccccaggagagcccggcttgccaggcttgccgggcagcccaggaccgcagggtccagtcggtccgcccgggaagaagggggagaagggcgattcagaagatggcgctccaggactcccgggacagccgggctcccctggggagcagggtcccagaggcccaccaggggccatcgggccgaaaggcgaccgggggtttccgggtccgcttggagaagccggtgaaaaaggggaaagaggccctccaggcccggcggggagccgggggttgccaggcgtggcaggaaggcctggtgccaagggcccagagggtcctccgggaccaactggacgccagggcgaaaagggcgagcctggacggcctggtgacccagcagtggtaggaccagcggtggcggggccgaaaggagagaaaggggatgtgggccccgctggcccgagaggagcaactggagtgcaaggggaacgagggccgcctggcctggtgctgccgggggacccagggcctaagggggatccaggtgaccgggggccgatcggactcaccggtcgcgcgggacccccgggagactcaggtcccccaggtgaaaagggtgaccctggacggccgggacctccagggcctgtggggcctagggggcgggacggcgaagtgggagagaaaggcgatgaaggaccgcctggagatccagggctcccgggtaaggccggtgaacgcggactgcggggcgccccaggcgtgcgagggccagtcggggaaaaaggcgaccaaggtgaccctggtgaggacggcaggaacggctcgcctggatcttccgggccgaagggcgatcggggtgagccaggacccccgggccccccgggacgcctggttgacactggacccggagcgcgtgagaagggagaacctggcgaccgcggtcaagaagggccgcggggaccaaaaggtgatcctggtttgccaggtgcacccggagaacgcgggatcgaaggctttcgcggtccgcctggcccgcaaggggaccctggtgtgcggggaccagccggcgaaaagggggaccgtggacccccaggacttgacggacgctcgggacttgatggaaagccgggagctgcaggaccttcaggaccgaacggagcagcaggaaaggcgggtgaccccgggagagatggactgccggggctcaggggagaacaaggtctgccagggccgtcgggaccgccaggcctccccggcaagccaggcgaggacggaaagcccggactgaatggtaagaatggagaacctggagatccgggagaggacggccgcaaaggcgaaaaaggtgacagcggcgcgagcggccgagagggacgagacggaccgaagggagaacgtggcgccccggggatcctgggaccacaggggccacctgggctcccagggcccgtcgggccgcctggtcaaggctttccgggagtgccggggggtaccggtccaaagggggatagaggagaaactggatccaagggggaacaggggctgccgggagagcgtggtctgcgtggagaaccaggctcagtgccgaacgtcgaccgcctgctcgaaacggctggtatcaaagcctcagcgcttcgcgagatcgtcgaaacttgggatgagagctcaggatcatttctgccagtgccggaacggcgccgaggccccaaaggagactctggcgagcaagggccaccgggaaaagaggggccaatcggattcccaggagagcgcggactgaagggagatcggggggatccggggcctcagggacctcctggtcttgcactcggtgaacgtgggccgcccggcccatcaggacttgcgggagagccaggaaagcctggcatccccggcctgccgggccgcgcgggaggagtaggagaagcaggtagacctggtgaacggggggagcgcggcgaaaaaggagagagaggcgaacagggacgggatggaccccccggcctcccgggtacgccagggccacctggcccacccggcccgaaggtgtcggtggacgagccaggaccaggactgtcaggagaacaaggaccaccgggccttaagggagccaaaggagaaccgggatcgaatggtgaccagggaccgaagggtgaccgaggtgtcccaggcatcaagggggacagaggcgaaccgggtccgagaggacaggatggtaatcccgggcttcctggagaacgaggtatggccgggcccgagggcaagcccgggctgcaaggaccgcgcggaccacctgggccagttgggggacatggggatcctggtcctccgggcgcaccgggattggctggtcccgcaggcccgcagggaccgagcggactcaaaggcgagccaggggaaaccggaccgccggggcgcggcctcactggcccaactggagctgtgggacttccgggcccaccgggaccgtccggacttgtgggacctcaaggctcacctggcctgccggggcaagtgggggagactgggaaacccggagcgcctggacgggatggtgcaagcggaaaggacggagatcgcggctcccctggcgtgccaggaagtccaggtctgccgggaccagtcggtcctaagggtgagccgggacctacgggtgcccctggacaggctgtagtgggtttgccgggggccaaaggtgagaaaggagctccaggggggctggctggggatcttgtcggagaaccgggggcgaagggtgataggggcctccctggacctcgaggagagaagggtgaggccggtcgggccggcgaaccaggtgacccaggagaggacggacagaaaggagccccggggccgaagggattcaaaggggacccgggagtgggagtgcctggaagcccaggcccgccgggccctccgggagtcaagggagatctcggacttccgggactcccgggcgctcctggcgtggtcggatttcccggccagactggaccacgaggagaaatgggccagccaggcccctctggagagaggggcctcgccggaccaccgggacgggaaggaattccgggacctttgggaccaccggggccgcccgggtccgtgggaccacctggagcctcgggactgaagggcgataaaggagatccaggcgtgggcttgcccggaccccgcggtgaacggggcgaacccggaatcagaggcgaagatggccgaccggggcaggaggggccgagaggtctgactggaccgcccggctctcgcggcgagcggggagagaagggagacgttggatccgccggtctgaagggcgacaagggtgactccgcggtgatcctgggcccacctggcccgcgtggcgctaaaggagacatgggggagagaggacctcgtggattggatggcgataagggacccagaggagataacggcgacccgggagacaagggttcaaaaggcgaacccggggacaaaggatcggccggattgcctggcctcaggggcctgctcgggccccaagggcaaccgggggccgccggcataccgggcgacccggggagcccgggaaaagatggagttccgggaatcaggggtgaaaagggggatgtgggattcatgggaccgcggggtctgaaaggagaacgcggcgttaaaggagcctgcgggctggacggggagaagggagataagggagaagcaggcccaccgggtcggcctggactcgcgggccacaaaggagagatgggtgaacctggtgtcccagggcaatcgggagcacccggaaaggagggattgatcggcccaaagggtgaccgcggattcgatggacagccgggtccgaagggggatcaaggtgagaagggggaacgcggaactccgggaatcggaggatttccgggcccgagcggaaatgacggatcggctggacctcccggaccgccaggatcagtcgggcctcggggacctgaaggcctgcaaggccagaagggagaaaggggcccgcccggagagcgcgtggtcggtgccccaggggtaccgggcgcaccaggtgagcgcggtgaacaggggcgccccggcccggctggaccaagaggcgagaagggagaggccgccctcacggaggatgacatccgcggtttcgtgagacaggagatgagccagcactgtgcctgccagggccagttcatcgcctcgggatcgcggccgctgccgagctacgcggccgacactgctggctcccagttgcatgccgtgccggtgctgagagtgtcccatgcggaggaagaagaaagagtgccgcctgaggacgacgagtactcagaatacagcgaatactcggtcgaagaataccaggatcctgaggccccatgggactcggacgacccatgttcgctgccactggacgaaggatcatgcaccgcgtacacccttcgttggtaccaccgggcggttactggaagtaccgaggcgtgccacccgttcgtgtacggaggatgcgggggcaacgcaaatcggttcggtactcgcgaggcgtgtgagcgccggtgcccgcctagagtggtccaatcccagggaactggaactgcacaggat

SEQ ID NO: 9592 - DNA, 8832 bp, Artificial Sequence
  Description of Artificial Sequence: Synthetic coding sequence
atgaccctcagacttctggtggcggcactgtgtgcgggcatactggcagaagctcccagagtgcgcgcgcaacatagagagagagttacctgtaccaggctttatgccgcagatattgtctttcttctggacggatcgtcgtcgattggcaggtcaaacttcagggaagttaggtcgttccttgaaggactggtcctcccttttagcggagcagcgtcagcacaaggtgtgcgctttgctactgttcagtattcggatgatccaagaaccgaatttggacttgatgcccttgggtccggaggtgacgtgatccgggcaattcgcgaattgtcgtacaaagggggaaacacgagaaccggagcagccatactgcacgtggcagatcacgtctttttgcctcaacttgcacgtccaggtgtgcccaaggtctgtattctcattaccgatggtaaaagccaagacctcgtggacactgctgcacagagactgaaaggccagggcgtgaaactttttgccgtcggcataaagaacgcagacccggaggagctgaagcgggtggcaagccaaccaacgagcgacttcttctttttcgtcaatgatttttcgattctccgaacccttctccctctcgtgtcgagacgggtgtgtaccactgccggcggggtgcctgtcactcgccctcctgatgattcgactagcgcaccacgtgatctcgtgctgtctgaaccttcctcacagtcgctgcgggtgcagtggactgccgcgtcgggtcccgtgactggctacaaagttcagtacactccacttactggactgggccagccactgccctcggaaagacaagaggtgaacgtgccagcaggagaaacctcagtgcgtctccgtggactgaggcctctcaccgaataccaggtcactgtgattgcactgtacgcgaactccattggtgaagcagtgagcggtactgcaaggacgaccgccctcgaggggcctgaattgaccattcagaatacgaccgcacattcgctcctggtggcatggagatctgtgccgggagccaccggataccgagtgacgtggagggtcctttcgggaggacccacccagcaacaggaactgggaccagggcagggttccgtgttgttgagggatcttgaacccggtactgattatgaggtgaccgtttcgactctcttcggaagatcggtcggccctgcaaccagcctgatggcacggacggatgcaagcgtggaacagaccctgcgacctgtgatcctgggacctaccagcatccttctgagctggaatcttgtccctgaggcacgaggttacagacttgagtggcgtcgtgagactgggcttgaaccacctcaaaaagtcgtccttccgtcagatgtgactcgttaccaactcgacggactgcaaccaggaacggaataccggctcaccctctacacccttctcgaaggtcatgaagtggccactcctgcaactgtggtgccaaccggtcctgaacttcctgtcagccccgtcacggacctccaagcaaccgagctgccgggtcagcgggtgcgggtgagctggtcgccagtgcccggagctacccagtaccggataatcgtgaggtctactcaaggagtcgagcggactctcgtgcttcccggaagccaaactgcattcgatcttgacgacgtgcaagcagggctctcatacaccgtcagagtctcagccagagtcggtccacgagagggttcagcatcagtgttgaccgtgagaagagaaccagaaaccccactggctgtcccagggctcagggtcgtggtgtccgatgccactagagtgcgcgtggcatggggacccgtcccaggagcgtccgggtttcgcatctcgtggtccactggatcgggaccagagtcgtcacaaaccctcccccctgattccaccgccacggatattacgggacttcagcccgggactacgtatcaagtggccgtctcagtgcttcgcggtcgagaagaaggtcccgcagcggtgatcgtggctagaacggatcctctgggacctgtccgcactgttcacgtgacccaggcctcctcgtcctcggtgactataacgtggacccgcgtcccaggagcaactggctaccgtgtctcctggcactccgcccacggacccgagaagtcccaattggtgtccggcgaagccacggtggctgaactcgatggactggaaccagatactgaatacactgtgcacgttcgtgcgcatgtggccggggtcgacgggcctccagcaagcgtggtcgtcaggactgcaccagaaccggtggggcgggtgtcaaggcttcagattcttaatgcatcgtcagatgtgcttcgcataacttgggtgggtgtgactggcgccaccgcatacaggcttgcatgggggagatcagaagggggtcctatgcggcaccaaattctgcccggaaacaccgacagcgcagaaatccgcggactcgaagggggagtttcttactccgtgagagtgactgcgcttgtcggagatcgtgaagggactcctgttagcattgtggtgactacccctcctgaagctccccctgcactgggaaccctgcatgtggtccaacggggtgagcattcactgcgattgaggtgggaacctgtgcctagggcccaaggattcttgttgcattggcagccagagggtgggcaagagcagagccgcgtgttggggcctgaacttagctcgtaccatctcgacggtcttgaaccggcaactcagtacagagttcgcctgtcagtgctcgggcctgccggcgaaggacctagcgccgaagtgaccgcaaggaccgaatccccaagagtgccttccattgaactcagggtggttgacacctcgatcgatagcgtgactcttgcttggactccggtgtccagggcaagctcgtacatcctttcgtggcgccccttgcgcggccctggacaagaagtgcccggttctcctcagactctccctgggataagctccagccaacgcgtcaccgggcttgaaccaggagtgtcgtacattttctcgctgactccagtgctcgatggggtgcgaggaccagaagcatctgtgacccagaccccagtgtgcccacggggactcgcagatgtggtctttctgccacatgccacccaggataatgcacatcgagcagaagcaactagaagagtgcttgagaggctcgtgttggcccttggtccacttggtccgcaagccgtgcaggtgggtctgctgtcgtactctcatagaccatcccctctcttcccgcttaacggttcacatgacttgggtattatcctgcaacgcataagagacatgccctacatggatcctagcggtaacaatctgggaactgcagtggtcaccgctcatagatacatgttggctccagacgctcctggtagacggcaacatgtgcctggcgtgatggtgcttctggtggacgaacctcttcgcggagatatcttttcccccattagggaggcacaggcttctggtcttaatgtggtgatgctgggaatggccggtgccgatcctgagcaactgagacgcctggcacctggaatggatagcgtgcaaactttctttgcagtggatgatggacctagcctcgatcaggcagtgtcaggcctggcaacggcactgtgtcaagcctcctttaccacccagccccggcctgaaccttgtccggtctactgcccaaaggggcaaaagggtgaacctggcgaaatgggtctgagagggcaagtgggacccccgggagatccaggactgccgggacgcactggcgcccctggacctcaagggccccctggcagcgcgaccgccaagggcgaaagaggtttccctggagcagatggtagaccgggatccccgggtcgggcaggtaatccgggtacccccggggcgcctggtctgaagggaagcccaggccttcccggtccccggggggacccaggtgaaagagggccaagaggacccaagggggaacccggggcacccggtcaagtgatcggtggcgagggccctggtctgcctggccggaaaggtgatcctgggcctagcggcccacccggaccgcgaggtcctctgggcgaccccggaccaagaggacctcctggacttcctggaaccgcgatgaagggcgacaagggagatcgaggcgaacggggacctcccggtcctggcgaaggtggaattgcacccggagagcctggactgccaggcctgcctggatcgccaggcccacaaggcccagtgggacctcctggtaagaaaggtgaaaaaggagactccgaggatggagccccaggacttcccgggcagcccgggtcgcctggtgagcaaggccctcggggaccgcccggagcgattggtcctaagggtgatcgtggattccctggtccactcggtgaagcaggtgaaaagggagagcggggaccacccggacccgccggatcaagaggccttccgggcgtggcaggacgccccggagctaagggtccggaaggacccccgggtccaactggtcggcaaggcgagaagggtgaaccaggtcgtccgggcgaccctgccgtggtggggcccgcagtcgccgggcctaagggagagaaaggagacgtgggtccagctggcccgcggggcgccactggagtgcagggagaaagaggaccgccaggcctggtccttcccggagatcctgggccgaaaggtgacccaggagacaggggacctattggactgactgggcgagcaggccctcctggtgatagcggaccccccggcgaaaaaggagatccagggcgcccaggtcctcctggtcccgtgggacctcgcggccgggacggtgaggtgggagaaaagggcgatgagggaccgccaggagatccgggacttcctggcaaggcgggtgaacgtggccttcgtggagcccctggtgtcagggggcccgtcggcgaaaagggagatcagggagatccgggtgaggatggacgaaacggaagccccggttccagcggaccgaagggagacagaggtgaacctggacctcccggacctcctggacgacttgtggatactgggcccggcgccagggagaagggtgaaccaggggaccggggtcaagagggacctcgcggaccaaagggagatccggggcttcccggtgcaccgggagagcggggtattgaaggctttagaggacctcccgggccgcagggagatccaggtgtcagaggtccagcaggcgagaagggtgacagaggacctcccggcctcgatggacgatcgggtcttgatggaaagcccggagctgctggaccctccggccccaacggtgcagcaggtaaagcaggtgaccctggacgagatggattgccaggtctgcggggcgaacagggactgcctgggccaagcggcccacccgggctgcctggtaagcctggtgaggatggtaagcctggacttaatggcaagaacggcgaacccggggaccccggcgaagatggtcgtaagggggagaagggtgactcaggagcgtcgggacgggaggggcgtgatggtccaaagggagaacgtggagccccaggcatcctgggccctcaagggcctccggggctccctgggccagtgggtcctcctggtcaaggatttccgggcgtgccaggaggaaccggtcctaagggcgacagaggcgaaaccggatcgaagggggaacaggggctcccgggcgagcgcggacttcgaggagaaccaggctcggtgccaaatgtggatagactgcttgaaacggctgggataaaggcttcggcgctgagggagatcgtggaaacttgggacgagtcatccggctctttcctgcctgtgcctgagcgtcgcagaggtccgaagggcgattcaggcgaacaagggccacctggtaaagaaggtcctattggtttccctggtgaaagaggccttaaaggagatcgtggggatcctggtccgcaaggaccgccagggctcgcacttggggaaagagggccccctgggccttccggtcttgccggagaacccggcaagccaggaatccctggactgccgggaagagccggtggtgtgggagaagcaggacggcccggagaaaggggggagcgcggcgaaaagggtgaaaggggcgaacaaggacgcgacgggccgccaggattgccaggaaccccaggcccgcctgggccgccaggtccaaaggtgtccgtggatgaacctggccctggtcttagcggagaacaggggcctccgggtcttaaaggcgcaaaaggagaaccaggatccaatggagatcaaggacctaagggagatagaggtgtgccaggtatcaaaggtgaccgcggggaacctggcccacggggacaggacggaaatcctggactgcctggcgagcgagggatggccggtccagaaggtaagccaggactccaagggcccagaggtcctcctggccctgttggcggacatggagatccaggtccgccaggcgcacccggactggcaggacccgcgggacctcaaggaccatcgggtctgaagggggagccgggggaaaccgggccacccggacgtggactcactggccctacgggagcagtgggactgccaggtcctccgggcccgtcaggcctcgtcggacctcaaggatccccgggattgccaggacaagtcggagagactgggaagccaggagctcctggtcgggatggagcatcagggaaggatggtgaccgtggttcaccaggcgtgcccggatcgccaggactccctggacctgttggaccgaaaggagaaccagggccaactggtgcacctggacaagcggtggtcggactccccggtgcaaaaggtgaaaagggggcaccgggaggcctggccggcgacctcgtgggggagcctggtgccaagggggatagaggtctgccaggtccccgaggcgagaagggtgaagcaggtcgcgccggcgaaccaggggaccccggagaagatggacagaagggcgcaccaggccctaaaggatttaagggagatccaggcgtcggagtcccgggatcaccgggtccgccaggtcctcctggtgtgaagggcgatctgggtctgcctgggctccccggcgcccccggtgtggtcggctttcccggacaaaccgggccgaggggtgaaatggggcagcctggtccctcgggagaacgcgggctggcagggcctcccggtagagaaggtattccaggccccctgggtccacctggtccacccggtagcgttggacctcctggagcatcaggactcaagggcgacaagggggaccctggtgtgggcttgccaggtcctcggggtgagcgcggggaacctggaatcagaggagaagatggaaggcccggacaggaagggccaagaggcctcacgggaccaccgggttcgaggggggagcggggtgaaaagggggatgtcggatccgctgggcttaagggtgataaaggagattccgccgtcatcctgggacctcctggaccacggggagcaaagggcgatatgggagaaagagggccgcggggacttgatggagacaagggacctaggggtgacaacggcgacccgggagataaggggtccaagggagagcccggcgataagggtagcgcggggcttcccgggctgcgcggactgttggggccccaaggtcaacctggagcggccggtattcctggtgacccaggttcaccaggcaaggatggtgtgccgggaattaggggggagaaaggggacgtgggctttatgggacccaggggcctcaaaggagaacggggtgtcaagggagcatgtgggctggacggcgaaaagggggacaagggcgaggcaggaccaccagggcgtcccggactggcaggacataaaggggagatgggagaacccggggtcccaggacaatcgggcgcacctggtaaagagggattgattgggccaaagggagataggggatttgatggacaacctggacctaagggagatcaaggcgagaagggagaacgcggcacgcccggaatcggcggatttcccggtccttccggcaacgatggatccgccggacctcctggtccgccaggttccgtgggaccacgcgggccagaaggattgcagggccagaagggtgagcggggacctccgggggaaagggtcgtgggtgcaccaggtgtgccaggtgcaccaggcgaacgcggagagcagggtcgcccagggccagcaggccctcgtggagaaaagggcgaggcagcccttactgaggacgacattcggggattcgtccggcaggagatgtcacaacattgtgcatgtcaaggacagttcatcgcgagcggttcgcgacctctgccttcctatgccgcagataccgcaggctcccaacttcacgcagtgccagtgctgcgagtcagccatgccgaggaagaagagcgcgtgcccccggaagatgatgaatactcggaatactcggaatactcggtcgaggagtaccaggatccagaagccccctgggattccgacgatccttgctccctgcctctggatgaaggctcatgtacggcctacacccttagatggtaccatagggccgtgaccggatccaccgaagcctgtcacccttttgtttacggaggctgcgggggaaacgcaaaccgatttggaactcgtgaagcatgtgaacgtcgatgtcccccgagagtggtgcaatcgcagggcactggtactgcccaagat

SEQ ID NO: 9593 - DNA, 8832 bp, Artificial Sequence
  Description of Artificial Sequence: Synthetic coding sequence
atgacactgagactgttagtagctgccctgtgcgccggtatccttgcagaagcacccagggtcagggctcagcatagagagagagtgacgtgcacccgcctatacgcggctgacatcgtttttttactagatggttccagctcgatcgggcgcagtaatttccgggaagttcggtcatttctcgagggtctggttttgccattctccggagcggcatcggcccagggagtacgattcgccaccgtccagtactccgatgatccccggacagagtttggtctggatgctctgggaagcgggggcgatgttattcgggctatccgcgagctctcctacaaaggcggaaatacaaggactggtgctgcgatcctgcacgtcgccgaccatgtcttcctacctcagctggcacgccctggcgtccccaaagtgtgcatcttgataaccgacgggaaaagtcaggacttggtagacacagcagcacaacggctaaaaggccagggcgtaaagctctttgcagtaggcataaagaatgccgatccggaagagttgaagagagtcgcgagccagcctaccagcgactttttcttcttcgttaatgatttcagcatactgcggaccttactcccactcgttagccgccgtgtgtgcacgactgctggcggggtccccgtcacgcgcccaccagacgactccacttccgcccctagagatctcgtactctctgaacctagctcccaaagtctgagggtccagtggaccgccgcctcggggccagtgaccgggtacaaggtgcagtacacgcctctcacaggactcgggcagccattaccctcagagcggcaggaagtgaatgtgccggccggcgaaacatcagtaaggctgcgtggactgagacccctgaccgaataccaagtgacagtgatagccctgtacgccaactccatcggcgaagcagtgtcaggaactgctaggacaactgctctggagggcccagagctgaccattcagaatacaaccgcgcactctcttctggtagcctggcgatcggtaccgggcgcgaccgggtaccgcgtcacatggagggtgctctctgggggtcccactcaacaacaggagttaggtcccggtcagggcagtgtgctcctgagagacctcgagccaggtacagactacgaagtgaccgtcagcaccctctttgggaggtccgtgggacccgcgacgagcctcatggcccggaccgatgccagcgtagagcagaccctccggcctgtgatcctggggcctacctcaatcttactatcttggaatcttgtgccagaggccaggggttacagactggaatggcggcgcgagacaggtctcgaaccaccccagaaggtagtacttcctagcgatgtaacgcgctaccagttagatggccttcagccggggacagaatacagactgaccctatatacgttactggaaggccacgaggtggctaccccagcgactgtggttccaactggcccggagcttccagtcagccccgtgacggatctacaggcaaccgagctcccgggtcaaagggttagagtttcttggtctcctgtgcccggcgcaacccagtaccgcataatcgtgcgttctactcagggagtagagcggacgctcgtgctcccaggttcccagactgctttcgatctcgacgacgtgcaggctggtctgagttacaccgtacgcgtgtctgcacgtgttggtccccgggagggttcagcttccgtactgactgtgcggcgcgagccagagacgccactggctgtcccaggcctcagggtagtggtgtctgatgctacccgggttcgagtggcttggggacccgtccccggcgcctccggtttcaggatctcttggtcgacgggcagcggtcctgaaagctcccagacacttccaccagactccaccgccacagacatcaccggactgcaacctggcacgacctaccaggtggcagtttctgtgcttcggggcagggaggaaggacctgccgctgtcatcgtggcccgcacagatcccctgggacctgtgcggaccgtccacgtcacccaggcttcaagcagttcagttactattacctggaccagggttcctggcgccaccggataccgtgtgtcatggcattccgctcatgggccagaaaagagccagttggtctctggggaggctacggtggccgagctggacggacttgagcccgacacagaatacacagtccacgtaagagcccatgtggctggggtcgacgggcccccagcaagtgtggtcgtgcgtacggcccctgagcccgttggccgagtatcacggctccagatcctcaacgcgagcagcgacgttctgaggattacctgggtgggcgtaacaggcgcaaccgcctatcggcttgcctggggccgcagtgaaggcggacctatgcggcaccagattctgccggggaatacggactcagccgaaatcagaggcctcgaagggggggtaagctacagcgtccgtgtgacagcccttgtgggggacagggaaggaacccctgtcagtattgtcgtgacaaccccccctgaggctcctccagcattgggcacgctccatgtagtgcaaagaggcgaacacagcctgcggttaaggtgggagccggttcccagagcccaagggtttctgctgcactggcagcctgaggggggacaagaacagagcagagttctgggaccagagctgagctcatatcatctcgatggcctagaaccagccacccagtaccgcgtgcggttgtctgtcctgggacccgccggggagggcccctccgctgaggtgaccgcccgaactgaaagtcctagggttccatcaatcgagttgcgcgtggtggacacatcaatcgactccgtgaccttggcctggacgccagtaagccgagccagtagttacatcctttcctggcgtcctcttcgcggacctggccaggaggtccccggatctccccagactctgcccggaatttctagctctcagcgcgttacaggccttgaacccggcgtgagctatattttctcccttacccctgtacttgacggagtaagaggaccagaagctagtgttactcagacacccgtgtgtccacgtgggctggccgacgtggtgtttctgccccacgcaacacaggacaacgcccacagggccgaggccaccaggagagtcctggaacgcttggtacttgctctgggcccactaggcccacaagctgtgcaggttggtctcctgagctattctcaccgaccctcaccattgtttcctctgaatggatcacatgatcttggtattatattgcaacgcatcagagatatgccttacatggatcctagcggaaacaacttggggaccgcggttgtaaccgcccacaggtatatgttggctccggatgcccctggacgcaggcaacatgtacccggcgtgatggtgctgctggtggacgagccattgcgcggcgacatctttagccccattagagaggcccaggccagtggcctgaatgtggtcatgttaggaatggccggagctgacccagagcagttgcgacgccttgcacccggaatggattccgtgcagactttcttcgcagtggatgacggaccctcactggatcaggccgtgtcaggcttggccaccgccctgtgtcaggcaagcttcacaacccagccacggcccgagccctgccccgtgtattgtcccaagggccagaagggagaaccaggtgagatgggcctgcggggacaggtgggcccaccgggcgaccccggcctccccggtaggaccggcgcaccagggcctcagggtcctcctggcagcgctaccgctaaaggtgagaggggattccctggcgcagatggacgcccaggaagcccgggccgcgctgggaacccgggcacaccgggtgcacccggccttaagggaagccccggactgcccggtccccggggagaccccggtgagcggggtccgcggggtccaaagggggagcccggggctcctggacaggtgattggaggagagggaccaggactcccaggacggaagggtgatcccggaccatccggccccccaggcccaaggggtcccctgggggaccctggtccaaggggtccgcctggcctgcccgggaccgctatgaagggtgacaaaggagaccgcggggagcgcggtccccccggccccggtgagggcggcattgcacctggcgagccaggcctgccgggacttcctggctccccgggaccccagggccccgtggggcccccggggaaaaagggggagaagggagatagcgaagatggtgcaccggggctgcctggacagcctggtagtccaggggaacagggccccaggggccctccaggggcaatcggccccaagggtgacaggggttttcctggccccctgggggaggcaggagagaagggagagagagggccacccggccccgccggcagtaggggcctccccggggtcgccggtaggcctggcgcgaaaggtcctgaaggtccacctggcccaacagggcgacaaggcgagaaaggggagccgggccgaccaggagaccctgctgtggtcgggcccgcggtcgccggccccaagggcgaaaagggcgatgtgggtcctgccggacctcgcggggccactggagttcaaggggagaggggaccaccgggtctcgtcctgccaggtgatcccggccccaaaggtgacccaggcgaccgcgggccaatcgggctgaccgggagggccggacctccaggagactctggcccgcctggggagaaaggagaccccggtcgacccggcccgccaggcccagtcggcccacggggccgagacggggaggtaggcgaaaaaggagacgagggtccccctggtgacccagggttgcctggcaaggccggtgagcggggtcttcgcggagcacccggggtaaggggccccgtgggagagaagggtgaccagggggatccaggagaggatggacggaacggctcaccaggtagctcgggccccaagggcgatcgcggcgaacccggcccccccggcccccccggacggttagtggatacaggacccggcgccagagaaaaaggagaacctggggataggggtcaggaaggtcctcgtggacccaaaggtgaccctggcctgcccggggccccaggagagaggggaatcgaaggtttccgaggacccccaggtccacagggcgatccgggtgtgagaggacctgccggcgagaaaggtgacagagggcctccagggctcgatgggcgctccgggctggacggaaaacctggggccgcagggccatctggccccaatggagcggccggaaaggcaggcgaccctgggcgggatgggctacctggactgcggggtgaacagggcctgcccggtccgagtgggcccccgggactgcctgggaagcccggggaggacggcaaacccggtctgaatggaaagaatggcgagcccggggacccgggagaggatggtagaaagggtgagaagggcgactccggcgcgagtgggagagagggacgggacggacccaagggggaacggggcgcccccggcattctaggaccgcagggccctcccgggctgcctggacctgtgggacctcccgggcaagggttccccggcgtgcccggcggaaccggaccgaagggagaccgcggggaaacaggcagcaagggcgagcagggactccctggagaacgcggcctgaggggcgagccgggttcggtgccaaatgtggacagactgctggagactgccggaattaaagccagcgccctccgggagatcgttgaaacctgggacgaatcctctggcagtttcctccctgtgcccgagaggcgaagaggccccaaaggggactctggtgaacaggggccaccagggaaggaaggcccaatcgggtttcctggtgaacgcggcctgaaaggtgaccgcggagatcccggcccgcagggcccgcctggcttggcccttggcgagcgcggccctcccggcccttccggactggcgggagagcctgggaaaccagggatacccggcttgccaggccgcgctggcggcgtcggggaagctgggcgccctggggagagaggggaacggggtgaaaagggcgagaggggagagcagggtcgggacggcccacctggattgccgggcactcctggtcccccaggaccccccggcccaaaagtgtccgtcgatgagccggggcctgggttgtcaggggagcagggtccccccgggctgaaaggggctaaaggagaacccggaagtaacggtgaccaagggcccaagggagaccgtggcgtaccgggcatcaagggagataggggagagcctggaccccggggccaggatggcaatccaggactgcctggcgagcgggggatggcgggcccggagggcaaacccggactgcagggccccagagggccacccggccctgtcggtgggcatggcgaccccggaccccccggagctccaggcctggcaggccccgctggacctcagggccccagtggactgaaaggtgagcccggcgaaacaggccccccaggacgtggactgactggccccaccggggcagtgggcctgccgggacccccaggaccttcaggactggtcggtccacaggggtcacccgggttgcctggacaggtcggagagacgggcaaaccaggagctcctggtagagatggcgcttcagggaaagacggcgatcgcggatcacccggagttcctggttcccctggcctcccaggtcccgttgggcctaaaggagagcccgggcctacaggagctcctgggcaggccgtggtcggactgccgggagccaagggagagaagggcgcacctgggggactcgccggggacctagtgggcgaaccaggtgccaagggggatcggggactacccggacctcggggcgaaaagggagaggcaggtcgggctggagaacctggagaccctggagaggacggtcagaagggagcgcccggacctaaaggtttcaagggcgaccccggagtgggagtgccaggcagtcctggacctccaggtccacccggtgttaagggcgacctgggcctccccggccttcctggcgcacccggtgttgtcggattcccaggacaaacaggtccacgcggggagatgggccagcctgggccttccggagagcgaggattagctggtccaccaggcagggaggggatacctggacccctggggccacccggccctccgggctcagtcggtccacccggagcatcaggtctcaagggtgacaagggagatcccggtgtgggcttgcctggccccagaggcgaaaggggcgagcctggaatccggggcgaagatggaaggccgggccaggagggccctcgaggcctcactgggcccccaggtagtagaggagagcgtggtgaaaagggggacgtaggttcggccggcctgaaaggggataagggcgatagtgccgtgattttggggccccccgggcccagaggggccaaaggggacatgggtgagagaggcccaagaggcctggatggagataaggggcctaggggggataatggagatccaggagataaggggagtaagggggagcccggcgataagggctcagccgggttacccggtcttagggggctgctgggaccgcagggccagcctggcgcagctggcatccctggtgatcccggcagtcctgggaaagacggcgtccctggcatcaggggcgaaaaaggggatgtgggatttatgggtcccagaggattgaagggcgagcgcggagttaagggagcctgtgggctcgacggtgaaaaaggagataaaggcgaggccggtccaccaggaaggcctggactggccggacataagggcgaaatgggcgagccaggcgtaccaggtcagtctggtgcccctggtaaagaaggactaatcggcccaaagggcgatcgagggtttgatggtcagcctggtcccaagggcgaccagggagagaagggtgaaagaggcacgcccggaattggggggttcccaggaccatcaggcaatgatggaagcgctggtccccctgggccgcccggcagtgttgggccacgggggccagaggggctgcagggtcagaaaggcgaacgtggaccgcccggagaacgggtggtaggggcaccaggggtgcctggggcgccgggggagagaggcgaacaaggaagacctggccctgcgggtccaaggggggagaaaggcgaggcagccctgactgaggacgatatccgcggatttgtacgtcaggagatgtcacagcactgtgcatgtcagggacagttcatcgcttctggcagcagaccccttccttcatacgcagccgatacggccggaagtcagctgcatgcagttcccgtcctgcgggtgagtcatgctgaggaggaggagcgggtgcctccggaggatgacgaatactccgaatacagcgagtactcggtggaggaataccaagatccagaggctccttgggactccgacgacccatgctctctacccctagatgagggcagttgtacagcctatactttgagatggtaccacagagccgtgacaggctcaaccgaggcttgtcatccttttgtgtacggaggctgcggaggaaatgctaatcgtttcggcaccagagaggcctgcgaaagaaggtgcccccccagggtggttcagtctcaggggacgggaacagcacaggac

SEQ ID NO: 9594 - DNA, 8832 bp, Artificial Sequence
  Description of Artificial Sequence: Synthetic coding sequence
atgaccctgcggctacttgtcgcggctctctgtgctggtattcttgccgaggctccaagagtgagggcacaacatcgagagcgtgtgacatgtacccgcttgtatgccgctgacatcgtattcctgctggacggctcatcttctatcggccggagtaattttcgggaggtgcggtcattcctcgaggggctggtccttccattctcaggcgccgcctccgctcagggggtgcgcttcgctactgtgcaatattctgatgatccccgtactgaattcggtctggacgcccttgggtcgggcggggatgtcattcgggccatcagggaactgagttataagggcgggaacactagaactggagcagcaatcttacacgtcgcggatcatgtgttcctgccacagctagctcgtcccggcgtgccaaaggtttgcatcttgatcactgatggcaaaagccaggacctggttgatacagcagcccaaagattgaagggacagggtgtgaagctttttgctgtcggcatcaaaaacgctgaccctgaagagctgaagcgagtggcctcacagcccacatctgattttttcttcttcgtcaacgacttctctattctcaggaccctgctccccctggttagccgaagggtgtgcaccactgcaggcggcgtgcctgtgacacgtcctccagacgacagcacgtccgcacccagagatctggtccttagcgagcccagctcccagtctcttcgtgtgcagtggaccgccgcatcggggcccgtgaccggatataaggtgcaatacacacctcttactggtctcggacagcctctgccttcagaacgccaggaggtgaacgtgccggccggcgagacgagcgtgcggctgcggggcctgaggcctcttacggagtaccaagtcactgtcattgccctgtacgctaatagcataggagaggccgtttcaggaacagcccggaccaccgctctcgagggaccggaactaaccatccagaatactacggctcacagcctgctggtcgcttggcggagcgtgcctggggcgaccggttacagagttacctggcgggtcttgagcggcggacctacacagcagcaggagctgggcccaggccagggatccgtattgttgagggaccttgaaccgggaaccgactacgaagttaccgttagtaccttatttggacgaagcgtggggcctgccacttcactgatggctaggacggacgcctcagtggagcagacactgagaccagtgatactaggtccgacctccatactgctgagctggaacctggtgcctgaagccaggggttacagattggaatggcgaagggagactgggttggaacctcctcagaaggtagtcctgccttcagatgtgactcggtatcagctagatggcctgcagccgggaactgagtaccggctgacgctttacactttgcttgagggccatgaggtagcaacgcctgcgaccgtcgtccccaccggtccagagctgcccgtgagccccgttactgatctgcaagcgacagaactgcccggacagcgggtgcgtgtcagctggtcccctgtccccggcgccacgcagtatcggataatcgttagatccactcagggggtggagcggaccttggttctaccgggaagtcagacggcctttgacctggatgacgtacaggccggactgtcttatactgttcgcgtgtccgcccgcgtcggcccacgagaagggtccgcatcagtcctgactgtgcgccgggagcctgagacacccctggctgttccgggccttcgggttgtggtttccgatgccacgcgcgttcgagttgcatgggggcctgttccaggagcgtccggatttcgcatctcatggtccaccgggagtgggcctgagagcagtcaaacactgccacctgatagcacggcgactgacatcacggggttgcagcctggtacaacgtaccaagtcgcggtgagtgtgctgcggggcagggaagagggacccgccgcagtgatcgttgccaggaccgacccattgggaccagtgcgaaccgtccatgtcactcaagcctctagcagttccgtcaccatcacatggaccagagttccaggggcaacaggttatcgcgtgtcatggcactccgctcacgggcctgagaagtctcagctagtaagcggcgaggcaacagtggccgagttggatggcctggagcccgataccgagtacacggtgcacgtccgggctcacgttgctggagtggatggacctccagcctccgtggtggtgagaacagcccctgagcccgtcgggagagtgtccaggctgcagattttgaacgcctcaagtgacgtgctgagaatcacctgggttggggtgacaggggcaactgcttacagacttgcctgggggcgttccgaaggtggccctatgagacatcagatactaccgggcaatactgactccgcagaaatccggggcctggaaggcggtgtttcctactctgtaagagtcacagcgttggttggggatagggaggggactcccgtgtcaatcgtggtgactacaccgcccgaggcgcctcccgcattgggaaccctgcacgtcgtacagagaggcgagcactctctgaggctgcggtgggagcctgtccctagggcccaggggttccttctccattggcagcccgaaggaggccaggagcagtcacgcgtactgggccctgagctctcgtcctaccacttggacggcctcgaaccagcgacccagtaccgggtacggctctctgtcttgggcccggcaggggagggtccaagtgctgaagtgacggccagaacagagtcccctcgcgtgcctagcatcgagttaagggttgtggatacctctatcgactctgtcactcttgcctggaccccagtgagtcgagcatcaagctatatcctgagctggaggccattgaggggaccggggcaagaggtgcctggatccccccagaccctgccaggcatttcttcctcacagagggtaactgggctggagcctggtgtctcctatatctttagcctgacgcccgtgctcgatggcgtccgtgggcccgaggcctcagtgactcagacccccgtttgccctcgcggcctggctgatgtagttttcctacctcacgccacacaggataacgctcatcgggcagaagccacccggagggtccttgagcgccttgtacttgccctaggaccgctggggcctcaggctgtgcaggtgggccttctctcctacagtcatcggccgagtccattgttcccactgaacggttctcatgatctaggcattattttgcagagaatccgggatatgccctacatggacccaagcgggaataacctgggaacagctgtggtaaccgcccacaggtatatgttggcccctgatgcccctggcaggcgacaacatgtgcctggtgtgatggtgctgttggtagacgaacctttacgcggtgacatcttcagccctattagggaggcccaagcttccggactgaacgttgtgatgcttggaatggccggagccgatccggaacagctgagaaggttggctcctgggatggattctgtgcaaacattctttgccgtggacgatggtccctcgctggatcaggccgttagtggcctggcaacagcattgtgccaggccagttttacaacccagcctcgtcctgagccatgcccggtctactgccctaagggccaaaagggagagccaggcgagatgggcctccggggccaagtcgggcccccgggcgatccagggctgccaggtagaaccggcgctcctgggccacagggcccccctggttccgcgactgcgaagggtgagcgtggattcccaggcgccgacggtcgcccaggcagtcctggacgggccgggaatcctggcacccccggggctccagggctcaaaggatctccaggcctccctggtccgcggggagacccaggcgaacgagggccaaggggccctaaaggggaaccaggcgcccctggccaggtaattggaggagagggcccaggcctcccagggcgcaaaggcgaccccggcccatctggacctccaggtccaagggggcctctgggcgatcctggtccgcgaggccctcccgggcttcccgggaccgctatgaaaggagataaaggcgacagaggtgagcgcgggcccccaggccccggcgaggggggaatcgcccctggggaaccgggtctgccagggctgcccgggtcgcctggaccccagggaccagtgggacccccgggaaagaaaggagagaagggggactctgaggacggagcccctggtctgccaggtcagcccggctctcctggcgagcagggaccaagagggcccccaggtgccattggtcctaaaggagatcgcgggtttcccggccctttaggcgaggctggagagaagggcgaaagaggccccccgggtccagctggatctagggggcttcccggagtggcgggccggcctggtgcaaagggacctgagggaccgccaggccctaccggacggcagggcgagaaaggcgagccaggtaggcccggcgatcctgccgttgttggaccagctgttgctggaccgaagggagagaagggagatgtcgggcccgctgggcccaggggtgcaaccggggtacagggggaacgggggcctccggggctagttttgccaggggaccctggcccaaagggagacccgggcgaccgtggtcctatcggactgacgggcagagcggggccgccaggcgatagcggccctccaggagaaaagggggacccaggacgtcccggacctcccggaccggtgggcccacgaggccgtgatggagaagttggtgaaaaaggcgatgaaggcccacccggggatcccgggctccctgggaaggcaggcgagagggggctgaggggggcccccggcgtgcgtgggccagtcggggaaaagggggatcaaggcgacccaggtgaggacggacgaaatggatcccctgggagctcaggcccaaagggagatcgaggcgaaccggggcccccaggccccccaggtcgcttagttgacaccggcccgggcgccagggagaaaggcgagccaggcgaccgcggacaggagggaccacggggtccaaagggcgatccgggtctgccaggcgcccctggggaacgcggcattgaaggatttcgggggccaccgggtccccaaggtgacccaggcgtgcgtggccccgcaggcgagaagggggacagaggtccacccggattagatgggcgaagtggattggatgggaagcccggggctgcaggcccctccggcccgaacggagccgccggtaaagcgggggatcctgggcgggacggactccccggtcttagaggagagcagggcctgcccggcccgtcgggccctcctggcctgccagggaaaccaggtgaggatgggaaaccaggactgaatggaaagaacggtgaacctggcgatcccggggaggatggtaggaagggggagaagggcgactccggggcctccgggcgggaaggccgagacggtccgaaaggcgaaagaggggctcctggaatcctggggcctcaagggccaccaggactaccgggccctgtaggtccaccaggacaagggttccctggggtgcctggtggaacagggcctaagggtgataggggcgaaacgggcagcaagggcgaacaagggctgccaggcgaacgggggctaaggggcgagccagggtccgttcctaacgttgaccgtcttctcgaaaccgccggaattaaggcgagcgcactccgggaaattgtggaaacgtgggacgagagttccgggtcgtttttacccgtaccagagcgacgccggggacccaagggggactccggagaacagggcccacccggaaaggaaggcccgatcggatttcccggggagcgggggttgaagggggatcgcggggatcctggcccgcagggccccccgggactggctttaggcgagcgcggacccccggggccttccggcctggccggcgaacctggtaagccaggtatcccgggcctacccgggcgcgctggcggggtcggcgaggctgggcggccaggggaacgtggcgagcggggggagaagggtgagagaggcgagcaaggccgcgacggacccccaggactgcccggcacacccggcccgccggggccccctggtccaaaagtcagtgtggacgaacctggccccggcctgagtggcgagcaaggtcctcctggcttgaagggcgccaaaggagaacccggatctaacggagaccagggtcctaagggcgatcgcggtgtcccgggaatcaaaggcgacaggggagagccaggcccccgcggccaagacggtaatccaggcctccccggtgaaaggggtatggccgggccagaggggaaaccaggactgcagggcccccggggaccccctggaccagtaggcggtcacggcgatccaggacctcctggcgccccgggcctggccggacctgcaggtccccaggggccttccggcctcaaaggcgaacccggagagaccggcccccctggccgaggtcttacgggacctaccggcgccgtggggctgccagggccccccggaccgtctggtctcgtcggcccccagggctccccaggactgcctggccaggtgggggagactggtaaacccggagcaccaggccgcgacggtgcatcaggaaaggatggtgatagaggtagccctggtgttccaggaagtcctggcctccccggacccgtaggccccaagggggagccaggacctaccggcgctcctggccaggccgtggtcgggttgcctggcgctaaaggagaaaaaggggctcccggcggcttggccggggatctggtcggtgagcctggggcgaagggagaccgcggactcccggggcccaggggagagaaaggagaagccggacgggctggcgaacccggcgatcctggcgaggacggacagaaaggtgccccaggccccaagggctttaagggggatccaggggtgggggtgccggggagtcctggccccccgggtcccccaggcgtcaagggcgatttaggactccccggactgcctggagcaccaggagttgtgggattccctgggcagactgggccgagaggagagatggggcagcccggacctagtggggagagaggactggccgggcccccgggacgcgagggaatccccggacccttggggccacctggacctccaggctcagtggggccacctggggcaagtgggctgaaaggcgataaaggcgatcctggagtgggtctaccaggcccacgcggagagcgcggagagccagggatccggggtgaggacgggagacccgggcaggagggccctaggggccttacaggcccacctggctctcggggtgagcgcggcgagaaaggagacgtcgggagtgctggcctgaagggcgataagggggactcagccgtgatactgggtcctcctgggccgcggggtgcgaaaggggacatgggcgaacgcggcccaagaggcctagatggggacaagggccctaggggggacaacggggaccccggggacaaaggatctaagggggagcctggagataaaggttccgccggcctccccggcttacgaggccttctcggccctcagggtcagcccggcgccgcagggatccctggcgatccaggaagccctggcaaggacggcgtcccagggatccggggagagaagggcgatgttggtttcatggggccccgcggactgaaaggtgaacgcggtgtcaaaggcgcctgtggcctcgacggcgaaaaaggcgataaaggggaggccggacctcctgggcgccccggattggcaggacacaaaggcgaaatgggtgagcctggggtcccagggcagagcggtgcaccgggaaaggaggggctcatcggtccaaaaggcgacagagggttcgatggccagcctgggccaaagggggatcagggagaaaagggcgagcgtggtacccctggcattggggggttcccaggcccttccggcaacgatggctctgcaggaccaccggggcccccgggaagtgttggcccaaggggccccgaggggctgcagggacagaagggggagagggggcccccaggcgaacgggtcgtgggtgcacctggggtaccaggcgcccctggcgaaagaggagagcaaggcaggccagggcccgccggccctcgtggggagaaaggagaagctgcattgaccgaagatgacattagaggctttgttcggcaggagatgtcccagcactgtgcatgtcaaggacagttcattgcaagtggatcccgacccttaccaagctatgccgcggacacagcaggatctcagctgcatgctgtgcctgtcctgcgagtgagtcacgcagaagaggaagagagagtccccccagaagatgacgagtactctgaatactcagagtacagtgtggaggaataccaggatccggaggctccctgggattcggatgacccctgcagcctcccactggacgagggctcttgtacagcatatacccttcgctggtaccaccgggcagtcactgggagcacagaggcctgtcacccttttgtctatggaggctgtggaggcaacgcaaataggttcggaactcgggaagcatgcgagaggagatgtcctcctagagtcgtccagtctcagggaacaggaacagcgcaggat

SEQ ID NO: 9595 - DNA, 8832 bp, Artificial Sequence
  Description of Artificial Sequence: Synthetic coding sequence
atgactctgaggcttctggtggctgccctgtgcgctggcatcttggcggaggccccccgcgtgagagcgcagcatcgggagcgggtgacttgcacccggctgtacgccgccgatatagtgttccttctcgatggaagcagctccattgggcggtctaacttcagggaagtccggtcctttctcgagggactggtcctcccgttctccggcgccgcttcagcacagggagtgcggttcgccacggtgcagtactcagacgacccgcggaccgaattcgggctcgacgcactgggatctggaggcgacgtgatccgcgccatcagagaactgtcgtacaagggaggaaacacccggaccggagccgcaattttgcacgtggctgaccacgtctttctgccgcagctcgctcgcccgggagtccctaaggtctgcatcttgatcaccgatggcaaaagccaggatctggtcgatactgcggcccaaaggttgaagggccagggtgtgaagctctttgccgtgggtatcaaaaatgctgatccggaagagctcaaaagagtggctagccagccgacgtccgatttcttcttctttgtgaatgacttcagcatccttcgcactctgttgccactcgtctcccgccgggtttgcaccaccgccgggggagtgccggtcactcggcccccggacgactccacctcggctccccgggatctggtgctgtcggagccgtcctcccagtcgctccgcgtgcagtggactgcagcttcgggaccggtgacgggatacaaggtacagtacacccctttgactggccttggacaaccactgccgagcgagcggcaagaggtgaacgttccagcgggcgagactagcgttcggctgcggggactcagacccctcacggagtaccaggtgaccgtcatcgccctttatgcgaactctatcggcgaggccgtgtctggaaccgcccgcaccaccgcactggaagggccagaattgaccatccaaaacactacggcccattccctgctcgtcgcatggcggtccgtccctggagcgactggttatagagtgacctggagggttctctcaggcggaccgacgcaacagcaggaattgggaccaggacaaggatcggtgctcctccgggatctggagccgggaactgactacgaggtgactgtgagtactctctttggccggtcagtgggaccggcaacctctttgatggccaggaccgacgcatcggtggagcaaactctgcgccccgtgatcctcggcccgactagcatcctgctgagctggaatctggtccccgaagcgcgcggatacaggttggagtggcgccgtgaaacgggacttgaaccacctcaaaaagtggtcctcccttccgacgtgacccgctatcaactggacggtctgcagccgggaaccgaataccgcctgaccctgtacaccctcctggaaggccacgaagtggcgaccccggctaccgtcgtgcccactgggcctgaactgcccgtctccccggtcaccgatcttcaggccactgaactgccgggacaacgcgtgagggtgtcctggtccccagttccgggcgccacccaatatagaatcatagtcagatcaacccagggtgtggaacgcactctcgtgctgccaggctcgcagaccgccttcgacctggatgacgtccaagctggcctgtcctacactgtgcgcgtgtcagctcgggtggggccgcgcgaaggttccgcctcagtgctcactgtgagaagagagccggagactcccctcgcagtgccggggctcagagtggtggtgtccgacgccactcgcgtgcgcgtcgcttggggacctgtgcctggcgcctccggcttccgcatctcttggagcactggatccggaccagagtcgtcacagacgctgccgccggactcaaccgctaccgacatcactggactgcagccggggactacctaccaagttgccgtgtcggtcctccggggccgggaagaaggaccggcagcagtgatcgtggcccggactgatcccctcggacctgtccgcaccgttcatgtcactcaggcaagctcctcatccgtcacgatcacctggactagagtgcccggagccacgggatacagggtgagctggcactcggcccacggacccgaaaagtcacagctcgtgtcgggtgaagccaccgtggccgaactggacggactggagcctgacactgaatacaccgtgcatgtgcgcgcgcacgttgcgggtgtcgacggaccgccggcctcggtggtggtcagaaccgccccggaaccagtgggcagggtgtcccgcctccaaattcttaatgccagcagcgacgtgctgaggatcacctgggtgggagtgacgggagcgacggcctatcggctggcatgggggcgctcggagggcggaccgatgcgccatcaaatcttgccaggaaatactgattcggctgagattcgcggactggagggaggagtgtcctactcagtgcgggttacggcgctcgttggcgacagggaagggaccccggtgtcgatcgtggtgactactcctcccgaagccccgcctgccctcgggactctgcatgtcgtgcaacgcggagagcattccctccggctgaggtgggagccggtcccgcgggcccagggatttctgttgcattggcaacctgaaggtggtcaggaacagtcaagggtgctcggcccagaactctcgtcgtatcatcttgacgggctggaaccggcaactcaataccgggtgcgtctgagcgtgctgggaccggcaggcgagggcccatcggcagaagtgactgcccggaccgaatcaccgcgcgtgccttcaatcgagctgcgtgtggtcgatactagcatcgactcagtcaccctggcgtggaccccagtgtcccgggcgtcgtcgtacattctctcgtggcggcctctgagaggaccaggacaagaggtcccgggatctcctcaaacgttgccgggcatctcatcctcgcagcgggtgactggtctggaaccgggtgtgtcatacatcttctccttgactccggtgctggacggagtgagaggcccagaggcctcagtgactcaaactcctgtgtgcccgaggggactggcagatgtggttttcctgccacatgcaacgcaagacaatgcgcaccgggccgaagccactaggagagtgcttgagaggcttgtgctcgctctgggaccgctgggaccccaggctgtccaggtgggactgttgtcgtacagccaccggcctagccccctgttcccacttaatggatcacatgacttgggaattatcctgcaaagaatcagagatatgccgtacatggatccctcgggaaacaacctgggaaccgctgtggtgactgcacacagatacatgctggcacccgatgctcctggtcgcagacaacatgtcccgggagtgatggtcctcttggtggacgaaccgcttcggggagacatcttcagcccaatcagagaagcccaggcctcgggcctcaacgtggtcatgctgggaatggctggagcggaccctgaacaactccgccgcctcgcgccaggaatggatagcgtgcaaacttttttcgcggtagacgacggcccaagcctggaccaagccgtctcgggactggcaaccgcactgtgccaggcttctttcaccacccaaccgcggcccgaaccgtgcccagtctactgcccgaagggccaaaagggtgagccgggcgagatggggctgcgcggccaggtcggaccacctggggacccgggtctgcccggccggactggagcccctggaccgcagggcccgcccggatcggcaaccgccaaaggtgagcggggtttcccgggggcggatggtcggcctggaagccctggaagggcaggcaatcccggcactccgggagcgccgggtctgaaaggtagcccgggattgcctggaccgcggggagatcctggagaaagaggaccgagaggtcctaaaggagagcctggagctccgggacaagtaatcggcggcgagggtccgggactcccagggcggaagggagatcctggcccatccgggccaccgggaccgcgcggacctcttggggacccaggacctagaggacctccggggctgccaggaaccgcgatgaagggtgacaagggtgaccgcggagaacggggcccgccgggcccaggcgaaggaggaatcgccccgggagaaccgggactgccgggactgccaggatccccaggccctcaagggccggtcggtccgccgggcaagaaaggtgaaaagggcgactccgaggatggagctccaggacttccgggccagccgggatcaccgggagaacaaggcccgcgcggcccgcccggagcgatcggccctaaaggcgacagaggattcccagggcctctgggcgaagctggagaaaaaggggaaaggggaccacccggaccggccggatcgcgggggctcccgggtgtggccggcagacctggggcgaagggacccgaaggcccgcctgggccaacgggaaggcagggcgaaaagggagaaccggggcgccctggtgacccagcagtcgtcggccccgcagtggccgggccaaagggtgaaaaaggagacgtgggacccgctgggccaagaggagcgaccggagtgcaaggagaacgggggccacctggcctcgtgctcccgggggacccgggaccgaagggggaccccggagacagagggccaatcggacttactggacgggccgggccgccgggcgattcaggacctccgggcgaaaaaggagatcccggccggccgggcccgcccggaccggtgggacctcgcggacgggacggagaggtcggggaaaagggcgacgaaggacccccaggtgatccgggactcccgggcaaggccggagagcgcggtctgcggggcgccccaggagttcggggcccggtcggagagaaaggtgaccaaggagatccgggagaagatggaagaaacggatcacctggatcgtccggacctaagggcgaccgcggtgaaccaggccctccgggcccacccggacgtctggtcgataccggaccgggtgccagggagaagggtgagccgggtgatcgcgggcaagagggtcctcgcggacccaaaggggatcctggactcccaggtgctccgggtgagagaggcatcgagggctttcggggcccaccgggtccacagggagatccgggggtgcgcggacctgcgggtgagaagggcgaccgcggcccgcctggcctggacggacgaagcgggctcgacggaaaaccgggcgcagctggtccgtccggcccaaacggagccgccggaaaggctggagatccaggaagagacggactgcccggcctgaggggtgagcaaggcctgcccgggccgtcgggtcccccgggtctgccggggaagccgggggaggatggaaaaccaggtcttaacggcaagaacggcgagcctggcgacccgggcgaagatggccgtaagggagaaaaaggcgatagcggggcatcaggacgcgagggtcgggacggccctaagggtgaaaggggcgcgccgggaatactcggaccgcaggggcctccggggctcccgggcccggtcgggccgccagggcaaggatttccgggagtgccgggcggcaccgggccaaaaggggaccggggcgagactggttcaaagggcgaacagggactgccgggtgagcggggattgaggggtgaaccaggatcggtgccgaacgtggacaggttgctggagacggcgggaatcaaggcctccgcactgcgggaaatcgtggaaacctgggacgaatcctcgggatcgttcctcccagtcccggagcgcagaagaggaccgaagggtgattccggagagcagggtcctccagggaaggaaggtccgattgggtttcctggagagcgggggcttaagggtgataggggtgatccaggccctcagggcccgccaggactggccctcggagaacgcggaccgcccggtcctagcggcctggcaggagagcccggaaagccgggcatcccgggactcccaggacgggcaggcggcgttggcgaggccgggcgcccgggagagcgaggcgaacggggagaaaagggggaaagaggagagcagggaagagatgggcccccggggttgcctggaaccccaggaccaccgggaccacctggtcctaaagtgagtgtggacgaaccaggtccgggcctttcaggagagcaaggaccacccgggctgaagggggccaagggagaaccaggctcgaacggggaccaggggccaaagggagatcgcggagttccaggaatcaaaggggaccgcggcgaacccggcccaagaggacaggacggtaacccgggcctgcccggtgaacggggcatggcgggacccgaagggaaaccgggactccagggcccgcgcggaccgcctggaccggtgggtggacacggtgaccccggcccacccggcgcaccgggattggccggtccggccggaccgcaggggcctagcgggctgaagggagagcctggtgaaactggtccacccgggcggggattgactggacctaccggggccgtgggcctccctggtccgccgggaccgagtggattggtaggaccgcagggatccccggggctgccgggacaggtgggagagactgggaagccaggagcaccaggacgcgacggggccagcggcaaagatggagatagaggtagccctggtgtccccggaagtccgggcctgccgggcccagtcggaccgaagggggaaccggggccgaccggggcaccgggccaggcggtcgtgggcctgccaggtgcaaagggagaaaagggcgcacctggcggtctggccggtgacctggtgggcgaaccaggagccaaaggagacagagggctcccgggaccacgcggagagaaaggcgaggcgggccgcgcgggcgaacctggggacccaggtgaggacggacagaaaggagcaccgggcccgaagggattcaagggagatccaggggtgggagtgccggggagcccgggacctccgggaccgccaggagtcaaaggagatctgggactgcccggactgcccggagcaccgggtgtggtgggattccctggtcagactgggccgcgcggagaaatggggcagcccggcccgagcggggaacgtggcctcgccggacctccaggtcgcgaagggatcccgggcccgttgggcccgccaggaccacctggatcggttggacccccgggggcctccggactgaagggcgacaagggtgatccgggcgtcggtctgcctggtccgcggggtgaacgcggggagcccggtattagaggagaagatggaaggcccggccaggaaggacctagaggtctgaccggacctcctggatctcgaggggaacggggtgagaaaggcgatgtgggctcagcgggacttaagggagataagggagattcagctgtgattctgggaccgccaggcccgcgcggtgcgaagggggacatgggagaacgagggcctcgggggcttgatggtgataaaggtccgaggggagacaatggtgatcctggtgacaaaggctcgaagggggagccaggagacaagggctccgccggtctgccggggctgcgtggtttgctcgggccacagggacagccgggcgcggctggaattccaggcgatccgggcagcccagggaaagacggagtgccgggaataagaggagaaaagggagatgtgggattcatgggaccacgaggactgaagggcgagcggggagtgaagggagcctgcggtcttgacggggaaaagggagataagggggaggccggaccacctggccgcccaggactggctggacataagggtgaaatgggagagccaggagtcccgggccaatccggagctccgggaaaggaagggctcatcggacccaagggagatagaggattcgacgggcagccaggaccaaagggtgatcagggcgaaaagggagagagaggcactccaggaatcggcgggtttcctggaccgagcggcaatgacggctccgccggccctcctggacctccaggctccgtgggaccgagaggaccggagggactgcaaggccagaagggagagcggggtcccccgggtgagagggtcgttggcgctcctggagtgcccggcgccccgggcgaacggggcgagcagggcagaccgggcccggcgggcccaagaggagagaagggggaagctgccctgactgaggacgatatccgcggattcgtgcgccaagaaatgtctcagcactgcgcctgccagggccagtttattgcttcgggatcacgcccgctgccctcctacgcggccgatacggctggatcccagctgcacgccgtcccagtcctgagagtttcgcacgctgaggaagaagagcgggtgcccccggaggacgacgagtactccgagtacagcgagtactcagttgaggagtaccaggatccagaagccccctgggactcggacgatccctgcagcctgccgctggacgaagggagctgcactgcttacaccctgaggtggtaccaccgtgccgtgactggctccacggaggcgtgccacccgttcgtttacggtggatgtggcggaaacgccaaccggttcgggactagagaggcttgtgagcgccggtgtccaccgcgggtggtgcaatcgcagggcaccggcactgcgcaggat

SEQ ID NO: 9596 - DNA, 8832 bp, Artificial Sequence
  Description of Artificial Sequence: Synthetic coding sequence
atgacgctacgattgctcgtggccgccttgtgcgccgggattcttgccgaagcgcccagagtacgtgctcagcaccgcgagcgcgtcacctgcactcggctctacgccgctgatattgtgtttctgcttgacggcagctcttctatcggtaggtcgaactttcgcgaggtgaggtccttcttggagggccttgtcctacccttctcaggcgccgcaagtgcccagggggttagatttgctactgttcagtacagcgatgatccacgaactgagttcggtttggacgcgttggggagcgggggtgacgtgatcagggccattcgcgaactgtcttataagggaggcaataccagaaccggggctgccatcttacatgtagcggaccatgtgttcctgccccagctagctaggcccggtgtgccgaaggtgtgtatcctgataactgatggcaaatcacaggacctggtcgacaccgccgcccagaggctcaagggccagggtgtgaagctattcgccgtaggcattaagaatgccgatcctgaagagctgaagcgggtcgctagccaaccgacctcagacttctttttctttgtcaacgatttctcgattctgcgcacactgctgcccctcgtctctagacgtgtctgtactacagccgggggggtgccagtcactaggccacccgacgactccacaagcgcccccagggaccttgtcctcagcgaaccctctagtcaatccctaagggttcagtggactgccgcctccggccccgtcaccggatataaggtgcagtacacaccactgacagggttgggacaacccctgccaagtgagcgccaagaggtgaacgtgccagcaggcgaaacctccgtgcgactcagaggactccgcccactgacagaataccaggtgaccgtcatcgccctgtacgccaactcgatcggggaggctgtctcagggacggccagaacaacagccttagaaggccccgagctgaccatccagaataccaccgcccactctctgctcgtcgcatggaggtctgtgcccggagctacggggtacagagtcacctggagggtcttgtccggtgggccgactcaacaacaggagctgggtccgggacagggatctgtgttgcttagggatctggaacctggcacagattatgaggtgaccgtgtccactctttttggcaggagcgtcggaccagcaacgagcttgatggccaggactgacgcttcagtagagcagacactgcgacctgtgatcttgggacccacttcaatcttgctgagctggaacctcgttcctgaagcaagaggttatagactggaatggcgccgggaaaccggtctcgagcctccacagaaggtggtactcccttctgatgtgacaaggtatcagctggacggactgcagcccggtacagaatatcgactcactctgtatacactgctcgagggacatgaggtagccacccctgcaacggtcgtgccaaccggacccgagctgccagtctcacctgttacagaccttcaagccaccgaactgcctgggcagcgcgtgcgagtcagttggtcacccgttccaggcgccactcaatatcggataatcgttaggtccactcagggagtggagcggacattagtgcttcccgggtctcagacagcgttcgatcttgatgatgtgcaggcgggtttgagctataccgtgagggtgtctgcccgggtgggtcccagggagggctccgctagtgtgcttactgtaagaagagagccggagactcctctggctgtgccaggactccgcgtcgttgttagtgacgccactagggttcgggtcgcctggggaccagtccccggggcctctgggttccgaatctcctggtccacgggatcaggacctgaaagttcccagacgctgccgcccgattccacagccaccgatatcacaggtctccagcctgggaccacttatcaagtggctgtttctgtgctccggggacgcgaggagggcccggcagccgttatcgtagccagaactgatcctttgggcccagtgcgaacagtgcatgtcacccaggctagcagctcctcagttactataacctggacacgcgtgccaggtgctaccggctatagggtttcttggcattccgcgcatggacccgagaaatctcagctggtttcaggcgaggccacagtggcagaactggacggactggagcccgataccgagtataccgtacacgtgcgggcgcacgtggccggggtggatggtccccccgcatctgtggtagtcaggacagcacctgaacccgttggacgtgtgagcagattgcagattttgaacgcttcctccgatgtgcttcgcatcacctgggtaggcgtgactggagcaacagcctatcggcttgcatggggcagatcggaaggaggtcccatgcgccaccagattctgcctggcaataccgactctgccgagatacgaggactggaggggggggtatcctacagtgtgcgggtcacggcacttgttggagaccgggaaggcactccggtttcaatagtagttaccactcccccagaagctcctcctgccctgggaacacttcacgttgtccagaggggcgaacattcgctgcgtctccgctgggagccagtgcctagagcacaggggttcctgctgcactggcaaccagagggtgggcaggaacagtcacgagtgttggggcctgagttatcgagctaccacctggatggtttggaacccgctactcaatatcgagtccggttatcagtccttggccccgccggcgagggaccgtctgcggaggtgacagccagaacagaatctccgcgtgtcccctcgatcgaactgcgggtggtggacacttctattgattccgtgacattggcatggactccggtatcaagggcttcttcatatattctgtcgtggagacccctgcgcgggcctggacaagaggttcccggatctccacagaccctgcccggaatcagctcttcgcagcgagtcactggactggaacccggtgtgagctacatcttcagcctgaccccggtgttggatggcgtgcgaggcccagaggcgtctgtgactcagacccccgtctgtccccgcggtcttgccgatgtcgtctttctcccgcatgcgacacaagataatgctcatcgcgctgaagccactcgacgggtactcgaacgcctggtcttggcattgggaccccttggcccgcaggccgtgcaggtaggcctgttatcatatagccataggccatcacccctgttcccactgaacggttcgcacgaccttggtataattttacagagaattagggacatgccttacatggatccctccggaaacaacctggggacagctgtagtgacagcccaccggtacatgcttgcacctgacgcccctggcaggagacagcatgtgcccggtgtcatggtgctgctggttgatgaaccactgcggggcgacatctttagccctatccgagaagcacaagcctcaggtctgaatgtagtcatgctaggcatggccggggccgatcctgagcagcttcgaagactcgccccggggatggacagtgtgcagacctttttcgcagtcgacgacgggccttccctggaccaagctgtgtcagggctcgcgacagccttatgtcaggcatcttttacaacacagccgagacctgagccatgtcccgtttattgtccaaaaggccagaagggcgagcccggtgaaatggggctaagaggacaggtggggccccctggtgaccctggattgccggggagaacaggcgcacccgggccgcaggggcccccaggtagtgcaaccgccaagggggaaagaggattccccggcgccgacggcagaccaggatctccggggagagcgggcaatcccgggactccgggggcccctggccttaaggggagccctggcctccctgggcctaggggagatcctggtgagcggggccctagaggaccgaagggggaacccggagccccaggtcaggtcatcggaggcgagggccccggattacccggtagaaagggagatccaggtccttccggcccgcctggcccaagagggccgctgggggaccccggcccacgcggtccacccggcttgccaggcactgcgatgaaaggcgataagggggaccgcggggaaaggggtcccccggggcccggagaggggggtatcgccccaggggaaccaggcttgcccggattgcctggatcccccggcccacagggacccgtgggccccccagggaagaaaggagaaaagggggatagtgaggatggggcaccagggctgcccggacagcccggtagtcccggagaacagggtccaagaggccctcccggggcaattggaccgaaaggtgatagagggttcccagggcctttgggcgaggccggtgaaaagggggagcggggcccccccgggccagcaggaagtcgcggcctgcctggcgtggctgggaggcccggcgcaaagggtcccgaaggacccccaggcccgaccggaaggcagggtgaaaagggagagcctgggagaccgggtgaccctgcggtggtggggcccgcagtcgccggccctaaaggcgagaagggtgatgtggggcctgctggacctcgaggcgcgactggtgttcagggtgaacgcgggccacctgggcttgttctgccgggagatcctgggcctaagggcgacccaggagatcggggtcccatagggctcaccggccgagccggtcccccaggcgattctggacctccaggagaaaagggcgaccccgggaggccgggaccgcctgggccagtgggccctagaggccgcgacggggaggtgggcgaaaagggggacgaaggacctccaggtgatccgggattgcccggcaaagcaggcgagagagggttgagaggcgcacccggcgtacgtggccccgttggtgagaagggtgatcagggcgacccaggggaggatgggaggaacgggagcccaggctcaagtggccctaagggcgaccgaggggaaccaggcccaccgggtccacccggcagactcgtcgacaccgggccaggcgcgcgggagaaaggtgagcccggcgatcgaggtcaagagggacctcgtggccctaagggcgatcccggcctccctggggcacctggcgaacggggtatagagggcttccgcggcccgccgggccctcagggtgatcccggagtccgtggccctgctggtgagaagggggaccggggaccacccggccttgacgggcgcagtggcctggacggaaagcccggggcagctggacctagcggacccaatggagctgcggggaaagccggagacccaggcagagacggtcttccagggcttcgcggggaacagggtctgcctggcccgagcggacccccgggtctacccggcaaacccggggaggatgggaaaccaggtctgaatgggaaaaacggagaacccggagatcccggagaggatggtcgcaagggcgagaagggcgatagcggggcctcgggtcgcgaaggtagggacgggccgaaaggggagcggggggcccccggcatcctcggtccccaaggaccacctgggctgcccggacctgtcggcccccctggacagggatttccaggcgttccgggagggaccggaccaaaaggcgacaggggggagaccggctcgaagggcgagcaaggactgccaggagagaggggcctgaggggggaacctggctcggtgccgaacgtcgatagactgctcgagactgcaggcataaaggctagtgcactgagagagattgtagaaacctgggatgaatcatccgggtcttttttgcctgtgcccgagcggagacgggggcccaaaggggatagcggtgagcagggccctcctggcaaggaagggccgattggctttcctggagagaggggcctgaagggggaccggggcgatcctggaccccagggtccccccggactcgctctgggagaacggggccctccaggaccctctggacttgcaggcgagccgggcaaaccagggatccctggcctccctgggagggccgggggagttggggaagccggacgacctggcgaacgcggtgagcgcggtgagaagggcgaacgtggcgagcaaggccgcgacgggccacctgggttgccagggactcccggcccaccaggcccccccggaccgaaggtgtccgtggacgagccaggacctgggctgagcggagagcaggggcctcctgggctcaaaggagctaagggagaaccaggctccaacggagaccaagggcccaaaggagatcggggtgtgcctggcattaaaggcgatcgcggcgagccgggaccccgtggccaggacggcaatccgggcctgcccggtgaacgcggcatggcgggaccagagggaaaacctggcctgcagggcccaagggggccacccggccccgtgggagggcacggtgatccaggcccacctggagcgccgggactggctgggcccgcgggcccccagggtccgtcggggctgaaaggagaacctggcgagacggggccgcccggcaggggcttaacaggaccgactggtgcagtaggtttaccagggccccctggcccttccggccttgttggccctcagggtagccccggacttccaggacaggtaggggaaactggaaaaccgggggccccgggtagggatggggcgagcggaaaagacggtgataggggatcaccaggcgtgcccggctcccccgggctgcccggtcccgtggggcccaaaggggaacctggtccaacgggcgccccagggcaggccgtagtcggcctccccggggccaagggagagaagggcgctcctgggggcctggccggggacctggtgggggaacctggggccaagggcgatcggggattgcctggaccaagaggtgagaagggcgaagccgggagggctggggaacccggagatcccggtgaggacgggcagaaaggcgcccctgggccaaagggttttaagggggacccgggagtcggggttccaggcagccccggccccccggggccacccggtgtgaagggggatctgggtctgcccggattgcccggcgcacctggagttgtaggctttccaggccagactggacccagaggcgaaatggggcagcctggcccgagcggcgagagaggcctggcgggtccgccggggagggaaggtatacctggaccactgggcccgcctggtcccccggggagcgtggggccacccggggcgtctggtctgaagggagacaagggcgaccccggtgtgggcctaccaggtcccaggggagagaggggggagcccgggatcaggggggaggatgggaggcccggccaggaagggccccgcgggctgactggacctcccggtagcagaggagaaagaggtgaaaaaggtgatgtaggatccgctggtttgaagggagacaagggcgattcagctgtgattctggggccaccgggcccaagaggcgcaaagggcgacatgggtgaacggggtccccgcggcttggacggggacaaagggcctaggggagacaatggtgaccccggtgataagggtagtaagggcgagcctggggacaaggggtctgcaggtctaccaggacttcggggactcttaggcccccaaggacagccaggagcagctggaattcccggtgaccccggctcccccggcaaagacggcgtgcccggcattcgcggggagaagggcgatgtggggttcatgggcccacgaggcctgaagggcgagcgcggagtgaagggagcctgcggattagatggggaaaagggagataaaggcgaggcgggccctcccggacgacctgggttagccggccacaaaggggaaatgggcgagccaggggtccctggacaatcaggcgctcccggcaaagagggtctaattggaccaaaaggtgatcgggggttcgacggccagccgggacctaagggtgaccagggagagaagggggagcgtggcactccaggcatcggaggcttccctggtccctccggcaatgatggatcggcaggccctccagggcctcccggttccgtcggaccgcgaggacctgaggggctgcagggacaaaagggagaacgggggccacctggggagagagtggttggcgcccccggcgtgcccggcgccccaggcgaacgtggtgaacaggggaggcctgggccagcaggaccaaggggcgagaaaggagaggctgccttaaccgaagacgatattcggggttttgtaagacaggagatgtctcagcactgcgcgtgtcagggccagttcattgcctctggctcacggcccctgccaagctacgcggccgatacagcgggctcccagctgcacgcggtgccggtccttagggtaagccacgctgaggaggaagaacgggtcccaccagaggacgacgagtattctgaatactcagaatattccgtcgaggaataccaggatcctgaggccccatgggatagcgatgatccctgttccttgccactagacgaagggtcatgtacagcttacaccctgaggtggtatcaccgggctgtgaccggcagcacagaagcatgtcacccatttgtgtacggcggatgcggggggaatgccaataggtttggcactagagaggcttgcgagcgaaggtgtcccccacgggtggttcagtcgcaaggaaccggtacggctcaggac

SEQ ID NO: 9597 - DNA, 8832 bp, Artificial Sequence
  Description of Artificial Sequence: Synthetic coding sequence
atgactctgcgtctgcttgtcgcagcactgtgtgcaggcatactggctgaagcgccgagagtgcgcgcacaacatcgggaacgtgtgacttgtacccgcctgtacgcagccgacatcgtgtttctcctcgatggatcatcgagcatcggacgctccaactttagagaagtgcggtcatttctggaaggattggtgcttcctttttccggagcagcctcagcccagggagtgagatttgcaactgtgcaatattccgatgatccacgcaccgaatttgggctcgatgcacttggatccggtggtgatgttatccgagccattagggaattgtcctacaagggcggcaacacccgtacgggagcagcaattctgcacgtcgccgatcacgtattcctcccccaacttgcaaggcctggagtgcctaaggtgtgtatcctgattaccgacggaaagtcccaggatctggtggataccgccgcacaaagacttaagggtcagggagttaagctgttcgccgtgggcatcaaaaatgctgaccctgaagaactcaaacgcgtggcgtcccagccgacctccgatttcttcttttttgtgaacgattttagcattctgaggactcttctgccacttgtcagtagacgtgtctgcaccactgctggaggagtcccagtcactagaccgccggacgattcgacgagcgcccctagagacttggtcctgtccgaaccctcttcgcagtccctgagggtgcagtggactgcagccagcggtccagtgaccggctacaaggtgcaatacactcctctgactggcctcggccagcctctgccgtccgaacgtcaagaagtcaatgtcccagctggtgaaacctcggtgcgccttcgcggtctgcgccctcttaccgaataccaggtgactgtcatcgcactttatgcaaactccataggcgaggcagtgtcagggactgcgcgcacgaccgcacttgaagggccggaacttactatccaaaacacgacggcccattcgctgctcgttgcatggcgctcggtgcctggcgcgactgggtaccgagtcacctggcgggtgctgtcgggcggtccaacccaacaacaggaattgggacccggtcaaggcagcgtcttgcttagggatcttgaacctggaacggactacgaagtgactgtctcaaccctcttcggtcgttccgtgggccccgcaacctcgcttatggcccggaccgacgcatcggtggagcagaccctccggcccgtgattctgggccctactagcattctgctttcctggaacttggtgccagaggcgaggggatacaggctggagtggcggcgggaaaccggtctggagcctcctcaaaaagtggtgctgccatcagacgtgacccgataccagctggacgggcttcaacccggtactgagtacagactgacgctttacaccctgttggaaggacatgaagtggcgactccagcgaccgtggtgccaaccggacctgaattgccagtcagccctgtgaccgatctgcaagcaaccgagcttccggggcaacgtgtccgggtgagctggtcgccagtcccaggggcaactcagtaccgaattatcgtgcgttcgactcagggagtggagcggactcttgttctgccagggtcacaaacggcctttgatcttgacgacgtccaagcaggactctcctacactgtgcgggtgagtgcaagagtgggacctagagaaggatccgcttcggtgcttacggtgcggcgggaaccagaaactcctctggcagtcccaggcctgcgggtggtggtgtcggacgcaaccagggtgagggtggcatggggaccagttcccggggcatcaggctttcgtatttcctggtcaaccggttcaggtccagaatcatcacaaacccttccaccagactcgaccgccactgatataacgggactgcagcctggtactacctaccaagtggccgtgagcgtgctgagaggaagagaggaaggtcctgctgcagttattgtcgcgcgtacggatccattgggaccagtgagaaccgtgcatgtgacccaggcgtcgtcatccagcgtgactatcacctggactagagtgccaggagccacgggttaccgcgtcagctggcattcggcgcatggacccgagaagtcgcaacttgtcagcggggaggccactgtggccgagctggatggacttgaacctgatactgagtataccgtgcacgtgcgagcccacgtggcaggcgtggatggtccaccagcgagcgtggtggtcagaactgcaccggaaccagtcggtcgtgtgtcgcggctgcagatccttaatgcgtcctcggacgtgctgcggattacctgggtcggtgtcaccggagcaactgcataccggctcgcatggggccgatccgaaggaggtccgatgcgtcaccagattctgccaggaaacaccgattctgcagaaattcggggacttgaaggaggagtttcctactccgtcagagtgacggcattggtcggcgatcgtgaaggaactccagtgtctatcgtggtgactactccgccggaggcaccgcctgcactggggactctccatgtggtgcagcggggggaacatagccttagactccgatgggagccagtgccgagagcacaaggatttctcttgcactggcagcctgagggtggtcaggaacaatcccgcgtgcttggtccagaactttcgtcctaccacctggatggccttgaacctgcaactcagtaccgagtgcggctttccgtgcttgggcctgcaggtgaaggaccttcggcagaggtcaccgcccggactgagtcgcctagagtgccatcaatcgagctccgagtcgtcgatactagcatcgactccgtgaccttggcatggacccctgtcagcagggcatcgtcttacatcctttcatggcgtccccttagaggtcctggccaagaagtcccgggaagccctcagactctccctggaatctcatcgtcacaacgcgtgaccggactggaacctggtgtcagctacattttcagccttaccccagtccttgacggagtgcgcggacccgaagctagcgttacccagacccctgtgtgcccgagaggtcttgcagacgtggtgttcctcccccatgcaacccaagataacgcccatagagcggaagccacgagacgcgtcttggaacggctcgtgctggcactcggtcctctcgggccccaggcagtgcaagtgggacttctgagctacagccatagaccctccccgctgtttcccttgaacggatcccatgatctgggcatcatcctccaaaggattcgggacatgccatacatggatccttcggggaacaacttgggtactgccgtggtcactgcccaccgctacatgctcgcccctgatgcacctggccgacgacagcatgtgcctggagtgatggtccttctcgtcgatgaaccgctgcggggtgacattttctcaccaatccgggaagcacaggcatcgggtctgaacgtggtgatgcttgggatggccggcgcggaccctgaacaactgagacggctggcacccggcatggatagcgtccagacttttttcgccgtggatgatggtccgtcccttgaccaggccgtctcgggtttggcaaccgcgctgtgtcaggcctcgttcaccacccaacctcgtcccgaaccttgtccggtgtactgtcctaagggccaaaagggggaacctggtgagatgggtcttagaggccaagtcggacctccaggtgatccaggattgcccggtagaacgggagcccctggcccacagggacctcctggatcagcgaccgcaaagggcgagaggggctttcctggagcagatggccgacctggttcacctggtagagcaggcaacccggggactccaggcgcgcctggtcttaaggggagccccggacttcccggcccaaggggtgatccaggggagaggggtcctcgcggtccaaaaggagaaccaggggcaccaggccaagtcattggaggggaagggcccgggctcccgggtcgcaagggcgatcctggtccctctgggccacccggtccaaggggccctctgggtgaccccgggcctcgcggccctcctggactgccaggaacggcaatgaagggtgataaaggggatcgcggtgaacgtggtccacccggacctggagaaggaggaatagcacccggagaaccgggcttgccagggctgccgggttctcctggacctcaaggccctgtcggtccccctggaaagaagggagaaaaaggggattccgaggatggagcacctggacttccgggtcagcctggctcaccgggcgagcaggggccccgcggtccaccgggagcaataggacccaagggtgaccgcggatttcctggtccgttgggtgaagctggggagaagggtgagaggggacctccaggtcctgcaggttcccggggactgccgggtgtcgccggcaggccaggcgcaaagggaccagagggtcctccgggccccaccggacgacagggagagaagggggaaccaggacgtccaggtgatccggcagtggtgggtcctgccgtggcaggacctaagggggagaagggagacgtggggccggcaggaccaagaggagcaaccggcgttcagggcgagagaggaccacctggcctcgtgctgcctggggatccaggtcccaaaggagatccaggggatagaggtcccattggactcaccgggagagcaggccctccaggagattcgggtccaccgggagagaagggcgatcccgggcggcccggtccaccagggcccgtggggccgagggggagagacggagaggtgggtgaaaagggagatgaaggccccccaggagatccaggactccccggaaaggccggggagcgaggacttcggggtgcccccggggtcagaggcccggtgggagaaaaaggtgaccagggagatcctggagaagatggcaggaatggctcaccaggaagctcgggaccaaaaggtgaccgcggagaaccaggacctcccggtcctcctggtaggctggtggataccggtcccggtgcgcgggaaaaaggcgagccgggtgacagaggtcaagaaggcccacggggacccaagggtgaccccggtctgcctggtgccccgggcgagaggggaatcgagggttttcgcggccctccggggccacagggtgatcctggagtccgaggccctgcaggggaaaaaggcgaccgggggccaccgggattggacggacggtcgggactggatggtaagcctggggcagcaggacctagcggccctaatggagcagccggcaaggccggagatccgggtagagatggactccctggactgcggggtgaacaggggctccctgggccatcgggtccgcctgggcttccaggcaagcctggagaagatggaaagccagggctcaacggcaagaacggagaaccaggcgaccctggcgaggatggaaggaagggggaaaagggcgattcaggagcatcgggcagagaaggcagagatggacctaagggagaaagaggagcacctggtatactgggccctcaaggaccccctggtctgccaggtcccgtggggccaccaggacagggattccctggagtgcccggtggcaccggaccaaaaggggaccgcggtgaaaccggatccaaaggagagcagggactcccaggagaaagaggactgagaggagaacctggttcagtgcccaacgtggataggcttcttgaaactgccggtattaaggccagcgcccttcgcgagattgtcgaaacctgggacgaatcctccggatcctttctccccgtacctgaacgcagaagaggtccaaagggtgattccggagagcaaggcccacctggcaaggagggaccaattgggttcccaggtgaacgaggacttaaaggtgacagaggggatccgggaccacagggacctcctgggctggcattgggggaaagaggacctcctggcccctcggggcttgcaggagagccgggaaagcctggaatcccagggctccctgggagagcaggaggggtgggtgaagcggggaggcccggtgagagaggggagagaggcgaaaagggagaaagaggtgaacaaggacgggacggaccacctgggctgccaggcactcctggaccacccggtccccccggacctaaggtgtcagtcgatgaacctggacccgggctctccggggaacagggtcctccaggcctgaagggagcaaagggtgagccgggatcgaatggcgaccagggtcctaaaggggatagaggtgtgccaggcattaagggtgatcggggggaaccaggaccaagaggacaggacggaaacccagggctcccaggagagagaggaatggcaggtcctgaaggaaagccaggtttgcaaggtcctcggggaccccccggacctgtgggcggtcatggagatccaggcccacccggtgcacccggactggcaggccccgcaggaccccaggggccttcaggactcaaaggggaaccaggtgaaactggaccaccagggagaggtctgactggtcccacgggagcagtcggacttcctggtcctcccggcccttccgggctggtgggaccgcaaggaagcccagggctgcctggccaagtcggagagactggaaagcctggtgccccaggtagagatggagcaagcggaaaggatggagacagaggttcaccaggagtgccaggatcgcctggtctgcccggaccagtgggtcctaaaggtgagcctggtcctaccggggcgcccggtcaggccgtggtgggacttccaggcgcaaaaggagaaaagggcgccccagggggtttggcaggtgatctggtcggagaaccaggagcaaagggagatcgcggattgcccggcccacgcggcgaaaaaggagaagccggacgagctggcgagcccggggaccctggggaagatggacaaaaaggtgcacctgggccaaagggatttaagggcgatcctggggtgggcgtgcctggctctcccggccctcccggtcctccgggagtgaagggtgatctgggtttgccaggactgccaggagcccccggtgtggtgggctttccaggccaaaccggacctagaggtgaaatgggtcagccgggaccttcgggagagcgaggcctggcgggaccgcctggtagggaagggatacctggcccccttggaccacctggccccccggggagcgtgggcccaccgggtgcctccgggctgaagggagacaaaggagatcccggagtgggtttgccaggccctcgtggcgagagaggagaacccggaatcagaggggaggatggaaggccagggcaggaaggtcctcgaggacttacgggaccgcctggcagccggggcgaaagaggtgagaaaggagacgttggctcagcaggactgaaaggagataaaggggattccgcagtcatcctcggacctcccggtcctcgaggtgcaaagggtgatatgggtgaaagaggtcctcgcgggctggacggagacaagggtccccggggagataacggcgacccgggcgataagggctccaaaggggaacccggtgataaaggatcagctggtttgcccggtctgcggggtctgttgggcccgcaaggtcaacccggagcagcgggcataccaggcgaccctggctcacctggcaaggatggtgtgcccggaattcgaggggagaagggggatgtgggattcatgggaccacgcggcctcaagggagaaagaggagtaaagggagcgtgcggccttgacggagaaaaaggggataaaggagaggccgggccaccgggtcgtcccggcctcgcggggcataagggggagatgggagaacctggagtccctggacaatccggagcaccgggaaaggaaggccttattggtcccaaaggagatagaggcttcgacggtcagcccggacctaaaggggaccagggtgagaagggagaacgcgggactccaggaattggtggatttcctggtccctcaggaaatgatggttctgccggtcctccagggccacctggttctgtgggacctagaggaccagaaggacttcagggtcagaagggtgagcgcggtcctcctggcgagcgggtcgtgggtgcccccggagtccccggtgcacctggagagcgtggagaacaaggacgccctggacccgccggtccaaggggtgaaaagggcgaagcggcgctcactgaagatgatattcggggatttgtgcgccaggaaatgtcgcagcactgtgcatgtcagggacagttcatcgcctccggaagccggccacttccaagctacgcggcagacaccgccggttcccaattgcacgcagtgcccgtgcttcgcgtctcccacgcggaggaagaagaacgggtgcctcctgaagatgatgagtattccgaatactcagagtactccgtggaagaataccaagatccggaagcaccatgggattcagacgacccttgttccctgccgttggatgagggttcgtgcactgcatacacgctgcggtggtaccacagagccgtgaccggttccaccgaagcatgccacccatttgtgtacggtggatgcggcgggaacgcgaaccgatttggaactagagaagcatgcgaaagacgctgccctccacgcgtcgtgcaatcccaaggtaccggtacggcacaagac

SEQ ID NO: 9598 - DNA, 8832 bp, Artificial Sequence
  Description of Artificial Sequence: Synthetic coding sequence
atgacgctccggctgcttgtggccgcactgtgcgccgggatcctggcagaggctcctcgggtccgggcgcaacatcgggaacgggtgacttgtacgagactctacgcggctgacatcgtgtttctgttggacggttcctcgtcgatcgggcggtccaacttcagggaggtccggtccttcctcgaggggctggtgctgcctttcagcggcgcagcctccgcccagggagtccgctttgccaccgtgcagtacagcgacgatccaagaaccgaattcggacttgatgccctgggatcaggaggggacgtcattagagcgatccgggagctctcgtacaaaggaggaaacactagaaccggagctgcgattctgcacgtggccgaccatgtctttctgccacagttggcccggccgggagtgccgaaggtgtgtattctcattaccgacggaaagtcacaggacctggtggacaccgccgctcaacgactgaagggacaaggagttaagctgttcgcggtgggtatcaaaaacgcggacccggaggaactgaagagggtggccagccagccaacgtcggatttcttcttctttgtcaacgacttttccattttgcgcactctgctgccgttggtgtcgagacgtgtctgcaccaccgcaggaggagtgccggtcacgaggccaccggacgattcgacttctgcaccgcgtgacctggtgttgtcggaaccatcgtcccaatccctcagagtgcagtggactgccgcatcggggccagtgaccggctacaaggtgcagtacactccgctcaccgggctgggccagccactgccgtcggaacggcaagaagtgaacgtcccggccggagaaaccagcgtgcggttgcgcggactgcggccgctgaccgagtaccaagtcaccgtgatcgccttgtacgcaaattctatcggagaagctgtctccggtaccgcacgcaccaccgccctggagggaccagagctgaccattcagaatacgacggcccactcactgttggtggcgtggcgctcggtgccgggcgcaacggggtatcgggtgacgtggagggtgctgtccggcggcccaactcaacaacaagaactcggaccaggacagggctccgtgctgctgagagatctggaaccggggaccgattacgaggtgaccgtctcgaccttgtttgggcgctccgtcggcccagccacgtcgctcatggcccgcaccgacgccagtgtcgaacaaaccctgcgccctgtgatcctgggacccacctcaatcctgctttcttggaacctcgtgcccgaggccagaggataccgcctcgaatggcggcgggaaaccggacttgagccaccacagaaagtagtcttgccgtcagatgtgactcgctaccagctcgatggactgcagccgggcactgagtacagactcactttgtacacccttctcgaagggcacgaagtggcgacgccggccaccgtcgtgcctactggaccggaactgccggtgtcaccagtgactgatctgcaagccactgaactcccaggtcagcgagtgagagtgagctggtcaccggtgccgggagcaactcagtaccgcatcatcgtgcggtccacccagggagtggagcggaccctcgtgctgccgggatcgcagactgcattcgacctggacgacgtgcaggcagggctctcttacaccgtgcgagtctcagcccgagtgggccctcgcgaaggaagcgcatccgtgctgaccgtgcgcagggagccggaaaccccgctcgcggtgccagggctgcgggtggtggtgtcggacgcgactagggttagggtggcatgggggccagtgccaggagcgagcggttttagaatcagctggtctacgggatccggaccggaatcgagccaaaccttgccgcctgattcgaccgccactgacattactgggctccagccaggcactacctaccaggtcgcagtttccgtgctgcggggccgggaagagggaccggcggccgtgatcgtcgcgcggactgacccgctggggcctgtgcggacggtgcatgtgacccaggcgagcagctcctcagttactatcacgtggacgcgggtcccgggcgccactggataccgcgtgtcctggcattcggcccatggaccggagaagtcccagcttgtgtcaggagaggccactgtagctgagttggatggcctcgagccggacaccgaatacaccgtgcacgtgcgcgcccatgttgcaggagtcgacggaccaccggcgtccgtcgtggtgcgtaccgccccggaaccagtgggacgcgtgagccgcctccagatcctcaacgcatcttcagacgtgctgcgcatcacctgggtcggagtgacgggagcgactgcatacagattggcttggggtcggtcggaagggggaccgatgcggcaccagatcctgccgggcaacaccgatagcgctgaaatcagaggcctggagggaggcgtaagctactccgtgagagtgaccgctctggtaggcgatcgggaaggaaccccggtgagcatcgtcgtgacgacccctccggaagcgccgccggcactcggaaccctgcacgtggtgcagcgcggggagcacagcctgcggcttcggtgggagccggtgccgagggctcaaggatttctgctccactggcagccggaagggggacaagaacagtcgagggtcctcggcccagaactgagctcgtatcatctggatggactggaacctgcaactcaataccgtgtgagactgtccgtcctgggtcctgccggggaaggcccgtccgcggaagtgaccgcgaggaccgaatcacctagagtgccctccattgagctccgggttgtggacaccagcatcgattccgtgactctggcctggactccagtctcacgcgcctcctcgtacatcctctcgtggcgcccgcttcgcggcccgggccaggaagtcccaggctcgccgcagaccctcccaggcatctcctcgtcacagcgcgtgactggcctggagccgggagtgtcgtacattttctccctcactcccgtgctggacggggtgcggggcccagaggcctcggtcacgcaaaccccagtgtgccctagggggctcgccgacgtggtgttcctgccacacgcgacccaggacaatgcgcacagggctgaagcaactcggcgcgtgctggagaggctggtgctcgccttgggcccactgggaccgcaagctgtccaggtggggctcctttcttacagccatcgcccgtcccctctgttcccgctcaacggcagccatgaccttggaattatcctgcagcgcatccgggacatgccatacatggacccgtcgggcaataacctgggaactgctgtcgtgaccgcccaccgctacatgcttgctccagacgcgcccggccgcagacaacatgtgcctggagtgatggtgcttctggtggatgaaccgttgaggggagacatcttctccccgatccgggaagcgcaggcgagcggattgaatgtggtcatgctgggcatggccggtgctgacccagagcaactccggcggctggctccgggtatggattcggtccaaacgttcttcgctgtggacgatggaccgtccctggatcaggctgtgtccggcctggcgactgcactgtgccaggcatcattcactacccagccgcgcccggaaccatgtcctgtgtactgcccgaaaggacaaaagggggaaccaggagagatgggactccgggggcaagtcggaccaccaggcgatcctggactgccgggacggactggagccccgggcccacaagggccccctggatccgcgactgccaagggggagagaggattcccgggagctgatgggcggccgggaagtccgggccgggctggtaacccggggacccctggcgccccgggacttaaaggttcgcccgggctcccggggccgaggggtgacccaggagaacggggcccgaggggaccgaagggcgagccaggcgcacctggacaggtcatcggaggcgagggaccagggctgccgggacggaagggtgacccgggaccaagcgggccgcctggaccacgcggacctctcggagatcccggaccgcgcggcccacctggactccctgggaccgccatgaaaggcgacaaaggagatcgcggcgaacgcggacctccgggaccgggcgaagggggaattgcaccgggcgaaccgggcctgccagggctccccggctcacccggaccgcagggaccggtgggcccgccgggaaagaagggcgaaaagggcgactctgaggacggtgcacctggactgcccggccagccgggctcgccaggagagcaaggaccacgtggcccgccgggagcgatcggaccaaaaggtgaccgtggattccccggcccgctcggggaagcaggagaaaaaggagaacgagggccacctggccccgccggctccagaggactcccgggcgtggcaggtaggccgggtgctaagggcccagagggtccgccaggcccaactggtagacaaggtgaaaagggagagccgggacggcctggagatcctgcagtggtcggacctgcagtcgcaggtccgaaaggggaaaagggagatgtgggacctgcgggaccccgcggggcaactggcgtgcagggagaacggggcccgccaggactcgtgctgcctggggaccccggaccaaagggggatcctggcgatcggggcccgatcggacttactggtagggccggacctccgggcgattccggaccaccaggggagaaaggcgacccaggtcggcctggaccaccaggaccagtcggtcctcgaggcagagatggagaagtcggcgagaagggagatgagggtcccccgggggaccccggcctgcctggcaaggcaggagagcggggcctgagaggcgccccaggcgtcaggggaccagtcggagaaaagggtgaccagggcgaccctggagaagatggaagaaatggcagccctggatcctccgggccaaagggcgacagaggggagccgggaccacctgggccaccggggcggttggtggatactggcccaggagctcgggagaagggggagccaggagatcgcggacaagagggaccgagaggccctaagggcgaccctggactccctggcgccccgggagagcgcggaatcgaaggattcagaggaccgcccggtccccagggggacccaggagtgcgcggtcccgccggtgaaaaaggggatcggggtccgccgggactcgatgggagatcaggcctcgacgggaaaccgggagccgctggaccgtccgggcctaacggagcagcgggaaaagctggagatcccggacgggacggactgccgggactgcgcggcgaacaagggctgcccggcccgtccgggcccccaggactccctggcaaaccaggggaagatggaaagccggggctcaacggaaagaatggagagccgggtgatcctggagaggacggacgcaagggggaaaagggggattccggagcatccggacgcgaaggccgggatggcccaaagggagagagaggagcgcctggcatcctcggcccgcagggaccgccgggtttgccgggaccagtcgggcctcctggacagggatttccaggagtgccggggggaaccggacccaagggcgatcggggtgagacgggaagcaagggggaacaagggttgcctggcgaacgcggtctgcgtggggaacccggatcggttcccaacgtcgaccgcctgctggaaactgcgggtatcaaggccagcgccctgagggaaatcgtagaaacttgggacgagagctcaggctccttcctgccagtgcccgagcgccgtagagggccgaagggcgactccggggaacagggccctcctggaaaagaaggacctattgggttcccgggagagagaggattgaaaggcgatagaggcgaccctgggccgcaaggtcctccgggacttgcattgggtgagcgcggaccccctggcccgtcgggattggctggtgaaccaggtaaacctgggatcccagggcttccgggacgcgctggcggcgtgggggaggcgggcagaccaggagaacgcggggaaagaggagagaagggggagcggggtgagcagggtagagacgggcccccgggacttccgggcaccccgggaccaccggggccaccgggaccgaaagtctccgtggacgagccgggtccgggactcagcggcgaacagggcccgccagggcttaaaggagcgaagggcgagccaggatcgaacggggatcagggaccgaagggagatcggggagtccctggaattaagggagatcgcggtgagccgggaccacgcggccaggacggaaaccctggccttcccggagagcggggcatggcgggaccggaaggtaagcccggccttcaaggtccacgcgggccgccgggtcctgtcggcggacacggcgacccgggaccgccgggtgctccaggactggccggtcctgccggaccccagggaccaagcggccttaaaggagagcctggagaaacggggccaccgggcagaggattgaccggccctactggtgccgtcgggctgccgggaccaccaggaccctcgggcctggtgggcccgcaaggttcaccaggactgccaggacaggtgggagaaactggtaaaccaggtgcgccaggtcgggacggagcaagcggaaaggatggtgatagaggtagcccaggggtaccaggatcgccaggcttgcctggtccagtgggcccaaagggggaaccggggcctaccggcgccccgggacaagcggtggtgggactgccgggtgcaaagggtgagaagggagcccccggaggccttgcaggggatcttgtgggagaacctggtgccaagggagacagaggtctgccagggccgcgcggagagaagggcgaggccggacgagccggcgagcctggcgatcccggagaggacggacagaagggtgccccggggccgaagggattcaagggggacccgggcgtgggagtgccgggatcaccggggccgccaggcccaccgggagtcaagggcgacctgggactgcctggattgccgggagccccgggagtggtgggtttcccgggtcagaccggtccgcggggagaaatgggtcaacccggtccgtccggggagagaggattggccggacctcctgggcgggagggcatcccaggcccgcttggaccgcctggcccaccgggctcggtgggtccgcccggagcgtcaggacttaagggtgataagggtgacccaggcgtgggtctgccgggaccgaggggggagcggggagaaccgggcatcaggggcgaggacggcagaccgggccaggaaggcccgcggggcctgactggaccgccgggatcccgcggagaaagaggagaaaagggagatgtcggatcggctggactcaaaggcgataagggagattcggccgtgatcctgggaccgccaggcccaagaggagcgaagggagacatgggggaacgcggcccgcgcggactggacggagacaaggggccgagaggtgacaatggggatccaggggataaaggatcgaagggagagccgggtgacaaaggaagcgccggactgcctggcctccggggattgctgggaccgcagggacagccaggcgcggccggaattcccggcgacccagggagccctggaaaggacggtgtgccgggaatcagaggagagaaaggtgatgtgggatttatgggaccgagaggtcttaaaggagagcgcggggtcaagggagcctgcggactggatggagagaaaggtgataagggggaggccggaccgccaggccgccctggactggcgggccacaagggtgaaatgggcgaaccaggagtgccgggacagtcgggagcgccaggaaaggagggcctgattggacctaagggcgatcggggattcgacggccagcccggcccaaaaggggatcagggtgaaaaaggagaacgcgggaccccaggaatcggcggattcccggggccgtcgggaaatgatggatcggctggtccgccgggacctccgggctcagtggggccacgcggaccagagggactccaggggcaaaaaggagaaaggggtccgccgggggagcgcgtggtgggcgctcccggagtccccggcgcccctggagagcggggcgaacaagggaggcccggacctgcagggcctcgcggcgagaagggcgaagctgccctcactgaagatgatatccggggattcgtgagacaagaaatgagtcagcattgcgcgtgccagggacagtttatcgccagtggatcacggccgctgccgagctacgcggcagacaccgccggcagccagctccatgccgtgcccgtgctcagggtgtcccacgccgaggaggaggaacgagtgcccccggaggacgacgaatactcggaatactctgagtattctgttgaggaatatcaggaccctgaggctccatgggactcagacgatccttgcagcctcccgctcgatgaaggctcgtgtaccgcatacacccttagatggtaccaccgggctgtgactggttccactgaagcatgccacccattcgtgtacggtggatgtggaggcaatgccaaccgctttggtactagagaagcctgcgaacgccgctgcccgccgagggtggtgcaaagccagggaaccggaaccgcgcaggac

SEQ ID NO: 9599 - DNA, 8832 bp, Artificial Sequence
  Description of Artificial Sequence: Synthetic coding sequence
atgaccctccgcttgctcgtggcggcattgtgtgcaggaatcctcgcagaagctccacgcgtgagagcgcagcatcgagaacgcgtgacctgtaccaggctgtacgcagcagatatcgtgttcctgctggacggttcatcgtccattggacggtcaaactttagagaagtgcgttcctttctggagggactcgtgcttcctttctccggggcggcatccgcacaaggcgtgcggtttgcaactgtgcagtattccgacgacccacgaactgaatttggacttgacgcgcttggctcgggtggtgacgtgataagagctattcgggagctgtcatacaagggaggtaatactaggaccggagccgcaattctccatgtggccgatcatgtgttccttccccagttggcccgcccgggagtgcctaaggtgtgcattcttatcaccgatggcaaatcgcaagacttggtcgatactgcagcacagaggctgaaaggccagggggtgaaattgttcgcagtgggaatcaagaacgcagatccagaagaactgaagcgagtggcgtcccagcctacctccgatttcttcttcttcgtgaacgattttagcatcttgagaaccctgctgccactggtgtcacgtagggtgtgtaccaccgcaggaggtgtccctgtgacccggccccctgatgattccacctcggcacctagagatctcgtgttgtcggagccgtcctcgcaatcgctgcgagtgcagtggactgcggcatcggggccagtcactggctacaaggtgcaatacactccgttgaccggcctgggtcaaccactgccatcggagcggcaggaggtgaatgtgccagcaggagaaacttcggtgcggcttcgtggcctccgccctctcacggagtatcaagtgactgtgattgcactgtacgcaaactcaattggagaggctgtctcaggcaccgcacggactactgcattggaaggacctgaactgaccatccaaaacactaccgcccattcactgctcgtggcatggcgctccgtccccggagccactggttacagggtcacctggcgtgtgctctctggtggacctacccagcaacaagaactgggaccagggcaaggctcggtccttcttcgcgatttggagccaggtacggattacgaggtgaccgtttccactttgttcggcagatccgtgggtccagcgacttcgctcatggcaaggactgatgctagcgtggaacagacgttgcggcctgtgatacttggacctacgtccattttgctttcctggaacctggtgcccgaggccagaggataccggttggaatggcgtagagaaaccggccttgagcctccgcaaaaagttgtcctgcccagcgacgtgaccagataccaactcgacgggctgcagcctggtactgagtaccgattgacgctgtacaccctgctggagggacacgaagtggcaactccagccaccgtcgtgcctacgggaccagaacttcccgtgagccccgtgaccgatcttcaagcaaccgaactgccaggacaacgagtgcgtgtgagctggtcgccagttccaggcgcgactcaataccgaatcatcgttagatcgactcagggagtcgaacggactcttgtgctgccaggatcgcagactgcatttgacttggatgatgtccaggcaggtcttagctacacggtgcgagtcagcgcacgtgtcggtcctagagaaggttcggcgtcggttctgactgtgaggagagaaccagaaacccctcttgccgtgcctggtcttagggtcgtcgtctcggatgcaacgagagtccgcgtggcgtggggcccagtgccgggggcatcgggatttagaatctcatggtcgaccggcagcgggcctgagtcatcccaaaccctgccccctgattcaactgcaaccgacatcactggtctgcagcctgggaccacttatcaagtggcagtctcggtgctgcggggtagggaggagggacccgccgcagtgatcgtggctcgtaccgatcctctgggtcctgtcaggacggttcatgtcacccaggcttcgtcctcgtcagtgaccattacctggacccgggttccgggagcaacggggtacagagtgtcgtggcattcggcacatggaccagaaaagagccagctcgtgtccggtgaagccaccgttgcggagcttgatggcctcgaacctgacactgaatacacggtgcatgtgagagcgcacgtggctggggtggatggtccacccgcatctgtggttgtgagaaccgcacctgaacctgtcggcagagtgtcacgcttgcagattttgaacgcatccagcgacgtgctgagaattacctgggtgggagtcactggtgcaactgcttataggcttgcgtggggacggtccgagggtggcccaatgaggcaccagattcttcccggaaacactgatagcgcagaaatccgcggccttgagggcggagtgtcatactcagtgcgcgtgactgcacttgtcggggacagggaaggcactcctgttagcattgtcgtgactaccccacccgaggcgccgccagcgctgggaaccctccacgtggtccaacgtggagagcattcactccggctgagatgggaaccggtgcctcgcgcgcaggggttcctcctgcattggcagcccgagggaggccaagaacaatcaagagtgctgggacctgaactttcgagctaccatctggacggactggagccagctactcaataccgtgtgagacttagcgtgctcggtcctgccggggagggtccgtctgccgaggtgactgcaagaactgaatccccacgcgtgccttcgatagagcttagggtcgtggatacttccattgatagcgtcaccctggcctggacgcccgtctcgcgagcatcaagctacatcctgagctggaggccgctgcgaggaccaggacaggaagtgcctggatctccacagacccttcctggcatttcatcgtcacaacgggtcactggccttgagccaggagtgtcctacattttctcgctcacgcctgtgctcgacggagtcagaggacctgaggcttcagtcactcagactcccgtgtgtccaaggggcctggccgacgtggtgtttctgcctcacgcaacccaggacaacgcacaccgtgcagaggccactcgtcgcgtgctcgagcggcttgtcctggcactgggtcccctgggtccacaagcagtccaagtcggcttgttgagctactcgcaccggccttctccactttttcctcttaacggttcccatgatctcggaatcattctccaaagaatcagagacatgccatacatggatccatctggcaacaatctcgggaccgccgtggtcaccgcccatagatacatgcttgctcccgacgctcctggccgtagacagcacgtgcccggggtcatggtgctccttgtggatgaacctcttcggggagatatcttcagcccgattagggaagcccaagcaagcggattgaacgtcgtcatgttgggaatggcaggtgcagaccccgaacaacttagacgcctggcacctgggatggactcggtgcaaaccttttttgccgtggacgacgggccctcgctggatcaggcggtgagcggcctggcaaccgcactctgccaggcgtcctttaccacgcaacctagacccgagccttgtccagtttactgtcctaagggacagaaaggtgagcctggcgagatgggccttcgcggacaggtcggtccaccgggtgaccctgggcttccgggacgcactggagcccctggacctcagggtccacccggttctgcaaccgcaaaaggtgaacggggattccccggcgcagatggacgacccgggtccccgggccgtgcagggaatccgggcactccgggtgcccctggactcaaagggtcgcctggtttgccaggccccagaggcgatcctggtgaaaggggtccacggggcccgaagggtgagcctggtgcccccgggcaggtgatagggggagaaggacctggcctgcccggcaggaagggtgatccaggaccgtcggggccaccaggtccgcgcggcccactgggcgaccctggcccaagaggcccaccaggcctccctggcacggctatgaagggtgataagggtgatcgtggtgaaagaggacctcctgggcccggcgaaggaggaattgcaccgggagaacccggacttcctggactgcctggatcaccagggcctcaaggacccgtcgggccaccagggaaaaagggagaaaagggagattcagaggacggagccccaggcctgcccggacaaccaggttccccgggagaacaaggcccgcggggaccgcccggcgcaatcggccctaagggggatcggggatttcccggaccgctgggtgaagcaggggaaaagggggaacggggaccaccagggcccgccggatcaagaggacttcctggagtggccgggaggcccggggccaaaggtccggagggtcctcctggacccaccggtagacaaggagagaagggagaaccagggcgccccggagatcccgccgtggtgggccctgcagtcgcaggccccaaaggcgaaaagggtgacgtgggcccggccggtccacgaggtgcaactggggtccagggagaacgaggtccacctggacttgtgctccccggtgatccaggaccgaagggggacccgggagatagaggacccatagggctcaccgggagagccggtccaccgggggattctggcccccctggtgagaagggagatccgggaaggcctggcccgcctggtccggtgggtccacggggccgggacggagaagtcggagagaaaggggatgaaggaccacctggtgatcccggtctgcctggtaaagcaggagagcggggtctgagaggcgccccaggagtcagaggccccgtgggagaaaagggggaccaaggtgatccaggtgaagatggaagaaacggtagccccggtagctcaggacctaagggagatcgtggagagcctgggcccccgggaccacccggtcgcctcgtcgataccggacctggcgctagggaaaagggcgaacccggggaccgagggcaagaaggtcctcgtggacctaagggagatcccggactgccaggcgccccaggagagcgcggaattgaagggtttcgtggtccaccaggtccccaaggtgaccctggagtgcgaggaccggcaggagaaaaaggagatcgaggccctcccgggcttgatggaagatcaggactggacggtaagccgggagcggccgggccttccggtcccaacggggcagccggaaaggccggtgaccctgggcgagatggacttcccggtctgcggggggagcaaggccttcctggtccaagcggaccacctggactgcccggaaagcccggagaggatggcaagcctggcctgaacggtaaaaacggagaaccgggggatcctggtgaagatggtcgcaagggtgaaaagggcgattcaggggcatcggggcgagagggacgcgatggtcctaagggcgaaaggggcgcacctgggattcttggcccgcaaggtccacctgggctgccaggaccagtcggcccgccaggccaaggttttcccggggtgccaggcggaactgggcctaaaggagatcgcggagaaaccggttcaaagggagagcagggtctgccaggtgaacgagggcttaggggcgaaccgggtagcgtccctaatgtggatagattgctcgaaactgcagggattaaggcgtcagcactcagagagattgttgaaacctgggatgaatcctccggatcctttctgcctgtgccagaacggcggagaggacctaagggagactcgggggagcagggtcctcctggtaaggagggacctattggatttcctggtgaaagggggctgaaaggcgatagaggtgatcctgggccccagggacctcccggtctggcactgggagaaagaggtcctcctggtccttccgggctggcaggagaaccaggcaagcctggcataccggggttgcccggaagagcaggaggcgtcggagaggccgggcggcccggggaacggggagagagaggtgaaaagggcgaaaggggtgagcaaggtagagacgggcctcctggcctgcccggaactcccggaccgccagggcctcctggtccgaaggtgtcagtcgacgaacctgggccaggcctttcgggtgagcaaggtcctcctggtctgaagggtgcaaagggggagcctggtagcaacggtgatcaaggacctaaaggggaccggggagtccctggaattaagggagatcgtggggaacctggtcctagaggccaggacggaaacccaggactccctggtgaaagaggtatggcaggtccagagggaaagcctggtctgcaagggcctcgcggtccccctggacctgtcggaggacacggcgatcctggcccccctggagctcctggtctggcaggaccagccggaccccagggaccttccggtttgaagggtgaacctggtgaaactggaccccccgggcggggtctgaccggacctaccggggccgtcggccttcccgggccacctggaccatcaggacttgtcggaccacaaggttcccctgggctccctggacaagtgggagaaaccgggaagccaggggcacccggccgggacggagctagcggaaaggatggcgatcggggatcgcctggagtgccaggatcccctggtttgccaggacctgtcggaccaaagggagaaccagggcccaccggtgcaccaggacaagctgtggtgggacttccgggagcaaagggcgaaaagggtgccccaggtgggcttgccggagatctcgtgggtgaacccggcgcgaagggtgatcgcggactgccgggacctcgcggggagaagggcgaagccggtagagcgggagaaccaggagatcctggtgaagatggacagaagggagcaccaggacccaaggggtttaaaggcgatccaggtgtcggagtccctggatcgccagggcctcccggcccacctggtgtgaagggagatctgggcttgccaggtctgcccggtgcaccgggcgtggtgggattccccggacagacggggccaagaggagaaatgggtcaacctggtccatccggagaacgaggactggcgggtcctcctggcagggaaggaatccctggtccgctgggccctccgggtccacctggttcagtcgggcctcccggagcctcggggctgaaaggggataagggagatccaggagtgggtttgcccggcccaaggggagaacgcggtgagcctggaattagaggggaagatggtagacccgggcaagagggtcctcgcggactcactggcccgccgggatccagaggagagagaggagaaaagggcgacgtgggtagcgctggactcaagggggacaaaggagacagcgccgtgattcttggccctcctggtccgcgcggggcaaagggggatatgggcgaaagaggtccacgtggtctggatggcgacaaaggacccagaggcgataacggggatccaggtgacaagggctcgaagggagaacctggcgacaagggaagcgcaggactgccaggactgcgtggcctgctgggacctcaaggtcagcctggtgcagcaggtatccccggcgatcccggatcccctggtaaagatggagtgcctggcattcggggtgaaaagggagatgtcggctttatggggccaaggggactcaagggagaaagaggagtgaagggcgcttgcggacttgatggtgaaaaaggggacaagggtgaagccggaccaccagggcgccccggacttgccggccataagggcgaaatgggtgagccaggtgtccccgggcagtccggagctccaggtaaggaaggtcttattggtccgaaaggtgatcgcggatttgacggacagccagggccaaagggagatcagggcgaaaagggcgaacgtggcaccccaggaatcggaggttttcctggtccatcgggtaacgacggcagcgcaggtccaccaggaccaccaggttcggtgggacctcgcggaccagagggactgcagggacaaaaaggagaaaggggacccccgggagaaagagtggttggggcaccaggagtgcccggagcgccaggggagcgaggagagcaaggacgtccaggtccggccggaccaaggggagaaaagggtgaagcagccctcacggaggacgacataagaggatttgtgagacaagagatgtcgcagcactgcgcatgtcagggccaattcatagcaagcggatcccggcctcttccttcctacgctgcagacactgccggatcgcaactccatgctgtgcctgtgctgcgagtgtctcatgctgaggaagaagaacgagtgccacccgaagatgatgaatactctgaatacagcgaatactcagtggaggaataccaggatcccgaagcaccttgggattctgacgatccttgttcactccccttggacgagggttcctgcaccgcttacaccctgcgctggtaccaccgcgcggtcaccggtagcactgaggcatgtcatccttttgtctacggtggatgtggggggaatgcaaatcgcttcgggaccagggaagcatgcgagaggcgctgtcctcctagagtcgtgcaatcgcagggaactggaaccgcacaagat

SEQ ID NO: 9600 - DNA, 8832 bp, Artificial Sequence
  Description of Artificial Sequence: Synthetic coding sequence
atgaccctcaggctcttggtcgctgcactttgcgccggcatactggccgaggcaccgagagtgcgcgcccagcacagagaaagagtcacgtgcactcgcttgtatgctgcggacatcgtgtttctcctggacggttcatcaagcattggcagatctaatttcagagaagtcaggagttttctggaaggactggtgctccccttctccggtgcggcttcagctcagggcgtgaggtttgctacggtacagtactctgatgatcccaggacagaatttggattggatgctttgggttctggtggtgacgtgattcgcgcaatccgcgaactctcatacaaaggaggaaacaccagaaccggagctgctatcctgcacgtggcggaccacgtctttttgccacagctcgctcgccctggagtgcccaaggtatgtattttgattaccgatggtaagtctcaggatctggtggacacagctgcgcagaggctgaagggccaaggagtaaaactgtttgccgtcggtatcaagaacgccgatccggaagagctgaaaagggtagcatcacagccaacctctgatttcttctttttcgtcaacgattttagcatcctgaggaccctgttgcccctggtttctagaagagtctgcactacagctggcggagtccctgtcacacgcccacccgacgacagcacgtctgccccaagagatctggttctgtcagagccctctagtcagtccctgagagttcagtggaccgctgcctctggccctgttaccggatataaagtgcagtacacaccactgacaggacttggacaaccactcccaagtgaaaggcaagaagtcaacgtccccgcgggcgagaccagcgtcaggttgcgcggcctcaggcccttgacagagtaccaagttacagtgatcgccctctatgcaaactctattggcgaagcagtgtccggaaccgcaagaaccaccgcacttgagggtcccgaattgacgattcagaacactacagctcactccttgctcgtggcttggagatccgttccaggtgccactggctacagggttacgtggagagttttgagcggtggtccaacgcagcagcaggagctgggcccaggtcaaggtagtgttctcctgagggacctggaacccggcacggattacgaggtgaccgtctccaccctgttcggtcgcagcgtgggaccagctacgagtttgatggcgagaacggatgcttctgttgaacaaacacttcgccccgtcatattgggaccaacctccatcctgctgagctggaacctcgtgccggaggcacgcggttaccgccttgaatggaggcgcgagaccggactcgagccacctcagaaggtggtcctgcctagcgacgtaacacgctaccagttggatggtctgcagcccggtacggaataccgcttgaccctgtataccctgttggagggccacgaagtggcgacaccggctacagtcgtgcccactggccctgagctgcctgtttcccccgtcactgacctccaggccaccgaactccctggtcaacgcgttagagtttcttggagtccagtccctggtgcaactcagtaccgcatcattgtaagatccacacaaggcgtggaacgcacattggtactccctggaagccaaactgcctttgacctggatgacgtgcaagcaggactctcttacacagtaagagtgtctgctagagttggtccccgcgaaggcagtgccagtgtgctgactgtgaggagagaacccgagacccctctcgccgtccccggcctgagagtcgtcgtctcagacgccactcgcgtgagggttgcatggggaccagtgccaggcgcctctggattcaggatatcctggagtactggctcaggccctgagagctcccagaccctgccccccgattctaccgctactgacattaccggtctgcagcccggaacaacataccaggtggccgtgtccgtgcttagaggtagggaggagggacctgcagctgtcatcgtggctaggacggatccccttggccccgtgcgcaccgtacacgtgacacaagcatccagcagcagtgtaacaatcacatggacgcgcgttcctggcgcaacaggttacagggtgagttggcactctgcccatggccctgagaaaagtcagttggtatccggagaagccaccgtcgctgaactggacggtcttgaacccgatacagagtacacggttcacgtaagggcccacgtcgccggtgtggacggtcctccagctagtgtagtggtgaggaccgcgccagagcctgtgggacgcgtgtctaggcttcagattttgaatgcttcttctgatgtcctcaggatcacctgggtgggagtgactggtgccactgcttatcgcctggcttggggcagatcagagggtggcccaatgagacaccagattctgccaggcaacaccgactccgcagaaatccgcggtttggaaggaggtgtgagctatagtgttagggttactgcgctcgtgggtgatagagagggaacacccgtcagtatagttgtaacaactcccccagaagctcctcctgcgctcggtaccctccatgtggtgcagcgcggagagcatagcttgagattgagatgggagcctgttccccgcgcccaaggattcttgttgcactggcagccggaaggtggccaggaacaaagtcgcgtcctgggtccggagctgagctcttaccatttggacggtctggagcctgccacacagtatagggttaggctgtcagtcctgggccctgctggcgaaggaccgtctgcagaggttacagctagaaccgagagtcctagagtaccatctattgaacttcgcgtcgtagatacctctattgattcagtcaccctggcgtggactcctgtctcacgcgcctcttcatacatccttagctggaggcccctgaggggaccaggtcaggaggtgcccggttctccccaaaccctcccaggcattagtagttctcagagagtcaccggcttggaaccaggtgtctcctatatttttagcctcactccagtgctggatggagtacgcggtccagaagcgagcgtgacacagacacctgtgtgtcctaggggactggccgatgtcgtgttcctcccccacgccactcaggacaacgcacatagggctgaagcgacccgcagagtccttgagaggctggtgctcgccctcggtcctctgggaccgcaagccgtccaagtgggccttcttagttattcccataggccctccccattgttcccactcaacggctctcatgacctcggaatcatcctccagaggataagggatatgccttacatggatcccagcggtaacaacctcggcacggccgtcgtgacagcccacagatacatgttggcccctgatgcccccggccgccgccagcatgtcccaggtgtgatggtgttgctcgtagatgagcctcttcgcggtgacatcttctcaccaattagagaggcgcaagcctccggcctgaatgtggtgatgctcggaatggccggcgcagaccccgaacaattgaggagactggcacctggcatggactctgtgcagactttcttcgcagtggacgatggcccttctctcgaccaggcagtgagtggcctcgccaccgccctttgccaagcttctttcaccacacagccacgcccagagccgtgcccagtgtactgtccaaagggacagaaaggcgagcctggcgaaatgggtctcagaggccaggtgggtccccccggagacccgggactcccaggcaggacgggtgcccctggtccacagggccctcctggatctgcgaccgcaaagggtgaacgcggattcccaggcgctgacggtagaccaggatcccctggaagagcgggaaatcctggcacgcctggagcgcctggtctgaagggcagtccaggactgccgggcccacgcggtgacccgggcgaaagaggaccaagaggacccaaaggcgaacccggagctccaggacaggtgatcggaggagagggacctggcctgcctggaaggaagggcgacccaggtccatctggcccaccgggacctaggggtcctttgggtgaccccggtcctcgcggacccccaggccttccaggaactgctatgaagggtgacaaaggagacaggggcgaaaggggccccccaggccccggtgaaggaggaattgctcctggagagccaggattgcctggactcccaggatctcccggaccccagggacctgtaggcccacccggtaaaaaaggtgagaagggtgacagcgaggacggagcccccggcctcccaggacagcccggtagccctggagagcaaggtccccgcggaccaccaggcgccattggacctaagggcgataggggctttcctggaccccttggcgaagcaggagagaagggcgagagaggtcctcctggccctgccggctccaggggtttgccgggcgtggctggtagacccggcgctaaaggccctgagggacctcctggtcccaccggaagacagggagagaaaggtgaaccgggtagaccaggagaccccgcggttgtcggtccggcggtcgctggaccaaagggtgagaagggagacgtgggcccagctggaccacgcggcgcgactggagtgcaaggtgaaagaggcccacctggattggtgctgccaggagaccctggtcccaaaggtgacccaggcgataggggtcccatcggactgactggtagagcaggcccacctggtgactccggaccgccaggagagaaaggcgatcctggccgcccgggaccccccggaccagtcggacctcgcggcagggacggtgaagtcggcgaaaaaggagacgagggtcctcctggagaccctggcctcccaggtaaagcaggcgaacgcggactcaggggtgctccaggcgttagaggacccgtcggcgagaagggtgatcagggcgatcccggtgaggacggtcgcaacggcagcccgggctcctcaggcccaaagggcgatcgcggagagcctggacccccaggccccccgggacgcctcgtggacactggccctggcgctagagaaaagggtgaacctggtgacaggggccaggagggaccccgcggtcccaagggagacccaggcctcccgggtgctcccggcgagcgcggaattgagggcttccgcggaccaccaggaccccagggagatccaggtgtacgcggccccgcgggcgagaagggagacagaggaccacccggcttggacggaagaagcggtctcgacggaaagcctggagctgctggtccttcaggtcccaacggtgctgcaggcaaagccggagaccccggaagagatggacttcctggacttcgcggtgagcaaggactgccaggtccatccggtccacccggactccctggtaagccgggagaggatggtaagccgggtctgaacggaaaaaatggcgagcctggagatcctggagaggacggcagaaagggcgagaagggtgacagtggcgcgagtggcagggagggtagggacggccctaaaggcgaaagaggtgctcctggaatcctgggcccacagggaccacccggactcccgggcccagttggaccccccggccagggctttcctggcgtaccaggcggcacaggcccaaagggagacaggggtgagactggttccaaaggcgaacagggcctgcccggtgaaagaggtctgaggggagagccgggctccgtaccgaacgtggaccgcctgcttgagacagcgggtataaaagccagcgctctgcgcgaaatcgtcgagacctgggatgagtcatctggctccttcctgcctgtgcctgagaggaggaggggcccaaagggcgactccggcgagcagggaccccccggcaaggaaggaccgattggttttcctggcgaaaggggcttgaaaggcgacaggggcgaccctggaccccaaggcccacccggtctggctttgggtgagagaggaccgccaggtccctccggtctggcaggagaaccgggtaagccgggcatccctggcttgccaggccgcgccggtggtgtcggagaggccggaaggcccggagaacgcggagagaggggtgagaaaggtgagcgcggcgagcagggcagggacggacctccaggcctgccaggcacaccaggtcctcccggtccacctggcccgaaggtgtcagtcgacgaacccggtccgggtttgtccggtgaacagggcccccccggcctgaaaggcgccaagggtgagccaggctctaacggtgaccagggccccaagggtgatagaggagtccccggaatcaaaggtgatagaggcgagcctggcccacgcggtcaagacggcaatcccggcctgccgggagaaaggggaatggctggcccggaaggtaagcccggcctccagggtccaaggggaccacctggtcctgtgggcggtcacggagatcctggcccgccaggcgctcctggtttggccggaccagcaggtccacagggtcccagtggactgaagggagagccaggcgagacaggcccgcctggcaggggtcttacgggtccgacgggcgcagttggtctccctggtcccccaggcccctccggcctggtcggtccccagggtagtcctggacttcctggtcaggtgggtgagactggcaagcctggagcacccggtagggacggagcgtcaggaaaggacggcgataggggtagccccggagtccctggctcccccggcctgcctggtcccgtgggaccaaagggagagcctggccctacaggagccccgggtcaagccgttgtaggtttgcccggagccaagggcgagaagggtgctcctggcggactcgccggagacctggtgggcgaacccggcgctaagggcgatagaggcctgccgggcccaaggggtgagaagggagaggcaggccgcgctggtgaaccgggagaccccggcgaagacggtcagaagggagcccccggccctaagggtttcaaaggtgaccctggagtgggagtacctggcagtcccggtccccccggccctcctggcgtcaaaggagatctgggtctgcctggtctgcccggcgcccccggcgtggtgggattcccaggacagacaggtcctcgcggagaaatgggtcaacccggaccgagtggtgagaggggccttgctggccccccaggcagggagggaatacctggtcctctgggtccgcccggtccccctggaagtgtcggaccgcccggcgctagcggactgaagggtgataagggagatccaggagtgggactccccggtccccgcggcgaaaggggagaacctggcatacgcggagaagacggtaggcctggacaggagggccctcgcggcttgaccggtccccccggatccagaggcgagaggggcgagaaaggcgacgtgggcagcgcaggcctgaaaggtgacaagggtgactctgctgtgatcctgggaccgccaggtcctcgcggtgccaagggcgacatgggagaaagaggtccgagaggactcgacggtgacaaaggtcctagaggtgacaatggcgaccccggagacaagggcagtaagggcgaacccggtgacaagggtagcgctggtttgcccggactgaggggactgttgggtcctcaaggtcagccaggtgcagccggaatacccggtgatcccggatcacccggtaaggacggagtgcctggaatccgcggtgaaaagggcgacgtcggattcatgggtccccgcggattgaaaggagagagaggcgtgaagggtgcttgtggactggacggcgaaaagggcgacaagggtgaagccggtccgccaggtagacctggtctggccggccataagggagaaatgggcgaacccggagttccaggccaatccggagcccctggcaaagaaggtttgattggccctaagggcgatcgcggtttcgacggtcaaccaggccctaagggagatcagggcgaaaagggcgagaggggcacaccgggtattggaggatttcccggaccctccggtaacgatggctctgcgggaccccctggtccgcctggctccgttggccctagaggcccagagggtctccagggtcagaagggtgaacgcggtcctcccggagaaagagtggtcggagcacccggtgtccccggtgcgccaggcgagcgcggcgagcagggcaggcctggacctgcaggtccaaggggtgaaaagggcgaagcggccctgactgaagacgacattagaggattcgtcagacaagaaatgagccagcactgcgcctgccagggtcagttcatagcaagtggttcccgccccttgccaagctacgccgcagacactgcaggatctcagctccacgcagttcccgtgctcagagtgtcccacgccgaggaggaagagagagtacctcccgaggatgatgagtacagcgagtactcagagtactcagttgaagagtatcaggacccggaggccccttgggacagtgacgacccctgcagtctgcccctggacgagggttcctgcactgcgtatacactgcgctggtatcacagggccgtaaccggatctaccgaagcctgtcaccctttcgtttatggaggttgcggcggcaacgctaatagatttggtacgagagaggcttgtgagagaaggtgtcctccccgcgtggtacaatctcagggcacgggaactgcgcaggat

SEQ ID NO: 9601 - DNA, 8832 bp, Artificial Sequence
  Description of Artificial Sequence: Synthetic coding sequence
atgactcttcggctgctggtggcagcactctgtgcaggaatactcgctgaggcacctcgtgtgcgagctcaacacagggaaagagtcacgtgtaccagactctacgccgcagatattgttttccttcttgatggctcctcaagcattgggcgaagcaactttcgtgaagtgaggtcgtttcttgaaggtttggtgctgccattcagcggggcggcatcggcacagggggtgcgcttcgcaactgtgcagtacagcgacgacccccggaccgaatttggacttgacgcacttggtagcggtggagatgtgattagagcaattagagagcttagctacaagggtggcaacacccggactggtgcggccatacttcatgtggccgaccacgtgttcctgcctcaactcgcaaggccaggtgtgcctaaggtttgcattctgattactgacggaaagtcccaggacctggtcgacacggctgcccaacggctgaagggacagggggtcaagctcttcgcagtcgggataaagaacgcagatcccgaagaactgaagagagtggcatcccagcctacctcagatttcttcttttttgtcaatgatttttctatacttcgaactcttctccctctcgtgagcagacgcgtctgtactaccgcaggaggagtgcctgtgaccaggcctccagacgattcgacgagcgctccccgcgaccttgtgctttcggaaccttcctcacaatcgctgcgcgtgcagtggactgccgcgtccggacccgtgaccggatacaaagtgcaatacactcctcttaccggccttggacagccacttccatcagaaaggcaggaagtgaatgtgcctgcaggagaaacctcagtccgtctgaggggactgcgtccgctgaccgaataccaagtcactgtcattgccctgtacgcaaacagcataggcgaagcagtctccggaaccgcaagaaccactgcactggaagggcctgaactgactatccaaaataccaccgcgcatagcctgcttgttgcttggcgatcggtgcccggagccaccggttaccgtgtgacttggagagtcctgtccggaggaccgacccaacagcaagagcttggacccggtcaaggttcggtcctgcttagagatcttgaaccaggaaccgattatgaggtcaccgtttcgaccctttttggccgatcggtcggccccgcaacttcgcttatggctcgtactgatgcatccgtggagcagacccttcgacctgtgatcctcggtcctacctcaatccttctgtcatggaatcttgtgcctgaagcgagaggataccggctggaatggaggagagaaaccgggctggagccaccccagaaggtcgtgctgcctagcgatgtgacgagataccaattggatgggcttcaaccgggaactgaataccgtctgactttgtacactctgcttgagggtcatgaagtggccactccggctactgtggtgccaactgggccagaattgccagtgagccctgtgaccgacttgcaggccaccgaacttcctggccaacgcgtccgcgtctcttggagcccagtgcccggggcaactcagtataggataatcgtcagatcgactcagggggtcgaaaggacgctggtgcttccagggagccaaactgcatttgacctggatgatgtgcaagcggggctgtcctacactgtgagagtgtccgcgagagtcggtcccagggaaggttcagcctcggtcctgactgtgaggagggaacctgagactcctctggcagtcccagggctccgcgtggtcgtatccgatgcaactagagtcagagtggcctggggaccagtgcctggcgccagcggattccgcatttcatggagcacgggtagcggaccagaatcgtctcaaaccctcccacccgattcgactgcgactgatatcactggcctgcagcccggcactacttaccaagtggccgtgtccgtactccggggacgcgaggagggacctgcagccgtgattgtcgccagaaccgaccctctgggtccagtcaggactgtgcatgtgactcaggcatcgtcatcgtcggtgaccattacctggactagagtaccaggtgctactgggtacagagtgtcatggcattcagcacatggcccagaaaagagccaactcgtgtcgggagaagcgaccgtggcggaattggacgggcttgaaccagataccgagtacaccgtgcacgtgagagcccatgtcgccggagtggacggcccaccagcaagcgtcgtggtgagaaccgcccctgagcctgtgggcagggtttccagacttcaaatcctgaacgcctcttccgatgtgctccgcattacttgggtgggggtgactggcgcgactgcttaccgtctggcatggggtcgttcagagggtggacctatgaggcaccaaattcttccaggcaataccgattccgcagaaattagaggcctggaaggaggggtcagctactccgtgcgggtcacggccctggtgggagacagggaagggactcccgtgtccattgtggtgaccacccctcctgaggcgccacctgctttgggtactttgcacgtggtccaacggggagaacattcccttcgcctgagatgggaacctgtgccgcgcgcgcagggattcctgcttcattggcaaccagaaggagggcaggagcaatcgcgcgtgctgggacccgaactgtcgagctatcacctggacggcctggagccagctactcagtacagggtgcggctttcagtgctgggccctgcaggggaggggccctcggccgaggtcactgcccggaccgagtcgcctcgcgttccctcgatcgaacttcgggtggtggatactagcatcgattccgtgacgctcgcttggacccctgtgtcgcgtgcttcatcgtacattctgtcatggcgccctcttagaggccccggtcaagaggtcccagggagccctcaaaccctgcccggaatttcgtcctcacaaagggtgaccggattggagcccggcgtgtcctacatcttttcgcttactccggtgcttgacggagttaggggaccagaagcatcagtgacccaaacgcctgtgtgtcccaggggactggcggatgtggtctttctcccgcatgcaactcaggataacgcccacagagcagaggctaccagaagggtgcttgaaagattggtgctcgccctgggccccctgggcccgcaggctgtgcaagtcggacttctgtcctactcccacaggccctcccctctgtttccgcttaatggtagccatgatctcggcataatcctgcagcggattagagacatgccatacatggacccatcgggaaacaatcttgggaccgcggtcgtcaccgcacatcgatacatgctcgctccagacgccccgggtcgtagacaacacgtgcctggcgtgatggtgctccttgtggacgaaccactgcggggtgacatctttagtcctatcagggaagcgcaggcctcaggacttaacgtggtgatgctgggcatggctggtgctgatcccgagcaactcagacgtctggcaccaggtatggattcggtgcaaacgttctttgcggtcgatgacggaccatccctggatcaagccgtatccggcctcgcaaccgcactttgccaagcgagcttcaccacccaaccgcgcccagagccttgtcccgtgtactgcccaaagggacagaaaggagagccgggagaaatgggacttcgcggacaggtgggaccaccgggcgacccaggtttgccaggtcggaccggtgcacccggaccacaggggcctccaggtagcgcgactgcaaaaggagagagagggtttcctggcgctgatgggcgcccaggttccccaggtagagctgggaacccgggaactcccggtgcaccaggcctcaagggttcgccagggctgccaggaccacgcggggatcctggtgagagggggccgcgtgggcctaagggtgaacccggagcacctgggcaggtgatcggaggagaagggccggggcttcctggtcgtaagggtgatccaggaccgtcaggtccaccgggcccacgaggaccactgggggatccagggcctcgcggaccaccaggactcccaggtactgcgatgaagggcgataagggtgataggggcgaaagagggcctccaggtccgggagaaggcggtatcgctcccggtgagccaggattgccagggctgcctgggtcacctgggccacaaggacctgtgggtcctcctggtaagaagggagagaaaggagattcggaggatggggcgcctggcctcccggggcagcctggatctccaggagaacaaggcccacgcggtccacccggtgcaatcgggcctaagggcgatcgcggcttccctggtcctctcggagaggcgggagaaaagggtgagcgagggcctcctggaccagctggtagcagagggttgccaggagtcgcaggtcgtccgggtgcgaaaggtcctgagggaccgcctggtccaaccggaaggcagggcgagaagggagagccaggacggcctggcgatcctgcagtggtgggtcctgcagtggcgggtccaaagggggaaaagggcgacgtgggccctgccgggcctaggggggcaaccggtgtccaaggcgagcgtggcccacctgggctcgtgctgcccggtgaccctggacccaaaggcgaccccggcgatcgagggcctattggacttaccgggagagcgggaccgccaggagacagcggaccacctggggagaagggagatcctggacgtccaggaccgcctggtccagtgggtcctaggggccgggatggggaagtcggagaaaagggagacgagggacccccaggagatcccggtttgcctggaaaagcaggagaacgtggactccggggcgcccctggggttcggggaccagtcggtgaaaagggagatcaaggagatcccggagaggacggtcgcaacggttcgcctggttcgagtggccctaagggtgacaggggagaaccaggaccaccggggccgcctggccgccttgtcgacaccggtcccggagccagagagaagggggagcctggagatcggggtcaggagggaccacggggaccaaaaggtgaccctggactgcctggcgcgcctggagaacgaggtatcgaaggttttaggggaccacctggacctcaaggtgaccctggtgtgcggggtccagcgggtgaaaagggggaccgtggaccaccaggactcgatggcagatcgggactcgatggcaaaccaggagccgcaggaccttcgggaccgaacggtgcagcggggaaggccggagatcccggacgcgatggcctcccaggcctgcgaggagaacaaggactgccaggcccgtcgggaccccctggcctcccaggcaagccaggcgaagatggcaagccaggactgaacgggaaaaacggagagccgggcgatccaggcgaagatggacggaagggcgaaaagggagattcaggagcatcgggacgggagggacgggacgggcccaaaggtgaaagaggggctcctggcatccttggccctcagggtccaccaggccttcctggcccggtcggccccccaggtcaaggctttcctggagtccctgggggtactggacctaagggggaccgaggcgaaactggatcaaagggggaacaaggattgcctggagaacgggggcttagaggagaacctgggtccgtccctaatgtcgaccgtctgctcgaaaccgcgggtattaaggccagcgcacttcgtgaaatcgtcgaaacctgggatgagagctccggctcatttctccctgtgccagagcggcggcgcggtccaaaaggggattccggggagcaaggtcctcctggaaaagaaggccctattggatttccaggggaacgcggccttaagggagatcgaggcgatccaggacctcaaggacctccaggactggcgctgggcgagaggggtccacccggaccgtccggacttgcaggagagccaggcaaacccgggattcctggactgccaggacgagcaggcggagtcggagaggcaggacgccctggcgagcgcggggagcgcggggaaaagggcgaacgcggggagcagggtcgagatggtcctccaggccttcctggtactcccggcccacctggaccgcctggacccaaggtgtctgtggacgaaccgggacctggtctttcgggcgaacaaggtcctcccggccttaaaggagcaaaaggagaacctggctccaacggagatcaggggcccaagggtgataggggggtgccaggtatcaaaggagacaggggtgaaccgggtcctcgtggacaagacggtaatcccgggctgcccggggaacggggcatggcaggtccagagggaaagccagggttgcagggacccaggggacccccagggccggtggggggccacggcgatccgggcccacctggagccccgggactggcaggccctgctggccctcagggtccttcgggacttaagggtgaacctggtgaaaccggcccacctgggcggggactcaccggtccaaccggagcggtggggttgccaggacccccaggaccatctggccttgttggtcctcagggaagcccaggactgcctggccaagtgggcgagactgggaaacccggtgcacctggtcgcgatggagcaagcggaaaagatggagatcggggctcacctggggttcccgggtcaccgggcctccccggtccagtggggcctaagggagaacctggaccaactggcgccccaggacaagcagtggtcggccttcctggggcaaagggagagaaaggcgccccaggtggactggcaggagatctggtcggcgagccaggggccaagggtgatcgtgggctgccaggccctaggggggagaagggagaggctggccgcgcaggagaaccaggagatcccggagaagatggtcagaagggtgcccctggcccaaaaggattcaaaggagatcctggtgtcggtgtccccggctctcctgggcccccaggaccccctggtgtgaaaggagatctgggccttcccggattgccaggtgcacctggcgtggtgggattcccaggacagactggaccgagaggggagatgggtcagcctggaccgagcggcgaacgcggactggcgggaccccctggacgtgagggtatccctgggccacttggccccccaggacctccagggtcggtgggaccaccaggagcatcgggacttaagggtgacaagggagatcccggcgtgggactgcctggacctcggggagaacgaggagaaccgggtatccggggagaagatggcagacccggacaggaaggaccgagggggcttacggggcctcccggcagccgaggagaacggggtgagaagggagatgtgggatccgccgggctcaagggagataaaggggattccgccgtgattctcgggccacctggacctagaggagccaagggagatatgggggaacgcggccctcggggacttgacggagataagggtccgcggggagataacggtgatcccggtgataagggatcgaaaggagagcctggtgataagggaagcgcaggactcccaggactgcgaggattgcttggccctcaaggtcagcccggagcagcgggaatcccaggagatcctggttcgcctggcaaggatggagtgccgggaattcgcggtgaaaagggtgacgtcggatttatgggacctcgcgggctgaagggtgagcgcggagtgaaaggcgcttgtgggcttgacggagagaagggagacaagggagaagcagggcctcctggacggcctgggctcgccggacataaaggagaaatgggggaacctggggttcctggacaatcgggggcacctggaaaggaaggactcataggaccgaagggggaccgtggatttgatggtcagcccggtccaaaaggggatcaaggagagaaaggagaacgtggcacgcccgggataggaggttttcctggacccagcggaaatgacggttccgctggacctcctggacctcctggttcagtgggacctcgcggacctgagggattgcagggccagaaaggtgagagggggcctccaggggagagagtggtcggtgcacctggcgtgccaggagcacctggtgaacgcggcgaacagggccgaccaggtccagcgggccctagaggtgagaagggtgaggcagcccttacggaggatgacatcagaggatttgtccgccaagaaatgtcccagcactgcgcatgccagggtcagttcattgcaagcggttcccgccccctgccatcatacgcggcagacaccgcaggttcccaacttcatgcagtccctgtgctccgagtgagccatgcggaagaggaggagcgggtgcctccagaagatgatgagtactccgaatactccgagtactccgtcgaggaataccaagaccccgaagcaccttgggattcggacgatccttgttcgctccctcttgacgagggtagctgtactgcatacacccttcggtggtaccatcgtgcggtcacgggttctactgaggcatgccacccctttgtttacgggggttgtggcggcaatgcaaacagatttggcactcgagaggcatgcgaacggcggtgcccaccacgggtggtccagagccaaggtactggaactgcacaagat

SEQ ID NO: 9602 - DNA, 8832 bp, Artificial Sequence
  Description of Artificial Sequence: Synthetic coding sequence
atgacccttagactgctggtggccgccctttgtgccggaatcctcgcggaggcgccgagggtccgggcacagcatagggaacgggtgacgtgtacccggttgtacgcggcagacatcgtgttcctcctcgacggctcgtcgtccatcggtagatcaaacttcagggaagtgaggtccttcctggaagggctcgtgctgccgttcagcggagccgcatcagctcagggagtgaggttcgcgactgtccaatacagcgacgatccgcgcaccgaattcggactggacgccttgggatcgggtggagacgtgatccgcgcgatcagagaactgagctacaagggagggaatactagaactggagccgcaatcctgcacgtggcggaccacgtctttctcccgcagcttgcacggcccggcgtgcctaaggtgtgcatcctcatcactgacggcaaatcgcaggacctcgtcgacactgccgcccagcggcttaagggccagggagtcaaactgttcgcggtgggtatcaagaatgcggatccggaggagctgaagagggtggcatcccagccgacctcagacttcttctttttcgtgaacgatttcagcatcttgcggaccctcttgccgctggtgtccagaagggtgtgcaccactgcggggggagtcccagtgactcggcccccagatgactccacctccgccccacgggatctggtgctttccgagccctcgagccagtccctgcgggtgcagtggaccgccgcatcaggtccagtgactggatacaaagtgcaatatacgcccctgaccggcctcggacaaccactgccgagcgaacggcaggaagtgaatgtgccggcgggagagactagcgttaggctgcgcggtctgcgcccactcactgaataccaggtcactgtgattgccctgtacgcgaattcgatcggagaggccgtgtcgggcactgccagaactaccgctctggagggcccggaactgaccatccagaataccaccgcccattcgctgctggtcgcctggcggtcggtgccaggagccactggataccgcgtgacctggcgcgtactgtcgggaggacccacgcagcagcaggagctgggcccgggccagggaagcgtcttgttgcgcgacctcgaacctggcactgactacgaggtcactgtgtccaccctgttcggccggtccgtggggccggccaccagcttgatggcccgcactgacgcctcggtggaacagaccctcagaccagtgatcctgggaccaaccagcatccttctctcgtggaacttggtgcccgaggcgcgcggataccgcctcgagtggcgcagagaaactggactcgaacccccacagaaggtggtcttgccgtccgacgtgaccagataccaactggatggcctccagcccggaactgagtaccgcctgactctctacaccctgctggagggacacgaagtggcaaccccggcgactgtggttccgactgggcctgagctgccggtgagcccggttacggacttgcaggctaccgagctcccgggacagcgcgtgcgtgtctcctggagccccgtgcctggggcaactcagtaccggattatcgtgaggtcgacccagggcgtggagcggaccctggtgctgcccggctcacaaaccgctttcgatcttgacgacgtgcaagcaggtctttcatatactgtgagggtgtctgccagagtggggcctcgggaaggatcggcgtcggttctgactgtcagaagagagccggagacgcccttggcggtgcccgggctgagagtggtcgtgagcgatgctaccagagtccgagtggcatggggcccagtcccgggcgcctcgggattccgcatctcatggtcaacgggctctgggccggagtcgtcacaaactctgccgccggactccaccgctactgacatcactgggctgcagcctgggaccacctaccaagtggcagtctccgtgctgcgggggcgcgaggaggggcctgcggccgtgatcgtcgcgagaactgatccactgggtccggtgcgcactgtgcacgtcactcaagccagttcgtcctccgtcactatcacctggaccagggtcccgggcgcgactgggtaccgggtgtcgtggcattcagcgcacggcccagaaaaatcccaattggtttcaggcgaagccactgtggcggaactggatggtctggagccggacaccgagtacaccgtgcacgtgagggcgcatgtcgcgggcgtggacgggccgcctgcctcggtggtggtgcggaccgccccggaaccggtgggacgcgtgagccggctccagatcctcaacgcttcgtcagacgttcttcgcatcacctgggtgggagtgaccggagccaccgcttaccggctggcgtgggggcgctccgaagggggtccgatgaggcatcagatcctccctggaaacaccgactcagcagagataagaggcctggagggaggagtgtcgtacagcgtgcgggtgaccgcgctggtgggagatcgcgaggggacgccggtgagcatcgtggtgaccaccccgccagaagcaccgcctgccctgggaactttgcatgtcgtccagcgaggtgagcattcgcttcggctccgctgggaaccggtgcctagagcgcagggattcctgctccattggcagcctgaaggaggccaggagcagtcgcgtgtcctcggacctgagttgagctcataccatctggatggacttgaacctgcgacccagtatcgcgtcaggttgagcgtgctcgggcctgccggggagggaccatcggcggaagttaccgctcggaccgagtccccgagagtccctagcatcgaactcagggtggtggacaccagcatcgactcagtcaccctggcatggactccagtcagcagagcctccagctacattctgtcctggaggcctcttcgcggcccaggccaggaggtgccgggaagccctcaaaccctgccaggaatatcatcaagccaacgcgtgaccggcctggaaccgggtgtctcgtacatcttttctctgaccccagtcctggacggcgtgagaggtcccgaagcctcggttacccaaaccccagtgtgcccgagaggactcgctgacgtggtgttcctgccgcacgcgactcaggacaatgcccacagggcagaggccacccgacgagtgctggagcggctcgtcctggcgctgggcccccttggtccacaggccgtccaggtcgggctgctgagctacagccatcgcccgtcgccactgttcccgcttaacgggagccatgaccttggaatcatcctccaacgaatcagagatatgccgtacatggatccgtctggaaacaacctcggaactgcggtggttactgcgcaccgctacatgctcgctccggacgcgcctggacggcgccaacacgtgcctggcgtgatggtcctcctggtggacgaacccctgcggggagatatcttctcgccgatccgcgaggcccaggccagtggactgaacgtggtgatgctgggcatggccggcgcagatccagaacaattgcggcggctcgccccaggaatggactctgtgcagactttcttcgccgtggacgacggaccctcgctcgaccaggcagtgagcggcttggccacggcgctctgccaggcatctttcactacccaacctcgcccagagccatgcccggtctactgcccaaaaggacagaaaggcgagccgggagaaatgggactgcgcggccaggtgggaccgcctggagatcccgggctcccgggtcgcaccggcgcccctgggccgcaaggaccaccgggcagcgccaccgccaagggagaacgcggttttccgggagctgacggacgcccgggaagccccggccgggccggaaacccggggacccctggcgctcccgggctcaagggatccccgggactgcctgggccgcgcggtgaccccggtgagcggggaccccgcgggccaaaaggagaacccggggcccccggacaagtgatcggaggcgagggtcccggactgccggggcggaaaggtgacccgggaccatcagggcctcccgggccaaggggccctctcggcgacccgggaccgcgcggcccacccggcctgcctggaacggctatgaagggagataagggcgacagaggtgagcggggtcctcctggacctggagaaggaggaatcgccccgggagaacctggactgccgggtctgccgggatccccgggcccgcaaggaccggtgggcccgccaggaaagaaaggtgaaaagggagattcggaagatggtgcccccggactgccagggcagccaggatccccgggggaacaggggccgagaggacccccaggagctatcggacctaagggggaccgcggattcccgggaccgctgggggaagccggagaaaagggagaaagaggcccaccgggaccggctggatccagagggctgccgggcgtcgccggacgaccgggtgcgaagggaccagaaggcccgcccggccctaccggccggcagggtgagaaaggagagccgggtcggcccggcgatccagccgtggtcggacctgctgtggcaggtccgaagggtgaaaagggggacgtgggacctgcgggaccacggggagctaccggcgtgcagggtgaacggggccccccggggttggtgctcccaggcgacccgggcccaaaaggagatcctggggatcgcggaccaatcgggctgactggacgcgccggtccgccaggcgactcaggacctccaggagagaagggtgacccgggacgtccggggccgccagggcctgtgggaccacgaggcagggacggggaggtcggggagaagggagatgaaggaccgccaggggacccaggcctccctggcaaagctggtgagagaggactgcgcggagctccgggcgtgagaggaccggtaggtgagaagggcgaccagggggacccaggagaggacggtcggaacggctcgcctggatcctcgggacctaagggagacagaggcgaaccaggacctcctgggccgccgggccgcctggtggacactggacctggagcaagggaaaaaggggagcccggcgaccggggccaagaagggccacggggacctaagggggaccccggactcccgggagcgccgggagaaagagggatcgagggtttcagaggcccacctggcccgcaaggcgacccgggcgtccggggaccggccggcgagaaaggcgaccgcggaccgccgggactggacggacggtccggcctcgacggcaaaccaggcgcggccggaccttcgggacccaatggagcggccggaaaagccggagatcctgggcgcgacggactgccgggattgcgcggcgagcagggtctgccgggaccgtccgggccgcctggcctgccgggaaagccaggcgaggatggcaagccgggactgaatggaaaaaacggtgagcctggagatcctggagaagatggacgcaagggagaaaagggtgattcaggagccagcggccgcgagggacgcgacggaccaaaaggagaaagaggcgcgccgggaatccttggcccgcagggcccgccagggcttccgggaccagtgggtcccccgggacaaggatttccgggggttccggggggcaccggcccgaagggggaccgcggcgaaactggatcgaaaggtgaacagggcctgccgggtgaaagaggtctgcgcggagagcctggatcagtgccaaatgtggacaggctcttggaaactgctggaatcaaggcctccgccctgagagaaatcgtggaaacttgggacgaaagctcgggatcgtttctgccagtgcccgagaggcgccgcggaccaaaaggggactcaggcgagcaaggaccaccgggcaaggaggggccgatcggattcccaggcgagagaggtctgaagggcgaccgtggggatccgggaccgcagggcccaccagggctcgccctgggagaacggggtcctcctggcccgtcaggcctggccggcgagcccggaaagccaggtatccccggactgccggggcgcgcgggaggcgtcggagaagcgggacggcctggagaacgaggcgagcggggcgaaaaaggcgagcggggagagcagggtagggacgggccaccaggactgccggggacgccaggacctccgggacccccaggaccgaaggtcagcgtggacgagccaggaccgggcctgtcgggagagcagggaccaccaggcctgaagggagcaaaaggcgaaccaggatcaaacggggaccaggggccgaagggagatcgaggtgtgccgggcatcaagggcgaccgcggcgagcctggacctcgcggacaggacgggaaccctgggctgcctggagagcggggtatggctgggccggagggcaagcctggactgcaaggcccacgcggcccgccaggcccagtggggggacatggggaccccggcccacctggtgccccaggccttgcaggcccggctgggccacaaggaccaagcggattgaaaggagaacctggggagacgggaccgccaggaagaggcctcactggtcccaccggagcggtgggactgccgggccctcctggcccttcgggactcgtgggaccgcaggggtccccaggcctgccgggacaggtgggtgaaacgggtaaacccggcgccccgggtagagatggagcatccggaaaggacggcgacagaggctcaccgggagtgccgggctcgccgggactgcctggcccggttggcccgaaaggagagccggggccgactggagccccaggacaagcggtcgtgggcctgccaggggccaagggggaaaagggcgcaccgggtggactggcgggcgacctcgtgggagagccgggagccaagggggataggggactgcctggcccaagaggagaaaagggagaagccggaagagcgggagagccgggtgaccccggagaggacggccagaagggggccccggggccgaaaggcttcaagggggacccaggggtgggcgtgccgggtagcccgggaccgcccgggccgccgggggtgaaaggcgatttgggactcccgggactgcccggcgcgccaggagtagtgggattcccgggacagaccgggccgagaggcgagatgggacagccgggcccgtcaggcgaacggggcttggcaggacctcccggtagagaaggaatcccgggcccactcggaccgccaggaccgccaggatcggtcggaccgccgggagcatccggcctgaagggcgataaaggtgacccgggtgttggattgccgggacctagaggggaaagaggagagcctggcatccgcggagaagatggacgcccggggcaggaaggcccgcggggactcaccggtccgccagggtccagaggcgaacggggagagaagggagacgtggggtccgcgggcctcaagggagataagggggattctgccgtcattttggggcctccgggacctcgcggagccaaaggtgacatgggagaacgtggaccaaggggactggatggagacaaggggccccgcggggataacggggacccaggcgacaagggaagcaagggcgagccaggagacaagggatcggctggacttccgggccttcgcggcctgctgggaccacagggtcagccgggagcggcgggcattccgggagatccgggctcccctggaaaagacggagtccctggcattcgcggcgaaaaaggggatgtgggatttatgggcccacgcggactgaaaggggaacgcggggtgaaaggagcatgcggactggatggagagaaaggtgataaaggggaggctgggccgccgggaaggccaggactggcaggacacaagggagagatgggcgagcccggagtgcccggacaaagcggagccccgggtaaggaaggcctgatcggaccgaaaggcgatcgcggattcgacggccaaccaggaccaaaaggcgaccaaggggaaaagggtgaacgcggaacccccggaatcggcggcttccccggacctagcggaaacgacggatcggcggggccgccgggaccaccgggcagcgtcggaccgagggggcccgaaggactgcagggacagaagggcgaacgcggacccccgggcgaacgcgttgtgggtgcacctggcgtgccaggggcgccaggagaacggggggaacaaggaaggcccggacctgccggaccccggggagaaaaaggtgaggcagcgctcactgaggacgacattcgcggctttgtccggcaagagatgtcccagcactgcgcgtgccaaggacagttcatcgcgtccggatccaggccgttgccgtcctacgcagcagataccgcagggtcgcagctgcatgctgtgccggtcctcagagttagtcacgccgaagaggaagagcgcgtcccgccagaggacgacgaatactccgagtattccgagtactctgttgaggaataccaagacccggaggcaccgtgggattcagacgatccctgcagcctgcctctcgatgaaggttcttgtaccgcctacaccttgaggtggtaccaccgcgccgtgaccgggtccaccgaagcatgtcatccgttcgtatacggaggatgcggagggaatgctaaccgcttcggcacccgcgaagcgtgtgagagaaggtgcccgccgagagtggtccagtcgcagggcaccggaaccgcgcaagac

SEQ ID NO: 9603 - DNA, 8832 bp, Artificial Sequence
  Description of Artificial Sequence: Synthetic coding sequence
atgaccctgaggctgctggtggcagcgctctgtgcaggcatcctggccgaagcgccgcgggtccgtgcgcagcatcgggagcgcgtgacttgcacccgcctgtacgccgcagacatcgtgttcttgctggacggatcttcatcgatcggacggagcaacttccgcgaagtgcgctccttcttggagggcctcgtgctgccattcagcggtgcagccagcgctcagggagtccggttcgccacggtgcagtactcagatgacccgcggactgagtttggtctggacgcccttggcagcggaggggacgtgatcagggccatccgggagttgtcctacaagggaggaaacacccgcactggcgctgcaatactgcacgttgccgaccacgtgttcttgccccagctcgcccggccgggggtccctaaggtctgcatcctcatcaccgatggaaaatcacaagatctcgtcgacaccgcggcccagcgcctgaagggtcaaggagtgaagctgtttgcagtgggcatcaagaacgctgaccctgaagagctgaagcgcgtggccagccagccgaccagcgatttcttcttcttcgtcaatgatttcagcatccttcggaccctgctgccacttgtgtcccggagagtgtgtacgaccgccggcggagtaccggttactcggccgcccgatgactcaacctcggcaccgcgcgacctggtgttgagcgagcccagctcacagtcgttgcgcgtgcagtggaccgcagcctcagggccggtgactggttacaaggtgcaatacacccctctcaccgggctgggccagccactgccatcagaacgccaggaagtgaacgtgccggcaggagaaactagcgtcagactccgcggactccgccccctcaccgaataccaggtgactgtgatcgctttgtacgcgaactcaatcggagaggcggtgtcgggaactgcaagaaccaccgcgctggaaggaccggaactgaccatccaaaacaccaccgcgcatagcctgttggtggcctggcggtcggtcccgggcgctaccggatatcgagtgacctggcgagtcctttcgggcggtcccacgcagcaacaggaactcggacctggacagggatcggtattgctccgcgaccttgagccgggtacggactacgaagtgaccgtgagcaccctgttcggtcggtccgtgggcccggccacgtcgctcatggccaggacggacgcaagcgtcgaacaaaccctgcggccggtgattctgggaccgacctcgatcctgctttcgtggaacctggtgcccgaagcgagaggatacagactcgaatggagacgggaaacgggcctggaaccgccgcaaaaggtggtgctgccgtcggacgtgaccagataccagctggatggactgcaacctggaactgagtacagactcacgctgtacactttgttggaagggcatgaggtcgctacccccgccaccgtcgtccccaccggaccggaactccctgtgtcaccggtgacggacctgcaggccactgaactccccggacaacgcgtcagagtctcgtggagccctgtcccgggagccacccaataccggatcatcgtgcggagcactcagggagtggaacggacgctcgtgctccccggatcccaaactgcctttgacctggatgacgtgcaagctggcctgtcgtacactgtccgcgtgtcggcgcgtgtgggacctcgggaaggttcggcgtctgtgctgacggtcagaagggaaccggagactccactggcagtcccgggcctccgcgtcgtggtgtcggacgcaacccgcgtccgagtggcctggggaccagttccaggcgcctcaggtttccggatcagctggtcaactgggtccggaccagaatcgtctcaaaccctgccgccggacagcaccgccaccgatatcacgggactgcagcctgggaccacttatcaggtcgcggtgtcagtgcttagaggacgcgaagaaggcccagctgctgtcatcgtggcgcggactgatccactcggaccggtcaggactgtgcatgtcacccaggcttcatcgagctcggtcaccatcacctggactcgggttccaggtgccactggatacagggtcagctggcactccgcgcacggacccgaaaagtcccaactcgtgtccggagaggccaccgtggcagaactggacgggctggagccggacaccgagtacactgtgcacgttagagcacatgtcgccggagttgacggcccccctgcatctgttgtcgtacgcactgcaccggaacccgtgggacgagtgtcaagactgcaaatcctcaacgcgtcgtccgacgtcctcagaatcacttgggtgggcgtcacgggagcaaccgcttaccggctcgcatgggggcgctcagaaggtggccccatgcgtcaccagattttgcctggtaatacggattcggcagagatccgtggtctggagggaggggtgtcttactctgttcgcgtgactgcgttggtcggggacagggaaggaactcccgtctcgatcgtggtgactacccctcccgaggcccctccggccctgggcactctgcatgtcgtccagaggggagagcactcgctgcggctgcggtgggaaccggtgccgagagctcagggctttcttctgcattggcagccggagggcgggcaggaacagtcccgggtgcttggcccagaactcagcagctaccacctcgatggcctcgagcccgccactcaataccgggtgcggctgtccgtgctcggacccgccggagaaggaccgtccgcagaggtgaccgcacgcaccgagtcaccgcgggtgccgtcaatcgaattgcgggtggtcgacacctcgatcgattcagtgaccctggcctggactcctgtgtcgcgggcctcctcatacattcttagctggcgcccgctgcgggggccaggacaagaggtgccgggatcaccacagactcttcccgggatctcgtcgtcccagcgcgtgaccggtctggagccgggcgtgtcctacatcttctctctgactcctgtgctcgatggagtgcggggtccagaagcatccgtgactcagacgcctgtgtgcccgcgcggactggcggatgtggttttcctgcctcacgctactcaggataatgcgcatagggcagaggcgacgcgccgcgtgctggagagactggtgctggcactgggacctctgggaccacaagccgtgcaggtgggactgctgagctacagccaccgcccttcgccgctgtttccgctgaatggctcccacgatctcggcattatccttcaaagaatccgggacatgccatacatggacccttccggtaataaccttggaactgccgtggtgactgcacaccgctacatgctcgcccctgacgcgcctggtagacgccaacatgtgccgggcgtgatggtcctcttggtcgacgagccgctgaggggggacatcttcagccctatccgggaagcgcaggcttcagggctgaacgtggtaatgctcggcatggcaggagccgacccggagcaactgcgacgtctcgctccgggaatggattcagtgcaaactttcttcgcagtagacgacggaccttctctggaccaagcggtgagcggactggctactgctttgtgtcaggcttccttcaccacccagccaagaccagagccctgcccagtatattgtcccaaaggacagaagggagaaccaggcgagatgggtctgaggggccaggtgggaccgccgggtgacccggggctcccgggcaggactggtgccccgggacctcaaggacccccaggttccgcgactgccaagggtgaacgcggattcccaggagcggatggccgcccgggatcgccgggtagagcaggaaacccgggcactcctggcgcaccgggacttaaaggatcgccaggactgccgggccctagaggcgacccgggcgagcgaggaccacggggaccgaagggtgaacctggagcgcccggacaggtgatcggcggtgaaggacctggcctgcccggacggaagggcgacccgggcccgtcgggacccccgggtccgcgcggaccactgggggacccaggaccacgcggaccgccaggactgcctggaactgcgatgaaaggagataaaggagatagaggcgagcgcgggcccccagggcccggagagggcggaattgccccaggagaaccgggacttccagggcttccgggctcgccgggacctcagggtccggtggggcctcccgggaagaagggagaaaagggagactcggaggacggtgcgccgggactgccggggcaaccaggatcgcctggagagcaggggccccgggggccaccgggagcaatcggcccgaaaggagatcgaggattcccgggcccgttgggtgaagcgggtgaaaaaggagagcgcgggccgccgggccccgccggttcgcggggcctcccaggagttgccggaaggccaggagccaaaggtcccgagggcccgccaggtccgactggacggcagggagagaaaggagaaccgggccggccgggagatccggccgtggtcggtccggccgtggcgggccctaagggagaaaaaggcgacgtcggtcctgccggccccagaggggctactggagtgcagggagaacgcggcccgccgggactcgtgttgccgggggacccgggaccgaagggcgatccaggagatagaggcccgatcggacttaccggcagggcaggaccccctggagactcaggcccgccaggagaaaagggagatccgggcagaccaggccctccaggacctgtgggaccgcggggacgggatggtgaggtgggggaaaaaggcgacgaaggcccgccaggcgatcctggcctgccgggtaaagccggcgaacgggggttgcggggtgcaccaggcgtccgcgggccagtcggcgaaaagggagatcagggtgaccctggagaggacggaagaaacggatcgccaggatcgagcggaccaaagggggatagaggtgaaccaggaccaccgggcccaccgggacgcctggtcgatactggacctggagctcgcgaaaagggagaaccgggcgaccggggacaggaaggtccgcgcggaccaaagggtgacccaggccttccaggggccccgggcgaacgcggtattgagggatttcggggaccgccaggaccgcagggagatccgggcgtgaggggaccggccggtgagaaaggtgacagaggcccaccggggcttgatggcagatcaggcctggatggaaagccgggcgcggccggcccgtcgggcccgaacggagcggcgggaaaggccggcgatcctggcagggacggactgccaggactgcggggagaacaaggcttgccgggaccatccggcccaccaggactcccaggcaagccgggggaggacgggaagccgggactgaatggtaagaatggagagccgggagatccaggcgaggacggaaggaagggcgagaaaggcgatagcggagccagcggaagggagggccgcgatggcccgaagggagagcgcggcgcaccgggtatcctcggaccacagggcccgcctggattgccaggacccgtggggcccccaggtcagggtttcccgggggtcccaggaggcaccggtccgaagggcgaccggggagaaactggctcgaagggagaacaagggctcccgggggagagagggctgagaggtgaacccgggtcagtcccgaacgttgaccgcctgctggagacggccggcattaaagcgtcggccctgcgggagatcgtggaaacctgggatgagtcctcgggatcgttcttgcctgtgccagaaagacgcaggggacctaaaggagactcgggagaacaaggtccgccgggaaaggaaggacctataggttttccaggagaacggggactcaagggtgatcggggagatccgggacctcagggacctccgggtttggccctcggagaaaggggaccgccaggtccaagcggactggctggagagccaggtaaaccgggcatcccaggattgccgggacgggcgggcggagtgggtgaggccggacgcccgggagaaaggggagaaaggggagaaaagggagaacgtggcgaacagggacgcgacgggccgccgggactcccgggtaccccgggtccgcctggaccgccaggcccgaaggtgtcggtggatgaaccagggcctggattgagcggggaacagggaccgccgggcctgaagggcgcgaagggtgagcctggaagcaatggtgatcaaggcccgaagggggaccggggtgtgcctggaatcaaaggcgataggggcgaaccggggcctagaggacaagacggcaacccgggactgcccggtgagcgggggatggctggtccggaggggaagcccggactgcaaggaccgcgcggtccgccgggtccagtgggtgggcatggtgacccgggacctccaggggctcccggacttgcaggcccggccgggccgcagggaccatcagggctcaaaggggagccgggtgaaaccggtccgccgggacgcggtttgactggaccaactggcgcggtgggtctgccgggacctccaggaccgtcgggactggtggggccacagggctcccctgggctgccgggccaagtgggtgaaaccggaaaaccgggggcacctggacgggatggagcgtccggcaaggacggagatcgagggtcccctggcgtgccggggtccccgggactgccgggaccggtcggcccaaaaggagagccgggccctaccggagccccgggccaagcggtggtgggactcccaggcgccaagggagaaaaaggagcccctggaggactggccggtgacctggtcggggaaccgggcgctaagggagacaggggattgccggggccacgcggagagaagggagaagccggaagagcaggcgagccgggcgacccgggagaggacggacagaagggcgcaccgggacctaagggattcaagggggaccccggagtcggagtgcctggctcaccgggaccgccaggccctcccggagtgaagggagatctggggttgccgggactgccgggggcgcccggggttgtcgggttcccaggacagaccgggccacgaggggaaatgggccagccagggccctcgggagaacgcggcctggctggtccgccgggcagggaggggatccctggcccactcggacctcctggtcctcctggcagtgtggggccaccgggcgcatccgggctgaagggagacaaaggcgacccgggagtgggccttccaggaccaaggggagagaggggagagccaggaatcagaggcgaagatggacgccctggacaggagggtcctcggggtctgactggccctcccggatcgagaggtgaacgtggagagaagggagacgtcggaagcgcgggtttgaagggagataagggggactcagccgtgatcctgggtccgccagggccccgcggagcaaaaggagacatgggtgagcgcgggccacgcggacttgacggagataagggaccacggggagataatggggacccgggcgataaggggtccaagggggaacccggagacaaaggatcggctggcctgccagggctccgcggccttctgggaccgcagggacaaccgggcgcagccggaatcccaggcgacccgggtagtccggggaaggacggtgtgcctggtatcagaggtgaaaagggagatgtcgggttcatgggcccacggggcctgaaaggtgaacggggagtgaagggggcctgcggactggacggtgaaaagggagacaagggagaagccggaccgccgggcagacccggactcgcaggacacaagggagagatgggcgagccgggcgtgccaggacagtcgggcgctcctggaaaggaaggacttatcggcccaaagggagatcgcggattcgatggacaaccaggacccaagggagatcagggcgagaagggcgagagagggaccccgggcatcggcggcttcccgggaccatcggggaacgacggatcagccgggccgcctgggccgccgggatctgtcggaccaagaggtccagaagggttgcaaggccagaagggtgagagaggaccgccaggagaacgcgtggtgggcgccccgggagtgcctggcgcccccggagaaagaggcgagcaaggacggccaggtcctgcggggccacgcggagaaaaaggggaagccgcattgacggaagatgacataagaggatttgttaggcaagagatgtcccaacactgcgcctgtcagggacagtttatcgcgagcggtagccgtccgttgccatcgtacgccgcggataccgcaggctcccagctgcacgccgtgcctgtgctgcgcgtgtcccacgcagaggaagaagagagggtgcccccggaagatgacgagtactcagagtattcggaatactccgttgaggaataccaggacccggaagcaccttgggacagcgacgacccgtgctcactcccgcttgacgagggaagttgcactgcttataccctgaggtggtaccatagagcagtgacgggatccaccgaagcgtgccacccttttgtgtacggaggttgcggaggaaatgccaaccggtttggaaccagggaagcatgcgagcgcagatgcccgcctcgcgtggtccagtcccaggggactggaaccgcgcaggat

SEQ ID NO: 9604 - DNA, 8832 bp, Artificial Sequence
  Description of Artificial Sequence: Synthetic coding sequence
atgaccctgaggctgttggtggcagctctttgcgcaggaatcttggcggaagcgcccagagtgcgcgcccaacatcgcgagagagtcacctgcacccggctctacgcggccgatattgtgttcttgctggatggatcgtcatcgatcggaagatcgaatttcagggaagtgaggagcttcctcgaaggtctggtgctccctttcagcggagcggcctccgcgcaaggtgtccgattcgcaaccgtgcaatactcggacgatccgcggactgaattcggactggacgccctgggttcgggtggggacgtgatacgggccatccgggaactctcgtacaagggcggaaatacccggactggagcggcgatcctgcacgttgcggaccacgtctttctgccccaactggctcggcctggagtgccgaaggtgtgcatcctgattaccgatgggaagtcccaggacctcgtggacaccgcggcgcaacggctgaagggacagggagtgaagctcttcgctgtcggcatcaaaaatgccgacccggaggaactgaaacgcgtggcatctcaacctacttctgatttcttcttcttcgtcaacgatttctccatcctccgcaccctcctccctctggtgagcaggagagtctgcacgactgccggaggcgtccctgtcactcgcccgcccgacgactccacctcggcaccccgggacctcgtcctttcggaaccttcatcccaatcactgcgggtgcagtggactgccgcctccggaccggtgaccgggtacaaagtccagtacaccccgctgactggattgggtcagccactcccctccgaaagacaagaagtcaatgtgccagccggggaaacctcggtgcgccttagaggactccggccgcttaccgagtaccaggtgactgtgattgcactctacgcaaactcgatcggggaggctgtgagcggaacggctcgcaccaccgcactggaaggcccggagcttacgatccaaaatactactgcccactcgctccttgtggcttggcggtccgtgccgggagccactggataccgcgtgacctggcgggtgctgtcaggcggcccaactcagcagcaggagctgggaccagggcaggggtcagtgctcctgagggatttggagccagggacggattacgaggtgactgtctctactctgttcggacgctccgtggggccggccacttctcttatggcccggacggatgcatccgtggagcaaactctgcgaccggttatcctggggccaaccagcatcctgctgtcgtggaacctcgtgccggaagcacgggggtaccggctggagtggcgcagagaaaccggactggaaccccctcagaaggtggtgttgccctcggatgtgacccgataccaactcgacgggctgcaaccgggaactgaataccgactgacgctgtacactcttctggaaggccatgaagtggccacgccagctactgtggtgccgactggcccggaacttccagtgtccccggtcacggaccttcaggctactgagctcccgggacagcgggtgcgggtgtcctggagcccagtgccgggtgccactcagtacaggatcatcgtccgcagcactcagggagtcgaaagaaccctggtgctgcctggatcgcaaaccgccttcgacctggatgacgtccaggcaggcctcagctacactgtgcgcgtgtcagccagggtgggtccgcgagagggatcggcttcagtgcttacggtaagacgagaacctgagacgccgttggcggtcccgggactgagagtcgtcgtgtctgacgcaactcgggtgagagtcgcatggggacctgtccccggggcctccggatttcgcatctcatggagcaccgggagcggacctgaatcgtcacaaactcttccaccggatagcaccgccactgacatcactggactgcagcctggaactacctaccaggttgctgtgtcggtgctcagaggacgtgaggaaggaccggcggccgtgatcgtcgcaagaactgacccactcggaccagtgcggactgtgcacgtcacgcaggcctcatcgtcatccgtcaccatcacctggacccgcgttccgggagcgaccggataccgcgtatcgtggcatagcgcccatggaccagaaaagtcccagcttgtcagcggagaagccaccgtggcggaactggacgggctggaacccgatactgaatacaccgtccacgtcagagctcacgtcgcgggagtggacggcccacctgcttccgtcgtggtgagaaccgccccagaacccgtggggagggtgagccgcctccaaatccttaacgcgagctccgatgtcctccggattacttgggtgggggtgaccggagctactgcctaccgccttgcctggggacgatcggaaggtggaccgatgcggcatcaaatcctgccgggcaacaccgattcggcagaaatcaggggactggaagggggagtttcatactcagtccgtgtcactgctctggtgggcgaccgggagggaacgcctgtgtctatcgtggtcactaccccgcccgaggcccctccggcactcggaacgctccacgtggtgcaacgcggagaacactcactgcgcctgcggtgggagcccgtgccgcgcgcccagggtttccttctgcattggcaacccgaaggaggccaagaacagtcccgggtgctgggaccggagttgtcaagctatcatctcgatggacttgaacccgcaacccagtacagagtccggctttccgtgttgggccctgcgggagagggcccgagcgccgaagtgaccgctcggaccgagtcccctcgcgttccgtccatcgagctcagagtggtggatacctcgattgactcggtgaccctggcctggaccccggtgagccgcgcttcctcgtacatcctgtcgtggaggccgctgagaggcccaggacaggaagtgccaggctcgccgcagactctgccgggtatttcaagctcgcagcgcgtcactggtctggaaccgggagtgtcatacatcttcagcctcaccccggtgttggatggtgtccgcggacccgaggcttccgtgactcaaacgccggtgtgcccgcgcggactcgccgacgtcgtctttctgccacatgcgacccaagataacgcccaccgcgccgaggcaacgcggcgcgtgcttgagcgcttggtcctcgccctgggaccactgggaccgcaggcagtgcaagtcggactgctgtcctactctcaccggccctcccctctcttcccactgaacggctcccatgacctgggaatcatcctgcagcggatccgagacatgccgtatatggatccatcaggaaataacttggggaccgccgtcgtgactgcccaccgctacatgctcgcgccggatgccccagggcggcgtcagcatgtcccgggagtgatggtcctgctcgtggacgagcctctccggggtgacatcttctcgccaatcagagaggcgcaggccagcggtttgaacgtggtgatgctcgggatggctggcgccgacccggagcaactgaggcggctcgcgccgggaatggactcagtgcaaacctttttcgccgttgacgacgggccgtcattggatcaggcagtctccggcctggccactgcgctgtgccaagctagcttcaccacccagcctagaccagagccgtgcccggtgtactgccccaaggggcagaagggcgagccaggagaaatgggactgagagggcaggtcggtcctccgggcgaccctggcctgcctggcagaaccggagcccctggccctcaggggcctccggggtcggctactgcgaaaggagaacgcgggtttcccggtgccgacggacggccgggcagccccggaagagctggtaacccgggaacccctggggcaccaggactcaagggcagcccaggactgcccggtccgagaggtgatcccggagagaggggcccgcgcgggccgaaaggagagcctggcgccccgggacaggtgatcgggggtgaaggcccgggtttgccgggacggaagggcgatcctggcccgtctggaccgccgggaccgcgcggaccgctgggagatccgggacctagaggaccgccaggactgcctggaactgccatgaagggagacaagggtgacagaggcgaaagaggcccgccagggccgggcgaaggaggtattgcgcccggagagccgggactcccaggactgccaggaagcccagggccccaaggacctgtcgggccaccggggaaaaagggagaaaagggagactccgaggacggggctccgggactcccaggacagccaggatcgccaggagaacagggcccgagaggccccccgggagccatcggtccgaaaggagacagggggttccctggcccgctgggcgaggccggcgaaaagggagagcgtggaccgcctggcccggcgggatcaagaggactcccgggggttgcggggcgcccgggtgcgaaggggccggagggcccacccggacccaccggacggcagggagaaaagggtgaacctgggcggccaggagatccggcggtggtggggccagccgtggcgggccctaagggagagaaaggggatgtcgggccggctggaccacggggcgccactggagtccaaggtgagcggggaccacctggactcgtgctgccgggagatcctggacccaagggggacccgggtgaccggggacccatcggactcactggccgcgcaggaccaccaggagattcggggccgcctggggagaagggagatcccgggcgccctgggccacctggaccagtcggaccacgcggccgggacggagaagtgggagaaaagggagacgaaggacccccgggggatccgggactcccaggaaaagctggagagcgcggactgagaggagctccaggcgtgcgcgggccggtcggagaaaagggggatcagggcgaccccggtgaagatggacggaacggttccccaggatctagcggtccaaagggagatcgcggagagcctggccccccaggcccgccaggccgcctggtcgataccggtccaggagccagggagaagggagagccgggagatcgcggtcaggaaggtcctagaggcccgaagggcgatcctggactgccaggagccccaggagaacggggaatcgagggctttagaggaccgccaggtccccagggggatccaggagtgcgggggccggccggtgagaagggggaccggggaccaccggggctggatggacggagcggactcgacggaaagccgggagccgccggcccgtccggaccaaatggagcggccgggaaggccggggatccaggtcgggatgggctgcctggactgagaggagaacaggggctcccagggccatccggacctcctggcctcccgggaaagcctggcgaagatggaaagccgggactcaacggcaaaaacggcgagccgggtgacccaggagaggacggcaggaaaggtgaaaaaggagattcgggagcgagcggacgtgagggtcgcgatggcccgaagggcgagcggggagcgcctggaatcctgggtccgcagggaccaccaggactgccggggcctgtcggaccacctgggcagggcttcccgggtgtgccgggaggaactggcccaaagggagataggggagaaaccggaagcaagggcgaacagggccttccgggagaacgcgggctgcgcggagagccgggatcagtgcccaatgtggacagactgctggaaaccgccgggattaaggcctctgccctccgcgaaatcgtggaaacttgggatgagtccagcggttcgtttctgccagttccagaacgtcggagaggccctaagggtgattctggcgagcaggggccaccgggtaaagagggaccgattgggttcccgggagaaaggggcctcaagggagatcggggcgatcctggaccccagggaccgccgggactggcgctcggcgagcgcggccctcccggaccgagcgggcttgcaggggaaccgggaaagccaggaatcccgggacttcctggcagagccggcggtgtgggagaagctggacggcctggcgaacgcggcgagagaggtgaaaagggggagagaggagagcagggccgcgatggaccaccagggctgccggggacccctgggccgccgggaccgccagggccaaaggtgtcggtcgacgagccggggccaggactgtcgggggagcaaggaccccccggactgaagggagcaaagggagagccgggtagcaacggtgatcaaggaccaaagggggaccgcggggtgccgggaatcaagggagataggggcgaaccgggaccgagaggccaggatggcaatccgggacttccaggagaacgcggcatggcaggccctgaaggaaaacctggactgcagggccccaggggaccaccggggcccgtgggcggacacggcgatccaggcccaccgggagccccaggactggcgggaccggcgggcccacagggcccgagcggactgaagggggagccgggcgagactggcccgccggggcggggcctgacgggaccaactggagccgtgggactgccaggccctccgggtccgagcggactggtgggaccacaggggtccccgggactcccaggacaggtcggtgagactggcaagccaggagcgcccggacgcgatggcgcatcgggcaaggacggcgatcggggatcgcccggcgttcccggttccccaggactcccggggcccgtgggcccgaaaggggagccaggtccgactggagcgcccggacaggcggttgtgggcctgccaggcgccaaaggagaaaaaggggcacctggcggactcgccggtgacctcgtgggcgaacccggagcaaagggggaccggggactgcccggtccacggggagagaagggagaggcagggagggcgggagaaccaggagatcccggcgaggacggacagaaaggcgcgccaggccccaagggattcaagggggacccgggggttggagtcccgggatcaccggggccgccgggcccgccgggggtgaaaggagatctgggtttgccggggctcccgggtgcccccggagtggtgggattcccaggacagaccggaccacgcggagaaatgggacaaccaggtccttcaggggagagaggactggcaggtccgccaggaagagaaggcattcctggtccgttgggccccccaggacctcccggttcggtgggaccaccaggagcctcgggcctcaagggggataaaggagatccgggagtgggactgccgggacctcggggagagagaggcgagccgggcatccggggcgaagatggccgccctggccaagaaggaccacgcggactgacgggaccgcctggttcacgcggagaacggggagaaaaaggagatgtggggtccgctggactgaagggggacaagggggactccgccgtgatcctcggaccgcctggcccgcggggtgctaaaggagatatgggggagcgcggaccacggggactcgacggagataaaggcccaagaggcgacaacggggaccccggagataagggctcgaaaggggaacctggtgataaaggatccgccggcctgcccggactgcgcggactgctgggaccgcagggacagcctggggcagccggcatccctggagatccaggaagcccaggcaaggacggtgtccctggaatccgcggagaaaaaggtgatgtgggcttcatgggcccgagggggctgaaaggggaacggggcgtgaagggcgcctgcgggctggatggtgaaaaaggagacaagggagaagctggaccgccaggacgaccgggattggcgggacacaaaggcgagatgggcgaaccgggagtgccgggccagtccggagctccgggaaaggaaggactgatcggaccgaagggggaccgcggcttcgatggacaaccgggcccgaaaggagatcaaggagaaaaaggcgaacgcggcaccccgggcatcggaggatttccgggcccctcgggtaatgacggatcggccgggccgccaggaccgccgggatcggtgggtccacggggcccagagggattgcagggacaaaaaggagagcggggccctccgggtgaacgcgtggttggtgccccgggagtgccaggagcgccgggagaacgcggagagcagggccggccgggtccagccggcccgcggggggaaaagggagaggcggccctgactgaggacgacatccggggttttgtccggcaggagatgtcacaacattgcgcatgccaaggacagttcatcgcgtcgggatcgcgcccgcttccgtcttacgccgcggacactgctggaagccaactccacgccgtgccggtgctgcgcgtgtcgcacgcggaggaagaagagcgggtgcctccagaggatgacgagtacagcgaatactctgagtactcggtggaggagtatcaagatccggaagcaccgtgggattcggacgatccgtgcagcctcccactggacgaggggtcatgcactgcatacactcttcgctggtaccatcgggctgtcactgggtcaactgaggcctgccatccgtttgtgtatggaggctgtggaggaaacgcgaaccgcttcggaacgagagaggcctgtgagcggcgctgtcccccgcgcgtggtgcaatcgcaaggaaccgggacggcgcaagat

SEQ ID NO: 9605 - DNA, 8832 bp, Artificial Sequence
  Description of Artificial Sequence: Synthetic coding sequence
atgacattgcgcctattagtcgctgcgctgtgtgctggaatcctggccgaagccccgagagtaagagcccagcatcgggagcgtgtgacctgcacgagactgtatgcggctgatattgtctttttattagatggaagttcatcaattggcagatctaatttccgggaagtgcgttcctttttagaagggttagttttgccgttttccggggcagcatctgcgcagggggttagatttgccacggttcagtattcagatgatccgcgcacggagtttggtcttgatgccctaggcagcggcggcgacgtgatcagagcaatcagggagctctcgtataaaggcggaaacacacgcacaggtgcagccatacttcatgtcgcggatcacgtttttttacctcaactagcacgtcctggagtccctaaagtatgcattctcattacagatgggaaaagccaggatttagttgatactgctgcacagcgattgaaaggacagggagtcaaactgttcgccgtgggtattaaaaatgcggatcctgaagaattaaaaagagtcgcctctcagccgacatccgactttttcttttttgtcaacgacttttcgattcttcggactctattgccactggtttccagacgtgtatgtaccacggcaggaggcgttcccgtgacacggccgccggatgattccacatccgcaccaagagacttggtgttaagtgagccttcatctcaatcactccgcgtgcagtggacggctgcgtcgggaccggttacgggttacaaagttcagtacactccattaacaggtctcgggcaacctctcccgtcagagcgccaggaggtaaatgtgcccgctggagaaacatcggtgcgtctgcgtggcttgagaccgttgacagaatatcaggtaacggtcatcgccctttatgctaattccattggcgaagcagtgtcaggaacagctcggacaacggcgctggaaggaccggaacttactatccagaatacaacggctcattcccttttagttgcctggcgcagtgtacctggtgctacgggatatcgcgttacgtggcgcgtgctctcgggggggccaacacagcaacaggaattaggtccggggcaaggcagcgttttgttacgcgatttggaaccgggcacagattacgaagtgacggtttcaacactttttggtagaagtgtaggcccggcaacctctctgatggcgcgtacagatgcgtctgtggaacaaaccttacgtcctgtaattctaggcccgacttcgattttgctttcttggaatttggtcccagaagcccgtggctatagattggaatggagacgcgaaacaggcctcgaacctccgcaaaaagtggtacttccgagtgatgtgacacggtaccaacttgacggactgcaacctggtactgagtatcgcctgacgttgtacacgttgttggaaggacacgaggttgctacgcccgccaccgtagtgccgacgggcccggaattacctgttagccctgtgaccgatcttcaagctacagaattgccgggtcaaagggtgcgtgtatcttggagccctgtgccgggcgctacacaatatcgcatcatcgtaagaagtacacagggggttgagcggacgttagttcttccgggatcacagacggcctttgatcttgacgatgtccaagcggggttgagctatacagtgagagtttccgcccgagtgggtccgcgtgaaggcagcgcgtcggttttaacagtccgtagggagcccgaaacaccgttagctgtccccggtttgagagtcgttgtttcggatgcaacacgggtgagagtcgcgtggggcccggtgcctggtgctagcggtttcagaatttcttggtctaccggctctggccctgaatcttctcaaacgctgccgcctgattccactgcgacagatataaccggtctgcaaccggggactacatatcaagtagccgtgtctgtccttcgaggacgggaagaaggtccagctgcagtgattgtcgccagaactgaccccttaggacccgttcgtactgtacacgtaacacaggcatcgtcaagctcagtaacaattacgtggactcgggtgcctggcgcaacgggttatcgagtttcgtggcactcagcacatggcccggagaagtcgcagttggtatcgggtgaagcaacagtggcagaattggatggcctcgaaccggacactgagtacaccgtgcatgttcgagcacatgttgcgggcgtggacggtccgccagcctcagtcgtggttcggacggcaccggaacctgtgggacgagtatcacgactgcaaattttaaatgcatcctccgatgttttgcgcattacttgggtgggagttactggtgcgaccgcctatagacttgcgtgggggagatccgaaggggggcctatgcgccaccagattttaccggggaatacagattcggccgaaattcgtggcttagagggaggggtctcctatagcgtaagagtgaccgccttggtgggtgatcgagaaggcactcctgtctcaatcgttgtaacaaccccccctgaggcgccgcctgctttgggaacacttcatgtagtgcaacggggcgaacattcattacggttgcggtgggaacctgtcccgcgtgcacaaggttttctactgcactggcagccagaaggaggccaggaacagtctagggtcctagggcctgaattatcatcataccatttggatggactagaaccggctacacagtaccgggtgagacttagcgtgcttggaccagccggtgagggccccagtgccgaagtcaccgctcgcacggagagccctcgtgttccatcgattgagctacgggttgtggatacgagcattgactctgtaacgcttgcgtggacaccggttagcagagctagcagttatatcttaagttggagaccgttgcgcggacctggccaggaagtgccgggctcaccacagacgcttccaggcatctccagttctcagagagttacaggactggaaccaggagtgagctatattttctcgttaacccctgtgctggatggcgttcgcggccctgaggcgagcgtaacacaaacgccggtatgcccaagaggtcttgcggatgtggtgtttctgccgcatgcgacccaagataacgcacatcgcgcggaagccacacggcgagtccttgaacggttagtcctggcacttggccctctgggaccgcaggctgttcaagtcggccttctttcatatagccatcgcccgtctccgctgtttccattaaatggatcacacgatttaggcatcattttgcaaagaatccgggatatgccgtatatggatccatccggcaataacctggggactgcggttgtgactgcgcatcgctatatgctagctccggacgcgcctggacgccgccagcatgtgccgggtgttatggtcctccttgtggatgaacctctacggggggatatcttctccccgattcgtgaggcgcaggcttctggcctgaacgtcgtaatgttaggaatggccggagcggacccagaacaactgagacgtcttgcgcctggaatggattcagtgcaaacgttcttcgcagtggatgacggcccgtctttggaccaagctgtaagcggacttgcgacagcattatgccaagcgagcttcacaacgcaacctagacccgaaccgtgccctgtctattgtcctaaaggacagaaaggagaacctggagagatgggactccgcggccaagtcggtccgccgggagatccagggttacccgggcgcacaggagcacctggcccgcagggcccgccgggctcagctactgctaaaggtgaacggggcttccctggagctgatggccgacccggctcccccgggagagccgggaaccccggaactccgggggcccctggactgaaaggttctccgggtttaccggggccccgaggagaccctggagagagaggcccgagaggtccgaaaggcgagccaggagcaccgggacaagtcattggtggagaggggcccggtcttcctggccgaaagggggatccgggcccatcaggaccaccgggtccacgcgggcctctgggtgacccgggaccacgtgggcccccaggacttcctggaaccgctatgaaaggtgataaaggtgatcgcggtgaacgtggtccgccgggtccgggtgaaggcggcatcgctccgggagaaccgggactccctgggctgccgggatcccctggacctcaaggccctgttggcccaccgggtaaaaaaggtgaaaaaggtgattcagaggacggagccccaggtctcccgggacaaccgggctctccgggcgaacaaggaccgcggggacctccaggcgccatcggccctaaaggggaccgtggatttccgggcccccttggagaggctggcgagaagggagaaagaggccctccgggtcccgcgggcagtcgtggtctcccgggcgttgccggtcgcccaggcgccaagggccccgaaggcccgcctgggccgacgggtcgtcaaggtgaaaagggagaaccggggcgtcctggggaccctgcggtggtcggccctgccgtggccggaccgaagggagaaaaaggagatgtagggccagctggaccccgtggcgcgaccggggtccaaggcgagcgtggccctccgggactcgtgctacctggcgatccgggacccaaaggagacccaggggatagaggacctattggtttaacgggcagagcgggaccacctggcgattcgggaccgcctggggaaaaaggcgatccgggcagacctgggccaccgggaccagttggtccgagaggtagggatggagaagtaggagagaaaggggatgaaggtcctccgggagatcctggtttgccgggcaaagcaggggaacgcgggcttcgcggagctccaggcgtgcggggcccggtcggagaaaaaggagaccaaggggatccaggagaggatggccggaacggcagtccaggatcctcagggcctaaaggtgatcgcggcgaacctggcccgcccgggcctccaggccggttagtagatacaggacccggcgctcgggaaaaaggagaaccgggtgatcgggggcaagaagggcctcgggggcctaaaggtgatccggggctgcctggtgctccgggagaacgtggcatagaaggatttcgcggacctccgggtccgcaaggggatccgggagtccgtgggccggcaggagaaaaaggcgatagaggccccccaggactggatggcagatcaggccttgatggaaaaccgggcgccgctggacctagcggaccgaacggagcggctggtaaagcgggagacccgggcagggatgggcttccgggcctccggggcgagcaaggcttgcctggcccatctggcccgcctgggttgccgggcaaacctggcgaggacggcaaaccagggctgaacgggaaaaatggggaaccgggagatccgggtgaggatggacgcaagggagagaagggagactctggcgcaagcggccgtgaaggtcgagatggcccgaagggtgagaggggtgctcctggcatcttaggtccgcagggaccaccgggacttccgggtccggttggaccgccgggccaaggatttccgggcgtgccgggcggaacaggccccaaaggcgatagaggcgagacaggcagcaagggagagcaaggactgcctggggaaagaggtctgcgcggtgaaccgggttctgtgccaaatgtggaccgccttttggaaaccgcgggcattaaagcgtcagcattgagagaaatagttgaaacttgggatgaatcatcagggtcttttttacctgttcctgaaagacgacgcggccctaaaggagattctggagaacaaggaccgccaggaaaagaaggccccattggctttcctggggaacgcggccttaagggcgatagaggagatccggggccgcagggcccgccgggactggcgttaggagaacgaggtccaccaggaccgagcggattggcgggtgagcctggcaaaccgggaattcctggacttcccggaagggctggtggtgtgggggaagctggtagaccaggagagcggggagagaggggagagaaaggggaacggggggaacaaggtcgggacggtccgccgggccttcctggaaccccgggacctcctggtccgccgggccctaaagtgtctgttgacgaaccaggaccaggcctgtctggagaacagggtccgccgggactgaaaggcgcgaaaggagagccgggtagcaatggcgatcagggtccgaaaggggatcgcggcgttcctggtattaagggggatagaggtgagccgggaccgcgtggacaggatgggaatccgggattgccgggtgaacgggggatggcaggaccagaaggaaagcctgggctacaagggccgcgaggtccaccaggaccagttggcggacatggcgaccctgggccgccgggtgccccgggattggctggacctgctggccctcagggtccttcgggactgaaaggagaacctggcgaaacaggtccgcctggcagaggtttaacgggccctacgggagcagtcggacttcctgggcctcctggtccgtcgggactagtcggaccacaagggagcccgggattaccgggacaggtcggggagacaggtaaacctggagcccccggacgggatggtgcgtcaggaaaagatggcgatagaggctcaccaggagttcctggttctccagggctacccggacctgttggaccgaaaggagaaccggggcctacgggtgccccggggcaagcagtagtcggcctaccaggagcgaaaggagaaaaaggagcccctgggggtctggccggagacctagtcggagaacctggcgcaaagggagatcgcggcttaccgggaccgcgcggagaaaaaggggaggctggtcgtgcgggtgaaccgggtgatccgggagaggatgggcaaaaaggggctccaggcccgaaagggtttaaaggcgatccgggcgtcggcgtgcctggatcaccggggccacctgggccgcctggagtcaaaggtgatttggggttaccggggctgccgggagcccctggagtggtaggctttccgggccaaacgggcccgcgcggagaaatgggacagccgggccctagcggtgaaaggggactggctggtccgcctggcagggaaggcatcccgggaccgttggggcccccgggccctccggggtccgtaggaccccctggggcatctgggttaaagggcgacaaaggggaccctggcgttggactgcctggtccacgcggagaaagaggtgaaccgggaatccgtggggaagatggaagaccaggtcaggaaggtccgcgaggcctcactggcccgccaggaagccgtggggaacggggggaaaaaggtgacgtaggctccgctgggcttaagggagataaaggggactcagctgttattttgggcccccctgggcctcgaggggcaaaaggagatatgggcgagcgtggaccgcgagggttggatggagacaaaggacctagaggtgataacggggatcccggcgataaaggatctaagggcgaacctggagataaaggtagcgctggtctgccggggttgcggggtttattaggcccacaagggcaacctggggctgccggaataccgggggatccggggtctccgggcaaggacggtgtccctggcattagaggagagaagggggacgtcggttttatgggacctcgtggccttaaaggggaacggggagtgaagggcgcatgtggtctagatggagaaaaaggcgacaagggcgaagccggcccgccggggaggcccggcttggcagggcataaaggagagatgggagaacccggcgtacctgggcaatcaggcgcgcccggaaaggaagggttgattggtcctaaaggagatagaggctttgatggacagcctggcccgaaaggggaccagggggaaaaaggggaaagaggtaccccagggattgggggctttcctggcccttctggaaatgatggcagcgcaggaccgccgggaccgccagggtcagttggacctaggggaccggaaggcttacaaggccagaagggagaacgggggccgcctggcgaaagagtcgttggagcgccgggagttcctggtgcgcccggagagcgtggggaacaggggcgcccaggaccggcgggaccgcgtggagaaaaaggtgaggcagctcttaccgaggatgatattcgtggcttcgtccgccaagaaatgagccagcattgcgcttgccaagggcagtttattgcatccggctctagacctttaccgtcttatgcagccgatactgcgggaagccagctccatgcggttccagttttgcgtgtcagccatgccgaagaagaagaacgagtgcctccagaggacgacgaatattccgagtattcggagtactcagtcgaagagtatcaggatcccgaggctccgtgggattctgatgatccctgttctctccctcttgatgaaggatcatgtacggcgtataccttaagatggtaccatagagcagttacaggttccacagaggcttgccatccgtttgtttatggaggatgcggaggcaatgctaaccgttttggaacacgcgaagcgtgcgagcggagatgtccgccacgtgtggtgcaatcacaaggaacaggcactgcgcaggac

SEQ ID NO: 9606 - DNA, 8832 bp, Artificial Sequence
  Description of Artificial Sequence: Synthetic coding sequence
atgacattgaggctcctcgtggctgctctttgcgctggaatcctcgctgaggcacctcgcgtgagagcacagcatagggagagggtgacctgtactcggctctatgctgccgatatcgttttcctcttagatgggtcatcatccattggaagatctaattttcgtgaagtccgttctttcctcgaggggctcgttctgccgttctcgggtgctgcttctgctcagggtgttcggttcgctacggttcaatactctgatgacccccggacagaatttggacttgacgctcttggatcaggtggagacgttatacgtgctattcgtgaactatcatataaagggggaaacaccaggacaggagcagcaattctgcatgttgccgaccatgtttttttacctcaattggccaggcccggtgtccctaaggtctgtatcttaatcaccgatggaaaatcgcaagatctggttgacacagcagcgcagcgtcttaaaggtcagggagtcaaattgtttgcagttggaattaagaacgcagatcctgaagagttgaaaagggttgcaagccaacccactagcgattttttttttttcgttaatgatttcagcattcttcgaactctcctccccctggtttcaaggcgtgtgtgcactacagctgggggagttcctgtgacaaggccaccagatgattcaacctccgcaccacgagaccttgttttgtcagagccatcatctcagtctctaagggtgcagtggaccgccgcgtctgggccggttacaggttataaagtccaatacactccactgacgggattgggtcagccacttccctccgaacggcaggaggttaacgtgcccgctggagaaacgtccgtgaggttgcgaggactaagaccactaaccgagtatcaggtgaccgtgattgctctttacgctaattcaataggggaagctgtttcggggacggctaggactactgctttggagggtccagagctgaccatacagaacactactgcgcactcgcttctagtagcttggcgctctgtaccaggggcaacagggtatcgtgttacttggagagttttgagcggtggaccaacacaacaacaggaacttggaccaggtcaaggttccgttcttttgcgtgatcttgagccaggtaccgattacgaagtgaccgtaagcacattattcggtagaagcgttggccctgctacctctttgatggcacgaacagatgctagcgtcgagcagactcttcggcctgtgatcctcggaccgaccagcattcttctgagctggaaccttgttccagaagcgagaggttatcggcttgaatggcggcgtgagaccggacttgagcctcctcaaaaggtggttctcccatctgacgtaactcgttatcaactcgatggactacaacctgggacggaatatcggttgaccttgtatacattattggaggggcatgaagttgctacgcctgctactgttgtccctaccggtcctgaattaccagttagtccagtcaccgatctccaggcaacagaattgcctggtcaaagggttcgtgtttcatggtcacctgtgcctggcgctactcagtatagaattatcgttcgtagcacacagggcgttgaaaggaccttggtgctcccaggatcccagacagcttttgaccttgatgatgtccaagctggtctgtcgtacacagtacgtgtctcagctagggtgggtcctagggaaggttccgcctcagtgttaacagtgcgtagggagccagagactccactagccgtgcctggacttcgagtggtcgtttctgatgcaacgcgagttagggtggcttggggacctgtgcccggcgcatcaggatttcgaatctcttggtcaactggatctggacctgaaagttcgcagacactcccccccgactcaacagcaactgacatcacggggcttcagccaggtacgacctaccaagtagcggtgtccgtgcttagaggccgcgaagaagggcccgcagctgtcatagtggctcgcactgatccactggggcctgtccgcactgtgcatgttacacaagcctcaagctcctccgttacgataacttggacgagggtgcctggggctaccggttatagggtgtcttggcattcggctcacggacccgaaaagtctcagctagtcagcggcgaggctaccgtggctgaactcgatggactggagcccgatactgagtacaccgtgcatgtgcgtgctcatgtcgctggtgtggatggtccaccggcctcagttgtggttcgcacggctcccgagccagttggtcgagtatctaggcttcaaatcctgaatgcgagcagtgatgttttaaggattacctgggtcggtgtgaccggagctactgcttaccgcttggcatggggacgatcagagggtggccctatgagacaccaaattcttcctggcaatactgattctgcagagataagaggtttagaaggaggggtttcctatagcgttagagtgacggcattagtgggtgaccgagagggaacccccgtgtcaattgtcgtgactactccaccggaagctccacctgctttgggcaccctgcatgtcgttcagaggggagagcatagtcttaggcttaggtgggaaccagttccaagggcgcagggatttctgttacactggcagcccgagggagggcaggagcaatcgagggttcttggtccagaactttcttcctaccatcttgacggattagaacctgcgacgcagtatcgtgtaagactctccgtcctggggcctgccggtgaaggaccatcagcagaagtaaccgcgaggaccgagagcccgagggttccttctatcgaattaagagtcgtggacacaagtattgactcagtgactctagcctggactcctgtttctagagctagttcatatatactcagttggaggcccttgaggggacctggacaggaagtgccaggaagtccacaaacactaccaggcatctcatcttcgcagcgtgttactggactggagccaggtgtctcttatatattctcacttactcctgtgctagatggagtgaggggtcctgaagcatcagtgacccagactcctgtttgccctaggggactcgcagatgttgtgttcttaccgcatgcaacccaagataatgcccatagagccgaggctacaagaagagttttagaaagactcgttctggcacttggaccactcggacctcaagctgtgcaagtggggcttctgtcttacagccataggccttcaccattgtttccattaaatggaagccatgacttgggaattattcttcagcgtatccgggatatgccatatatggatccgtcaggtaacaacttgggtaccgctgtggtgacggctcatcgttacatgcttgcaccagatgctccaggaaggagacagcacgttcctggagtcatggtacttctcgtcgatgagcctctgaggggagacatcttttctcccattcgggaagctcaagccagtggtttgaacgttgtcatgttgggtatggcgggcgcagacccagagcaacttaggcggcttgcgccagggatggactccgttcaaacgttttttgccgtcgacgacggtccttcacttgatcaagcagtatctggtttagcaactgctttgtgtcaggcttccttcaccactcaacccaggcccgagccatgcccggtgtactgtcccaagggccaaaaaggagaacctggagagatgggtctcaggggtcaagttggcccaccgggagatccgggactaccaggtcggaccggtgcacctggtccccaaggacctccaggatctgcaaccgcaaagggcgaaaggggcttccctggtgcagacggtcgccctgggtcgccaggacgggctggtaatcctggaactcctggggcacctgggctcaagggttcaccaggcttgcctggacctcgcggagaccctggagaaagaggccctcgggggcctaaaggtgagccaggcgccccgggacaagtaattggtggtgaaggaccagggctgcctggtcgtaagggagatccaggtccttctggaccccccggtcctcggggacctttgggagatccggggcccaggggaccaccaggtttgcctgggactgcgatgaaaggcgataagggggatagaggggaaaggggcccgcctggtccaggggaaggtgggattgcccctggagagcccggactccctgggttaccaggatcaccagggccgcaaggaccagtaggaccccctggtaagaagggagagaaaggtgattcagaggacggggctccgggtctacccggacaaccaggctctccgggggaacagggacccagaggtccacctggtgctattggtcccaaaggggacaggggattcccaggcccccttggtgaggcaggtgagaaaggggagaggggcccacctggtccagctggaagcaggggtcttccaggcgtcgctggacgacccggcgctaagggacctgagggcccaccgggccctactggtagacagggcgagaagggtgaaccaggaagacccggtgatcctgcagtggtgggaccagctgttgcggggcccaaaggagagaaaggcgatgtgggccccgctgggcctaggggggctacaggagtacagggggaacgtggacccccgggccttgttctgccaggtgatcccggtccaaagggtgacccaggggaccgtggtccaatcggtctcacaggtcgtgcgggtcctccgggagactccggtccgccaggcgagaagggtgatccggggcgccccggtcctcccggaccagtcggcccgcgtggacgtgatggtgaggttggtgaaaaaggtgatgagggccccccaggagatcccggtcttcctggaaaggccggtgaaagggggttgaggggcgcacctggcgtgagaggaccagtgggtgagaagggcgatcaaggagatccaggagaggatggtaggaacgggtcccctggtagctccgggccgaagggtgacagaggtgaacctggtccacctggcccgcctggtcgtcttgttgacacaggtcctggcgcacgtgagaaaggcgagccaggagatcggggtcaagagggtcctcgcggacctaaaggtgacccagggcttcctggcgcgccgggagagaggggcatcgaaggtttcagagggccacctggtcctcaaggagaccctggagtgcggggtccagcgggggagaagggagatcggggacctccaggcctcgatggccgatcaggtttggatggtaaacccggtgcagctggtccctcgggcccaaacggagctgccggtaaagctggtgatcctggccgagacggcctgcctggcctcaggggagaacagggattgccaggaccctccggccctccgggtctgccagggaagccaggtgaggatggaaaaccggggttaaacgggaagaacggcgagcctggagacccgggggaagacggaagaaagggagaaaaaggtgactccggagcaagcggccgtgaaggtagggatggccctaagggagaacgtggtgcgcccgggatcttaggaccacaaggcccaccaggccttccagggccagtcggcccgccgggtcaaggattccctggtgttccaggggggactgggccaaaaggtgatcgtggggaaaccgggtccaagggcgagcagggtttaccgggagagcggggtcttaggggtgaacctggctcagttcccaatgttgatcgtcttttggagactgccggcattaaagcatctgcactccgtgagatcgtagaaacttgggatgagtcgtcaggttcctttttgccagtgccagaaaggaggagaggaccaaagggtgattctggggaacaaggtccaccaggcaaggaaggacccattgggttccctggcgaacggggattaaaaggtgatcgaggtgatccaggtccacagggtcctcctggtctggctcttggggagcgtggccctccagggccttcggggctcgcgggcgagcccggtaagcccggaattcctgggcttcctggtcgtgctgggggggttggtgaggctgggcgtcctggcgagcggggagagagaggcgaaaagggcgagagaggtgaacaaggacgtgatgggccaccagggctccccggaactcccggcccacctggtccgcctggccctaaggtctctgtcgatgaacctggtcccggtttgtctggggaacaggggcctcctggtcttaagggtgctaaaggcgaacctggtagcaacggggatcagggacccaaaggggaccgtggtgttcctggaattaaaggtgacagaggtgaaccgggcccaagaggccaggatggcaatcccggtctcccaggtgagcgtggaatggcaggtccggaggggaagcctggcctccagggtcctagggggccgccaggccctgttggtggacatggtgatcctggacctccaggcgctcctgggttggctggaccagccggaccccagggaccaagcggattgaaaggggaacctggcgagactgggccccctggtcggggcttgaccgggcctacaggcgccgttggacttccaggtcctcctggacctagtgggttggttggacctcagggatctccggggctcccgggacaagtaggagagactggtaaaccgggagctccagggcgagatggtgctagcggaaaggatggagatcgagggagtcctggagtccctggaagccctggacttcccggaccggtgggtcctaagggagaaccaggccctactggagcgcctggacaggctgtagtggggctacctggtgcgaagggtgaaaagggcgctcctgggggattggcaggagatctggtcggggagccaggggcgaaaggtgatagagggcttcctgggccgcgaggtgagaaaggggaagccggacgagcgggcgaaccaggagaccccggggaggatggacagaagggagcacctggaccgaagggattcaagggtgatcctggggttggtgttccaggctcacctggtcctccagggccacctggtgtaaagggagacttggggcttcctgggctcccaggcgctcctggggttgtcggtttcccaggccaaacaggtccgagaggtgaaatgggtcagccagggccctcaggtgagagaggtctcgctggaccgcctggccgtgaaggtattcctggacccttgggtcctccaggaccacctggttctgtgggtccaccaggtgcatccgggttaaaaggggataaaggagacccaggagtcggccttccgggtccaagaggagagagaggtgaaccgggcatcaggggtgaggatggtcgaccagggcaagaaggaccccgtggtttgacgggtcctcctgggagtaggggggagaggggtgagaagggtgacgttggaagcgcagggcttaaaggtgataagggtgattctgctgtgatcctgggtccacctgggccccgtggggctaaaggagatatgggcgaacgtgggcctcgtgggcttgatggagataagggacctcgaggggataacggagatcccggggataagggttcaaaaggtgaaccaggtgataaaggttccgcaggactgccaggacttcgcggtctattggggcctcaaggtcaacctggagcagctggaattcctggtgatcctggaagccccggtaaggacggagttccaggaattcgaggagaaaaaggtgatgttggtttcatggggcctcggggtttgaaaggtgaaaggggtgtgaaaggtgcatgtggtttggatggagagaaaggagacaagggcgaagctggtccgccggggcgaccaggacttgcaggtcacaagggcgagatgggcgaaccaggcgtcccagggcagagtggtgcccctggtaaggaaggccttataggaccaaaaggggatcgcggcttcgacggccaacctggccctaagggagatcagggggaaaaaggagagcgagggacaccgggaattggtggttttccaggcccttcgggtaacgacgggtctgcgggaccacctggtcctccaggaagtgtgggacctagggggcccgaaggattgcagggccaaaaaggagagcgaggtccgcctggggaacgggttgttggcgctcccggtgttcctggtgctccaggggagagaggcgagcaaggccgtccaggtcccgccggacccagaggagagaagggtgaagcagcccttacagaagatgatataagaggattcgtgagacaagaaatgtcccagcactgtgcatgtcaaggacaatttattgcttctggttctaggcccctgcctagttacgcggcggacactgctgggtcacaactacatgctgtgccagttctccgtgtttcacatgccgaggaggaagagcgcgttccgccagaggatgatgaatactccgagtattcagagtacagcgtggaggaataccaggaccccgaagcaccatgggattcagacgatccttgttccctgccattggatgaaggatcgtgtaccgcctatactctgaggtggtatcaccgcgctgttacagggtctacagaagcttgtcatccttttgtgtacggaggttgtgggggtaatgccaaccgcttcggtactagagaggcttgtgagagaagatgcccccctcgcgttgttcaaagccagggaaccggcacggctcaggat

SEQ ID NO: 9607 - DNA, 8832 bp, Artificial Sequence
  Description of Artificial Sequence: Synthetic coding sequence
atgactctgagactgctggtcgcagccctatgcgctggaattttagccgaagccccccgagtgagggcacaacatagagaacgcgtaacttgcactcggctctatgccgccgatatagtcttcctcctcgatggaagtagttcaataggaaggtcgaactttcgggaagtgaggtcatttctggaggggctggttctaccattctcaggggcagcctctgcccagggggtccgcttcgccacagtgcagtattctgatgatccaaggactgaattcggactagacgccctcgggtctgggggggatgttatccgcgctatacgggaactgtcttataaaggagggaatactaggactggagccgccatactccacgtcgcagatcatgtttttctcccccagctcgcaaggcctggagttcctaaagtgtgtatccttataactgatggaaaatcacaagacctagtggacacagccgctcagcggctgaaagggcagggagtgaagctatttgcagtcgggataaaaaacgcagaccccgaagagctgaaacgcgtcgcgtctcagcctacatccgatttttttttctttgtgaacgatttttctatactacggacgctactgccactcgtctctaggcgcgtgtgtactacagctgggggagtgccagtgacgagacctccagacgattctacaagtgccccaagagatctggtgctctccgaaccttcatcacagtctttgcgggtgcagtggactgctgctagtgggcctgttacaggatacaaagtgcaatatacaccactcactggactcggacagccacttccttcggaaagacaggaagtgaacgttcccgctggggagacttccgttcggctcagggggctccgccctctaactgaataccaggtcactgtcattgccttgtacgcaaactcaataggagaagctgtttctggaacagctcggactactgccttagaaggacctgaacttactatacagaacacaacagctcatagtctccttgtggcatggagatctgtgcctggggcaacagggtatcgggtgacttggagagtgctaagtggggggcccacacagcagcaggaacttgggcctggacagggatctgtactccttcgggatttggaacctgggactgattacgaagttactgtaagtacattatttgggcgctctgtagggcctgctacatcactgatggcacgtacagatgcgtctgtagaacagacattaagacccgtgatattggggcctacttcaattctcctttcctggaatctcgtgcctgaggctcgcggatacagactagaatggcgacgggaaacaggactagagccccctcagaaagtggtcctcccttcggatgtaacacgataccagttagacggactgcagccagggacagaataccggctgacattatatacactactagaaggacatgaagtggccacgcccgctacagtggtgcctactgggcccgaactacctgtgtctccagtaactgacctgcaggctactgaactaccagggcagagggtgagagtgagttggtcccccgtacccggagctactcagtatcgaatcattgtgcggtccactcagggagtggaaaggacactggtacttcccggatcccaaacagcctttgatctagatgatgttcaggccggacttagttacactgtccgcgtctcagcccgcgtggggcccagagagggatccgcttccgtgttgacagtgaggagggaacccgagacacctttagctgtccctggactcagggtagtggtgtcagatgctacgcgagtaagagtcgcatggggacctgtacccggagcctccgggttcaggatctcctggagtacaggaagtgggcccgaatcttcacagacattaccccccgacagtactgctacagatattactgggctccagcccgggactacataccaggtggctgtgtctgtgctgaggggaagagaggaagggcctgcagctgttatagtggctcgaactgatcctctggggccagtgcgcacagtgcatgtgacacaggcaagttcgtcctctgtaacaataacatggacgagggtgcccggggccacaggatatcgggtctcatggcatagtgcgcacggacctgaaaaatctcagctcgtgagtggggaagctactgtggctgaattagatgggttggaacctgatactgaatacacagtacacgtaagggcgcacgttgccggggtagacgggccccccgcgtctgtagtcgtacgaactgctcctgaacctgttgggcgggtatctaggctgcagatcctcaacgctagttctgatgtactcaggattacatgggtgggggtcactggagctacagcataccgccttgcttggggaagatccgaaggagggccaatgaggcatcagatcctgcccgggaacactgattcagctgaaattcgcgggctggaagggggggtgtcgtacagtgtgcgggtgactgcgctggtcggagatagggaagggacacccgtgtctatcgtcgtgacaacaccccccgaagcgcctccagcgctggggacattacacgtagtgcagcggggagaacattctctcaggctcaggtgggagcctgtcccacgcgctcagggatttcttctgcactggcagccagaagggggacaggaacagtcacgagtgcttgggcctgaactctcatcttatcatttagatggactcgaacccgctactcagtatcgggtgagattatcagttctggggcccgcaggagaaggaccttccgcagaagtgacagctaggactgaatctccaagggtcccatcgatcgaattacgcgtggtagatacatcgatagactctgtgacactggcatggacacctgtctctcgggccagttcttatatcctttcttggaggcctttaagaggaccagggcaggaagtgcctggatccccacagactctaccaggaatctcttcctctcagagagtcacagggctggaacctggggtgtcctatatcttttctctgacacctgtccttgatggagtgagagggcctgaagcatctgtcacgcagactccagtttgtccacgggggctggccgatgtcgtgtttctgcctcacgccacacaggataatgcccatcgagcagaggccacacggagggttctggagcgcttggttctagcgctggggccactagggcctcaggctgtccaggttgggcttctctcttattcccacagaccatcacccctttttcctctgaatgggagtcatgatctagggataatactccagaggattagagatatgccatatatggatccatccgggaataacctggggactgcagtagtgactgctcataggtatatgcttgcccctgatgctcccggacggcggcagcatgtccccggagttatggtgctgttagtggatgaacctcttcgcggagatatcttttctcccatcagggaagctcaggcctcaggactcaacgtggtcatgctgggaatggctggggccgatccagagcagcttcggcgattagctcctggaatggattctgtgcagacgttcttcgccgtagacgatggaccctctctggatcaagctgtgtcagggcttgcaacagccctttgtcaagcctccttcacaacacagcctagacctgaaccttgtcccgtttattgtcccaaaggacagaagggggagccaggagagatggggcttaggggacaggtggggccaccaggggatcctggactcccaggacggactggagcccctgggccacaggggcctcccgggagtgctactgccaaaggggaacgcgggtttcctggggctgatggacggcccgggtcccccgggagggctgggaatcccgggacaccaggggctccggggctgaaaggatcccctggactgcccgggcccagaggggatccaggggaaagaggacctagagggcccaaaggggaacccggagctcctgggcaggttatagggggggagggacctgggctgcccggacgcaagggagatcctgggccatctgggccaccaggaccaaggggacccctcggagatccaggacctcgggggccacccggacttcccggaactgctatgaaaggagataaaggagatagaggagaacggggaccacccggaccaggggaaggggggattgcacccggagaaccagggcttccaggacttcctggatctcctggacctcaaggacctgtcgggcctcccgggaaaaaaggggaaaaaggggattcagaggatggagctcctggactgcctggacagccaggatcacccggggaacaagggccaagaggaccccctggagcaatagggcccaaaggggatagggggtttcccggacctctaggagaagcgggagagaaaggggaacgggggccccctgggccagccgggagtcgggggctgcctggagtcgctgggaggccaggagccaagggaccagaagggcctcccggacccactgggaggcagggagagaaaggggaacccggaaggcccggagatccagctgttgtgggacccgctgtagctgggccaaaaggggaaaaaggagatgtcggacctgccgggcctcgaggagccactggggttcagggagaacggggaccccctgggcttgtgctccccggagaccctggaccaaaaggggatccaggggataggggacccatcgggctgactggacgcgctggacctccaggagattccggacccccaggagaaaaaggagatcccgggaggcctggacccccagggccagtagggcccaggggacgggatggggaggtgggggaaaagggggatgaagggccacccggggatcccggattacccggaaaggcgggagaacgtgggctccggggggcccccggggttagagggcctgtgggagaaaagggagatcagggagatcccggggaagatgggcgcaatgggagtcccggatctagtggacccaagggagataggggagaaccaggaccacccgggccccctggaaggcttgttgatactgggcctggggctcgggaaaaaggagaaccaggggatagggggcaggaagggcctcgaggacccaaaggggatccaggattgcccggggccccaggagagcgcgggatcgaaggattcagggggcctcccggaccacagggggatccaggagtgagggggccagctggggaaaaaggggaccgaggaccacctgggcttgatggacgatctgggcttgatgggaaacccggggccgccgggccttctgggcccaacggagctgccgggaaagctggggatcccgggcgcgacggactccccggattacgaggagaacaggggctcccaggaccttcaggacccccaggactccccggaaagccgggagaagacggaaaacctgggctgaatggaaaaaatggagaacctggagatccaggggaggatgggcgaaaaggggagaaaggagatagtggggccagtgggagagagggacgggatggacccaaaggagaacggggggcccccggaatacttggaccccagggaccccccgggcttcccggaccagtggggccccccggacaggggtttcctggagtgccaggggggactgggccgaagggagataggggggaaacggggtccaaaggagagcaggggctgcctggggaaagggggctgcggggagagcccgggtccgtgcctaacgttgatagattgctggaaacagcaggaataaaggcctccgccctgagggaaattgtggaaacatgggatgaatcttccggatcgtttctgccagtacccgaacgacgccgggggcccaaaggagattccggggaacagggaccccccggaaaagaaggacctatcggattccccggggagcgcggactcaaaggggatcggggggacccggggccacaagggccaccagggctggcattaggagaacgcggaccacctgggccttctgggctggccggggagcctggaaaacccggaattcccgggctccccggacgggccggaggggtaggagaagcggggcggcccggggagaggggagaaaggggggaaaagggggaacgcggagaacaggggcgagatggaccccccggactgcccggaactccagggcccccgggaccaccaggacctaaagtaagtgtggatgaacccggacctggactgtctggggaacagggacctcctggactgaaaggggccaaaggagaacccggatccaacggggaccaggggcctaaaggagatcggggggtgcctgggataaaaggagatcggggggaacccggacctagggggcaagacgggaaccctgggttacccggggagagaggaatggctgggcctgagggaaaacctggactccaggggcccagagggcctcccggacctgtggggggacacggagatcccgggcctcctggggccccagggctcgcagggcccgccggaccccaaggaccaagtgggctcaagggagaacccggagaaactggaccccctggacggggattaactgggcctactggagccgtcgggcttcctggacctcccggaccttccggactcgtcggaccccagggatcacccgggcttccaggacaggtgggagagactgggaaacctggggctccagggagggatggagcatcagggaaagacggggatagaggatcgcctggggttcctggatccccagggctgcctggaccagttggaccaaaaggagaaccaggaccaactggggccccaggacaggccgtggtggggctccccggggccaaaggggaaaaaggggccccaggggggctggctggagatctcgtgggagaaccgggggccaagggagataggggactgcccgggccacggggagaaaaaggggaagcgggaagggccggagaacccggggatcctggagaagatggacaaaaaggggctcccggacctaaaggattcaaaggagatcccggagtgggagtccctggatctccagggcccccggggcctcccggagttaaaggggacctggggctgcccgggcttcccggggctcctggggtggtgggatttcctggacagacaggacctagaggggaaatgggacagcctgggccctcaggggagaggggattagcagggccccccgggagagagggaatccctgggcctctcggaccaccagggccccccggatcagttggacctccaggagcatccggattaaaaggagataaaggagatccaggggtcggactgccgggaccccgaggagaacgcggagaaccagggataaggggagaagatgggagacccgggcaagaggggcctcggggacttactgggccacccggatcacgtggagagagaggagaaaaaggggatgtagggtcagccggactgaaaggagataaaggggattccgctgttatcctcgggcctccaggaccacgaggggcaaaaggagatatgggagagagagggccaagaggattagatggggataaaggaccaagaggagataacggggatccaggagataaggggtcaaagggagaacccggggataaagggtccgccgggctgccagggctgaggggactcctcggaccacagggacagcccggagctgctgggataccaggagatcctgggagtcctggaaaagatggggtccctgggatccgcggagagaaaggagacgtcgggtttatggggcctcgggggctaaaaggagaaagaggggtgaaaggagcatgcgggcttgacggggaaaaaggagataaaggagaagctggaccacctgggcggcctgggttagccggacacaaaggggaaatgggagaacccggggtccctgggcagtctggagctcccggaaaagaggggctaatagggccaaagggagacagagggtttgatgggcagccaggacctaaaggagatcagggggaaaaaggagaacgggggacacccggaatcggggggtttcctgggcccagtgggaatgatgggtctgctgggccacctgggccccctggatcagtcgggcccagaggacccgaaggacttcaggggcagaaaggagagagggggccccctggagaaagagtggtaggagcgccaggagtccccggagccccaggggaaaggggggaacagggacgacccggaccagctggaccacggggggagaaaggagaagcagcgctcactgaagacgatatccgagggtttgttcgtcaggagatgtcacagcactgtgcgtgccaggggcagttcatcgcttctggatcgaggcctctcccttcctatgcagccgatactgctggatctcagttgcacgctgtccccgtgctgcgggtcagtcatgccgaagaagaagagcgagtgcctcccgaggatgacgaatattccgaatactctgagtactccgttgaagaatatcaggatcctgaagcaccttgggattcggatgatccctgctctctgcccctagacgagggatcttgtacagcctatacactccggtggtatcatcgagccgtgactgggagtacagaagcctgccaccccttcgtatatggggggtgtggagggaatgctaatagatttgggactagggaagcttgcgaacggcggtgccctcctcgagtggtacagagtcagggaactggaactgctcaggac

SEQ ID NO: 9608 - DNA, 8832 bp, Artificial Sequence
  Description of Artificial Sequence: Synthetic coding sequence
atgaccctccgccttctggtagctgctctgtgcgcagggatactggccgaggctcctagggtccgcgcacagcacagggagcgggtgacctgcacaaggttgtacgcggccgatatcgtcttcctgctggacggtagcagctccattgggaggagcaacttccgggaagtgcggtcttttctcgagggactggtgctgccgttctctggtgctgccagcgcccagggcgtgcgattcgccactgtacagtacagcgatgatccccggacggagtttggactcgacgctctcggttccggtggggatgtgattcgcgccattagggagctgagctacaaagggggaaatacccggactggtgcggcaatcctgcacgttgccgaccatgtgtttctgccgcagctcgctagaccaggcgtgcctaaagtgtgtatcctgatcactgatggcaaaagccaagatttggtagatactgctgctcagcgccttaaggggcagggcgtcaaactgtttgctgtcgggataaagaatgctgaccccgaggagttgaagagggtcgcctcacagccgacttcagacttttttttttttgtaaacgacttttcaatcctgaggaccctgcttccattggtgtctcgccgggtgtgcacaacggccgggggggtgccggtaaccagacctcctgacgattcaaccagtgccccgagagatcttgtgctgagtgagcccagcagccagtcactgcgcgtgcaatggaccgccgcaagcggacctgtgactggttacaaagtgcagtatacgcccctgaccggtcttggacagcccctcccaagcgagaggcaagaagtgaatgtgccggccggagaaacctccgtcagacttaggggcctccgacctctcaccgagtatcaggtcaccgttattgctctgtacgccaacagtattggggaggcagtgagcgggacagcaaggacaactgcccttgagggtcctgagttgacaatccagaacacaactgcccactcactgcttgtcgcctggcggagcgtacctggtgcaactggctacagagtgacatggagagtcttgagcggagggccaacgcaacagcaggaactcggccctggccaggggagcgtattgctgcgggatctggaaccgggcacggactatgaggttacagtgtcaacactgtttggtcgcagcgtgggcccggcgactagccttatggccagaactgacgctagcgtcgagcagacccttaggcctgtgatcctggggccaacctctattctgctctcttggaatcttgtgcccgaagctcgaggctatcggctggaatggaggcgggagaccggattggaacccccccaaaaggtggtgctgccatctgatgtgacaaggtatcagctggatggactgcagcccggaaccgagtatcgattgaccctctacacattgttggaggggcatgaggtcgccacaccagctacagtggttccaacagggccagagctccccgtgtcaccagtgactgatctccaggcgaccgaactgcccggtcagagagtccgagtcagctggtccccggtccccggggccacccagtaccgcatcattgtgcggtccacccagggagtggaacgcaccctggttctccccggaagccagaccgcgtttgatctcgacgatgtccaggccggtctgtcctacaccgtgagagtgagtgcccgggtgggaccacgagaagggtcagccagcgtgctgacggtcagacgggaacctgaaacgcctctggccgtgcctggtctgagggtcgtggtgtccgacgccactagagtgcgggtagcatgggggcccgtcccaggtgcgtccggtttcaggataagctggagcacgggcagcggcccagaatcctcccagacgctcccgcccgacagcaccgcaacagatattaccggcctgcaacctggaactacatatcaggtcgccgtgagcgtgttgagaggtagggaagaagggcctgctgcagtgatcgtggcaagaacagacccactggggcctgttcgcacagtgcacgttactcaggcatcaagttcctccgtcaccattacgtggacacgggtgccaggggcgacaggctacagggtctcatggcattccgctcacgggcctgagaaaagccagctggttagtggggaggcaacagtcgcagagctcgacggactggaaccagacactgagtacaccgtgcatgtgcgggcccacgtggctggcgtggacggcccccccgcttccgtcgtagtgagaaccgcaccagagcctgtgggtagagtgtctaggctgcagatcctcaatgccagttcagatgtactgcggatcacgtgggtcggggtaacaggcgctactgcgtataggttggcctggggcaggtctgagggtggaccaatgaggcatcagatcttgcctggtaacacggactccgcagagatcagaggcctggagggaggtgtcagctatagcgtacgagtgacagcactcgtgggcgatcgcgagggcactccggttagcattgtggtgaccaccccccctgaggccccccctgccctcggtacgctgcacgtggtccaacggggcgaacatagccttaggctgcgatgggagccagtcccacgagcccaaggattcttgctccactggcagcccgagggtggacaggagcagtcacgagttctggggcccgagctgagcagctaccatctcgatggcttggagccagccactcagtaccgagtgagactttccgtgctgggcccggcgggcgaagggccttctgctgaggtgacagctcggactgaatctccgcgcgtgcccagcatcgaattgcgggtggtggacaccagcatcgattccgtgacactggcgtggaccccagtctccagagcctctagttatatcctgtcttggaggccgctgagaggacctggacaggaagtccctggatcaccacagaccctgccaggaatctcttcttcccagagagtcacaggcctggagcccggagtgtcctacatcttcagcctgactccagtgctcgacggcgtcagagggcccgaagcctcagtcacgcagacaccagtatgccctaggggcctcgccgacgtggtgttcctgccccatgcaacccaggataatgctcacagggcggaagctactcgaagggtactggaacgcctcgtgctcgctctggggccacttggccctcaggctgtgcaggtggggctgctttcttattcacacaggcctagccctctcttccccttgaacgggagccacgacttgggcatcatactgcagagaattagagatatgccttatatggaccctagtggcaataaccttggcacagcggtagtcaccgcacatcggtacatgctggcccccgacgcaccaggccggcgccagcacgtcccgggagtcatggtgctgctggttgatgaacccctccgaggagatattttttctcccattcgcgaggcccaggcctccggcctcaacgtcgttatgctgggcatggccggtgctgatcccgagcagttgagaaggctggccccgggcatggatagcgttcagaccttctttgccgtggatgacggtccctcactggaccaggcggtgagcggcctcgccacagccctgtgtcaggcctcctttactacgcagcctaggcctgaaccctgtcccgtttattgtccaaagggccagaagggcgagcccggagaaatgggccttcgaggacaggtagggcctcctggcgaccctggacttcctggaagaacaggtgcgccaggaccacagggccctcccggaagcgcgactgctaagggcgaacggggatttcctggggcagatgggaggcccggaagccctggacgcgctggaaatccagggacccccggcgcgccaggcctgaagggcagccctggccttcctgggccccgcggggaccccggcgagcgggggccaaggggccctaagggagagcctggcgctcctggccaggttatcggtggcgaagggccaggcctgccaggaagaaaaggggaccccggtccttccggaccaccgggcccacggggccctctgggcgatcctggccctaggggtccgcccggattgcccgggaccgctatgaagggggacaaaggcgaccggggcgagagagggccccctggaccaggagagggcggtatcgcgcctggcgaaccgggactccctggactcccaggtagtccgggccctcagggtcccgttggacctccgggcaagaaaggcgagaagggcgatagtgaagacggagcccccgggctcccagggcagcccgggtctccaggggaacaggggccccggggcccgcccggtgccatcggaccaaagggagaccggggattcccaggccctttgggtgaagcgggcgaaaagggtgagcgggggccccccggtcccgccggctccagaggactgccaggagtggcggggagaccaggagccaagggtccagagggaccaccgggaccaaccggcagacaaggcgagaagggcgaacctgggcgcccgggtgacccagcagtcgttgggccagccgtcgccggcccaaagggggagaaaggcgacgtgggaccagcgggcccccggggagcaacaggcgttcagggcgagcggggaccacctggtctggtcctgcctggagatcccgggccaaagggtgacccaggcgacagagggcctattgggctgactgggcgggccggacctcctggcgattccggtccgccgggagagaaaggagatccagggaggcccggcccgcctggacctgtgggtcccagaggccgggacggcgaagtcggcgagaaaggggatgagggacctccaggagaccccggacttcctgggaaagcaggtgagcgcgggttgcgcggagctcctggcgtcaggggccctgtcggtgagaaaggggatcagggggatccaggggaggacggtaggaatggctctccagggagttccggaccgaaaggcgatagaggcgagcccggtcccccaggccctccaggccggctggtggataccggtccgggagcacgcgagaagggagagcccggtgatcgcggtcaggaggggcctagagggccaaaaggcgaccctggactgcctggcgcacccggagaaagaggtattgagggtttcagggggcctccaggaccccagggagaccccggtgtccgggggccagctggcgaaaagggcgaccggggaccgcccggcctggacggacggtccgggctcgatggtaagccaggggctgccggcccctctgggccgaatggcgccgcgggtaaggcaggagacccgggccgcgacggactgcccggtttgcggggggagcagggcctcccggggcctagtggcccccctggcctccctggcaaaccaggcgaagatggcaaacccgggctgaatggaaaaaatggcgaaccaggagatcccggggaagatggccgaaagggagagaaaggcgattctggagcctccggccgagaggggcgagatgggcccaaaggtgaacggggtgcccccggcattctgggaccccagggaccacctgggctgccaggaccagtgggaccgccaggccagggcttccccggcgtgccaggtggaaccgggcccaaaggagacagaggagagactggatctaagggggagcagggcctgcctggtgagaggggcctgaggggcgagcctggttccgtgccaaatgtggaccggctgctggaaactgctggcattaaggcgagtgcccttcgcgagatcgtggaaacctgggacgaatcctctgggtcattcctgcctgtgccggaacggcgcagaggaccaaagggcgactctggcgaacagggtcccccaggtaaggaaggccccatcggtttcccgggagagcgaggcctgaagggcgaccggggcgatccaggcccgcaggggccgcccggtctcgcactcggagaacgaggccctccaggaccaagcgggctggccggggagcctgggaagcctgggattccaggactgcctggaagagctggaggagtcggcgaagcggggcgacctggagagcgaggcgagcgcggtgaaaagggggaacgaggcgagcagggacgagacgggcccccaggcctgcccggaacacctggacctccgggcccccccggccccaaggtcagtgtcgacgagcccggcccgggattgagcggggagcaggggccaccagggctgaaaggggcaaagggagagccaggctcaaacggggatcaaggcccaaagggggacaggggtgtacctgggatcaagggggacaggggcgaacccgggcctagaggccaagacggcaatccagggctgcctggggagagagggatggctggtcctgagggtaagccagggctccagggacctcggggtcctcccgggcctgttggaggtcacggagatccaggacctccgggggccccagggttggccggccctgcagggccacagggaccgagtgggctgaagggggagccaggcgagacagggcccccaggcaggggtctgactgggcccacaggagccgttggtctgcctggcccccccggaccatcagggttggtaggaccgcaaggatcccctggcttgcccggacaggttggcgagactggcaagcctggggccccgggacgggatggcgcctccggcaaagacggggatcgcggcagcccaggggtgccgggaagtccaggtctgcctgggcccgtgggcccaaagggagaaccgggacccaccggagcccctggtcaggccgtggtagggcttcctggggcaaaaggcgaaaagggggccccaggtggcttggcaggcgatctggtgggggagcccggtgctaagggcgacaggggattgcccgggccccgaggggagaagggggaggccggccgagcaggagagcctggcgatccgggggaggatggacagaagggagctcccgggcctaaaggattcaaaggagacccaggagtgggtgtgccaggaagtcctggcccccccgggccccccggcgtaaagggggaccttggactgcccgggctccctggggccccaggcgtagtagggttccccggtcaaacaggtcccaggggggagatggggcagcctgggccctccggagaaagaggcctggccggcccacctggcagggaaggcatacccgggcccctggggccaccagggccgccagggtccgttggcccgccaggcgcaagtgggctgaagggcgataagggagacccgggcgtcggcctgccagggcctagaggggaaaggggggagccgggaatcaggggggaagatggccggccgggccaagaagggccgaggggtcttactgggcccccagggtctcgcggagagcgcggggagaagggggacgttgggagcgcaggcttgaaaggggacaaaggggactcagcggtgatcctgggtcccccaggtccccgaggagccaaaggagatatgggcgaacgggggcccagggggctggacggtgacaagggcccccggggggataatggcgacccaggagacaaaggttccaaaggcgaacccggggataagggttccgccgggctcccgggcttgaggggcctgctcggaccgcaaggccagccgggcgctgcaggcattcccggcgacccgggatcaccggggaaggacggagtcccggggataaggggtgagaaaggagatgtcgggtttatgggacctcggggattgaaaggtgaaagaggcgtgaagggagcttgtggtctggacggggaaaaaggcgataaaggcgaggccggaccacccggccggcccgggctggcaggacacaaaggcgaaatgggggagcccggtgttcctggccaatctggcgctcctggaaaggagggactgattgggcctaaaggtgatcgcgggtttgacggtcagcctggcccaaaaggggatcagggtgaaaaaggcgagagggggacccccggcatcggtgggttccctggccccagtgggaacgacgggagcgctggcccccccggcccgcccggaagcgtgggccctagaggtccagaggggctgcagggacagaagggtgagagaggtcctccgggggagagggtggtgggagccccaggggtgccaggagccccaggcgaaaggggggagcaaggcagaccaggtcccgctggacccagaggggagaagggtgaagcggccttgacagaggacgacatacgggggttcgtccggcaagaaatgtcacaacattgtgcctgccaaggacagttcattgcctcaggctctcggccactgccgagctacgccgctgatacagccggttctcagctgcacgcagttcctgtcctgcgcgtcagtcatgcggaggaagaggagcgggttccaccagaagacgacgaatactccgagtattctgagtactcagtagaagaataccaggacccggaagctccttgggatagcgatgatccttgttccctgcccttggacgaggggagctgcaccgcctatactttgagatggtatcaccgagcagttacaggctctacggaggcatgtcaccccttcgtgtacgggggatgcggcggtaatgccaacagatttgggaccagggaagcttgcgagcggcgatgccctccacgagtcgttcagtcccaggggacaggcaccgcacaagac

SEQ ID NO: 9609 - DNA, 8832 bp, Artificial Sequence
  Description of Artificial Sequence: Synthetic coding sequence
atgactttgcgcctccttgtcgcggcactttgtgcgggaatcttggccgaggcccctagagtcagggcccagcatagggagcgtgttacttgcacgcgcctttatgcagcggatattgtcttcttgttggatggtagttccagcatcggccgatcaaacttcagggaggttcgttccttccttgaaggccttgtcctacccttctcgggagcagcgtctgcacaaggtgtgcgcttcgctaccgtccaatattccgatgatcctagaaccgagttcggtcttgatgctctggggtccgggggcgacgtcatccgtgctatccgagagttgtcctacaagggaggcaatacaagaacaggcgcagcgattctacacgttgcagatcatgttttccttccccaactggcgcgtcctggagtcccgaaggtctgcatcctgatcacagacggaaagagtcaggacctcgtagatacggcggcccagcgcctgaaaggacaaggagttaaactattcgctgtgggtattaaaaacgctgatccggaggaattaaagagggttgcttcgcagccgacatcggatttcttcttttttgttaatgacttttcgatcctacgaacgttgttgcctttggtctcgcgccgtgtctgcactacagctgggggagtccccgtcacccggccgcctgatgattctacgagtgccccgagagatcttgttctttcggaaccgtcatcgcaatcccttagggtccaatggacagcagctagcggaccggtcactgggtacaaggtccaatacaccccacttacggggttaggtcagcccttaccatcggagaggcaggaggtgaatgtccccgctggcgaaaccagtgtgcgtttgcggggactacgaccgcttaccgaataccaggtcaccgttattgcgctgtacgcgaactcaattggcgaggcagttagcggcacagcaagaacaaccgctctagaaggacccgagttgactattcaaaacacgacagcacattccctactagtagcatggcggtctgtacctggtgccactgggtaccgggttacctggcgcgtgctctccggcggtcccactcagcagcaggagctgggcccgggtcagggcagcgtcctcttaagggatttggagccaggaacggactacgaagtcacggtatcgacattgtttggtcggtctgtaggcccagcaaccagcctcatggctcggactgacgcgagtgttgagcagactcttaggccggttattcttgggccgacatcaatcttgctgtcgtggaatctggtaccagaggccaggggctaccgcctagagtggcggcgagagactgggcttgaaccccctcagaaggtcgtcctcccttcggatgtgacgcgctatcaacttgacggtctacaaccggggacagagtacaggctcaccttgtataccctgctcgaaggccatgaggtggcaacgcccgccaccgtggtgcctaccggccccgaattgcctgtgagccctgtgaccgacttacaggccacggaattgccgggtcagcgcgtccgcgtcagctggagccccgttccaggggcaacgcagtatcgtataattgtgcgctccacccagggtgttgagcggaccctcgtcctgccaggctctcagacggcatttgatctcgatgatgtacaagcagggctgtcctatacggtgagggtctctgcgcgggttggtccacgcgaaggatccgctagtgtattgacagtccgccgggagccagaaacaccacttgccgtaccaggccttcgcgtcgttgtttctgacgctaccagagtccgtgtcgcttggggacctgttcccggtgcgtctggatttcgaatatcctggtccaccggctccggtcctgaatcttcgcagaccttgccacctgattctacggccacggatataacaggtttgcagccagggaccacttatcaggtcgccgtctcggtccttcgcggccgtgaagagggccctgcggcggttatcgtcgcgcgtactgatcccctaggtccagtccgaaccgttcacgttacccaagcgagctcatcctctgtgacaattacctggaccagggtcccaggcgcaacggggtatcgagtatcgtggcactctgcccatggcccagagaagagccagttggtttcaggagaggccaccgtcgccgagctggatggattggaaccagacacagaatacaccgtgcacgtccgcgctcatgtcgccggcgtagacgggccaccggcttccgtcgttgtgcgcacggcgccagagccagttggtcgtgtctctcgtctccaaatcctaaacgcttcaagtgacgttctccgcattacatgggtcggtgttaccggagcgaccgcctatcgtttggcgtgggggcgatctgagggtgggccaatgcgacaccaaattctaccaggaaacactgattctgcggagatccgaggtttggaagggggagtcagttatagcgttcgtgtgacggccttggtgggcgatcgcgagggaacaccagtgtcgatcgtggtcaccactccccccgaggctccaccggctttgggcacccttcatgtcgttcagcgtggtgagcactctcttaggcttcgatgggaaccagtacctcgagcccaagggttcctcttacattggcagccagaaggcggccaagagcaatcgcgcgtacttggccccgaactttcgtcataccaccttgatggtttggagcctgcaacccagtacagagtcaggctcagcgttctcggaccggcgggcgagggcccgagcgcggaagttactgctcgcaccgagtctcctcgcgttccatccatcgagttgcgtgttgtggacacttcgattgactcggttacgctggcctggacccctgtttctcgtgcgagtagttatattctctcatggcggccacttcggggcccagggcaggaagtgccaggttcaccgcaaacgcttcccggaattagttcatcacaacgagttacaggtttggaaccgggggtcagttatattttctcactcacaccagtccttgatggcgtgcgaggccctgaagcttcggtaacacagacacccgtctgcccaaggggcttagcggatgtcgtcttcctacctcacgcgacccaggataacgctcatcgtgctgaggcaactcggcgtgtgctggagagactggtgctggcgctcggaccgctaggcccgcaagctgtgcaggtcggtttactgtcctacagccataggccttccccactctttcctctgaacggatctcatgatctaggtatcattttgcaacgcattcgtgacatgccatacatggacccctccggtaacaatcttgggacagctgtagtaacggcacatcggtacatgttggctccagatgctccagggcgccgccaacatgttcccggggtgatggtgctgctcgtcgacgagccgctccgaggtgatatctttagtcctattcgcgaagcccaggcctctggcctcaacgttgtgatgctgggaatggccggcgcggacccagagcaactacgcaggcttgcacctggcatggattccgttcagaccttctttgctgttgatgatggtccatccctcgaccaagccgttagcgggctggccaccgctctctgccaagcgtcatttaccacacaacctagacccgagccttgtcctgtgtactgcccgaaaggtcaaaagggcgagccaggtgagatgggcctaagaggccaagttggcccacccggagaccccgggctgccaggaagaaccggagctcccggtcctcagggtccaccaggctccgctacagccaaaggtgagagagggttccctggtgcagacgggcgccctgggtccccaggtagggctggcaatcctggaacgcccggagcccctgggcttaaaggttcccctggtctcccgggtcctcgtggcgatcctggtgagcggggccctcgcggtccaaagggtgaacccggtgctcctggacaagtcatcggaggcgaaggtcccggcctaccaggtagaaagggagatcctgggccgtcaggtcctccgggccctaggggcccgctcggggacccgggacctcgtggacctcccgggcttccaggaaccgctatgaagggggacaagggggaccgtggggagcggggtcctccgggtccgggcgaggggggcatcgcgcccggtgagccaggacttccaggactgccgggttcccctggccctcagggacccgtcggcccccctggaaagaaaggagaaaaaggtgattctgaggacggtgcccccggattgcccggacaacccggatcgcccggtgagcaaggtccgcgcggaccgcctggggccatcggcccaaaaggagaccgaggttttcctggaccccttggagaagcaggcgagaagggcgagcgcggtcccccggggcctgcggggtcacgtgggctccctggggtggcagggaggcccggtgcgaagggtcctgaggggccacccggcccaactgggcgtcagggtgagaagggcgaaccgggccggccaggtgatccagccgttgttggccctgcagtcgcagggcctaagggcgagaagggtgacgtcggacctgcaggtccacgaggcgcaactggtgtccaaggtgaacgaggaccacctggattggttttgccgggtgatcctgggcctaaaggtgaccctggggataggggtcctatcggcctaactggtcgcgcggggcccccgggtgattctggtccaccaggtgaaaaaggcgacccgggccgtccgggccctccggggcctgtaggtccccgaggtcgcgatggggaggtaggtgagaaaggagatgagggaccacccggagacccaggactgcctggaaaagcaggcgaaagaggcttacgcggggctccaggcgtgcggggacctgtcggcgaaaaaggcgaccagggtgaccctggcgaagacgggagaaatggttcgccaggatccagtggcccgaaaggcgatcgcggcgagccaggtcctccgggcccacctggccgtctggtcgacactgggcccggtgcccgggaaaagggagaacctggggaccggggacaagaagggccaaggggacctaaaggtgacccggggcttcccggggcgccaggcgagagaggcattgagggtttcagagggccccctggtccacagggtgacccaggagtacgcggcccagctggtgaaaagggtgacagggggcctccggggctggacggccgatccggtcttgatggtaagccaggagcggccgggccgtcgggccccaacggtgctgccgggaaggctggcgaccctggacgggacgggctccctggactacgcggagagcagggtttgccggggccctccggccccccaggactccctggcaagccgggcgaggacggaaagccgggtctcaacggcaagaacggtgagcctggagatccgggtgaggacggccgaaagggcgagaaaggggactcgggagcatcagggcgggaagggagagacggccccaaaggtgagcggggagcgcctggcattttgggcccgcagggacctccgggccttcctggccctgtcggtcccccaggtcaaggtttcccaggtgttcccggaggtacaggcccaaagggcgatcgtggagagaccggatcaaaaggcgaacaaggattgcccggagaacgtggtcttcgaggtgagcctggatcggttcctaacgtggatcgcctcttggagacggccgggatcaaggctagtgccctgagagaaatcgttgagacgtgggatgagtcctctggttctttcttgcctgtgcccgagaggcgtcgcggtcctaagggagattcgggtgagcaaggacctccagggaaagagggtccaataggtttcccaggggagcgcggactgaagggagatcgtggagaccctggccctcagggtccacctggattggctttgggagagcgtggcccccctggcccttccggcttggctggcgagcctgggaagcccggtatcccgggacttccaggtagagcgggcggtgttggagaggctggtagacccggagagcgaggtgaacggggggaaaagggtgaacgaggagagcagggtcgagacgggccgcccggtctacctggcacgcctgggcctcctggcccccctgggcccaaggtctctgttgacgaacctggaccaggcctgtctggcgagcaggggccccccggcctcaagggtgcgaagggtgaaccaggcagcaacggagatcaaggacccaagggtgacaggggcgtgcccggcattaagggtgacaggggtgagcccggcccacgagggcaggatggcaacccaggcctccctggggagcgtggtatggccggtccagagggcaagcccgggttgcaaggaccgcgagggcctcccgggcccgtcggcggtcatggggaccctggcccaccaggcgcaccaggtcttgcaggcccagccggaccacaaggaccgtccgggttgaagggagagccaggtgagaccggtcctccggggaggggattgaccggtccaacaggcgccgtcggcttgccgggtcctcccggcccctcgggcctagtgggccctcaaggttcaccaggactgcctggtcaagtcggagaaaccggtaagcctggtgcgccgggccgggatggagccagcggaaaggacggggacagaggaagccccggcgtccccggaagcccgggcctgcctggtcctgtaggcccaaagggcgagccaggcccaacgggtgctccgggccaggcggtggtgggtcttcccggcgctaagggggaaaagggcgcgcccggtggcctagctggtgacctggtcggggaacccggggccaagggtgatcgtggtctccctggcccccgcggtgagaagggagaggcaggccgagcaggtgagccaggtgaccccggcgaggatggccaaaagggcgcgcccggtccgaaggggtttaaaggtgacccaggggttggtgtaccgggttcccctggccccccagggccccccggcgtgaagggcgatcttggcctaccaggcttgcccggagcccccggagtggtggggtttcccggccagaccgggcctaggggggagatgggccagcctggcccatcgggagagagaggattagctggcccgcccggtcgtgaggggatacccggaccattggggccacctggacccccaggctccgtcggtccccctggagccagtggtcttaagggagataagggtgaccctggagtaggtctcccaggcccccgtggggaacgtggcgaacccggaatacgaggtgaggacggccgcccaggacaggagggccctcgtgggcttacaggtccacctggatcccgaggcgagcggggcgaaaagggggatgttggtagtgcgggactgaagggcgacaagggtgattcagcggtcatcctaggaccgccaggaccgcgtggtgcaaagggcgacatgggagaacgaggtccgcgaggcctagatggggacaagggaccgcgcggagacaatggcgatccgggagacaagggtagtaaaggggaaccaggcgataaaggatctgctggactcccgggtctacgcggactcctggggccccaaggccaaccaggagccgccggaatccccggagacccgggtagccccgggaaggacggtgtcccgggtatcagaggggaaaagggtgatgtaggattcatgggcccccgcgggctaaaaggcgagcgaggagtaaagggtgcgtgtgggcttgatggcgaaaagggcgacaagggtgaggcagggccacccggccgtccgggccttgcagggcataagggtgaaatgggggaacccggtgtacccggccagagcggtgcacccgggaaggagggacttatcggaccaaaaggagatcggggcttcgatgggcagccaggtccgaagggtgaccaaggggagaagggagaacgtggtacaccaggtattggcggcttcccagggccttcagggaatgatggtagcgcgggacctcctgggccgcctggctccgttggcccccgagggcctgagggtctgcagggtcagaaaggcgaacgggggccccccggtgaaagggtggttggtgcccctggcgttcccggtgcacccggtgaacgaggcgagcaaggaagaccgggccctgcaggcccacggggtgagaagggagaagcagctcttaccgaggatgacattcgcggttttgtccgacaggagatgagtcaacattgtgcgtgtcaaggccagttcatcgcgagcggctctcggccccttccctcatatgccgcggatactgcaggatctcagctgcatgctgtgccagtgctccgcgtctcacatgcggaggaggaggagcgtgtccccccggaggacgatgaatatagcgagtactccgaatactcagttgaagagtatcaagaccccgaggcgccctgggattcggacgatccctgttctctaccgcttgacgaggggtcctgcacggcgtacacgctccgatggtaccatcgggccgttacaggtagtacagaggcttgccatcccttcgtttatggtgggtgcggagggaacgctaaccgctttgggacgagagaggcttgcgaaagacgctgtcctcctcgcgttgtgcaatcgcagggcactggaaccgcccaggac

SEQ ID NO: 9610 - DNA, 8832 bp, Artificial Sequence
  Description of Artificial Sequence: Synthetic coding sequence
atgaccctgcgcctcctggttgccgcactctgtgccggtatcctggctgaggcccccagagtgcgagctcagcaccgagaacgggtgacctgcacccgcctttatgctgccgatattgtctttctcctcgatggctcttcaagcattgggcgatctaattttcgggaggtgaggagtttcctggaagggctcgtgctgccgttttctggcgcggccagcgcccaaggggtgaggttcgccaccgtgcagtacagtgatgatccaagaaccgagttcgggctggatgccctgggtagtgggggcgatgttatccgagcaattagggaactgtcttataaaggtggtaacactcgcacaggggccgctatactgcacgtcgccgaccatgttttcctcccacagctagcgcggccaggagttcccaaagtctgcatcttgataacggatggcaaatctcaggacctggtggacaccgccgctcagaggctgaagggtcagggggtaaagttgtttgccgtgggaatcaagaatgccgaccccgaggagcttaagcgcgtggcgagtcagcccacatcagacttcttcttctttgttaacgacttctctattctgcggactctgctgccacttgtctctcgccgggtgtgtaccacagcgggcggagtccctgtcactcgaccgcccgatgactcaacctcggcccccagggatttagttctgtctgaacccagctctcagtccctgagggtgcaatggaccgccgcatctggtccagtcaccggctacaaggtgcaatacaccccgttgaccggcttgggacaaccgctacccagtgaacggcaagaggtgaacgtgcctgctggagagacatccgttaggttacgcgggctgagaccattgaccgagtatcaggtgaccgtgatcgctctgtacgccaactccatcggcgaagcagtgtctggcacggcaagaactaccgcgttggaagggccagagctcacgattcagaacacaacggctcactccctacttgtggcctggcgatcggttccaggcgccaccggctaccgagtaacatggagggtgctctccggaggacctactcagcaacaggagctcggcccaggccaggggtccgtcctactgagggacttggaaccgggcactgattatgaagtgactgtctctacgctgttcggtagatcggtgggccctgccacttccctcatggcccggacagacgcatccgtcgagcagactctaaggccagtaatcctcgggcctacatcaatactgctgtcatggaatctggtgcctgaagccagaggctataggctcgaatggagacgcgagaccgggctagaaccacctcaaaaggtggttttgccatccgatgtgactcgctatcaattggatggcttgcagccaggaacagaataccggctgaccctgtacaccctccttgagggccacgaggtagctacccccgccacggtggtccctacgggcccagagctgccggtctctcctgttactgacctgcaggcaacagagctcccaggtcaaagagtcagggtgagctggagccctgtacccggcgccacgcaatatcgaatcatcgtccggtccacacagggcgtggaacgcaccctcgtgctgccaggtagtcagaccgctttcgatctggatgatgtgcaggctggcctgtcctatacggtgagagtttcggcaagggtgggaccgcgggaggggtctgcaagtgtcctaactgtgcgtagagaaccggagactccactagcggtgcccggtcttcgcgtggtagtatccgacgccacccgagtgagggtggcgtggggtcccgtgccaggcgcgagtggatttcggatctcttggtccacaggaagtggccctgagtcttctcagactcttccccccgactctacagcaactgatataactgggctgcagccaggtacaacataccaggtggccgtcagtgtgctccgcggtagggaagagggacctgctgccgtcatcgtcgcccggactgaccccctgggtcctgtaaggaccgtgcacgtaacccaggccagctcttcatccgtcaccatcacgtggacgagggttcctggtgcaaccggctatcgggtgtcatggcatagtgcccatgggccggaaaagtcacagctggttagcggtgaggccacagtcgcagagcttgacggactggaacccgacacagagtacactgtgcacgtgagagcccacgtcgccggagtggatggaccccctgcctcggtggtagtgcgcacagcccccgagccggttgggcgcgtgagcagacttcagattctcaatgcctcatcagacgtgctgcggataacctgggtcggggtgacaggagcaacagcatataggctggcctggggcaggtctgaagggggtcccatgcgccatcagatcctgcctggaaataccgactccgctgagataaggggcctcgagggtggggtcagctactctgtgcgagtcaccgccttggtgggcgacagagagggcacaccggtttccattgtggtgacaacacctcctgaggcacctccagccctaggtactttgcacgtggtgcagaggggtgaacattccctgagacttagatgggaaccagtgccaagggcgcagggcttcctcttacactggcagcccgaaggcgggcaggagcaatcgagagttctagggcctgaactttctagctaccatctcgatgggttagagccggcaactcagtatcgcgttaggctttcagtgctgggtcctgccggggaaggcccctcagctgaggttaccgctcggaccgagtctccccgagtccctagcatcgagctccgggtagtcgatacgtccatcgattctgtcacgcttgcttggacaccggtttccagggcctcgagttatattctgtcatggcggcccctgcggggacctggccaggaagtgcctgggtccccccagaccttaccagggatcagctcttcgcagcgggtgaccggattggaacccggagtcagttacatctttagcttgacacccgtgctggacggtgtgcgaggtccagaagcctctgtcacacagacaccagtctgcccccgtgggctcgcggacgtagttttcctacctcatgctacccaggacaacgcccatagggcggaagccacccgcagagtcctggaaaggctcgtactcgcgcttggccccctcgggccgcaggctgttcaagtcggtctgctgtcgtacagccatcgaccttcccctctgttccctctgaacgggtcccatgacctaggaatcatcctgcagaggattcgggacatgccctacatggatccttctggtaataatctgggcacagctgtagttacagcacataggtacatgctggctcccgatgccccaggccgccggcagcacgtgccgggcgttatggtgttgctggtggatgagcccctgcgtggagacatctttagcccgatccgggaggcacaggccagtggccttaacgtggtgatgttaggtatggctggtgccgatccggagcaactgagacgccttgcaccaggaatggatagcgtgcaaacatttttcgctgtagatgatggccctagcttggaccaggcggtgtctggtctggcaacagccctttgtcaggcctcttttacaacgcaacctcgccctgagccctgccctgtgtattgcccgaaagggcagaagggcgagcctggagaaatgggcctgcgaggccaagtgggcccaccaggagaccctgggctgcccggcagaacaggagctcccggcccacaggggcctcccggtagtgcaactgcaaagggagagcgggggttcccgggcgccgatggtcgaccaggatctcccgggcgggcaggaaaccctggcacccccggcgcccccggccttaaaggatcccccggtctacctggtcctagaggggatccgggagagagagggcccaggggaccaaagggagagccaggcgctccgggccaggtcatcgggggcgagggcccaggactcccaggccggaaaggcgatccaggcccgtctgggcctcccgggccgcgtggccctctgggcgaccccggacctcgagggccccccggacttcctggaactgccatgaagggcgacaaaggcgacaggggagagcggggccctccagggccaggagagggaggaattgcacctggggagcctggcctgccaggactgcccgggtcacccggccctcagggtccagtaggaccaccaggcaagaagggagagaaaggagattctgaggatggggcccctggacttcctggacagcccggtagtccaggagaacaaggcccacgcggtccacctggcgcgatcggtccaaagggggatagaggttttcctggccccctcggagaagccggggaaaaaggcgagagagggcctcccgggcccgcgggctccagaggactgcctggcgtggctggacggcctggcgcgaaagggccagagggacccccaggccctaccgggcgacagggggaaaaaggggagcctggacgccctggtgaccccgccgtagtgggccctgcagtagccggtcctaaaggcgagaaaggcgacgtgggacctgccggcccaaggggagccaccggagtgcagggagaacgcggcccgccaggtttggtgctccctggagatcctgggccaaagggggatcccggcgataggggccccatcggactgacgggccgcgctggtcctccaggcgattcgggaccgcccggggaaaaaggtgaccctggtaggccaggcccacccggcccggtagggccgaggggccgcgatggagaggtaggggagaaaggagatgaaggaccacctggagacccaggactgccagggaaggccggggagcgaggccttaggggggctcccggggttcgggggcccgtcggggagaagggcgatcagggcgatccgggcgaggatggaaggaacgggagccccggttcttccgggccaaaaggtgacagaggcgagcctggccccccgggacctccaggtcggcttgtcgatacgggaccgggcgcccgtgagaagggtgaacctggcgatcggggtcaggaaggcccgagaggccccaagggggatcctgggctgccgggagctccgggagagcggggaatcgaaggtttccgcggcccgcctgggccacagggggaccccggggtgcggggccccgctggagagaaaggagacagaggcccacccggcctcgatggacggtcagggctggacggcaagcctggggctgcagggcctagcggtcccaacggggcagccggaaaggctggagatcccgggcgggatgggctgccaggcctgcggggggaacaggggctaccaggacccagcggccccccaggcctgccaggcaagccgggggaagatggaaaacccggcctaaacggcaaaaacggagagcccggcgatccgggagaggatggccgcaaaggtgagaagggcgattctggggcatcaggcagagaggggagagacggacctaaaggagagaggggggcccccgggatcctgggtcctcaaggtcccccagggctccctgggcctgtaggcccaccaggacagggcttccctggggtgccaggcgggactgggccgaagggtgataggggtgagaccgggtctaagggggaacaagggctgccaggagagagaggcttgagaggagagcctggctctgtgcccaacgtggacagactcctggagaccgcaggcataaaggcctcggcactccgggaaatcgtcgaaacctgggacgagagttcaggctcatttctgccagtgcccgagagacgccggggtccaaaaggtgatagtggcgaacaggggccacccggcaaggagggtcccattggcttcccaggggagcggggactgaaaggcgaccggggagatcctggcccacagggaccccctggtttggctttgggcgagagggggcctccaggcccgagcgggctggctggggaaccggggaagccgggtatccctgggctaccaggccgggctggaggagtgggggaggctggccggccaggagaacgcggagaacgcggcgagaagggtgagcggggggagcaaggaagggatggaccacctggcctgccaggaacacctggccccccaggacctcctgggcccaaggtgtctgtggacgagccaggacctgggctgtctggcgaacagggcccccctggcctgaagggagccaaaggcgagcctggatctaacggggatcagggccccaaaggcgacaggggcgtgccagggatcaagggggacagaggagagcccggtcctcggggtcaggacggaaatccagggttacccggcgaacgtgggatggccggacctgagggcaagcccggtcttcaggggccacgtggaccaccgggacctgttggcggccacggagaccccggtcccccaggtgctccaggcttggccggccccgctggtccccaagggccctccggactgaaaggcgagcctggcgagacgggaccaccaggccgcggcctgacaggcccgaccggcgcagtgggattgcctggtcctcctggcccctcgggcttggttggaccccagggcagtcccggtctcccaggccaggtgggcgagaccgggaagcccggtgcccctggtcgcgacggagcctcgggaaaggatggggacagagggtcaccgggcgtcccggggtcacctgggctcccaggcccagtaggccccaagggcgagccaggcccaaccggcgcccccggccaggcggtcgttggactgcctggggccaagggagaaaagggtgcccccggaggactggcgggcgacctggttggggaacccggagctaagggtgaccggggcctgccagggcccagaggagaaaaaggggaagcggggcgagccggagagcctggggatccgggggaagacggccagaaaggtgcaccagggccaaaggggtttaaaggcgatcctggagttggagtacccggcagccccggcccacccggaccacctggtgtcaaaggcgatctgggactgcccgggctgcccggtgcccctggcgtcgttggatttccggggcagactggcccgcgaggagagatgggtcagcctggcccttccggggaacgtggccttgccggacccccagggcgcgagggcataccagggcccctgggcccccctggacccccgggatcggtggggccacctggcgctagtggcttaaagggggacaaaggggaccctggagtgggtctgcctggtcccagaggggaacgaggcgagccaggaatccggggagaggacggccggcccgggcaggagggcccccgagggctcactggccctccaggatcaagaggagagcggggggagaaaggagatgtcggctcagccggacttaaaggtgataagggcgatagcgccgtgatcctgggacccccaggccccaggggcgctaaaggcgacatgggagagcgggggcctcgcgggttagatggggataagggcccacggggcgacaatggcgatcctggagataagggctcgaaaggagagccaggagataaaggtagcgcaggccttcctggcctcaggggcctgctggggccacagggccagccgggggctgcgggcatccctggcgacccagggtccccagggaaagacggagtacccggaatcaggggagagaaaggcgatgtcgggtttatggggccaagaggcctgaagggcgaaagaggagtgaagggtgcatgcggcctggacggagagaaaggtgataaaggcgaagctggaccacccggcagacccggcctggcagggcataaaggcgagatgggagaaccaggtgttcctgggcaaagtggggcacccggtaaggaggggttgatagggcccaagggggaccggggttttgacggccaaccgggaccgaagggcgatcaaggagagaagggagagagggggactccagggataggcggattcccaggaccttctggcaacgatgggtctgccgggccccccggaccaccggggtctgtcgggccaagaggaccagaggggctgcaggggcaaaagggcgagaggggtccccccggagagagggtggtaggcgccccaggcgtcccgggagctcccggggaaagaggagagcaggggagacccggtccagctggcccccggggtgagaagggtgaagccgccctgactgaagacgatattcgaggcttcgttcggcaagaaatgtcccagcactgtgcctgccagggacagtttattgcatctggctcccgcccgctgccaagctacgcagctgatacggctggatctcagctacatgctgtaccagtgttgcgggtgtcacatgcggaggaggaggagagagtgcctcccgaggacgacgaatattctgaatactctgaatattcggtggaagagtaccaggatcccgaggctccctgggactccgatgatccttgcagccttcccctggacgagggatcctgcactgcttatacattgcgatggtaccatcgggccgtgacgggctccaccgaagcctgccaccccttcgtttacggcggatgtggtggtaacgccaatcgatttggtacacgagaagcctgtgagcgtcggtgtcctccccgcgtggttcagtcacaaggcacggggactgctcaggat

SEQ ID NO: 9611 - DNA, 8832 bp, Artificial Sequence
  Description of Artificial Sequence: Synthetic coding sequence
atgacccttcggcttttggtcgcagctctctgtgcggggatcctggctgaggcaccacgtgttcgcgcacagcatcgagaaagagtcacgtgcacaagactttatgcagccgacatcgtcttcctgcttgatggctctagcagcatcggtagatcaaacttccgtgaggtcaggagctttctggaggggctcgtcctgccctttagtggtgccgcctctgcccaaggcgtcagattcgctacagtgcaatactccgacgatcctaggactgagtttggtcttgacgctctgggcagcggcggcgacgtgattcgggctattcgggagttgtcatataaaggggggaacaccaggactggtgctgccatcttgcacgttgctgaccacgtcttcctcccgcagttggcacggcccggcgtgcctaaagtgtgcatactgatcaccgacggaaaatcacaagatctcgttgacacagcagctcagcggcttaaaggccagggggtcaagttgtttgcggttggaatcaagaacgccgatcccgaagagctcaaaagggttgctagccagccgacatctgactttttctttttcgtaaacgacttctctatcctaaggactttgctgcccctggtctctcgccgggtgtgcacaaccgcaggaggagtccccgtgacccggccgcctgacgactctaccagcgccccacgggaccttgttctttcagagccttcgtcacagagcctgcgggtgcagtggacagcagcgagcggtcccgtgaccggctacaaggttcagtatacacctctcacagggctgggccaaccactgccctccgaaaggcaggaagtaaatgtccctgccggggaaactagtgtgcgtctgcgcgggctgcgaccccttaccgagtatcaggtcactgtgattgccttatacgcaaactcaataggcgaggcggtgtccgggaccgcccggactacggctcttgaaggaccagaattaacaattcagaacaccacggcccactccttgttggtagcatggcgaagcgtgccaggggctaccggctacagggtgacctggcgagtcctgagcggaggcccaacccagcagcaggagctgggaccagggcaaggcagcgttctgctgagggacctggagcccggcacggactacgaagtgactgtttcaactttgtttgggagaagtgtagggcccgctacttccctcatggcaagaaccgatgcgtcagtcgagcagacactcagaccagtgattctggggcctacttccatcctgctgtcctggaacttagtccccgaagctcggggttaccgtctggaatggaggagagagactgggctcgaacctcctcagaaggtggtattgcccagcgacgtcactaggtaccagttagacggactgcagccaggaaccgagtaccgcttgactctgtatacactgctggaaggccatgaggtggccactccagctaccgtcgtgcctacaggcccagagttgcccgtgtctcccgttactgacctgcaggccacggagttgcctggacaacgggtgcgggtttcctggagccccgtcccaggagccacacagtacagaattattgtgcgaagtacacagggggttgagcggacattggttctgcccggtagccagacggcgttcgacctggacgacgtgcaggctggcttaagctacaccgtaagagttagcgctcgtgtcggcccccgtgaagggagcgcatctgtgctcactgtccggagagagccggagaccccactcgcggtgcctggcctgagagttgtcgtctcagacgccacacgagtaagagtggcctgggggccagtgccaggtgcctccggcttcaggatcagctggtctacaggtagcggacctgagtccagtcagaccctcccccccgattcaacggctactgatatcaccggactgcagcctggtaccacgtatcaggtggccgtgagtgtccttcggggcagagaagagggaccagcggccgtcatcgtcgctcggaccgaccccctcggccctgttcgaacagtgcatgtgactcaggcctcctccagctcggtgactatcacgtggacccgagtacctggggctacgggctaccgagtgtcgtggcactccgcacacggccccgagaaaagccaactcgtcagtggggaagcaaccgtggcagagctggatgggctggagccggacactgagtacactgtgcacgtcagggcacatgtggctggcgtggatggtccccccgcctcagtggtcgtgcggactgcacctgagccggtggggcgggtgagccggttgcaaatactcaatgcatcctcagacgtgttgcgaatcacttgggtgggcgtgaccggcgctactgcttatcggttggcttgggggcgctcggaaggcgggccaatgcgccaccagattctgcctggcaacacagactctgccgagattcgtggcctggaaggcggtgtgtcctattcagtgagagtgacagcactggtgggagatcgggaaggcacccccgtttcgattgtagtgactacccctcccgaggcaccccccgctctaggcaccctccatgttgtgcagcgcggcgagcactctctccggctaaggtgggagcctgtcccaagagctcagggttttctactacactggcagcccgagggcggccaagagcagagccgagtgctaggaccagaactatcttcataccacttggatggcctggagccggccacgcagtaccgggtgcgcctgagcgttttgggacccgccggcgagggccccagcgccgaggtgacagctcggactgaatctcccagagttccaagtatagaactgcgcgtagttgacacttctatagattctgtgacactggcgtggactcctgtcagccgggctagcagctatattctgagttggcggcctttgaggggccctggacaggaagtccctgggtcaccacagactctgcccgggatctcttcatcccagagagtgaccggcctggaaccgggagtctcgtatattttctcactgacccccgtcctagatggagtacgtggcccggaggcttctgtcacccagacacccgtgtgtccgagaggattggccgatgtggtgttcctgcctcacgctacccaggacaacgcccaccgagcagaggcaacccgcagggtgctcgagcggctagtcctggccctaggccctctcggcccgcaggcagttcaagtgggtcttctgtcttatagccatcgaccttctcctctgttcccattaaatggttctcacgatctgggaatcatactacagcgcattcgtgatatgccgtacatggatcccagcggaaataatttaggcacagcggtggtgaccgcacatagatacatgctggcccctgacgctccgggtcgccgccagcacgtcccaggcgtcatggtgcttctcgttgatgaacccttgcggggtgatattttcagccctatccgggaagcccaagccagcgggttgaacgtggtaatgctgggcatggcgggtgcagatcccgaacagctcaggagactcgctccgggcatggattcagttcagacattcttcgccgtcgatgatggcccgagtttggatcaggccgtgtctggcctcgccacagcactgtgtcaggcctcatttactactcaaccccggcctgagccttgcccagtttattgccccaaagggcagaagggggagcctggtgaaatgggactgcgcggccaggtgggtcctccaggcgatccgggtctgccaggaagaaccggggcccctgggccccagggccctccaggaagcgccaccgcaaagggcgaacgcgggttccctggagccgacggacggccgggatcccccgggcgagcgggaaaccctggtacccccggagctcctggtctcaagggatcccctggactacccgggcccagaggagaccccggcgagagaggacctcgaggtcccaagggggagcctggcgccccaggacaggtcatagggggcgagggacctggtctgccaggccgaaaaggcgatcccggaccctcgggtccacccggtcccaggggaccgctgggcgaccctgggccgcgggggcctcccggcttgcccggcaccgctatgaagggtgacaagggagatagaggtgagagggggccaccgggcccaggtgagggcggcattgccccaggcgaaccgggcctgcctgggctgccagggagccccggaccccagggacctgtgggcccaccagggaaaaagggggaaaaaggagacagcgaagacggggcccctggcctgcccggccagcccggatcacctggcgagcaggggcctcgagggccaccaggcgcaatcgggcctaagggggacaggggattccccgggcccctgggagaagctggagaaaagggggagagggggccgcccggccctgccggctctaggggcctgccaggagtggccggacgacccggcgctaaaggtcctgagggaccccctggacccacgggtaggcagggggagaagggagagcccggtcggcctggggatcctgcagtcgtgggcccggccgttgccggaccgaaaggagagaaaggtgacgttggccctgccgggccacgcggagctacaggggtacaaggggaaaggggaccccccggtctcgtcctgcccggcgaccctggacccaaaggggatcctggtgatcgtgggcctatcgggttgactggacgagccggcccaccgggagactctggcccccccggcgagaagggagacccaggacgtccaggccccccaggccccgttgggcctaggggaagggatggagaagtgggggaaaagggcgacgaggggccccctggcgacccgggcctccctggtaaagcaggcgagcggggactgcgcggcgcccccggagtgagagggcccgtcggagaaaagggggatcagggagaccctggagaagatgggcggaacggctcaccaggttcctctgggcctaaaggcgatcgcggggagcctggcccccccggaccaccaggacggctggtagatactggccccggggcacgggaaaagggcgagcctggcgatcggggccaggagggcccccggggccccaagggcgatcctggtttgcctggcgccccaggtgagagagggatcgaggggtttagaggcccccctggacctcagggtgatcctggcgttaggggcccagctggagaaaaaggcgatcggggcccacccggattagatgggaggagtgggttagacgggaagcctggtgccgcaggaccctctggtcctaacggtgcggcgggcaaggcaggggatcctggccgcgatggactccccggtttacggggggaacagggcttaccggggcctagcggacctcctggtttgcctggcaaacctggcgaggatggaaagccggggctgaacggcaagaacggagaacctggcgacccaggtgaagacggaaggaaaggcgaaaaaggcgattccggagcctctggcagagaaggaagggacggccctaagggggagcgaggcgcgccagggatcctgggtccccaaggccctccgggtctcccaggcccagtcggtccccctggtcaagggttcccaggggtccccggcggtactggtcctaagggcgatcggggtgaaaccggatctaaaggagagcaggggcttcccggggaaagggggctgcgcggtgagcctggctctgtgcctaacgttgataggctgctcgagacagccggcatcaaagcctctgccctccgcgaaatcgtggaaacatgggacgagtcaagcggatcattcctgccagtgccagagaggaggcggggtcctaagggggattcaggagaacagggccctccaggcaaggaaggcccaataggattcccgggggaacgcggcctgaaaggcgataggggcgaccccgggccgcagggaccccccggcttagccctcggagagagaggccctcctgggccttctggcctggcgggggaacccggcaagcccgggattcccggtctccccggtagagccggtggggtgggggaggctgggcggccgggagagaggggagaacgaggcgaaaagggggagagaggcgagcaagggagagacggtcctccaggattgccaggcactcctgggccacccggaccgccaggaccaaaagtcagcgtcgatgagcccggaccaggcctgtcaggtgaacagggcccacccggactcaagggcgcaaagggtgaacctggctcaaacggagatcaggggccaaaaggcgacagaggagtgccaggtattaaaggtgaccggggggagcctggacctcgcggtcaggatggtaatccagggctgccaggagagcgtgggatggctggccccgaaggtaagccaggcctgcaaggtcctagaggacctcctggccccgtgggcggccacggcgatccaggaccgcctggtgctcccggactcgccggacctgcaggcccccaggggcccagtggtttgaagggtgaacccggtgaaactgggccaccaggtaggggcttgactggccccacgggcgctgttggattaccaggtcctcctgggcccagtgggctggtgggcccccaggggtctcctggtctcccaggacaagtaggcgagacggggaaacccggggcgccgggcagggacggcgcgtctggcaaggatggcgacaggggatctcccggtgtcccaggcagtccaggactgcccgggccagttggccctaagggtgagcctggcccgaccggtgcacctgggcaggccgtagtcggcctcccaggagcgaagggtgagaagggggccccgggcggtctggccggagatctagtcggtgagcccggagctaaaggcgaccgtggtctccctggccctcgcggtgaaaaaggagaggccggaagggccggggagcccggcgacccaggggaagacggacaaaagggagctcccgggcccaagggtttcaagggcgatccaggagtgggggtcccaggcagtccagggccgcccggccccccgggggtgaaaggcgatcttggtctcccgggcttgcctggggctccaggtgtggtcggttttcccggccagaccgggccacgcggcgaaatgggtcagccagggccttcaggagagcgcggtcttgcaggtcccccagggagagagggtatccccggtccactgggaccaccaggcccacctggaagcgttggaccgcccggtgctagcggacttaaaggagacaaaggtgaccccggtgtcgggctccccgggccgcgtggagaaaggggtgagcctgggattcggggggaagatgggcgtcccggacaggagggcccccgtggcttgacagggccaccagggtctaggggagaacggggtgagaagggtgacgtgggatcagccggcctgaagggagataaaggcgattcggctgtgatattaggaccaccaggcccgaggggagccaaaggggatatgggagaacgtgggcctcgtggcctggacggagataaaggccctcgcggagacaacggcgaccccggcgataaaggctcaaaaggagagcccggtgacaaaggtagcgccggattgcccggcctgcgagggctgctgggaccccagggtcagcccggggcggccggcatccccggtgacccaggtagcccgggcaaagatggagtcccaggcattcgaggggagaaaggggatgtcggcttcatgggcccccggggcctgaagggagagcggggagttaagggggcctgtggactggatggagaaaagggcgataagggcgaagcgggaccgccgggccgccctgggttagctggacataagggtgagatgggggaacctggggtacccggacagtctggcgcacccggcaaggaaggactgatcggcccaaagggagacaggggattcgatggccagccaggccctaagggagatcagggcgagaagggcgaaagggggacccccggcatcggcggctttcctggcccgtcgggcaatgacggctccgcaggaccccctggcccccccggcagtgtgggccccaggggccccgagggccttcagggccagaagggggagcggggaccacccggtgaacgggtggtgggggccccaggagtcccgggcgcccccggagaacggggagagcagggcagacccggacctgccggaccccgcggcgagaaaggagaggctgcactgacagaagatgacatccggggattcgtacggcaggaaatgagccaacactgcgcatgtcagggccagttcatcgccagcggttctcggccattgccctcttatgctgctgataccgccggaagtcagctccacgcagttcccgtgttgcgagtctcgcacgctgaagaagaagagcgggtgcctccagaagacgacgagtatagcgaatattccgagtactctgtggaggagtatcaagatccagaggccccttgggactcagacgatccttgtagcttgccgttagatgagggctcctgcactgcctataccctgcgttggtatcaccgcgctgtcaccggtagtacagaagcttgtcatccattcgtttacggggggtgtggtgggaacgccaataggttcggcacacgagaggcatgcgagcgccgctgcccacctcgggtggtacagtcccaaggtactggcaccgcccaggat

SEQ ID NO: 9612 - DNA, 8832 bp, Artificial Sequence
  Description of Artificial Sequence: Synthetic coding sequence
atgaccttgcgtctgctggtggcggccctctgtgcaggcatcctcgcagaagcaccgagggtgcgcgcgcagcatcgggaacgcgtgacctgtactcgactttacgcagcagacattgtgtttcttctcgacggatcatcgtcgataggtcggagcaactttagagaggtgaggagctttcttgagggtctggtgcttcccttttcaggtgcagcaagcgcacaaggcgtgaggttcgcaaccgttcagtactcagacgacccacgtaccgagtttggactggatgccttgggaagcgggggagatgtgataagagcaatacgtgaactttcgtacaaaggtgggaacactcgcactggagccgcaatcctgcatgttgctgaccacgtgtttctccctcagcttgcacgccctggcgtgccaaaagtttgcattctgattactgatggtaagtcacaagatctggtcgatacggcagcgcaaaggttgaagggccagggtgtcaaactttttgctgtcggaattaagaatgcagatcctgaagaactgaaacgagttgcatcccaacctacctcagacttctttttcttcgtgaatgatttctcgattctccgcactttgctgccgctcgtctcgaggcgagtgtgcactactgcaggtggtgtcccggtgactagacctcctgacgattcgacttcggctcccagagatctcgtgctctcagagccgtcatcgcaatcccttcgggtccaatggacggcagccagcggacctgtcactggttacaaagtccagtatactccacttaccggtcttggacaaccgctgccttcagaacgccaggaagtgaacgtgccagctggggagacttccgtccgactgcgcggactcaggccgctgaccgaataccaagtcactgtcattgcactgtacgccaacagcatcggggaagcagtctcaggtaccgcacgtaccacggcacttgaaggtccagaacttactattcagaacactacggcacactccctgttggtcgcctggagatccgtccccggtgcaactggataccgtgtgacctggcgcgtcctcagcggaggccctactcaacagcaagaacttggtcctggccaaggatcggtgctgctgcgcgaccttgagccagggaccgactacgaagtgacggtgtccaccctttttggtcgctccgtgggcccagcaactagcctgatggcacggaccgacgcaagcgtggagcagacccttcggccggtgattctgggaccgacctcaatcctcctttcttggaatctggttcccgaagcgaggggttacagattggagtggcggagggaaaccgggctggagcctccacaaaaggtggtgctcccaagcgatgtgactagataccaacttgatggacttcagcccggcaccgaataccgcctgactctgtataccctcctggaaggccatgaagtggctactccggcaaccgtggtgcccaccggtccagagctgcctgtctcacccgtgaccgatctccaagcaaccgagctgcccggccaaagagtccgcgtcagctggtcgccggtcccaggagctacccaataccggattattgtgagaagcacccagggtgtggaaaggaccctggtgcttcccggcagccagactgccttcgatctggacgacgtgcaagcgggactgtcctacacggtgcgcgtctccgcaagggtggggccgcgggaaggtagcgcatctgtgctgaccgtgagaagagagcccgagactcctcttgcagtgccgggactgagagtggtggtgtcagatgctacccgagtgcgggtggcctggggaccagtcccaggagcgtcgggattccgtatctcctggagcaccggatccggtccagaaagcagccagacccttccacccgatagcacggcaacggatattaccggactccagccaggaacgacctaccaagtggccgtctccgtcctgcggggtagggaagagggacctgcagccgtgatcgtcgcgagaacggatcctcttggacctgtgagaactgtgcatgtcacccaagcgtcgtcctcatcagtgacgattacgtggactagagttccaggagcaacgggttacagagtgagctggcattcggcacatgggcctgaaaagtcccagttggtgtcgggggaagcgactgtcgccgagttggatggacttgaaccggatactgaatatactgtgcatgtgcgcgcacatgtggcaggggtggatggacccccagcgtccgtcgtggtgagaactgcgcctgaaccggtggggcgcgtgtcaagactccagatactcaacgcatcctccgacgtgctccgcatcacctgggtgggtgtgacgggagccaccgcctacagactcgcgtggggacgctcggaggggggacccatgaggcatcaaattcttccgggtaatacggactccgcagaaattcgggggctcgaagggggagtgtcgtattcggtgcgagtcactgcgcttgtgggggatcgggagggtactcccgtctcgattgtggtgacgactccacctgaggcacctccagcactgggaacccttcacgtcgtgcagcgtggtgaacactcactccggttgcgctgggaacctgtcccacgggctcaggggtttcttctgcactggcaacctgaggggggacaagaacaaagccgggtgctgggacctgagctttcgtcttaccatcttgatggtctggaaccagcaacccaataccgggtgagactgtcggtcctgggaccggcaggtgagggaccatccgcggaagtgaccgctcgtaccgaatcgccaagagtcccctctatagaacttagggtcgtggatacttccattgattcggtgactctggcgtggactcctgtgtcccgggcctcgtcatatatcctgtcctggcgacctttgcgggggccgggtcaggaggtccctgggtcgccccagactttgcctggtatttcctctagccaaagagtgactggacttgaacccggagtctcgtatatcttctcgctcactcctgtgctggatggcgtgcgcggtcccgaggcctcggtgacccaaacccccgtgtgccctagaggcctcgcggatgtggtgtttcttccacacgcaacccaggacaacgcacatagggcagaagcaacccggcgggtgctcgaacgcctcgtgctggctctgggaccgctggggccccaggccgtgcaagtcggccttctttcctactcgcatcgccccagccctctctttccgctcaatggaagccacgatctggggatcatcctccaacggatccgcgacatgccatatatggatccgtccggtaacaacctcggaactgcagtcgtgaccgcacatcgatacatgctggcccccgatgccccggggcgaaggcaacacgtgcccggggtgatggtgctcctcgtggatgaacctcttcgaggagacatattcagtcctatccgagaagcacaggcgagcgggttgaacgtcgtcatgctgggcatggccggagcagatcctgaacagctgcggcgactggcacccgggatggactcagtgcaaaccttttttgccgtggatgatggaccctccctggatcaggcagtgagcggccttgcaactgcactgtgccaggcatcgttcactactcaaccaagaccagaaccatgtccagtctactgcccaaaaggacagaagggagagccgggagagatgggtcttagaggacaagtgggtccaccaggggaccccgggctgcctggtaggaccggtgcacctggtccccagggaccgcctggatcggccaccgcaaagggagagcgaggatttcccggtgctgacggacgtcctggttcgcccggacgggcaggtaatccgggtacgccgggtgcccctggcctcaagggttccccaggtttgcctggaccaaggggtgatccaggcgagcgcggacctaggggacccaagggggaacctggggctccaggtcaagttataggaggcgaaggacccgggctgccaggccgcaagggcgatcctggcccatccggtccccctggacctcgcggaccactgggagatcctggtccgcgcggaccaccaggactgccaggcactgcaatgaagggtgataaaggagatcggggtgagcgcggccctcctggtccaggagaaggcgggattgccccaggtgaaccgggccttcctgggctcccaggctcacctggtccacaaggtcctgtcggaccacccggcaagaaaggtgaaaagggagattccgaagatggggcccccggacttcccgggcaaccaggatccccaggagaacagggtcctagaggacctcctggagcgattggccccaagggcgatcgggggtttccaggacctctgggcgaggccggtgagaagggtgaacgtggcccacccggacctgcaggatcgagaggtctgccaggtgtggcagggcgtccaggtgcaaagggccccgaaggacctcccgggccaactggtcggcaaggtgagaagggtgagcccggtcggcccggagatcccgcagtggtgggccccgcagtggcaggtcctaaaggggagaaaggggatgtggggcctgctggacccaggggcgctactggagtgcaaggcgagcggggccctcctggcctcgtgctgccaggagatccagggccaaagggtgatcccggggatcgcggacctattggactgaccggtagagcgggaccgcctggagactcgggacctccaggggagaaaggggaccctggccgccctgggcctccgggccctgtggggccacgcggaagggatggggaagtcggagagaaaggtgatgaaggcccaccaggagatccaggcctccctggcaaagcgggagaaaggggactccgaggagctcctggtgtcagggggcctgttggcgagaaaggggaccagggtgaccctggcgaagatggaaggaacggatctccgggttcgagcggtcccaagggggatcgcggagagcctgggcctcctggtcctcctggacggctcgttgatactggcccgggtgcacgggaaaagggagaacctggggacaggggacaggagggtccgcgcggcccgaagggcgatcctggtctgccgggagcgccgggagagagaggtattgaagggtttagaggccctccaggacctcagggagatcccggcgtccgagggccagcaggcgaaaagggcgacagggggccacccggcctggacggtcgctccggacttgacggtaaacctggcgcggcaggcccttccggaccgaacggagcagccgggaaggcaggagatccgggacgcgatggcctgcctgggttgcggggcgaacaaggcctccctgggccatctggacccccaggcctgcctggtaagccaggcgaagatggaaagcctggactgaacgggaagaatggtgaaccgggagatcctggtgaggacggcagaaagggggaaaagggtgactccggtgcaagcggaagagaaggacgcgatggcccgaagggcgagagaggggcccctggcatccttggacctcaaggacctcctggacttcccgggccagtcggaccgcctggacaaggatttccaggcgtgccgggtggtaccggtcctaagggtgatcgaggagaaactgggtcgaagggcgaacaagggctgccgggagagagaggccttcgtggagagccgggatccgtgcctaacgtggatcggctgctggaaactgcgggcatcaaggccagtgcccttcgggaaattgtggaaacttgggatgaatccagcggttccttccttcccgtgcctgagcgcagacgtggaccaaagggcgattccggagagcaaggacccccaggcaaagaggggcctatcgggttcccaggtgaaaggggactgaaaggggaccggggagatcctggaccccagggaccacctgggttggcgctgggcgagagagggccgccaggaccaagcggacttgcaggcgaaccgggaaaaccaggaattcctggactgccaggtcgggctggaggtgtcggagaagcgggcagacctggggaaagaggtgaacgaggcgaaaaaggggagagaggggaacaaggtagagatggtccacctggcctgcccggaactcctggcccaccagggccacctggacccaaagtgtcggtggacgaaccaggccctggcctttcaggtgaacaggggccacctggcctgaagggagcaaaaggagaaccgggttcaaacggggaccaaggtcccaagggcgaccgaggagtcccggggattaaaggagataggggagaaccaggaccgagagggcaggatggcaatccaggactgcctggagaacgaggaatggcaggaccggagggtaagccaggattgcagggtccacggggccctccaggtccagtggggggacatggagatccggggcctccaggagcacccggccttgcgggaccggccggaccgcagggaccgagcggactcaaaggcgaacccggagaaaccggtccaccaggcagaggtcttactggcccaaccggcgcagtgggccttcctggtcccccgggaccctcgggccttgtggggccgcagggatcgccaggactgcctggccaagtcggggagactggaaagcctggagcccctggccgcgatggagcctcaggaaaagatggtgaccgcggatcacctggagtgccaggatcgccgggtctgcccgggcctgtgggaccaaagggagagccagggcccactggtgccccaggccaggcagtggttggacttccaggtgccaaaggagaaaagggagccccaggcggcttggcaggagacttggtgggcgaacccggcgcaaagggggaccgtggcctgcctgggcctcgcggtgaaaagggagaagcaggccgagcaggtgaacccggggatccgggcgaagatggacaaaagggagcacccggaccaaaaggttttaagggtgatcctggagtaggagtcccgggttcacctggaccccccggtcccccgggtgtcaaaggcgaccttggacttcctggacttcccggagcaccaggcgtggttgggtttcctggccaaaccggaccgcgcggggaaatgggtcaaccaggaccatccggagaacgcggtcttgctggtccacccgggcgggaaggtattccaggccctctgggcccacctggacctccaggatcggttggtcctcctggtgcctcaggtcttaaaggtgataagggagatccaggcgtgggacttcctgggccaagaggggagcgcggagagccagggatacgtggagaagatgggcggccgggtcaagagggcccgcgggggttgactgggcctccaggctcgaggggtgaacgaggagaaaagggtgatgtcggtagcgcggggcttaagggtgacaagggagactccgcggtgattctcgggcctccaggaccaagaggcgcgaaaggtgatatgggagaaaggggaccaagaggacttgatggagataagggtccacgcggagataacggtgatccaggtgataagggatccaagggtgagcccggagacaagggatccgccggcctgcctggtctgcggggacttctggggcctcagggacagcctggagcagcagggattcccggcgatcctggctcacctgggaaagatggcgtgcccggaattagaggagagaaaggtgatgtgggttttatggggccacggggactgaagggcgaacgaggagtgaagggtgcatgcggccttgatggcgagaagggtgataagggagaggctggtccccctggtaggccaggactggcaggtcacaagggtgaaatgggggagccaggtgtgccaggccaatcgggggcaccaggaaaggaggggcttatcggccctaagggcgaccgaggtttcgatggacaacctgggcctaaaggcgatcaaggcgagaagggcgaaagaggcacgccgggaattggagggtttccgggcccttcaggaaatgacggatccgcaggcccgccgggacctccagggtcggtgggacctcgtggcccagaaggactgcaaggtcaaaagggagagagaggtcctcctggagaacgtgtggtgggagcccctggagtgccaggcgctcctggtgagaggggagagcaaggtcggcctggaccggcaggtcctagaggggaaaagggggaagccgccctgaccgaagatgatattagaggattcgtgcgccaagaaatgtcccaacattgtgcatgtcaaggtcagttcatcgcttccgggtctaggccacttccttcatacgcagcagacactgcagggtcacaacttcacgctgtgccggtgctgagggtttcccatgcggaagaagaggaacgggtgccaccagaggacgacgaatacagtgagtactcagagtactccgtcgaggaataccaggaccccgaagcaccatgggacagcgatgacccctgtagcctgccactcgatgagggctcatgcaccgcgtacaccctccgatggtaccatcgggccgtgactggatccaccgaggcgtgccacccctttgtctacggcggatgtggaggcaacgcaaacagatttggaaccagggaagcatgtgaaagacggtgtcctcccagagtggtgcaatcccagggaactggtaccgcccaggac

SEQ ID NO: 9613 - DNA, 8832 bp, Artificial Sequence
  Description of Artificial Sequence: Synthetic coding sequence
atgacattacggctcttggtggccgccctctgcgccgggatccttgctgaggctccaagagtgcgagcccagcaccgcgagagggtaacatgcactagattgtatgccgcagatatcgtgtttctcctggatggatcttcctccatcgggaggtcaaattttcgcgaagtccgttcattcctggaggggctggtactgcccttctcaggagcagcatctgcgcagggagttcggttcgcaactgtccagtacagtgatgatcctagaactgaattcggattggatgcactcgggtctgggggagatgtcatccgcgccataagagaactttcctataaagggggaaacactcggacaggagcagccatactacatgtggctgatcacgtgttccttccccaactcgcccgccccggggtgcccaaagtctgtatccttattacagatggaaagagtcaggacctcgtcgatactgctgcacagaggctcaaaggacagggagtgaaactttttgctgtgggaatcaaaaatgctgatcccgaagagttgaaaagagtagcttcccagcccacttcagacttttttttttttgtgaacgatttctccatattgagaacactattgcctctggtttctcggcgagtttgtacgactgcgggaggagtaccggtcactagacctccagatgattctacatcagctccccgggatctcgtcctttcagagccttctagtcagtctctccgggtccagtggacagcagcctctggacccgttactggatacaaagttcagtatactccactaactgggctgggacagccactccctagtgaacggcaggaagtaaatgtgcctgccggggagacatctgtcagactgcggggactccgacccctcactgagtaccaggtgacggtcatagcgctttatgcaaacagtatcggagaggctgtgtcgggaactgctcggactacagctctcgaaggacctgagttgactatacagaacactacagcccacagtctacttgttgcctggagatcggtacctggggctactgggtatagggttacttggagggttttgtctggggggccaactcaacagcaggaactggggccaggacagggatctgtcttacttcgagatttagaacccgggacagattatgaagtgactgtgtccactctattcgggaggtcagtaggacccgctacatccctcatggcacgaacagatgcctcagtcgagcagactttacgacctgtgatactggggcccactagtatcctgctaagttggaaccttgttccagaggcccgagggtatagactcgaatggaggcgagagacgggactcgaaccccctcagaaagtcgtactgccaagtgatgtcactcgataccagcttgatgggctgcagcccggaactgaataccggctaactctttatacactcctagaaggacacgaagtcgccacaccagcaactgtggtgccaacaggacccgaactccccgtgagtcctgtgactgatctccaggccacggaactcccagggcagcgggttcgggtctcgtggtcacccgtgcccggggccacacagtataggatcatcgtccgttcaacacagggagttgaacgaactctggttcttcctggatctcagacagcatttgatttagatgacgtgcaggccggactctcctacacagtccgagtttccgctcgggtgggacccagggaggggtcagcctcagtattaacagtaaggcgggagcctgaaacaccgcttgccgtcccagggctccgggttgtagtgtctgatgccacaagggtcagagtcgcatggggacccgttccaggagcgtccgggtttaggatttcctggtccacaggatctgggcccgaatcatcccagacactacctcctgatagtacagctacagatataacaggactacaacctgggacaacataccaagtcgccgtgtcagttcttcgcggacgggaggaggggcccgccgctgtgattgtagcgaggacggatcccctcgggcccgtgaggactgttcacgtaactcaggcatcatcttcctctgtgacaatcacatggacacgagtgcccggagccactgggtatcgagtatcttggcactcggctcatggaccagaaaaatcacagctggtttctggagaagcaacagtggcagagttggacggattagaaccagatacagaatatactgtccatgtgagggcacacgttgcgggagtcgatgggcctcccgcttcagtggtggtaaggactgcccccgaacctgtcggaagagtgagtagacttcaaatcctcaacgccagttcggatgttctcagaatcacatgggtcggagttactggagcgacagcataccgcttggcatggggaaggtctgaagggggaccaatgaggcaccagatattgccaggaaacactgattcagcagaaatccgggggctagaggggggggtaagttactccgtaagagtaacagctctggtgggagatcgagaaggaacacctgtctccatagtggtaacaacaccccccgaggctcctccagctcttggaactctgcatgtagtgcagcgtggggaacattcccttcgcctacgctgggagccagtgccgagggcacagggattcctacttcattggcagccagaagggggacaggagcaatcccgtgtcctggggcccgaactatcgtcttatcacttggatgggctcgaacccgccactcagtatcgcgtgcgcctgtcagttctggggccagccggagaaggaccttccgctgaagtaactgcccggactgaatcacctcgcgtgccttctatagaactcagagtagtagatacttccatcgattcagtaacacttgcgtggactccagtctcccgagccagttcttatatattgtcttggcggcctttgagagggcccggacaggaagtgccaggatccccacagacactacctggaatctcctcttctcagagagtaactgggctggaaccgggagtttcatacatctttagtctgactccagtgttagatggagtgcgggggccagaggcctccgtgactcagacaccagtttgtcccaggggacttgctgacgtggtgtttctccctcatgcaacacaggacaacgcccacagagccgaagccacacgtcgggtgcttgaaaggttagtgcttgcactgggacccctcgggccacaggcagtccaggtcgggttgctatcttattcgcacaggccttcacctctattccccctcaatggaagtcatgatctcgggatcatcttacagagaatccgtgatatgccatacatggatccttcagggaacaatctcggaacagccgtagtgactgctcataggtatatgctcgcaccagatgcccccgggaggaggcagcacgtgcctggggtgatggtgttgttggttgatgaacctcttcgaggggatatcttctcccccataagagaagctcaggcatcaggattaaatgtcgtgatgctcggaatggcaggggcagatcctgaacagcttcggcggctagcccctgggatggactccgtgcagacattcttcgctgtcgatgatgggccgtcccttgatcaggctgtgtcagggcttgcaactgccctctgtcaggcttcctttacaacacaacccaggcctgagccctgtcccgtgtattgcccaaaaggacagaaaggggagcccggggaaatgggattgagggggcaggtgggaccccctggggatccagggctccccgggaggacaggagccccagggccacagggacccccaggatcagcgactgcaaaaggagaaaggggattccctggggctgatggaaggccagggtctcctgggagggcggggaaccccgggacgccaggggcaccaggactaaagggaagtcctggacttcctggaccacggggagatccaggggaacgagggccaaggggacctaaaggagaaccaggggccccaggacaggtgatagggggagaaggaccaggactaccagggagaaagggagatcctggaccttcagggccccctgggccaagaggacccctcggggacccagggccacgggggccccctggactccccggaactgccatgaaaggggataaaggggatagaggggagcgggggcccccagggccaggggaggggggaatcgccccaggggaacccggattacccgggctccccggatcacctgggccacagggacccgtcggacccccaggaaaaaaaggagagaaaggggattctgaagacggggcgcccgggctacccggacagcccggatctccaggggaacagggacccagagggcccccaggggcaatagggcctaaaggagatcgagggtttcccggacccctcggggaagccggagaaaaaggggagagggggccacctgggccagcaggatcgaggggattaccaggggtcgctggaagaccaggggccaaagggcccgaggggcctcctgggccaactggacgacaaggggaaaagggagagcctgggaggcctggagatcccgccgttgtaggacctgccgtggcaggacctaaaggagaaaagggagatgttgggcctgccgggccccgaggggccacaggggtacagggagaacgggggcctcccggactggtcctgcctggggatccaggaccaaaaggagatcccggggatcgggggccaatcgggcttactggaagagctgggccacccggagattctgggccccccggagaaaaaggggatccaggaaggccagggccccccggacccgtagggccaagagggagggatggagaagtaggggaaaagggagatgaggggcctcctggggatccaggattgcctgggaaagccggagaaagagggcttaggggagcaccaggggtccgcgggcctgtaggggaaaaaggagatcagggagatccaggagaagatggaaggaacggatctcctggaagttcaggacccaaaggggatcggggggaaccagggccacctgggcccccagggcggctcgtagacacagggccaggagcaagggaaaagggggaacccggagatagagggcaggaaggaccccggggaccaaaaggggatcccggattaccaggagcaccaggagaacgagggatagaggggttcaggggaccccctgggccacagggggatcccggggtcaggggacctgctggggaaaaaggggacaggggaccacccggactagacgggcgatccggactggatggaaaacccggggcggcagggccttccggacccaatggagcagccgggaaagccggggaccccggaagagatggacttcccggattacggggagaacagggactaccagggccttcagggcctcccggactccctggaaagccgggggaagatggaaaacctggacttaatggaaaaaatggggaacctggggatccaggggaagatggaaggaaaggagaaaagggagattctggggcctctgggcgggaagggcgagacggacctaaaggagaacgcggggcacctgggatactcggaccccaagggcctcctggactgcctggacctgtgggaccaccagggcaggggttcccaggagtccccggaggaacaggacccaagggggataggggagagactgggtcgaaaggagagcagggattaccaggagaacggggactaaggggagagcctgggtctgtgcccaatgtagatagacttctggagactgcggggatcaaagcttccgccctgagagaaatagttgaaacatgggatgaatcttcggggtctttcctgcccgtcccagaaaggcggcgaggacctaaaggggattcgggagaacaaggaccacctggaaaagaagggccaatcgggtttcccggagaacgtgggctgaaaggagataggggagatcccggacctcaggggccaccagggctggccctcggggagagagggccccctggaccatccggactcgccggggaacctgggaaacccgggattccagggctcccagggagagcagggggggttggggaagcgggaaggccaggagaacgcggagaaagaggggaaaaaggagaaagaggagaacaggggagggatgggcctccagggttgcctggaacacccggacctcctggaccaccaggacctaaagtgtccgtggatgaaccagggcctggattgagtggagagcaggggccaccaggactaaaaggagccaaaggagaaccaggatctaacggagatcaggggcctaaaggagaccggggggtgcctggaattaaaggggatcgcggggagcctggaccccgagggcaggatgggaaccccgggctacccggggaacgcgggatggcaggacctgaaggaaaaccagggctccaggggccccgggggccccccgggccagtgggggggcatggggatcctgggccacccggagctcctgggctcgcagggcccgccgggccacagggaccctcggggttaaagggggagccaggagagactggaccccccgggagggggcttactggaccaacaggggccgtggggttgcccgggccccccggaccatccgggctggtaggacctcagggatccccaggacttcccggacaggtcggggaaacagggaagcccggggccccaggacgggacggggctagtggaaaagatggggacaggggatcgccaggagtacctgggagtcccgggttgcctgggcccgtagggcccaaaggagagccaggacccactggagcaccggggcaggctgtcgtagggctcccaggagccaagggagagaaaggagctcccggaggacttgccggggatctagtgggagaaccaggagcaaaaggggatcgggggcttcccgggcccagaggagagaaaggggaggctggacgggcaggggaacctggagatccaggggaagatgggcagaaaggagcacctgggcccaaagggttcaaaggagatcctggggtcggagtgcctggatcacccggaccccctgggcctcccggagtgaaaggggatctcgggctgcccgggctccccggggctcctggggtagttgggttcccaggacagacagggccccgcggagaaatggggcagcccgggccctctggggaaaggggactcgctggaccccctggaagggaaggaattccagggcctttagggccccccggacccccaggatccgtcgggcctcccggggcctctgggcttaaaggggataaaggagatcctggggttgggcttcccggaccccggggagaaaggggagaacccgggatacgaggggaagatgggcggcctgggcaggaaggacccagagggcttacagggcctcctgggtctcgcggggaacgcggagaaaaaggagatgttgggtctgcagggctcaaaggagataaaggagactcagccgtgattctggggccccctgggccacggggggccaaaggagatatgggggaacgggggccgcgaggactggatggagataaggggccacggggggataatggagatcccggagataaaggatccaaaggagaacccggggataaagggtcagccggactacctggattgcgggggttgctgggaccccaggggcagccaggagccgctggaattcctggagatcccggatcacctgggaaggatggagtacccgggatcagaggagaaaaaggggatgttgggtttatggggccaagaggattaaagggagaacgcggagtcaagggggcctgtgggttggatggggagaaaggggacaaaggggaagcagggcctcctgggcggcccgggttagctggacacaaaggagaaatgggggaacccggagtccctggacagtccggggctccagggaaagaagggctgatcggaccaaaaggagatcgcggattcgatggacagccaggacctaaaggagatcagggagagaaaggagaaagaggaactcctggaattgggggattcccaggaccttcaggaaatgatggatctgcaggacctcctggaccccccgggagtgttggaccacgcgggccagaaggactgcaggggcagaagggggaaagggggccacccggggaacgagttgttggagcccctggagtgccaggagctccaggagaacgcggggagcaaggaagacccgggcccgcaggacctcggggggaaaagggagaggcagctctcacggaagatgatattaggggatttgtgcggcaggaaatgtctcagcattgcgcttgtcagggacagttcatcgcttccgggtcccggcccctcccttcctatgccgctgacacggcggggtcccagctgcacgccgtacccgtcttaagggtgtcccacgccgaagaggaagaacgggtacccccagaagatgatgaatattccgaatattctgagtattctgtggaagaatatcaggatcccgaagccccatgggattccgacgatccctgttccctccccctcgatgaagggtcctgcacagcttacactctaaggtggtatcatagagccgtcacaggatctacagaagcgtgtcatccttttgtgtacggggggtgtggaggaaatgccaacaggtttgggacacgggaggcctgtgagagacgttgcccccccagggtggtgcagtctcaggggacagggacagctcaggat

SEQ ID NO: 9614 - DNA, 8832 bp, Artificial Sequence
  Description of Artificial Sequence: Synthetic coding sequence
atgactctgcggctcctcgtggcagcgctctgtgctggcattctcgctgaggctccacgagtcagagctcagcatcgagagagagtgacttgcacacgattgtacgctgctgatatcgtgtttctgctcgatggaagtagctctatcgggagaagcaacttcagagaggtccgttccttcctggaggggctggtcttgccgttcagcggggccgctagtgctcagggggtgaggtttgctacagtgcaatacagcgatgaccctcggacggaatttggcctggatgccctgggcagtggcggtgacgtaatccgcgccatcagagaactatcttataagggtgggaacacgcggaccggagctgctattcttcacgtagcagaccacgtattcttgccacagctcgcacgtccaggcgtccccaaagtgtgtatcttgataacagatgggaagtcacaggatctggtggacacagctgctcagagactcaagggtcagggggtcaagctcttcgccgtgggaatcaagaacgctgatccggaggaactcaagcgcgtggcatcccagcctactagcgatttcttcttctttgtgaatgactttagtatactcagaactttactgccgctggttagccggagggtgtgcaccaccgccggaggcgtgcccgtcacccgtcctccagatgacagtacaagcgcccctagagacctcgtgttatcagaaccatccagccagagcctaagagttcagtggactgctgcctcaggaccagtgaccggctataaagtccagtacacacccctcactggtctaggacaaccattgccaagtgaacgacaggaagtcaacgtgcctgcaggcgaaacctccgtccgactaagggggcttagaccactgacagaatatcaggtcaccgtcatagcgctgtatgctaattcaatcggagaggcagtctcaggcaccgctcggaccactgctttggaaggaccggagctcacaatccagaatacaaccgcacattcactactggttgcttggcgttcggtccctggagcgacaggatatcgggtaacctggagagtgctgtcgggcggccctacccagcaacaagagttggggcccggacagggaagcgtgctcctgcgggacctcgaaccaggcacggactatgaggtgactgtttcgaccctctttgggagatctgtgggccccgccacctccctgatggccaggaccgacgcatccgtggagcagaccctgcgccccgtcatcctggggcccacttctattcttctctcttggaatcttgtgccagaggccagaggatacagacttgaatggagaagggaaacaggattggagccaccacaaaaagtggtattaccttcagatgtcacacgatatcagctggacggactgcaacctggtacagaatacaggctgactctctacaccttgttagaaggccatgaggtggcaacacctgccaccgtggtgccaacaggccctgagctcccagtctcacctgttacagatctgcaagccactgagctgcccggtcagagggtgcgagtgagctggtctcccgtgccaggcgcaacccagtatcggattattgtgcgcagtactcaaggagtagaacggacacttgtgctgccaggttcacagactgctttcgacctggacgacgtgcaggcaggtctgtcttacacggtccgggtgtcggcccgggtaggaccacgagaggggtcagccagtgtgctgaccgttcggcgcgagcccgaaacacctttggcggtccccggcctgagggttgtcgtgtcggatgccacccgtgtccgcgtagcctggggacccgtgccaggagcaagcggcttccgtatctcatggagtaccggtagtggtcccgagtcctcacagaccctgccacctgacagcaccgcaacagacatcaccggactacagccggggacaacctaccaggtggcggtgtcagttctgcgcggcagggaggaggggccagccgccgtgatcgttgccaggaccgatcctttgggccctgtcagaactgttcacgtcacacaggcatcttcctctagcgtcaccatcacctggacaagagtgccaggagccaccggttatagggtttcgtggcacagtgcccacggcccggagaaatcccagctcgtcagcggggaggccacagtcgcggaattggacggtttggagcccgacaccgagtatacagtgcatgtccgcgcacacgttgctggtgttgacggccccccggcgtctgttgtagtgagaacagcacccgagccggtgggccgcgtgtccaggctacagattctgaatgcaagttcggatgtgttacgcatcacctgggtgggcgtgacaggcgctaccgcctatcgtctcgcttggggacggtcggaaggcggccctatgcggcaccagattttgccagggaatacagattccgcggagatacggggcttagaggggggcgtatcctactctgttcgggtgaccgccctggttggcgatcgggaaggaactcccgtgtcaattgtggtgaccacccctcctgaggccccacccgctctggggaccctacacgtcgtccaacgcggtgaacactccctgaggctgcgttgggagcctgtgccccgggcccagggttttctactgcattggcagcccgagggagggcaggagcagagtcgcgtcctgggtccggagctgtccagctaccatcttgatggactggaaccggctacccagtatcgggtccgactgtcagtgctggggcccgctggggaaggaccttccgcagaggtcacagctcggactgaaagcccccgggttccttctatagaactgcgggtggtggatacgtcaatcgattcagtgactcttgcgtggacacctgtctctagagcctcatcctatatactatcttggagaccgctacgcggacccggccaggaagtacctggtagccctcagaccctgcctggaatttcgtccagccagcgggtaaccggtctcgagcctggagtaagctatatcttctcattaactccagttctcgacggggtgagaggccctgaggcgtccgtcacccagacaccagtctgcccgaggggcctggctgatgtggtgttcctgccccatgcgacccaagacaacgctcacagagctgaagcaacacggcgggtcctcgagcgcctcgtactcgccctagggccgcttggcccacaggctgttcaggtgggtctgctgtcttacagccatcggccctccccattgtttccactcaacggaagccacgacctgggtatcatcttacaaagaatccgcgatatgccatatatggatcccagcggaaacaacctagggaccgccgtcgtcacagcacacaggtacatgctcgccccggatgctcctggcaggcggcagcacgtccctggcgtgatggtcctgctggtcgacgaaccgctgaggggggacatattctcacccatcagggaagcgcaggccagcggcttaaatgtggtgatgctgggaatggctggtgctgaccccgaacagctccggcgcctggcgccaggtatggacagcgttcaaaccttcttcgctgtggacgacgggccaagcctggatcaggctgttagtgggcttgccactgccctgtgtcaggcctcgtttacaacgcagccaagaccagagccgtgcccagtctactgcccaaagggtcaaaaaggggaaccaggggaaatgggcctgcggggacaagtcgggccccctggggacccgggcctaccaggccgaacgggggccccaggcccccagggaccgcccggcagcgctaccgccaaaggcgaacgcggtttccccggggcagatggacggcctggcagccctggcagggcgggaaacccgggcacacctggggcacctggcctcaagggatccccgggcctacccggacctcggggagatcccggagagcgtggacctagaggccccaaaggggagcccggggcccccgggcaagttataggtggggagggccctgggttgcctggccgaaagggtgaccctggtcctagcggcccaccagggcctcgcgggccacttggcgatccagggccccgggggccaccgggacttcccgggacggcaatgaagggagataagggcgaccgtggggaacggggacccccaggcccgggtgaagggggaatcgcacctggcgaacctggactgccaggcctgcctggctctcccgggcctcaggggcctgtgggccccccaggaaaaaagggtgaaaagggagacagcgaagacggagcgcctgggcttccaggtcagccaggatcacctggtgaacagggtccgcgaggccccccaggcgctattgggcctaaaggtgacagagggttccctggacctctaggtgaggccggagagaagggagagcgcggccccccgggccctgctgggtctaggggactacctggcgtggccggccgacctggggccaaaggccctgaaggaccccctggtcctactgggcgccaaggagagaagggcgaacccggaaggccgggggaccccgcagtcgtaggtccggctgtcgccggtcccaagggtgaaaagggagacgtggggcctgctggtcctcggggagccaccggggtccagggcgaacgggggccgcctggacttgtactcccaggcgacccaggcccgaagggggaccccggtgatcggggtccaatcggcctcacaggccgcgctggaccccccggagatagtggacccccaggtgagaaaggggaccccggccggcccggaccccctggaccggttgggccaaggggtcgggacggggaagttggagagaaaggggacgagggcccacccggtgatccagggctccctgggaaggcgggggagcgcggacttcgtggtgccccaggagtcagaggacccgtcggcgagaagggggaccagggagaccctggagaggatggaaggaatggaagccccggatccagcgggcctaagggggaccgcggagagcccgggccgcctggacctcctggaagactcgttgacactggccctggagcacgggaaaaaggggagcctggtgaccggggacaggaaggtcctaggggcccaaagggcgatcctgggctgcccggagcacctggggaaaggggcatcgagggttttcgcggtcctccaggcccgcagggtgaccctggagttcgaggccccgcgggcgaaaagggcgaccgagggccaccggggctagatggtagaagcggcctcgacggcaaacccggcgcagcaggaccaagcggccctaacggggccgccggaaaggcaggagatccggggcgagatgggttgccaggcctcagaggagaacaggggctgcccggtccctcaggccctcctggcctgccaggaaagcccggcgaggatggaaagcccggactgaatgggaaaaacggagaaccaggggaccctggtgaagacggccggaagggggaaaaaggcgacagtggggccagtggaagagaggggcgggacgggccaaagggggagcgtggcgccccaggcatcctcggccctcagggacctcctggactgcctggcccggttggccccccgggacagggatttcctggggtccctggaggtacagggcctaaaggcgatagaggggagactggatcaaaaggagaacagggattgcccggggagcggggcctgagaggtgaacctggctcagtccccaatgtggacagattgctggagactgccggaattaaagcctcagctctccgtgagattgttgaaacctgggatgagagttctggttcatttctgccagtgcccgagcgccggcgaggacccaagggtgacagcggggaacagggcccgccagggaaggaaggacccattggctttccaggggagcggggcctgaaaggcgaccggggtgatccaggcccgcagggtccccccggactcgctctaggcgagcgcggaccacccggaccctcaggactagccggagagccaggaaagcctgggatccccggtcttccaggacgcgcaggcggcgtgggcgaggccggaagacccggggaacgcggggaacgtggtgagaagggcgaacgcggcgaacagggaagggatggcccgccagggctacctggtacacccgggccccctgggccgcctgggcctaaggtgtctgtcgatgaacctggtccagggctctccggggaacaaggaccccccggcctcaaaggagccaaaggtgaacccggaagcaacggggaccaaggcccaaaaggggatcggggagtgccgggcattaagggcgatcgcggggaaccagggccaagagggcaggacggtaacccaggattaccaggagagcgcggcatggccggcccagaaggcaagcctggactgcaggggcctcgtgggcctccaggacctgtgggtgggcacggagacccgggccccccaggagcacctggactcgctggccccgcagggccacagggccccagcggactgaagggcgagcccggagagactggaccgcccggccgcggcctaactggtccaaccggtgcggttgggttgcctggtccaccaggccctagcgggctcgtgggacctcagggctctccaggcttacccgggcaggtgggggaaacaggcaaacctggcgcccccgggcgtgacggggcaagcgggaaggatggcgatcgcggctcacccggagtgcccgggagcccagggttaccaggtcccgtcggacctaaaggggagccagggcccacgggggcaccgggtcaggccgtagtgggcctgccaggagcaaagggcgagaaaggcgcacccggggggcttgccggcgatctggtgggagaacccggggcaaagggagacaggggactgcccggtccccggggcgaaaagggagaagcaggccgtgcgggggagcccggggatcctggggaagacggccagaagggagctccaggacctaagggattcaagggtgacccaggcgttggagtgccagggagcccgggacctccagggccaccgggggtgaagggcgatttaggcctccccggcctccccggagctccaggcgttgtgggtttcccagggcagaccggccctcgcggtgagatgggacagcctgggccaagtggagaacggggcctggctggtcctcccggtagagaaggaatacccgggcccctcggcccacctggtcctcccggttccgttgggcctcctggtgcgtccggattgaagggggacaagggggacccaggcgtggggttaccagggccgcggggagaacgcggcgaacccggaatccgaggagaagatggccgcccagggcaggagggcccgagagggttaacgggacctcccggctcccgaggcgagcgcggcgaaaagggtgatgtaggatccgccggtctcaagggcgacaaaggagatagcgcggtcattctgggtcctccaggtccccgcggggccaaaggggatatgggagagcggggccctcggggattagatggcgataaaggcccacgaggcgacaatggagatcccggggacaaaggatccaagggcgagccgggggataaaggaagcgctggtctgcccgggctcaggggactgctcggaccacagggccagcccggagccgcgggcattcctggagatcctgggagccccggtaaggatggcgttcccggcatccggggggagaagggcgacgtgggattcatggggccgcgggggctgaagggcgagcgcggcgtcaaaggagcgtgcggcttggatggagaaaaaggagataagggtgaggccggacccccaggaaggcccggcctggccggtcacaaaggagagatgggcgaacctggagtgcctggtcagagtggggcccccggaaaggagggcctaattggacccaaaggagatcgagggtttgacgggcagcctggacccaaaggtgaccagggagaaaagggagagaggggaaccccaggtatcggagggttcccaggtccttcaggtaacgacgggagtgctggcccccctggcccgccgggtagtgtcggccctagggggcccgaaggactccaggggcagaaaggagagcgcggcccccctggtgagcgggttgtgggcgccccgggagtacccggcgcaccaggcgagcgtggtgaacagggcagacctggacctgctggaccccgcggagaaaagggtgaggcggccctcactgaggacgacattcgcgggtttgtcagacaggaaatgtcacaacattgcgcttgccaaggacagttcattgcttccggttcaagaccacttccttcatacgccgccgacaccgcgggctctcagctgcacgctgttcccgtgctacgcgtctcacacgctgaggaagaggaaagagtcccgccggaggatgacgaatacagtgagtactctgagtactctgtcgaggagtaccaggacccggaagccccttgggattctgatgacccctgtagtcttccccttgatgagggatcctgtacagcatatacccttagatggtaccatcgcgctgtcactggaagcactgaagcgtgccatccattcgtctacggagggtgtggcggcaatgcaaatcgctttggaacacgtgaagcctgtgagcgtcggtgccctccccgtgtggtgcagtcacaaggaacgggaacggcccaagac

SEQ ID NO: 9615 - DNA, 8832 bp, Artificial Sequence
  Description of Artificial Sequence: Synthetic coding sequence
atgacgttgcggttgctggtggcagccctgtgcgctggaatcttggctgaggcccctcgagtgcgggcgcaacacagggaacgggtcacatgcacccgcctgtacgcggcagacatagtctttctgctggacggttccagtagtatcgggcgctccaatttccgcgaggtaagatcattccttgagggcctcgtcctccccttttcaggggccgcttccgcgcagggtgtccgattcgcaacagtacagtacagcgatgacccacggactgaattcgggctcgatgcactggggagcgggggtgacgtaataagggccatcagggaactctcttacaagggcggaaatacccggacaggcgcggccatcctccacgtggcagatcatgtcttcctgcctcagttggcacgcccaggcgtgccgaaagtctgtatcctcattacggacggtaagtcacaagatctggttgacaccgccgcccaacgcctgaaggggcaaggggtgaagctctttgccgtcggtattaagaatgccgacccggaggaattgaagcgcgtcgccagccagcctacgtccgactttttcttctttgtaaatgactttagcattctgcggacactcctgcctctggtgtccaggagagtgtgcacaacagccggtggcgtaccagtaactaggcctccagacgactccacatctgcacctcgcgatctggtgttgtccgagccaagttcacaaagcctgcgggtgcagtggactgctgcttctgggcctgtgacgggttataaggtccagtatacgccgttgactggactgggccagcctctgcccagcgagaggcaggaggtgaacgtccctgctggcgaaacatccgtaaggcttaggggcctcaggccactgaccgaatatcaagtcaccgtaatagcactgtatgcaaattccatcggtgaagctgttagcggtaccgctaggaccacagctctcgagggtcccgagctgaccatccagaacacaacagcccactccctgctggtagcgtggcgctcagttccaggcgccaccggatatagagtgacctggagggtgctgtcaggaggaccaacgcagcagcaggagctgggtcccggtcaaggatccgtgctgctcagggatctggaaccagggacggattatgaggttaccgtgagtactctgttcggtcggtctgtggggccagccacgtccttgatggcccggacggacgcaagcgtcgagcagaccctgcggccagtgatactggggcccaccagcatcttgctctcttggaatctcgtgcctgaggctagaggttacaggttggagtggcgcagagagacaggcctggaaccacctcagaaggtcgtgctgccaagcgatgtgacccgatatcagctggatggcctccagcccgggacagagtataggttgactctgtacaccctcctcgagggacacgaagtcgcgacccccgcaacagtggtgcccaccggtcccgaactgcctgtgagtcctgtgaccgatcttcaggccacggaactgccgggccagagggtgagagtcagctggtctcccgtacccggggcaacccagtacagaattatcgtcagatcaactcagggggtcgagcgcaccctcgtacttccaggcagccagacggcattcgaccttgacgacgtgcaggccggactctcatacacggtcagggtgagcgctagggtcggtcctagagaagggagtgcttcagtattgaccgttaggcgggaacctgagacccccctggccgtacccggtctgagagtggtcgtgtctgacgccacgcgggtgagggtggcatggggccccgtccctggtgccagtggcttccggatatcctggtctacagggtccggtccagaatcctcccagacattgccgcctgattccactgcaaccgatatcacgggtttgcagccaggtacgacctaccaggtcgccgtgtccgtgctgcggggacgcgaagagggaccagctgctgtaatagtggctcggacggatcccctgggtcccgtacggacggtgcatgtgacacaagccagcagcagcagtgtcacaatcacatggactagggtcccaggagcaaccgggtatagggtcagctggcacagcgctcacggcccagaaaaatctcagctggtcagtggcgaggccaccgtcgccgagctcgatggactggagcccgacacggagtacactgtccatgtgagagcccatgtcgccggagtggatggaccccccgcgtctgttgttgtgcgcacagcacctgagccggtgggccgggtcagccgcctgcagatcttgaacgcttcaagcgatgtgttgaggatcacatgggttggagttacgggagcaactgcttataggctggcctggggaagaagcgagggagggcccatgcggcatcagattctgcccggtaacacagactctgcagaaattcgcggactggaggggggcgtctcatactcagtgcgagtgactgctcttgtcggggaccgcgagggaacacccgtgagtattgtagtcacgacgcccccagaggctccacccgcgctgggcaccctccacgtcgttcagaggggcgagcattctctccgacttcgatgggagcccgtacctagggctcagggcttcctgttgcattggcaacctgaggggggccaggagcagtcaagagtgctgggacccgagctgagctcatatcatcttgatgggttggagcctgccacccagtacagggtcagactcagcgtgctgggccctgccggcgaagggccctcagccgaggttacagcgcgaaccgagagcccaagagtgccatctatcgagctccgagttgtcgatactagcattgactctgttaccctcgcatggaccccggtgtctagggcttccagctatattctgagttggaggccgctcagggggcctggtcaggaagtcccagggtccccccagactctcccagggattagttccagtcaacgggtcactggtctcgaaccgggggtgtcttacatcttctccctgacccctgtgctggacggcgtgcgaggcccggaggccagcgtcacacagacccccgtctgcccccggggactcgccgacgtggtgtttctgccgcatgccacccaagataacgcgcatagagcagaagcaactaggcgagtcctcgagaggctggtgcttgccctcggcccattgggacctcaggccgtgcaagtcgggttgctttcctactcacacagaccgtcaccactgtttcctctgaatggaagtcatgaccttgggatcatcctgcagcgcatacgagatatgccttacatggacccaagcggaaataatcttggcactgccgtagtcacagcccaccggtatatgcttgcccccgatgcacctggaagacgccagcatgtaccgggggtgatggtgcttctggtggacgaaccactgaggggtgacatattctctcctatcagagaggcccaggcatctgggctgaacgtggtcatgctggggatggctggcgcagatcctgaacagctgagaaggcttgcacccggcatggattccgttcaaacatttttcgccgtggatgatggacctagcctggaccaggcggtgtctgggttggccaccgcactgtgccaggccagtttcaccactcagccgaggccagaaccatgtcctgtgtactgcccaaaaggacagaagggggagccgggggaaatggggctgcggggtcaggtgggtcctcccggagaccccgggctgcccgggcgcaccggagccccgggaccccaagggcctcccggctcagcaacagccaagggggagagagggtttccaggtgccgacgggcgccccgggtcccccggtagagccggtaacccaggcacccctggcgccccaggactgaagggaagtcccggcttgccaggtcctcgcggagaccccggtgaaaggggacctcggggtcctaaaggcgaaccaggcgcccccggccaggtgatcgggggcgagggcccagggctgcccgggagaaaaggcgatccaggaccgtccgggcctcccggacccagaggccctctgggggatccagggccacggggccctccaggtctccctggtacagctatgaagggagataagggggataggggggaaagaggacctcccggacctggtgagggggggattgcgcctggtgaacccgggctgcccggcctgccaggttctcctggcccccaggggcccgttggaccacctgggaaaaaaggtgaaaaaggagattctgaagacggcgccccaggcctccccggacagccaggtagtcccggtgagcagggccctcggggaccacccggtgcaatagggccgaaaggggaccggggctttcccgggcccctcggcgaggcaggagaaaagggagaaagaggcccgccagggccagccggtagccgggggttgcctggtgtggctggaagacctggcgccaaaggacccgaggggcctcccggcccaaccggaaggcagggtgagaaaggagagcccggccggccgggggatccggccgtggtgggcccagcagtggccggcccaaagggcgagaaaggcgatgtcggacctgccggaccgaggggggccacgggtgtacagggcgaaaggggacctccaggtctcgtgctgccaggcgacccaggaccgaaaggcgacccaggagacagggggccaataggactgactggcagagccggaccccccggagattctggtcctcctggggaaaagggggaccctggcagacctggcccacctggcccagtgggtccccgaggtagggacggcgaggttggcgagaagggcgacgaaggcccgccaggagatcctgggctgcctggaaaggcaggcgagcgcgggctcaggggcgctcccggggtacgcgggcctgttggcgaaaagggggatcaaggtgatcctggcgaagacggaagaaatggtagccccgggagctctgggccgaaaggggaccggggtgagcccggccctccaggtcctccaggtcgattggtagacactggccccggtgctcgagaaaaaggagaacctggcgatcgagggcaagagggacctaggggacccaagggagaccctgggcttccaggagctcccggggaaagggggatcgaaggcttccggggcccccctgggccccagggggacccaggagtgcgcggccctgctggtgagaagggcgaccgcggccctcctggcctggatggcaggtctggacttgacggaaagccgggcgccgccggcccctcaggcccgaacggtgccgctggcaaggccggagacccaggccgggatggactcccaggactgaggggtgagcagggcctgcctggcccctctggcccgccaggccttccggggaagcccggggaggacggcaagccgggcctgaacgggaaaaacggtgaacccggggacccaggtgaggatgggaggaagggcgaaaagggagatagcggagcctcaggtagagagggccgggacgggcccaaaggagagaggggagctccaggaatcctggggcctcagggccctccaggccttcccgggccggtagggccaccaggccaggggttccccggggttccggggggaaccggacctaagggcgacagaggcgaaactggttcaaaaggtgaacaaggtcttcccggcgagcggggattgagaggtgaaccgggatccgtgccgaatgtggacagactgctggagaccgccggcatcaaggcaagcgcgcttagagagatcgtggagacctgggacgagtccagcggtagctttctgcctgtgcctgagagaaggagaggtccaaagggggacagtggcgagcaggggccgccagggaaagaaggcccgattggattcccaggggagcgaggcctgaaaggcgaccggggtgacccaggccctcagggcccacccggacttgctcttggggagcgcggacctccagggccttccgggttggccggggaaccaggaaaaccagggatcccaggcctgcccggaagagcaggcggcgttggggaggctggcagacctggtgagcggggtgagaggggtgagaaaggagagcggggagagcaaggcagggatggccctcctgggctgcccggtacccccgggcctcctggtccgcctggacccaaagtgtcagtcgatgaacctggccctggtctgagtggagagcaggggcctccaggcctgaagggggcaaagggtgaacccggttctaacggagaccagggaccaaaaggcgatcgaggcgtccccggtattaaaggagaccggggagagcctggccctcgcggccaggacggaaaccccggtttgcccggagagaggggcatggccgggccagaggggaagccgggattgcaaggacctcggggtccccccgggcccgtcggtggacacggggatcctggccctcctggagccccagggcttgcaggtccggccggaccgcagggcccgtcaggactgaaaggagagccaggagagacaggaccaccaggccgaggtctcacagggcctaccggagctgtagggctccccggcccccctggccccagcggcctggtggggccccaggggtcccctggtctgccgggtcaggtaggagaaacagggaagcctggagcaccagggcgcgatggagcttcaggtaaggacggcgatagggggagccccggagtgcccgggtcccccgggctcccaggacctgtagggcccaaaggagagccgggccccacaggagcccccggtcaagccgtggtaggccttccaggagctaagggcgagaagggtgccccaggggggcttgcaggagacctggttggcgagccaggagccaaaggcgatagaggactgcctgggcccaggggcgaaaaaggtgaggccggacgcgcaggcgagcccggtgatccaggcgaggacgggcagaagggggctcctggaccaaagggttttaagggcgatcccggtgtcggtgtccctgggtccccaggaccaccaggcccacctggcgtgaaaggggacttgggcttgcctggtctgcccggcgctcccggcgttgtcggatttcctggtcaaacgggcccacggggcgaaatgggccagcctgggccgagtggggaacgcggcctcgccgggccacccggaagagagggaatccccggaccactgggtccacctggaccacccggctccgtgggaccacccggggcaagcggcctgaagggtgacaagggagacccaggagtgggcctcccagggccacggggcgaacgcggggagcctggaatcaggggagaggacggtcggccgggacaggagggccctagaggcctcacgggccctcccggatcacggggcgaaagaggggaaaaaggggacgtggggagcgctggcttgaagggagacaagggagactcagccgtcattctgggtcctccaggccctagaggtgctaagggcgacatgggtgagcgggggccaaggggactggatggtgataaggggccgaggggcgacaacggtgatccaggcgacaagggaagtaagggcgaacctggagataaagggagtgccggccttccgggtctgcggggtcttctgggtccccagggacagccaggcgccgccggaattcccggagaccctggatcccccgggaaggatggagttcctggcatccggggagaaaagggcgacgtgggattcatgggacccagaggcctcaaaggagagcgcggagtaaagggtgcctgcgggctcgatggcgagaaaggggataaaggagaagcagggcctccaggccgaccggggcttgcaggacacaagggagagatgggagagcccggcgtgcccgggcagtccggggcacccggaaaggaaggccttatcggtccgaagggagaccgagggttcgacgggcagccaggtcccaaaggagaccagggcgaaaaaggtgaaagagggacccctggcattgggggtttcccaggtccaagtggaaacgacgggtctgccgggcccccaggaccccccggctctgtggggcctagagggcccgaaggcctgcaaggacagaagggcgaacgggggcctcccggagaacgggttgtgggcgctccaggtgttccaggtgcaccaggggaacggggcgagcaaggaaggccggggcctgctggaccgaggggagaaaagggtgaggctgcgctgacagaagatgacatacgaggatttgttcgccaggaaatgtcacagcattgtgcctgccagggacagtttattgcctcagggtctagacccctgccaagctacgcggctgacacagctggcagtcagctgcatgccgtgcctgttctccgcgtgtctcacgctgaagaggaggaacgagtccccccggaagacgatgaatactctgagtacagcgagtatagcgtcgaagagtaccaagaccccgaagcaccctgggactccgacgatccctgtagcctgcctctggacgaagggagttgtacagcttatacactgcggtggtatcaccgcgcagtgaccggtagtaccgaagcgtgtcaccctttcgtgtatggcggctgcggggggaacgcaaacaggtttgggacccgggaggcctgcgaacgaagatgcccgcctcgcgtggtccagtcacaaggcacggggactgcacaagac

SEQ ID NO: 9616 - DNA, 8832 bp, Artificial Sequence
  Description of Artificial Sequence: Synthetic coding sequence
atgaccctccggctccttgtggctgctctgtgcgctggaattttggcggaagcgccacgcgtccgcgcccagcaccgcgagcgcgtgacttgcacccggctgtacgccgctgacattgttttcctgctggacgggagcagctcaatcggacgttccaattttcgagaagttagatcattcctcgagggactggtcttgcctttcagcggagccgcgtctgcacagggagtccgcttcgcaaccgtgcaatactcggatgacccacggactgagttcggcctcgatgccctgggatcgggcggagacgtgatccgggctatccgcgaactcagctacaagggaggaaacacccggactggagcggctatcctgcatgtggcggaccatgtgttcctcccgcagctggcgcggcccggagtcccgaaggtctgcatcctgatcaccgacggcaaatcccaggacctggtggatactgctgcacagcgtctgaagggtcaaggtgtcaagttgtttgctgtgggcatcaagaacgctgacccggaagaactcaagcgggtggcctcacagcctacttcagatttctttttcttcgtgaatgatttctccattttgcgcacgctgctgccactcgtctcgaggcgcgtgtgtactaccgcaggaggggttccagtgaccagaccgccagacgatagcacttccgcccctcgggatctcgtgctgtctgagccgtcatcccaatcgctccgcgtgcaatggaccgcagcgtcgggacctgtcaccggctacaaagtccagtacaccccactcactggactcggacaacctctcccatccgaaaggcaggaagtgaacgtcccagccggagaaacctcggtgaggctgcgggggctcagaccccttaccgagtatcaagtgaccgtgatcgccctctacgctaactcaatcggagaggccgtgtcaggaacggctcgcaccaccgcactggagggcccagaattgactattcaaaataccacggctcatagcctcctggtcgcctggcggtccgtcccaggagctactggctaccgagtgacctggcgggtgctgtccggaggcccgacgcagcagcaggaactgggtccgggtcagggctccgtcctgctgcgggacctcgaacctggaactgactacgaagtgactgtgtcaactctgtttggacgctcggtgggaccggcaacgtcactgatggccaggactgacgcgagcgtggagcagactctcagaccagtgatcctgggtccaacgtcaatcctcttgtcgtggaatctggttccggaagctaggggatacagactggagtggaggcgcgagactggcctggaaccgcctcagaaggtggtgctgccgtctgacgtcactcggtaccagctggatggactccagccaggaaccgaataccgtctgacgctgtatactctcctcgaaggccacgaagtcgctaccccggcaaccgtggtgccgaccggcccggaactgcctgtgtccccagtcactgatctgcaagccaccgagctgccgggtcagcgggtcagagtgtcgtggtcgccagtgcctggagccacccagtacagaatcatcgtgcgatccactcagggcgtggagcggaccctggtgctccctggcagccagacggcgtttgacctcgacgatgtgcaagcaggcttgtcgtacacggtgcgcgtctccgccagggtcgggccacgggaaggatcggccagcgtgctgaccgtgagacgggaaccggaaaccccactggccgtgccgggtctgcgggtggtcgtgtcggacgccactcgtgtgcgcgtggcctggggtccggtgccaggcgcgtcgggattccggatatcgtggtcaacgggctcgggacctgagtcaagccagaccctccccccggactccactgcaaccgacatcaccggtctgcaacccggaaccacctaccaggtcgccgtgtccgtccttcgcggtcgggaggaaggcccggctgccgtcatcgttgcccgcaccgatccgctgggcccggtgagaacggtccatgtgactcaggcctccagctcctctgtgaccattacgtggacccgggtgcccggcgccactggataccgcgtctcatggcactcggcgcacggacccgaaaaatcccaactggtgagcggggaagccaccgtggcggaactggacggactggagccggatactgaatacactgtgcacgtgcgcgcacacgtcgcaggggtggatggaccaccggcgtccgttgtggtgaggaccgccccggagcctgttggaagagtgtccagactgcaaatcctcaacgcctcctccgacgtgctcaggatcacctgggtcggggtcaccggggctactgcgtatcggttggcatggggcagatctgaaggagggccaatgaggcaccaaatcctgcctggtaataccgacagcgcagagatcagaggacttgaaggaggagtgagctactccgtgcgcgtgaccgctctggtgggcgatcgggagggtactcctgtgtcaattgtcgtcaccaccccgccggaggctccgcccgcgctcggcactctccatgtggtccagcgaggagagcatagcctccggctgaggtgggaaccggtcccccgggcccaagggttccttctgcattggcaaccggagggaggacaggaacaatcacgcgtgctcgggcccgaactgagcagctaccacctggacggactggagcctgcgactcagtaccgcgttagactgtcggttctcggccccgccggagagggaccgtcggccgaggtgactgcgcggacggaatcccctcgcgtgccgtcgatcgaactccgggtcgtggacacctccatcgattcggtgactctggcatggactccagtgtcccgggcatcatcgtacatcctcagctggcgcccgctgcgcgggccgggtcaagaagtgccaggtagcccgcagaccttgcctggaatctcatcgagccagcgagtcactgggcttgaaccaggtgtgtcctacatcttttcactgactcccgtccttgacggagtgcggggaccagaggcgagcgtcactcagactccggtgtgtcctcggggcctggcagacgtcgtgttcctcccacacgccacccaagataacgcacatagggccgaggcgaccagaagggtcctggaacgattggtgctggccctgggaccgctgggcccgcaagcggtgcaggtgggactgctctcgtacagccatcggccatcaccgctgttcccgctgaacggatctcacgatctgggaatcatcctccagagaatccgagacatgccttacatggacccttctggcaacaacttgggaactgcggtcgtcaccgcccaccgctacatgttggccccggacgccccgggacgccgccaacacgtgccgggggtcatggtgctcctggtcgacgaacctcttagaggagacatcttcagcccaatcagagaagcccaggcctccggactcaacgtggtgatgctcggcatggcgggagccgacccggaacagttgcgccggctcgcccccggaatggattccgtccagaccttcttcgccgtggacgacggtcctagcctggaccaggcagtgtccggacttgcgactgcactgtgtcaggcgtcattcactactcaaccgcggccagagccctgccccgtgtactgccctaaaggacagaagggagaacctggtgagatgggacttcggggccaagttggcccgccgggcgaccccggactgcctgggcggaccggggcgcccggccctcaaggacctccggggtctgcgaccgctaaaggagagcgcggatttcccggcgccgatggtcgcccgggatcgcctggacgggccggaaacccggggactccaggagcgccagggttgaagggatccccgggcctcccgggaccacgcggtgaccccggagaacgaggcccaagaggcccgaagggcgaaccgggagcccctggtcaggttataggaggagaaggacctggactgccgggtagaaagggggatccagggccgagcggtccaccaggccctcgcggcccattgggcgacccgggaccgaggggtccgccgggcttgccgggaactgccatgaaaggggacaagggtgacaggggcgaacggggacctccggggcccggcgaagggggaattgcgccgggagagcccggcttgccgggccttccgggatcgcctggtccccaaggaccggtgggcccgccaggcaagaagggtgaaaagggagacagcgaggacggcgcaccaggtctgccgggacagcccgggtcgccgggtgagcaggggccaagaggaccgcccggtgccatcggacctaagggagatcgcggattcccgggaccgctgggggaggcgggagagaagggagagcgcggaccaccaggaccggcgggatcacgcggactcccgggagtggccggacggcctggggctaagggccccgagggaccccccgggccaactgggcggcagggtgagaagggcgagccggggcgaccgggcgacccggccgtggtgggaccagccgtggccggaccgaagggggaaaagggcgatgtcggaccagccggaccaagaggagcaactggcgtccagggcgagcggggtccgccgggcctggtcctgccgggcgatccgggcccaaaaggcgatcctggcgacagaggcccgatcggcctcacgggaagggcaggaccgccgggggactccgggccgcctggcgagaaaggggatccaggacgccccggccctcctggcccggtgggacctcgcggtcgagacggggaggtgggagaaaaaggcgatgagggaccaccgggtgaccccggactccccggaaaagcaggagaacggggcctccgcggcgcaccgggtgtgagaggtccagtgggtgagaaaggtgaccagggcgatccgggcgaagatggacggaatggcagcccaggttcctcgggaccaaagggagacaggggggagccaggaccaccaggaccaccgggtagactcgtggacacgggacctggcgcacgcgaaaagggagaaccgggggaccgcgggcaggaaggccccagaggacctaagggcgatccagggctgccgggagccccgggagagcgcggcattgaaggcttcaggggccctcccggaccacagggtgaccccggggtgaggggccccgcgggcgaaaagggggaccgcggcccaccgggactggatggacgctcgggacttgacggtaagccgggcgccgccggaccatctggaccgaacggagcggcaggaaaggctggggaccccggccgcgacggacttccggggttgcggggtgaacaaggactcccgggcccttccggacctcctggactcccggggaagccaggggaggacggaaaaccaggtctgaacgggaagaacggagaaccgggagatcccggggaggatggaaggaagggagagaaaggagatagcggtgcctcaggccgggagggccgcgacggtccgaagggagagagaggagctccggggattctgggaccgcaaggcccgccggggcttccgggacctgtcggaccgccaggacaggggttcccgggggtgccagggggcactggacctaaaggagatcggggggagactgggtccaaaggagagcaggggttgccaggcgaacggggactgagaggtgagcccggctcagtgccgaacgtcgaccgacttctggaaaccgctggcattaaggcctcggccctccgggagattgtggaaacctgggacgagagctccggctcgtttctgcccgtcccggaaaggaggaggggaccgaagggcgactcgggagaacaaggacctccggggaaggaaggcccgatcggtttccccggagagagaggcctcaagggcgaccgcggagatcccggaccccagggacccccgggacttgctctgggcgagcgcggccctccgggtccatcgggactggccggagagccaggcaagccgggcatcccgggacttcccggcagggccggaggagtcggtgaggcgggacgtccaggagaaaggggagagcgcggagagaagggcgaaaggggcgaacagggacgggacgggccgccgggtctgccgggcaccccgggacctcccggcccgccaggaccaaaagtgtctgtggacgaaccaggaccgggactgtcgggagagcaggggccaccaggactgaaaggagctaagggcgagccgggatcaaacggcgatcagggaccaaagggagatcgcggggtgccgggcatcaagggagacagaggagagcctggtccgcgaggacaagacggaaatcccggacttccgggagagcggggcatggccggtccagaaggcaaaccagggttgcagggcccacgtggaccgcctggtccagtgggaggccacggcgaccccggcccaccgggagctccaggactggccgggccggctggcccacaaggcccatcgggcctcaagggggaacccggagagactggaccaccgggacgcggactgaccggaccaaccggagcggtgggcctgccggggccccctggcccctccggccttgttggaccccaaggatcccccggtttgccgggacaggtcggggaaactgggaaaccgggggccccgggcagggacggagcatccggtaaggatggcgatcgcggatcgcctggagtgccgggatcgcctggactccctgggcctgttggcccgaagggagaacccgggccgaccggggcgccgggacaagcggtcgtcggactgccgggagcgaagggcgaaaagggtgcaccagggggattggctggtgacctggtgggtgaaccgggagcgaagggtgacagagggctgccggggccgcgcggtgagaagggcgaggcaggcagagcaggagaaccgggtgacccaggagaagatggacaaaagggggcaccggggcctaagggcttcaaaggtgatcccggcgtgggagtgccgggctcccccggtccgccggggccgccgggagtgaagggtgatctgggactccctggtctgccaggggcgcctggagtggtcggctttccgggacaaactggtccgcgaggagagatgggccagccgggaccctcgggcgagagagggcttgccggaccgccaggccgggagggtatcccgggaccgctcggaccgccaggaccgcccggaagcgtcgggccaccaggggcctctggattgaagggtgacaaaggggacccaggcgtgggccttcctggacctcggggagagagaggcgaaccgggtatccgcggagaagatggtcgcccaggtcaggaaggaccgaggggactgacgggccctcctggatcccggggcgagagaggcgaaaagggggatgttggctcagcagggttgaagggtgataagggagacagcgccgtcatactcggccctcccggtccacggggagccaagggcgacatgggagaacgggggccgagaggactggatggagacaagggaccccgcggagataatggtgaccccggggacaaagggtcgaaaggcgaaccgggagacaagggcagcgctgggctgcctggattgagaggactgttgggcccacaaggtcagccgggcgcggctgggatcccaggagatccaggaagcccaggtaaggatggagtcccgggaatccggggagagaaaggagacgtgggattcatggggcctcggggtctgaagggcgagcgtggcgtgaagggagcctgcggcctggatggggaaaaaggagataaaggtgaagcaggcccgccaggacggcctgggttggctggacacaagggcgagatgggagaacctggcgttcctggccagtcgggggccccaggcaaggaaggactgatcgggccgaagggagatagaggttttgacggacagccaggaccaaagggagatcagggcgagaaaggcgagcgcggcacccctggtattgggggattcccgggaccctcgggcaatgatggttcggccggaccgccgggtcctcctggctcagtcggaccgcgcggcccggagggactgcagggacagaagggagaaaggggtccacccggagagcgcgtggtgggtgcgcctggagtgcctggagcccccggcgagcgaggagaacaaggacggcctggaccggctggaccgaggggagaaaaaggagaagcggccctgaccgaagatgacatccgcgggtttgtgagacaggaaatgagccagcactgcgcatgccagggacaattcatagccagcggatcccgccctctgccgtcgtacgcggcggacaccgccggatctcaattgcatgcagttcccgttctgagagtctcgcacgccgaagaagaagaaagggtcccgccggaggacgatgagtactcagagtattcagaatactcagttgaagaataccaggaccccgaagcgccttgggactccgatgacccgtgttcgctgccactcgatgaaggctcttgtaccgcatacactctgcggtggtaccacagagcagtcaccggaagcactgaagcatgccatcccttcgtctacggcggatgcggaggaaatgccaacaggttcggaacgagggaggcatgcgagcgccgttgccctccaagagttgtgcagagccaaggaaccggcacggcgcaggac

SEQ ID NO: 9617 - DNA, 8832 bp, Artificial Sequence
  Description of Artificial Sequence: Synthetic coding sequence
atgactctgcggctgctcgtggcagccctttgtgcagggattcttgcagaagcaccccgagttcgagcacaacatagagagcgggtgacctgtactcgactgtacgcggcagatatcgtctttctgttggatggctcctcatccatcggtagatccaactttcgtgaagtcagatcatttctggagggattggtgcttccatttagcggagcggcgtcagcacaaggggtgagatttgcaacggtgcaatacagcgatgaccctcgtaccgagtttggacttgatgcactgggttccggaggggacgtcatcagagcaataagagagttgagctacaaggggggcaatacccgcactggagcggcaattcttcacgtggcagaccatgtgtttctgcctcaacttgctcgcccaggtgtgcctaaggtgtgtattctgatcactgacggaaaaagccaggacctggtggataccgcagcacaaaggcttaaggggcagggagtcaaactcttcgctgtcggaatcaaaaacgcagatcccgaagaacttaagcgggtggcatcgcaacctacttctgatttctttttctttgtgaacgacttttcaattctgcgcacccttctcccacttgtgtcgcggagagtgtgcaccacggccggaggtgtgccagtgactaggcccccggatgattcaacctccgctccgcgtgatcttgtgctctcggaaccctcttcgcagtccctgcgggtccagtggactgcagcatcaggcccagtcactggttacaaggtccaatacactcctcttactggactgggccaaccactcccttccgagagacaagaggtgaacgtgcctgcgggagaaaccagcgtgcggctgcggggacttaggccactgaccgaataccaggtgaccgtgatcgcactttacgccaactcgatcggcgaagctgtgtcggggaccgcacgcaccactgcacttgaagggcctgagcttaccatccaaaacaccacggcacattccctcctggtggcctggcgctccgttcctggagcaaccggttacagagtgacttggcgcgtgctgagcgggggaccaacgcaacagcaagaactcggaccagggcaaggatcggtgcttctgcgagacttggagcctggaactgattacgaagtgaccgtctcaaccctgttcggtcgtagcgttggtcccgcgacctccctgatggctagaaccgatgccagtgtggaacagaccttgaggccggtcatccttggaccgacttctatccttctttcttggaacctggtcccagaagcacgtggataccgattggaatggcgccgcgaaaccggacttgaaccaccacagaaggtggtcctgccctcagacgtgacgagataccagctggacgggctccagcctggaaccgaataccgtctgactctgtacactcttttggaaggccacgaagtggcaaccccagcaacggtggtcccaactggtccagaactgcctgtgtccccagtcaccgacctgcaagcaactgaacttccaggtcaacgtgtcagagtgtcgtggagccccgtcccgggtgcaactcagtacaggattatagtgcgttccactcaaggcgtggagagaaccttggtgttgcccggatcacaaaccgcattcgacctcgatgatgtacaggcagggctttcgtacaccgtgcgtgtgtcggcgagagtcggaccacgtgaagggtccgcgtccgtgctgactgtgcgcagagaacctgaaacgccccttgccgtgcctggtcttagagttgtcgtgtcggatgccacccgagtgagagtcgcatggggccctgtgccaggagcgtccggattccgtataagctggtcgactgggtctgggcccgagtcctcccagactctgcctccagattcgaccgcgaccgacataaccgggctgcagccgggaaccacttaccaggtcgcagtgagcgtgctgcggggaagggaagaaggcccagctgcggtgatcgtggccaggaccgatcctctgggacccgtgcgcaccgtgcatgtgacccaggcctcaagctcctcagttacgattacttggaccagagtccctggcgccacgggatacagggtgtcgtggcatagcgcacacgggcctgaaaagtcgcagctcgttagcggcgaagcaaccgtggccgagcttgatggcctggaacctgatactgaatatacggtccatgtgagagcacatgtcgcaggagtggatggacctccagcttctgtcgttgtaagaaccgctccagagccggtgggtagggtcagcaggctgcagattcttaacgctagctccgacgtcctccggattacctgggtcggggtgactggtgcaaccgcctacagactcgcatggggtcgctcagaaggagggcctatgcgtcatcaaattctccctggtaacactgattcagcagagattcgcggacttgaaggtggggtttcgtactcggtgcgggtgaccgcactggtcggcgatcgcgagggtactcctgtgagcattgtcgtcaccaccccaccagaagcgcctcctgcacttgggactcttcacgtggtgcagcgaggggaacactcactcagacttcgatgggagccagtccccagagcacaggggttcttgcttcattggcagccagagggtggacaagaacagtcgcgagtgcttggccccgaattgtctagctaccacctcgatggactcgagccagccactcaataccgtgtgagactgtcggtcctggggccagcaggagagggaccgtccgcggaagtgaccgcaaggaccgagtcccctcgggtgccatctattgaactgcgggtggtggacacttccattgattcggtgactctggcatggactccggtgtccagggccagcagctacattctttcgtggcggcccctgcggggacctggacaagaggtgccgggtagccctcaaactcttccgggaatctcgtcgtcccaaagagtcaccggcctggagccaggagtgtcatacatctttagccttactcctgttcttgacggcgtccgagggcccgaggcgtccgtcactcagacccccgtctgtcctcggggtcttgcagatgtggtgtttctgccacatgccacccaggataatgcccaccgcgccgaagccactcgcagggtcctggagcggctggtgcttgcactgggtccactcgggccacaggccgtgcaagtgggactgctgtcatattcgcatcgcccttcccctctcttcccacttaacggttcacacgatttggggatcatccttcagcgaattagggatatgccatacatggatccgtcaggtaacaatctgggtacggcagtggtgacggcccataggtacatgctcgcacctgatgccccagggagacgacagcacgtgcccggtgtgatggtcctgctcgtggacgaaccgctccggggagatatctttagtccaattagggaagcccaagcatccggtcttaacgtggtaatgcttggcatggcaggtgcagatcctgagcaactgcggcggctcgcacccggtatggattcggtgcagaccttcttcgcggtcgacgacggtccatcgctcgatcaagcagtgtccgggctcgcgaccgcactttgccaagcatcgtttaccacccaaccaaggcctgaaccttgtccggtttactgccctaagggacaaaagggtgaaccgggagaaatggggcttcggggtcaagtgggcccgccaggtgatcccgggctgccaggtcggaccggtgcaccaggtccccagggaccccccgggtcagcgacggcaaaaggagagagggggtttcctggcgccgacggtaggccaggtagcccggggcgtgcaggtaacccaggaactcccggagcccctggccttaaggggtcgccaggccttccaggtcctcgcggtgatcctggggagcgcggtccgcgcggtcctaagggggagccaggagcaccaggacaggtgattggcggtgaaggccccggacttcccggtcgaaagggcgatccaggccccagcggccctccagggcctagaggtccgctgggtgacccaggccctcgcggccccccgggacttcccggcaccgccatgaagggagataaaggagatcgtggggaacgtggaccaccaggaccgggagagggaggtattgcaccaggggaacctggactgccaggactccctggatcgccagggccccaagggccagtgggtccccctgggaagaagggggaaaagggtgactcagaggatggtgcaccgggactgcctggacaacctggttcgcccggagaacaaggaccgagagggccgcctggcgcgattggccctaagggtgaccgagggtttccaggacctctgggtgaagctggcgagaagggcgaacgaggtcctcctgggcctgcgggcagccgcggtctgcccggtgtcgctggacgccccggtgctaaaggaccagaaggccctccagggccgactgggcggcagggagaaaagggagaacctgggcggccaggggatcctgcagtggtgggaccagcagtcgctggtccaaaaggcgagaaaggcgatgtgggtcctgcaggtcctcggggagcaactggcgtccagggtgaacgcggtcccccgggacttgtgctcccaggtgaccctggacctaagggagatcccggagacagaggccctataggactcactggcagggccggccccccaggagatagtgggccacctggagaaaaaggcgaccctggacggccagggccgccgggccctgtcggacctcgcggacgggatggagaagtcggcgaaaaaggagatgaaggacctcctggcgatccgggcctgccaggtaaggcaggggaacgtgggcttcgcggagcccctggtgtcaggggtcctgtaggcgagaagggggatcaaggggacccgggcgaggacggacggaatggatccccaggttcgtcaggtcccaagggggacaggggggagccgggtccgcctggtccgccaggaagattggtggataccggacctggggcgcgtgagaagggcgagccaggcgacagaggtcaggagggacctcgcggacctaaaggcgacccaggactgcctggagcacccggagaaagaggcatagaaggtttccgaggaccaccgggccctcagggtgatccaggggttcgcggacctgcaggagaaaaaggcgatagaggccctccggggctggacggtcgctccggtctggatggaaagccgggagcagccggcccctccggacccaatggagccgccggcaaggccggagatcctggccgagatggcctcccaggactgcgcggagaacaaggactcccaggaccttccggaccacctgggctccctggcaagcctggagaggacggaaaacctggactgaatgggaagaatggtgagccaggggatccaggagaagatggaagaaagggcgaaaaaggggactctggagcatccggaagggaaggccgcgatggccccaaaggtgaacggggtgcaccaggaattcttggacctcagggtccccccggactgccgggtcctgtaggccctccaggtcagggatttccgggtgtccctggagggaccgggccaaagggcgataggggagaaactggttcaaagggagagcaaggactccctggtgaacgaggattgcgtggcgagccgggatccgtgccaaacgtcgatagactcctggaaacggccggaattaaggcatcggcgcttagggagatcgtggaaacgtgggatgagtcgtccggcagcttcctgccagtgcctgaacgccgacgtggtccaaagggtgactctggggaacaaggtcctcctggaaaagaaggtccaatcggttttcctggagaacggggactgaagggtgatcgcggagatcccggtccccagggacctccaggactggcgctcggagagagaggaccaccaggaccctcgggactggctggggagcccggaaaacctggaattcccggccttccgggacgcgccggaggcgtgggggaagcaggacgaccgggtgaacgcggcgaacggggagaaaagggtgaaaggggggagcaaggaagggatggaccgcctggccttccaggaactccgggccctcctggtcctcctgggcccaaggtgtcagtggatgaacctggccctggtctgagcggagagcagggaccgcccggactgaagggggccaagggtgaaccagggtccaacggcgatcaaggaccgaaaggggatagaggtgtgcccggtattaagggcgatagaggtgagccaggtcccagaggacaagacgggaaccccggtttgcctggagaacgaggaatggcagggcctgagggaaagccaggtttgcaaggtccaagaggtccgcctggtccagtgggcggtcatggcgacccaggtccacctggagcccctggactcgcagggccagccggccctcaagggccctcgggcctgaagggagagccaggcgaaaccggacctccggggagaggtctgactggtcctaccggagccgtcggacttcctgggccccctgggccatcgggattggtcggcccgcaagggagtccagggttgccgggacaagttggggaaaccggcaaaccaggcgcacccggcagagacggtgcctcggggaaggacggagatcgcggtagtccgggcgtgcccggtagtcctgggcttcccggcccagtcggaccaaaaggcgaacccgggcctactggtgcccctgggcaagcagtcgttggacttcccggagccaagggagagaagggagcgcccggcgggctcgctggtgatctggtgggagaacccggcgcgaaaggcgatagaggactgcccggtccacggggtgaaaaaggtgaggcaggacgggcgggagaaccaggtgacccaggtgaagatggacagaagggcgctcctggtcccaaaggctttaagggtgatcccggtgtgggagtcccaggatccccaggcccccctgggcccccaggtgtgaaaggtgatctcggcctccccggacttcctggcgcgcccggtgtggttggatttcctggacagactggaccgcggggcgagatgggacagcccgggccttcaggggagcggggtctggccggtcctccgggacgagagggtattcctggaccccttggtccacctggaccccctggatccgtaggacccccaggggcttcgggtctgaaaggggataagggtgatccgggagttggactcccggggcctaggggcgagcgcggtgagcctggaatcagaggtgaagatgggaggccaggtcaagaaggtccgagaggcttgactggcccgcctggttcacggggcgaacgtggtgagaagggcgacgtcggcagcgctggcttgaagggtgataagggcgactcagcagtgattcttggcccgcctggccctagaggagccaagggagatatgggagagagaggtccacgcggcctcgatggtgacaagggaccaagaggagacaatggggaccctggagacaaaggcagcaagggcgaacccggagataaagggtccgcaggcttgccaggcctgagaggactcctgggccctcagggacagcccggtgcagcaggaataccaggcgatcctggcagccccggtaaagatggggtgcccggaatcagaggggaaaaaggtgatgtgggattcatgggaccacgcggacttaaaggggaaagaggtgtgaagggagcatgtggcctcgacggggagaagggagacaagggcgaggcaggacctccgggtcgccctggactcgcgggtcacaagggtgaaatgggggaaccaggagtccctggacagtccggagccccagggaaggaagggctcattggtcctaagggtgaccggggatttgacggacaacctggacctaagggtgaccagggtgagaagggtgagcggggtactcctgggataggtggatttcctgggccaagcgggaacgacgggtcagcggggccaccaggaccaccggggtcggtgggacccagaggccctgaaggtttgcaaggacaaaagggggaacggggacctcctggcgagcgggtcgtgggggcccccggtgtgcccggtgcgcctggcgaaaggggtgaacaaggacgtcctggaccggccggcccgagaggcgaaaagggggaagccgcactcaccgaagatgacatcagaggatttgtcaggcaagagatgtcccaacattgtgcatgtcaagggcagttcatcgctagcggtagccgccctcttccgtcatatgcagcagacaccgcagggagccagcttcatgcggtgcctgtccttagagtctcgcacgcagaagaagaggaacgtgtgccaccagaggacgacgagtactcggaatactcagagtacagcgtggaagaataccaagatcctgaggctccttgggattcagatgacccctgctcccttcccctggatgaaggatcgtgcactgcatatactctcagatggtaccatagagctgtgaccggatcaactgaagcatgccatccgtttgtgtacggcggatgtggcggaaatgcaaatcgattcggaacgagggaggcttgtgaaaggcgctgtccaccgagagttgtgcaatcgcaaggaaccggtacggcacaggac

SEQ ID NO: 9618 - DNA, 8832 bp, Artificial Sequence
  Description of Artificial Sequence: Synthetic coding sequence
atgacactgcgtttgttggtcgccgcactctgtgccggcatcctagcggaggccccacgtgtgcgggcccagcatcgggagcgcgtaacatgtacacggctttacgctgccgacattgtgttccttttggatgggtcgagttctatcggtcggagtaacttccgtgaagtgagatcttttctggaggggctggtgctgcctttttcaggagccgcctctgctcagggagttagatttgccaccgtgcagtactcggatgaccccaggaccgaatttggattggatgctctgggtagcggaggcgacgtgataagggctatacgcgagctgtcctataagggcggcaacactcgtacaggcgcagcgatacttcatgtggcagaccacgtgtttctgccgcaactcgcccgtcccggagtgcccaaagtatgcatcctgataaccgacgggaagtctcaggatctcgtggataccgctgctcagcgtcttaaaggacagggggtcaaacttttcgctgtgggcataaaaaacgccgaccccgaggaactcaaaagagtcgcatcccagcccacctcagacttctttttttttgttaacgatttcagtatcctgaggaccctcttgccactcgtgtctagacgggtgtgcacaacagcaggcggtgtgccagttacccgccctcccgatgactccacctctgccccccgagatctggtactgagcgagccctcttcacaatctctgagagtacagtggactgccgccagtgggcccgtgactgggtataaggtgcagtacactcccctgactggcctcggtcagccactgccttcagagaggcaggaagtcaacgttcctgctggcgagacatcagtgcggctacgtggtctgagaccactgactgaataccaagtcacagtgatagctctgtatgccaacagtatcggggaagccgtttctgggactgcccgaacaacagcactcgaaggacccgagcttacgattcagaacactaccgcgcattctttgttggttgcctggagatctgtgcctggggccacaggctaccgggtaacatggagggtcctctccgggggtccgactcaacagcaggaacttggccccggccaggggtccgttctactccgggacctcgaaccaggtaccgactacgaggttacagtcagcaccctctttgggaggagcgtcggtccggctaccagtctcatggctcgaacagacgcttcagtcgagcagacactgagacccgttatcctaggaccaacttcaatactcctgtcctggaatttggtcccggaggcccggggctaccggctcgagtggcgtagggagacaggactggaacctccccagaaagtcgtgcttccatctgacgtaacccgctatcagctggatggtcttcagcccggcaccgagtatagacttaccttatacactcttctcgagggacatgaggtggcaactcccgccacagttgtgcctactgggcctgagttgcctgtgagtcctgttacggacctccaagccactgagctccctgggcagcgggttcgcgttagttggagccccgtgccgggggctacccagtaccgcatcatcgttaggtcgacccagggggtggaacgcaccttggttttgccaggaagccaaaccgcttttgacctggacgacgttcaagcgggactttcttatactgtgagggtgagcgcgagggttggaccacgggagggctcggcatccgtgcttaccgtccgcagggagcctgaaacccccctggccgttcctggtctccgggtcgtggtgagtgatgcaacacgggttagggtcgcatggggtccagtgcctggcgctagcgggtttcgaatctcttggagcaccggctcaggacctgagagcagccagacattgccacccgacagtactgccacggacatcacagggctgcaaccaggaacaacataccaagtcgctgtgagtgtgcttagggggagggaagaaggacctgccgcagtcatcgttgcccggacagatcctcttggccctgttcgcaccgtccacgtgactcaagcatccagttcttctgtaaccatcacttggacacgtgtgcctggggctacgggttaccgtgtttcctggcactctgcgcatggccccgagaagtcgcaactggtctcaggggaggctacagttgccgaactggatggcctggagccagataccgagtataccgtacatgtgcgtgcacacgtggctggggttgatgggcctcctgcttctgttgtcgtgcgcaccgctcccgaacctgtgggccgggttagccggctccagattctcaatgccagcagtgatgtacttcgaattacttgggtgggcgtcacaggggcaaccgcatacagattagcatggggacggtccgaggggggacccatgaggcaccagatcttgccaggcaacacagacagtgcagaaatccgggggcttgaggggggagtgtcttacagtgtacgagttaccgcactcgtcggagatagggagggcacccctgtttctatcgtggttactacgccgccagaggctcctcctgcacttggaactttgcacgttgtacagcgcggagagcactctttgagactccgttgggagccagttccgcgcgcacagggctttctgctccactggcagcctgagggcggacaggaacaaagccgggtgttgggccccgagctgagttcctaccacttggatgggctggaacctgctacccagtatcgcgtccggctgtcagtattagggcctgcgggcgaaggcccaagcgccgaggtcacagcccgcaccgagtctccccgagtccccagcattgaactgagggtggtcgacacttcgatcgattccgtgactttggcttggactcccgtgagtcgagccagcagttatatattgtcatggcgacccctccggggtcccggccaggaggtgcccgggtctcctcagacactgccaggcatctccagcagccagagagtgacgggcttggagcccggggtgagctacatcttctctctgacccccgtgcttgatggtgtgcgtggaccagaggcctcagtcacccagaccccagtctgccctcgagggctcgcagatgtcgtttttctcccgcacgcgactcaggacaatgctcatcgcgctgaagctaccagacgcgtgttggagaggctggtgctggccctcggcccattggggccccaggcagtccaggtgggactgctgagttattcacaccgcccatctcctttatttccattgaatgggtcccatgatctaggcataatattgcagcggatcagggacatgccctacatggatccatctgggaataacttgggaacagcggtggtgaccgcccatcggtatatgctggcccccgacgccccaggccgacgccagcacgtgcccggggttatggttctcctcgttgacgaaccattacgcggtgatattttctcacccataagagaggcacaagcttccggactcaatgtggtcatgcttggcatggcgggggctgaccccgagcagctgcgacgcctcgcccccggcatggattccgtccagaccttcttcgcggtcgatgacggtcccagcctcgatcaagccgtttcgggcctagcaacagccctttgtcaggcaagcttcactactcagccgcggcctgaaccgtgtccagtctactgtcctaaaggtcagaaaggggaacctggtgagatgggccttagagggcaagttgggccacccggcgatcctgggctgcctggtagaactggtgcccccggcccacagggcccacccggatcagcaaccgctaagggcgaaaggggcttcccgggcgctgacggccgccccggctctcccgggcgagccggcaacccgggcaccccaggtgctccaggcttgaagggcagcccaggcctccctggcccgcggggggatccgggggaaaggggtcctcgggggccaaagggtgaacccggagcgcccggccaggtgattggcggtgaaggtcccgggctccctggccggaagggagatcctgggccaagtggtcccccaggtccacgcggtcctctgggtgaccccggcccacggggacctcccggtctgcctgggaccgccatgaaaggtgacaaaggagaccggggcgagaggggcccgccagggcctggggaaggaggtattgccccaggtgagcctggtctccccggcttgcccggttctcctggccctcagggaccagtgggccctccaggcaagaaaggcgagaaaggcgatagtgaggacggcgcccccggcctccccggacagcctggctctccaggagagcaaggaccacgcggccccccaggtgcaattggacctaaaggggatcggggattcccaggtccattgggagaggccggggagaaaggcgaaagaggtcccccaggccccgccgggtcgagggggctccctggggtcgccgggcggccaggggctaaggggccagaaggaccccctggccccactggccgtcagggtgagaagggggaacctggccgcccaggagaccctgcggtggtgggaccagcagtggccgggcccaaaggcgagaagggagacgtggggcccgcgggccccagaggggcgaccggtgttcagggggagaggggacctcctggcctggtgcttcccggcgaccccgggccgaaaggggatcctggcgatcgtggtcccataggactcacaggacgtgctggaccccccggcgattcagggccccccggggagaagggggatcccggccggcccggcccccctgggccagtgggtccaaggggacgggatggggaggtgggagaaaagggtgacgaaggaccgccgggcgaccctgggcttcctggaaaagcaggtgaacgcgggctgaggggagccccgggtgtgcgcggacctgtaggtgagaagggcgaccagggtgaccctggcgaggatggtaggaacggaagccccggctcttcagggcccaaaggtgaccgaggagaacctgggccccctggaccgccgggtcgtctggtagatacaggacccggtgcacgtgagaagggggaacccggcgacagggggcaggaaggaccgcgcggcccaaagggggacccaggcctgcctggagctcccggggagcggggcatcgagggcttccgtggtccacctggcccacagggtgaccccggcgtccgggggccggcaggtgagaaaggtgaccggggtccacctggactcgacgggcgcagcgggctggacggtaaaccaggggcagccgggccctcaggccctaacggtgccgcaggcaaagccggagatcccggtcgtgatggtctccccgggctgcgaggcgaacagggtttgcccgggccttccgggcctccgggcctgcctgggaagccaggagaggatggaaagcccggcctgaacggcaaaaatggggaacccggggaccctggggaagacggcaggaagggcgaaaaaggcgatagcggagcctcaggccgggaaggcagggatggtcccaagggcgaacgaggagcaccagggatactgggacctcagggaccccccgggcttccagggcctgtggggccccccggtcaggggtttcccggcgtcccggggggaacgggtccaaaaggcgacagaggagaaacagggagtaagggcgaacaggggcttcctggagaacggggcctccggggggagcctgggagcgtcccgaacgtggatcgactcctggaaactgccggaattaaggccagcgccctcagggagatagtggaaacttgggacgagtcctctggctcatttctccccgtgcccgagcgacgaagaggccctaaaggggacagcggagaacagggcccccctggtaaagagggcccaattggatttccgggggagaggggtttgaagggtgatcgaggggatcccggtcctcagggaccacccgggctagcgctgggggaaaggggccctccagggcctagcggactggcaggagagcccggcaagccaggcattcccggcctccccggaagagcgggaggggtgggagaggctgggcgccccggggagcgaggcgaacggggcgaaaaaggcgagcggggcgagcagggccgagatggaccccctggcctgcctggcaccccaggtccccctggtccccccggacccaaagtgtccgtcgatgaaccggggccagggctgtctggggaacaggggccaccaggcttgaagggcgctaaaggcgagccaggaagcaatggcgatcagggccctaagggcgatcgaggcgttccgggaattaagggcgaccggggtgagccaggacctcgaggtcaggatgggaatcccggtctacctggcgaaagaggcatggctgggcccgagggtaagcctggtctgcagggccctagaggaccccccggtcctgttggaggacacggcgatcctggcccacctggggctccaggcctggctggccctgcgggtcctcaagggccatctggcttgaaaggagaacccggcgaaaccggcccgcccgggagaggcctgacagggccaaccggggccgtcggacttcccggtccgcctgggccctccggactcgtggggccccaggggagtcccggactccccggtcaggtgggcgaaacaggtaaaccaggcgcccctggacgggatggcgccagcgggaaggatggggatcgaggctccccgggcgtgcctggctctccgggtttacctggccccgttggtcccaaaggcgagccgggccccaccggagctccggggcaggcagtggtcgggctcccaggcgcaaaaggcgaaaagggggccccaggggggctcgccggagacctggttggggagccgggcgcaaaaggcgacaggggcctgccaggccccaggggtgagaagggggaggctgggagagcaggcgagcccggggaccctggggaggacggacaaaagggtgcccccggacctaaagggttcaaaggcgaccccggtgtgggcgttcccggctccccaggaccacctggaccccctggcgttaagggggacctcggccttccgggactccccggggcaccgggggtggtgggtttcccaggccagactggcccgcgcggagaaatgggccaaccaggcccctctggagaaaggggcctggctggacccccagggagagagggcatccccggtcctctcgggcctcccgggcctcctggctccgtgggccccccaggcgccagtggcctgaaaggagataaaggtgatcctggagtggggctaccaggccccagaggtgagaggggtgagccgggcatccgtggcgaagatggaaggcctggacaagagggccctagaggcctgactgggccccctggctctcgaggggagcgcggggaaaagggcgatgtcggaagcgctggcctgaaaggcgataagggcgattccgctgtgatccttggcccacccggcccacgtggagcgaaaggagacatgggcgaacgaggcccaagagggttagacggtgacaagggcccacggggggacaacggcgatcccggcgacaaaggcagtaagggagaacctggcgacaaaggctcggctgggctacccgggctgcggggactgctgggtcctcaggggcagccaggggcggcaggcatcccaggcgatcctgggtctcctggtaaagacggagttcctggcattcgcggggaaaaaggtgatgtagggtttatgggcccccgggggctcaagggagaaaggggcgttaagggcgcatgcggcctggacggagagaagggtgacaaaggcgaagcaggaccaccaggacggcctgggctggccggtcataagggtgaaatgggggagcctggagttccaggccagtccggcgccccagggaaagaaggtctcatcgggccaaaaggggaccgggggtttgatggccagccaggtcccaaaggcgatcagggcgaaaagggggaaaggggcaccccggggatcggtggatttcccggacctagtggcaacgatgggtccgccgggccccccggcccccccggctctgtgggcccccgcggcccggagggtcttcagggtcagaaaggcgagagaggtcctccgggggaacgagtggtcggagcgcccggcgttcccggcgcaccgggtgaacgcggtgaacagggacggcccgggcccgccgggccccgcggcgagaagggggaggcggcactaactgaggacgacattcggggcttcgtgcgccaggagatgtcccaacattgcgcctgccagggccagttcatcgccagtgggtcgcgacccctgccctcttacgctgcagatacagcagggagtcagctgcacgcggtgccagtgctgagggtgagccatgcagaagaggaggagagagtgccccccgaagacgatgagtactcggagtattccgaatattcagttgaggagtatcaggatcctgaagctccatgggactctgatgacccttgcagtctgcccctggacgagggaagctgtactgcctacacccttaggtggtatcaccgcgccgtgactggatccacagaggcatgtcatccctttgtctatggcggatgcggcggcaatgcaaatcggttcgggacacgagaggcttgcgaacggaggtgtcccccaagagtggtgcagtcacagggaacaggcacagcccaggac

SEQ ID NO: 9619 - DNA, 8832 bp, Artificial Sequence
  Description of Artificial Sequence: Synthetic coding sequence
atgactttaagattattagttgccgcactatgtgcaggaattttagctgaagctccaagagttagagcacaacatagagaacgtgttacatgtacaaggctttatgcagctgacattgtttttcttcttgatggatcctcatctattggaagatcaaatttccgtgaagtacgtagttttttagaaggattagttttacctttttcaggtgcagcatctgcacaaggagttcgatttgctacagttcaatatagtgatgatccaagaacagaattcggtcttgatgcattaggatctggaggtgacgttattagagctattagagaacttagttataaaggaggaaatactagaactggagcagctattttacatgttgcagatcatgtatttttgccacaattagcaagaccaggagttccaaaagtttgtattttaattactgacggaaaatcacaagatttggttgatactgcagcacaacgactcaaaggacaaggtgtaaaattatttgcagttggtattaaaaacgctgatccagaagaacttaagcgtgtagcttctcaacctacttcagatttttttttttttgtaaatgatttttcaattttaaggacattacttccattagtatcaagacgagtttgtacaactgctggaggtgttccagtcactagaccaccagatgattcaacatcagctccaagagatttagtattatctgaaccatcatcacaatcattgagagttcaatggacagcagcttcaggaccagtaactggatataaggttcaatatactccacttactggattgggtcaaccattaccatcagagagacaagaagttaatgtaccagctggagaaacatcagttaggttgagaggattaagaccacttactgaatatcaagtaactgttattgcattatatgctaattcaattggagaggcagtcagtggaactgcacgaacaactgcacttgaaggaccagaattaacaatacaaaatactacagcacattctttattagtagcttggagatccgttccaggagcaacaggatatagagttacttggagagttttatcaggaggaccaactcaacaacaagaattaggaccaggacaaggatctgttcttcttcgagatttagaaccaggaactgattatgaagttactgtttctactttatttggaagaagtgttggtccagcaacatctttgatggcaagaaccgatgcttctgttgaacaaacattaagaccagttattttaggacctacatcaattcttttatcatggaatttagttccagaagctagaggttatagattagaatggagacgtgaaacgggattggaaccacctcaaaaagtagttttaccttcggatgttacaagataccaattagatggtttacaaccagggactgaatacagattgactttgtatacgctattagaaggacatgaagttgcaacaccagctactgttgttccaactggacctgaattaccagtaagtccagtaactgatttacaagctactgaattaccaggacaaagagtaagagtttcttggtcaccagttccaggtgcaactcaatatagaattattgttagatcaactcaaggagttgagagaactcttgtattacctggatctcaaactgcttttgatttagatgatgttcaagctggactttcatatacagtacgagtaagtgcacgtgttggaccacgtgagggatctgcttctgtcttaaccgttaggcgtgaacctgagacaccattagcagttccaggattaagagtagtagtaagtgatgctacaagagttagagtagcatggggtccagttccaggagcttcaggatttagaatttcatggtctacaggatcaggtccagaaagttctcaaactttaccaccagattcaacagcaaccgacatcactggacttcaaccaggaacaacatatcaagtagctgtttctgttttaagaggacgagaggaaggtccagctgcagttattgttgcaagaacagatccattaggacctgttagaacagtgcatgttactcaagcatcttcatcaagtgtaactataacatggacaagagttccaggagctacaggataccgagtaagttggcattcagctcatggtcctgaaaaatctcaacttgtttccggagaagctacagttgctgaactagatggtcttgaaccagatacagaatatacagttcatgttcgtgctcatgtagctggagttgatggaccacctgcatctgtagttgttagaacagctccagaaccagttggaagagtttcaagattacaaattttaaatgcttcatcagatgttttacgtattacatgggtaggagtcaccggtgcaactgcatatagattagcttggggtagatctgaaggtggaccaatgagacatcaaattcttccaggaaatacagacagtgctgaaattagaggattagaaggtggagttagttatagtgtaagagttactgctttagttggtgatagagaaggaactccagtttcaatagtagttactacaccaccagaagcacctccagctctagggacattgcatgttgttcaaagaggagaacattcattacgtctaagatgggaaccagttccaagagctcaaggttttttacttcattggcaaccagaaggaggtcaagaacaatcaagagtgcttggaccagaattatcttcttaccacttagatggacttgagccagctacacaatacagagtaagattaagtgttcttggtccagcaggagaaggaccaagtgctgaagttacagctagaactgaatctccaagagtaccatctattgaattgagagttgttgatacatctatagatagtgtaacattagcatggactccagtttcaagagctagttcatatattttaagttggagaccattaagaggaccaggacaggaagtaccaggatctccacaaacattaccaggaatttcaagtagtcaaagagttacaggacttgaacctggagtatcttatatattttcattgactccagttttagatggagtcagaggtccagaagcatcagtaacacaaacgcctgtttgtccaagaggattagctgatgttgtatttttgccacatgcaactcaagataatgctcatagagcagaagctactcgtagagttttagaaagattagttcttgctttaggaccactaggtccacaagcagtacaagtaggtttattatcttattcacatagaccaagtccattatttcctcttaatggatctcatgaccttggaattattttacaacgtataagagatatgccatatatggatccatcaggaaataatcttggaacagcagttgttacagcacatagatatatgcttgctccagatgctccaggaagaaggcaacatgttccaggagttatggttttacttgttgatgaaccattaagaggtgatattttttcaccaatcagagaagcacaagcttctggattaaatgtcgttatgttaggtatggcaggtgctgatccagaacaacttagaagattagctccaggaatggatagtgttcaaacttttttcgctgttgatgatggtccttcacttgatcaggcagttagtggtttagctacagcactttgtcaagcatcttttacaactcaaccacgtccagaaccatgtcctgtttactgtccaaaaggacaaaagggagaacctggagaaatgggactacgaggacaagttggaccaccaggagatcctggtcttccaggaagaactggtgctccaggaccacaaggacctcctggttcagctacagcaaaaggagaaagaggttttccaggagcagatggacgtccaggatctccaggaagagctggaaatccaggaacacctggagctccaggattaaagggatctccaggacttccagggccaagaggagatccaggagaaagagggccacgtggaccaaaaggtgagccaggagcacctgggcaggttataggaggtgaaggacctggacttccaggaagaaaaggggatccaggaccatcaggacctcctggacctagaggtcctcttggagatccaggtcctagaggtccaccaggattaccaggaactgcaatgaagggagataaaggagatagaggagaaagaggaccacctggaccaggagaaggtggaatcgcacctggagaacctggattaccaggacttccaggatcaccaggtccacaaggacctgtaggtccacctggaaaaaaaggagaaaaaggtgattcagaagatggagcacctggtttgccaggtcaaccaggatcaccaggagaacaaggtccacgtggaccaccaggagctattgggcctaaaggtgatcgaggattccctggaccacttggagaagctggggaaaaaggagaacgtggaccaccaggaccagctggttcaagaggacttcctggtgtagctggtagaccaggagcaaaaggaccagaaggacctccaggaccaacaggaagacaaggagaaaagggagaacctggaagaccaggagacccagcagtagttggtccagcagtagctggtccaaaaggtgaaaagggagatgtcggaccagctggaccacgtggagctacaggagttcaaggagaaagaggaccaccaggattggttcttcctggagatcctggtccaaaaggagatcctggagatagaggtcctattggattaactggaagagcaggaccaccaggtgactctggaccaccaggtgaaaaaggagatccaggaagaccaggaccaccaggtccagttggaccaagaggaagggacggagaagttggagaaaaaggtgatgaaggtccacctggagatccaggattaccaggtaaagcaggtgaaagagggttaagaggagcaccaggagttagaggaccagttggagaaaaaggtgatcaaggagatccaggagaagatggaagaaatggatcaccaggaagttcaggaccaaaaggtgatagaggagaaccaggaccaccaggacctccaggaagacttgttgatactggaccaggtgctagagaaaaaggagaaccaggagacagaggacaagagggtccaagaggtccaaaaggagatccaggattaccaggagctccaggagaaagaggtattgaaggatttagaggaccaccaggacctcagggtgacccaggtgtaagaggtccagccggagaaaaaggagatagaggacctccaggattagatggaagaagtggtttagatggaaaacctggtgcagctggaccttcaggaccaaatggagctgctgggaaagcaggggacccagggagagatggattaccaggtttaagaggagaacaaggtcttccaggaccatctggtcctccaggtcttccaggaaagcctggtgaagacggaaaaccaggattaaacggaaaaaatggagaaccaggagatccaggagaagatggtagaaaaggtgaaaaaggtgattcaggagcatcaggtagagaaggaagagacggtcctaagggagaaaggggggcacctggtattttaggaccacaaggaccaccaggacttccaggaccagttggacctccaggacaaggtttcccaggtgtaccaggaggaacaggaccaaaaggagatagaggagaaactggttcaaaaggagaacaaggattaccaggtgagagaggtcttagaggggaaccaggatctgttccaaatgtagatagattattagaaacagcaggaattaaagcaagcgcattgagagaaattgttgaaacatgggatgaaagttcaggaagtttccttccagttccagaaagaagaagaggaccaaaaggagattcaggagaacaagggcctccaggaaaggaaggacctattggttttcctggagaaagaggacttaaaggggatagaggagatccaggtcctcaaggaccaccaggattagcacttggagaaagaggaccaccaggtccatcaggtttagcaggagaaccaggaaaacctggaattccaggattaccaggaagagctggtggtgtaggagaagcaggaagacctggtgaaagaggagaaagaggagaaaaaggagaaagaggagaacaaggaagagatggtccaccaggtttaccaggaactccaggtccaccaggacctccaggaccaaaagtatcagtagatgaaccagggcctggactttcaggtgaacaggggccaccaggattgaaaggagctaagggtgaaccaggatctaatggtgatcaaggaccaaagggtgatagaggagtcccaggtattaaaggagatagaggtgaaccaggtccaagaggacaagatggaaatcctgggcttccaggtgaacgagggatggctggaccagagggtaaaccaggattacaaggaccaagaggtcctccaggaccagttggaggacatggtgacccaggaccaccaggagctcctggtttagcaggaccagcaggtcctcaaggtcctagtggacttaaaggagaaccaggagaaactggaccacctggtagagggttgactggacctactggagcagtgggtcttccaggaccaccaggtccatcaggattagttggaccacaaggttcaccaggtttaccaggacaggtgggagaaacaggaaaaccaggagctccaggtagagatggagcatcaggaaaagatggtgatagaggatctcctggagttccaggttcaccaggacttcctggaccagttgggccaaaaggtgaaccaggacctactggtgctccaggtcaagcagttgttggattaccaggagctaagggagaaaaaggagcaccaggaggacttgcaggagacttagttggagaaccaggtgctaaaggagatagaggtttacctggacctcgtggagaaaaaggagaagctggaagagcaggagaaccaggtgatccaggagaggatggacaaaaaggggcaccaggaccaaaaggttttaaaggagatccaggtgttggtgttcctggatcaccaggaccaccaggaccaccaggagttaaaggagacttaggtcttccaggtttaccaggagcaccaggagttgttggatttccagggcaaacaggaccaagaggtgaaatgggacaaccaggaccttcaggtgaaagaggtcttgcaggaccaccaggaagagaaggtataccaggaccattaggtccaccaggaccaccaggatctgttggtccacctggagcttctggattaaaaggtgataaaggtgatccaggagtgggacttccaggaccaaggggagagagaggagaacctggaataagaggagaagatggaagaccaggtcaagaaggaccaagaggacttacaggaccaccaggaagtagaggtgaaagaggtgaaaaaggtgatgttggttcagcaggtcttaaaggagataaaggagattcagctgttatattaggtccaccaggaccaagaggtgcaaagggtgatatgggtgaaagaggaccaagaggattggatggagataaaggaccaaggggagataatggtgatccaggggataaaggttctaaaggtgagcctggagataaaggatctgctggattacctggtttaagaggtttgttaggaccacaaggacaacctggagcagcaggtataccaggtgatccaggtagtccaggtaaagatggtgttcctggaattagaggagaaaagggtgatgttggttttatgggaccacgaggtttaaagggagaaagaggagtaaaaggagcttgtggattagacggagaaaaaggtgataaaggagaagctggtccaccaggaagaccaggtttagcagggcataaaggagaaatgggagaacctggagttccaggtcaaagtggagcaccaggtaaagaaggattaattgggccaaaaggggatcgtggttttgacggacaaccaggaccaaaaggagatcaaggagaaaaaggtgaaagaggaacaccaggaataggaggattcccaggtccatcaggaaatgatggatcagctggaccacctggtccacctggatctgttggtccaagaggaccagaaggattacaaggacaaaaaggagaacgtggaccaccaggagaaagagttgttggtgctccaggagttccaggtgctccaggtgaaagaggggaacaaggaagaccaggtccagctggacctcgaggagaaaaaggagaagctgctctaacagaagatgatattagagggttcgtgcgtcaagaaatgtcacaacattgtgcttgtcagggacaatttattgcatcaggaagcagaccacttccaagttatgcagcagatactgctggtagtcaacttcatgcagtaccagtacttagagtttcccatgctgaagaagaagagagagttccaccagaagatgatgaatattcagaatatagtgaatattcagtagaagaataccaagatccagaagctccatgggatagtgatgatccatgtagtttaccattagacgaaggatcatgtactgcttatacattaagatggtatcacagagccgttacaggatcaacagaagcatgccatccatttgtatatggaggttgcgggggtaacgctaatagatttggaacacgagaagcttgtgaaagacgttgtccacctcgagtggtacagtctcaaggaacaggaaccgcacaagat

SEQ ID NO: 9620 - DNA, 8832 bp, Artificial Sequence
  Description of Artificial Sequence: Synthetic coding sequence
atgaccctgaggttgcttgtggcagccctgtgtgcaggaattctcgcagaggctcctagagtgcgtgcgcagcaccgcgaaagagtgacttgcacccgcctttatgcggcggatatagtgttcctgctggatggaagctcatcgatcggaagatcaaactttagggaggtgaggtcctttctggaaggactggtgctcccattttcgggagcagcatccgcacaaggcgtcagatttgcaacggtacaatactccgatgatccaagaaccgaattcggcctcgatgcactgggttcgggtggggatgtcattagagctatcagagagctgtcctacaaggggggaaacaccagaaccggcgcggccattctgcacgtggccgatcacgtgtttttgccgcaacttgccaggcctggggtccctaaggtgtgtatccttatcacggatgggaagtctcaagacctggtcgatacggcagcacaaaggctcaaaggacagggagtgaagttgtttgcagtgggcattaagaatgcagatcccgaagaacttaaaagagtggcatcacagccaacttcggacttctttttctttgtgaacgactttagcatcctgagaaccctcctgcctctcgtgtcgagaagggtctgtaccaccgcgggaggtgtgccggtcacgaggccccccgatgatagtacgagcgcccccagagatctggtcctctcggaaccaagcagccagtccttgcgggtccagtggactgcagcatcgggaccagtcactggatataaggtccaatacaccccgcttaccggacttggtcaacccctgccctcggagcgccaggaggtgaacgtgcctgcaggggaaacttcggtgagactgaggggactccgacctctgaccgagtaccaagtgaccgtcattgcactgtacgctaactcgataggtgaggcagtcagcggaactgcacggaccaccgctctggagggaccagaactcactatacagaatactactgcacattcactcctggtggcctggagatcagtgccaggcgctactgggtacagagtgacgtggcgagtgctttcgggcggtcctacccagcaacaagagttgggcccaggtcagggctcagtgttgttgcgggatcttgaaccaggcactgactacgaagtgaccgtgagcactctcttcggcagatctgtgggaccagcgacttcactgatggcaagaaccgatgcctcggtcgaacagaccctgcgacccgtgatcctgggaccgaccagcattcttctcagctggaaccttgtgccggaagcacgcgggtaccggttggaatggcgccgtgaaaccgggctcgaaccacctcaaaaggtggtgctcccttccgatgtgactcgttaccaactggatggccttcagcctggtacggagtaccgactcaccctttacactcttctggagggacatgaggtcgccactcctgcaaccgtggtgcctacggggcctgaactccccgtgagtccagtgaccgacctgcaagcaactgaactgcctggacaaagagtcagggtgtcctggtcgcctgtgccaggggcaacccagtaccgcataattgtgagaagcactcaaggcgtggagagaaccctggtgcttcctggatcgcagactgcgttcgatctggacgacgttcaggccggactttcatataccgtgcgcgtgtcagccagggtgggccctcgcgagggcagcgcaagcgtgttgaccgtgaggcgcgaacctgaaaccccactggccgtgcccggtctgcgtgtggtcgtgtccgacgcaactagagtgagagtggcttggggaccagtcccaggggcatcaggattcagaatctcgtggagcaccgggtcaggtcctgaaagctcgcagaccctcccacctgattccaccgccaccgatattactggactgcagccaggaactacctaccaggtcgcagtgagcgtccttaggggccgggaagaaggtcctgcagctgtgattgtcgcccgaaccgatccactcggaccggtgagaaccgtgcacgtgacgcaagcctcgtcatcctccgtcaccattacctggacccgtgtgcctggtgcaacgggttaccgagtctcatggcacagcgcacacggtccggagaagagccagctcgtgagcggtgaggccaccgtggcagaacttgatggtctggaaccagatactgaatacacggtccacgtgcgggcacacgtggccggagtggatggccctcctgcgtccgtggtcgtgagaactgcaccagaacccgttgggcgagtcagcagactccaaatacttaatgcatcgtctgatgtgctgcgcatcacctgggtgggagtgaccggtgcaaccgcgtacagattggcatggggacggtccgaaggcggtcccatgcggcatcaaatactgccaggtaataccgattccgcagagattcgggggcttgagggaggggtgtcgtactccgttagagtgactgcgctggtcggagatcgggagggaactccagtgtccatcgtcgtcaccaccccgcctgaagcgcctccagcacttggaaccctccatgtggtgcaacgtggcgaacacagcctccgcctgcgatgggagcctgtccccagagcacaaggttttctgttgcactggcagccagaggggggacaagaacagtcgcgggtgttgggacccgaactgtccagctatcaccttgatggacttgaaccagcaactcaataccgagtcaggctgagcgtgttgggtccagcaggcgaaggaccttcggcagaggtgactgcacgtactgagtcgcctcgtgttccgtcgatagaacttcgcgtcgtggacacctcaattgattcggtgacccttgcttggactcccgtgtcaagggcctcatcgtacatcctgtcctggcgtccgctcaggggacccggtcaagaagtccctgggtcccctcaaacgcttcctgggattagctcgtcccaaagggtcacgggactggaaccaggtgtgtcgtacattttctcgcttacccctgtcctggacggtgtccgaggaccagaggcaagcgtgacccaaaccccagtgtgtcctcggggacttgcggatgtggtttttcttcctcatgccactcaagataatgcgcatcgcgctgaagctacccggcgagtcttggaaaggctggttcttgctttggggcctttgggtccacaggccgtgcaagtgggcctgttgtcgtactcgcacagaccttcaccactgttcccactgaatggttcccatgacctcggcatcatactgcagcggatccgagacatgccgtacatggatcctagcggcaacaatctgggaaccgcagtggtcaccgcccataggtacatgctggcacctgatgcaccagggcgaaggcagcatgtccccggagtcatggtgctgctggtggacgaaccacttcggggagatatctttagccctatcagggaagcacaagcctccggtctgaacgtggtcatgcttggaatggccggagccgatcccgagcaactgagaagattggctcctggaatggactctgtgcagactttctttgcagtggatgatggtccttcccttgaccaggcggtgtcgggactggcaaccgcactttgtcaagcctccttcaccacgcaaccacggccggagccatgccctgtttactgtccaaagggtcagaaaggcgagcccggagaaatggggctgcgcggccaggttggtccaccgggtgaccctggcctcccgggccgaactggtgcacctggaccccagggtccgccaggctccgcaaccgcaaagggtgaaagaggtttccctggtgcagatggcagaccaggatcacctggaagagcaggcaaccctggcactccgggtgcgcccggtctgaaaggatcccctggactgcctggacctcgaggtgatcccggggagagagggcctcgtgggcccaagggagaacctggtgcgcctggacaagtcatcggtggtgaaggacctggactgcctggaagaaagggcgaccccggcccttccggtcctcccgggccccggggtccacttggtgacccaggaccccggggaccaccaggacttcctggtaccgcgatgaaaggagataagggagatcgcggtgagagagggccacctggcccaggagagggcggtattgcccctggagagccaggcctgccaggactgcctggaagcccaggcccgcaaggacccgtgggccctcctggaaagaaaggtgaaaagggagactccgaagatggtgcaccaggacttccaggtcagcccggctcacctggtgaacagggtcctcgtgggccaccgggcgcaattggcccaaagggtgatcgagggtttccaggacccctgggtgaagccggggagaaaggagaaagagggccacctggccccgccggatcaagaggattgccgggcgtggctggtagacctggggccaaaggtcctgaaggaccacctggacccaccggtagacagggcgaaaaaggtgagccaggacggccaggtgaccctgcagtggtggggccagccgtggcaggtccaaaaggggagaagggagacgtgggacccgcggggcctcgcggcgcaactggagtccaaggagaacgtggtcctccggggttggtgcttccaggcgaccccggtcccaagggtgatccaggcgaccgcggaccaattggactgaccggacgcgccggcccccctggtgattccggtccaccaggtgagaaaggtgacccaggccgcccagggccccctggaccagtgggtcctaggggtagagatggagaggtgggtgagaaaggagatgaaggacctcctggtgatccgggactgcctggaaaggcgggtgaaagaggactgagaggcgcaccaggcgtccgcggacccgtcggagaaaagggagatcagggtgatcctggtgaagatggtagaaatggatcccctggaagctccggcccaaagggtgacagaggagagccaggcccacccggcccacccggtcgacttgtggatactggtcccggagcaagagaaaagggagagccaggcgaccgaggccaggaagggcctcgcggtccgaaaggtgacccaggactgccgggagcccccggtgagagaggaattgaaggattcaggggaccccctggtcctcaaggtgacccaggggtgcggggacctgcaggtgagaagggagatcgggggcccccgggactggatggtcggtccggccttgacggaaagcccggcgcagcaggaccgtctgggccaaatggagctgcaggaaaggccggcgacccaggtcgcgatggacttccagggttgaggggagaacagggacttcccggtccttcgggaccccccggtctgccagggaagcctggggaagatggcaagccaggcctcaatgggaagaacggagaacctggtgaccctggggaagatgggcggaaaggagaaaagggagattcaggagcgtccggacgagagggcagagacggaccgaaaggggaacgcggtgcacctggtattcttgggccacaaggtccccctggcttgcccggaccagtcggcccccctgggcaagggttcccaggtgtgccaggggggacgggccctaagggcgaccgaggagagactggatcaaagggagaacaaggcctgccgggagaacgcggactgagaggtgaaccaggatcagtacctaacgtggatcggcttctggaaactgcgggaatcaaagcatctgctcttcgagaaattgtggagacttgggacgaaagctcgggttcctttcttccagtgccagagaggagacgcggacccaagggcgactcaggcgaacagggaccacctggaaaggaaggtcctattggctttccaggcgagcgggggcttaagggagatcggggcgacccgggacctcaggggccaccaggactggcgctgggtgagcgagggcctccaggaccaagcggcctggcaggcgaacctggaaagcctggcattcccggacttcccggacgcgccggtggggtgggagaggcaggacgcccgggggaaagaggagagcggggagaaaaaggagagcgcggtgaacagggtcgcgatgggccgcctggcttgcctggaactcctgggccgccgggaccgccaggacctaaggtttccgtggatgagcctggtcctggtttgtccggagagcaaggtccacctggacttaagggtgccaagggggaacccgggtccaatggtgatcagggacctaagggggacagaggtgtccctggtattaagggtgatagaggggagcctggaccccgaggccaggatggcaatcccggacttcccggtgaacggggtatggcaggaccagaagggaaacccggacttcagggaccacggggaccacctggcccagtgggcggtcatggcgacccgggtccacccggagcacctgggcttgccggcccagcgggtccccaagggccttcggggctgaagggagaacctggagaaactggacctccaggaagagggctcacgggaccaaccggagccgtcggactgcctggacctcccggcccttccggacttgtcggcccacagggtagtcctgggctccctgggcaagtgggtgagacgggcaagccgggtgcaccaggtagagacggcgcatctggtaaagacggagacagaggatcgcccggtgtccccgggagccctgggctgccaggaccagttggaccaaagggagaaccaggacctaccggtgcacctggtcaggccgtggtcgggcttcccggtgccaaaggagagaaaggtgcgcctggaggacttgcaggggatctggtgggtgaacctggagcaaagggtgatcgaggtctgcctgggccgaggggcgagaagggtgaggcagggcgcgcaggagagcctggggatcccggagaagatggacagaagggagcaccagggcccaaaggtttcaagggagatcctggagtgggggtgccaggatcgcctggcccgcccggcccccctggagttaagggtgatctgggtttgccaggcttgcccggagcgcctggagtcgtcggctttcctggacaaaccgggcctagaggagaaatgggacagccgggaccaagcggcgaacgcggactggcaggccctcctggtcgggagggtatccctgggccacttggaccccccggcccacctggctcggtaggaccgccaggagcttctggactgaagggggataagggcgatccaggagtgggtctgccaggtccccggggtgaaagaggagaaccagggattagaggcgaagatggacggccaggtcaggaagggcctcgcgggctgacgggtcctcctggttcccgaggagagagaggagaaaagggagacgtaggttctgcagggctgaagggagacaagggggattcggcagtgatcttgggcccaccagggccgagaggggccaagggagatatgggcgaacgaggcccacggggtctggatggagataagggacccagaggtgacaatggggatcccggtgacaagggatccaagggggaacccggcgataaagggtctgcgggtctgccaggcctccggggacttctgggaccacaaggccagcctggagcagcaggcattcctggtgaccctgggtcgccaggtaaggacggcgtccccggtataagaggagaaaaaggagatgtggggtttatgggaccccgaggcctcaagggcgaaaggggtgtgaagggggcctgcggccttgatggagaaaagggagataaaggagaagccggcccacctggtagacctggcctcgcaggtcacaagggtgaaatgggtgagccaggagtgcctggacagagcggcgcccctggtaaagaaggacttattggacctaaaggagataggggcttcgacggtcaacctggcccaaaaggcgaccagggtgaaaaaggagaaagagggacccctgggattggaggtttccccggcccttcggggaacgatggttcggcaggccccccaggaccacctgggagcgtcggtccaagaggaccagaaggtctgcagggtcagaagggtgagagaggtcccccaggagaacgcgtggtgggagctcctggagtgcccggagctcccggggaacgcggagaacaaggacgtcccggacctgcgggtcctaggggtgaaaagggggaagcagctcttacggaggatgacatccgcggatttgtccgtcaagaaatgtcgcagcattgtgcatgtcaaggacagtttattgcatccggatcgcgaccactcccttcttacgccgcagatactgcgggttcacaattgcatgcagtccccgtccttcgagtgtcccacgcggaagaagaagagagggtgccccctgaggacgacgaatactccgaatactcggaatacagcgtggaagaataccaagatcccgaggcaccatgggattcagatgacccctgttccctccctctcgatgaaggttcctgcaccgcctacaccctgaggtggtaccaccgtgccgtgaccggatccactgaagcctgtcatcctttcgtgtacggaggatgtggaggtaacgcaaaccgttttggaactcgggaagcatgtgagagaagatgtcctccaagggtggtccagtcacagggaacgggaaccgcgcaagat

SEQ ID NO: 9621 - DNA, 8832 bp, Artificial Sequence
  Description of Artificial Sequence: Synthetic coding sequence
atgacgctccgactgctcgtagccgcgctatgcgccggcattctggccgaggctcctagggtgcgcgcacagcaccgagaacgcgtgacctgcacacgcctgtatgccgctgacattgtgttcctgctagacgggtccagctcaattggcagaagcaacttccgggaagtcagatctttcctcgagggcctggttctgccattttctggcgcagcttctgcacagggcgttaggtttgccacagttcagtactcagatgatccaaggactgagttcggcctggatgctctagggtccgggggcgacgtgattagagccattcgggaactgtcctataaaggcgggaacactcgcacaggagccgccattttgcacgtagctgatcacgtattccttcctcagctggcccggcccggcgtcccaaaggtgtgtatactaattacagacgggaaatcccaggacctggtggacactgccgcccagcgcttgaaaggacagggagtgaagttattcgctgtcgggatcaaaaatgctgatcctgaagaactgaaaagagtcgcgtcccaacctacgagtgactttttcttttttgttaacgatttcagcattctcagaacactgcttcccctcgtttcgcgccgggtatgcactacggccggaggcgtacccgtgacacgcccaccagacgactcaacgtctgcacctcgtgatcttgtcctctctgagccatcttcacaatccctgcgggttcagtggacagccgcctccggccccgtaacaggctataaagtgcaatacacacccttaacggggttggggcagccattaccatccgagcggcaggaagtgaatgtgcctgccggagagacgtcagtgaggctgcgcggcctgaggccactgactgaatatcaggtgactgttatagccctctacgccaactctattggcgaagccgtatcgggcaccgcaaggaccaccgccctggaagggccagagctcacaatacagaacacaactgcccactcactgctagtcgcctggaggagtgtgccgggagctacaggctatcgtgtgacctggagggttctgtctggcgggcccacacagcaacaggagctgggcccgggtcaaggtagtgtgttactcagggacctcgaaccagggacggattacgaagtcaccgtctccaccctcttcggtaggtcagttggacccgccacttcactgatggcacgtacagacgcctccgtggagcaaactcttaggccagttatcctgggtccaacttcaatactgctttcttggaacctcgtccctgaagcacgcggatatcgtctggagtggcggagggaaacaggccttgagccaccgcaaaaggtagttctcccatccgacgtgacgaggtaccaactggacggacttcagccagggacggagtatcgcttgacattgtacaccttgctggaagggcacgaggtcgcaacgcctgcaaccgttgtaccgaccggtccagaactgcctgtgtcacccgtgacagacctccaagccaccgagctgcctggtcaaagggtgcgagtgtcctggagcccagtgcctggcgctacacagtatagaatcattgtaaggtccacccaaggtgtggaaaggacactggtgcttccgggttctcagacagcattcgatctcgatgacgtccaggctggcctgagctatactgtccgcgttagtgcccgtgtaggtccccgggagggttcagcgtcggtcctgactgtacgtcgcgaaccagaaacaccactggctgtccccggattaagagtggtggtgtctgacgcaacaagggtccgagtggcttgggggcctgtgcctggcgctagcggcttccgcattagctggtctactgggtcgggaccagaatcttcacagaccctcccacctgactccactgccactgatattacagggctccaacccggaaccacttatcaagtcgccgtgtctgtgctgcggggccgcgaggaagggcccgctgctgttatcgtggcccgcactgacccactagggcctgtgaggaccgtgcacgtgactcaggcttcttcctctagcgtcacaataacttggacgagggtacctggtgccacaggttacagagtgagttggcactctgcacacgggcccgagaaaagtcagctggtgtctggcgaggccactgtagctgagctggatgggttggaaccggacactgagtacacagtgcatgtgcgggcccacgtggctggtgtggatggtccccccgcttccgttgtggtgagaacagcccctgagcctgtgggccgggtttccaggctgcagattctcaatgcaagcagcgatgtgctccgaattacctgggtcggcgtgacaggtgccactgcttataggctggcttggggcagatcagagggaggtccaatgagacatcaaatactcccaggaaataccgattccgctgaaattaggggcctggaggggggcgtcagctactccgttcgggtcactgcattggtgggggaccgagaaggaacccccgtgtctattgttgtgacaactccgcctgaggcccctcccgcacttgggactctgcacgtggtacagcggggggagcatagccttcgcctacgctgggaaccggtaccaagggctcagggctttttactgcactggcagcccgagggggggcaggagcagtctcgggtgctcggacccgaactctccagctaccatttagatgggctggaacctgcaacgcagtaccgagtgcgactgtcagtcttggggccagcaggagaggggccttcagctgaggtcactgctagaactgagtctccaagagttccctctattgaactgagagtagtggacacaagcattgactctgtgacgcttgcttggacccccgttagcagggcaagtagctacatactgagctggagacccttgcgtggccccggtcaagaagtgcctggatctccccagactctccccgggatatcttcatcccagcgggtgaccggcctcgaacccggggtcagttatatcttttccctcacaccggtgctcgatggggtgcgaggccctgaggcttcggttacccagacccctgtatgtcctcgggggctggctgatgtggtcttcctgcctcacgccacccaggacaacgcacaccgcgcagaggccacgcggagagtcttggagcgcctggtgctagctctggggcccctgggaccacaggccgtacaggtagggttgctgtcttactcgcatcgtcctagcccccttttccccctgaacggctcccatgacttgggcatcattttgcagcggatcagggatatgccgtacatggatccaagtggcaacaacttaggcacagcagtggtcaccgctcaccgttacatgctagcgccagatgcccctggtcgcaggcagcatgtcccaggtgttatggtgctcctggttgacgagcctctcaggggcgatatattttctcccattcgggaggcacaggcctctggactgaacgtggtgatgcttgggatggccggcgccgacccagaacagctcaggaggctggcacccggtatggattccgtgcagacatttttcgctgtggacgacgggcctagcctggaccaagcagtatcaggcctggcaacggcactatgccaggcatcatttactacacagccccgacctgagccctgtcccgtctactgtcccaagggccagaagggcgaacccggcgaaatgggtctgagagggcaggtgggacctccgggcgatccgggtttgcccggacgcaccggggcccccggaccccaggggcccccgggaagtgcaacagccaaaggcgaacgaggttttcctggggcagacggacgtccaggcagccccggaagagcaggaaaccccggaacacctggcgcaccaggtctcaaaggctcaccaggcctgccaggacccaggggcgatcccggtgagcgggggcccagaggacccaagggggagcccggagcaccagggcaggtcattggtggtgagggtcccggactcccagggaggaagggggatcctgggcctagtggtccacccggcccgcggggcccactaggcgacccaggtcccaggggcccccccggcctgcctggtacagctatgaagggggataagggagatcgcggcgaacggggtccacccgggcctggagagggcggaattgcccccggagaaccagggctgcctggcctgcccgggagtcccgggccacaggggccggtgggccctccagggaagaagggcgagaaaggcgattcagaggacggggcccccggcctcccaggccaacctggcagtcccggcgaacaagggccaagaggacctcccggagccattggccctaagggcgacagaggctttcccggtccactgggggaggcgggagagaaaggggagcgtggccccccaggacctgcaggctctaggggtctccctggcgtggctgggcggcccggagctaaaggaccagaagggcctcccggtcccaccggtcgccagggggagaaaggcgagcccggccgcccaggcgaccctgctgtcgtggggcctgccgttgccggccctaagggcgaaaagggcgatgtgggcccagccggaccccggggcgcaacaggagtccagggtgaaagaggtccaccaggtttggtactgcctggtgacccaggacccaagggtgaccccggtgatcgaggtcccattggccttaccggcagggccggaccccccggagattcaggaccaccaggcgaaaagggcgaccctgggcgaccaggtcctcccgggccggtcggccctcgcgggcgcgatggcgaggttggggagaagggagacgaaggaccgcctggtgatcccgggcttcccgggaaggcaggggagcgcgggctgaggggagctccgggcgttcggggacccgtgggagaaaagggcgaccagggcgaccctggggaagatggtcgtaacggcagccctggttcatctggcccgaagggtgaccggggcgagcccggtccccccggcccaccaggaaggcttgtggacactggccctggagcgagggagaaaggtgagcctggagataggggccaggaagggcctaggggtccgaaaggagaccctggactgcccggtgcgccgggcgagaggggcatcgaggggtttagagggccccctggccctcagggcgatccaggggtgcggggaccggccggtgagaaaggagataggggacccccgggactcgacgggcgctcaggacttgatggaaagccaggcgccgccgggcccagcgggccaaacggtgccgcgggtaaggcaggagaccctggaagggacggcttgcccggactcagaggggaacaaggcctgcccgggccatccgggccacccgggctgccgggtaagccaggagaagacggaaaacctggactgaacggaaaaaacggggagcccggggaccctggagaggatgggcggaaaggtgaaaaaggcgatagcggtgcatccggtcgggaagggcgtgacggcccaaaaggggaaaggggggccccaggtatcttaggtccacagggcccccccggcttgcctgggccagtcggcccgcctgggcagggttttccaggcgtgcctgggggcaccggacctaagggcgaccggggcgaaaccggctccaaaggggaacaaggactaccaggtgagagaggactcaggggcgagcccggatccgtgcccaacgtcgataggctgctggagactgctggtatcaaagcatccgcacttcgcgaaattgttgagacctgggacgaatcctccgggagttttctgccggtccccgagaggcggcggggacccaaaggagactccggcgagcaggggcccccaggaaaagaaggccccatagggtttcctggggagcgaggcctgaagggtgatcggggagacccagggcctcaggggccacctggactggccctaggcgagagagggcctcccggaccatcaggtctagccggagaacccggaaaacccggcatcccaggcctgcccggcagggctggcggggtgggcgaagccggccgtcctggagagagaggggaacggggagagaagggcgagcgcggcgagcagggcagggacgggccacccggactgcccgggactccaggtcctccaggtccccccggaccaaaagtgtcagttgatgaacccggacccggcctttcaggtgaacaggggcctccagggctgaaaggggcgaaaggggagccagggtccaacggcgaccagggaccgaagggtgaccgcggggttcctggaatcaagggagatcgtggggaacctggccccaggggacaggacggcaatcccggattgccgggcgaaaggggaatggctggaccagagggcaagccaggactacagggccccagggggccccccggcccagtgggcggtcacggggaccccgggcccccaggcgcccctgggctggccggacctgctgggccacaggggccttccggcctgaaaggggaacctggagagactgggccccccggtcgcggcctgacaggccccactggcgcggtcggtcttcccggacctcccggaccgagcggcctggtagggccacagggaagccctggtctgcccggccaggtgggagaaaccggtaagccaggcgcaccgggtcgtgatggggcatctgggaaagatggggatagagggagtcctggcgtcccagggagcccaggactgccaggccccgtgggaccaaagggcgaaccaggcccgaccggtgcccctggtcaggccgtggtgggtctgccgggcgctaaaggcgagaagggagcacctggcgggctggctggagatctagttggagagccgggcgcgaagggagatcgcggcttgccgggtcctagaggagaaaaaggggaagccggaagagccggcgaaccaggggatcccggggaggacggccagaaaggggcccccggacccaagggtttcaaaggcgacccaggcgtgggtgttcctgggagccccggcccccctggcccgccaggagtcaagggggacctcggattacccgggctgccgggcgctcctggcgtcgttggctttcctggacagacgggaccacgcggggagatgggacagcccggaccctccggtgagaggggcttagccgggcccccgggccgggaggggatccccgggccgctggggccacctggtcccccagggtctgtgggccccccaggcgccagcggcctaaaaggtgacaagggcgatccaggggtcggcttgccaggcccacgaggagagcgaggggaaccaggcatcaggggggaggacggtagacctggccaggaagggcccaggggcctaaccggcccaccaggttctcggggcgaacgcggagaaaagggcgatgtcggaagcgccggcttgaagggtgacaaaggcgacagcgccgtcatcctaggacccccaggccctcgcggagccaaaggcgacatgggagagagagggcccagagggctcgatggcgacaagggacctcgcggtgataatggcgatcctggagataaaggcagcaagggtgagcctggagataaaggatccgccggattaccagggctgagagggttactcggaccccagggacagcccggtgctgccgggatcccgggcgaccctgggagccccgggaaggacggcgtgccgggaattagaggggagaaaggcgatgttggtttcatgggccccaggggcctgaaaggcgagcgcggggttaaaggagcgtgtggcctggacggcgagaagggcgacaaaggggaagcaggaccgcctggccgtcctggtttggcggggcacaaaggagagatgggtgaacccggtgtacccggacagtcaggggcaccaggaaaggagggcttgatagggcccaagggcgataggggctttgacggacagccaggtcccaagggtgaccaaggcgagaagggagagaggggaacacctgggatcggcggtttcccagggccctccggaaatgacggaagtgcgggacccccgggacctcctgggtctgtgggtcccaggggccccgagggcctgcagggccagaagggcgagagggggcctcctggcgaacgcgttgtcggcgcccctggggtgcctggcgccccaggcgagagaggcgagcagggccggccgggaccagccggcccaaggggcgagaagggggaagccgcgctaactgaagatgatataaggggcttcgtccgccaggaaatgtcacagcactgcgcatgccagggccagttcatcgccagcggatcgagacctttgcctagctacgctgcagacacggccgggtcacagttacacgctgtgcctgttttacgagtctctcatgccgaggaagaagaacgagtgccccccgaggatgatgaatacagcgaatattccgaatactccgttgaggagtatcaagaccctgaggccccctgggattctgacgacccatgcagcctacccctggatgagggctcctgcacagcctataccttgcgctggtaccatcgggccgtgaccggcagcacagaggcctgccaccccttcgtgtacggcggctgcggcggcaacgcgaacagatttggcacccgtgaggcctgtgagcgtcgatgtccacccagagttgtgcagtctcagggcacgggtactgctcaggac

SEQ ID NO: 9622 - DNA, 8832 bp, Artificial Sequence
  Description of Artificial Sequence: Synthetic coding sequence
atgactctgagattgctggtggcagccctgtgcgcaggaatactcgctgaggcaccacgggtgagggcacaacaccgcgaaagggtgacctgtaccaggctgtacgcggctgacatagtgttcctcctcgacggatccagtagcatagggaggagtaactttcgtgaagtgagatctttcctggaggggctggtcctgccattcagcggcgcagctagtgctcagggagtccggtttgctaccgtgcagtacagcgacgatcctcgcactgagttcggactcgatgcactgggctctggaggagatgtgatacgggcaattcgcgagctttcttacaaaggcggcaacaccagaaccggcgctgctatcctgcatgtcgcagaccacgtgttccttccgcaactcgccaggcccggcgttccgaaggtgtgcattctaattactgacggaaagagccaggatctcgtcgacacagcagctcagaggcttaaaggccaaggagtcaagctgttcgcagtcgggattaagaatgcagacccagaagaactgaaacgcgtagcctcacagccaaccagcgacttcttcttttttgtcaacgatttcagcatcttgagaaccctgttgcccttggtaagcaggagggtgtgcaccaccgctgggggagtcccggtcactcggccccctgacgatagcacgtcagccccaagggatctggttctgtcagaacctagcagccagagtcttagggtccagtggaccgctgcctccggtcctgtgacaggatacaaggtgcagtacactcccctaactggcctggggcagcccttgccgtctgaacggcaggaggttaacgtgcctgccggcgaaacctctgtgcggctgagggggcttaggcccctcacagagtaccaggtgaccgttatcgccttgtatgccaatagcatcggcgaagccgtcagcgggacggctaggaccaccgctctcgaagggcccgaattgaccatccagaacacaaccgcccattccctgctggtagcctggagatctgtgcccggagcgaccggataccgtgtaacttggagggtgttgagcggaggaccaactcaacaacaagagctgggcccgggacagggctctgttctgttgagggatcttgaacctggaactgattatgaagtcacagtgtctaccctgttcggacgctctgtgggcccagctacttcgttgatggctcgcaccgatgctagtgtggagcagaccttgcgccccgtgattctgggacccacatctatcctcctcagctggaatctagtgcctgaggcacgtgggtaccggcttgagtggagaagggagacagggctggagccaccacagaaggtggtgcttccaagcgacgtgactcggtaccagctggatggccttcagcccggcaccgagtacaggctgaccctttacactcttctcgaggggcacgaggtcgcaacacccgcgactgtagtccccaccggtccagaacttcctgtgtcccctgtgactgacctgcaagctactgagctgcccggccagagggttcgcgtgtcatggagtcccgttccaggcgctacccagtatcgcatcatcgtcagaagcacgcagggagtcgagcgcactctggtcctccctggaagccagacggcatttgatctggatgatgtgcaggctggcctgagctacaccgttcgtgttagtgctcgggtgggaccccgcgagggaagcgccagcgtgttgaccgttaggagagaacccgaaaccccgctcgcagtcccgggcctgagagtagttgtctccgatgctacccgcgttagggttgcatggggtcccgtgcctggggcatcaggctttcgcatcagctggtcaaccggcagcggacctgaatcttctcagacactccccccagactcaacggctactgacatcacgggtcttcagcctggaaccacataccaagtagcggtgagtgtgctgcgcggccgcgaagaagggccggctgcagtcatcgtggctagaaccgacccactcgggcccgttagaactgtgcacgtgacccaggcatccagctcttctgtcacaatcacttggacccgggtccctggtgcaacaggctacagggtaagctggcactctgctcatggccctgagaagagccagctggttagcggtgaagcaaccgtcgcagagcttgatgggctcgagcctgacaccgaatacacggttcacgtgagggctcacgtggctggcgtggacgggcctcccgcaagcgttgtagtccgcactgctccagagcccgtaggacgcgtttctagactgcagatactaaacgcgagtagcgacgtgcttagaattacttgggtgggagtgacaggggcaacagcctacaggctggcttggggcagatccgaaggaggcccaatgcgtcatcagatcctgccaggcaacaccgattcagctgaaattcgcggacttgagggtggcgtatcatattccgtgagggtgaccgcactcgtgggcgatagagaaggaactcctgtcagcatcgtggtcaccacaccacccgaggcaccgcccgcccttggcacactgcatgtagtgcaaaggggcgagcattcactgcgcttaaggtgggagccagtgccaagagcacagggattcctattgcactggcaacctgagggtggacaagaacagtctcgcgtgcttggacctgagctgagtagttatcatctggatggactcgagcctgctacacagtaccgagtgagacttagtgtccttggacccgctggcgagggcccaagcgctgaggtgacggcccgtaccgagtcacccagggtgccaagcattgaactgcgggtggtcgatacatctatcgattctgtgaccctggcttggactcccgtgagcagggcatccagttacatcctcagttggaggcctttaagggggcctgggcaggaagtcccaggcagccctcagacacttccaggtatctcatcttcccaacgtgtaaccggtctcgagcccggggttagttatatattctctctgaccccagtacttgatggcgtgcggggccccgaggcctcagtgacgcagacgccagtgtgtcctagaggccttgctgatgtcgttttcctaccccacgctacacaagataacgcccaccgcgcagaagccactcgccgtgtgctggagagactggtcctggccctgggcccactgggcccacaggccgttcaggtgggcctcctgtcatattcccacaggccttcacccctcttccccctcaacgggagccatgacctcggcataatcctccagcggatccgcgacatgccttacatggaccccagcggcaacaatctcggaacggctgtcgtgacagctcacagatacatgctggctcccgatgcccctgggcgccgtcagcatgtgccgggggtcatggttttgttggtcgacgagcccctcagaggcgacatttttagtcccatcagggaagcacaagcgagcgggctcaacgtggttatgcttggaatggcgggagcagatccggaacagttacgaaggctggcccctggcatggacagcgtccaaacgttttttgcagtcgatgacggaccctccctggaccaggccgtatctgggctggccacagctctctgtcaggcgtcctttacaacgcagcctagacccgaaccttgccccgtgtactgccccaaaggacagaagggggagcctggcgaaatgggtctccgcggccaagtaggaccccctggtgatccaggacttccaggaaggactggggccccgggcccccagggtcctccgggctcagctaccgcgaagggcgaaagaggatttcccggagcagatggcaggcccggctcacctggacgggccggaaacccaggtactcctggagctccgggcctgaagggctcacccgggctcccaggtcctcggggcgatccaggagagcgcggtccacgcggccccaagggagaaccaggcgcccctggacaggtcataggaggtgagggccccggacttcccgggagaaagggcgatccagggccaagtggaccgccaggcccaaggggacccttaggagaccccggccctagaggaccacccggcttgccaggcaccgcaatgaaaggagacaagggagataggggagaacgggggccgcccggacccggagaaggcggaatcgcgcccggggaaccaggactgcctggattgcccgggagtcccgggccacagggccccgtcggccctcctggtaagaaaggggagaaaggagattcggaagacggagcaccaggcctgcccggtcagccaggttcacctggagagcagggtcccagaggcccgcctggtgccatcggacccaagggtgaccgcgggtttccaggccccttgggcgaagcgggcgagaaaggagaaagaggcccacctggacccgctggctcaagaggactcccaggggtagccggaaggcctggtgccaaagggcccgagggccccccgggaccgactggaaggcagggcgaaaaaggcgaacccggacgacccggggatccagccgtcgtgggaccagctgttgctggcccaaaaggcgaaaaaggagacgtgggacctgccggaccgagaggggctactggagtgcagggcgaacgcgggccgcctgggctcgtgctgccaggcgaccccggccctaaaggcgatcccggcgataggggcccaatcggcctcacaggcagagcagggccacctggcgattcgggccctccaggagagaaaggagatccagggagacctggaccgccaggacctgttggacctagaggtagggacggagaggtgggagaaaaaggagacgaaggacctccgggagaccccgggctgcctggcaaagcaggagaacgaggacttcgaggggctcctggagttagggggccagtgggggagaaaggagaccaaggagatcctggcgaagatggcagaaatggctcaccaggatctagcggtcccaaaggggacagaggcgaacccggaccccctggacctcccgggcgtctcgttgataccggcccaggcgcccgcgagaaaggagagcccggcgaccggggacaggaaggacctagggggcctaaaggagatccagggctcccaggtgctcctggagagaggggcatagaagggtttagagggccgccaggccctcaaggcgacccaggcgtgagaggccctgccggggaaaagggagatcgcggaccccctggattggatggcagaagcggactcgatggcaaacccggagctgctggacctagcggacccaatggagcagctggcaaagccggagatccgggccgagatggcctgccaggactgagaggagagcagggacttccaggaccttcaggtcctcctggcctgccaggcaagcctggagaggatggaaagcccggcctaaatgggaaaaacggcgaacccggcgatcctggcgaagacggaagaaagggagagaaaggagatagtggagcttccgggcgcgaaggaagagatgggccaaagggggaaaggggtgctcccggcattcttggcccgcaagggccaccgggactccctggcccagtgggccctccgggtcaagggttcccaggagtccctgggggcacgggccccaaaggggatcgtggagagaccgggtctaagggtgagcagggacttccaggagagaggggcctccgaggagaacctggctcggtaccaaacgtcgatcgcctgctggagacggccggaatcaaggcttctgccctgagagagattgtggagacctgggatgaaagctctggaagctttctcccagtgccagagcgtaggcgtggacctaaaggggattctggggaacaggggcctcccggtaaggagggacctattggatttccaggggagcgcggtttgaaaggcgatagaggcgatccgggtccacagggaccccccggcctcgcgcttggagagcggggaccccccggcccttccgggcttgcaggcgagcctggaaagcccggcatccccggactgcctggcagggctggcggagttggagaagccggacggcctggagaacgcggagagcgaggcgaaaagggcgagcgtggcgaacaggggcgggacgggccccccggccttccaggcacgcctggcccccctggcccacctggcccgaaggtttcagtcgacgaaccaggtcccggtctgagcggggaacagggaccacccgggctcaagggggcaaaaggcgagcctggctctaacggcgatcaagggccgaagggagaccgcggtgttcccgggatcaaaggcgacagaggcgagccgggaccgaggggccaagacggcaacccgggtttgcccggcgaacgaggtatggctggtcctgagggcaagcccggcctccagggccccagggggccacccggtccagtaggcggccacggagatccgggaccgcctggtgcacctggactggctggtcccgccggcccacagggcccctccggtctgaaaggcgagcccggagaaacagggccccctggaaggggattgacagggcccaccggcgctgtgggacttccaggcccacctggaccttcaggcctggtcggacctcagggaagcccagggctgcccggtcaagtgggcgagaccggcaaacctggggctcccggccgggacggagccagcgggaaggatggagataggggaagcccaggcgtgccgggatcacccggcctgcctggcccagtcggacctaagggcgaacctggccctactggcgcacccggacaggcagttgtcgggctgccgggcgccaaaggcgaaaagggagctccaggcggacttgcaggagacttggtcggagaaccaggagccaagggggatagaggactgccgggccctaggggtgagaagggcgaagcgggaagggcaggcgagccgggagaccccggtgaggatggccaaaagggggccccagggcccaaaggctttaaaggcgacccaggagtcggggtacctggaagccccggtcctcctggacctcccggcgtgaaaggagatctgggcctgcccggactccctggcgctccaggagtggttggattccccggtcagaccggaccacgcggggagatgggccaaccaggtccctcaggtgagaggggccttgccggcccaccggggcgtgaggggatccccggacctcttggacctcctgggccccctggatcagtggggcccccgggcgcatctggacttaagggagacaaaggcgaccctggcgttggcctgcctggccctcgcggagagagaggagagcccggaataaggggagaggatggaaggcccggacaggaaggacccagggggttgactggaccccctgggtcaagaggcgagagaggtgagaaaggtgatgtggggtccgcgggactgaagggagacaagggggactccgcagtgatattgggaccacctggaccacgcggcgcaaaaggcgatatgggagaaagaggcccccgcggcttggatggagacaaaggaccgaggggcgacaatggagatcccggagacaaaggctcaaagggagagccaggagacaaagggtctgccggcctccccggcctgagaggacttctgggcccccaaggccagcccggagcagcaggcatccccggcgaccctggctcgcctggtaaagatggcgtacccgggattaggggcgagaaaggagatgtgggcttcatgggccccagggggctgaaaggcgagaggggtgtcaaaggagcgtgcggcctggatggcgagaagggtgataagggcgaagctggaccaccgggtagacccggactagcaggacacaagggagagatgggtgaaccaggagtgcctggacagtctggcgctcctggtaaagaggggctgatcggccctaagggagatagaggatttgatggacagcctggacccaagggcgatcagggggagaagggggaaaggggcacacctggaatcggcggcttccccggtccgagtggaaatgatgggtctgcaggcccacctggacccccagggagtgtgggcccacgcggccccgagggtcttcaaggccagaaaggcgaaagggggccaccaggagagagggtggtgggcgcacctggcgtcccaggcgcacctggcgagaggggagagcaaggaaggcccggccctgctggccctaggggtgagaagggagaagctgcattaaccgaggacgacatcagaggcttcgttcgccaggagatgagccagcactgtgcatgtcagggccaatttatcgcttccgggtccaggcccctgccctcttacgctgctgacactgcaggttcacaactgcacgctgtccctgtgctgcgcgtgagccacgccgaggaggaggagagagttcctcctgaggacgatgaatattctgaatactccgaatacagtgtggaagaataccaggaccctgaggccccctgggactcagacgacccatgttccctgccattggacgaggggtcctgcacagcatacactctgagatggtaccaccgagcagtaaccggaagcactgaggcttgtcatcctttcgtatacggaggttgcggtggcaatgcaaacagattcggaacacgagaggcatgtgagagacgttgtccacctcgcgtcgtgcaatcacagggcaccggcacggcgcaagac

SEQ ID NO: 9623 - DNA, 8832 bp, Artificial Sequence
  Description of Artificial Sequence: Synthetic coding sequence
atgaccctcagactgctggtggcggcgctgtgcgcgggtattctggctgaagcccccagagtccgggcccaacacagagagcgggtaacctgcaccaggctgtatgccgcggacatcgtttttctgctcgacggatctagctccattgggcgcagtaacttccgcgaggtgaggagctttcttgaaggcttggtcctcccttttagcggagcagcatctgcacagggggttaggttcgccacagtgcagtactcagatgacccgcgcaccgagtttgggctggatgcactaggctccgggggtgacgtgatcagagccattagagaactgtcttacaagggcggcaataccaggacaggagcagctattctgcatgtggccgatcatgtctttttgccacagctggcccgaccaggcgttccaaaagtgtgtatacttatcacagacggtaagtcccaagacctcgtggacacagcggcccagcggttaaagggacagggcgtgaaactcttcgccgtgggaattaaaaatgccgatcccgaggagcttaagagggttgcgtctcagccaacatcggatttctttttctttgtgaacgatttctccatactgcggactctgctccccttagtaagccgacgagtttgtactaccgccggaggtgttcctgtgacaaggcccccagacgattcaacaagtgcccccagggaccttgtgctctcagagccttcttcccaaagcctgcgcgttcagtggacagcagcttccgggcctgttacaggatacaaggtacagtatacaccccttaccgggctggggcagccacttccaagcgagcgacaggaagtgaacgtacccgccggcgagacgtccgtgcggctgcgtggactgagaccactgaccgaataccaggtgacagtgatcgctctgtatgccaatagcataggtgaggccgtgagcggtaccgctaggacgactgctctggaagggcctgaactgaccatacagaacacaaccgcccattcgttgttagtggcgtggcgctcagtacctggcgcaacaggatatagagtaacatggcgcgtgctgagtggagggcccacccaacagcaggagctgggtcccggccaaggcagcgtgctgttacgtgatctggaaccagggaccgattatgaagtgactgttagcacactcttcgggcggtctgtggggcctgcaacgagtttgatggcacgcaccgacgctagcgttgagcagacattaagaccagtgattttggggccaacaagtattctgctgagttggaacctggtgccagaggcacgcggatatagattggagtggagaagagagacgggtctggagcctccccagaaggtggtgcttccgagcgatgtcacgaggtatcagctagatggcctgcagcccggaaccgagtatcgcctcactctctacactctgctggaaggccacgaagtcgcgacaccagctaccgtggtgcccactggacccgagctccctgtgtccccagtcaccgatttgcaagctaccgagctccccggtcaacgggtcagggtgtcctggtcccctgtcccaggggccactcagtacaggatcatcgtgcgttctactcagggcgttgagcgtacactggtgttacccggatctcagaccgccttcgaccttgatgatgtgcaggctggcttgtcctataccgtccgcgtctccgcgcgagtggggcccagggaggggagcgccagcgttctaaccgtaaggcgcgagcccgagactcccctggccgtgcctggactacgcgtggtggtgtctgacgccacacgagtgcgggtggcctggggtccggtgccgggtgcctccggctttcgcatttcttggtctactggcagtgggccagagagttcccagaccttacctcctgactctacggccacagacattaccggcctgcagcccggcacgacttatcaggttgccgtgtccgttctgcgaggtagagaagaaggcccagctgccgttatcgtcgccagaacagatccacttggccctgtccgtaccgtgcacgtgactcaggcgagctcctccagcgttaccattacatggaccagagtgccaggagcgaccggctatagggtgagttggcattctgcccatggccctgaaaaatctcagctggtcagtggggaagcaaccgtggcggaacttgatggactggaacccgacaccgagtacaccgtacatgttcgggctcacgttgcgggcgtcgacgggcctcctgcctcggttgtggtgagaactgcgccagagcccgtcggccgcgtctcacggctgcagatcctgaacgcctcttccgatgtcctgcgaatcacctgggtgggcgtgaccggggcgacagcctacaggctcgcctggggccgttcggagggaggccctatgcgccatcagattttaccaggtaatacggattcagctgaaatcaggggtcttgaaggaggagtttcttactcggtaagggtaacggccctggttggcgacagagaggggacaccagtcagtattgtagtgactacgcccccggaggccccacccgcgctgggtacgcttcatgtggtacaaagaggtgagcacagtcttcggttacggtgggaacctgtgccccgcgcccagggctttctcctccattggcagccagagggtggacaggaacagagccgcgtcctcgggccagagttatcgtcctaccacctggacggattggaacctgccacacagtatcgcgttagactttctgtcctgggaccagcaggagaaggacccagcgccgaggttaccgctcgcaccgagagtccacgagttccaagcatagaattaagagtggtcgatacatcgatcgacagcgttaccctagcatggactcctgtgagtcgtgcctccagctacattttatcctggcggccattgaggggcccgggacaggaggtcccaggcagcccacagacactgcccggaattagtagcagccagcgtgtgactggcctcgagcccggagtctcctacatcttttccctgacccccgtactggacggagttcgcggccccgaagcatccgtcactcagacacctgtgtgtcctagggggctggcagatgtggtttttttgcctcacgcgactcaggacaacgcccaccgagccgaggcaacaaggcgagtactggaacggctggtgctcgcactggggccgctggggccccaggctgtgcaggttggactgctgtcctacagccatcgaccttcaccactgtttcctttaaatggttctcacgatttaggtattatcctccagcggatccgagatatgccgtacatggacccctctgggaataacttaggcaccgccgttgtgactgcacatcgatacatgctggcaccggacgctccaggcagaagacaacatgtgcctggtgtgatggtgctcctggtggacgagcctctgcgcggcgatatctttagccctatccgggaagctcaggcgagtggtcttaacgtcgtgatgctgggcatggccggtgcggatcccgagcagctgcggcgcttggcacccggaatggattcggtgcagactttcttcgctgtcgacgatggcccctcgcttgatcaggctgtaagtgggctggctactgctctgtgtcaggcgtccttcactacacagccccgacctgagccttgccccgtttactgtccgaagggacagaagggtgaaccaggcgaaatgggtttgcggggtcaggtcgggccgcccggtgaccccgggcttccagggcgaaccggcgctccagggccgcaagggccgccaggttcagccaccgccaaaggagagcgcgggttcccgggggctgatggcaggcccggctcccctggccgcgctggaaatcctgggaccccaggggcgcctgggttgaagggatcccccggtcttcccggtccccgcggcgaccccggggagcgcgggccccgcggacctaagggagagcctggcgcgcctggccaggttattggaggcgagggtccaggcttgcccggccgcaagggggacccgggaccaagcggccctccggggccacgggggcctctcggcgatcccggccccagggggcctccagggctgcctggcacagctatgaaaggtgataagggcgatcggggagagagaggtcctccaggaccaggggaagggggcatcgcgcctggagagccagggctgcctggacttcctgggagccccggtccccaggggccagtcggaccacccgggaagaaaggggagaaaggagatagcgaagatggcgcccctgggcttccaggtcaacccggatcaccaggtgagcaaggacctcgcggacctcctggcgccattggacctaagggggatagaggcttcccaggcccattgggcgaggccggcgagaagggggagcgagggcctcccggccccgctggcagtaggggcttgcctggagtggcaggccgtccaggagctaaggggcccgaagggccaccaggccccacaggaagacagggagaaaagggcgaaccaggacgaccaggagatcctgctgtagtgggtccagccgttgcaggtcctaagggagaaaagggagacgttggccctgcagggcctcgaggagcgaccggcgtgcagggtgagcgcggccccccagggttggttctgccgggagatcccggaccaaagggtgacccaggcgaccgaggcccaatcggtctgaccggacgcgccggtccaccgggagatagtggtccgcctggcgaaaagggagacccggggaggccggggcccccaggcccggtcggccctcgaggccgcgacggggaggtgggcgaaaaaggggacgagggaccgccaggagacccaggcctccccgggaaggcaggagaaagagggctcagaggcgccccgggcgtgcgtggaccagtgggggaaaagggagatcagggagaccctggagaagatggccgcaatggaagccccggctcatcagggccaaaaggcgataggggcgaacccgggccgcccggtcctcctggacgcttagtagacacagggcccggggcaagagaaaagggcgagcccggcgatagggggcaggagggacccagaggacctaaaggcgatccaggcctccccggcgcccccggcgaacgcggaattgaaggtttcaggggaccacccggcccccagggggatccaggagtgaggggaccggccggggagaaaggagacaggggccccccaggactggatgggagatcagggctggacggcaaacccggcgcagccggaccgtctggcccgaatggagcagccggcaaggcaggagaccccggtcgggacggcctgcctggtttgaggggagagcagggcctgccaggaccgtcggggccgccaggacttcctggcaaacccggggaggacggtaaaccaggactcaatgggaaaaatggggaacctggggaccctggtgaggatggtcgaaagggagaaaagggcgatagcggagcaagcggcagggaaggccgcgatggccccaagggcgagagaggagctccaggaattttaggtcctcagggaccaccgggcctgcctggccccgtgggtcctcctggccaggggttccctggagttcccgggggcacgggccccaagggagacaggggcgaaaccggaagcaaaggagaacagggactgcccggtgagcgcgggctgaggggtgagccaggttcagttcctaatgtggacaggctgcttgagaccgcagggatcaaagctagtgcactgagggagattgtggaaacctgggatgagtccagcggaagcttcctccccgttccggaaaggcggcgtggaccgaagggagattctggggagcagggaccgccaggcaaagaggggcccatcgggtttcccggagaacgtggactgaaaggtgatcggggtgacccaggacctcagggccctcccggtctcgccttaggcgaacgggggcctcccggcccttccgggcttgccggtgagcccggtaaacctgggatcccaggacttccaggacgggctgggggagtgggggaggccggccggcccggcgaaaggggagagaggggagagaaaggcgaacggggggagcagggacgagatggacccccaggactacctgggacacctggtcctccaggccctcccggacctaaagtcagtgtagacgaacctggccccggactcagcggcgagcagggacccccagggctgaaaggggcgaagggagaacctggctcaaacggcgaccaaggaccaaaaggggatcggggggtgccggggatcaaaggagacaggggtgaacccgggccccggggccaggacggtaaccccgggttgccgggagagcgggggatggcagggccggaagggaaacctggattacagggccccaggggtcctccagggcctgtggggggacacggagaccccgggccaccaggtgccccgggactcgccgggccagccggtccccagggcccgagcgggctaaaaggggagccgggcgagaccggccctcctgggagaggcctgacagggccaaccggggccgtgggattgccgggaccccccggacctagcggcctcgtgggcccacagggttctccagggctcccgggccaagtcggcgagactggcaagccgggggccccaggaagggacggagccagcggaaaggatggcgatcgaggctctccaggggtgcccggctctcctggactgcccggacccgtggggccaaagggtgaacccggtcctacaggcgcgccagggcaggcggtggtgggactccctggcgccaagggggaaaagggagccccaggggggttagctggtgatcttgtaggagaacctggggccaagggtgatcgcggacttcctggccctcggggcgagaagggggaagccggccgggctggagaaccgggcgatccaggcgaggatggacagaagggggctccagggcctaagggcttcaagggggaccctggagtaggagtgcctggaagccctggaccccccggacctccaggtgtaaaaggcgacctcggtctgcccggcttgccaggggcccccggcgtggtgggatttcccggccagacaggcccacgaggcgaaatgggacaacccggaccatcaggggaaagagggctagctgggcccccgggccgcgagggcattccagggccactaggacccccggggccgccgggctctgttggaccccctggggcttctggccttaagggagacaaaggcgaccctggtgtaggactccccggaccgagaggcgaaaggggggaacctggaatacggggcgaagatggccgtcctgggcaggagggccccaggggcctgacagggccacccggctcccgaggcgagagaggagaaaaaggcgatgtaggctcagcaggcctgaaaggggacaagggggatagcgcagtgatcttgggtccaccgggccctagaggtgccaaaggggacatgggagagcgcggaccacgtgggctcgacggagacaagggacctcggggggataatggggaccccggagacaagggcagtaaaggtgaacccggagataaagggagcgccggcttgccgggattgagggggctgctgggaccacagggacaacccggggctgcgggcatccccggggaccctgggagtcctggcaaggatggtgtgcccgggatcagaggggagaaaggggatgttggattcatgggtcctcgcggactcaaaggggaacggggggtcaagggtgcttgcggcttggacggcgagaagggcgataaaggggaggctggccctcccggcagacctggtctggccggacacaaaggcgagatgggcgaaccgggcgtgccagggcagagtggcgccccaggaaaagagggactgattggccctaaaggcgacaggggttttgacggtcaaccgggccccaaaggcgaccagggtgagaagggggagcgcgggacaccgggcattggcggcttccccggtccatcgggcaacgacggatcggcaggacctcctggccctccaggatctgtgggccccaggggcccagagggtttgcagggccaaaagggggagaggggaccccctggggaaagagttgtgggtgcaccaggggtacctggagcgccaggagagaggggggagcaggggcgaccaggccctgctggaccgagaggcgagaagggagaagctgccctgacagaggatgatattagaggatttgtacgacaggagatgtctcagcattgcgcctgccagggacagttcattgcaagcggcagcaggcctttacccagctacgccgccgacaccgcgggtagtcagctgcacgctgtgccagtgcttagggtcagccacgccgaggaggaggaaagagtgcctccagaagatgatgaatatagcgaatactctgagtattctgtggaagagtaccaggatccagaggccccctgggattcagacgacccttgctccctgccgcttgacgagggcagctgtactgcgtacaccctacgctggtaccaccgcgccgttacgggatcaacagaagcctgtcacccttttgtgtacggaggctgcggcggaaatgcaaaccggttcgggacgcgcgaagcgtgtgagcggcggtgtccacccagggtcgtgcagtcacaggggactggcaccgcccaggac

SEQ ID NO: 9624 - DNA, 8832 bp, Artificial Sequence
  Description of Artificial Sequence: Synthetic coding sequence
atgaccctgaggcttcttgtcgcggcgctgtgtgcaggaattctcgcagaagcgcctcgggtcagggcacaacacagggagcgcgtgacctgcactcggctctacgccgcggatatagtgttcttgctcgacggctcatcctcaataggcagatcaaactttcgcgaggtgcgctcatttctggaaggactggtgcttcccttttcaggtgccgcaagcgcacagggggtccggttcgccactgtccaatatagcgatgacccccgtaccgaatttggtttggacgctctgggatccgggggtgatgtgattagagccattagagagctttcatacaagggagggaatactcgcactggggctgcgattcttcatgtggcagatcatgtgtttctgcctcagcttgcgcgccctggagttcccaaggtctgtatcctcattacggacggtaagtcgcaagatctggtcgacacggcagctcagagactcaaaggacagggggtgaaactttttgcagtaggaattaagaacgctgatccagaggaactcaagagagtagcaagccagcctacttccgactttttcttttttgtgaacgattttagcatcctccgaactctgttgccgcttgtgagcagaagggtgtgtaccactgcaggcggggtgcctgtcactagacctccagatgattcgacgtcagcaccacgcgatctggtgctgagcgaaccaagcagccagtcgcttagagtgcagtggactgcagcctccggccccgtgaccggatacaaggttcaatacactccactgactgggctcggacagccacttccaagcgaacgccaagaagtgaacgtgcctgcaggtgaaactagcgtcagacttagagggctgaggccgctgaccgagtaccaggtgaccgtcattgccctgtacgcaaattccattggagaggcagtttccggaaccgcacggaccaccgccttggaaggtccggaacttactattcaaaataccactgcgcattctttgttggtggcttggcggagcgtcccaggagcaacgggttacagagtgacgtggcgagtcctttcaggaggacctacccaacaacaggaactgggacctggtcaaggctcggtccttcttcgggatctggagcctggaaccgattacgaagtgaccgtgtcaaccctgttcggacgctcagtggggcctgcaacttcgcttatggccagaactgatgcaagcgttgaacagactcttagaccggtcatacttggtcctacttcaatactcctttcgtggaacctcgtccctgaagcaagaggttaccggctcgaatggagacgggaaactgggctggaacctccacagaaggtggtgcttccttccgatgtcaccaggtaccagctggacggattgcaacccgggaccgaataccggctgaccctgtatactcttctcgagggccatgaggtggcaacccctgcaacggtcgtgcctaccggaccagaactccctgtgagccccgtcaccgatctgcaggccaccgagctgcctgggcagagagtcagagtttcgtggagcccggtgcccggcgcaactcaataccgaattatcgtccgctccacccaaggcgtggaacggacgctggtgttgccaggaagccagacggctttcgatctggatgatgtgcaagcaggactctcgtacactgtccgggtgtcagcacgcgtgggaccgcgtgagggtagcgcatccgtcttgactgttagacgagaaccggaaacgccccttgccgtgcccggacttagggtggtcgtaagcgatgccacgcgcgttcgcgtggcgtggggacctgtgcccggagcaagcggcttcagaatttcatggtcgactggatccggtccggagtcctcgcaaactctgcctccagatagcaccgcaactgacatcaccggactgcaaccaggtaccacttaccaagtggcagtgtctgtcctgagaggccgcgaggaaggacctgcagcggtgattgtggcaaggactgacccactgggccctgtccggacggtgcatgtgacccaggcgtcctcgtcctccgtgaccatcacttggactagagtgccgggagcgaccggctaccgcgtgtcctggcattcggctcatggtcctgagaagtcccagctggtgtctggtgaagcaaccgtggccgaacttgacggtctggagcccgataccgaatacactgtccacgtgcgcgcacatgtggcaggagtcgatgggccccctgcatcggtcgtggtgaggaccgcaccagagcccgtcggtagagtttcgcggctgcagatccttaacgcttcgtcggacgtgctgcgtattacgtgggtgggagtaactggtgccaccgcctatcgcctggcatgggggagatccgaaggtgggcctatgcgtcaccaaatacttcccggaaatactgattcggccgagatccgcggattggaaggcggcgtgtcgtactcggtgagagtgaccgccctggtcggagatcgcgagggtacccctgtctccatcgtggtgaccacgccccctgaagcacctccagcacttggaactctgcatgtggtgcaacggggtgaacattcgttgcggcttcgttgggagccagtgcctcgtgcacaagggtttctgcttcattggcaacctgaaggaggacaggaacaatcacgtgtgttgggtcctgagctttcgagctaccacctggacggactggaacctgctactcagtacagggtcaggctttcggtgctcggcccggcaggggagggaccatcagcggaggtgaccgcgcgaaccgaatcacctcgcgtgccgtcgattgagctgcgtgtggtggatacttcaatagattcagtgactctcgcatggactccagtctccagagcatcatcctacattctgtcgtggaggccactgagaggacctggacaagaggtgcctggatcgccacaaactctgccaggtattagcagctcacaaagggtgaccggtctggaacctggagtgtcgtacattttcagtcttacgccagtgctggatggagtgcgcggccccgaggcctccgtgactcaaacccccgtgtgtccaaggggcctggcagacgtggtctttttgcctcacgcaacccaggataacgcacatcgtgcagaagctactcgacgtgtgcttgaaagactcgtgctcgcactgggccctctgggacctcaggcagtgcaggtcggtctgctgtcctacagccacaggccctcaccactttttcctttgaatggatcccacgacttgggcatcatcctccaacgcattcgggacatgccatacatggacccgtcaggcaacaaccttggtactgcagtcgtcactgcccaccggtatatgctggcccccgacgccccgggcaggcgacaacatgtccctggagtgatggtgctgctcgtggacgaaccacttaggggcgacatcttttcacctattagggaagcccaagcgtcgggacttaacgtggtcatgctgggcatggctggtgccgatccagagcagctgcgacgactggcacctggcatggattccgtgcaaacctttttcgcagtggacgatggaccctcgctggatcaagctgtgtcagggttggccaccgctttgtgccaagcatccttcaccacccaacctcgcccagaaccttgtccagtgtactgtcccaaggggcaaaagggagagcctggggaaatgggtctgcgtggccaggtgggtccgccaggtgacccaggccttcctggtcgcaccggagcaccagggcctcaagggcccccagggtcggctaccgcaaagggagaacgcggatttccaggtgcagatggtcggccaggatcacctggtagagccggtaacccaggcactccaggggcacctggattgaaggggtcgcctggactgcctggaccccggggggacccaggcgaacgcggtcccagaggacctaagggagaaccgggtgccccaggacaggtgattggaggtgaaggcccaggtttgccaggaaggaagggcgatccaggcccgtcgggaccaccgggacccaggggtcctctcggggaccccggcccgcggggcccacctggtttgcccggtacggcaatgaagggtgataaaggggatagaggtgagcgtggccctcctggacccggtgaaggaggaattgcccccggagaacctggactgcctgggctccctggatcgcctggtccacaaggacccgtgggcccccctggaaagaagggagaaaaaggtgatagcgaggatggcgcgcctggtctgccaggccaaccgggatcccctggagaacagggacctagagggcctcccggagcaatcggccctaagggagatcgcgggtttcctggtccactcggagaggcaggggaaaagggagaacgcggcccacctggacctgcagggagccgtggactgcccggagtcgccggacgaccgggcgcaaagggacctgagggtcctcccggaccaaccggacgccaaggggagaagggtgaacccggtagacccggcgacccagcagtggtgggaccagcagtggcaggaccaaaaggagaaaagggggatgtcggacctgctgggcctcggggcgctaccggagtccaaggcgaaagaggccctcctggactggtgctgcctggagatcctggccccaaaggagatcccggcgacagaggtcctattggattgactggtcgcgcaggccctcctggagactccggaccacctggtgagaagggggatcctggccgccctggcccacctggaccagtcgggccaaggggaagagatggagaggtcggagaaaagggagatgaaggaccccccggtgatccaggactccccgggaaagcaggtgaaagggggcttaggggcgcacctggagtgagaggtcctgtgggagaaaagggtgaccaaggagatcccggagaggatgggagaaatggttcgcctggttcctcaggtccaaagggagatcgaggagaacccggaccacccggtccccccggccggctggtggacaccggtccgggtgcaagggaaaagggagaacccggagacagagggcaggaaggtccgcggggacccaagggtgaccccggattgcccggcgcccctggcgagcgcggtattgaaggatttagaggtcctcctggtcctcagggagatccaggtgtgcgcgggcccgccggcgagaagggcgataggggaccacccggactggatggacgcagcggcctggacggcaagcccggagccgcaggtccttcaggacctaatggcgcagccggaaaggcgggggatccggggcgtgatgggctgcctggacttagaggcgagcaaggactccccggaccgtccggcccccctggacttccaggcaagcccggcgaggacggtaaacctggtcttaatggaaagaacggtgagcccggggaccctggtgaggacggtaggaagggggaaaaaggtgattcgggagcatccggaagagaaggcagagacggccccaagggagaaaggggcgcccctggaattctggggcctcaaggtcctcctgggctcccaggtcccgtgggtccgccaggacaaggatttcctggcgtcccaggaggtactggacccaagggagatcgtggagaaaccggctcgaagggagaacagggacttcctggcgaacgagggctgcgaggagaacctggctccgtcccgaacgtggaccgtctgctggaaaccgccggtattaaggcgtcagccttgcgagaaattgtggaaacgtgggatgaaagctcgggctctttccttcctgtgcccgaaagacgccgcggaccaaagggagattccggcgagcaaggccctcctggaaaggagggtcctattggattccctggcgagagaggccttaagggcgatagaggtgacccgggtccacaaggacctcccggcctggccctgggggagcgcggacctcctggtccttcgggtctggcgggagagccaggaaagccaggaattcctggcctgccgggtcgagcaggcggggtgggcgaagccggacggcccggcgagaggggggagcggggtgagaagggagaacggggagaacaaggtagagacggacccccaggccttccaggcacccctggaccgccaggtccaccgggccctaaggtttcggtggacgaacctgggccaggtttgtccggtgaacagggacctccagggcttaaaggtgccaaaggggagcctggcagcaatggagatcaaggaccaaagggagatcgaggagtgcctgggattaaaggggaccgaggtgagcctggccctagaggtcaagatggtaaccctggccttccaggagagcgcggtatggcagggcctgaaggaaaacctggtctgcagggacctcgcgggcctcctggcccagtcggaggccatggcgaccctggacccccaggagctcctggcctcgcaggacctgccggccctcaagggccttccggcttgaaaggagagccaggggaaaccggaccacctggacgcggtcttaccggaccgaccggggcggtgggattgccggggcccccaggtccatcagggcttgtgggaccacaagggtcgcccggccttccaggacaggtgggagaaaccggtaaacctggtgcgccgggccgagacggagcatccggtaaagatggcgacagaggtagccctggagttcctggatcccctgggcttcctggaccagtgggtccaaagggagaaccaggacctaccggtgccccgggtcaagccgtcgtgggactgcccggtgcaaaaggagaaaaaggtgcacctgggggactggcaggggatcttgtcggggaaccaggagcaaaaggcgaccgcggtctgccgggtccacgtggagagaagggagaagcgggacgtgcaggagaaccgggcgaccccggagaggatggacagaagggagcaccaggacctaaggggtttaagggcgatccaggcgttggagtccccggatcgccaggtcctccaggccctcccggtgtcaagggagatctggggttgcctggccttcctggagcaccgggtgtggtgggtttccctgggcaaactggccctagaggtgaaatgggtcagccgggaccatcgggtgaacgtggcctggccgggccaccaggtcgggaaggcattcccgggccactcggacctcctggcccgcctggttcggtgggtccccctggtgcaagcggtcttaaaggggacaagggtgacccaggagtgggtctgccaggacctcggggtgaacggggagaacccggcattcggggcgaggacggtagacccggccaagaaggaccacggggcctcactggacctcctggttcgcgcggtgagcgcggagaaaagggagacgtcggatcggccggattgaagggagataagggggattcggccgtgatcctggggcctcctggcccgcggggcgcgaagggcgacatgggagagcgcggtccacggggtcttgatggtgataaagggcctagaggagataacggcgacccaggtgacaagggctccaagggtgaacctggggataagggttccgcaggactgccaggcctccgtgggctcctgggaccgcagggacaacctggagccgcgggaatccctggagatcctggaagcccaggtaaggatggagtgccaggtattcgcggagaaaagggagatgtcgggtttatgggacctcgagggcttaagggggagcgcggggtgaagggagcatgcgggctcgatggggaaaagggcgacaagggggaagccggtccacctggcagacctggactcgcagggcacaagggagagatgggtgaaccgggggtgcctggtcaatccggcgctcctggtaaggagggacttataggacctaaaggagatcgtgggttcgatggacaaccgggacctaagggggatcagggtgagaagggagaacggggtacccctggcatcggggggtttcctggcccaagcggaaatgatggatccgcaggcccgccaggtcctccaggatcagtgggaccacgagggccggaaggactgcagggacaaaagggggaaaggggacctccaggcgaaagagtggttggagcaccaggagtccctggtgctccgggcgaaaggggggagcaaggcagacccggccccgcaggaccaagaggagaaaagggcgaagcagcactgaccgaggatgacattcgtggcttcgtccggcaagaaatgtcgcaacattgtgcttgccagggtcagtttattgcctccggctctcgccctctgccatcctacgcagccgatactgccggtagccaacttcatgccgtgcctgtgctccgggtatcgcatgctgaagaggaggagcgcgtcccacccgaggatgatgaatactcagaatactcggaatactcggtggaagagtaccaggatcctgaagcaccttgggattcggacgacccatgttcgctcccacttgatgaaggttcctgtactgcgtacacccttagatggtaccaccgcgccgtgactggttcaactgaagcctgtcaccctttcgtttacggaggatgtggaggcaacgccaacagatttggcacccgcgaggcatgtgaaagacgctgtccaccccgtgtcgtgcagtcacagggaacgggaactgctcaagat

SEQ ID NO: 9625 - DNA, 8832 bp, Artificial Sequence
  Description of Artificial Sequence: Synthetic coding sequence
atgactctcagactcttggtcgcagcgctatgcgctggtatactagccgaagccccacgagtgcgtgcacagcatcgcgaacgtgtaacttgtacccgcctgtatgcagcggacattgtttttctcctggatggcagcagttccatcggcagaagcaacttcagggaagtccggtcatttcttgaaggtctcgtgttgccattctcgggggccgcgtctgcgcagggcgtccggtttgccaccgtgcagtatagtgacgatcccaggaccgagttcggattagatgcactcggctcgggaggagatgtgatcagggcaattagagagctgagctacaagggcggaaacacaaggactggcgcggcaatactccacgttgccgatcacgtgtttttgccccagcttgcacggcctggtgtgcctaaggtttgcatcttgattaccgatggaaagtctcaggaccttgtggataccgccgctcagcgcctgaagggacagggggttaaacttttcgccgttgggataaagaacgctgacccggaggaactgaagagggtggcatcccaacccacatccgacttcttcttcttcgtgaacgatttctcgatactgcgaacattattgcctcttgtcagtcggagggtctgcacaacggcgggcggggtgcctgtcaccagacccccggatgatagcacctctgcaccacgcgacttggtgttgagtgaacccagcagtcagagcctgcgggtgcaatggactgccgcgagcgggcccgtgacaggttacaaagtccagtataccccgctgaccggactaggtcagccactgcccagcgagaggcaggaggttaatgtgcccgccggcgagacgtccgtgcggctcagggggctgcgcccactaacagagtaccaagttacggttatcgccctgtacgctaactccatcggcgaagccgtgtcaggaaccgccaggactaccgcccttgaaggccccgaactgacgattcagaatacaacagcgcactcccttctggtggcttggcgctccgtgccgggagctacaggataccgcgtcacatggcgcgtgttgtctggaggacccactcagcagcaggagctaggcccaggccagggtagtgtgctcctgcgggacttggagccaggaaccgactacgaggtcacagtgtcaacactcttcggaagatcagtcggacccgccacgtcccttatggccaggaccgacgcatctgttgagcagacgttgagaccagtgatccttggtcccacctccatcctgttatcatggaatttggtcccggaggcgagaggctaccgattagaatggagaagggagactggtcttgagcctcctcagaaggtggtgctcccaagcgacgtcacacgttaccaattagacggcctgcaacctgggacggagtatagactgacgctgtataccctgctggagggccatgaagtggccaccccagcaactgtagttcccacgggacccgagctgcctgtttcacccgtgacggacctgcaggcgaccgagcttcctgggcagcgcgtgcgggtgtcctggagtcccgtgcctggggctacgcagtacaggattatcgtgcggagtacccaaggagtggagcgaacactggtgctgccaggttcacagaccgcatttgacctggatgacgtccaggctggtctgtcttataccgtccgagtttccgcccgagttgggccccgggaggggtccgccagtgtcctgacggtcaggagggagccagaaacacctcttgcggtgcccggactgagggtggtcgtgtccgatgccactcgcgtcagagtggcttggggccctgtcccgggggcatcaggatttagaatttcgtggtcaacgggatcagggcccgagagttcgcagacgctgccccccgatagcacagctaccgatattacaggcttgcagcctggcacaacataccaggtggcagtgagcgtcttaagggggcgcgaggagggccccgccgcagtgatcgtagcacgaaccgaccccctggggccagtgcgtaccgtgcacgtgacccaggcctccagcagctccgtgacaatcacttggactagggtccctggtgccacaggataccgtgtctcctggcacagcgctcatggtccggagaagtcgcagctggtcagcggggaggcgaccgtggccgagctcgacggactggagcccgataccgagtataccgttcacgtgagagcgcacgtggcgggcgtggatggcccccccgcctctgtggtggtacggacagcacctgaaccggtgggcagggttagccgattacaaatactgaatgcgtcttctgatgtgctgcgcatcacctgggttggagtgactggcgccaccgcctacaggctggcttggggaaggagtgagggaggcccaatgcgacatcaaattctacccggaaacaccgattccgctgagatccggggcctcgaggggggcgtgtcctatagcgtgcgcgtgacggccctggtcggcgacagggagggcacaccagtgtctatagtcgtgacgacgccgcctgaggcgccccctgctctggggactctgcatgtggtccagcgaggggagcactccctaaggttgcgatgggaacccgtgccaagagcacagggcttcctgttacattggcagcctgaaggcggccaggagcaaagtcgggttcttggacccgaactctcatcttaccatctcgatgggctagaacctgcaacacaatacagggtcaggctgtctgtcttgggtcctgccggagagggtcctagtgccgaggtgacagcacgcacagagtcgccccgcgtcccaagcattgagctgcgagtggtcgatacgagtatcgattccgttactctcgcctggacccctgtgtcgcgagcgagctcctatatactgtcttggcgccctttgcggggccccgggcaagaggtgccaggatctcctcagactctgcccgggatctcctcctcccaacgtgtaaccggtctggagcccggtgtctcttacatattctctcttacgccggtgctcgatggagtgaggggacctgaggcatccgtcacccagacgccggtgtgccctagaggcctcgccgatgtcgtgttccttccccatgccacccaggataatgctcaccgtgcagaggccacacggagggtgctggaacgcttggtactagcactggggccactgggcccacaggcagtccaggtcgggctgctttcctacagccatcgacccagccccctgttccccctcaacggaagtcatgacttggggatcatcctgcagaggatcagggatatgccatatatggacccgagcgggaataatctgggaacagccgtagtgaccgcccacagatacatgttggcccctgatgcccctggacgcagacagcacgtccctggggtaatggtgcttctcgtagacgagccactgcgcggggacatattttcccctatcagagaggcgcaagcctccggtctcaatgtggtgatgctgggtatggcaggagccgatccggagcaacttcggcgactggcaccagggatggattccgtccagacctttttcgcagtggacgatgggcccagtctagaccaagccgtgtccgggcttgcgactgccctgtgccaagcatcctttacaacacaacctagacctgagccttgcccagtgtactgcccaaagggccaaaagggggaacctggcgaaatgggactccgaggacaagtgggccctcctggcgatccagggctaccaggacgcacgggcgcacccggaccacagggaccaccaggtagcgccacggcaaaaggagagcgcggatttccaggtgccgacggtcgtcccgggtccccgggccgggccggcaacccagggaccccaggagccccggggctgaagggctctccaggcctcccaggccctaggggtgacccaggtgaacgagggccccgcggcccaaaaggcgagccgggtgcgccgggccaggtgatcggaggggagggccccggtttgcctggccggaagggcgatccgggcccttctggccctcctggcccacgcgggcccctgggagatcctggaccgcgagggccgccgggccttccaggaaccgctatgaaaggcgataagggagatcgcggcgagagagggccacccggcccaggggaaggcggcatagccccgggagagccagggctgccaggtctgcccgggagccctggcccgcaagggcccgtgggacctcctggcaagaaaggcgagaagggagattcagaggacggtgcccccgggctgccaggccagccgggcagtcctggcgagcaagggccacgcgggcctcctggcgcaatcggccccaaaggagaccggggatttcctggccccctgggcgaggcgggggagaaaggggagaggggacctccgggcccggcagggagccgaggtttacctggagtggccggacgacctggcgccaagggacctgagggtcctcctggtcccacggggaggcagggtgaaaaaggggaaccaggacgtcccggggatcccgcagtggtgggtcccgcagtggctgggcccaagggtgaaaagggggatgttggtccggctgggccaagaggcgcaaccggggtccagggagaaaggggccccccgggcctggtcctgccaggggatccggggccaaaaggggatcctggagatcggggacctataggtctgactgggcgggccggtccacctggcgattcagggccaccaggggaaaagggtgaccctggaaggcctggtcctcccggacctgtcggtcccaggggacgtgacggcgaggtgggggagaagggggacgaaggtcctccgggggatcccggcctccccggcaaagccggcgaaagaggattgcggggggcacctggagtacgagggccggtgggcgaaaagggagaccagggcgaccccggcgaagacgggcgaaacggcagccctggcagtagcggtccaaaaggggatcgaggtgaaccggggccacccggtccgcctggacgcctcgtggatactggacctggggctcgggagaagggagaacccggtgacagagggcaggagggacctaggggacccaagggcgatcctgggctgcccggggcaccaggcgaacgcggtatcgaaggctttcgaggacctcccggcccacaaggggatcctggcgttaggggacctgcaggagaaaagggcgatagaggcccacctggcttggatgggagatcaggattggatggcaaacccggcgcggccggtccatcaggaccaaacggtgctgccgggaaggccggcgacccagggagggacggactgcctggactcaggggcgaacagggtcttccgggaccctctgggcctcctggcctgccaggaaaaccaggggaagacggcaaaccaggactgaacggcaagaatggcgagcccggcgaccctggggaggatggaaggaaaggagaaaagggcgacagcggggcctccggacgcgagggccgagacgggccaaaaggggagcgaggcgctcctggcatactgggcccacaggggcctccaggtctgcccggccctgtgggtcccccggggcaagggttccctggcgtccccgggggcactggcccgaaaggagaccgcggggaaactggctccaagggtgaacagggactcccaggtgaacgggggttgcgaggcgaacctgggtccgtgcccaatgtggacaggctgctggagactgcgggcatcaaggcatccgccttaagagagatcgtcgaaacttgggatgagtcttccggctcatttcttccagtgcccgagaggaggcgtggccctaagggcgacagtggcgagcaaggtccgccgggcaaagaagggccaatcggattcccgggcgagcgtgggctgaaaggtgatcgaggggatcccggaccccagggacccccaggactcgcactgggagaacgggggccccctggaccttcggggctggccggggagcctggcaaacccggaatcccgggcctacctggcagggccggcggagtaggagaagccgggcggcccggcgagcggggggagcgtggggaaaagggcgagcgaggagagcaaggacgggacggccctcccggactgccgggtacaccagggcctccaggtcctcccggacccaaagtgagcgtggacgagcctggccccggcctgagcggagagcagggccctccagggctcaagggcgccaaaggtgagcccggcagtaatggggaccaggggcctaaaggagaccgcggcgtcccaggcatcaagggagatagaggtgagcccggaccacgaggccaggacggcaacccagggctcccaggggaaagaggaatggctggcccagaggggaagcccggcctccaaggcccccggggaccgcccggccccgtgggtggccacggggatccgggtccgccaggcgcacctgggcttgcgggccccgccggccctcaggggccttctgggctgaaaggggagcctggcgaaaccggcccaccagggcgggggctaactgggcccaccggagccgtgggtttgccgggtcccccaggtccctctggacttgtagggccccagggctcacccggcttgccgggacaggtcggcgagaccgggaagcctggggctcccggccgtgatggggcctctggcaaggacggggaccggggctctccgggggttcccggtagtcctggcttgcccggccccgtcggccccaaaggcgagcccggccctactggcgcgcccggacaggccgtggttgggctccccggagcgaagggcgagaaaggagcccctgggggactggcgggtgatctggtaggcgaaccaggcgccaagggagatagggggctccccggaccccgaggggaaaagggcgaggcgggtcgggccggagaaccgggggatcctggcgaggacggtcagaagggtgcgcccggacctaaaggcttcaagggcgatcctggagtgggcgtgccaggtagtcctggaccgccgggcccgccaggcgtgaagggtgacctggggctgcctggtctgccaggtgcaccgggtgtcgtgggattccccggacagacgggcccacggggagagatggggcagcccgggccctccggcgagcggggactggctggcccacctggcagggagggcattccgggtccactcgggccccctgggccgccaggctccgtaggcccacccggcgcatcaggactgaagggggacaagggtgatcctggcgtcgggctaccaggaccaaggggcgagcgcggggagcctggcataaggggtgaagacggtcgccctggccaggaaggaccccgtgggttgaccggccccccaggaagccgcggagagcggggagagaagggggacgtcggttccgcgggactcaagggcgataagggagacagcgcagtgatccttggccctcctggtcccagaggcgccaaaggcgacatgggggagcgcggacctagagggcttgacggcgacaaaggtccacgcggcgacaatggagatcctggcgataaaggctccaagggagagcccggggacaagggtagtgctggactgccagggctccgcggtctgctgggccctcagggccagcccggggccgctgggatcccaggcgatcctggaagccccggaaaggacggagtaccaggcatacgcggcgaaaaaggagacgtcggcttcatggggccccgaggcctgaagggggagaggggagtgaagggcgcctgcggactggatggagaaaagggtgataagggggaagcagggcctcctgggcgaccaggtctggcaggacataaaggtgaaatgggggaacccggcgtccccggtcagagcggggctcctggcaaggaggggcttataggccctaaaggagacaggggattcgatggacagcccgggccaaaaggcgatcaaggcgagaagggcgaaagaggcacgcctggaatcgggggtttccctggaccaagtggaaacgacgggtctgcgggtccgcctggcccccccgggagcgtagggccaagaggacctgaggggctgcaaggccagaaaggcgaacggggccccccaggagaacgggtggtgggagcccccggggtccctggagctcccggagagcgaggagaacagggcaggcccggcccagcggggcctcggggggagaaaggggaagcggcgctgacagaagatgacatacggggttttgtgaggcaggagatgagccagcactgcgcatgtcagggacaattcattgcctccggatcgaggcccctcccttcgtatgccgccgatacagcgggcagccagctccacgccgtccctgtgctgagagtatcacacgcggaggaagaagagcgcgtcccgcccgaggacgacgagtatagtgaatactccgagtatagcgtggaagagtatcaggaccccgaggccccctgggactccgacgacccttgttctcttccactcgatgagggtagctgcacggcttacacattaagatggtaccaccgcgcagtcaccggatctaccgaggcatgccacccgttcgtctacggcggatgtggcggcaacgcaaatcgcttcggcaccagggaggcgtgcgagagaaggtgtcctcctagagtggttcagtctcagggaacagggacagcccaggac

SEQ ID NO: 9626 - DNA, 8832 bp, Artificial Sequence
  Description of Artificial Sequence: Synthetic coding sequence
atgaccctgcgcctgctggtggcggccctgtgcgcaggtattctcgcagaagcaccgagagtgagagcacaacaccgggaacgcgtcacttgcactcgactttatgcggcggacatcgtgtttctcctggatggttcgtcatcaatcggaagatcgaactttcgcgaagtgcggtcgtttctcgagggtcttgtgctgcctttctcaggagcagcctcagcacagggcgtgagatttgcaaccgtgcagtactctgatgatcctcgaaccgaattcggacttgatgcccttggttccggtggcgatgtgattcgtgcaatcagggaattgtcgtacaaaggaggcaacacccgcaccggagccgcgattctccatgtggcagatcacgtattcttgcctcaactggcaagacccggggtccccaaggtgtgtatcctcatcactgacggaaagtcacaagaccttgtggacacggcagcacaacgcctgaagggtcaaggagttaaactgttcgcagtgggaatcaaaaacgctgatcctgaggagcttaagcgtgtcgcatcccagcctaccagcgacttcttcttttttgtgaacgattttagcattcttcgcaccctcctgcctcttgtgtcacggagggtctgtactacggcagggggagtgcccgtgactaggccccctgatgactccacttcggcacctcgtgatctggtgctttccgaaccttcgtcccaatccctgagagtgcaatggactgcggcatcgggccctgtgactggttacaaggtgcaatacactcccttgactggacttggacagcctctcccctcggaacgccaagaggtcaatgtgcctgcaggcgaaacgtcggtcagactgagaggactgcgacccctgacggaatatcaggtgactgtcatcgcactgtacgctaattcgatcggtgaagctgtgtcgggaactgcgaggaccactgcacttgaaggtcctgagctcactatccagaacaccaccgcacattcacttttggtggcgtggagaagcgtcccaggcgcaaccggctatcgcgttacctggcgagtgctgagcggtggtcccacccagcaacaagagttgggcccaggtcaaggatccgtgctgcttcgggatctggaacccggtaccgattacgaagtgaccgtctccacgctgttcggcaggtcggtcggaccggccacctccttgatggcgcgaaccgatgcatccgtggaacagacccttagacccgtgatactcggtcccacctccattctgctgtcatggaatctcgtgcctgaggcacgaggctaccggctggagtggcgccgtgagactggacttgaaccgccacagaaagtggtgcttccctcggacgtgactaggtaccagctggatggactgcagcctggtactgagtacagactcactctgtacactctgctggaagggcatgaggtcgcaacccctgcgaccgttgtcccaacgggccctgagctccccgtctcgcccgtgactgatcttcaagcaacggagctccctggacaacgtgtgagagtcagttggagcccagtccctggagcaactcagtataggatcattgtcagatcgacgcaaggcgtcgaaaggaccctggtccttcctgggtcccaaactgcatttgatcttgacgatgtgcaggccggactctcatacaccgttagagtgtccgccagagtcggccccagggaaggttcagccagcgtcctgaccgtccgaagagagcctgaaacgccattggccgtgcctggcctgagagtggtggtgagcgacgcaactagggtgcgggtcgcctggggccccgtcccgggagcttcgggattccgtatttcgtggtcaactggatccggacccgaatcatcacaaaccctgccacctgatagcactgctactgatataaccgggctccagccaggtaccacctaccaagtggcagtcagcgttctccgggggcgcgaagaagggcctgcagcagtgatcgtggcacgcaccgacccccttggccccgtgagaacggtgcacgtgacccaggccagcagcagctcggtgaccattacctggacgcgggtgccaggcgcaaccgggtacagggtatcgtggcattcggcacatgggccagaaaagtcccaacttgtgtccggagaagcaactgtggccgaactggacggtcttgaaccagatactgaatacaccgtgcatgtacgggcgcatgttgcgggggtggatggacctcctgccagcgtcgtcgtccgtactgcacctgaaccagtggggcgagtgagtcggctccagattcttaacgcatcatctgatgtgctgcgtattacttgggtgggtgtcaccggggccacggcataccgactggcgtggggtcgaagcgagggtggacctatgcggcaccagattctccccggcaacactgattccgccgaaatccggggacttgaggggggcgtgagctacagcgtgcgtgtgacggcgctggtgggcgatagagaaggtactcccgtgtcgatcgtggtcaccacgccccctgaagcacctcccgcacttggtactcttcatgtggtgcaaaggggtgagcattcgctcaggctgaggtgggagccggtcccaagggcgcaaggtttcctcctgcattggcaaccggagggtggtcaggaacaatcccgagtgctcggacctgagctgtcctcctaccatctggatggtctggaacctgcaactcaatacagagtcagactttcggttcttgggcctgcaggtgagggtccctccgcagaggtcacggctagaactgaatcgcctcgagtgcccagcattgaactgagggtggtggacacctcgattgactcagtgactctcgcatggactccagtgtcgagagcatcttcgtacattctctcatggcggccactgcgcgggcctggacaagaagttcccggaagtccccaaactcttccaggtatatcctcttcccaaagagtcactggactcgaaccgggcgtttcgtacatcttttcactgactccggtgttggacggggtgcgcggcccagaagcctccgttacccagaccccggtctgtcctcgcggactggcagatgtggttttcctcccacatgctacccaggataacgcccatagggcagaggctaccaggcgagtccttgaacgcctggtccttgctctggggccccttggaccccaagcagtccaggtggggctccttagctactcacatagaccttccccgttgtttccgcttaacggaagccacgaccttggcatcatactccagcgcattcgcgatatgccttacatggacccatcgggcaataatctgggaaccgcagtggtcactgcacatcgctacatgctggcccctgatgcacccggtcggcggcagcacgtgcctggagttatggtgctgctcgtggacgaaccccttagaggcgacatcttttcgcctatacgggaagctcaagcatccggccttaatgtggtcatgctcggaatggccggggcagacccagaacaacttagacggctggcaccagggatggattcggtccagacttttttcgcagtggatgatgggccgagccttgatcaggcagtgtcagggcttgctaccgcgctctgccaggcatcgtttacgacccaacccagacctgaaccatgtccagtgtactgcccaaaggggcaaaaaggggaacccggagaaatgggattgaggggacaggtggggccaccaggtgaccccgggctgccgggccgtaccggtgcgccaggaccacaaggccctccaggaagcgcaacggccaagggtgaacggggttttccaggggccgatgggaggcctggatcgccaggtagggcaggaaacccaggtacgccgggtgcgccaggacttaagggttcgcctggactccccggacctaggggcgaccctggcgagcgcggtcctcgtggaccaaagggtgaacctggcgcccctggtcaagtgattggtggtgagggtcctggtctgccaggtcgcaaaggcgaccccggacccagcggacctccggggccaagaggaccactcggagatcctggcccaagaggtcctcccgggctccctggtaccgctatgaaaggagataaaggagatcgtggagagcggggcccacccggtcctggtgaaggtggtatcgcacccggtgagccagggctgcctggcctgcctggtagccctggcccgcagggacctgtaggacctccaggcaaaaagggagagaagggagatagcgaagatggagcacctggactcccggggcagccgggttcacctggcgaacaaggccctcggggtccgcctggagccattggcccaaagggagatcgtggatttccagggcctcttggtgaggcgggagaaaagggtgagcggggtcccccgggacccgcaggatcaagaggactgccgggtgtggcgggaaggcccggagcaaagggcccagaggggccccctggaccaactggaaggcagggtgagaaaggtgaacccgggcgcccaggagatccagccgtggtgggcccggctgtggccggacctaagggagagaagggtgacgtgggaccggcaggtccacgtggtgccactggggtgcaaggcgaacgtggtcctccagggctggtcctgccgggtgacccaggaccaaaaggcgatcctggtgatagagggccgattggactgaccggtcgggcaggaccgccaggtgactccggaccaccgggcgagaaaggggatcctggtcgaccggggcctccaggtccagtgggtccccgcggccgggatggcgaagtgggggaaaaaggagatgaaggtccaccaggagatcctggcctcccaggaaaggcaggagagagagggctgaggggtgctccaggcgtgcgggggccagttggagaaaagggggaccaaggtgatccgggtgaagatggccggaacggtagccccggatcaagcggtccgaagggggacaggggtgaacctgggcctcctgggcccccaggccgcctggtggatactggccccggtgcaagagagaagggggaaccaggggaccgggggcaagagggtcctagagggcccaaaggcgaccccggactgcccggtgctccgggagagagaggtatcgagggatttcgcggtccccctgggccccagggtgaccctggagtccgcggccctgcgggtgaaaaaggcgaccgcggccctcctggcctggatggacgctcggggttggatggtaagcctggtgcagcaggcccctcgggaccgaatggagcggcgggcaaggctggtgaccccggtagagatgggctcccaggattgagaggagaacaaggactgcccggtccttctggtcccccgggccttccgggcaagcctggagaagatggaaaacctggacttaatgggaagaacggcgaacctggcgatccaggcgaggatggaagaaaaggggaaaagggagatagtggagcctcgggtagggaaggacgcgatggcccaaaaggcgagagaggagcacctgggattcttggacctcagggaccccctggcttgcccggcccagtgggaccccccggtcagggtttcccgggtgtcccaggtggaacgggcccgaagggtgatcggggggagactggatcgaagggagagcagggattgccaggtgaacgaggccttagaggagaaccagggtctgtcccaaatgtggatagactgttggaaaccgccgggataaaggcctctgcccttcgcgagatagtcgaaacctgggatgagtcgagcggctcatttcttcctgtccccgaacggagaagaggccctaagggggactccggagaacaggggcctcctggaaaggagggccctattggcttccccggggagcggggtcttaagggcgaccgcggtgacccaggtccgcaaggcccgcctggactcgctctgggggagagaggccccccagggccaagcggacttgctggagaacctgggaagcccggaattcctgggttgccgggacgcgcaggaggagtgggagaagcaggtagacccggggaaagaggggaacgcggcgaaaagggagaacgcggggaacaggggcgcgatggacctccaggtttgccagggacgccaggacctccggggccccctggtccaaaggtatctgtggatgaacctggccctggactttcgggcgagcaaggaccaccggggctgaagggtgccaaaggagagccaggaagcaacggcgaccagggccctaaaggagatcgtggtgtgccgggcattaagggtgaccgaggagagccgggccctcgcggacaggatggaaatcccggccttcccggcgagcgaggtatggcaggacccgaggggaagcctggtctgcaaggaccccgcggacctcccggacccgtcgggggtcacggtgacccaggacctcctggtgccccaggtctggctggaccagccggaccacagggaccctcgggcctcaagggagaacctggagaaactggtccgccgggacgagggctgaccggaccgactggtgcggtcggacttccaggtccacctggtccctccggtctggtgggtccccaaggctcccctggtctgccgggacaggtgggcgagacgggtaagcctggggcacctggaagagatggcgctagcggaaaagatggcgacaggggatccccaggagtccctggatctcccgggttgccaggtcctgtgggacctaagggtgaacctggacccactggcgcccctggacaagcggtggtgggactgcccggcgctaagggagaaaagggcgcacctggaggactcgcaggtgatttggtcggggaaccaggagcaaagggtgaccggggactgccgggcccccgaggagaaaaaggcgaggcaggacgggcgggcgaacctggtgaccctggcgaggacggccaaaagggtgcccctggccccaagggattcaagggcgatcctggggtgggagtgcctggctcgccaggccctcctggtcctcctggtgtgaagggagatctcgggctccctggacttcccggggcgcctggagtggtgggatttcccggacaaactggtcctcgtggggaaatgggtcaaccaggccctagcggagaaagagggctcgcagggcccccaggaagagagggaattccgggaccactggggccacccggccctcctggatcagttggaccgccaggagcatcaggacttaagggcgataagggagatcctggtgtcggactcccggggcctcgcggggagcggggagaacccggcattcgaggcgaagatggcagacctggtcaagaagggccccgcggccttactggccctcccggctcaagaggggaacggggagaaaagggcgatgtgggaagcgccggacttaaaggggacaagggagattccgctgtcattttgggccctcctggaccacggggagcgaagggagatatgggcgagaggggtcctcgaggcctggacggagataagggacctcgtggagataacggagatccgggcgacaaaggatccaaaggggaaccaggcgacaaaggttcagcaggacttccaggccttagaggcttgttgggtccacaaggacaaccaggggctgcggggattcctggggaccctgggagccctgggaaagatggagtccctggaattcgaggagaaaagggagacgtgggttttatgggcccacggggacttaagggagaaagaggcgtgaaaggggcctgtggacttgatggtgagaagggagacaaaggagaagctgggccacccgggaggccgggtctggcgggccacaagggtgaaatgggggagcccggtgtgcctggacaatctggtgcacctggaaaggaaggactcatcggccctaaaggtgatcgtgggtttgatggacagcccggtccaaagggggatcaaggtgagaagggagaacggggtacgccaggcattggaggattccccggcccatccgggaacgatggctccgccggtccccctgggccgcctggatcggtggggcctagaggtccagaaggcttgcaaggtcaaaagggtgaaagaggtcccccgggtgagcgtgtggtgggggcgccgggcgtgcctggtgcccctggtgaacggggcgagcagggacgcccagggccggcaggtccccgcggggaaaaaggagaagcggcccttaccgaagatgacattcgtggatttgtccgccaagagatgtcccagcactgtgcatgtcaaggacagtttatagccagcggatcacgtccactgccttcgtacgcggcagataccgcaggctcccagctccacgccgtcccagtcttgagggtttcccatgcagaagaagaagaaagggtccctcccgaagatgatgaatactcagagtacagcgaatactcagtggaagagtaccaggacccggaagcaccatgggactcggacgacccctgttcccttcctctggacgaaggatcatgtactgcctatacgcttagatggtaccatagggccgtgaccggctcgaccgaagcatgccacccctttgtctacggaggttgtggagggaacgcaaatagattcggtaccagagaggcatgcgagagacgctgtccccctcgtgtcgtgcagtcccagggaaccggaactgcacaggat

SEQ ID NO: 9627 - DNA, 8832 bp, Artificial Sequence
  Description of Artificial Sequence: Synthetic coding sequence
atgactctgcgcctcctggtggcagccctgtgcgcgggaatcttggcggaagcccctcgcgtccgcgctcagcaccgcgagcgtgtgacttgcacccgcctgtacgccgctgacatcgtgtttctgctcgatggctcgtcgtcgatcggtcgctccaacttcagagaagtgcgatccttcctcgaaggtcttgtgctcccgttctcaggcgctgcctccgcgcagggagtgagatttgctaccgtgcaatactccgacgaccctcggaccgaattcggcctggacgccctcggctcgggaggagacgtcatcagggccatccgggagcttagctataagggtggaaatacccgcaccggggcagcaatcctccacgtggccgaccatgtgttcctcccgcagctcgcccggccaggggtgccgaaggtctgcatcctcatcacggacggcaagtcgcaagatttggtcgataccgcggcccaacgccttaagggacagggagtcaagctctttgcggtgggaatcaagaacgcagatcctgaagaattgaagagggtagccagccagccaacctcggacttcttctttttcgtcaatgacttctccattctgcgcacgctcctcccgctcgtctcgcgcagggtgtgcactaccgccggaggcgtgcccgtgacccgaccgccagatgatagcacttcagcaccacgggacctggtgctgtctgagccgagctcacagtcgctgcgagtgcagtggacggccgcatcgggaccggtgacgggctacaaggtccagtacactcctctgactggcctgggccagccactcccaagcgagagacaggaggtcaacgtgcctgcaggagaaactagcgtccgccttcgtggactccgcccactgactgagtaccaggtcaccgtcatcgcgctgtacgccaactcgatcggggaggccgtcagcgggaccgcgcgcactacggccctggagggaccagaactgactatccagaacactaccgcccatagcctgctggtggcgtggcggtccgtgccaggtgcgaccggctaccgcgtcacttggcgcgtcctgtcaggcggaccgactcagcaacaggagctcggccccggccagggcagcgtgctcttgagagatttggaaccaggaaccgattacgaagtgaccgtgtcaactctgtttggccggtcggtgggaccagctaccagcctcatggcccggacggacgcgtccgtggagcaaactttgcggccggtgattcttggtccgactagcatcctgctgagctggaatctcgtgccagaagcacgggggtaccggctggaatggagacgggaaactggactggagcccccacaaaaggtggtcctcccgtcggacgtgaccagataccaactggatggactccaaccgggaaccgaataccgcctcactttgtacactttgctcgaaggtcacgaagtcgccacccctgcgaccgtggtgccgaccgggccagaactgcccgtttcccccgtcactgacctccaggcaaccgagctgcctggacaacgggtgcgcgtgtcgtggagcccagtgccaggcgccactcaataccggatcatcgtccgctcgacccagggagttgaacggacgctcgtcctgccaggctcgcagaccgcctttgacctcgatgacgtgcaagccggactgagctacaccgtccgggtgtccgcccgcgtcgggcctagagagggatcggcgtccgtcctgacggttcgccgcgaaccggaaactcccctcgcagtgccgggcctgcgcgtggtggtgtcggacgccaccagagtgagagtggcttggggaccggtgcctggagcctcgggattccggatctcatggtcgaccggctcgggaccggagtcgtcccagacccttccgcctgattcaaccgctaccgacattactggactccagccaggaaccacgtaccaggtggcagtgtccgtgctgcgcggccgcgaggaaggcccagcggccgtgattgtggcgcgcactgacccgctgggcccggtgcggacggtccacgtgacccaggccagcagctcttcggtgactatcacctggacccgggtgccaggggccaccggatacagagtgtcgtggcattccgcccatggcccggaaaagtcgcaactggtcagcggggaggcgaccgtggctgaactggatgggctcgaaccagatactgaatacaccgtgcacgtgcgggctcacgttgctggcgttgacggacctccggcgagcgtcgtggtgcgcaccgcaccggaaccggttggccgcgtgtcccgtctccaaatcctgaacgcctcgtcggacgtgctccgaattacctgggtcggggtcaccggagctacggcctacagactggcatggggccggtcagagggaggtccgatgcgccaccagatcttgcccggaaataccgatagcgccgaaattcgggggctggaaggaggggtgtcctacagcgtgagagtgactgctctcgtcggcgaccgggagggcacgccggtgtccatcgtggtgaccactccgccggaagctccccctgcgctgggaactcttcacgtggtgcaacggggagagcattcccttcgcttgcggtgggaacccgtcccacgggctcagggattcctcctgcattggcagccggaaggaggacaagaacagtcgagagtgctgggaccggaactctccagctatcacttggacgggctggaaccggcgacccagtacagagtcaggctgagcgttcttggcccggccggagaaggaccttcggcggaggtaactgcgagaaccgagtccccgagagtgcctagcatcgagttgcgcgtggtggacactagcatcgattcggtcactctcgcctggaccccagtctcgcgcgcttcttcttacatcctcagctggcggccgctgcgcggaccgggacaggaggtgccaggatcgccgcagaccctgccaggaatctcaagctcccagagagtgactggcctcgagcctggcgtgagctacatcttctcccttaccccagtgctcgacggagtccgcggcccagaggcgtccgtcactcagacgccagtgtgtccacgcggactggcggacgtggtcttcctgcctcacgccactcaggataacgctcacagagctgaagcgacccgcagagtgctggagcggctcgtgctggccctcggaccacttggaccgcaggcggtgcaggtggggcttttgagctacagccaccgaccgagcccgctgttcccgctgaacggatcgcacgatcttggtatcattttgcaacgcatccgcgacatgccctacatggacccctccggaaacaaccttggaactgcggtggtgactgcccacaggtacatgctggccccggacgccccgggaagaagacagcatgtgccaggtgtgatggtgctgctggtggacgaaccactccggggggatatcttctcaccaatcagggaagcccaagcctccggcctgaatgtcgtcatgctgggaatggccggcgcagaccccgagcagctgcgccggctggcaccgggaatggattcggtgcagacctttttcgccgtcgacgacggaccatccctggaccaggctgtcagcgggctggcaactgccctttgtcaggcgtcgttcaccacccagcccagacctgagccatgcccagtgtactgtccaaagggacagaaaggcgaacctggagaaatgggcctcaggggacaggtgggaccgccgggcgacccgggactcccgggtaggactggggccccaggaccacagggacccccgggatcggccaccgccaagggagaacggggcttcccgggggctgatggaagaccaggatcacctggaagggcgggaaaccccggcaccccaggagccccgggactcaaagggtcgccgggcctgccgggaccacgcggagatccgggcgaacgggggccacgcggtccgaagggagagccgggagccccaggacaagtgattggcggggaaggaccaggtctgccaggtcggaagggggaccctggaccgtctggtccgcctggaccgcgggggccactgggagatccaggaccgcggggcccccctggcttgccaggcaccgcaatgaaaggcgataaaggcgatcgcggtgagaggggaccgccgggacctggggagggcggaattgcccctggtgagccgggactcccgggcctgccggggagcccaggaccacaagggccggtgggaccgccggggaagaagggagaaaagggagactccgaggacggggccccaggactgcctggacagccaggctccccaggcgagcagggaccgcggggacctccgggcgcaattggaccaaagggggatcgcggattcccggggcctctgggagaagcaggcgagaaaggagaacgcggaccacccgggccggccggatcccgcggattgccgggagtggcgggacgccccggagcaaaggggccggaggggcctccgggccctactggaaggcaaggcgagaagggagaaccgggccgccctggagatcccgctgttgtgggaccagccgtcgccgggccaaaaggggagaagggcgacgtgggcccagcaggcccgcgcggtgcgaccggagtgcagggagaaaggggacctcctggactggtgctgcctggtgacccgggaccgaaaggcgacccgggagatcgggggcctatcggactgactggaagagccggaccgcctggggactcaggcccaccgggagaaaagggagatccgggacggccgggacccccggggcctgtgggcccgcgcgggcgggatggagaggtgggagagaagggggacgagggaccaccgggggaccctggactgccaggcaaggcaggtgagcgaggactcaggggagccccgggagtgaggggccctgtgggcgagaagggcgaccagggagatccaggagaagacggacgcaatggatcacctggttcgagcgggccgaaaggtgaccggggggagcctgggccacctggtcctccgggtagactggtggacactggaccgggagcgagggagaagggtgagccgggagatcggggtcaggagggacctcggggaccgaaaggtgaccctggactgcctggcgctccaggtgaaagaggaatcgaaggattcagaggaccgccaggaccacagggagatccgggagtgagaggcccagccggcgaaaaaggagacagggggccaccgggacttgacggaagatctggcctggatggcaaaccgggcgccgccggcccgtcgggaccgaatggagccgccgggaaggccggggacccgggccgagatggactgcctggcctcaggggagaacaaggcctcccaggaccttcaggcccgccgggactgccaggaaaaccaggagaagatggaaagcctggactgaatggtaagaacggagaaccgggagatcccggagaagacggacgcaaaggtgagaaaggcgactccggggcatccggacgggagggacgcgacggacccaagggggaaagaggcgcccccgggatcttgggaccacagggaccaccaggattgccgggacctgtgggacccccgggacaaggattcccgggagttccgggaggcaccggcccaaagggcgacaggggagaaactggtagcaagggtgagcaggggctcccaggtgagagaggcctgcgaggagagccgggatccgtgccaaacgttgatcgcctcctcgaaaccgcaggcattaaggcgtccgctctcagagagattgtggaaacctgggatgagtcaagcggatcattccttccggtgcctgaaagacgaagaggaccgaaaggggactcgggagaacaaggtccacccggaaaagagggaccaatcggattcccaggggagcgagggctgaaaggagacaggggcgatcctggaccgcagggaccgccggggctggcccttggagaaagaggcccgcctgggccgtcgggcctggctggggaacctggaaaaccggggataccagggctgccgggccgcgctggaggggtgggggaggcgggaagaccgggcgaacggggagaacgaggtgaaaagggagaacggggagaacagggtcgcgacggaccaccagggctgccaggaaccccgggaccaccgggaccgcctggccccaaggtcagcgttgacgaaccgggtccgggactttccggagaacagggaccgcccggattgaagggcgcaaagggggagcccggctcaaacggtgatcagggaccaaagggagacaggggggtgccggggatcaagggagatcgcggagagccagggccgcgggggcaagatggaaatccaggactgccgggtgagcgcggcatggcggggcccgaaggaaagccgggactgcaaggacctagaggaccgcccggcccggtgggcgggcatggagatccaggacccccaggagcgccgggcctggcggggccggcgggaccgcaaggaccatcgggcctgaagggcgaaccgggagaaactgggccgcctggcagaggactgaccggacctactggagcggtgggactgccaggaccaccaggaccttccgggcttgtcggaccccaggggtcgccgggactcccaggccaggtcggggagactggaaagccgggcgccccagggagagatggggcgtcaggcaaggatggggatcgcggttccccgggtgtccctggaagcccaggactgccgggaccggttgggccaaaaggtgagccggggcccactggcgcccccggacaagccgtggtggggctcccaggtgcgaagggcgaaaaaggagcgcctggaggactggccggcgaccttgtcggagagcctggtgccaagggcgatcgcggtctgcctggacctagaggcgagaaaggagaagcaggacgggcgggagagcctggcgatccgggagaggacggacagaagggagcaccggggccgaaaggattcaaaggggacccaggagtcggtgtcccgggttcccccggcccgcctggcccgcctggagtgaagggagatctgggactgcctggcctgccaggcgctccaggagtcgtcggattcccgggacagactggaccacggggagaaatgggacaaccaggaccctcgggagaacgcggcctcgctggacctccggggagagaggggatccctggtccgctcgggccgccggggccgccaggatctgttggaccgccaggagcgagcggcctcaaaggagacaaaggagatcctggggtgggactcccaggaccgagaggagagcggggggagccaggtatcaggggggaggatggacggccaggacaagaaggacccaggggattgaccgggccgccgggatcacggggagaacgcggagaaaagggagacgtgggaagcgccggccttaaaggtgacaagggagattccgctgtcatcctcggaccaccaggaccccgcggtgccaaaggcgacatgggggaaaggggtccgaggggactcgacggagataaaggaccgcggggagacaacggcgaccctggagataagggctcgaagggagaaccaggagataaagggtcagcagggctgcccggactgcggggactgctgggaccgcagggccaacctggcgcggcggggatccctggagatcctgggtcaccgggaaaagatggagttccaggcattcgcggcgaaaagggcgatgtgggctttatggggccacggggactcaagggagaaaggggggtgaaaggcgcatgcggactggacggtgaaaagggagataagggcgaagctggaccaccgggacgcccgggcctcgcaggacacaaaggtgaaatgggtgagccgggagtgccaggacagtccggcgccccgggaaaggagggtttgattggaccgaagggagatcgcggattcgacggacagccgggacctaagggtgatcagggagagaagggggagcgcggaacccctggcatcgggggattcccgggaccatctggcaatgatggaagcgcgggtcctccggggcccccgggatccgttgggccgcgcggtccggagggcctccagggacagaagggagaacgcggcccaccgggtgaacgggtggtgggagctcccggagtgccgggagcgccgggggaacgcggagaacagggaagaccgggcccggccggaccgcggggcgagaagggcgaagctgccctgactgaagatgatattagggggtttgtcagacaggaaatgtcccagcactgcgcttgccaaggacagtttattgcctccggatcacggccgctgccttcgtacgccgctgacaccgcgggaagccaactgcatgcagtcccggtgctccgcgtctctcacgccgaagaggaggagagagtgccgccggaagacgatgaatattcggagtactcagaatacagcgtcgaagaataccaagatcccgaagcaccgtgggacagcgatgacccttgctcgttgccgctcgacgagggatcgtgcaccgcgtacactctccgctggtatcaccgcgcggtgaccggaagcaccgaggcctgtcatcccttcgtgtacggtggctgcgggggaaatgccaatcgcttcggcactagagaagcgtgcgagcggcgctgcccgccccgcgtggtccaatcgcagggaaccggaactgcccaggac

SEQ ID NO: 9628 - DNA, 8832 bp, Artificial Sequence
  Description of Artificial Sequence: Synthetic coding sequence
atgactttaagactgctagtggctgccctgtgcgccggcatcttggcagaagctcctagagtgcgggcccagcatcgagagcgcgtgacttgcactcggctttatgccgccgacattgttttcctgttggatggctcttcttcaattggtcggtcgaattttcgggaagtaaggagttttctggagggactggtgttgcctttctctggagccgctagtgctcagggcgtgcgctttgctacggtccagtactcagacgatcctagaaccgagttcgggttggacgctctggggtccggcggcgatgttattcgcgctattcgcgagctaagctacaaaggcggtaatacacgcactggcgccgctatactccacgtcgccgatcatgtgttcctgccgcagctggcgcgtcctggcgttcctaaggtgtgcatcctgatcacagatggtaagagccaagacttagtcgacaccgccgctcagcgtctcaaagggcagggcgtgaagctcttcgcagtggggatcaagaatgcagacccagaagagttaaaaagggtggccagccagccaacctctgatttttttttctttgtaaacgatttttccatcttgcgaacgctcctccccttggtatcacgcagggtttgcacaacagctggcggcgttcccgtcactcgacccccagatgattcgaccagcgcgccccgggatctggtgctttcagagccctccagtcagtcactgagagtccagtggaccgcggcatctggtcctgtgacaggttacaaagtgcagtacaccccgttgactggactcggacagcctctgccgagcgagagacaggaggttaacgttccagccggcgagacgtctgtccggctcagagggctgcggcccttgactgaataccaggtcaccgtaatcgccttgtacgccaatagcatcggggaggccgtatccggaactgcccgcacaaccgcgctggagggtcccgagttaaccatccagaacactacagcgcattccctgttggtggcgtggcggtccgtcccgggtgctacaggttacagagtgacctggagggttctgagtgggggtcctacccaacaacaggaactgggaccaggacaaggttcagtcttgctccgcgatctcgaaccaggcacggactatgaagtgaccgtgtcaactttgtttggccgctctgtgggacccgcgacttctctgatggcacggaccgacgcgtccgtagagcagactcttcggcccgtgatcctaggccccacttctatcctactcagttggaacctggtaccggaagcgcgagggtataggcttgagtggaggagggaaacaggcttagagccccctcaaaaagtcgttctgccttccgatgtcacccggtaccaactggacgggctgcagccagggactgaatacagactcactttgtacacattgctggagggtcatgaggtggccacaccagccacagtggtcccgaccggacctgagctgcctgtgtctccagttactgacttacaggcaacagaactgcccggccagcgagtgcgagtgtcatggtcacccgttcccggcgccacacagtaccgaatcatcgtccggtcgacccagggtgtcgagcgaaccctggtcctgccaggctctcagacggcattcgacctggacgacgtgcaggcaggactcagctacactgttagggtctccgcgagggtagggccaagagaggggtcggcgtcggtcctcacagtgaggcgcgagcctgaaactcctctcgcagtaccaggccttcgagtggtggtcagtgatgccacgcgcgtgagagtcgcgtgggggcccgtgcccggagcaagcggattccgaatatcctggtccactggtagcggccccgagtccagtcagaccctcccacccgactctacagccaccgacataaccggtctgcaaccagggaccacttatcaagttgccgttagtgtgttaagggggcgtgaagaagggcctgccgctgtgatcgtagccagaacagatcctctaggacctgttcgtactgtgcacgtgacacaggcttctagtagcagtgtgactataacctggacacgcgtcccaggggccactgggtatcgggtcagctggcacagcgcacatgggcctgaaaagtcacagctagtcagtggggaagctaccgtggcggaactggacggcctggagcccgacaccgagtataccgtccatgtgcgtgcccatgtcgccggtgttgatggtccacctgccagcgtcgtggttcgaacggcccctgagcctgttgggcgagtatcaaggttacagatcttaaatgcatcttctgatgtgctgcggatcacctgggtgggcgtcaccggcgcaacagcttatcgcctggcgtgggggcggtctgaaggaggccccatgaggcatcagatcttacctgggaatactgacagcgcagagatcagaggcctggaaggcggcgtgtcctattctgtcagagtcactgccttggtcggtgaccgcgaggggacacccgtcagtatagtggtaacgacccctccggaagctccccctgctctgggcactctgcacgtcgttcagagaggggaacatagtctgagactccgatgggaaccagttcccagggcccaaggctttttgctccactggcagcccgaggggggacaggagcagtctagggtcttgggacctgagctgtcctcttatcatctggatgggcttgaacctgcgacccagtatagagtgcgcctcagcgtgctaggacccgccggagagggacccagtgcagaggttaccgcccgaactgaaagccccagagtcccgtctatcgagttacgcgtagtggacactagtatcgactccgttacgttggcctggacacctgtgagccgggcatcatcatatattctgagttggcgccccctgcggggtcccgggcaagaagtgccagggtccccgcaaactctgcccgggatcagttcaagccagagggttaccgggctcgagcccggggtttcttacatttttagccttacacctgtgctcgacggcgtacgcggtccggaggcaagcgtgacccagacccccgtttgccccaggggactggccgatgttgtatttttaccacacgcaacacaggataacgcccatcgcgctgaggccacgcggagggtgctggagaggctggtgctggctttaggcccactgggcccccaggctgtccaggtgggtctgttatcctactcccataggccctccccattattcccattgaacggctcccatgatttgggtattattctccaacgcattagagacatgccctacatggacccctctggaaacaatctgggcactgctgtggtcaccgctcacaggtacatgcttgcgcctgatgcgcccgggcgaagacagcacgtgccaggggttatggtgctattggtggacgaaccacttcgtggtgacatttttagccctatccgcgaggcacaggcgtccggactaaatgtggtcatgctcggaatggccggagccgacccggagcagcttagacggctcgcaccaggaatggattcagttcagacattcttcgcagtggatgatgggcccagccttgaccaggctgtgtctggtctggcgaccgcactatgccaagcttcatttaccacgcagccgcgacctgaaccttgcccagtctactgtccaaaaggtcagaagggcgagccgggcgaaatggggctgcgtggtcaagtgggccctcccggggaccccgggttgcccggtagaactggtgcccctgggcctcaggggccacctgggtccgccactgcgaaaggggaaagaggattccccggcgcagatggcagaccaggaagcccaggaagggccgggaacccagggacccctggtgcgccagggctgaagggatcccccggactacccggtccacgcggcgatccaggagaaaggggtcctaggggccccaagggcgaaccaggagcccctggccaggtaattgggggtgaagggcccggactgcctggaagaaagggcgaccccggtccctccggaccccccggtccacgggggccgttaggtgatccaggccctcgaggaccgccaggattaccggggaccgccatgaaaggcgataagggcgatcgcggcgaacgggggccgcccggccctggcgagggcggaattgcccctggggagcctggcctccccggtctccccggatccccagggcctcagggccctgttggcccacctgggaagaagggtgagaaaggtgattccgaagacggtgctccggggctcccggggcaacctggatcacctggcgagcagggaccacgcggaccaccaggggctattggcccgaaaggggatcgggggttccctggcccgcttggggaagccggagaaaaaggggagcgggggcctcccgggcctgcggggagcagaggcctgccgggtgtagccgggcgacctggcgccaaggggcccgaagggcctcctggacccaccggaagacagggagaaaagggcgagcctggtaggcccggagaccccgccgtggttggacccgctgtggcgggccctaagggcgagaaaggggacgtgggccctgctggccccaggggggccactggcgtgcagggagagcgcggcccgcccggcctcgtccttcctggcgatcctggccctaaaggcgatccaggagaccggggcccaatcggtcttactggccgagcagggcctcctggagattctgggcctcctggggagaaaggggaccctggcagacccgggccacccggaccggtgggtcctcggggacgggacggcgaggtaggggagaaaggtgacgaaggaccacctggagaccccggactgccggggaaggcaggggagcgcgggttgagaggcgccccaggagtgcggggaccagtgggcgagaagggcgatcagggggacccaggcgaagacgggagaaacgggtcacctgggagtagcgggccaaagggtgatagaggggagcccggaccacctgggcctcctggccggttggtcgatactggaccaggcgctcgagagaaaggcgagccaggtgacagggggcaggaggggcctcgcggccccaaaggggacccaggcctccctggcgccccaggcgagcgggggattgagggttttagaggaccaccagggccacagggggatccaggtgttagaggcccagccggcgaaaaaggtgacagggggcccccaggcctcgacggtagatccggcttagacggaaagccgggagccgccgggcccagtggtcctaatggcgccgctggcaaggcaggggatccgggacgcgacggcctacctggattgcgtggcgagcagggtctacctggtccaagcgggcccccgggactgccaggaaagccgggcgaggatgggaaacctggattgaacggcaaaaatggcgaaccaggggatccaggtgaggacggccggaaaggggagaagggtgatagtggtgcttccggcagagagggacgagacggccccaagggggaacgcggggctccagggatcctaggacctcagggcccgccagggctgccgggcccggtcgggccacctggacaggggtttcccggtgtccccggggggactggccctaaaggggatcgcggagagaccgggtccaagggtgagcagggtctgcctggagagagaggtttaaggggggagcccgggtccgttcctaacgtagatcgcctgctcgagaccgccggcataaaggcttctgcacttcgcgaaattgtggaaacctgggacgaatctagcggcagttttttacccgttcctgaacggcgacgaggtccaaaaggcgactctggagagcaagggccgccaggcaaagagggccccataggttttccgggggaacgcggattgaagggggatcggggggacccggggccccagggaccaccagggctcgcactgggcgaacggggccccccaggaccctctggactggcaggtgagccaggtaagcctgggattcccgggctcccaggccgagctggtggagtcggggaagccgggcggcctggggagcgcggcgaacgcggagagaaaggtgaaaggggcgaacagggtcgggatggcccccccggtttgccaggcacccctggaccgccaggtccccccgggcccaaagtcagcgtcgatgaaccgggtccagggctctctggggaacagggcccacccggactgaaaggcgctaagggagagccagggtcgaacggggaccaaggtccgaagggcgaccgcggggtgcctgggatcaaaggagaccgaggcgagccagggccccggggacaggacggtaacccaggattgcccggtgagagaggaatggctggcccagagggcaaacctggattacagggtccaagaggaccccccggtccggtcggcggccacggagatcccggtcccccaggagctcccgggctggctggtcctgccggacctcagggcccctccggattgaagggtgaacccggagaaacaggaccgccgggccgggggttgacgggacccactggcgccgtcggactgcccggccccccggggccatccggactagtgggtccccaaggatctccaggcttacccggccaggttggtgaaactggaaagcccggcgcacccggtagagacggcgcaagcggtaaagacggagaccgcggatctcccggtgtaccaggctctcccgggctgcccgggcctgtcggtcccaagggcgagccaggtcccaccggagctcctgggcaagcagtcgtgggcttgccgggtgccaaaggagagaaaggggcccctggcggattggctggggacttggtcggtgagcccggcgccaaaggggatagaggacttcccgggccaagaggagagaagggagaagcaggccgcgccggggagcccggagatcccggagaagacgggcagaaaggcgcaccagggcctaaaggtttcaaaggagacccaggggtcggggtccccggtagccccgggcctcctggtccaccaggagtaaagggtgatcttggccttcctgggctccccggcgctcccggggtggtcggcttccctgggcagaccgggccgcgcggggagatgggccaaccagggccttcgggagaacgcggactggccggccccccagggcgggaaggaatacctggtccgctgggccccccaggccccccggggtctgttgggccccccggcgcctctggccttaaaggggacaagggagatccaggtgtcggtcttcccggacctcggggtgagaggggtgagccaggtatcaggggcgaggatggacgccccgggcaggaaggtcctcggggattgactggcccacccggcagtagaggtgaaaggggcgaaaaaggggacgtgggctccgctgggttaaagggggataagggcgattcagcagtgattttgggcccacccggacctcgaggcgctaagggcgacatgggtgagagaggtccgcgcggactcgatggagacaagggacccagaggcgacaacggtgatccaggagataagggaagcaaaggtgaacccggagataaggggagcgcgggcctgcccgggcttcgtggactacttggaccacaaggacagcctggagcggccggcatcccgggggacccaggctctcctggcaaggatggggttcctggcatcagaggggaaaagggggacgtcgggttcatgggaccccgcggtcttaagggtgaacgcggtgtaaaaggcgcttgtggcctggacggagaaaaaggggacaaaggcgaggctggacctccgggccggcctgggctggccgggcacaagggtgaaatgggcgagccaggtgtcccagggcaaagtggtgctcccgggaaggagggactgatcggccccaaaggggacagagggtttgacggacagccagggcccaaaggcgaccaaggcgaaaaaggcgaaagaggcacccctggcataggcggttttccagggccttccggcaatgatggatctgccggcccccccgggcctcctggaagcgtgggtccacggggacctgagggtctccagggccagaaaggcgagagaggccctccaggcgagcgggtcgtgggagcccctggcgtgcccggagcacccggcgagaggggagagcaggggaggccgggacctgccggtcccaggggggagaaaggcgaagctgctctgaccgaggatgacatacgcggtttcgttcgacaagaaatgagtcagcactgtgcttgccagggccaatttatcgccagtggaagtcgccccctcccttcctacgccgctgataccgccggaagccagctgcatgccgtacctgtgctccgcgtgtcgcatgctgaggaggaagagagggttccccccgaggatgatgaatacagcgaatactccgaatacagtgtggaggagtatcaggatccagaagcgccttgggattccgatgacccatgttcacttcctctggacgagggctcatgtacagcttacacactgagatggtaccatagggctgttaccgggagtacagaggcgtgtcacccgttcgtatacgggggctgcggtggcaacgctaatcggttcgggactagggaagcttgcgaacggagatgcccccctcgtgtcgtgcagtcccagggcactggcactgcccaggac

SEQ ID NO: 9629 - DNA, 8832 bp, Artificial Sequence
  Description of Artificial Sequence: Synthetic coding sequence
atgaccttgagactgctagttgctgctctgtgcgcgggcatcctggcagaggccccacgcgtgagggcgcaacaccgtgagcgcgtgacttgcacaagactgtacgccgcagacatcgtctttctgctagacgggtcttcgtccatcgggagaagtaattttagagaagtcaggtcttttcttgaggggctggtcttgccattttccggcgccgcatcggcccagggggtgcgcttcgctacggtgcaatactctgacgacccccgtaccgagtttggcctggatgcactcggttctggaggcgatgtaatccgggctatcagagagctttcttataaagggggaaatacacggactggcgctgccattttgcatgtggccgaccacgtgttcctgccccagctggctaggccgggcgtacccaaagtgtgtattctgatcaccgatggaaagagccaagacttggttgacaccgccgcgcaacgcctgaaggggcagggggtcaaactgttcgctgttgggataaagaatgcagaccccgaagagctcaagcgggtggctagtcagcctacgtctgacttctttttttttgtgaacgatttcagtattctgagaacattgctccctctcgtgagccgtcgagtctgcacaactgcaggtggcgtccccgtgacccgccccccagacgatagtacaagcgctccccgcgatcttgtactatcagaaccaagttcccaaagcctgagggtgcagtggactgctgcgtctggtccagtcaccggatataaggtgcaatatacaccactgacggggctggggcaacccttgcctagcgaaaggcaagaggttaatgtgccggctggcgaaacatctgttagactcaggggactgagacctctgactgagtatcaggtcacagtgattgccttatatgccaattctataggagaggcggtttctggaacagctaggacaactgcgcttgaagggccagaactcaccattcagaacaccaccgcccattccctgctggtggcctggaggtcggtgccgggtgccacaggttatagggtgacctggcgcgtgctgtctggcggacctacacaacaacaagaattaggccctggccaggggagtgtcttgcttagagacctggagccaggaactgactacgaagttaccgtatccaccctctttggaagatccgttgggcctgctacttcactgatggcccggacggatgcctctgtagagcagaccttgcggcctgtcatccttgggcccacatctatccttctctcgtggaaccttgtgccggaagctcggggctacagactcgaatggcgtcgtgaaacaggtttggagcccccgcagaaggttgtgctcccctctgatgttacccggtaccagctggatggcctgcagcctggtactgagtacaggctcacactgtacacactgctggagggtcacgaggttgcgaccccagcaactgttgtgcctacaggccctgaactccccgtaagtccagttacagatctgcaggcgacggagctaccaggacagcgggtgagggtctcctggtcaccggtgccgggagctacacaataccgtataatcgtgcgaagtacccagggggtagagaggaccctagtccttcctggcagtcagacagcgtttgatctcgacgacgtgcaggcagggctatcctataccgtacgagtgtccgcccgcgtgggaccgcgtgagggtagcgcgagcgtcctgacagtgcgtagagagccagaaaccccgttggcagttcccgggctgcgagtggtcgtctctgatgcaactcgggtgagagtggcttggggtcccgtgcccggagcaagcggattcaggatcagctggagcacagggagtggccctgagtcgtcgcaaaccctgcctccagattccaccgcaacagatattactgggctgcagcccggcaccacatatcaggtggctgtttcagtccttagaggtcgagaggagggtcccgccgccgtaatcgttgctcgcacggatccacttgggccagttcgcaccgtccacgtgacacaggcctcttcttcttccgtaaccattacctggactagggtgccgggggccaccggttatcgggtttcatggcactccgcccacggtccagagaagagtcagttggttagcggcgaggccactgtggccgagctggatgggctcgagcccgataccgagtacaccgtgcatgtgcgagctcatgtcgccggagtggacggaccccctgctagtgtcgtggttaggacagcccccgaacctgtggggagagtctcaagactgcagattctcaatgcaagctcggatgtccttagaataacttgggtcggtgttaccggtgctaccgcatacaggctggcctggggacgaagtgaaggaggacctatgagacatcaaattcttcccggcaatacagattcagccgaaattaggggactggagggaggagtgagctacagtgttcgggtgacggccctcgtgggtgacagggaaggtacacccgtgagcatagtggtgactaccccccctgaagctccacccgctctgggtacactgcatgttgtgcagagaggagagcattccctgcgactcaggtgggaaccagtcccgcgagcccagggcttcctactccattggcagcccgaaggcgggcaagagcaatccagagtgctcggacctgaattgtcctcctatcacctggatggtctcgagcccgcaacacagtatagagtcaggctttcagttctgggaccagcaggtgaggggccttctgccgaggtgacagcccgaacagaatctccccgcgtccccagcatagaactgagggtggtggataccagcatcgatagcgtgaccctggcctggactcctgtaagcagagcaagctcctatatcctaagctggagacctcttagaggacccggacaggaagttccagggtctcctcaaaccctcccgggcattagctcatctcagcgggtaacaggcctcgagccaggcgtttcctacatattctctctgacccccgtcctggacggtgttcggggcccagaggcttccgtgacccaaactcccgtctgcccccgtggcctggccgacgtcgtgtttttaccgcacgccacccaggataatgcccaccgagccgaggcaacccgacgagttctggaacgcctggtgctagctctggggcctctcggtccacaggccgtgcaagtgggcctgctgtcttactcacaccgacccagccctctattcccgctgaacgggagtcacgatctgggaataatcctgcagcggataagagacatgccttacatggacccttcagggaacaatctcggcactgcagtagtcaccgctcaccgttacatgcttgcgccagatgcaccgggcagaaggcagcatgtgccgggcgttatggtactgctggtggacgagcccctgaggggagacattttctcgcccatacgggaggcccaggcgtcggggctgaatgtggtaatgctgggaatggccggcgctgatccagagcagctgagacggcttgcaccaggaatggactctgtgcagaccttctttgccgtggatgacggccctagcctagatcaagcagtgtccgggcttgccaccgccctttgtcaggcttccttcaccactcagcctcgccccgaaccctgcccagtttactgcccaaaagggcagaaaggggagcctggtgaaatgggactgcggggacaagtggggcctcccggcgatccgggactgcctggtcgcacaggcgctcccgggccgcagggtccccctggaagcgcaactgccaaaggggaacgtggtttcccaggtgcggacgggcgtcctggatccccaggaagagctggtaacccaggcacgccaggagcaccaggtctgaagggtagtcctggactccctggacccagaggtgatcctggcgaacgggggccccgcggaccaaaaggagagcccggagcaccagggcaagtcattggcggtgagggtcctgggctacctggtcgcaagggagatcctgggccaagcggcccaccagggccacgggggcccctcggagacccaggcccaagagggccacctggcctgccaggcacagcgatgaagggggacaagggcgaccgaggcgaaagagggccacctggccctggcgaaggaggaatagcccccggagagcccgggctccctggattgcccggttccccgggaccccagggccctgttggacctccgggcaagaagggcgagaaaggcgattcagaggatggggcacccggtctgccaggacagccggggtcacccggcgaacaggggccaagggggcccccaggcgcaattgggcctaaaggggatcgaggatttccaggacctctcggggaagcaggcgaaaagggagagcgcggccccccaggaccggccggctctcggggactgccaggtgtggccggtagaccaggggcaaaggggcctgagggcccccccggtcctacaggccgccagggcgaaaaaggagagccaggacgcccaggggaccctgcagtggttggacccgcagtggcggggcccaagggcgaaaaaggggatgtgggaccggcaggcccccggggagccaccggagtgcagggcgaacgggggcctccgggtctggttctgccaggagatcctggtcctaaaggagacccaggggatagaggaccgatcggactcacgggccgcgctggcccccctggtgatagcggtccgcctggggagaagggtgatccaggtagacctggcccccctgggcccgttggacccagaggcagggacggtgaggtgggggaaaagggagacgagggtccaccaggtgaccctggactccctggtaaggctggcgagcgtgggctgaggggggcgcctggcgtccggggtcctgttggggaaaagggagaccaaggggaccccggcgaagatggtcggaacgggtccccaggatccagtggacccaagggagacagaggggagccaggcccccccggaccaccagggcgtcttgtagatacaggtcccggcgcaagggaaaagggcgagcccggcgaccgggggcaggaggggccgcgaggcccaaagggtgatcctgggcttccgggagccccaggcgagaggggaatcgaaggcttcagaggacctcccggtccacagggagaccctggagtcaggggccccgccggcgagaaaggggaccgaggaccaccggggctcgatggtagatcaggcttagacggcaaacctggagctgccgggcccagcggacccaacggcgctgccggcaaggccggtgaccccggccgggatggactacccggcctccgcggggagcaaggtcttccaggcccttctggaccccccgggctccctgggaaacctggcgaggacggcaaacctggactgaatgggaagaatggcgagcccggagacccaggagaggacggccgcaagggcgagaagggcgatagtggagcttcgggaagagagggacgggacggacccaagggcgaacgtggagcccctggtatactgggtccccaaggcccccctggcctgccaggccctgtggggccacccggtcagggattcccaggcgtgcctggtggcactgggcccaagggtgataggggcgagacaggcagcaaaggagagcagggactgccaggcgagcgggggttaaggggcgaacccggctccgtcccaaatgtggaccgactgctggaaacggcaggaattaaggccagcgccctcagggagattgtcgagacctgggacgagagtagcgggagcttcctccccgtgcccgagagacgaaggggccccaaaggggacagcggtgagcagggcccacctggcaaggaagggcctatcggcttccctggcgagcgaggactgaagggggataggggcgatccgggcccacaaggaccaccaggattggccctgggggaaagaggaccccctggaccgtcaggcctcgctggagagccaggcaagcccggcatcccgggactgcccggccgagcaggaggcgtgggggaggccggtcgtcctggcgagcgtggggaacgaggggaaaaaggggagagaggtgagcagggcagggacggtccacccggccttccgggcacccccggaccgcctggtccgcctggcccaaaagtgtccgtggatgagcccggcccaggacttagcggcgagcagggacctcctgggctgaagggcgccaaaggcgagcctggctcaaatggagaccaaggccctaagggcgataggggggtaccaggtatcaagggagaccgcggcgaaccaggtccaaggggccaggacgggaatcctggtctgcctggggagagggggatggcagggcctgaaggaaagcctggcctgcaaggacctcgaggccccccaggccccgtgggagggcatggggatccaggccctccaggcgcgcctggcctggccggccccgccgggcctcaggggccttctggcttgaagggagagccgggggaaaccgggcctcccggcagaggtctgacaggacccactggagctgtcggactgcccggaccacctggcccgtccgggcttgtgggtcctcaaggctcgccaggcctccctggacaggtcggcgagaccggcaagccgggtgctcccggcagagatggagccagtggcaaggatggagaccgtggcagtcccggggtccccggctcacctggccttcccgggcctgtaggcccaaagggggagcccgggccgactggcgcgcccggccaggcagtggttgggcttcccggggcaaagggcgaaaaaggagcgcccggcgggctggctggggatcttgtgggtgagccgggggcaaagggtgatcgaggtctccctgggcctcgaggtgagaagggagaagccggaagagccggcgagccgggggaccccggagaggacggtcagaaaggcgcccccgggccaaagggttttaaaggggatcctggagtcggtgtccccggtagtcctgggccacccggcccacccggcgtcaagggcgacctggggttgcctgggttaccaggggctcccggtgtggtcggcttccccggacagaccgggccccgtggtgagatggggcagccaggcccttccggggagagggggttggctggcccccctgggcgggaggggatccccgggcctctgggcccccctgggccacccggatctgtcggtccccctggtgcctcgggcctaaagggggataaaggggatcctggcgttggtttacctggaccacgaggagaacgtggggagcccggcatccggggtgaggacgggaggccgggtcaagagggcccacgtggcttgaccgggccacccggatccaggggggagcgcggcgaaaaaggagacgtcggatcagctggtctgaagggggataaaggcgattccgcggttatcctcggaccaccgggaccaaggggagcgaaaggcgacatgggcgagagaggacctagaggcctggacggagacaaaggaccacgcggggataatggtgaccctggggacaagggtagcaaaggagagccaggagacaaaggcagcgctgggcttcctggactgagaggcctgttgggccctcaggggcagccaggtgcagctggtatcccgggcgacccagggagcccaggcaaagacggggtgccgggaatcaggggagagaaaggagatgttggctttatgggaccacggggcttgaagggtgaaaggggagttaaaggagcctgtggcttggacggcgaaaagggcgataagggggaggccggccccccaggcagacctggacttgcaggccacaagggcgaaatgggggagccgggggtaccggggcaatctggagcccctggtaaagagggcttgattggccccaaaggtgaccgagggttcgacggccagccaggacctaagggcgaccagggagagaaaggtgaacgaggcactcctgggatcgggggcttccctggccctagcgggaatgatggaagcgcgggtccgcccggtccgccaggctccgttggaccgagagggcctgaagggctccaaggccagaaaggcgaacgtggccctcccggagaaagggtagtgggtgcccctggagttcctggcgcgccgggtgagcgtggagagcagggacggccaggacctgcaggtcctaggggcgagaaaggcgaggctgcgctgactgaggacgatataaggggcttcgtgagacaggagatgtcgcagcactgtgcatgccagggtcagttcattgcttctggatctagaccactgccgtcctacgccgcagacacggccggaagccagttacacgctgttcctgtgttaagagtgagccacgccgaggaagaagaaagagtgcctccagaggacgatgagtactctgaatacagcgagtacagtgtcgaagaataccaggaccccgaagccccctgggatagtgatgatccctgtagtttgccgttggacgagggatcatgcactgcctatacactgagatggtaccaccgggcggtgacaggctctacggaggcgtgccaccccttcgtctacggcggctgtgggggaaatgcaaacaggtttggtacacgggaagcttgcgagaggagatgtccccccagggtggtgcaaagtcagggcaccggcaccgcccaggac

SEQ ID NO: 9630 - DNA, 8832 bp, Artificial Sequence
  Description of Artificial Sequence: Synthetic coding sequence
atgactctccggctcctggtggccgctctctgtgccggtatcttggccgaggcaccgcgcgtgagggcccagcacagagagagggtgacttgcacccgactttacgccgctgatatcgtctttctgctggacggctcgtcgagtatcgggcggagcaacttccgggaggtgcggagcttcctggaaggccttgtgttgcccttctctggagccgcgagcgctcagggcgtcagattcgctactgtccagtactcagacgacccgagaaccgaattcggacttgacgctctgggctcaggaggagacgtgattcgcgcaatccgcgaactctcatataaaggcggaaacacgcggacgggagcggctatcctccacgtcgcggatcatgtgttcctgccgcagctggcacgcccaggagtgccaaaagtgtgcatcctcattaccgatggaaagtcgcaagacctggtggacaccgcggcacagcgcctgaagggccaaggagtgaagctgtttgctgtgggtatcaagaacgcggacccagaagaactgaaacgcgtcgcgtctcagccgacttcggactttttctttttcgtcaatgatttctccattctgaggactttgctccctcttgtgtcacgccgcgtctgcactaccgccggaggagtgcctgtcacccggccgccagacgattccacctcagcaccgagagatcttgttctgagcgagccgtccagccagtcactgagggtccaatggaccgccgcttcgggaccagttaccggatacaaggtgcagtacactcctttgaccggactgggacaacctttgccgtccgaaagacaggaagtgaacgtgccggccggagagacttcagtgcggcttcgtggactgcgcccactgaccgagtaccaagtcacggtgatcgcgctttacgctaattctatcggagaggccgtgtcgggcactgcgcggaccaccgctctggaggggccggaactcacgatccaaaacactacggcgcatagcctcctcgtggcctggagaagcgtgcccggcgcaaccggataccgagtgacctggagagtgctgtccggcggacctacccaacagcaagaattgggtccgggacagggatccgtgttgcttcgggatctcgaaccaggcacggactacgaggtgactgtgtcaactctgttcggccggtccgtcggtcccgccacctcgctgatggcgagaaccgacgctagcgtggagcaaaccctgcggccagtcatcctcggtccaacttccatcctcctgtcctggaatctggtcccggaggcgaggggctaccggctggagtggagacgcgaaactggcctggagcctccgcaaaaggtggtcctgccaagcgacgtgactcggtaccagttggacggtctgcagccaggaaccgagtaccggctgaccctctacaccctccttgagggacacgaggtggccactcctgccaccgttgtgccgaccggtccagagctgccggtgtcgcctgtgaccgaccttcaggctactgagctcccgggtcagagagtgcgggtgtcgtggagtccggtccctggcgctactcagtacagaatcatagtccgcagcactcaaggcgtagaacgcaccctggtgctcccgggatcgcagaccgcgtttgatctggacgacgtgcaggcaggactctcctacactgtgagggtttccgcgcgcgtgggtccccgggagggatccgccagcgtgctcacggtgagaagggaaccggaaactcccctcgctgtgccgggactgcgcgtcgtggtgtcggacgccaccagagtgcgggttgcctggggtccagtgcctggagcctcgggattccgcatttcctggtccaccgggagcggaccggagagctcgcagaccctgcctccggactcgactgcaaccgatatcactggactgcagccgggcactacctaccaagtggcagtctccgtgctgcggggtcgcgaggagggaccggcagccgtgattgttgcacgcactgacccgctcggcccagtcagaactgtccatgtgactcaagcgtcgtcgtcgtcagtcaccatcacctggaccagggtgccgggggccaccggctaccgagtctcgtggcactccgcccacgggcccgagaagtcccaactggtcagcggggaggccactgtggcagagctggatggacttgagccggacactgaatacactgttcacgtgcgggctcatgtcgctggagtggatggcccaccagcatccgtcgtggttcggaccgcccctgagcctgtcggaagggtcagccgactccagatcctgaacgcatcctcagatgtgctgagaatcacctgggtcggggtgactggcgctactgcgtatcgcctcgcctggggaaggtccgaagggggaccgatgagacatcaaatcttgccaggcaatactgatagcgcagaaatccgcggcctcgaaggtggtgtttcatactccgtccgggtgacggctctcgtcggggaccgggagggaacccctgtctccatcgtggtgactacccctcccgaggcaccaccggccctgggaactctgcacgtcgtccagcgcggtgagcattcccttcgcctcagatgggaaccggtgccccgggcgcagggatttctcctgcactggcagcctgagggtggccaggagcagtcccgggtcttgggaccggaactgtcgtcctatcatctggacggacttgaaccggccacccaataccgtgtgcgcctttccgtgttgggaccagcgggagaaggaccatcggctgaagtcactgcccgcactgaatccccgcgcgtgccttcgattgagttgcgcgtggtggacacttcgattgactccgtgaccctggcgtggaccccagtgtcccgcgcatcctcatacatcctctcgtggcgcccgctgcggggacctggccaagaagtgcctggctcgccccagactctgccaggaatctccagctcgcagagagtgaccggactggagccgggagtctcctacatcttctctctgaccccggtcctggatggcgtgcgagggccggaagccagcgtgacccagactccagtgtgtccgaggggactcgccgatgtggttttcctgccccacgccacccaggacaacgcgcaccgagccgaagcgactcgccgcgttctcgaacgcctcgtgctcgccctgggaccgctgggcccgcaggccgtgcaagtgggactgctgtcctactcacaccggccgtccccgctgttcccgctgaacggttcacatgatctcggcatcatcttgcagagaattcgggacatgccgtacatggatccgtccggaaataatttgggaacggccgtggtgactgcccacagatacatgctggcaccagacgcccccggacgcagacagcacgtgcctggggtcatggtgcttctggtggatgagccccttcgcggtgatatcttcagcccgatccgtgaggcccaagcctcaggactcaatgtggtgatgctcggaatggccggcgccgatccggagcaactgcggcgcctcgccccaggaatggactcggtgcagaccttcttcgcggtggacgacggaccgtcactcgaccaggccgtgtcgggactcgcgaccgccctctgccaggcgagcttcaccactcaacctcgcccggagccttgtccagtctactgccccaagggacaaaagggtgaaccaggggagatggggctccgcgggcaagttggccctcccggcgacccgggtctgccaggaagaaccggtgcgcccggcccgcaaggaccgccaggatcagccaccgccaagggagaaaggggatttccgggagccgacggccggccgggaagcccaggccgcgccggtaaccccggaactcctggcgccccaggtctgaagggaagccctggactgccaggcccgcggggcgacccgggcgaaaggggaccgcgtggcccgaagggggagcccggggcaccgggacaggtcatcgggggagaaggtccgggattgcctggcagaaagggggacccagggccgagcggccccccaggaccgagagggccacttggtgaccccggaccacgcggaccaccaggactcccgggcactgccatgaaaggagacaaaggcgacagaggagaacgaggaccacctggacccggcgaaggaggaatcgctccgggcgagccaggattgcctggactgccaggttcaccaggaccccaaggaccggtcgggcctccaggcaagaagggcgagaagggagactccgaagatggagcccctgggctgccggggcaacccggatcgccaggtgaacagggccctcggggccctcctggagcgatcggtccaaagggagatcggggattcccggggcctctgggcgaggctggagaaaagggagaacgcggaccaccggggccagccggttcgcggggtctgcctggtgtcgccggtagaccaggcgctaagggtccggaaggaccgcctggaccaaccggacggcaaggcgagaagggggaaccggggcggccaggagatcctgccgtggtgggcccggcagtggccggtcccaaaggtgaaaagggcgatgtggggccagccggaccgaggggagccactggtgtgcaaggagaaaggggtccaccgggattggtgctgccgggcgatccgggccccaagggagatcctggggacagaggaccaatcggtctgaccggaagggcgggaccaccaggagactcgggaccaccgggcgagaagggcgacccgggaaggccgggcccaccgggcccggtggggcctcggggtagggatggagaagtgggcgagaaaggagatgaaggaccgccgggggatcctgggctgccgggaaaggcaggggagcgcggcctcagaggtgcgccgggagtgaggggcccagtcggagaaaagggggaccagggcgatccaggcgaggacggccgcaacgggagcccgggttcctcgggaccgaaaggtgaccggggagaacctgggccgccgggtccccctgggagactggtcgacaccggccctggagcccgggaaaagggtgagccgggggaccgcgggcaggagggccctcggggcccaaagggggatcctggactgccgggcgctccgggagaacggggaatcgaaggatttcggggaccgccgggcccgcagggggacccaggggtgcggggaccagccggtgagaagggtgaccgcggcccgcccggactcgacggtagatccgggctggatggaaagcctggagcggctggcccgtctgggccgaacggagcggcgggaaaggcaggagatcccggacgcgacggactccctggactccggggagaacagggattgcctggaccgtcagggcccccaggcttgccgggaaagccgggagaagatggcaaaccagggcttaacggcaaaaacggagaaccgggggacccgggagaagatggtagaaagggcgaaaaaggagactcaggagcatcgggacgggaaggccgggacggacccaagggcgaacgcggggcgccaggaatcctgggaccgcagggacctcctggcttgccaggccctgtgggccccccgggccaggggttcccaggcgtgcccggagggacgggcccgaaaggagatagaggagaaaccggttcaaaaggagaacagggtctgccaggagaacggggactgagaggagaaccgggaagcgtcccgaatgtggataggttgctggaaactgcaggaatcaaggcgagcgcactgcgcgaaatcgtggaaacttgggatgaaagctccggatcattcctgccggtcccggagcggcgccggggacccaagggtgattctggcgaacagggccccccggggaaggaagggcctattggattccccggcgaacgcggactgaagggggatcgcggcgacccaggaccgcaaggcccgccaggcctggcgctgggagagcgcggaccgccgggtccatcaggactggcaggagaacccggaaagccggggatcccaggactcccgggccgcgcaggcggcgtcggcgaagccggacgaccaggagagcgcggggagagaggagaaaaaggagagcgcggcgagcaaggacgggacggcccgccagggctgccaggaaccccgggccctccggggccgccagggcctaaggtcagcgtggacgaaccgggaccgggcctctcaggagagcagggaccgcccgggctgaagggcgcaaaaggcgagcctgggtcgaacggggatcagggcccgaagggagatcggggcgtgcctggaattaagggtgaccggggtgagccgggaccgcgcggtcaagacggaaacccagggctccctggggaacggggcatggctggacccgaggggaagccagggctccaggggccacgcggaccgccgggcccggtgggaggacacggcgacccgggaccgccaggcgctccaggactcgctggaccggccggcccgcaggggccgtcgggtctgaaaggagaacccggagagacgggaccgccggggcgaggacttactggccccactggcgcagtgggcctgccaggtccaccgggaccttcaggtcttgtgggaccccagggctcccctggcctgcccggacaggtcggagaaactggaaagcctggggcgcccggaagagatggcgcatcgggaaaggacggcgaccgcgggagccccggtgtgcccggatcgcccggcctcccgggacctgtcgggccaaagggagaacctggacctactggtgcaccgggacaggcggtggtgggactgccgggagccaaaggagaaaaaggagcgccgggaggtctggctggtgatctggtgggggaacctggggccaagggcgaccggggacttccgggaccgagaggagagaaaggagaggccggccgcgccggagaacccggagatcctggagaggacggacagaagggagcgcctggaccgaaaggattcaagggagatccgggagtgggcgtcccgggttcaccaggaccgcccggccccccgggagtgaaaggtgacctggggctgccgggtctgccaggcgcgcccggggtcgtaggattccctgggcaaaccggaccgcgcggagagatgggacaaccaggcccatcaggggagcgcggactcgcgggaccaccgggtcgcgagggtatcccgggccccctcggaccacctggtccaccgggatcggtgggaccgccgggggcaagcggcctcaaaggcgacaagggagatccaggagtgggcctgccaggacccagaggcgagcgcggagagccgggaatccgcggggaggatggaaggccgggccaggaaggaccacgggggctgaccgggcctccgggctcgcgtggagaacggggagagaagggggacgtgggatcagctggactgaagggcgacaagggagacagcgcagtcattctggggcctccgggacctcgcggggccaagggagacatgggcgaacgcggaccgaggggtctggacggggacaagggaccgcggggcgataatggggatccaggcgacaagggatccaagggagaacctggagacaagggatcggcaggcctcccaggactgcgcggtttgctgggcccacagggccagccaggagccgccggaatcccgggtgaccctggctccccggggaaagacggagtgccaggaatcaggggagaaaaaggggacgtgggcttcatgggacccagaggcctcaagggcgaacggggagtgaagggagcgtgtgggctcgacggagagaagggagacaaaggtgaagccgggcctccgggtcggccgggcctggcaggccacaaaggcgaaatgggcgagcctggagtccccggacagagcggagccccaggaaaagaagggctgatcggaccaaagggagatcgaggcttcgacgggcaacctggcccgaagggtgatcagggagaaaaaggagaacgcggtaccccaggaatcggaggctttccaggaccctcaggcaacgacggaagcgcgggcccgccaggaccgccagggtcggtgggaccgagaggacccgaaggactgcagggacagaaaggcgaacggggacctccaggtgaacgcgtggttggtgcgccgggagtaccgggcgctcctggtgaaagaggtgagcagggacgcccgggacccgccggacctcgcggagagaagggagaagcggctcttaccgaggatgatatccggggattcgtgcgccaggaaatgtcccaacactgcgcctgtcaaggccaatttatcgcctcgggttcgaggccactgccgagctacgcagctgatacggccggatcacagctgcatgcagtcccggtcctcagggtgagccatgcggaagaggaagaacgcgtcccgccggaggacgacgaatacagcgagtattccgaatactcggttgaagagtaccaagaccctgaagcaccctgggattcggatgacccgtgcagcttgcctctggacgaaggctcgtgcacggcttacaccctccggtggtaccaccgcgccgtcaccggttcgacggaggcatgccatccttttgtctacggcggatgcggtggcaacgcgaatcggttcggaaccagggaggcctgcgagagaagatgcccaccgagagtggtccagtctcaaggaacggggactgcccaggat

SEQ ID NO: 9631 - DNA, 8832 bp, Artificial Sequence
  Description of Artificial Sequence: Synthetic coding sequence
atgaccctgagactgcttgtcgcggccctttgcgccggcattctcgccgaagccccccgtgtgagagcgcagcaccgcgaacgtgtgacctgcacgcgattgtacgccgcggacattgtgttcttgttggatggttcgtcctcgattggacggtctaattttcgagaagtgcgcagcttcctagagggactagttctgcccttttcgggtgccgccagcgcacagggagtccgcttcgctacagtgcagtacagcgacgacccacgaacagagtttggactggacgcgttaggtagcggcggggatgtgatccgagccattagggagctgtcttataaaggaggtaatacgaggacaggggcagctattttgcatgtggccgatcatgtgtttctcccgcagttggctcgcccgggcgtaccgaaggtgtgcatattgataactgacggtaagtcccaggatcttgtcgatactgccgctcagcgattgaagggacagggagtaaagttatttgcagtaggaatcaagaacgcggatccagaagagctgaagcgggtagcctctcagcccacgtcggatttctttttcttcgtgaatgacttctccatccttcgcaccctgttaccgctggtgagcaggcgtgtgtgtaccacggccggtggagtccctgttacacgtccaccggacgattcgacatccgccccccgagacttggtgctaagcgaaccgtccagccagtcgctgcgagtgcagtggacggcggcctctggcccagttaccggctacaaggtacagtacacgccgctgacaggactgggtcagcccctcccgagtgagaggcaggaagtaaacgtgccggccggcgagacttccgtgcggctgcgcggattgcgccccctcacggagtatcaggtgacggtgatcgctttgtatgcgaacagcatcggcgaggcggtgtcaggcacagcgcggaccactgctcttgagggacccgagcttactattcagaatacgacggctcacagtctgctagtagcctggcgcagcgtccctggtgccacaggctaccgcgtgacatggcgtgtcctatcgggcggaccgacgcaacaacaagagttgggaccaggacaggggtcggttctgttacgcgatctagagcccggaaccgattatgaggtgactgtctcgaccctgttcggacgctccgttggccccgcaacgtcgttaatggcgcgcacggacgcaagtgtggaacagaccttgcgtcccgtaatcctgggtccgacgagcatcctgctgagctggaacctagtgcccgaggcccgcggataccgtttagaatggcgtcgtgagaccggcctcgaaccaccgcagaaggtagtgctgccaagcgatgtcacacggtatcagctggatggactgcagcccggaaccgagtatcggctcactctgtacaccctattggagggacatgaggtagccaccccggccacggtggtgcccactggccccgagctgcccgttagtccggttaccgatctgcaggccactgagctccccggccaaagggtccgtgtgagttggtcccccgtgcctggcgctacccagtaccgcattatcgttcgtagcacacagggcgtggaaagaacactggtgctccccggctcccagacggccttcgatctcgatgatgtgcaagctggccttagctacaccgtgcgggtgtctgcacgtgtaggaccaagggagggatctgcatccgtactcactgtccggcgcgagccggagacccccctggctgtgcccggcctgcgagtagtcgtttcagatgcgactcgtgtgagggtggcatggggcccagtccctggcgcctccggattcagaataagttggtcgacaggatccggtccagaatccagtcagaccttgccgccggactcaaccgcaacggatattaccggcctgcagcccggtaccacctatcaagttgcggtttccgtgttgcgcggccgcgaggagggccccgccgcagtgatcgttgccaggacggaccccctgggcccggtccgcacagtccacgtgacgcaagcttcgtcgagctctgtaactatcacctggacccgagttccaggagccacgggctacagggtaagttggcactcagcgcacggtccagagaagtcccagttggttagcggagaagcaactgttgccgaactggacggtctggaacccgatacagagtataccgtgcatgtgcgcgcccacgtggcgggggtggacggcccccccgcgagtgtcgtggtgcgcacggccccggagcccgttggtcgtgtgtcgcgtctacagatactgaacgcttcgtccgacgtcctccgaataacgtgggtcggcgtgaccggagccaccgcatacagattagcatgggggcgctccgaaggtggacctatgcgccaccagatcctaccgggcaacacagattcggcagagatccgcggtttggaaggtggcgtcagctactcggttcgagttacggcactcgtaggcgatcgcgagggaacccccgtcagtatcgtggtgacaaccccgccggaggcccccccagctctggggaccctccacgttgtgcaacgcggcgaacattccctgcgcctgaggtgggagccggttccaagagcccagggattcttgttacattggcagccagagggaggtcaggaacagagtcgagtgctcggccccgagctttctagctatcacttggacggactggagcccgccacgcagtatcgggtccgcctgtccgtgttgggccccgcgggtgagggaccgtccgccgaagttacggcccggaccgagagtccgcgcgtgccatcgattgagctgcgcgtcgtggataccagcattgacagtgtgacgctggcctggacacccgtctcgcgcgccagctcgtatattctgagttggcgccccctgcgcggcccaggtcaggaggtgccgggaagtccgcagacactgccaggaatcagctctagtcaaagagtgacgggcctggagccaggagtgtcctacatcttttctctgacccccgtgttggacggtgtgaggggcccggaagccagcgtcacgcagacacccgtgtgccctcgaggcctagcagatgttgtgttcctgccccatgccactcaagataacgctcaccgcgctgaggccacacgacgggtcctagagaggctggtcctggccctcggccccctgggcccacaggccgtccaagtgggtcttttgtcatacagtcacaggccaagcccactgttcccactgaacggtagccacgacttgggtataatactccagcgtatcagggatatgccctacatggatccatcaggaaacaatctgggcacggcagttgtaacggcgcatcgttacatgctggctcccgacgcaccaggtcgcaggcagcacgtgccgggcgtgatggttctgctggtggacgagccactgagaggcgacatcttctcgccgatccgcgaagcccaggcgagtggcctgaacgtggttatgttgggaatggcgggtgccgacccggaacagctgcgacgactggctcccggaatggattcggtgcaaacatttttcgccgtcgatgatgggcctagcctagatcaggccgtgtctggactggctacggcgctgtgccaagcatcgttcaccacccagccgcgccctgagccgtgtccagtgtattgcccaaagggccagaagggtgagccgggcgagatgggactcagaggacaggtgggaccccccggcgatccaggactgccgggacgaactggtgctccgggaccccagggccctccgggctcggccaccgcgaaaggcgagaggggctttcccggagcggacggacgtcctggctcgcccgggcgtgccggaaatcccgggacaccaggtgctccaggtctaaagggaagccccggcctcccgggaccacgcggtgatccaggagagcgagggccgcgtggcccgaagggcgaaccaggcgccccaggccaggtcatcggaggagagggccccggtctaccgggacgcaagggcgacccgggcccgtcaggaccccccggtccccgaggacctctgggagaccctggccctcgtggtcccccaggcctacctggtaccgcgatgaaaggcgataagggggatcgtggggagcgcggcccgccaggcccgggcgagggaggtatagctccgggagaaccgggactgccgggtctcccaggctccccgggaccacagggtccagttggtcccccgggaaagaagggcgagaaaggcgatagcgaggacggtgctcctggactgcccggtcaacctgggagcccgggagaacagggcccccgcggacccccgggcgcaataggcccgaaaggggatcgcggattccccggcccgttaggcgaagccggcgagaagggcgagagaggccccccaggcccggcgggctcccgcggtctgccgggcgtcgccggtcgcccgggcgctaagggtccggaaggcccccctggtcccacaggacggcagggtgagaagggcgagcctggacgcccgggtgatccggcggtggtaggaccagcggtggctgggccaaagggagaaaagggcgacgtaggccccgcaggtccccgaggagccaccggggttcaaggcgagcgaggccctccgggtcttgtgctgccaggcgaccctggacccaagggggatcccggagatcgcggacctattggactgacgggacgtgccggaccacctggagattctggtcctccgggagagaagggcgacccaggccgtccgggcccaccgggaccggtgggtcctcgtggccgggatggggaggtaggtgagaagggcgacgaagggccaccaggtgacccaggactcccgggaaaggccggagagcgcgggctgcgcggtgccccaggggttcgcggacctgtgggcgagaaaggggaccagggtgatcctggcgaagacggtcgaaacggttcgcccggatcctcgggcccgaagggtgaccgtggcgaaccgggaccgccgggcccgcccggccgcttggtggacactggaccgggcgcgcgcgaaaagggcgagcctggtgaccgaggacaggagggcccgcgcggcccaaagggagatcccggactacccggcgctccaggcgagcgtgggatagagggttttagaggaccgccaggaccacagggggaccctggcgtgcgtggtccggccggagaaaaaggtgaccgcggcccccccggattggacggacggtcggggttggatggcaagcccggggctgcgggcccgtcaggaccaaacggcgcagcaggtaaggctggcgatcccggtcgggacggactgcccggcctccgaggcgaacagggtctgccggggcctagcggaccccccggattgccgggaaagcccggcgaggacggaaagcccggcctgaacggtaagaacggagagcctggagatccaggagaggacggccgcaagggcgagaagggcgattccggcgccagcggccgcgaggggcgcgatggacccaagggagagcgcggtgcgccgggcatcttaggcccccagggtccgccgggtctgccaggtcccgtgggtccgccgggacagggcttccctggagtgccaggaggcacagggccaaagggcgatcgcggagagactggttcaaagggtgagcagggcctgcccggagagagagggctgcgtggagagcccggtagcgtaccaaacgttgatcgcttgctggagactgctggcattaaagccagtgctttgcgtgagatcgtggagacatgggacgagtcgtcgggcagcttcctaccggtgccagagcgtcgacgaggcccaaagggggattccggcgagcagggcccccccggaaaggaaggcccaatcggtttcccgggagagcgggggctgaagggcgatcgtggagaccccggaccgcagggaccgcccggcttggcactgggcgagcgtggcccacccggcccgagcggtctggcgggcgagcccggaaagccgggtattccaggcctccccggacgcgcaggcggcgtgggtgaagccgggcggcccggagagagaggagagaggggagaaaagggggagagaggcgaacagggccgcgatggacctccgggcctccccggcaccccgggtcctcccggacccccgggcccgaaggtgagtgtcgatgagcccggcccaggtctgagcggagagcagggaccaccaggtctgaaaggcgcgaagggagagccgggcagtaacggcgatcagggacccaagggagatagaggcgtgcctggaatcaagggcgatcggggagaacccggcccccgcggccaggatggtaatccgggattacctggcgagcgcggaatggccggccccgagggcaaacctggattgcagggcccccgaggaccaccgggtcccgttggtggacatggagatcccggcccgccgggagcgcccggcctcgcaggtccggctggccctcagggcccaagcggattgaagggagagccgggcgagacgggtcccccgggacgtgggctgacaggcccgaccggcgccgtgggactgccaggacccccaggccccagcggtttggtgggaccacaaggctcgccaggcctgccaggccaggtcggcgaaaccggcaagccaggtgcgccaggacgcgatggggcatcgggaaaggatggtgaccgaggtagccccggcgtacccggaagccccggcttacccgggcctgtgggaccaaagggcgagcccgggccaaccggcgccccaggccaggccgttgttggtctccccggtgccaaaggcgagaagggcgccccgggaggcttggccggtgacctggtgggtgagccgggggccaagggagaccgaggactgcccggcccacgaggtgagaagggggaagctggccgtgcaggcgagccgggagatcccggagaggacggccagaagggggcacctggtccaaaaggcttcaagggcgatccgggcgtgggagtgccaggatcgcccgggccaccgggcccccctggtgtcaagggtgacctgggcttgccgggcctgccaggagcgccaggcgtggtcggattccccgggcagacaggtccgcggggcgagatgggacagcccggcccaagcggcgaacgcggcctggcgggtccgcccggccgtgagggcatacctggccccctggggccaccgggaccccccggctccgtgggacccccgggcgcttcgggtctgaagggcgacaaaggagatcccggcgtgggactgcctggcccgcgaggagagagaggcgagccgggaatacgaggagaagacggtagacccggccaggagggtcctcgcggcctgacgggacccccgggaagtcgaggagagcgcggagaaaagggcgatgtcggtagcgcaggcttgaaaggagacaagggcgattcagcagttatcttaggaccgcccggcccacggggcgccaagggagatatgggtgaacgcggaccccgcggcctggacggggacaagggtcccagaggcgataatggagatccgggcgacaagggaagcaaaggtgagcctggcgacaagggctcggccggcttaccgggccttcggggattgctggggccccagggccaacctggcgcggccggcatcccgggcgatccggggagcccaggaaaagacggagtgcccggcatccggggagagaagggggatgtgggctttatgggcccacggggactgaagggcgagagaggcgtgaagggtgcttgcggacttgacggcgagaagggcgataagggtgaagcgggtccgcccggccgaccaggactggctggccataaaggtgagatgggagaaccgggtgtgccgggacagtcgggcgcgccgggtaaagagggcttgatcggccctaaaggtgatcgcggttttgacggccagccaggcccgaagggcgatcagggtgagaagggtgagcgaggcacccccggcataggcgggttccccgggccctccggcaacgacggatcggcgggcccgcctggacctcctggttctgtcggcccgcggggacccgagggactccaaggccaaaagggagagcggggtccacccggagagcgtgtagttggcgcgcccggcgtacccggagctccgggcgagcgcggggaacaaggccgccccggcccggctggcccccgaggcgagaagggggaggcagctctcaccgaagacgacatacgaggctttgttcgtcaggagatgtcgcaacattgtgcgtgtcagggtcaattcatcgccagcggctcccgtccgctcccgtcctacgcggccgacacggccggatcccaactgcatgcggtccccgtgctacgagtgtcgcacgcagaggaggaagaacgcgtgccgccagaggatgatgagtattcggagtatagcgagtacagtgtcgaagagtatcaggatcccgaggctccatgggattcagatgacccctgcagcttacccctggatgaaggatcctgtaccgcctacaccctacgatggtatcaccgtgccgtgaccggttccaccgaagcatgtcatcccttcgtctacgggggatgtggcggtaatgctaaccgcttcggcacccgcgaggcttgcgaaaggcgctgcccgccacgagttgtgcagagtcagggtacaggaacggcccaagat

SEQ ID NO: 9632 - DNA, 8832 bp, Artificial Sequence
  Description of Artificial Sequence: Synthetic coding sequence
atgactctgaggctgctggtggccgcattgtgcgctggaatcttggccgaagctccgcgggtgcgcgctcaacaccgggaaagagttacctgtacccggctttacgccgcagacatagtgttcctgctggacggcagctccagcattggaagatcgaactttcgggaggtacgatcgttcctggaagggttggtgctgccctttagtggagcagcctccgcccaaggagtgcggttcgccaccgtgcagtacagcgatgatccccggaccgaattcggattggacgcgctcggatcagggggagacgtcatccgggccattcgcgagctctcctacaagggagggaacactcggactggagctgccatcctgcatgtggcggatcatgttttcctgccccagctggcccgaccaggagtccccaaggtctgcatcctcataaccgacgggaaatcccaagacctggttgataccgccgcccagcgcctgaagggacagggtgtgaagttgttcgcggtaggaattaagaatgcggatccggaggagctgaagagagttgcctcccaaccaacgtcagacttcttctttttcgttaacgacttcagcattctcaggaccttgctgccgcttgtgtcaagacgcgtttgtaccactgccggcggggtgcccgtgactcggccgcctgacgacagcacttccgcaccgcgcgacttggtgctcagcgaaccaagctcgcagtcgctgagagtgcagtggactgcggcgtccgggccggtcactggatacaaggtgcagtacactccgcttaccggactcggccagccgctgcctagcgagcgccaagaagtcaacgtgccggccggggaaacctcggtccggttgcgcgggctgcgcccgctgaccgagtaccaggtgaccgtgatcgcattgtacgccaattcaattggcgaagcggtgtcgggaactgctagaaccactgccctcgaaggaccagaactgaccatccaaaacactaccgcgcattctcttcttgtcgcctggcgatcagtgcctggcgccacgggttaccgcgtgacttggcgcgtgctctcaggcggtccgactcaacagcaagaactcggcccaggacaaggttcggtgctcctcagggatcttgagccagggaccgattacgaagtcaccgtgtccactctgtttggacgctctgttggcccagccactagcctgatggccagaacggacgcaagcgtggaacagaccctgaggcccgtgattctcggacctacttcaatcctcctgagctggaaccttgtaccagaggcccggggttacaggctggaatggcgacgcgaaaccggattggaacctccacaaaaggtcgtgctgccaagcgacgtcactcgataccagctcgacgggctgcagccaggaaccgaatacagactgaccctctataccctgcttgagggtcacgaggtggcaaccccggccacggtggtcccaaccggcccggagttgccggtgtcgccagtgaccgacctccaggcgaccgaactgccgggacagagggtccgcgtctcgtggtcgccggtgccgggcgcgacccaatacaggatcatcgtcagatcgacccaaggcgtggagcgcaccctcgtccttccgggatcgcagaccgcgttcgatctcgacgacgtccaggccggactttcctacaccgtgagggtgtcagctcgggtggggccccgggagggatcggcatcggtgttgaccgtgcgccgcgaaccagaaaccccgctcgctgtcccgggcctgcgggtagtggtatcagatgcaactcgcgttcgggtcgcctggggcccagtgcctggagcctccggattccggatctcgtggtccactggaagcggccctgagtcctcgcaaaccctgccaccggacagcactgctacggatatcaccggactgcagcccggtactacctaccaggtggctgtatccgttctccgtggaagagaggagggcccggcagcagtgatcgtggcccgcactgaccccctgggaccagttcggaccgtgcacgttacccaggcttcgtcctcgagcgtgacgattacttggacccgcgtgcccggagctacgggttatcgagtgtcgtggcactcggcccacggacctgagaagtcccagctcgtgagcggcgaggccactgtcgcagagctggacgggctcgaacctgatactgagtacaccgtgcatgtgcgtgctcatgtcgcaggggtggatggacctccggcatcggtggtggtgcggactgccccggagccagtcggaagagtctcgaggctgcagatccttaacgcttcaagcgatgtgcttcgcatcacctgggtcggcgtaaccggagcaaccgcctatcgcttggcttggggccgctccgaaggaggacccatgagacaccaaatccttccaggcaatactgactccgccgaaatcagggggctggaaggtggcgtctcgtactcagtgcgcgtgacggcactggtgggtgaccgggagggcacgccggtcagcatcgtcgtgactactccaccggaggcaccgcccgccctgggaactctgcacgtggtccaaaggggcgaacatagcctgcgcctccggtgggaacctgtgccgcgggcccaaggattcctgctccattggcagcctgagggaggccaagaacagagccgggtgctgggaccggaactgtcctcctaccatttggacggtctggagccggccactcagtaccgcgtccggctgtctgtgctcggaccagccggagagggccccagtgcggaggtgacggccagaactgaatccccgagagtgccgtcgatcgaacttagagtcgtcgacacctccatcgatagcgttactctggcgtggactcctgtgtcaagagcctcatcgtacattctgtcctggcggccgctgaggggaccgggccaggaagtccctggcagtccgcagactttgcccggtatctcctcatcacaaagagtgactggactggaacctggagtgagctacatcttttccctcacccctgtactggatggcgtgagaggacctgaggcctcagtgacgcaaacccccgtctgtccgcggggcctggcagatgtcgtgtttcttccgcacgctacgcaggacaacgctcaccgcgccgaggccacccgccgcgtgcttgaaaggctggtccttgccctcggaccgttgggtccgcaggcagtgcaggtgggacttctttcctactcacaccgcccttccccactgtttcctttgaacggatcacacgatctgggaatcatactgcagagaatccgcgacatgccgtacatggacccgtcgggtaataacctgggaactgctgtggtgaccgctcatagatacatgctggctcccgacgcaccgggccgccgccagcacgtgccaggagtgatggtgctgttggtggacgagcccctgcggggggacatcttcagtcccatcagggaggcccaggcatcggggctgaacgtggtcatgctgggaatggcaggggcagaccctgagcaactccggcgactcgcaccgggtatggattcggtgcaaaccttcttcgcggtggatgatggaccatcgctggatcaagctgtcagcggactcgcgacggccctctgtcaggcttcgttcaccacccaaccccgccccgaaccctgccctgtgtactgcccaaagggacaaaaaggtgagcctggcgaaatggggctgcggggtcaggtcggcccgccgggagatccggggctccccgggcggactggggccccgggaccacagggcccccctgggtccgctaccgccaagggcgagagaggtttcccaggcgcggatggccgcccgggaagcccaggacgcgccgggaaccctggtactcccggagctccgggactcaagggatccccaggattgcctggaccgcggggggaccctggagaaaggggacccaggggaccaaagggcgaaccaggggccccgggccaggtgatcggcggagaggggccgggcctgccgggaagaaagggtgacccgggacctagcggaccccctggaccgcggggcccgttgggagatccgggtccgcgagggccgccgggactcccgggcaccgcgatgaaaggagacaaaggtgaccggggtgagcgcggccccccggggccgggcgagggtggcatcgccccgggagagccggggctccctggactcccagggtccccgggaccacagggccctgtcggcccgcctggcaagaagggcgaaaagggagactcggaggatggagccccaggactgccgggacaacctggttcccctggtgagcaagggccgcggggaccgcctggcgcgatcggaccgaaaggagatcgtggatttccaggtccgctcggtgaagcgggagaaaagggcgagcgcggcccacccggcccggcgggaagcagaggccttccaggagtggcgggtagaccgggcgcgaagggcccggaaggtccacccggacctactgggagacagggggaaaaaggcgaaccgggacgtccgggggaccctgcagtggtcggacctgctgtggccggacctaaaggtgaaaaaggcgacgtcggacctgcaggcccgaggggggcgactggcgttcagggtgagcgaggaccacccggactggtgttgccaggcgaccctggacccaaaggcgatccgggcgaccggggacccatcgggctcacgggacgcgcgggaccgcctggggattctggaccaccgggtgaaaagggggaccccgggcggccgggccctccgggaccagtcggaccgagaggacgtgacggagaggtcggtgaaaagggggacgagggaccgcctggcgacccggggctgcccgggaaggcaggagagcggggtcttaggggcgcgcctggcgtgcgcggacccgtcggggaaaaaggagatcagggggatcccggagaggacgggcgcaatggctcgccaggaagctccggtcccaagggagatcgaggcgaaccaggacctcccggacctcccggccgcctcgttgacactggtccaggagcccgggagaaaggagaaccgggggataggggccaggagggcccacgcggcccaaagggagatccaggccttcctggcgcgcccggagaacggggaatcgagggttttcgcggtccgccaggtccgcagggggacccaggagttcgaggaccagcaggtgaaaagggtgacaggggacctccgggacttgacggtcgctccggactggacggaaagccgggagctgccggaccatcgggccctaacggtgcagccggtaaggctggtgacccgggccgagatggacttcctggactccggggggaacagggactgccaggaccgtctgggccccctggacttcctggaaaaccgggagaagatggtaagccaggactcaacggaaagaatggagagccgggcgacccaggagaagatggacgcaaaggggaaaagggcgactcgggagcctccggacgggaaggacgcgacgggccgaagggagaacggggagctccggggatccttggacctcagggcccgcctggactgccgggacctgtcggtccgccagggcagggatttccaggtgtgccaggaggtaccggcccaaagggagatcgcggtgaaaccgggtcaaagggcgagcaggggctgccgggtgaaagaggactccgcggagagccagggtcggtgcctaatgtggatcggctgctcgagacggcgggtattaaggcgtccgcgctccgggagattgtcgaaacctgggatgagagctcaggatccttcctgccggtcccagaacgcagaagaggaccgaagggggacagcggggaacagggcccgccgggtaaggagggcccgatcggattccctggcgagagagggctgaagggtgacagaggggaccccgggcctcaaggcccgcctgggctcgcgctcggtgaaaggggacctccgggaccgtccggtctggcaggtgaacccggtaagcccggaattccaggactcccgggacgcgcaggtggtgtcggtgaagcaggacgcccgggcgagaggggagaaagaggggagaagggagaacgcggggaacaaggacgggatggcccgccgggactgccgggcactcccggacccccgggcccacctggacccaaggtgtcagtggacgagccaggacctgggctctcgggggaacaaggcccgccgggactgaaaggcgccaagggagagccgggatctaacggggatcagggaccaaaaggggaccgcggcgtgcctggaatcaaaggtgacaggggagagccgggaccacggggacaggacggcaaccctggtttgccgggagaacggggaatggctgggcctgaaggaaagccgggactgcagggtccgcggggaccacctggcccggtgggaggccacggcgacccgggccctccgggggcaccaggactggccggcccagcgggccctcaaggcccgagcgggctcaagggggaacccggagaaactggcccgcctggtagagggctgactgggccaaccggagcggtcggactgccaggacctccggggccttccggactggtggggccccagggaagccctgggctgcctggacaggtgggagaaaccggcaagccaggggcgccaggccgcgacggggcctcgggcaaggacggtgaccgcgggtcccctggagtcccgggatccccagggcttcccggaccggtgggacccaagggagaacctggtccgaccggtgctccgggccaagcggtggtgggactgccgggggccaagggagagaaaggcgcgccgggagggctcgctggtgacctggtcggcgaacctggagcaaaaggcgatagaggactcccaggaccgcgcggtgagaaaggggaagcgggaagggcgggggagccgggcgatcccggcgaagatggtcagaagggggcaccgggaccgaaaggctttaagggcgatccgggagtgggagtcccagggtcgcctgggcccccgggcccacctggcgtgaaaggagatctggggctgccgggcttgcctggggctcccggagtcgtcggcttcccgggacagactggcccgcggggtgaaatgggccagccggggccgtccggcgaaagaggtctggctggtccgccgggtcgcgaaggaatcccgggcccactcgggccaccggggccaccaggttccgtcggtccccctggagcatccggactgaagggagataagggggatccaggtgtgggactcccgggcccgcggggagagagaggagagccaggaatccgtggcgaggacggccgccctggccaagaaggacctcgcggccttactggaccgcccggatcgcgcggcgaacgcggagagaaaggagatgtgggaagcgcgggactgaagggcgataagggggactcggccgtgatcctgggacctccgggccctcggggcgccaagggagacatgggtgaaagaggacctcggggacttgacggagacaagggacctcggggagacaatggggaccctggagataagggcagcaaaggagaacccggcgacaaagggtcagctggactcccgggcttgaggggcctgctcggaccacaaggacagccaggggccgccggaatcccaggcgacccgggaagccctggaaaagacggcgtgccaggaatccggggcgaaaagggcgacgtgggattcatgggaccgagaggactcaagggagagcggggcgtgaagggcgcctgcggcctcgacggagaaaagggcgacaaaggagaagcgggaccgccaggccgcccgggactggcaggacataaaggagaaatgggggaaccgggcgtgccaggacaatccggagcaccaggaaaggaaggcctgatcggaccgaaaggtgacaggggattcgatgggcagccgggccccaagggcgatcagggggagaagggagagagagggactccgggaattggaggattcccggggccgtcagggaatgacggaagcgccggcccgccaggtccaccaggatcggtgggtccgcgcggcccagaaggactgcagggacaaaagggtgaacggggacctcctggagagcgcgtggtgggagctccgggagtgcctggtgctccaggcgagaggggcgagcaaggacggcctggtcctgcgggcccgcgcggtgagaaaggggaggcggcactcacggaggatgatatcagaggattcgtgcgccaggagatgtcgcagcactgcgcttgccagggacagtttattgcgtccggctcgcgcccactgccgtcgtacgccgcggacacggcgggctcgcaactgcacgcagtgccagtcctgcgggtgagccatgcagaagaggaagaacgcgtcccgccggaagatgacgagtactcagaatactcggaatactcagtggaagaataccaggatcctgaagccccatgggactcggacgacccctgcagtctcccgctggacgaaggctcatgcactgcttacacgctgcggtggtatcaccgggccgtcactggctctactgaggcgtgccatccgttcgtctacggaggatgcggcgggaacgctaatagatttggaactcgcgaggcgtgtgaacgaaggtgcccaccgagagtggtgcaatcccagggcacgggtaccgcccaagat

SEQ ID NO: 9633 - DNA, 8832 bp, Artificial Sequence
  Description of Artificial Sequence: Synthetic coding sequence
atgacgttgcggctgctggttgctgcgctttgtgccggtatcctggcagaggctccacgagtgcgtgcgcagcatagggagagggtcacttgcacgcgcctgtatgctgcagacatcgtatttctcctcgacggctcatcaagtattggcagatccaatttcagagaagtccgaagttttctggagggactggtgctccctttctctggtgctgcgagcgcgcagggtgtcagattcgctaccgtccagtacagcgacgatccgcgcacagagttcggcctagatgctctcgggtcaggaggcgatgtgatccgtgccattagggagcttagctataaaggagggaatacccggacgggtgccgccattttgcacgtggccgaccatgtttttctgccacagctcgcccgccccggggtgccaaaagtttgtatcctcattaccgacggaaagagtcaggatttggtggataccgccgcgcaacgactcaaggggcaaggagtcaaactcttcgcggtgggaattaaaaacgcggatcccgaagaactcaaacgggttgccagccagccaacttctgatttcttcttctttgtaaatgacttctcaatcctgagaacactgctccctctggtttccaggcgcgtgtgtaccactgccggcggagtgcctgttactcgcccccccgacgatagcacaagcgcacctagggatttggtgctcagcgagcccagcagccaatctctaagggtacagtggacagcagcatctggtccagtaacgggatataaggttcaatacactccattgaccggtctgggtcagccactgccttccgaacggcaggaagtgaacgtaccagccggcgaaacatccgtccggttaagagggcttaggcctctgaccgaatatcaggtcaccgtgatcgcactgtacgccaacagtattggagaagccgtgtcaggcaccgcaaggactactgctttagagggacccgaattaactattcagaatactacagcgcactctctgctggtcgcatggcgctcagtgcctggcgccacgggctatcgggtgacctggcgcgtcttgtcgggtggccctacacagcaacaggagctcggtcctgggcagggatcggtactgctgagggacctcgagccaggcactgactacgaggttacagtgtccaccctgttcgggcgcagcgtcggcccagcaacttccctaatggcacgtacagacgcctcagttgagcagaccctgcggccagtgattctaggcccaacaagtatcctgctgtcatggaatcttgtacctgaggcgcgcgggtatagactggaatggaggagagagaccggtctggagccaccacaaaaggtcgtccttccaagcgatgtaacccgttatcaactggacgggttgcagcccggcacagaatatagactaacactgtatactctgctcgaaggacatgaggttgcgacaccggcgaccgtcgtccctaccggccctgagctccctgtcagcccggtcaccgatctgcaagccactgaactcccagggcagcgtgttcgggtgtcatggagccctgtgccaggggctactcaataccgcatcatcgtgagaagcacccaaggtgttgaacgaactttggtactccccggatcacagacagctttcgacctcgacgatgtgcaggcgggactcagttataccgtccgcgtctccgcgcgagttggacctagagaaggaagcgcgagcgtcctgacggtccgccgcgagccagagacccccctggcagtgccggggttgagggttgtagtgagtgatgctacacgagtgagggttgcatggggtccagtgccaggcgcttcagggttccgcatttcctggtccactggtagcggccctgagtcatcccagaccctgcccccagactccaccgccacggatatcacaggtcttcagccaggcacgacctaccaggtggcagtttctgtgcttcggggccgagaggagggtcccgccgcagtcatagtggcacgcactgacccgcttggacctgtgcgtaccgtgcatgtgacgcaggcaagtagctccagcgtgactatcacttggaccagagtccccggggccactgggtatagagttagttggcatagcgcgcacggaccggaaaagagccagttggtctcaggtgaagcgactgtggcagaactggacgggctggagcccgatacagagtacacagtgcatgttagggcccatgtggccggggtggatgggccgcctgcttcggttgtggtgcggacggcccctgagcctgtggggagagtgagccggcttcagatactgaatgcctcttctgacgtcctacggatcacttgggtgggggtgactggggcaacagcttaccggctggcatggggacgaagtgagggagggccaatgagacaccagatattacccggaaatactgactccgccgagataagggggctggagggtggagtcagctactcggtgcgagtgaccgcgctggtcggagaccgagagggaaccccagtgtctattgtcgtcactaccccccctgaggcccccccagctttaggtacgctgcacgtggttcagcgaggcgagcactctctacgtcttaggtgggaaccagtgcctcgcgcacaaggattcctgctgcattggcagccggagggggggcaggaacagagtcgagtcctcggccccgaattaagcagctaccatctggatggccttgaaccggcaacccaatacagggtccgactatccgtgcttggacccgcaggggagggcccatcagctgaggtgacagcccgcaccgaaagccctcgggttccatcaattgagctccgggtggtggatacatcaatcgatagcgtcacacttgcttggacacccgttagccgggcttcatcttatattctgagctggcggcctctgcggggacctggacaagaggttccgggttctcctcagaccctccccgggatcagcagttctcagcgggtcactggccttgagcccggtgtttcctacattttctcgttgacaccagtgctcgatggcgtgcgaggaccagaggcctctgtcacgcagacccctgtatgtccgcgcggtctggcagatgtcgttttcttgccgcacgcgacccaggacaatgcccacagagccgaggcaacccggcgggtccttgaaaggctggtgctcgcgctagggcctctgggaccccaggcagtccaggtgggtctgcttagttatagtcaccgcccctctccattgttccctctgaacggtagtcatgatttagggataatactgcagcgcatcagggacatgccatacatggatccatctgggaacaacctgggcactgccgttgtgaccgcccaccgctacatgctagctccagacgctcccgggagacggcagcacgttcccggggtcatggtgttgctggtggatgaaccgctgcggggtgacattttttcccccatccgggaggcccaggcctctggactgaacgtcgtcatgcttggaatggcgggtgcagaccccgaacagctgcgtcgtctcgctccaggaatggattcagtccaaacgttcttcgcggtggacgatggcccctctctcgatcaggctgtctctggtctggccaccgctctgtgtcaggctagctttaccacacagccccggccggagccatgtccggtgtactgcccgaagggtcagaagggcgagcctggggagatgggtctgcgggggcaggtcggcccgccaggggacccagggttaccagggaggactggcgcacctggccctcagggtcctccgggtagcgctacagccaaaggtgagagaggttttcccggagccgatgggaggccaggcagccctggccgcgccggcaatcccggaacccctggcgccccaggcctgaagggaagtccaggtctgccgggtccacggggagaccccggcgaaagaggccctcgcggcccgaaaggcgagcctggcgcaccgggccaggtgattggaggcgaggggcctggactgcccgggaggaaaggggaccccggacctagcgggcctcctgggcctagaggaccccttggtgatcctggcccccgggggcctcctggcctcccgggaacggcaatgaagggggataaaggggaccggggggaacgcggacctccaggacccggtgaaggcggaattgcgccaggagagccagggctgccaggactccccgggtcccccggacctcagggcccagtgggcccaccaggaaaaaaaggagaaaagggagatagcgaggacggcgctccaggcttgccaggccagcctggaagtcctggagaacaggggccaaggggtcctccaggagccatcggccccaagggggatcgggggtttcctggacctctgggagaggctggtgaaaaaggagagagaggccctcctggacctgcagggtcaagaggacttcctggcgtcgccgggaggcccggcgccaaaggtcccgaaggtcctccgggcccgactgggcggcagggcgagaaaggcgaaccaggtcgacccggtgatcccgcagtggttggccctgcggtggccgggccaaagggagaaaaaggcgacgtaggacccgccggacccaggggagccaccggcgtacagggagagagggggccccctggtctcgtacttccaggcgatcccgggccaaagggggacccgggggacaggggaccaattggcctgactgggcgagctggccctcctggagattcagggcctcccggggaaaaaggcgacccgggacgcccaggcccgccggggccagtaggccctcgcggacgagacggcgaggtaggcgaaaaaggtgatgaggggcctcctggtgatcctggcctgcccggtaaagcaggggagcgaggactaagaggcgcccctggggttcgcggcccggtgggagagaaaggagatcagggggatcccggagaggacggaaggaacggctctcctggcagtagcggacctaagggtgacaggggagagccaggacccccaggtccgcccggacgtctcgtggataccggacccggtgctagggaaaaaggcgagcctggagacaggggtcaggagggtccacgggggcctaaaggtgacccaggccttccgggtgcccccggggagagggggattgaggggtttcgcggtccacctgggccgcagggagacccgggcgtgcgtggccctgctggcgagaagggcgacagaggcccaccagggttagacgggcggagcggactcgatggcaagcctggggccgccggaccaagcggtcctaatggggccgcgggtaaggcgggtgacccaggtagggacgggctgccaggcctacgcggcgaacaaggacttcccgggccatccggtcctcccggtttaccgggaaaaccaggggaggatggcaagccagggctgaatggaaaaaatggcgaacctggggaccctggagaggacgggcggaagggcgaaaaaggagattcaggggcatccggtagagaagggagggatggccctaagggggagagaggagccccagggatcttagggccgcaggggcctccaggcctgccaggaccagtcggaccaccaggacaggggttcccgggcgttcccggaggcactggccctaagggggatcgaggcgagacgggatcaaaaggagagcaaggcctgcccggagagcggggactgaggggcgagcctggctcggttcccaacgtggatcggctgctggaaactgctggaatcaaagcttctgctttgagagagatagtggagacctgggacgagagcagcggctcctttcttcctgtgccagagaggagaagaggtcccaaaggtgactcaggcgaacagggacccccaggcaaagaagggcctatcggtttccctggcgaaagagggctgaaaggagatcgaggtgaccctggtccccagggcccaccagggctagctctgggagagaggggcccacccggacccagcggcctggcgggtgagccaggtaagccaggcatcccaggcctccctggccgtgctggtggcgttggggaagccggccggcccggcgagaggggggaaagaggcgagaagggcgaaaggggcgagcagggcagggacggacccccaggactgcccggcactccaggccccccgggaccccccggacccaaagtgtcagtcgatgaaccaggtccaggcctcagtggggaacaaggacccccaggtctgaaaggcgctaaaggggaacctggatctaatggcgatcaagggcccaagggagaccgaggcgtccctggaattaaaggggatcgcggtgagcctgggcccaggggccaggatgggaatcctggactccctggagaaagaggaatggcggggccagaggggaagcccggtcttcagggcccaagaggcccaccaggcccagtgggcggtcatggggatccaggaccacctggggcccctggcttagcgggccccgccgggccgcagggccctagcggactgaagggggagcccggagagaccggcccccctgggagaggcctaacgggtcctaccggagccgtgggcttacctggtccaccagggccaagtggactggtgggccctcaaggtagcccagggctcccaggtcaagtgggagagaccgggaaacctggtgcaccaggcagagatggagcttctggaaaggatggggaccgcggaagtcctggggtgccgggctccccaggtctgcccgggccagtcggtccgaagggggagccgggccccaccggcgctcccggacaggcagtggtggggctcccaggggcaaaaggggaaaaaggcgcacctggcgggttggccggcgatctggttggtgagccaggcgccaagggtgatcggggcctgcctgggccgcggggggaaaaaggcgaagcagggcgtgctggtgaacctggcgatccaggcgaggacggacagaaaggcgctcccggacccaaagggttcaaaggcgatccaggggtcggggtgccaggctccccagggccccctggcccgccaggcgttaaaggagacctcggattgccaggcctcccaggcgcccctggagttgtaggctttcctggccagaccgggccgcgcggcgaaatggggcagcccgggccaagtggtgaaagggggcttgctggtcctcccggaagagagggcatccctggccctctgggcccacctggaccacccggctctgtcggaccaccaggagcctcagggctgaagggggataagggagaccccggggtgggactgcccggcccaaggggcgagcgcggtgagcccggaatccggggggaggacgggcgtcctgggcaggaaggaccacggggcttgacgggccccccagggagcaggggcgagcggggtgagaagggcgacgttggatctgcgggcctcaagggcgacaaaggagatagtgccgtgatacttgggccccctggccctagaggagccaaaggagacatgggggaacgggggcctcgcgggctcgacggtgacaagggacccaggggcgataacggagatcccggtgataaaggctctaaaggagagcctggagacaaggggtctgcagggctgccaggcttacgcgggttgttgggaccccagggacaacccggtgcggccggaatccccggagaccccggctcaccggggaaagatggtgtgccaggaatacgcggcgaaaaaggggacgtgggcttcatggggcccaggggcttaaagggcgagcggggcgttaagggggcttgtggcctggatggtgagaaaggagacaagggggaagcaggaccacccggcaggcccggtctcgcagggcataaaggggaaatgggcgaacccggggtgccaggacagtccggggcccccggaaaggagggtctgatcggacctaagggagaccgcggtttcgacggacagccagggccaaagggtgaccagggcgagaagggagagaggggcaccccgggcattggcgggtttcccggcccgtccggcaacgacggatccgctgggccccccggacctccaggcagcgtggggcctagagggccagaaggactgcagggccaaaagggggagagagggccccccggagaacgagtagtaggtgcaccaggggtcccgggagcacccggtgagcggggggaacagggcagacctggccctgcagggccaagaggcgaaaaaggggaggccgcgcttaccgaggatgacattcgcggtttcgtcaggcaggagatgagccagcattgcgcttgccagggtcagtttattgcaagcggatccagacccctgccatcatacgctgcagacacggcaggctcccagttgcatgcggttcctgtgctacgggtgagccatgcagaggaggaagaacgcgtgcctccagaagacgacgagtacagcgagtattccgagtacagcgtggaggaatatcaggacccggaggccccctgggacagtgacgacccttgcagcttgcccctggatgaggggagctgcaccgcatataccctgcgatggtatcatcgggccgtgacgggtagcacggaagcctgtcatccctttgtatacggcggctgcggcggtaacgcaaataggttcggaaccagagaggcctgcgagcgccgttgccctcccagggtggttcagagtcagggcacaggtacagctcaggat

SEQ ID NO: 9634 - DNA, 8832 bp, Artificial Sequence
  Description of Artificial Sequence: Synthetic coding sequence
atgaccctccgtctgctggtggccgcattgtgcgcggggatccttgcagaagccccccgcgtacgcgcccagcacagggagcgggtgacatgtacacggttatatgctgcagacattgtatttctgctcgacgggtcatcttctataggccgtagcaactttagagaggtcagatcgttccttgagggtttggtcctccccttcagcggggctgcctccgcccaaggggtgaggtttgcgaccgtccagtattctgatgacccacgtaccgagtttggattggatgctctcggtagtgggggcgacgtgatccgcgccatcagagaactgtcgtataaaggtggaaacacaagaactggagccgctatactgcacgtggccgatcatgttttcctcccacaactagccaggccgggcgttcccaaggtgtgtattctcataacagacgggaaaagccaggatctagtggacacagccgctcagcgccttaaaggacagggagtgaagctcttcgctgtggggatcaagaacgccgatccggaggaacttaagagagtcgcctcccaacccaccagcgactttttcttcttcgtgaacgatttctcgattcttagaaccctactgccacttgtgtcacggagagtatgtacgacggcaggtggagtaccagtaactcgacccccagatgattccaccagcgcacctcgagacctggtcctgagcgagccctcatcccaaagccttagggttcaatggaccgctgcctcagggcctgtcactgggtataaagttcaatatacacctctgacaggcctgggtcagccactcccatccgagcggcaggaggtgaatgtacccgccggcgaaacaagcgttagactaaggggtttgaggcccctaaccgaataccaggtgaccgttatagcgctgtatgccaatagcattggcgaagctgtgtccgggaccgcacggacaacagcactggaaggccctgagttgactatccagaacaccaccgcccactctctactggtggcctggcgctctgtgccaggagcaacaggttaccgggtaacctggagagttctatccggcggccccactcagcagcaggagctcggccctgggcagggaagtgtgctcctgagggatctggagcccgggacagactacgaagtgacagtgagcaccctgtttggtaggtccgtggggccagccacaagccttatggcccggaccgatgcaagcgtcgagcaaactttgcggcccgtgatactaggcccgactagcatcttgctgtcttggaacctggtcccggaagccagaggctatcggctggagtggcggagagaaaccggccttgagccaccccagaaagttgtgctgccatcggatgtaacacgataccagctggatggattgcagcccggcacagaataccgcttgacactgtataccctgctggaggggcacgaagttgctacccccgctacagtggtgccgaccgggccagagctgccggtctctcctgtaaccgacctacaggcgaccgagctccctggtcagagggtgagggtttcatggagtcctgtgccaggcgcgacgcagtacagaattatcgttaggtcgacacagggtgtcgagcgtactctcgttcttcctgggtcgcaaacagccttcgacctggacgatgttcaggccggcttaagctataccgttagggtgagcgccagagttggccctagggaaggctctgcatcagtgctcactgtgagaagagaacctgaaacaccccttgctgtgcccgggctgcgggtggtggtcagcgatgccacccgggtaagagtggcctggggaccagtgcctggcgcctccggctttcggatctcctggtccaccggctccggcccagaaagcagtcagaccctccccccagacagcactgccaccgatattactggcctgcagccgggaacaacctaccaggtggctgtcagcgttctgcgtggacgggaggagggacccgccgcagttattgtcgctcgcactgaccccttgggccccgttaggactgtacacgttacgcaggctagttcctctagcgtgaccataacatggacccgggtacccggggctaccggctatcgtgtgtcctggcacagcgcacatggacccgagaagtcgcagctcgtgtccggcgaagccactgtcgcagaactggatggacttgagccagacacagagtatactgtgcatgtgagagcacatgtcgcaggcgttgacggcccccccgcatccgtggtggtcagaacagcaccagaaccagtcgggagagtatctagattacagattttgaacgcatcaagcgacgtgcttcgtatcacttgggtgggcgtgacgggcgcaaccgcttatcggcttgcttggggacgatctgagggcgggcccatgcggcaccagattctccccggcaacaccgactccgccgagatcaggggtttagaagggggcgtgtcttacagcgttcgagtgaccgctttagtcggcgatagggaagggactccagtcagtattgttgtgacaacgccacccgaagcgccccctgcattggggacactgcatgtcgttcagcgaggagagcactcattgcgtctgcggtgggagcccgtgcctcgagcccagggctttctcttgcactggcagcctgagggcggacaggaacagagtcgcgtcctaggcccagagctgtcatcttatcacttggacggactggagcctgcaacgcagtacagggtccgcctgagtgtgctcggcccagctggagagggaccgtcagcagaagtcacagcccgtacagagtccccaagggtcccatcaatcgaactgagagtggttgatacaagcattgattcggttactctggcttggactccagtgtcccgtgctagtagttacatcttaagctggaggccacttcggggcccaggacaggaagtcccaggttcaccacaaacactgcccggcatctcatccagccagagagtcactggcctggagccaggcgtgtcctacatttttagtttgacgccggtgctggatggtgtgcgaggccccgaggcaagtgtgacacagacccctgtatgtcctcgcggtctcgctgacgtagtgttccttccacatgccactcaggacaatgcccatcgagcagaggcaactaggagggtcctggaaagactcgtcttagcactgggaccactcggtccacaggccgtacaggtgggcttgcttagttatagccaccgcccctcaccactgttccctcttaacggatcgcatgatctgggaatcatcctgcagagaatcagggacatgccatatatggaccccagtggaaataatctgggaacagcagtggtgaccgcacatagatacatgttagcacccgacgcaccaggcaggcgccagcacgtcccgggagtcatggtgctactggtcgatgaaccgctgcgaggtgacattttttcccccatccgcgaagcacaagcctctggcctcaatgtcgtgatgctcggaatggctggggcagaccctgagcaactgcggaggcttgctccgggcatggatagcgttcaaactttttttgcagtggatgacgggcccagccttgatcaagccgtgtccggcctggccactgcattgtgccaagcaagttttactacccagcctcgccctgagccatgccccgtgtactgtccaaagggccaaaaaggcgagcccggtgagatggggctgagaggacaggtagggcctccaggcgatccggggctgcccgggcgtaccggcgcccccggaccgcagggcccacctggtagcgctaccgccaaaggggaacggggatttcccggcgctgacggtaggcctggctccccagggcgcgcgggaaacccaggcactccaggcgcccccgggctgaaaggatcgcctggactgcccggtccccgtggagacccaggtgaacgagggccgaggggccccaagggtgagccaggcgcgccaggtcaggtcattggtggcgagggccctggattgccaggacgaaagggggaccccgggccctccggtcctccaggccctaggggcccgctcggcgacccaggcccaaggggtccgcccggcctgccaggaactgctatgaaaggcgataagggcgataggggggagagagggcccccagggcccggggaaggcggaatcgcacccggggagcctggacttccaggacttccagggagccccggtccacagggacctgtgggacctcctggtaagaaaggagagaaaggggactccgaggacggggctcccggcctgccgggtcagccggggtcccccggagagcaaggcccacgcgggcctcccggcgcaatcgggccaaagggggatcggggctttcctggaccacttggtgaggcgggtgagaagggggaacgcggaccaccagggcccgctggctctagaggcctgccaggggtcgcaggtagacctggcgcaaaggggcccgagggaccacctgggcctactgggagacagggagagaaaggggaacccggacgtcccggcgatccagcggtggtgggtccagctgttgccggcccaaaaggagaaaaaggggatgtgggtccggccggtccccggggagcgacaggcgtgcagggagagcgagggccccccggcttagtgcttcccggagaccccgggccaaagggagaccccggagaccggggcccaatcggtctgacaggccgggccggtcccccaggcgattcaggtcctcccggcgagaaaggcgaccccgggcgcccgggccctccagggccagtagggccccgtgggcgcgatggtgaagtcggagagaaaggggatgaagggccaccaggggatcctggtcttcctgggaaagcgggagagcgcggtcttcgcggcgcaccgggggtccgaggtcctgttggagagaagggggaccagggcgacccgggtgaagacggaaggaacggcagcccgggctcatccgggcccaaaggcgaccgaggcgaacccggaccaccaggaccccctggacgcttagtggatacaggaccaggggcccgcgaaaagggcgagcctggagatcggggccaagagggccctaggggacctaagggcgaccctggtctacctggggctcctggggaacgggggatcgaaggctttcggggaccccccggcccccagggcgatcccggcgtacggggacctgccggagaaaaaggagacagaggtccccctggcctggatggaagatccgggctggacggaaagccaggcgccgctgggccaagtggaccgaacggggcagctggcaaggctggggacccaggacgggacggtctccccggactgcgaggcgagcagggtttaccaggaccatcggggcctcctggactccctggcaaaccgggggaggatgggaaacccggactcaatggcaagaatggagagccaggcgacccaggagaggatgggcggaagggagaaaagggtgactcaggcgcttctggaagggagggtcgggatgggcccaaaggggagaggggtgcgcctggcattctcggcccccagggaccgcccggtctgcctggccctgtcggaccccctgggcagggcttcccgggcgtgcctggcggtaccgggcctaagggggataggggcgaaacaggctctaagggcgaacagggcctgcccggtgaacggggcctcagaggtgagccgggcagcgtacctaacgtggacaggctgctggagaccgcaggaattaaggccagcgccctgagagaaatcgtggagacctgggatgaaagcagcgggtctttcctccccgttccggagcgcagacgaggtccgaaaggcgactccggcgagcagggaccgcctggcaaagaggggccaatcggtttccctggtgagcggggtctcaagggggatagaggagatcccggtccacagggtccaccagggctcgcacttggtgagcggggcccacccgggccaagcggactggccggagagccagggaaaccagggataccgggtctgcccgggcgcgcagggggcgtgggggaagccggccggcccggggaaagaggggagagaggagagaagggagagcgaggcgaacaggggcgggatggccctccaggcctccctggcacaccagggcctcccggtccacccggacctaaagtttcagtcgatgaacccggtcctggtctgtcaggagagcagggtccccctggccttaagggcgctaagggcgagcccgggagcaacggtgatcaaggaccaaagggggatcggggcgtgccgggcattaaaggagacaggggtgaacccggcccacgggggcaagatgggaatccagggctccccggagagcgaggcatggcaggacctgagggaaagccaggcctgcaaggcccccgtggaccccccggcccagtggggggccatggcgatcctgggccaccgggcgccccagggctggctgggcctgctggccctcaggggccaagtggcctcaagggggaaccaggcgagactggtccgccagggcggggactaacaggccccacaggggccgtaggcctgccaggtccgcctggccccagcggtctcgttggcccacagggcagccccgggctccccggtcaggtcggggaaaccgggaaaccaggagcccctgggcgggacggggcctccggaaaggatggggacagaggatctcctggagttcccggcagccctggacttcccgggcctgttgggcccaagggcgaacccggtcctacaggagctccaggccaggcagttgtgggtctgcccggagcgaagggagaaaagggggcacccggcggactggccggagacctggtaggagagccgggagctaagggcgatagaggtttgccgggccctagaggggagaaaggtgaagctggacgagcgggggagcccggcgatcctggcgaagacgggcagaaaggcgctccagggccaaaaggattcaagggtgaccctggggtgggggtgcccggcagccctggtcctccagggccccccggtgtcaagggagaccttggtctccctggtctgccaggggcccctggagtggtcgggttccctggccagacagggccccgaggggaaatgggccagcccggaccaagcggtgagcgcgggctcgcgggtccgcctggccgtgagggcatccccggacccctgggcccaccaggcccccccgggagcgtggggccacccggcgcgtcgggactaaagggcgacaaaggcgacccgggggtggggctccccgggccccgcggagagcgcggcgagccaggcatccggggagaggacggccgtcccggccaagagggaccgcgggggctgacaggaccaccaggatccagaggagaaagaggcgagaagggggacgttggtagtgccggcttgaagggagataagggagactctgctgttattctcgggcctccgggcccccgcggggctaaaggcgacatgggggagagggggccccgggggctggatggcgataagggcccgagaggggacaatggggatccaggcgataaaggttccaagggggagcctggggataaaggatccgcgggacttcccgggctccggggcctgctcggaccgcagggtcagcccggtgctgccggtattcctggagatcctggatcacctgggaaagacggagtacccggtatccgaggtgagaagggcgatgtcgggttcatgggtccccgagggctgaagggggagcgtggcgtcaaaggcgcctgcggcttggacggagaaaagggcgacaagggggaggccggaccgcccggccgcccggggctggccggtcataagggggaaatgggggaacccggcgtccctgggcagtctggggcgcctggcaaagagggcctgattggcccgaagggagaccggggatttgatggccagccaggccctaaaggtgatcaaggagaaaagggggaacgtgggacgcccggaattggcggatttcccgggccctctgggaacgacgggagtgccggacctccagggcccccaggaagcgtgggaccacgggggcccgagggtcttcaaggccaaaaaggagagcggggcccacccggggagcgggtggtaggagcgcctggagtaccgggcgcgcctggtgagcgaggcgaacaggggcgcccgggacccgcaggtcctagaggagaaaagggcgaggcagcgctgactgaagacgatattcggggcttcgttagacaggaaatgagccagcactgcgcctgccaaggccagttcatcgcctcagggtccagacctctgccttcctatgcagctgatactgctgggagtcagctgcacgcagtgccggtcttgcgcgtgagccacgccgaggaggaagagcgcgtcccccccgaagatgatgagtactctgaatacagtgagtattcagtggaggagtatcaagatccagaagccccctgggacagcgacgatccatgcagcttacccctggatgaaggctcatgcacagcatataccctgaggtggtaccaccgtgctgtcacaggaagtacggaggcctgtcaccctttcgtctacggcggatgtggcggtaatgcaaatcgatttggaacgagagaggcgtgcgagcggcgatgtcccccacgggtggtgcaatctcaaggtactggtactgcacaagat

SEQ ID NO: 9635 - DNA, 8832 bp, Artificial Sequence
  Description of Artificial Sequence: Synthetic coding sequence
atgactctgagactgctggttgcagcactgtgcgccggtatccttgccgaggccccgcgcgtgagggcccagcaccgcgaacgcgtgacctgcacccggctgtacgccgcagatatcgtgttcctcctggatggatcttcctcgatcggccggtcgaactttcgcgaagtccggtccttcctcgaaggactggtcctgccgttctcaggagcggcaagcgcccaaggtgttcgttttgctactgtgcaatactccgacgacccgcgcacggagttcggactggatgcgcttggatccggtggagatgtgatccgggccatccgagagttgagctacaagggaggaaacacgcggactggcgctgcgatccttcacgtcgctgaccatgtgttcctccctcagctggctcgccccggggtgcctaaggtgtgtatcctgatcacggacggaaagtcacaggatctggtggatactgccgcacaacgccttaaggggcaaggggtcaagctgtttgccgtgggaatcaagaatgcggatcccgaagaactcaagagagtcgcatcccaaccaaccagtgacttcttcttttttgttaatgattttagcatccttcggactctcctgccgctcgtgagccgccgggtctgcaccacggcagggggcgtccccgtgactcgtccaccggatgacagcacctcggctccacgggaccttgtgctgtcagaacctagctcgcagtcgctgagggtgcagtggacggcggcctcgggaccggtcaccggatacaaggttcagtatactccgctcaccggcctgggtcagccgctgccgtccgagaggcaggaagtcaacgtcccggccggagaaacgtccgtccgcctgcgggggctccgccccctcactgagtatcaagtgaccgtcatcgccctgtacgccaattccatcggggaggccgtctcgggtactgcgcgcaccactgccctggagggaccggaactgaccatccagaataccaccgcacacagcctgctggtggcctggcgcagcgtcccaggcgccaccggttacagagtgacctggagagtcctgtcggggggacccacccagcagcaagagctgggacctggacagggctcggtgctgctgcgcgacttggaacctggaaccgactacgaagtgacggtgtcgaccctgttcgggagaagcgtcggtcctgctacctcactcatggcgagaactgatgcttccgtggaacaaaccctgcgcccggtgattctggggccgaccagcattctgctctcgtggaacctggtgccggaggcccgaggctaccggctcgagtggcggagagagactggactggaacctccgcaaaaggttgtgctgccgtcggatgtgactcggtaccaactggacggcttgcaacctgggactgagtatcggttgactttgtatactctcctggaagggcatgaagtcgctaccccagccaccgttgtgccgaccggaccagagcttccagtgagcccagtgaccgacctgcaggcaactgagctgcccggccagcgcgtgcgggtgagctggtcccctgtcccaggagcaacccagtaccggatcatagtccggtcgactcaaggtgtggaacggacgctggtgctgcctggctcccagactgccttcgatttggatgacgtgcaagccggcctttcgtatactgtgcgggtgagcgcacgagtgggaccgcgcgagggatcagccagcgtgctgactgtgcgccgcgagccagagactccactggctgtgccaggtttgcgcgtggtggtgagcgacgcgacccgggtgcgggtggcctggggtccggtgccaggagcgtcgggattcagaatctcctggtccaccggatccggaccggaatcgtcccaaaccctgccgccagacagtaccgcaaccgacatcactggacttcaaccggggaccacgtaccaggtcgccgtctctgtcctgagaggtagggaggaagggcctgccgccgtgatcgtggcccgcaccgatcctttgggacctgtgagaactgtccacgtgactcaggcctcctcatcgagcgtgactattacttggaccagagtgccgggagcaaccggttaccgggtttcatggcactccgcgcatggaccagagaagtcgcagcttgtgtccggcgaggccaccgtggccgagctggacggactggagcctgacactgagtacacggtgcacgtgcgggctcacgtggcgggggtggatggacccccagcctccgtggtcgtgagaactgcgccggaacctgtcggaagggtgtcccggctgcaaatcctcaatgcctcctcagacgtgctgcgcatcacgtgggtgggtgtgacgggagcaaccgcataccgcctggcatggggccgctcagagggaggcccgatgcggcatcaaatcctgccgggaaacaccgattcagctgagatccgaggactggagggaggagtgagctacagcgtgcgcgtgaccgctctggtgggggaccgggagggcactccggtgtctatcgtggtcacgactccgcctgaggcgccgccggcgctcggaaccctccatgtcgtgcaacggggagaacactcccttaggctccggtgggagcccgtccctagggcccagggattcctgctgcactggcagccagagggtgggcaagagcagtctagggtcctgggacctgaattgtcctcataccacctggatggactggaaccggccacccagtaccgtgtgaggctgagcgtcctgggaccagcgggggagggaccatcagctgaggtgaccgcacggacggagagcccgcgcgtcccctcaatcgaactgagagtggtagacactagcatcgattccgtgaccctggcgtggaccccggtgtcaagggccagctcttacattctttcgtggcgacctttgcggggccctggtcaggaggtgccaggttccccgcagactctcccaggcatatcaagctcccagcgcgtcaccgggctggaaccgggagtgtcatacatcttctcattgactcctgttctcgatggagtgcgaggccctgaggcttcagtgacccagactcctgtgtgcccccgaggactcgccgacgtcgtgttcctcccacacgcgactcaagacaatgcgcaccgagcagaggcaactaggcgcgtgctggagagactggtgttggcattgggaccgctgggaccgcaggcagtgcaggtgggactgttgtcctacagccaccgtccgtccccactcttcccgctcaatgggtcacacgacctcgggattatcctgcagcggattagagacatgccgtacatggatccgtccggcaacaacctgggaactgcagtggtgaccgcgcatcgctacatgctcgcaccggatgcccccgggaggcggcaacatgtccctggcgtaatggtgctcctcgtggacgaacctctgaggggagacatcttcagcccgattcgggaagcgcaggcgagcggactgaacgtcgtgatgctggggatggctggcgcagaccccgagcagctgcggagacttgcacccggcatggatagcgtccaaacttttttcgcagtcgacgacggaccgtcgcttgaccaagcagtgtcgggtctggccaccgcactgtgtcaagcatccttcactacccagccgcgccctgaaccatgcccggtgtactgcccgaagggccaaaaaggagaaccaggtgagatgggattgcggggacaggtcgggccgccgggagatccgggtctgccaggacggactggtgccccaggaccccagggacctcccggatcagcgactgcaaaaggggaacgcggctttccgggagcagatggccgcccaggatccccaggccgggcaggaaaccctggcaccccaggcgcccctggtctgaagggctcaccaggactgccgggccctcggggtgaccctggcgaaagggggcctagaggacccaagggagaaccgggcgccccgggacaggtgatcgggggcgaaggcccaggcctccctggacgcaagggcgacccaggacccagcggaccgccaggccctagagggcctttgggtgaccccggaccacgcgggccgcctggcctgccaggaaccgccatgaaaggcgacaaaggggaccgcggagagcggggcccgccgggtccgggagaaggtggaatcgccccgggagaacccggcctgccgggactccccggctcgccgggtccgcaaggaccggtgggtcctcccggcaagaaaggcgaaaaaggagactccgaagatggagctcctggattgcctgggcaaccgggttcgccgggggaacaggggccgcggggaccaccgggcgcgattggaccgaaaggtgaccgcggattcccaggaccactgggagaggcgggggagaagggagaaagaggaccgccgggtccggctggatcacgcggcctccctggagtggccggcagacctggagcaaagggacctgaaggaccgccgggaccaaccggccggcagggagaaaagggcgaaccgggaaggccgggagatcccgcggtcgtcggacctgccgtggctggcccaaagggagagaaaggcgatgtgggaccggcgggaccccgcggagcgaccggggtccagggagagcgcggacctccgggactggtgctgccgggagatccgggaccaaagggagatccgggggatcggggcccaatcggattgactggaagagccggcccacctggcgactccggcccgccgggagaaaagggggatcctgggcggcctggaccgccgggccctgtcggaccgcgcggaagagacggagaagtgggagaaaaaggtgacgaagggccaccgggggacccgggccttcctggaaaggcaggagagagaggactgcgcggcgccccaggagtgagaggcccagtgggagaaaagggggatcagggggaccctggagaggacggaagaaacggtagccccgggagctccggtccgaaaggagacagaggcgaaccaggacccccagggccgccgggtagactggtggatacgggacctggtgctagagaaaagggagagcccggtgacagaggccaggaaggaccgcgcggcccaaagggcgacccaggcctcccgggcgcccccggagaaaggggtatcgaaggtttcagaggaccacctggacctcagggagatcccggcgtgagaggaccggctggagagaagggagatcgtggcccgcccgggctcgatggcagatcaggactggacggcaagccgggagcagctgggccaagcggacctaacggagcggccgggaaagctggcgacccaggccgcgatgggctcccaggactgcggggagagcaaggtctgccaggccctagcggaccgcccggactccccggaaagcctggagaggacggcaagcctggactgaacggaaagaatggcgagccgggcgaccctggcgaggatggacggaagggagagaagggagactcgggagcctcgggacgcgaaggacgagacggaccaaaaggggaaagaggagctccaggaatcctgggcccgcaagggccaccaggcctgccgggcccggtggggccaccaggccaggggttccctggcgtccctggaggcaccggaccaaagggagatcgcggagagacgggaagcaagggagaacaggggttgcctggagagcgggggctgaggggagaaccaggcagcgtccccaatgtcgacaggcttctcgaaaccgccggaatcaaggcaagcgccctccgcgaaatcgtcgaaacttgggacgaaagctccggatcattcttgccagtcccggagcggcggagagggcctaagggagattcgggcgagcaaggacctccaggaaaggagggaccgataggatttccgggagaaagaggcctcaaaggagacagaggggacccgggtcctcaaggaccaccgggtctggccctgggagagcgcggcccgcctggaccgtcgggactggcaggcgaacccggaaagcctggaatccccggactgccaggcagagccgggggcgtgggtgaggccggtagaccgggcgaaagaggcgagcgcggcgaaaagggagaacggggtgagcaggggagagatggaccgcccggccttccggggacccccggacccccgggaccgccaggcccgaaagtgtcagtggatgaaccgggacctggactcagcggagaacaagggccccccggcctcaagggagcaaagggcgaaccggggtcgaacggagatcagggacccaagggcgaccgcggagtgcctggcatcaaaggagacaggggtgaaccgggaccgaggggacaagacgggaaccctgggttgcctggggagagagggatggccggccccgaggggaagccaggtctgcagggcccacggggcccaccagggcctgtgggaggacacggagatccaggtcccccgggcgccccaggcttggccgggccggccggaccgcaaggccctagtggactcaagggggagccaggcgaaaccggtccacctggtcgcggtcttaccggaccgactggggctgtgggactgccagggccgccaggaccgtcgggattggtgggccctcaaggatcgccgggacttcctggacaggtgggggagactggcaagcccggcgccccgggacgagacggagcctcgggaaaggacggagatcgcggttcaccgggagtgccaggctcccccggtctgccaggaccggtgggccctaagggagagccgggaccgaccggcgccccgggacaagccgtcgtggggctgccgggagccaaaggagaaaagggcgccccggggggtctggcgggagatttggtcggcgaaccgggagcgaagggtgaccgcggccttccgggaccaaggggagagaagggtgaggcaggtcgcgcgggtgaacccggagatcccggcgaggacggacaaaaaggtgcgcccggaccgaagggtttcaaaggggacccgggagtcggagtgcccggatccccgggaccgccaggtcctccaggagtgaagggagatcttggattgccgggactcccgggcgccccaggagtggtcggcttccctggccaaaccggacctagaggagagatgggacagccaggcccctccggagaaagggggctggcaggtccgcccggtagagaaggtattccgggacccctgggaccgccgggacccccaggctccgtgggacctcccggggcatccggactcaagggtgacaaaggcgatccgggagtgggactgccgggaccacggggcgaacgaggggaacctgggataaggggcgaggatgggcgaccgggccaggagggcccgcgaggactgactggcccgccaggcagccgcggcgaaagaggggagaaaggggacgtcggatccgctggactcaagggtgataagggagactctgctgtcatcctgggccctccagggccgcggggagcaaagggggatatgggcgagcgggggccgcggggcctggacggcgacaaaggacccaggggagacaatggcgatccgggagacaaaggctcgaagggagaaccaggggataaaggttcggctggattgcctggcctgagaggactgctgggcccgcagggacaaccgggagctgcgggaatcccaggggacccgggatcacctggaaaggatggggtgccaggaatccgcggggaaaaaggagacgtcgggtttatgggaccaagaggcctgaagggagagcggggtgtgaagggcgcatgcggtttggatggggaaaaaggagataagggggaagcgggcccccctggacgccctggtctggccggacacaaaggagaaatgggagaaccaggggtgcccggacagtcgggcgcgcctggaaaggaaggcttgatcggaccaaagggagacaggggcttcgatggacaaccgggccctaagggcgatcaaggcgagaagggagaacggggaactccgggaatcggtggattccctggaccttccggtaatgacggatcggccgggccgccaggaccaccgggttcggtcggcccgaggggacctgaaggactgcaaggtcaaaagggtgagagaggacccccaggcgaacgcgtcgtgggagcaccgggagtccctggagcaccaggggaaaggggcgagcaagggcgaccgggcccagcgggccctcgaggcgagaagggtgaggcggcgctgaccgaagatgacatcagaggattcgttcgccaggaaatgtcccaacactgcgcgtgccaggggcaattcatcgcatccggtagcaggcctctgccatcctacgctgctgacaccgccgggagccagctgcatgcagtgccagtgctgcgggtgtcacacgccgaggaagaggagcgcgtgcccccagaggacgacgaatactccgagtactcagagtactcggtggaagaataccaggacccagaggccccgtgggatagcgacgacccatgctcgctgccgctggacgaaggatcgtgcaccgcgtacactctgcggtggtaccatcgcgcggtcactggctccaccgaggcctgtcatccattcgtgtatggagggtgtggcggaaacgccaatcggttcggaaccagagaggcttgtgaacggcggtgcccgccccgagtggtgcagagccagggcactggaactgctcaagac

SEQ ID NO: 9636 - DNA, 8832 bp, Artificial Sequence
  Description of Artificial Sequence: Synthetic coding sequence
atgaccttgcgcctgctcgtagcggcattgtgcgcaggcattctggcagaagctccacgagtaagagcccagcatcgggagcgggtcacttgcacccggctgtacgccgcagatattgtgtttcttctcgatggctcttcttccatcggacgcagcaattttcgcgaggtgaggtcattccttgagggcttggttttgcccttctccggcgcggccagcgcccagggagttcggttcgcaactgtgcagtacagcgacgaccccaggacggagtttggccttgatgccctgggctctggcggtgatgtcatcagagctattagagaactcagctataaaggtggcaatacccggactggagcggcaatcctgcacgtagcagaccacgtgttccttccacagctggcccgaccgggagtccctaaagtatgtattctgataaccgatggcaagtctcaggatctcgtggacacagccgctcaacggctcaagggccagggtgtgaaattgtttgccgtcggtattaagaacgccgatcccgaagagctgaaacgcgttgcatctcagcccaccagcgacttttttttctttgtgaatgacttcagcattctgcggactctcctccctcttgtgtctagacgggtttgcaccactgctggaggcgtgccagtgacccggcccccagatgattctaccagcgctcctcgcgatctggttctgagtgaaccttccagtcagtctctgagggtccagtggactgctgcttctggaccagtgaccggctataaagtgcaatacaccccactgacagggctgggccagcctttgccaagtgagcggcaggaagtgaatgtaccagccggagaaactagcgtgcggctcaggggtcttaggccccttacggagtaccaggtcactgttatagcattgtatgcaaacagcattggcgaggctgtgtcaggaactgctaggactacggctctcgaaggaccagagctcactatccaaaacaccacagctcacagccttctggtggcctggcgcagcgtacccggtgcaactggttaccgagtgacctggagagtgttgagcggcgggcctacccaacagcaggaactcggtccgggacagggaagcgtactccttagggacctggagcctggaactgattatgaagtcaccgtaagtacgctcttcggacgctctgtcggccccgcgaccagcctgatggcccggacggatgcgagcgtggagcagacactccgcccggttatcctgggacccacgagcattcttctgagttggaacctggtccccgaggctagaggctatcggctcgagtggcgcagagaaactgggttggagcctccccagaaagtcgttctgccatctgatgtcaccaggtatcagctggatggcctgcaacccggaacagaataccgcctcaccttgtacaccctgctggaggggcacgaagtagccacccctgctaccgttgtgcctactggacccgaattgcccgtctctcccgtgaccgacctgcaggcaaccgagctgcctgggcagcgagtccgagtgtcctggagtcctgtgcctggtgcaactcaatacaggatcatcgtgcgcagtactcagggcgttgagaggacactcgtgctccccgggagccagacggcctttgatctcgatgatgttcaagccggcctcagctacaccgtgcgcgttagcgcaagagtcgggcctagggagggtagtgcatctgtgttgacagtacgccgagagcccgagactcccctggcggtgcccggacttagagtcgtcgtcagtgacgctacccgcgtgagggtcgcatgggggcccgtgcctggggctagtggcttccgcatctcatggtccacgggaagcggcccagagagttcccaaacgctgcccccagactccactgccactgacatcactgggctccagcccggcacgacataccaggtggccgtttccgttctcaggggcagagaagagggtcccgccgcggtaatcgtcgccagaactgaccccctggggcccgtgagaacagtgcacgtcacacaggcctcaagttcaagcgttactataacatggactcgcgtgcccggcgcaacaggctatagagtgtcttggcacagtgctcacgggccagagaagtcccagctggtttccggagaggccaccgttgcagaactggacggcctggagcctgataccgaatacaccgtccacgtgagagctcatgttgcgggcgtagatggccccccagcatccgttgtcgtgaggactgcaccagagccagtaggccgggtgtcccggctgcagatactgaacgcgagcagcgatgtgttgcgcataacctgggttggcgttaccggtgcaacggcctataggctggcctggggccgcagcgaaggtggccccatgcgccaccagatccttcctggcaacacagacagcgcagagattcggggtctggaggggggcgtgagctactccgttagggtaacagccctcgtgggcgatcgagagggaacccctgtgagtatagtagtcaccacaccgccggaggctccaccagctctgggcaccctgcacgtcgtgcaacggggagaacattcattgagattgcgctgggagccagtaccgagggcccaagggtttctgcttcactggcagcctgaagggggccaggagcagtcccgggtgcttggtcccgagctgtccagttaccacctggacggactggaaccagctacccagtacagagttcggttgtccgtcctcggacccgccggggaaggccccagtgcggaagtcaccgctagaactgagtcaccccgcgtgccgtccatcgagttgcgggtagttgacacttcaatcgattcagtgacactcgcctggactcctgtctctagggcatccagttacatcctgagctggcgccctctgcggggcccaggtcaggaggtgccaggtagtccacaaacgctccctggtatcagttcaagccagcgggtcaccgggctcgagcctggtgtgagttatatcttttctcttacacctgtgctcgacggcgtgaggggccctgaggcgtccgtgacccagacgcctgtgtgtcccagaggcctggcagatgttgtttttctgccgcatgcaacccaggacaacgctcaccgcgctgaggccacccgaagagtgctcgagaggctcgtgctcgcgctgggtcctttgggcccccaggcggtgcaggtgggccttctctcatacagtcacaggccctccccactgttcccactcaatgggtcacacgacctggggatcatcctgcagaggatccgagatatgccgtacatggatccaagcggtaacaatctgggaactgctgtggttacagcccatcggtacatgctggcacctgacgccccggggaggaggcagcacgttccaggcgtgatggtactgttggtcgacgagcccctgagaggtgacatcttctcccccatccgggaggcacaggcctcaggccttaatgtcgtcatgcttggtatggccggggctgacccagaacagctgaggcgcctggctcctggaatggattcagtgcagactttttttgccgtagacgatggtcccagccttgaccaagccgtgagcggactcgccacagctctgtgtcaagcaagctttaccactcagccccgaccagaaccatgcccagtatactgcccaaaagggcagaagggagagcctggcgagatgggcctgagaggccaggttgggccgccaggagatcctggacttcctgggcgcacaggtgcccccgggccgcagggacctccagggagcgcgacagcaaagggcgagagaggctttcccggtgcagatggaagacccgggagcccgggacgcgccggaaaccctggtaccccgggcgcccccggcctcaaaggctccccagggctgcctggccccaggggggacccaggggagcggggtccaagaggtcctaaaggggagcccggggcccccggacaagtaatcggtggcgaggggccaggactgcccggccggaaaggcgacccgggaccctctggcccacccggtccaagagggcctctcggcgatcccggacccaggggaccgcctggactgccaggaactgcaatgaagggggacaagggggatcgcggagagagagggccccccgggcctggagagggaggcatcgcgccaggggagcctggcctccctgggctgcccggctctcccgggccgcaggggccagtgggtcctccaggcaagaaaggcgagaagggcgactccgaagacggagctccaggtctgcccggacagcccgggagccctggcgaacaaggcccgaggggccctcctggtgcgattggtccaaagggcgacagggggttcccaggtccactgggagaggctggtgagaagggcgagaggggcccaccaggcccagcaggctcccgcggtcttcccggtgtcgctgggcggccgggtgccaaaggtcccgaagggcctcccggaccgacaggtagacagggggagaagggggagccaggccggccaggggatcccgctgtggtagggccagccgtggccggaccgaagggggaaaagggggacgtgggacccgctggacctaggggcgcaacgggtgtgcagggggagcgcggcccacccggattggtcctccccggtgatcctggaccgaagggggaccctggggatcgcggtcctatcggtctgacaggccgcgccggaccccctggggattccggccctcccggagagaaaggcgatccaggtcgccctggcccacccggtccagtgggcccccgcgggagggatggtgaggtgggagaaaagggagacgaaggaccccccggcgatcccggtctgcccggtaaggctggtgagagaggtctgagaggggcacctggggtgcgcggacctgtcggggagaagggcgatcagggagaccccggggaggacggcagaaacggttccccaggatcttcaggcccaaagggcgaccgcggcgagcctgggcctccgggtcctcccgggcgccttgtcgataccggcccgggagctcgggagaagggagagccaggcgatagggggcaggaaggacctcggggtcccaagggagatcctggtcttccaggggctcctggggaaagggggatagaggggttccggggaccccctgggcctcagggagaccccggcgttcgcgggcccgcaggtgaaaaaggggaccgcggcccgcctggactcgacggccgctccggccttgacggaaagcctggcgccgcaggaccaagtggccctaacggagctgcaggcaaagcgggcgatccaggacgggacggactccctggactgagaggggaacaggggctgcctggcccatccggcccccctggccttcccggcaaaccgggcgaggacggaaagccaggccttaatggaaaaaatggggaacctggggacccaggagaagacggaaggaaaggtgagaagggggactccggagcaagtgggagagaggggcgggacggtcctaaaggagagaggggcgctccgggcatcctcggtcctcagggcccaccagggctgcctggccccgtggggcctcccggccagggatttccaggtgttcccggcggaacaggtccgaaaggtgacagaggggagactggatctaagggcgaacaaggcttgcccggagaaaggggtcttagaggggagcctggtagcgtcccaaacgtcgaccggctccttgagacagctggaattaaggcatccgccctcagagaaatagtcgagacatgggacgagagctctgggtcctttcttccggttcctgagagaagaagaggacctaagggagattcaggagagcaaggaccacccggaaaagaaggccctatcggatttccaggcgaaagagggctcaagggggataggggtgatcccggccctcaggggccaccgggcctggcacttggagagcgcgggccgcctggaccatccgggcttgccggggagcccggcaaaccgggtatcccaggcttgccaggacgggccgggggcgtgggagaagctggccggcctggggagcggggcgagcggggggagaaaggagagcgaggcgaacagggtcgcgatggacctcctggcctgcccggtacaccaggcccccccggtcccccaggccctaaagttagtgtcgacgaaccaggcccagggctcagtggggagcaaggccccccagggttgaagggtgccaaaggcgaaccaggttccaatggggatcagggacccaagggtgaccgaggcgtgcccggcattaaaggggaccgcggagagccaggacccaggggacaagatgggaatccgggactcccgggcgagaggggtatggccggacccgagggtaagcctggcttgcagggacctagaggtcccccgggccctgtaggcggccacggcgatcccggcccaccaggcgcccctggactggcaggacccgctggaccgcagggcccatcaggactcaaaggcgaaccaggggagacaggtccgccaggaagaggcctcaccggccccacaggagctgtggggctgcccggtccaccgggaccaagcggcctggtggggccacagggatccccgggactgcctgggcaggtaggagagacagggaagccaggtgcgcctggcagggacggagccagcgggaaagacggggatagaggcagccctggagtgcctggcagcccaggactgcctggccccgtcgggccaaaaggggaacccggaccgaccggggccccaggacaggcggtggtgggcctgcctggcgctaagggagagaagggagcacccgggggactggcaggagatctcgttggtgaaccaggtgcaaagggcgaccgcggtctgcccggtcctcggggggagaagggagaggcaggacgagctggggagccaggagatcctggagaggacggtcagaagggcgcgcctgggccaaaaggttttaagggcgacccaggagtgggtgtaccgggatcccctgggccccccggcccccccggagttaagggcgacctgggcctccccggactgcctggcgcaccaggagtggtcggattccccggtcaaacaggcccaaggggagagatgggtcagccaggacccagtggagagcgggggctggcaggcccacctggacgagaaggaatcccggggcccttgggcccccccgggccacccggctccgtgggcccccctggggcctctggtctgaaaggggacaaaggggacccaggtgtcggactgcccggcccccggggggagaggggagagccaggtattcggggagaagatggccgaccaggccaggaaggcccgaggggccttacaggaccccctgggtctcgcggcgagcggggagaaaagggagacgtaggatctgcgggtttgaaaggagacaaaggcgactccgcagtgatcctgggccctccaggccccagaggtgccaagggtgacatgggagagcgagggccacgaggactggatggcgataaaggacccagaggtgacaatggcgatcctggagataaggggtctaagggagagcctggcgataaggggtctgctggactccccggtttgagaggcctgcttggtcctcaaggtcaacccggagccgctgggattccgggggaccccggctccccggggaaggacggtgtcccaggcattagaggagaaaagggcgatgtcgggtttatgggaccaagaggtctcaagggggagcgcggagtgaaaggtgcttgcggacttgacggggagaaaggcgacaagggtgaggccggccctcctggcagaccggggctggcgggacacaaaggagagatgggcgaacccggagtacccggacaatcaggcgcacccggtaaggaggggctgattggcccaaagggcgatcgagggttcgatggacagcctggtccaaagggagaccagggcgagaaaggggagagggggacccccggcattgggggatttcctggtccaagtggcaatgacgggagcgcaggcccccccggtcctcccggaagcgtggggcctagaggcccggaagggctgcaaggacaaaagggtgagcgggggcctccgggtgaacgagtcgtaggcgctccaggcgtcccaggggcccctggcgagcgcggggaacaaggtaggcccggacctgcaggaccccggggagaaaaaggagaagcagccctgacggaggatgatattcgcggcttcgtacgccaggaaatgtcacagcactgtgcatgccagggtcaatttattgcctctggatccagacctctgcccagctacgcggcggatactgctggctctcaacttcacgccgtgcctgtgcttcgcgtgtcccacgcggaggaggaggagcgggtacctccggaagacgatgaatattctgaatacagcgagtatagtgttgaggaatatcaggacccagaggcaccttgggacagcgacgatccctgctcactccccctggacgaaggtagctgtactgcttatacgttgaggtggtatcaccgcgctgtgacgggctcaaccgaagcatgtcatccgttcgtgtacggtgggtgtggaggcaatgcaaatagatttggtacccgggaagcctgtgagagacggtgtccacctcgggtggtgcagtctcagggtaccggcaccgcgcaagat

SEQ ID NO: 9637 - DNA, 8832 bp, Artificial Sequence
  Description of Artificial Sequence: Synthetic coding sequence
atgactctgaggctgctggtggccgcgctgtgtgccgggattctggcggaagccccgagggtgagggctcaacacagagaaagagttacgtgcacccgcctgtacgccgctgacattgtctttctgctggacggctcctcgtccattggacgctccaacttccgggaggtgcgctcgtttctcgagggtctggttctgcctttctctggagccgccagtgcgcagggcgtccgcttcgcaactgtgcaatacagcgacgacccacggaccgaattcgggctggatgccctgggctccggaggggacgtgatccgcgccatcagggaactctcctacaaggggggaaacacgaggactggagccgcgattctgcacgtggctgatcacgtgtttctgccgcaactggcaagaccaggcgtcccaaaggtctgtatcctgattaccgacggaaaatcacaggacctggtcgacactgccgcgcaacggctcaagggacagggcgtgaaactgtttgccgtgggaatcaagaacgcggaccctgaagaactcaagcgggtggccagccaacctacttctgacttcttctttttcgtcaacgatttcagtatcctcaggacgcttctgcccctggtgtctcgccgcgtgtgcactaccgccgggggtgtgccagtcacccgcccgccagatgattccacttccgcacctcgggacctcgtgctgtccgagccatcctcgcagtcgttgcgcgtgcagtggactgcagcctcgggcccagtgaccggctacaaggtgcagtacactccgctgactggcctcggacaacctttgcccagcgaacgccaggaggtgaatgtcccagcaggagaaacctcggtcagactgcggggcctgcgccctctgaccgaatatcaggtgaccgtgatcgctctgtacgcgaactccatcggagaggccgtgtcgggtaccgcgcgcaccactgcgctggaaggacccgagcttactatccagaatactaccgctcattcgctgctggtcgcctggagatcggtcccgggcgctaccgggtatcgcgtcacttggcgcgtgctgtcgggaggaccaacgcagcaacaagaactgggaccaggccagggttcagtgctgctgcgggatctggagccggggaccgactacgaggtcaccgtgtccaccctgttcggtcgcagcgtgggaccggcaacgagcctgatggcgaggaccgacgcatcagtggagcaaactctgcggccagtcatcctcgggccaacttcaattctcctctcctggaatctggtgcctgaagcacgcggctaccggttggagtggcgcagggagactggcctggagcctccgcaaaaggtggtgctcccttcagatgtgacccggtaccaactcgacggactccagccgggcaccgaataccgcctcactctctacaccctcctggagggtcacgaagtggcaactccggccactgtcgtgcccaccggacccgagctgccggtgtcgccggtgaccgacctgcaggctaccgagctgccgggacagcgcgtgcgagtgagctggtcccccgtgccgggtgcgactcagtaccgcattatcgtgcgttcgacgcagggggtggaacggactttggtgttgccgggctcccagaccgcgttcgacctggacgacgtccaagccggactgtcctacaccgtgagagtgtctgcccgagtcggcccacgggaaggatcggcttcggtgctgacggtcaggagagaaccggagacgccgctcgctgtgccaggtttgagagttgtggtgtccgatgccaccagagtgcgcgtcgcctggggacctgtgccgggcgccagcggattcagaatctcgtggtcgactggcagcggaccggaatcttcgcaaacgcttccaccggactcgaccgccaccgacatcactggactccaaccgggaactacgtaccaagttgcggtgtcggtcctgagaggcagagaagaaggtccagcggcagtgatcgtggcacgcacggacccgcttggaccggttcgcaccgtacatgtgacccaagcatcgtcgtcatccgtgacgattacctggacccgggtgccgggcgcaactggctaccgcgtgtcgtggcactcagcgcacggaccagagaagagccagctcgtgtccggcgaagcgaccgtcgccgagctggatggtctggaacctgacaccgaatacactgtgcatgttcgcgcgcatgtggcgggcgtggatggaccaccggcatcagtggtggtccgcaccgctccggaaccagtgggacgggtgtctcgcttgcaaatcttgaacgcaagctcggatgtgctgcgcatcacctgggtcggagtgactggagccactgcataccggctggcatggggacgctcggagggcgggccgatgcggcaccaaatcctgccgggtaacaccgacagcgcagaaatccggggactggagggaggagtctcctacagcgtccgcgtgaccgcccttgtgggtgaccgggaaggaactccagtgtcgatcgtggtcactacgccgccagaagccccgccggccctgggaaccctgcacgtagtccagcggggtgaacatagccttcggctgcggtgggaaccagtgcctcgcgctcagggattcctgctgcattggcagccggaaggtgggcaggaacagtcccgggttctgggcccagaattgtcctcgtaccacctcgacggactcgagccggcaacccaataccgcgtgcgccttagcgtcctcggcccggctggcgagggtccgtcagcggaggtcaccgctagaacggagagcccgcgggtcccgtccatcgaactccgggtggtcgacacgagcatcgactcagtgactttggcgtggactccggtgtcgagagcctcatcttacatactctcttggcgaccgttgcgggggccgggacaggaggtcccaggcagcccgcagactctccctggaatctcatcgtcccagagagttactggactcgaaccgggggtgtcctatatcttcagtcttactccagtgctggacggcgtcagggggcctgaagcctcggtcactcaaaccccggtctgccctaggggactcgcagacgtggtgttcctcccacatgcaacccaggacaacgcgcatcgcgccgaggctacgcggcgcgtcctggagagactggtccttgccctcggcccactcggaccccaggccgtgcaggtcgggctgttgtcctactcccacagaccttccccgctcttcccgctgaacggctcccatgacctcggaatcattctgcagcggatccgtgacatgccctacatggacccaagcgggaataatctgggcaccgctgtcgtgactgcgcacagatacatgctggctccggacgcacctggacggagacagcatgtgccaggagttatggtgctgctggtcgacgaacctcttaggggggatatcttctcgcccatccgcgaggcgcaagctagcggcctgaacgtggtcatgctcgggatggccggcgccgaccctgagcaattgaggcggctcgcgcccggaatggactcggtgcaaactttcttcgcggtcgacgacggaccatcactggatcaggcagtgtccggtcttgcgaccgcactgtgccaggcttccttcaccacccagccacgcccagaaccatgcccggtgtactgcccaaagggacaaaaaggagaaccgggggagatgggactgcgcgggcaggtgggcccgccgggagatccagggcttccggggcggaccggagcccccgggccgcaagggccaccggggtccgcgaccgcgaaaggggagcgaggcttccctggggctgacggcaggccgggttcgcctggtcgcgcaggaaacccgggaaccccaggcgccccaggactgaagggaagtcccggtttgccgggcccacggggcgaccctggagagcgaggaccgcgcgggccgaagggcgagccgggagccccgggtcaggtgatcggtggggaaggcccaggcctccccggacggaagggcgatccaggaccgtccgggccacctggtccccgcggcccgcttggagatccagggccacgcgggcctccaggcctgccgggaaccgccatgaagggcgacaagggagacagaggagagagaggacctccggggccgggagaaggaggaattgcccccggtgagccgggactgcctgggctgccaggatcacccggacctcagggacccgtcggcccgccgggtaagaagggcgaaaaaggggacagcgaggacggcgcgcctggactcccaggccaaccgggatccccgggagagcaaggacctcgcgggccccctggagctatcggcccaaagggagatcgaggatttccgggaccactcggggaagcgggcgagaaaggggagcgaggacctccgggaccagccggctcgagaggcctcccaggtgtggccgggcggcccggagccaaggggccggaaggaccgcccggtcctactggaaggcagggagagaaaggagagccgggccgaccaggagatccagcagtcgtcggtccggctgtggcaggaccgaaaggagagaagggtgatgtggggccggctggaccaagaggagcaaccggtgtgcagggggagcggggcccgcccgggttggtgctcccaggggacccgggacctaagggagatcccggggacagaggcccgatcgggcttaccggacgcgccggtccacccggagactcagggccgcctggggaaaaaggtgatccgggacggccgggaccccctggacctgtggggccacgggggagggacggggaagtgggtgagaaaggagatgaagggccgccgggtgacccagggctcccgggaaaggctggcgaaagagggctccgaggagcacccggcgtgcgcgggcctgtcggagaaaaaggcgaccaaggcgatccgggagaagatggtcgcaacgggtcacccggatcgtcaggcccgaagggggataggggcgagcctggccccccgggacccccgggccggctggtcgacactggaccgggagcccgcgagaagggagaacctggtgatcgcggccaggaaggtccgcgcgggccaaagggagatcctggacttccgggagcgcccggagagcggggaatagagggatttcggggtccgcctggtccgcagggcgacccgggcgtacggggacctgctggcgaaaaaggcgaccggggaccacctgggttggacggtagatctgggctcgatggaaagccgggagccgcggggccgagcggacctaatggggcggccggaaaggcgggagatccgggacgggatggactccctggattgcggggcgagcagggactcccgggcccttccggtccacctggtctgccgggcaagccgggagaggacggtaagcctgggctcaatggcaagaacggcgaacccggagatcccggtgaagatgggagaaagggagaaaaaggagactcgggggcctcgggacgcgagggtcgcgacggcccaaagggggaacgtggagcgcccggcattctgggcccgcagggtcccccgggtttgccaggccctgtaggtccgccgggacagggattcccgggcgttccggggggaaccgggccaaaaggcgatagaggcgagactggaagcaagggagagcaggggctcccaggcgagcgcggattgagaggagagccgggatcggtgccgaacgtggaccgcctgctggaaaccgccggaatcaaggcctccgccttgcgggaaatcgtggaaacttgggacgagagctcaggatcgttcttgcctgtgccggagcgccggaggggtccgaagggcgatagtggagagcagggtccgcccgggaaggaagggccgatcggattccccggagaacgcgggctgaagggggaccgtggggaccctggcccacaggggccgccaggtctggcgctcggtgagaggggcccgcccggtccgagcggactggcgggtgaacctggcaagccgggcatccctggccttcctggtagagctggtggagtcggagaagcaggtcgcccaggagaacgtggcgagcggggagaaaaaggtgagcgcggggaacaaggcagagacggtccgcctggtctgcccgggactcccggaccacccgggccgcctgggccgaaagtctcggtggacgaacctggcccgggcctgtccggagaacaaggacctcctggactgaagggtgcgaaaggcgagcctggatcgaacggcgaccagggccctaagggagatcgcggtgtcccaggaatcaagggcgatcgcggcgagcccggtccacggggacaagacggaaatccgggtttgccgggcgagcgcggaatggcgggaccggaaggaaagcccggacttcaagggccgaggggaccgcccgggcctgttggaggacacggagatccggggcctccaggtgccccgggactggccggaccagccggtccacagggcccttcgggtctgaaaggagaacctggagagacgggcccccctggcagagggctgactggaccgaccggtgccgtgggcctgccaggaccacctggcccgtcgggattggtgggcccccagggatcaccgggactgccagggcaggtgggcgaaaccgggaaaccaggcgcacctggcagagatggagcgagcggaaaggatggtgaccggggcagcccgggagtacccggctcccccgggctgccaggacctgtaggaccaaagggtgaaccgggtccaaccggagcccctgggcaagccgtcgtggggctcccaggagcaaaaggcgaaaagggtgcaccgggcgggctggcgggggatctcgtcggtgaacccggagcgaagggtgaccgcggacttcccggcccacgaggtgaaaagggcgaagcgggacgggctggagagccgggtgacccaggagaggatggacaaaaaggcgccccagggccgaagggattcaagggagatcctggcgtgggagttccaggttcgccgggcccgcccggaccgccaggagttaaaggggatctggggctcccgggtctgcctggagccccgggcgtggtgggctttccgggtcaaaccggaccgcggggagaaatggggcagccgggacccagcggagaacggggtctggcaggaccgccgggaagagaaggcatccccggccctctgggtcctcccggcccacccggatcggttggacctccaggtgcaagcgggctcaaaggtgacaagggtgacccgggagtcggactgccaggaccgagaggagagcggggagaacctgggatccggggtgaagatggtagaccaggtcaggaaggcccaagaggacttactggccccccaggatctaggggagagcgtggagagaagggagatgtgggttcagcaggcctgaagggagataaaggtgactccgccgtgatccttggcccacctgggccgagaggtgctaagggtgatatgggagagcgcggaccgagagggctcgacggagacaagggtccgcgcggggataacggagatccaggcgacaagggcagcaagggtgagccgggcgataagggcagcgccggactgcctgggctcaggggattgctgggcccgcagggacagcccggagccgctggcatcccgggcgacccaggaagtccaggaaaggacggggtccctggcatcagaggtgaaaagggagacgtgggatttatgggcccccgaggactcaagggagaacggggcgtcaaaggggcatgcggactggatggagagaagggggacaagggcgaagccggacctccgggtcgaccgggcctcgctggacacaagggcgagatgggagaaccaggcgtgcccggacaatcgggagccccaggtaaagaaggcctgatcggacccaagggggaccgcgggttcgatggacaaccaggaccaaaaggcgatcaaggagagaagggagaacgtggcactccaggaatcggaggctttcctggcccatccggaaacgacggatccgcagggccaccaggcccaccagggagcgtcgggcctcgcggtccggaaggactgcaggggcagaaaggagagcggggcccacccggagaacgagtggtgggcgctcctggggttcctggtgccccaggggagaggggcgaacagggacgccccggacctgccggaccgaggggtgaaaagggagaggccgcgctgactgaggacgatatcagaggattcgtgagacaggaaatgtcacaacattgcgcctgccagggtcagttcatcgcctccggatcacggccgctgccttcatacgctgctgacactgcgggaagccagctccacgccgtcccggtgctccgtgtcagccacgccgaggaagaggaacgagtgccacctgaagatgacgaatactccgagtatagcgaatactcagtggaagagtaccaggatcctgaggccccgtgggactcagatgatccttgttcactcccgcttgacgagggaagctgcaccgcctacactctgcgctggtaccaccgggcagtgactgggtctaccgaagcgtgccacccgttcgtctacggtggatgtggaggaaatgctaatcgctttggcactcgcgaagcatgtgaaaggagatgccccccacgagtggtccagtcacaggggaccggaaccgcccaggac

SEQ ID NO: 9638 - DNA, 8832 bp, Artificial Sequence
  Description of Artificial Sequence: Synthetic coding sequence
atgactctgaggcttcttgtggctgccctttgtgcagggattcttgcagaagcccctcgcgtgagagcgcaacaccgggaacgcgtgacttgcaccagactgtacgcggcagacatcgtgtttcttctggatggatccagctcaataggcagatcgaattttcgcgaagtccgtagcttcctggaggggcttgttctcccgttttcaggagcagcgtcggcacagggagtgcgatttgcaactgtccaatactccgatgatccacggaccgaattcggactcgacgccctcggttccggcggtgacgtcatcagggccatccgcgaactttcttacaagggaggcaatacccgaactggggctgctatcctgcatgtcgcagaccacgtgttcctgccacagctggcaagacctggagtgccaaaggtgtgtatccttattactgatggcaaaagccaagatcttgtcgatactgcagcacaacgtctgaagggtcaaggtgtgaagctctttgctgtcggtattaagaatgccgatcctgaggaactgaagagagtggcctcccagccaacctctgacttctttttcttcgtgaatgatttttcgattcttaggaccctcctccctcttgtcagcaggcgcgtgtgcactacggcgggcggagtccccgtgactagaccccctgatgattcaacgtcggctcccagagatttggtcctgtcggaaccatcgtctcagagccttcgtgtgcagtggaccgcagcctcaggccctgtcactggctacaaggtgcagtacacccctctgaccggtcttggacaacccctgccatccgaacgccaggaggtgaatgtgccggcaggagaaacttccgtgagattgagaggtctgcgaccccttaccgaataccaagtgactgtgatcgcactgtacgcaaactccattggagaagcagtctcgggcaccgcgcgcactactgcacttgaagggcccgaacttacgattcagaatactactgctcatagcctgctcgtcgcatggcgttcggtcccaggtgcaaccggataccgtgtgacctggcgggtcctctcgggcggaccaacccaacaacaggagctgggacccggacaaggttccgtccttcttagagatttggagcctggaactgattacgaagtcactgtgtcgacccttttcggacgctccgtgggacctgcaaccagcctgatggcaaggactgatgcgtccgtggagcagacgctgcggccagttattcttgggccaacttcgattctgctttcgtggaacctcgtgcctgaggctcgtggatacaggctggagtggcggagagagacgggcctcgaaccaccacagaaggttgtcctgccttctgacgtgacgagataccaacttgatgggcttcaaccaggaacggagtacagactgaccctttacacccttctcgagggccatgaagttgcgactccagcaacggtggtgcctacgggcccggagctgccagtctcccccgtgactgaccttcaagcaaccgagctcccaggacagagggtcagagtgtcgtggtcacccgtccccggggcgacgcaataccgtatcatagtccgatctactcagggcgtggagaggaccctcgtccttccagggtcccagaccgctttcgacctggatgacgtgcaggcaggactgtcctacaccgttagagtttccgcgagagtggggcctagagaggggagcgcctcggtgttgaccgtgcgacgggaaccagagactccacttgcagtgccaggactgagagtcgtggtgtccgatgccaccagggtccgggtggcatgggggccagtccctggagcttcaggatttcgtatcagctggtcgaccggttcgggaccagagtcctcacaaacgctccctccggactccaccgctacggacattaccggactgcaaccgggtactacttaccaagtggcggtgtcagtcctgcgaggtagggaagaaggtccagccgccgtgatagtggcccgtactgatcctttgggcccagtcaggaccgttcatgtgacccaggcatccagctccagcgtcactatcacgtggacgagagtgccgggtgctactggttaccgagtgtcatggcatagtgcccatggaccagaaaagtcccagctcgtgtcgggtgaagccaccgtggcggagcttgacgggcttgaacccgataccgagtacaccgtccatgtgcgggcacatgtcgcgggtgtggatggtccaccagcctcggttgtggtgagaactgctcccgaaccagtgggaagggtttcgcgcctccaaattctgaacgcgtcatcagatgtgctgcgtatcacttgggtgggagtgaccggagccactgcctaccggctggcatgggggcggtcagaggggggtcccatgcgacatcaaatactcccaggcaatactgacagcgccgaaattcgtggacttgaaggtggagtgtcgtactcggtgcgggtgactgcacttgtcggggatcgggaaggcactcccgtctcgattgtggtgaccacgcctcccgaagcacctccagcgttgggaactcttcacgtggtgcaacggggagaacactcgttgagactcaggtgggagcctgtgcccagagcacaggggtttcttctccattggcaacctgaaggagggcaggaacagtcacgggtcctcggtccagagcttagctcatatcacctggacggacttgaacctgctacccagtacagagtcaggctctctgtccttggacctgcaggggagggaccctcggcagaggtgacggcaagaactgaatcgcccagagtgcccagcatcgaactgagagtcgtggatacctcgattgattcggtgaccttggcctggactcccgtctcgcgcgcatcaagctatatcctgtcgtggcgcccacttagaggcccaggacaagaggtccctggatcacctcaaaccctccctggaatttcttcgtcccaacgtgtgaccggtttggagccgggagtgtcgtacatcttttccctcactcctgtgctggacggagtgagaggacctgaagcgtcagtgacgcaaaccccggtgtgtcctagggggctcgcagatgtggtgtttctgccccacgctacccaagataatgctcaccgtgccgaagccactagacgcgttcttgagagactggtgctggctcttggacctctcggtcctcaagcagtgcaggtaggactgctttcatactcgcataggccatcgccactgtttccactgaacggtagccacgatcttggtatcattctgcaacgcatccgagatatgccatacatggatccgtccggtaataacctgggtaccgccgtggtgactgcccacaggtatatgctggcacctgacgcacccggacgtcgtcaacatgtgcccggagtgatggtgcttcttgtcgatgagcctttgcggggtgacattttctctccaatacgggaagctcaggcctcgggtctgaatgtggtgatgcttggaatggcaggtgctgaccctgaacagcttagacgtctggctccaggaatggattcagtccagacgttttttgcggtggacgacggcccttccttggatcaagccgtatccggattggcaaccgcactttgtcaagcatcctttactacccagcctaggcctgagccttgccccgtctactgccccaaagggcagaagggtgaacctggggagatgggccttagaggtcaggtggggccacccggagatccaggacttccaggaaggactggtgcaccaggacctcaaggtcctcctggttcggccaccgccaagggagagcgaggattccctggtgccgatggcagacccggttcgccaggtcgcgcaggaaaccccggcactccaggagctcctggactcaagggttccccgggcctgcctggccctcgtggtgaccctggagaacgcggaccaaggggtccaaagggcgaacccggagcaccaggacaagtcattgggggagaaggacctggactgcccgggcgtaagggtgacccaggtccctccggcccacctggcccacgaggtcccctgggcgaccctggcccacgaggtcctcctgggctgccaggaaccgcaatgaagggagacaagggcgaccggggagagcgcggtccaccagggccaggtgaggggggaatagcaccgggagaaccgggactccccggattgcctgggtcgcccggccctcaaggtccagtgggaccaccaggaaaaaagggtgaaaagggcgatagcgaagatggtgcacctggactgccaggtcagcctggttcccctggggaacaaggtccccgaggcccgcctggggctattggtcctaagggtgataggggttttcctggaccccttggtgaagccggcgaaaagggagagagaggacccccaggaccagcaggttcacgcggcctgcctggtgtggctggtcggcccggagcaaagggaccggagggaccacctggacccaccggtcgtcaaggagaaaagggagaacctggacggcctggcgaccctgcggtggtcgggccagcagtcgcaggacctaagggtgaaaagggagacgtcggaccagcaggtcctcgtggtgcaactggggtgcagggcgaaagggggccaccgggcctcgtgctcccaggagatcctggtccaaaaggagatccgggcgatcggggcccaatcggtctgacggggagagcaggtcctcctggagattccggaccccctggggaaaaaggagatccaggtaggcccggtcctcccggtcctgtgggccccagagggcgtgatggagaggtgggtgaaaagggagacgaaggtccgccaggagatccaggacttcccggaaaggcgggagaacgcggcctgagaggggcacctggggtgcggggtcctgtgggtgaaaagggtgaccagggagatccgggggaggatggaaggaatggaagccctggttcatccggacccaaaggggatcggggagaacccggtccaccaggaccaccgggacgactcgtggataccggtccgggggcccgtgaaaaaggagaaccgggagatcgcggacaagagggaccccgcggaccgaagggcgatccaggactgcctggagcacccggagaacgcgggatcgaggggttcagaggccctccaggaccacaaggagatccaggtgtccgagggcccgcaggggagaagggtgatagagggcccccgggcctggatggccgctcgggactcgacggtaagcccggagcggcaggaccatcgggaccgaacggcgctgcaggcaaggccggtgatccagggagggatggactccccgggcttcgcggagaacagggccttcctggtcctagcggtccaccaggtctgcctggaaaaccgggagaggacgggaagccgggtcttaacggtaagaacggggagcctggggatccaggagaagatggacgaaagggcgagaagggagactccggtgcttcagggagggaaggtcgtgatggaccaaaaggagaacgcggagcaccaggcatcctcggaccacagggccctcccggacttcctgggccagtgggccccccgggccaagggtttcccggtgtccctggaggtaccgggccaaagggagatcgcggagagactggttccaagggagaacaaggactgcctggtgagagaggcctccgcggcgaaccaggctcggtgcctaacgttgatcggctgcttgaaaccgcaggaataaaggcctcggcactgagagaaattgtggagacttgggacgaatcctcaggttcatttctgccggtgcccgaacggagaagagggccaaagggagactccggagagcagggaccccctggaaaggagggacccataggtttcccaggtgaacgcggtcttaagggggatcgcggagatcctggtccgcagggacccccaggactggcactcggagaacgaggacccccgggcccctcgggccttgccggagaacctggaaagcctggtattcctggtttgcccggtcgggcaggtggggtcggggaggcaggtcgccccggcgaaaggggagaaaggggtgaaaaaggcgaaagaggagaacaaggacgggatgggcctcctggcctccctggaaccccaggaccgccaggccctcccggccctaaggtgagcgtggacgagcctggccctggactttccggtgaacagggtccacctggtctgaagggagcaaagggcgaacctggatcaaacggagatcaggggcctaaaggggacaggggagtgcctggaattaagggtgatagaggtgaacctgggcctcggggacaagacggtaaccctgggctccctggcgagcggggaatggcgggaccagaggggaagcctggtctgcagggaccgagaggcccacctggccctgtggggggacacggggaccctggacctccgggtgcccctggactggcaggacctgcagggccccaagggccatcgggactcaagggtgaacctggggagactgggcctccaggacgtggcctgacgggcccaaccggcgcagtcggcttgcccggtcctcctggcccctcgggactcgtgggccctcaagggtcaccaggacttccgggtcaagtcggagaaactggtaagcctggcgcaccaggcagagacggggcatcaggaaaggatggagacagaggatcaccaggggtccctggatcacctgggctcccgggccctgtggggccaaagggggagcctggacctactggtgcccctggccaggccgtggtgggactccctggggcgaaaggcgaaaagggcgcacccggaggactggcgggagatttggtgggtgaaccgggagcaaagggcgatagaggactccctgggccaagaggtgaaaaaggtgaagccggacgtgccggagaaccaggcgatcctggagaggacggccagaagggcgcacccggtcccaaggggtttaagggggaccctggtgtcggtgttcctggatcccctggaccccctgggccccctggtgtgaaaggggaccttggtctgcctggactccctggtgcacctggagtcgtgggcttccctggacaaactggtccacgtggtgaaatgggccaacccggaccgtcgggcgagcgaggtcttgcgggtcccccaggaagagagggaattcccggaccacttggtcctccaggaccacctggatcggtggggcctccaggagcatccggactcaaaggcgataagggcgatccaggggtcggattgcctggtccaagaggagaacggggcgagccaggcatccgcggcgaagatggacggcccggccaagaaggtcctaggggacttaccggacctcccggatcgaggggagaacgcggtgaaaaaggagatgtgggatcagcagggcttaaaggggataagggcgattcggcagtcattcttggacctccaggaccacggggtgcaaaaggtgacatgggcgagaggggcccaaggggcctggatggtgacaaaggaccacgaggggataacggggatcctggtgacaagggctccaaaggagaacctggtgataagggctcagctgggctgcctggtctgcgaggactccttggccctcaaggacaacctggtgcggcaggcattcctggagatccaggctcgccaggtaaggatggagtgcctggaataagaggagaaaagggcgatgtcggcttcatgggtcctagagggctgaagggagagagaggagtcaagggggcctgtggtttggacggagaaaagggagacaaaggggaggcaggaccccctggccgcccaggacttgcaggtcataagggggagatgggtgagcctggagtgccgggtcaatcaggagcacctggtaaagagggactgattggtcctaagggcgatagaggttttgacggacagccgggaccaaagggggaccagggggagaagggggagagaggtaccccaggcatcggtggatttccggggccctcgggtaacgatggaagcgcaggtccaccgggtcccccagggtccgtgggtccccggggtcccgaggggctccagggacaaaagggagaaaggggaccgcccggagaacgcgtcgttggtgcacccggggtccccggagctccaggagaacgcggcgagcagggacgacctggaccggcagggccgagaggagagaaaggagaggctgcacttactgaggacgacattcgaggtttcgtgagacaagaaatgagccagcattgcgcatgtcaggggcaattcattgcaagcggatctcggcccttgccttcatacgcagccgatactgcgggttcccagctccatgcagtgcccgtgctgagagttagccatgcagaagaagaagagagagtccctccagaggacgatgaatactcggaatacagcgaatacagcgtggaagaataccaggaccccgaggcaccatgggattcggatgatccctgctcccttcccttggatgaaggatcgtgcactgcatacactctgcggtggtaccaccgggccgtgacgggatccactgaagcatgtcaccctttcgtgtacggaggatgcggcggaaacgcgaatcgattcggcacgagggaggcctgtgaacggagatgtccccccagagttgttcaatcgcaaggcactggcaccgcacaagac

SEQ ID NO: 9639 - DNA, 8832 bp, Artificial Sequence
  Description of Artificial Sequence: Synthetic coding sequence
atgaccctgaggctactggtagccgcactctgcgctgggattctggccgaggcccctagggtaagagcacaacatagggagcgagtgacctgcaccaggttgtacgccgctgacatcgtttttctgctggatgggagttcgagtatcgggcggagcaatttccgtgaggtacggagcttcctggagggtctggttctcccgttctccggtgctgccagtgcccagggagtccggtttgccaccgtccagtactcagatgatccacgaacggaattcggcttggacgctctcggctcggggggggatgttataagggcaatccgggagctgtcatacaaaggcggaaatacacgtactggagcggcaatcctgcacgttgcggatcatgtgtttttaccacagctggccagacctggggtgccgaaagtgtgtattctgataacagacggcaaatcccaggaccttgttgatactgctgcacagaggttgaagggccagggcgtcaagctgttcgccgtggggataaaaaatgccgacccagaggaactgaagcgtgttgcgagtcagcccacctctgatttcttttttttcgtcaatgatttcagcatcttgaggactctgctgcccttggtgtctcggcgggtgtgcacaaccgcaggcggcgtgccagtgacaagacctccggatgatagcacctctgcccctcgggaccttgtactcagtgaaccatcgtcacagtctcttagggtgcagtggactgccgcaagcgggccagttactggctataaggtccagtacacacctttaactgggctcggccaacctttgccctccgaacgacaggaggtcaacgttccggccggcgagacctctgttcggctgagggggctgagacccctgacggagtaccaggtcaccgtgatcgcactgtacgccaattctattggcgaggccgttagcgggacagcccgcaccactgcgctagagggcccggagttgacaattcaaaataccacagcccactcccttctggtcgcttggcgctctgtccctggcgctaccggatatcgcgtcacctggcgagtgctctcagggggcccaacccagcagcaagaactgggcccaggacaggggtctgtcctgctgagagatttggaacccggaacagactacgaggtaacagtgagcacactgttcggcaggtccgtcggtcccgcgacaagcttaatggcccgcaccgacgcaagcgtcgagcagactctacggcctgtcatccttggaccaacatctatcctcctaagctggaatcttgtgccagaggcccggggctaccggctggaatggcgccgcgagaccggtctggaacctcctcagaaagtcgttctaccatccgatgtgacacggtaccagctggatgggctacagcctggaacagaataccgactgaccctgtacaccctgttggaaggacatgaagtggccactccagccactgtcgtacctaccggcccagaacttcctgtgagtcctgtgaccgacctgcaggccaccgaacttcccggccaacgagttagagtgagttggagtcccgtccctggcgccacacagtacaggattatcgtcaggagcacgcagggtgtcgagaggaccctggtcctgccaggctctcagactgccttcgacctggacgatgtccaggctggtctgtcatacaccgtgagggtatccgcgcgcgttggacctcgagaaggaagcgcttccgttctaaccgtccgccgtgaaccggagacgccattggcggtgcctgggctgagagtggtggtgtcagacgcgacccgcgtgcgggttgcatggggcccagtgccaggagcgtcaggattcaggatatcatggagcactggcagcgggccagaaagttcccagaccctaccacccgactccactgccacagatatcacaggtcttcagcccggtaccacgtaccaagtcgcagtttctgtgctgcgaggtcgagaggaaggccccgctgccgtcatagtggcgcgcacagaccccctggggcctgtacgcactgttcatgtaacccaggcatcatcgtccagtgttacaatcacatggacacgggtgcccggtgcaacaggatatagagtgtcatggcactccgcccacggccctgaaaagagccaactcgtgtcaggagaggcaacggtggcagagctcgacggtctggaaccagacacagaatacacagtacacgtcagggcacatgtcgcaggcgttgacgggcccccagcgtctgtggttgttcggactgccccagagcctgtcggccgggtatcccggttgcagattttgaatgcaagctcagacgttctgaggattacttgggttggagtgaccggcgccacagcctataggctggcttggggacgcagcgaaggaggtccaatgcgccaccagatcctgcctggcaatactgacagtgcagaaattaggggtctcgaggggggcgtgtcatatagcgtgagagtgaccgcccttgtaggtgaccgggaggggactcctgtgagtatagtggtcacaactccccctgaggccccgccagcactgggaacactgcacgtcgtccagcggggcgaacactcactacgtctgcggtgggagccagtgccacgagcccagggctttctgctgcactggcaacctgaaggcggtcaagagcagagcagggtattagggcccgagctgtctagttatcaccttgacgggcttgaaccagcaacccaataccgtgtccggttaagcgtattaggcccagctggcgaggggccttcagcagaagtgacggccagaacagaaagcccacgagtcccttctatcgagctgcgagtcgtggatacctccatcgactccgttacactggcgtggactcctgtctcacgcgccagcagttacatactgtcatggcgccccttaaggggtccggggcaggaagttcctgggagccctcagacactgcctggaatctcatcgtcacagcgggtcacaggactggagccaggagtcagctacatattctctttaacaccagtacttgacggagttagagggccagaagcctccgtcacccagactccagtctgtccgcgcggactggctgacgtggtgtttctacctcatgcaactcaggacaacgctcaccgcgcagaggccaccaggagagtcctggaaagacttgttctggccctcggacctctggggccacaggccgtacaggtcggcttgctgagctatagccatagacctagccctctgttccccttaaatgggtctcacgacctaggaatcattcttcaaaggatcagggacatgccctacatggatccgagcggaaacaatctcgggaccgcggtggtgactgctcacaggtacatgctcgctcctgacgctcctggacggcggcaacatgtgcccggtgtgatggtactgctcgtggatgagccacttcggggagatatcttcagtcccatccgggaggctcaggcaagtgggttaaacgtcgttatgctgggcatggcaggagccgacccagagcagctgagacgcttagcacccgggatggactccgtgcaaaccttctttgccgtcgatgatgggccctcactcgaccaggccgtttctggcctggcgaccgctttgtgtcaagccagctttaccactcagccccgccccgagccatgtcctgtctactgccctaaagggcagaagggagagccgggtgagatgggcctgaggggtcaggtcgggcctccaggtgaccccggattgccagggaggacaggagcccccggaccacagggcccccccgggtccgccaccgctaaaggtgaacgagggttcccgggtgccgacgggcggccaggatctccaggtcgggcgggcaatccgggcacgcctggcgcccctgggctgaagggttctccgggcctgcccggcccccggggagacccgggcgagcgcggcccccgcggcccaaagggggagcccggtgcacccggccaggtgattggaggggagggtcccgggttaccagggagaaagggcgatcccggcccatctgggcctccgggacccagggggccactgggagaccccggacccagaggccctccgggcttgccaggtactgcaatgaaaggcgataaaggcgaccgcggcgaaaggggccccccaggcccgggcgaagggggaattgctcccggagaaccaggcctgccgggcctgcccggctcccctggaccgcagggccctgttggaccacccgggaagaagggtgaaaagggcgacagcgaagacggcgccccaggtctaccaggccagccaggtagcccaggagagcagggccccaggggcccaccgggagctatcgggccgaagggggaccgcggattccctgggcctttgggcgaggcgggcgaaaagggggaacgcgggccaccaggccccgctggaagccgcggcctgcctggggtcgcaggacgacccggcgctaaaggtcctgaagggcccccaggtcccacaggacgccagggcgagaagggagagcccggtagaccaggagatcctgctgtggttggacctgcggtcgcaggtcccaagggtgagaaaggtgatgtcggtcccgcaggcccacgaggagcgacaggtgtccagggcgagcggggtccccctggcctcgtgctgcccggcgatcctgggcccaagggcgacccaggcgaccgaggccctatcggcctcacggggcgcgcgggcccccccggcgacagcggccctccaggtgaaaaaggggaccctgggaggcctgggcctccagggcccgtggggccacgcgggcgcgacggcgaggtgggagagaaaggagacgaggggcctccaggggatccgggtcttcccggaaaagcaggtgagaggggtttgcgtggggctcctggcgtgagaggccctgtcggggaaaagggggatcaaggagatccaggtgaggatggacgcaacggatcccctggtagtagtggacctaagggcgacaggggcgagcctggtccccctggccccccaggcaggcttgtggacacagggcctggcgcaagagagaaaggcgaacctggagaccggggccaagagggccctcggggacctaaaggcgacccaggacttcccggggcgcctggcgaaagaggaatcgagggcttccggggcccgcctgggccacagggcgatccaggcgtgcgcgggccagctggcgagaagggagacaggggccccccagggctagacgggagaagtggtctggatggcaagcccggggctgccggcccgtcaggaccgaacggcgctgcagggaaagctggcgaccctggccgtgacggtctgcctgggctgcggggtgaacaggggctcccaggcccttcaggccctccagggttgcccggtaagcctggcgaagacggcaaaccgggccttaacggcaaaaacggggagccaggcgacccaggagaggatggcagaaagggtgagaaaggagatagtggcgctagcgggcgggagggccgggatgggcctaagggagaacgcggcgccccaggaatcttaggtccacaagggccacccggcctgccaggacccgttggccctcccggccagggtttccctggggtcccaggcggcactggcccaaagggcgataggggcgagaccgggtctaagggcgaacagggcttgcccggggagaggggcttgcgtggcgagcctggaagtgtaccgaacgtggacaggctcctggagaccgctgggatcaaagcaagcgcgctacgtgagatagtagaaacgtgggacgaatccagcggatcatttcttccagtccccgagaggcgccgaggccccaagggagactctggcgaacaagggccccccggaaaggaaggaccaatcggttttccgggagagcgtggcctgaagggagacagaggcgatcctggacctcaaggacctccgggccttgcgctgggggaacgtgggccccccggaccaagcgggctggcaggcgagcccggaaagccaggaatacccgggctgcccggacgggctggcggagtgggcgaagccggacggcctggtgagcgtggggagcggggcgagaagggagaacgcggcgaacaggggcgggatgggcctccaggtcttccgggaactcctggccccccaggaccccccggacccaaggtgtcggtggacgagccaggccctggcctgagcggcgaacagggaccaccaggtctgaagggggctaagggtgagcccggcagcaatggggaccagggcccaaaaggggaccgcggcgtgcctggaatcaagggcgatcgcggcgagccaggtccgaggggtcaggacggtaatcccgggctcccaggagaacgcggcatggccggacccgaaggcaagcccggcttgcaggggccaagggggcccccaggaccagtgggaggccacggtgaccctggcccccccggcgcccccggccttgcaggacctgccggaccacagggaccatccggcctcaaaggtgagcccggggaaacagggccccccggtagggggttgaccggtccaactggcgccgttggcttgcctggccccccaggaccatcaggtctggtggggccgcaggggagtcccggactgccagggcaggttggcgagactggtaagcctggagctcctgggagggacggcgcctcagggaaggatggggataggggcagtccgggtgtgcctggatcaccaggactgccgggacctgtcggtccgaagggtgaaccagggccaacaggagcccctggccaggctgttgttggcctaccaggcgcaaaaggcgagaagggggctccagggggcctcgcaggtgatctggtcggggagcctggtgctaaaggtgaccggggacttcccggcccccgtggcgaaaagggcgaagccggaagggctggcgaacctggggatcccggagaggacgggcaaaagggcgcaccaggaccaaagggcttcaaaggagatccgggcgtcggagtgcccggctctccaggccccccgggaccacctggagtcaaaggcgatcttgggctcccgggcttgccaggagccccgggtgtcgtcgggttccctggccagactgggccaaggggagagatggggcagcctggccccagcggcgagagagggttagctgggcctcctggcagagagggaattcctggccctctgggcccacccggcccccctggatccgtgggccctccaggtgcctccggcctcaaaggtgataagggagaccccggggtcggtctacccggcccaaggggcgagcggggagaaccaggaattcgtggcgaagacggtagaccaggccaagagggcccccgcggcctcacaggcccaccaggcagtaggggggagcgcggcgaaaagggcgatgtaggatccgcaggactcaaaggcgataagggggatagcgccgtgatcctcggaccaccaggaccccggggcgctaagggcgacatgggcgagaggggccccaggggcttagacggcgataaaggtcctagaggcgacaacggagaccctggagataagggtagcaaaggggagcccggtgataaagggtcagccggcttgcctggtctgcgcggcctgttgggtcctcaaggacagccgggcgccgctgggattccgggagaccctggttcccctggaaaagatggtgtccctggaatccggggtgagaaaggcgacgtagggttcatgggaccgagagggctcaaaggagaaaggggagtgaaaggtgcctgtggcttagacggtgaaaagggcgacaaaggggaagctggacctcctggaagacctggcctggcgggccacaaaggcgagatgggggagccgggcgtgcccggccagtcaggggcgccaggcaaggagggactgataggtcctaagggcgatagggggttcgacggccagcctggcccgaagggcgatcaaggcgagaaaggcgaaaggggcacccccggcatcggcggctttccgggtccttctgggaatgacgggtctgcaggacctcccgggcctccagggtccgtgggcccacgggggccagaagggttacaggggcagaagggcgaacggggaccacctggggagcgcgtcgtgggagctcccggagtgcccggagctcctggggaaaggggagagcagggtagacctggacccgccgggccccgcggtgaaaagggcgaagctgctctcactgaggacgacattcgcggctttgtgaggcaggagatgtctcaacactgtgcctgccagggtcagttcatagcttccggatctaggccattgccgagctacgccgcagacacagccgggagccagctccacgccgtcccagttttaagagtctcccacgcagaggaggaggagcgagtcccaccagaggatgacgagtattccgagtactcggagtatagtgtggaagaataccaggacccggaagccccttgggattcagatgacccatgctctcttcccctcgatgagggttcctgtacggcttacacccttcggtggtatcatagagcagtgacaggctctacagaggcatgccatccattcgtgtatggcggatgcggcggcaatgccaatcgctttgggacccgggaagcctgcgagagacgatgccccccccgcgtcgtccaaagccaagggacaggtaccgcccaggac

SEQ ID NO: 9640 - DNA, 8832 bp, Artificial Sequence
  Description of Artificial Sequence: Synthetic coding sequence
atgactttacggttgctggttgccgccctctgcgccggaatcttggctgaggcaccgcgcgttcgcgcgcagcatcgagaaagggttacttgcactagattatacgcagcagacatcgtcttccttttggatgggtcctcatccataggtcgcagtaatttcagagaggtcagatcctttttggaaggcctagtgttacctttctccggagccgcctccgcccagggggtcagatttgccaccgtacagtatagtgatgacccaagaacagagttcggcctcgatgctctcggtagtggaggagatgtgatccgagcaatcagggagttatcatataagggaggtaacacccgcacaggcgccgccatcctacacgtggctgaccacgtttttctacctcagttggccaggcctggcgtacctaaggtctgcattctgattaccgacgggaagagccaggacctggtggacaccgcagcccagaggctgaaaggacagggggtcaagctgtttgctgttggtatcaaaaacgcggatcccgaagagctgaagagggtagcatctcagccaacaagtgatttcttcttcttcgtcaatgactttagtatactccgcaccctcctcccgctggtgtctaggcgggtttgcactactgctggtggtgtgccagtcacacggccaccagacgattctactagtgccccccgggatctggtgctcagtgaaccttcctctcagtcactgcgggtgcagtggacagccgccagcggccctgttacagggtacaaggtccagtatacacctctgaccggactcggacagcccctgcccagcgaaaggcaggaggtgaacgtgcctgccggcgagaccagtgtgcggcttcggggtctgaggcccctgactgagtatcaggtgacagtgatcgccctctacgccaactctattggcgaggcggtgtcaggcacggctagaaccaccgcactcgaagggcccgagctcacaattcagaatacaactgcgcattctttgctcgtagcctggagatctgtccccggggccaccgggtaccgcgtgacttggcgcgtgctctctggggggcccacccagcagcaggaactgggaccgggtcagggcagcgtacttctcagagatcttgagccaggcacggactacgaggtgacagtgtctacactttttggacgtagcgtaggacccgctacaagcctgatggcacggaccgatgctagtgttgagcagactctccgacccgtaatactcggcccgacgagcatactcttgtcgtggaatctggtgcctgaagctcgcggatataggctggaatggcgcagggagactggccttgagccgccacagaaggttgtgctcccttctgacgtaactcggtatcagcttgacggcctgcaacccgggactgagtacaggctaactctttacactctattggagggccacgaggtggctacacctgccaccgtggtacccaccggtccagaactgccggtgagcccagtgaccgaccttcaggcgactgagctgcccgggcagcgggtgagagtgtcatggtcacctgtgcccggggccacccaatatcgcattatagtgagatcaactcagggagtggagaggaccctggtcctccccggctcccagacagccttcgatttagatgacgtgcaagccggcttatcatatacggtgagggtctccgcccgggttgggcccagggaaggatcagcttccgtactgactgtgaggcgtgagccagaaacacccttggcagtgccaggcctgcgggtcgtggtgtccgatgccacaagggttcgggtggcatggggcccagtacccggtgcaagcggctttaggatctcatggagcaccggatcagggccagagtccagccaaactttgccccccgactcgactgcgaccgatatcaccggcctgcaacccgggactacctaccaagtagccgtgtccgtgctgaggggtcgagaagagggaccagcagccgtgatcgtagctcgtaccgatccactgggcccggtgcggaccgtacacgtgacccaggcctcctctagctcagtgaccattacgtggacaagggttccaggcgcaacaggatatagagttagctggcatagtgcacatggaccggaaaagtcccagctggtatcaggcgaagctactgtagcggaactagatggactggaacctgacactgaatacacggttcatgttcgcgcccatgtcgcaggcgttgacgggcccccagctagtgtcgtcgtgcgcaccgccccagaacccgtcggacgcgtgtccagactgcagatcctgaacgcctcctccgatgttctgcgaatcacatgggttggagttacaggcgccacagcctaccgtctcgcctgggggcggtcagagggagggccaatgaggcaccaaattttgcccggcaacacagatagcgctgagatccggggcctcgaagggggagtgtcgtattctgttagggtgaccgcattggtcggtgatcgtgaaggaaccccagtttccattgtcgtcacaacacccccggaggcacctcccgctctcggtaccctacatgttgtccagaggggcgaacatagtctgcgccttcggtgggagcctgtgcctagagctcagggctttctgttgcattggcagcccgagggcggtcaggaacagtccagagtgttaggccccgagctgagctcctatcacctcgatggattggagcctgccacacagtaccgcgtaaggttgagcgttctcggccctgcaggcgagggccccagcgcagaggtgaccgctcggacagagtccccacgagtgccatcaatcgagcttcgagtggtggatacatctattgattcggtgaccctggcttggacaccagtgagcagggcctccagttacatcctatcatggaggccactgcgcggacctggccaggaagtgcctgggagcccacagaccctgcccggtatttccagctcccagagggtaaccgggctagagcctggcgtgtcttacatattcagcctcacacctgtgcttgacggggttagaggccccgaagcctccgtcacacagacccctgtgtgtccgcggggcctggctgatgttgtatttctacctcatgcgacccaggataacgcccatcgagcggaagccaccaggcgcgtgctggagcgacttgtgctagcactcgggcccttaggaccacaggccgtgcaggttggactcctgtcatattctcaccggccatctccactgtttcccctgaatggaagccatgaccttggtattatcttacagcgcatccgcgacatgccctacatggatcctagcgggaacaatttaggcaccgctgtggtcaccgcccaccggtacatgctggctcccgatgcccctggacgcaggcagcacgtgccgggcgtcatggtgctcctggtcgacgaaccacttaggggtgatattttctcccccattagggaagcccaggcgtctgggttaaacgttgtgatgttagggatggccggagcagaccctgagcagctacggcgcttagcacccgggatggactcggtgcagacattctttgccgtcgacgacggacccagcttggaccaggctgtgtccggtctggctaccgctctgtgtcaggcatcttttaccacccagcctcggccagaaccctgcccagtgtactgtcccaaggggcagaagggcgagccaggagaaatgggccttcgggggcaggtggggccccctggtgaccctggactccccgggaggaccggagcacccggacctcagggaccccctggatccgccactgctaagggcgaacgaggcttccctggcgccgacggacgcccggggagcccaggccgggctggcaaccccgggacccctggcgcgcccggactgaagggatctcccgggctgcctgggccaaggggggacccgggcgagcgggggcctagaggaccgaaaggagagcctggcgcccccgggcaagtgattggaggggagggccccgggttgccaggcagaaagggtgatcccggcccaagtgggccaccagggccgcggggccctctaggggatcctggacctcggggacctcccggccttccaggcacagccatgaagggcgataagggggatcgaggcgagcgggggcccccaggtcctggcgagggcggcattgcccctggagaacccggcctccctgggctgccaggctccccggggcctcaggggccagtaggaccccccggaaagaagggtgagaaaggagattctgaggacggagcccccggacttccagggcagcctgggtccccgggggagcagggacccagggggccccctggagcaataggccccaagggtgacaggggtttcccaggccccctgggagaggcaggtgagaagggtgagcgcggtcccccgggccctgcgggctctcgtggattgccgggcgttgccgggcgccctggcgctaagggccccgaagggcctcctgggccaacagggcgccaaggcgagaaaggcgaacctgggcgccccggagaccccgcggtggtaggcccagcagtggcagggcccaagggcgagaagggagatgttgggcccgcgggacctcgtggggctacaggcgtccagggcgagcgaggccccccaggactggttctgcccggagatcccggtccgaaaggagatcctggtgatagagggcctatcggattgaccggacgcgccgggccaccaggcgactcaggccctccgggcgagaaaggcgaccccggaaggcccggtccacctgggcctgtcggacccagaggcagggacggcgaagtcggagagaagggtgatgaaggtcctccaggcgatccgggcctgcccgggaaggctggcgagaggggcctgagaggggcgcccggagtgagaggccccgtaggagaaaaaggagatcagggcgatccgggcgaggatgggaggaacggaagcccaggcagtagtggccccaaaggcgacaggggcgagcccggacctccagggcctccagggcggctggtggacaccgggccgggtgctagagagaaaggagagccgggcgatagagggcaggaaggaccacgcggcccaaaaggcgacccagggctgcctggagctcctggagagaggggaatagaggggttccggggaccacccgggccacagggggatcccggcgtgcgggggcctgccggcgagaagggagatagaggtccgccagggctggacggcaggagcgggctggatggcaaacccggggctgcagggccaagcggccccaatggtgccgccggaaaggccggcgaccccggacgggatggtctgccgggtttaagaggggagcagggtctgccaggccccagtggccctcctgggctaccagggaagccgggtgaagacgggaaacctggtctcaatggtaagaatggcgagcccggcgatccgggtgaagatggcaggaaaggagagaagggagactccggagcatccggcagggagggaagggacggaccaaagggagaacggggagccccaggaatcctgggacctcagggaccaccaggtctgcctggcccagtgggaccccctggacagggctttcccggggtaccaggcggcaccggacccaaaggcgaccgtggcgaaaccggctccaaaggagaacagggccttccgggtgaaagaggactcaggggggaacccggctccgtccctaacgttgataggctgctggagactgcgggaatcaaggcctctgctcttagggagattgtggaaacatgggacgaatccagtggcagcttccttccagtcccagaaaggcggcgggggccgaaaggggatagtggagaacagggccctccgggcaaggagggtccgataggctttcccggtgaacggggtcttaagggggatcgcggggatcccggtccccagggcccacctggtctggccctgggtgagcgaggacccccgggaccctctgggttagctggcgagccgggtaagcccgggataccaggacttccgggccgtgctggcggcgtcggggaagccggtcgtccgggagagcgcggggagagaggggaaaaaggggaacgcggagagcaaggccgagacggcccccccggattaccgggtacaccaggaccccctggcccgcccggtcccaaggtcagcgtcgacgagcccgggccaggcttgtcaggcgagcagggcccgcccggtctgaaaggcgctaaaggcgagcctgggtctaacggagatcaggggccaaaaggcgacagaggggtgccaggcattaaaggcgatagaggggagcccggaccgagaggccaagacggaaaccctgggctcccaggcgagcggggcatggccggccctgagggcaagccaggactgcagggccctcgggggccaccaggcccggtcggcgggcacggggaccccggacctcccggagcccccgggctggccgggccagcgggcccccagggccccagcgggttgaagggcgagcctggggaaactggaccaccgggccggggattgacaggccctaccggggcagttggactgcccggcccacccggaccttccggactagttggcccccagggaagccctgggttgcctggtcaggtgggcgaaacagggaaacctggagcgcccggccgggatggagcgagcggaaaggacggtgaccgtgggagtccaggggtacctgggtccccaggattgcccggccctgtaggacccaagggagagcccgggcctaccggcgcacccggacaggcagtggtcggcttaccaggggctaaaggagagaagggcgccccaggtggactggcaggggaccttgtgggggagccaggcgcaaaaggcgatcgaggcttaccaggcccaaggggcgagaaaggcgaggcaggacgggcaggtgagcctggagaccccggtgaggacggccagaaaggagctccgggacccaaggggttcaagggagacccaggggtaggcgtacctggaagcccaggaccccctggacccccgggagtgaagggcgacttaggtcttcccgggctgcctggagccccgggggtggttgggttccctggacaaacgggccccagaggcgagatggggcagccaggtccttctggcgagaggggactggccggcccacctggtagagaagggatccctgggccgttaggccccccaggaccccccggaagcgtgggaccgcccggagcgtctgggctcaaaggcgacaagggtgatccgggtgtggggctccccggccccaggggcgaaagaggggagcctggaattcggggggaggacgggcgcccaggacaagagggccctagggggttaacgggacctcctggaagccgaggcgaacgaggagagaagggcgacgtgggctccgccggactgaaaggagacaagggtgatagcgcggtgattcttggcccaccgggtccccgcggtgcaaagggcgacatgggcgaacgaggcccgaggggcttggatggagataagggtcccaggggtgacaatggcgatcccggggacaaaggatctaagggagagccgggggataaaggaagtgcaggactgcccgggctccggggattgttgggcccccagggtcagccaggcgcagccggaatacccggagacccaggctctcctggcaaagatggtgttcccggcatcaggggagagaagggcgacgtgggatttatgggccctaggggcttaaaaggtgaacgcggggtaaagggggcctgtggcttggatggtgaaaaaggggataagggtgaggcaggaccccctggcagacccggccttgccggccacaaaggggaaatgggagagccaggggtccctgggcagtccggagcaccaggcaaagaaggattgatcggacccaagggggatcgcggctttgacggtcagcccggccccaagggcgatcaaggcgagaaaggggagcgtggaacaccggggatcggtgggttccctggaccgagtggcaatgatggatcggctggtccccctggcccccctggtagtgtaggcccgcgggggcctgagggtctccaggggcaaaagggcgaacggggacctcccggcgagcgtgttgtgggggcacccggagtacccggagcacctggagagcgtggggaacagggacgtcctgggcctgccggccctaggggggagaaaggagaggctgcgctgacagaggatgacatccgtggatttgtacgccaggaaatgtcacagcactgcgcttgtcagggccagtttatcgcttctggaagcagacctctgcccagctacgcagccgacaccgcaggatcgcagttacacgccgtcccagtgcttagagtgtcccatgctgaagaagaggaacgggttccacccgaggacgacgagtacagtgaatattctgagtattctgtggaggagtaccaggatcccgaggcaccttgggattctgatgacccttgtagtctaccactggacgagggatcctgcacagcctatacattacgctggtatcacagagctgtaactggaagtaccgaggcgtgtcacccattcgtctatggtggctgcggagggaacgcaaataggtttgggaccagagaggcgtgtgagaggaggtgccccccaagagtggtccagagtcagggtactggcacagcccaggac

SEQ ID NO: 9641 - DNA, 8832 bp, Artificial Sequence
  Description of Artificial Sequence: Synthetic coding sequence
atgaccctgcgactccttgtcgctgccctgtgcgctggaattctcgccgaagctccgcgggtgcgggcccagcatcgggagagggtcacttgcacccgtctgtacgcagccgacattgtctttctgctcgatgggtcgtcaagcatcggtaggtcaaatttccgcgaagtgcgctccttcctggaaggcctggtgctgccattttccggagctgcctccgcccaaggcgtccgcttcgcaaccgtccaatactcagacgacccgagaactgaattcggcctggatgccctcggctccggaggcgacgtgatccgggctatccgcgagctctcatacaagggcggaaacactagaaccggagcggcaatcctccacgtggccgaccacgtgttccttccacaactcgcgaggccgggggtgccaaaagtctgcattctgatcactgatggaaaatcacaggatctcgtcgacaccgctgcgcagaggctgaagggtcagggagtgaagctctttgctgtcggcatcaagaacgctgatcctgaggagctgaaacgagttgcttcacaaccgacgagcgactttttcttctttgtgaacgacttcagcatcctgcgcaccctcttgcccctggtgtcacgccgcgtgtgcacgaccgcaggaggagtgccggtcaccagaccgcctgacgactccacgtccgcgccgcgggatctggttctcagcgaaccctcttctcagtccctgcgcgtacagtggaccgccgcgtccggtcctgtcactggttacaaagttcagtacacccctctgacgggactgggacaacctttgccatccgaacgacaagaggtcaacgtgccagctggtgaaacttccgttcggctccgcggcctgaggccgcttaccgagtaccaggtgactgtgatcgccttgtacgccaactcaatcggcgaggctgtgagcggaaccgcgaggaccaccgcacttgagggcccggaactgactattcagaacaccaccgcacactcactcctggtagcgtggcgctccgtgccaggggccactggatacagggtcacgtggcgcgtgttgtccggaggaccgacccagcagcaggagcttggtccaggccaggggtcggtgctcttgagagacttggaaccgggcacggattacgaggtcaccgtgtcgactcttttcgggcgatccgttgggcctgcgacttccctcatggcgagaaccgatgcctctgtggagcagactctccgacccgtgattctgggtccgacctcgatcttgctgtcgtggaaccttgtgcctgaggcgcgcggctaccggctggagtggagacgggaaacggggttggagccgcctcagaaggtggtgttgccgtccgatgtgaccagatatcaattggatgggctccagccgggaacggaatacagactcaccctgtacaccctgctcgaaggacacgaagtggccaccccggccaccgtggtgcccaccggcccggagcttccggtgtcgcccgtcaccgacctgcaagccactgagttgcctggacaaagagtgagagtcagctggagcccagtgccaggagcaacccagtaccgcattatcgtccgctcaactcagggcgtcgagcgtaccctggtgctccctggcagtcaaactgccttcgatctcgacgacgtccaggcgggtctttcgtacactgtgcgggtcagcgctcgggtgggacctcgcgagggctcggcttccgtcctgaccgtgcggcgggaacccgagactccgctggcagtgcctggattgcgcgtggtggtgagcgacgcaacccgcgtgcgcgtcgcatggggccctgtgccaggagcgtccggcttccggatctcatggtccactggatcgggcccggagtcgtcgcaaacgttgcctccggattccactgccaccgacattacgggactccagccgggcactacttaccaggtggcggtgtccgtgctgcgcggacgcgaagaagggcccgcggccgtcatcgtggcccggactgatcctcttggcccggttcggactgtgcacgtcactcaagcctcatcatcgtccgtcactattacttggactcgcgtcccaggggccaccggataccgcgtgagctggcactccgcgcacggcccggagaagtcccagctcgtgtcaggtgaagccactgtggccgagctggacggcctggagcccgacactgagtacacggtgcacgtgagagcccatgtggcgggagtcgacggaccgccggcgtcggtggtggtgaggaccgccccggagccggttggacgtgtctctcgcctccagatcctgaatgcaagctcggacgtgctcagaatcacctgggtgggagtgactggagctactgcttaccggctcgcctggggccgctcggagggtgggcctatgcggcaccaaatcctgccgggcaatactgactctgctgaaatcaggggccttgaaggaggggtgtcctactcggtgagggtcactgcactggttggcgaccgagaaggtactcccgtctccatcgtggtgaccacgccgccggaggccccacctgccctgggtactctccacgtggtccagagaggtgaacactcgctgcgactcagatgggagccggtgccgagagctcagggattccttctccactggcagccagagggcggccaggagcagagcagagtcttggggccagaactctccagctaccacctcgatggattggagccggcaactcagtatagagtgagactgtcggtcttgggaccggcaggcgaggggccctcggccgaggtcaccgcacgcactgaaagcccgcgcgtgccttcaattgaactccgagtggtggatactagcatcgactcagtgacgctggcttggacccctgtttcacgcgcgtcatcgtacatcttgtcgtggcgccccctgagagggcccgggcaggaagtgccgggatcacctcagaccctgcctggaatcagctcctcacaacgggtgactggacttgagccgggagtgagctatatcttttcgctgacccctgtgcttgacggagtccggggccccgaggcatcagtgacccaaactccggtgtgccctcgggggctggcggacgtggtgttcctcccccacgctacccaagacaacgcgcacagagccgaggcgactcggcgggtcctggaaagactcgtcctggccctggggccgctcgggccgcaagcggtgcaggtgggattgctttcctactcacacaggccctccccactttttcccctgaatggtagccacgacctgggtatcatcctccagcggattagagacatgccgtacatggatccgtccggcaataatctgggcactgcggtggtgaccgctcaccgttacatgctggcgccggacgcaccgggcagacgccagcatgtgcctggggtgatggtgttgctcgttgacgagcccctgagaggcgatatcttctcgccgatccgcgaagcccaggcatcgggtttgaatgtcgtgatgctgggcatggcaggagccgacccggagcagctgcggcgcctcgcgccgggaatggattcggtgcaaaccttcttcgcagtcgatgacggcccgtctctcgaccaggccgtgagcggactggccaccgctttgtgccaggcctcgttcactacgcagccccgccctgagccgtgtcctgtgtactgcccgaaagggcagaaaggagaaccaggtgaaatgggtctgcggggtcaggtcggaccacctggggatccaggcctcccgggtcgaacgggagcacctggaccgcaaggacctcctggatcagcgactgcgaagggtgaacggggatttccgggcgcagacggccggccggggtcgccgggtcgggctgggaaccctggaactccaggcgcccctggactgaaaggcagccccggactcccggggcctcggggagatcctggagaacgcggcccgcgaggtcctaaaggagaacccggtgcgcccggacaggtcatcggcggagaaggtcccgggttgcctggacggaagggcgatccgggccccagcggacctccgggaccccggggaccactgggagatccaggcccgcggggaccacctggacttccggggaccgccatgaagggggacaagggagacaggggtgagcgcggcccccctggaccgggggagggcggaattgcgccaggagaaccagggctcccgggtctgccgggctcgccgggaccccaggggccagtgggaccgcctggaaagaagggcgagaagggggattccgaagatggggcgcccggactgccgggccagccgggatccccgggcgagcagggccctcgcggaccgccgggagctattggacctaagggtgatcggggtttccctggcccgctgggagaggcgggagaaaagggggagcgtggaccccccggacctgcgggcagcaggggcctcccaggagtggcaggccggcccggcgcgaaaggcccagagggaccaccgggaccaaccggacgccagggagaaaaaggagaaccaggtcgccctggcgacccagccgttgtgggccccgctgttgcaggacctaagggagaaaagggtgacgtgggcccggccggacctcggggtgcgaccggagtccaaggggaacgcggtcctccgggactggtcctcccaggagatcctgggccaaagggcgaccctggagataggggacctatcggactgacggggagggccggcccgccaggagattcaggacccccgggagagaagggagatccaggtagaccgggacctccaggcccagtgggcccgagaggacgggacggagaggttggcgagaagggagatgagggaccccctggggaccccggactgcctggtaaggccggtgagagaggtctgcggggcgcacccggagtcagaggcccggtcggcgagaagggggatcagggtgatccgggcgaggatggaagaaacggctcccccggatcgtcagggcctaaaggagatcggggagaaccgggccctcccgggccgcctggacggctggtggacaccggaccgggagcgcgggaaaagggtgaaccaggggacagaggacaagaagggccacgggggccaaagggagatcccgggcttccgggggccccgggggagagaggaattgagggatttcgcggacctcctggtccgcaaggagatccaggagtgcgggggccggcgggggaaaagggcgataggggaccgcctgggctggatggacggtcgggcctggacggaaaacccggagcagccggaccttcggggccaaacggcgcggccggaaaggccggggacccaggacgcgacggactgccgggcctccgcggcgaacagggattgcctggaccttcgggcccacccgggctgccaggcaagccgggagaggatggtaagccggggctcaatggcaaaaacggagagcccggcgatccgggcgaggatgggcggaagggagagaaaggagattccggagcttccgggcgcgagggacgggacggaccgaagggcgaaagaggcgctccgggaatcctgggaccgcaaggacctccaggcctgcctggccctgtgggtccgccgggtcaaggattcccgggagtgccgggcggaaccggaccaaaaggcgaccggggcgagacgggaagcaagggtgaacaaggactgccgggtgagaggggattgcgcggagaaccgggatccgtgccaaacgtggaccggttgctggaaaccgcaggaatcaaggcatcagcgctgcgcgagatcgtggaaacctgggacgaaagctccggctcattcctgccagtgccagaacgcagacgcggaccgaagggagactcgggtgaacaaggccctccaggcaaggagggcccgatcggcttcccgggagaacgcggactgaagggagataggggggatccgggcccgcaggggccacccgggcttgcgttgggagagcggggaccgccggggccttccggactggccggagaaccgggcaagccgggcattcctggtctgcccggtagggccggaggagtcggggaggccggtagacccggtgagcggggagaaagaggcgagaagggggaacgcggtgagcaaggtagagacggacccccaggcctgccgggaacccctggaccgccggggccgccgggaccaaaggtttcagtcgatgaaccgggaccaggactgagcggggaacagggacctccgggcttgaagggggcgaaaggagaacccggatcgaatggtgaccagggccccaaaggggaccggggagtccctggaatcaagggcgaccggggagagccaggacctagaggccaggacggcaacccagggcttccaggtgagcgcggaatggccggaccagaaggtaaaccgggactccaagggccgaggggtccgccaggccctgtgggagggcacggggacccgggtccgcctggagcaccgggcctggcaggacctgcaggtccgcagggaccctcggggttgaagggagaaccaggagaaaccggccccccgggaagaggactgaccggtcccactggagccgtaggactcccgggtccgccgggaccgtcgggactggtcggaccgcaaggatcgccggggctgccaggacaggtgggagagactggtaagccgggagccccaggtcgcgatggcgcctcaggaaaggatggagatcgaggatcgccaggcgttccaggaagcccggggctgccgggaccagtcggtccaaagggagagccggggccaactggagccccgggacaagctgtggtcggcctgcctggagctaagggggagaagggggcccccgggggactggccggagatctggtcggagaacctggagcaaaaggagacaggggcctgccgggtcctaggggagaaaagggggaggcgggtcgcgccggggaaccgggagatccgggggaggacggacagaagggggccccgggcccaaagggattcaagggtgatccgggggtgggcgtcccaggatcccccggaccacctgggccccccggtgtgaaaggtgacctgggcctgcccgggctcccgggagccccaggagtggtggggttcccgggacagacggggcccagaggagaaatgggccagcctggtccgtcaggcgagaggggtcttgccggaccgccaggtagagaggggatcccagggccgctgggaccacctggaccgcctggttcggtgggacctcccggagccagcgggctgaaaggagataaaggggacccgggggtgggacttccaggcccgcgcggagaacgtggagaaccgggcatccgcggagaggacggacgcccgggacaggaggggccacgcggactgaccggacccccgggctcgaggggagagcgcggggagaaaggagacgtgggctcagccggcctcaagggagacaagggcgacagcgctgtcatcctgggacctcctggaccgaggggagctaaaggcgatatgggagaacggggtccaagaggtctggatggagataagggccctcggggtgataacggtgacccgggcgacaagggctccaagggtgagcctggggacaagggcagcgcgggcctccccgggctgcggggacttctgggaccacagggacagccgggcgccgccggaatcccaggggatccaggatcgccagggaaggacggggtcccgggtatccggggagaaaaaggcgatgtcgggttcatgggacctcggggcctcaaaggagagcgcggggtcaaaggagcctgcggactcgacggagaaaaaggcgacaagggcgaggcaggaccaccaggtcgccccggacttgcgggacataagggcgaaatgggagagccaggggtgccagggcagtccggtgcccctgggaaggaaggtctgatcgggccgaagggcgatcggggctttgatgggcagccgggtcccaagggcgaccaaggtgaaaagggagaacggggaacgcctggaatcggcgggttcccggggccgagcggtaacgacggtagcgccgggccgccaggaccaccaggatccgtgggaccacggggaccggaaggactgcaagggcaaaagggcgaacggggacccccgggcgaaagagtggtgggagccccaggcgtgccaggagcccctggagagagaggggagcaaggacgacccggacctgcaggcccgcgcggagagaaaggtgaggccgcgctgactgaagatgacatccgcggattcgtgcgccaggagatgtcacagcactgcgcctgccagggtcagttcatcgcaagcgggtcgcggcctctgccttcttacgccgctgacactgccggcagccaactgcatgccgtgcctgtgctgcgcgtctcccacgccgaagaggaagaacgggtgccaccggaagatgacgaatactccgaatattcggagtactcagtggaggagtaccaagacccagaagcaccgtgggactcagacgacccttgctcactcccgctggacgagggttcatgcactgcctacaccctgagatggtaccaccgggcagtcaccggaagcaccgaggcctgccacccatttgtgtacggcggctgcggcggcaatgctaaccgcttcggtactcgcgaagcctgcgagcgccgctgccccccgcgcgtcgtccagtcccagggaactgggaccgcgcaggat

SEQ ID NO: 9642 - DNA, 8832 bp, Artificial Sequence; identical to SEQ ID NO: 9573
  Description of Artificial Sequence: Synthetic coding sequence

SEQ ID NO: 9643 - DNA, 432 bp, Artificial Sequence
  Description of Artificial Sequence: Synthetic coding sequence
atgtggctccagtcccttctccttcttggtaccgtcgcctgcagcatcagcgctccggcgagatcccctagcccgtcaacccagccatgggagcacgtgaacgctatccaggaagcccgtcggctgctcaatctctcgcgtgatactgccgcggagatgaacgagactgtggaagtcatatcggaaatgtttgatctccaagaacccacttgtctgcaaacgagactggaactttacaagcagggactccgggggtcactcaccaagctgaaaggaccactgactatgatggcgtcacattacaagcaacattgcccacccaccccggaaaccagttgtgcaacgcagattatcacgttcgaatcgtttaaggaaaacctgaaggacttcttgcttgtgattccctttgactgctgggagcctgtgcaggag

SEQ ID NO: 9644 - DNA, 432 bp, Artificial Sequence
  Description of Artificial Sequence: Synthetic coding sequence
atgtggctccagagtctactcttgctgggcactgttgcttgcagcatcagcgctcccgcaagaagtcctagcccctccacccagccatgggagcacgtcaatgctattcaggaagccagaaggctcctcaacctgagcagggacactgctgcggagatgaatgagacagttgaggtgatatctgagatgtttgaccttcaggaacccacctgcctccagactaggttggaactatacaagcaggggctgcgcgggagcctcactaagctcaaagggcctctgactatgatggcctcacattacaagcagcattgcccgcccacccccgagaccagctgcgcaactcagatcatcacatttgagagcttcaaagaaaaccttaaggattttcttttggtcatcccttttgactgctgggagcccgtgcaggag

SEQ ID NO: 9645 - DNA, 432 bp, Artificial Sequence
  Description of Artificial Sequence: Synthetic coding sequence
atgtggctgcagtcgctgctgctcctcggaaccgtcgcttgtagcatcagcgccccagcccgctcaccgagcccgtccactcagccgtgggagcacgtgaacgctatccaggaggcgcgacgccttctgaacctgtcacgcgacaccgccgccgagatgaatgaaaccgtggaagtgatctcggaaatgttcgacctgcaggaacctacttgcctgcaaacccgccttgagctttacaagcagggcctcaggggttcactcaccaaactcaaggggcccctcaccatgatggcgtcgcactacaaacagcattgcccacccacgcctgaaacgtcttgcgcgacgcagatcatcaccttcgaatccttcaaggagaaccttaaggacttcttgcttgttatccctttcgactgctgggaaccagtgcaggaa

SEQ ID NO: 9646 - DNA, 432 bp, Artificial Sequence
  Description of Artificial Sequence: Synthetic coding sequence
atgtggttgcaatctctcttgctgctggggaccgtagcttgtagcatctctgctcctgcccggtcaccctccccaagtacgcagccttgggagcacgtgaacgccattcaggaagctagacgactactgaatttgtccagggacacagcggccgaaatgaatgagactgttgaagtgatcagtgaaatgttcgatctgcaggaacccacatgcttgcaaacacgattagagctctacaagcaaggtctgagaggctcactcaccaaactgaagggcccgctgacaatgatggcctctcattacaagcagcattgcccaccaactccagaaactagctgcgccacccagattatcacgttcgagagctttaaagagaaccttaaagatttcctgttggttatcccattcgactgttgggagcccgtgcaagaa

SEQ ID NO: 9647 - DNA, 432 bp, Artificial Sequence
  Description of Artificial Sequence: Synthetic coding sequence
atgtggttgcagagtttgctattgctcggtactgtagcttgctcaatatccgccccagcgcggagccccagcccatcaactcagccttgggaacatgtgaacgctatccaggaggccagacggttgctgaacctttcaagggatacagccgctgagatgaacgaaaccgtcgaagtcatctccgagatgttcgatctgcaagagccgacctgcttacagacgcggctggagctctacaagcagggacttagggggtctctgacaaagctgaaaggccccctcactatgatggcctcccattacaagcagcactgccctcctaccccagaaacgtcatgtgccacccagatcatcacgttcgagtcattcaaggaaaatctgaaggacttcctgctggtcattccatttgactgctgggaacccgtgcaggag

SEQ ID NO: 9648 - DNA, 432 bp, Artificial Sequence
  Description of Artificial Sequence: Synthetic coding sequence
atgtggcttcaatcgcttctgctgctgggcacggtggcatgcagcatatcggcaccggcccgatctcccagtccatctactcaaccgtgggaacatgtgaacgcgatccaggaggcgcgccgcctgctcaatctctcaagagatactgcagcagagatgaacgaaactgtggaagttatatccgaaatgttcgacctgcaagagcctacttgtctccagacccggctggaactttacaagcaaggtcttagaggaagcctgaccaaactcaaggggccgcttaccatgatggcctcccactacaagcaacactgtccaccaacgcctgaaacgtcatgcgcaactcaaatcattaccttcgaatcatttaaggagaacctcaaggattttctgctggtgattccatttgactgttgggaacctgtccaagaa

SEQ ID NO: 9649 - DNA, 432 bp, Artificial Sequence
  Description of Artificial Sequence: Synthetic coding sequence
atgtggctgcagtcattgttattgctcggcaccgtcgcctgctcaatcagcgctccagcgagatcccccagtccatctacacagccctgggaacacgttaatgccatacaggaggctaggagattgcttaatttgagcagagatactgcggcagagatgaacgagactgtcgaggtgatctctgagatgttcgatctgcaggagccgacctgcctgcaaacacgcctggagctgtataaacagggcctgcgtggttccctgaccaagctcaaaggacctctgacaatgatggcatcccattataagcagcactgtcctcccaccccagagacatcttgtgcaactcaaattattactttcgaaagctttaaggagaatctcaaagacttcctgctggtgatacccttcgactgttgggagccagtccaggaa

SEQ ID NO: 9650 - DNA, 432 bp, Artificial Sequence
  Description of Artificial Sequence: Synthetic coding sequence
atgtggcttcaatcattactgttgcttggcacagtcgcatgctctatatccgcccccgcccgatcaccaagcccatcaactcaaccctgggaacatgtgaatgccatccaggaagcaagacgcctgctaaacctctctagagataccgccgccgaaatgaacgagacggtcgaagttatcagcgaaatgttcgatcttcaggaaccaacctgcctgcagacgagactcgaactgtacaagcagggattaagaggcagcctcacaaaattaaagggacctctgaccatgatggccagtcactacaaacagcactgccctccaactccggaaacaagttgcgccacacagatcattacatttgaaagcttcaaggagaaccttaaggacttcctactggtgatcccttttgactgctgggaacccgtgcaggag

SEQ ID NO: 9651 - DNA, 432 bp, Artificial Sequence
  Description of Artificial Sequence: Synthetic coding sequence
atgtggctccaatcgctgctcctcttgggcaccgtggcatgttccatctcggctccggccagatcgccttcgccgtccacccaaccgtgggaacatgtcaacgcgatccaggaagcacgccggcttcttaacctgtcaagggacaccgcggcagaaatgaatgagactgtggaggtgatttccgagatgttcgatctgcaagagccgacttgccttcaaactcggttggaattgtacaagcagggactcagaggtagccttaccaagttgaaagggccgctgaccatgatggcgagccactacaagcagcattgcccgccgacccctgagacttcctgcgcaacccaaatcattacgtttgaatctttcaaagagaacttgaaggacttccttctcgtcattccgttcgactgctgggaacccgtgcaagag

SEQ ID NO: 9652 - DNA, 432 bp, Artificial Sequence
  Description of Artificial Sequence: Synthetic coding sequence
atgtggctccagtccctattgctgcttgggacagtcgcctgttcaattagcgcgcccgcgagatcgccttccccgtcaacccaaccatgggaacacgtgaacgctatccaggaagctcgccggcttctgaacttgtctcgagatacagctgccgagatgaacgaaaccgtcgaggtcatatctgagatgttcgacctgcaagagccaacttgcctccaaactagactggagctttacaagcagggactacgcggcagcctgacgaaactgaaaggccctctaacaatgatggctagccattacaaacagcactgccctcctacccccgagacttcatgcgctacacagattatcacattcgagtcttttaaagagaaccttaaggattttttgttggtaatcccatttgactgttgggagcccgtccaggaa

SEQ ID NO: 9653 - DNA, 432 bp, Artificial Sequence
  Description of Artificial Sequence: Synthetic coding sequence
atgtggcttcagagtttactgctgctcggtaccgtggcctgctcaataagtgctccggccagatcaccatccccttctactcagccctgggagcacgtaaacgcgattcaagaggctaggcggctcctgaatctgagccgagataccgctgccgagatgaacgagacagtcgaggtgatctcagaaatgtttgacctccaggaaccaacttgtctgcagacccgcttagagttatataagcagggattgcggggatccttgacaaagctgaagggccctttgacaatgatggccagtcattacaaacagcattgcccgcctaccccagaaacctcatgcgccactcaaataattacatttgaaagctttaaggaaaacctgaaggacttcttgctggttattcctttcgactgctgggagccagtacaggaa

SEQ ID NO: 9654 - DNA, 432 bp, Artificial Sequence
  Description of Artificial Sequence: Synthetic coding sequence
atgtggctgcagagcctgctgcttctgggaaccgttgcctgctccattagtgcacccgccaggtcacctagcccgtccacacaaccatgggagcacgtgaatgcaatccaggaagccagaagactgcttaatctcagtagggacactgcagcagagatgaatgagaccgtggaggtaatttccgagatgttcgatctgcaggaaccgacctgtctgcaaactaggctggaactgtacaagcaggggctgcgcggcagtctaaccaaacttaaagggcctctaaccatgatggcaagccattacaaacagcactgcccacccacaccagaaacttcttgtgccacccagattatcacgttcgagtcctttaaagagaacttgaaggatttcttgctcgtgatccctttcgattgctgggaacctgtgcaggag

SEQ ID NO: 9655 - DNA, 432 bp, Artificial Sequence
  Description of Artificial Sequence: Synthetic coding sequence
atgtggttgcagagcctgcttctcctggggacggtggcatgctcgatctcggccccagctcgcagcccatccccttcaacccaaccatgggagcacgtgaatgccatccaggaagcacgccggctgctgaacctgtcccgcgacaccgcggcggagatgaatgagactgtcgaagtgatcagcgaaatgttcgatctgcaggaaccgacctgtctccagactagactcgaactgtacaaacaaggactgagaggatcgttgactaaactgaagggtccgctgaccatgatggcttcccattacaaacagcactgcccgccgacgcccgaaacctcctgcgcgactcagattatcaccttcgagtcgttcaaggagaatctgaaggacttcctgctggtgatcccgttcgactgctgggagccggtgcaggaa

SEQ ID NO: 9656 - DNA, 432 bp, Artificial Sequence
  Description of Artificial Sequence: Synthetic coding sequence
atgtggttgcagtccctactactgctcggcaccgtggcctgctccatctcagcccccgcgaggtccccaagtccatccacccaaccatgggagcatgtgaacgctatacaggaagcacggcggctcttgaatctttctagagacactgctgccgagatgaatgagacagtagaggtgatctcagagatgttcgacctccaggagcccacctgcctgcaaactaggctggagctgtacaagcaagggttgcgcgggtcgctcacgaagttgaagggacccctgaccatgatggcctcccactacaaacaacattgcccccctacccccgaaacttcatgtgccacacaaatcataacatttgagagttttaaagaaaacctgaaggattttctccttgtgataccctttgactgctgggagcccgtgcaggaa

SEQ ID NO: 9657 - DNA, 432 bp, Artificial Sequence
  Description of Artificial Sequence: Synthetic coding sequence
atgtggcttcaatctctgttgctcctggggacagttgcatgctccatatctgccccagctagatccccgtctccatctacacagccttgggagcacgtgaacgccatccaggaggccagaagacttttgaacttgtcacgcgatacggccgcagagatgaatgagactgtagaggtcattagtgaaatgttcgatctgcaggaacccacttgcctgcagacacggctggagttgtacaagcaaggcctgcgcggcagcctgaccaaactcaaggggccattgactatgatggctagtcactacaaacagcactgtccgcctactcccgaaacatcatgtgccactcaaataattaccttcgaatccttcaaggagaatctcaaggattttctgcttgtcatcccattcgattgttgggagccagttcaggaa

SEQ ID NO: 9658 - DNA, 432 bp, Artificial Sequence
  Description of Artificial Sequence: Synthetic coding sequence
atgtggctgcagtctcttctgctcctgggtactgtggcctgtagtataagcgcccccgcacgttcccccagcccgtctacccagccttgggaacacgtgaacgctatccaggaggcccggaggctcttaaacctttccagagatacggccgcggagatgaatgagacggtggaggtcatttcggagatgttcgatttgcaggagccaacctgcctgcagacccgcctggagctgtacaagcagggtcttcgtggtagcctaaccaagctcaaaggacccctgaccatgatggcctctcactacaagcagcattgccccccgactcccgagacgtcctgcgcgactcaaattatcactttcgagtcattcaaggagaacctcaaggacttcctgcttgtcatcccctttgattgctgggaacctgttcaggaa

SEQ ID NO: 9659 - DNA, 432 bp, Artificial Sequence
  Description of Artificial Sequence: Synthetic coding sequence
atgtggttacaatcgttactattattaggtacggtagcgtgttcgatatcggcgccggcgcgatcgccgtcgccgtcgacgcaaccgtgggaacatgtaaatgcgatacaagaagcgcgtcgactattaaatctatcgcgtgatacggcggcggaaatgaatgaaacggttgaagtaatatcggaaatgtttgatttacaagaaccgacgtgtttacaaacgcgtctagaattatataaacaaggtctacgaggttcgctaacgaaattaaaaggtccgctaacgatgatggcgtcgcattataaacaacattgtccgccgacgccggaaacgtcgtgtgcgacgcaaataataacgtttgaatcgtttaaagaaaatttaaaagattttttattagttataccgtttgattgttgggaaccggtacaagaa

SEQ ID NO: 9660 - DNA, 432 bp, Artificial Sequence
  Description of Artificial Sequence: Synthetic coding sequence
atgtggctacaatccctgcttttgctgggtaccgtcgcatgttccatcagtgcacctgctcgttccccttccccttctactcagccatgggaacacgtcaacgcaattcaagaggcgcgacgcctccttaatcttagccgagacacggctgcggagatgaacgagacagtggaagtcatatcagagatgttcgatctacaagagccaacatgtctacagacgcgcctggagttgtataagcagggcctacgtggttcgctgactaaactaaagggccccctcacaatgatggcatctcattataaacagcactgcccgcctacgcccgagacatcctgcgcgacacaaattatcacgttcgagtcatttaaagaaaatcttaaagacttccttctcgtcatcccctttgattgctgggagcctgtccaggag

SEQ ID NO: 9661 - DNA, 432 bp, Artificial Sequence
  Description of Artificial Sequence: Synthetic coding sequence
atgtggcttcagtcgcttctgcttttgggaactgtcgcatgtagcatatccgcaccagcgagatccccatcgccttcgactcagccttgggaacacgtgaatgccatccaagaagctcggcgcttgcttaatctgtcgagagatactgccgcagaaatgaacgaaactgtcgaagtgatctccgagatgtttgacctccaggaaccaacttgtttgcaaaccaggctggaactgtacaagcagggcctgagaggcagcctcactaaacttaaaggtccgttgaccatgatggcttcgcattacaagcaacattgtccaccaactcctgaaacctcgtgtgcaacccagattatcaccttcgagtccttcaaagagaatctgaaggattttctcctggtgatcccttttgattgttgggaaccggtgcaggaa

SEQ ID NO: 9662 - DNA, 432 bp, Artificial Sequence
  Description of Artificial Sequence: Synthetic coding sequence
atgtggcttcaaagtttgcttcttcttggtactgtggcatgtagtatttcagctcctgcaagaagtccttcaccatcaactcaaccatgggaacacgttaatgctatacaagaagctagaagattattaaatctctctagagacactgcagcagaaatgaacgagactgtagaagtcattagtgaaatgtttgacttacaagaaccaacttgtttacaaactagacttgaactttataaacaaggattgagaggatcattaactaaattaaaaggtcctttaactatgatggcttcacattataagcaacattgtccaccaacacctgagacttcatgtgcaacacaaatcattactttcgaatcatttaaagaaaatttaaaagattttcttcttgtaataccatttgattgttgggaaccagttcaagaa

SEQ ID NO: 9663 - DNA, 432 bp, Artificial Sequence
  Description of Artificial Sequence: Synthetic coding sequence
atgtggcttcaatctctgcttttactaggaacagtggcgtgttcaatatcagcacctgctcgctcaccttcaccgtcaacacaaccgtgggagcatgtgaatgcaatccaggaagcccggcgcctgttaaacttgagccgtgatacagctgctgaaatgaatgagacggtggaagttatctccgagatgtttgatcttcaggagccaacgtgtttgcagacacgccttgaactatataagcaaggacttcggggcagccttaccaagttgaaaggccccctgacgatgatggcgtcacattataaacagcactgtcctcctacaccggaaacgtcttgtgctacacaaattataacatttgagagttttaaagagaatttaaaagattttctgcttgtgattccttttgattgctgggaacctgtccaagaa

SEQ ID NO: 9664 - DNA, 432 bp, Artificial Sequence
  Description of Artificial Sequence: Synthetic coding sequence
atgtggcttcagtccttgctcttgcttgggaccgttgcttgctcgatctcggcacctgctcgaagccctagcccaagcacccagccctgggaacacgtcaatgccatccaggaagctcggagactgctgaatctcagtcgcgatactgcagctgagatgaatgaaaccgtcgaagtgatatccgagatgttcgacctgcaagagcctacatgcctccagacgcggctggagctgtacaagcaaggtctaaggggaagtttgactaaactgaaggggcctctgaccatgatggctagccattataaacagcattgcccacctaccccggagacatcctgcgccactcagataatcacattcgaaagttttaaagaaaatctgaaggattttttgctcgtgattcctttcgactgctgggaacccgtccaagaa

SEQ ID NO: 9665 - DNA, 432 bp, Artificial Sequence
  Description of Artificial Sequence: Synthetic coding sequence
atgtggttgcagagtctgttgctcttgggtacagtggcatgctccatctcagcccctgcaaggtctccctcaccttctacacagccatgggagcatgtaaacgcaatccaggaggcaagacggctgctgaacctttcccgggataccgccgcagaaatgaatgaaacagttgaagtcatttctgaaatgtttgatttacaggaacccacttgcctgcagacaaggctggagctctacaagcaggggttgagagggtcccttaccaagttgaaggggcccctgactatgatggcaagccactacaaacagcattgtccccccacccctgagacctcttgcgccactcagatcattaccttcgaatcatttaaagagaacttgaaggacttcttacttgtgattcccttcgactgctgggaacctgtgcaagag

SEQ ID NO: 9666 - DNA, 432 bp, Artificial Sequence
  Description of Artificial Sequence: Synthetic coding sequence
atgtggctccaatccctgcttctattgggtaccgtcgcctgcagtatcagcgcacccgcaagatcgccgtccccctccacccagccatgggagcacgtgaacgcaattcaggaggcccggcgcctgctgaacttgtctagggacactgccgccgagatgaatgagactgtggaggtcatctcagagatgtttgacctgcaggaacctacgtgccttcaaaccagacttgaactttataagcagggactaaggggttccctaaccaaactcaaagggcccctgaccatgatggccagccactataaacaacattgccctccaacaccagagacgtcatgcgctacgcagattattactttcgagtccttcaaggagaatcttaaggatttcctcctcgttataccattcgattgctgggaacctgtgcaggaa

SEQ ID NO: 9667 - DNA, 432 bp, Artificial Sequence
  Description of Artificial Sequence: Synthetic coding sequence
atgtggctgcagtcgctcctgctgctgggcactgtggcctgcagcatctctgcgccggctcggagcccatccccgtccactcagccttgggaacatgtgaacgctatccaggaggcccgccggctgcttaatctttcgagagacaccgcggctgagatgaacgagactgtcgaagtgatctccgagatgttcgacctccaagagccgacttgtttgcaaacccgcctggaattgtacaagcagggactgcgcggatcgctgactaaacttaaggggccgctgacgatgatggcctcccactacaagcagcactgtccgcccactccggaaacgtcatgcgctactcagatcattaccttcgagtccttcaaggagaatctcaaggattttctgctcgtgatcccttttgactgctgggagccggtgcaggag

SEQ ID NO: 9668 - DNA, 432 bp, Artificial Sequence
  Description of Artificial Sequence: Synthetic coding sequence
atgtggctccagtcccttttgctcctcggaactgtcgcatgtagcataagcgcacctgcccgctccccttccccaagtacccagccatgggagcatgtgaatgcgattcaggaggccagacgcctgctgaatttgtcaagagacaccgctgcagaaatgaacgaaactgtggaggtgatctcggaaatgttcgacctgcaagaacccacgtgccttcaaactagattggagctgtacaagcaaggccttcgggggagccttacgaaactcaaaggtcccctgactatgatggcatcccactacaagcaacattgccctcctacgccggaaacctcatgcgcaactcagataatcacgtttgaatcatttaaggaaaatcttaaggattttctcttggtgattccgttcgactgttgggaaccggtccaggaa

SEQ ID NO: 9669 - DNA, 432 bp, Artificial Sequence
  Description of Artificial Sequence: Synthetic coding sequence
atgtggcttcagagcctcttgctgctcggaactgtggcttgttccatttcagccccagcgcgctcgccatcgccgtctactcagccttgggagcacgtcaacgccatccaggaagcccggcgcctcctgaacctctcgagagacactgcagcagaaatgaatgagactgtggaagtgatctcagaaatgttcgacctccaggagccgacttgcctgcagacccgcctcgaactgtacaagcaaggtctgcgaggctcgctgactaagctgaagggaccactgactatgatggcatcgcattacaaacaacactgtccaccgactccagaaacgtcgtgcgctacccagatcatcacctttgaatctttcaaggagaatcttaaggatttcctgctcgtgatcccattcgactgttgggaacctgtgcaagaa

SEQ ID NO: 9670 - DNA, 432 bp, Artificial Sequence
  Description of Artificial Sequence: Synthetic coding sequence
atgtggctgcaatcgttgctgctgctcggtaccgtggcttgttccatctccgccccagcccgctccccatccccgtcgactcaaccgtgggagcacgtgaacgcgatccaggaagcccgcaggctgctgaatctgtcgcgggacacggcagctgaaatgaacgaaaccgttgaggtgatcagcgaaatgttcgacctgcaagaaccgacctgtctgcagaccagactcgagctgtacaagcagggcctgcgcggatccctgaccaagctcaagggcccgttgaccatgatggcctcgcattacaagcaacactgccctccgaccccagagacttcctgcgcgactcaaatcatcaccttcgagtccttcaaagaaaacctgaaggatttcctgcttgtgatcccgtttgactgctgggaaccggtccaggag

SEQ ID NO: 9671 - DNA, 432 bp, Artificial Sequence
  Description of Artificial Sequence: Synthetic coding sequence
atgtggttgcaatctttattattactcggtacagttgcatgttctattagtgctccagctagatctccatcaccatcaactcaaccatgggaacacgttaatgctatacaagaagcaagacgacttttaaatttatcaagagatactgcagctgaaatgaatgaaactgtagaagttatatctgaaatgttcgatttacaagagccaacatgtttacaaacacgtttagaactttataaacaaggacttagaggatcacttacaaaattaaaaggtccattaacaatgatggctagtcattataagcaacattgtccaccaacaccagaaacaagttgtgctactcaaataattacattcgaatcattcaaagaaaacttaaaagatttcttgttggtaattccatttgattgttgggaacctgtacaagaa

SEQ ID NO: 9672 - DNA, 432 bp, Artificial Sequence
  Description of Artificial Sequence: Synthetic coding sequence
atgtggttacagtccctgctccttttaggaactgtggcctgtagcatcagcgccccagccaggagtccatctccttcaacacagccctgggagcatgtgaacgcgatccaggaggctcgtcggctgctcaacttgagcagagatactgccgccgaaatgaacgaaacggtagaagttatttccgaaatgttcgacctacaggagccgacatgcctccagacccgccttgagctgtataaacagggtctgcgcggtagcctgaccaaactgaaggggcctctaaccatgatggctagccactacaaacaacactgccctcccacacccgagacaagctgcgcgacccagatcatcacattcgagtcgtttaaagagaatctgaaagattttctcttggtaattccgttcgactgctgggaacccgtacaagag

SEQ ID NO: 9673 - DNA, 432 bp, Artificial Sequence
  Description of Artificial Sequence: Synthetic coding sequence
atgtggctgcagtccctgctcctgttaggaacagtggcctgctctatatcagcgccagctagaagcccaagtccgtcgacccagccctgggaacacgtaaacgcgatccaagaagcgcggcgcctcctcaatcttagcagggatacagctgccgagatgaatgagacagtggaggtgatcagcgagatgttcgacctacaggagcccacatgcttgcagactagactggaattgtacaaacagggcctccggggcagcctgacaaaattaaaaggccctctgactatgatggcctctcactacaagcagcactgtcctcccacaccagagactagttgcgcgacccagataattacattcgagtccttcaaagagaatctgaaagatttccttttagtaattcccttcgattgttgggaacccgtccaagag

SEQ ID NO: 9674 - DNA, 432 bp, Artificial Sequence
  Description of Artificial Sequence: Synthetic coding sequence
atgtggctccagagcctacttctgttgggtaccgtagcttgtagtatttccgcacccgccagaagccccagcccctccacccagccgtgggaacatgtgaacgccattcaggaggctcgtaggctgcttaacttatcgcgagataccgccgctgagatgaatgagacagtggaggttatctcagagatgtttgacctccaggaacccacttgcttacaaacgaggctcgagctgtacaaacagggactgcgggggtccctgaccaagttgaaaggccctcttaccatgatggcttcccactataaacagcattgccctccaactcctgaaacctcctgcgcgactcaaataatcaccttcgagtccttcaaagaaaacctgaaggattttctgctggtgataccatttgattgttgggagcctgtgcaggag

SEQ ID NO: 9675 - DNA, 432 bp, Artificial Sequence
  Description of Artificial Sequence: Synthetic coding sequence
atgtggctgcagagtctgctactgttgggcactgtggcgtgctcgatttctgccccagctagatccccaagcccgagcacacagccctgggagcacgtcaatgctatacaagaagccagaagattgctgaatctctctagggatacagccgccgagatgaatgagacagtggaggtaatttcagagatgttcgatctgcaggagccaacttgcctgcagacacgcctggaattatacaaacaggggcttcgcgggtctctgacgaagttgaaagggcctctgacgatgatggcttcccactataagcagcattgccctccaacaccagaaacaagctgcgccacccagatcatcacattcgagagcttcaaggagaatctgaaggacttcctcttggtcatcccatttgattgctgggaaccagttcaggag

SEQ ID NO: 9676 - DNA, 432 bp, Artificial Sequence
  Description of Artificial Sequence: Synthetic coding sequence
atgtggctgcagagcctgttactgttaggcacggtcgcgtgtagcattagcgcgccggctcgcagcccatccccgagcacccaaccgtgggagcacgtgaatgccattcaggaagcaaggcgcttactgaacctttcccgtgataccgcagcggagatgaacgagaccgttgaggtaatttccgagatgtttgatctgcaggaacctacttgtctgcagacgcgtctggagctgtataagcagggtttgcgcggatcgttgactaaactgaagggacctctgaccatgatggcgagccactacaaacaacactgcccgcctactccagagacttcctgtgccactcaaattatcacgttcgagagcttcaaagagaacctgaaggatttcctgttggtcattccttttgattgttgggagcctgtccaagaa

SEQ ID NO: 9677 - DNA, 432 bp, Artificial Sequence
  Description of Artificial Sequence: Synthetic coding sequence
atgtggctgcagtcgctgctcctgttggggactgtggcttgctccatttcagccccagcaagatccccatcgccgtcaactcagccgtgggaacatgtgaacgcgatccaagaggcgagaaggctgctcaacctgtctcgagataccgcggccgagatgaacgaaactgtcgaggtgatttccgaaatgttcgacttgcaagagcctacctgtttgcagacgcgcctcgaactgtacaagcagggccttcggggatcgctcaccaagctgaaaggacctctcaccatgatggcctctcactacaagcagcactgcccgccgactccagagactagctgcgcgacccagatcatcactttcgagtcgtttaaggaaaatctcaaagatttcttgctcgtgatcccattcgattgctgggaaccggtccaagag

SEQ ID NO: 9678 - DNA, 432 bp, Artificial Sequence
  Description of Artificial Sequence: Synthetic coding sequence
atgtggctccagtctctacttttgttgggtaccgtcgcttgctccatctctgcccccgcccggtcgccatcgcctagtacccagccctgggagcacgtgaacgctatccaagaggctcggcgcctcctgaacctgtccagggacactgctgccgagatgaacgagaccgtcgaagtcatttcagagatgttcgacttgcaggagcccacatgccttcagacgcgcttagagctttataagcaggggctgaggggctcacttactaagttgaagggaccgctcactatgatggcttctcactacaagcaacattgtcccccgaccccggagacatcgtgcgcaacacagatcatcaccttcgagtcgtttaaggaaaaccttaaggatttcttgctggtcatcccttttgattgttgggagcccgtgcaagag

SEQ ID NO: 9679 - DNA, 432 bp, Artificial Sequence
  Description of Artificial Sequence: Synthetic coding sequence
atgtggctccaaagcctgcttctcctgggaaccgtggcttgcagcatttccgcgccggctagatccccatcgccgtcaacgcaaccttgggagcacgtgaacgccatccaggaggcgcggcggctgctcaatttgtctcgcgatactgcagccgaaatgaacgaaactgtggaagtgatctccgaaatgtttgacttgcaggaaccgacctgcctgcagaccaggctggaactgtacaagcagggactccgcggctcgctgaccaaacttaaggggccactgaccatgatggccagccattacaagcagcactgccctcccactccggagacttcatgcgcaactcaaatcatcaccttcgaatcgttcaaggagaacctcaaagacttcctgctggtcatcccgttcgattgttgggagccagtccaggag

SEQ ID NO: 9680 - DNA, 432 bp, Artificial Sequence
  Description of Artificial Sequence: Synthetic coding sequence
atgtggctccagtccctgttgcttcttgggactgtggcatgcagtatatctgccccagctagatccccatccccttccacacagccctgggaacatgttaacgcaatacaggaagctcggcgattgcttaacctttctcgggatactgcagccgaaatgaatgaaactgtggaggtaataagtgagatgttcgatctgcaggaacccacttgcctccagacacggcttgaattatataaacaggggctgagaggaagtctaacaaaactgaagggacctctcacaatgatggccagtcactataaacagcattgtccgcctactcccgaaacatcttgtgccacacagataataacttttgaatcctttaaagaaaacctaaaagattttctcctcgtgatcccttttgattgctgggaacccgtacaggag

SEQ ID NO: 9681 - DNA, 432 bp, Artificial Sequence
  Description of Artificial Sequence: Synthetic coding sequence
atgtggcttcagagcctgctgctcctgggtacagttgcgtgtagcatatcagcccccgcacggtcgccctcaccaagtacacagccctgggaacacgtaaacgcaattcaggaggcccgtagattgctaaacctctctcgggacacagctgcagaaatgaacgagaccgttgaggtgataagtgaaatgttcgaccttcaagagccgacgtgcctgcagacccgcctggaactgtacaagcagggactgcgcggatctcttacgaagctaaaggggcctctgactatgatggccagtcattataagcagcactgtccccccacacccgaaacgtcttgcgccacccagatcatcacgtttgagtcgttcaaggaaaatctgaaggacttcttactcgtcatcccatttgactgttgggagcctgtgcaggag

SEQ ID NO: 9682 - DNA, 432 bp, Artificial Sequence
  Description of Artificial Sequence: Synthetic coding sequence
atgtggctgcagtctttactgttactgggtactgtggcttgctccatctctgcacccgctcggtctccatcccccagcacccaaccttgggaacacgtgaatgctatccaggaggccagaagactgttgaatctatccagggacacggcagctgagatgaatgagacggttgaggtgatttctgagatgtttgatctgcaagagcctacatgcttacagaccagactggaactgtataagcagggacttcggggcagcctgacaaaactgaagggtccacttacgatgatggccagccattataagcagcactgcccccccacgcctgaaacctcctgcgcgacccagatcatcactttcgaatcgttcaaagagaaccttaaggactttctcttggtgatacctttcgattgctgggagcccgtgcaggag

SEQ ID NO: 9683 - DNA, 432 bp, Artificial Sequence
  Description of Artificial Sequence: Synthetic coding sequence
atgtggctccagtcactcctcttgttgggaaccgtggcgtgctcgatatccgctccggcccggagcccttcgccatcgactcaaccgtgggaacacgtcaacgcaatccaggaggcgaggcggctgctgaatctttcccgggacaccgcggcagagatgaatgaaactgtcgaggtgatttccgaaatgttcgatctgcaggagcccacgtgcctccagacccgcctggagctctacaagcaagggctcagggggtcactgactaagctgaagggtccgcttaccatgatggcttcccattacaagcagcactgcccaccgacgccagagacgtcttgtgccactcagatcatcactttcgagtcgttcaaggaaaatctgaaagactttctcctggtgattccctttgattgctgggagcctgtgcaagag

SEQ ID NO: 9684 - DNA, 432 bp, Artificial Sequence
  Description of Artificial Sequence: Synthetic coding sequence
atgtggttgcagtcactgctcctgcttggaacggtggcgtgctctatatcagccccggcacgatcgccatctccgtcaacacagccgtgggagcacgtgaatgctatacaggaagcacgtcggctgctaaatctctcacgggacaccgccgccgagatgaacgaaacagtcgaggtgatttctgaaatgttcgatctgcaagagccaacatgtctccagacaagactagagctgtacaaacagggcctacgcggatccctcacgaaactgaaaggccctctcaccatgatggctagtcactacaaacagcattgccccccgacccccgaaacgtcatgcgcaactcaaatcatcactttcgaaagttttaaagaaaacttgaaggatttcctgcttgtgatcccatttgattgctgggaacctgtgcaagag

SEQ ID NO: 9685 - DNA, 432 bp, Artificial Sequence
  Description of Artificial Sequence: Synthetic coding sequence
atgtggctgcaatcactgcttttgctgggcactgttgcttgtagcatatcggctccagcacggagcccatccccttccacgcagccatgggagcatgtgaatgctattcaggaagcacggcgactcctgaacttgagcagagatacagctgctgaaatgaacgaaacagtcgaagtgatctccgaaatgtttgatctacaagagcctacatgccttcaaacaaggctggaattgtacaaacaaggtctgagaggttcactaacaaaattgaagggaccacttaccatgatggcttcacattataaacaacattgtccaccaactccagagacttcgtgtgcgacacaaattataacgtttgaaagtttcaaagaaaaccttaaggactttttgttagtgatcccatttgattgttgggagccagtacaagag

SEQ ID NO: 9686 - DNA, 432 bp, Artificial Sequence
  Description of Artificial Sequence: Synthetic coding sequence
atgtggctccagtcactgctactgttaggcacagtcgcatgttcaatcagcgccccagcaagatccccctctccaagtacacagccttgggagcatgtgaacgccattcaggaggctagacggctgctaaacctatctagggataccgctgccgagatgaacgagacagtggaggtcatctccgaaatgttcgatctccaggaaccaacatgtctgcaaacccgtctggagctttataaacagggactgaggggatcactgacaaagctcaagggacctctgacaatgatggccagccactataaacagcattgccctcccactccggaaactagctgcgcaacccagatcatcacgtttgaaagtttcaaggaaaacctgaaagacttcctcctggtgattccatttgactgttgggaacctgtccaggaa

SEQ ID NO: 9687 - DNA, 432 bp, Artificial Sequence
  Description of Artificial Sequence: Synthetic coding sequence
atgtggcttcaaagtctgctgttgctgggcacagtagcttgttcaattagcgcccctgcacgtagccctagccccagtacccagccttgggaacatgtaaacgccatccaggaggccagaaggctgctgaacctgtccagggacactgccgccgagatgaatgagactgtggaggtaatctccgaaatgttcgacttgcaggagccaacttgtctccaaactagattggagctgtataaacagggcctgaggggatccctcaccaaattgaaaggcccactgacaatgatggcctcccactacaagcagcactgccctcccactccagagacatcctgcgctacccagatcatcacttttgagagcttcaaggagaatctgaaagatttcttgctcgtgattccctttgattgctgggagccagtccaggag

SEQ ID NO: 9688 - DNA, 432 bp, Artificial Sequence
  Description of Artificial Sequence: Synthetic coding sequence
atgtggctgcagagcctgctccttctcggaactgtagcttgttctatctccgcgcccgctcgcagtccctctccgagtacccagccctgggaacacgtgaatgccatccaggaggcacggaggctgctcaatctgagtcgggataccgccgccgagatgaatgagaccgtggaggtgatatccgaaatgtttgacctgcaggagccaacttgtctacagactcggctggaactgtacaaacaggggctccgagggagtctgacaaagctcaaaggccctctgacaatgatggcgagccactataagcagcactgtccacctacccccgaaacatcttgcgccacacaaattattacattcgaaagcttcaaggaaaatctcaaggactttctgctggttataccctttgattgttgggaacccgtgcaggaa

SEQ ID NO: 9689 - DNA, 432 bp, Artificial Sequence
  Description of Artificial Sequence: Synthetic coding sequence
atgtggttgcagagcctgctgctcctgggcacagtggcgtgttccatcagtgcccctgctaggagtccgagcccaagcacacaaccctgggaacacgtgaatgctatccaggaagccagacgcctattaaatctgagtagggacacggcagccgagatgaacgagacagtggaagtgatctccgaaatgttcgacctacaagagcctacttgtctccagactagactggaactgtacaagcagggcctgagaggctccctgacaaaactaaagggaccactaaccatgatggccagccactacaagcagcactgcccgcccacgccagaaacatcatgcgccacccagattatcacgttcgagagctttaaagagaacttaaaggatttcctcttggtgattccattcgactgttgggagcctgtgcaggaa

SEQ ID NO: 9690 - DNA, 432 bp, Artificial Sequence
  Description of Artificial Sequence: Synthetic coding sequence
atgtggcttcaaagcctcctgctcctgggcaccgtcgcatgttcgatctctgcaccagcacgcagccctagcccatcgactcagccatgggaacacgtgaacgccatacaggaagcgaggcgtctcctcaacctctcacgagataccgctgcagaaatgaatgaaactgtggaggtgatctcggaaatgtttgacctgcaagagcctacttgccttcagacccgtcttgagttgtataagcaaggacttcgcggtagcctgactaagctgaaggggccacttactatgatggcctcccattacaagcaacattgtccccctaccccggaaacctcgtgcgcgacccagataatcacctttgaatcctttaaggagaacctgaaggatttcctgcttgtgataccttttgattgttgggagcctgtgcaggag

SEQ ID NO: 9691 - DNA, 432 bp, Artificial Sequence
  Description of Artificial Sequence: Synthetic coding sequence
atgtggctgcagtcactgctgttgctgggtacagttgcttgttccatcagcgccccagcaagaagtccatctccttctacccaaccttgggagcacgtgaacgcaatacaggaggccaggaggcttcttaatctctcgcgtgatactgctgccgagatgaatgagaccgtggaggtgatttccgagatgtttgacttacaggaacccacttgtctgcagactcgtcttgagctctacaagcagggcctcagaggaagtctcaccaagctaaagggtcctctgacgatgatggcaagccactataagcaacactgtccacctaccccagagacaagttgtgccacccagatcataacatttgagtcattcaaggagaatctcaaggattttctcctggtcatcccgtttgactgttgggaaccagtgcaagag

SEQ ID NO: 9692 - DNA, 432 bp, Artificial Sequence
  Description of Artificial Sequence: Synthetic coding sequence
atgtggctgcagtcactgctgctgcttggcacagtcgcttgttcaatttccgcgcccgcgcggagtccctctccaagcacccaaccctgggaacacgtcaacgccatccaggaggctcggaggctcctcaatcttagtagggacactgccgcagaaatgaacgaaactgtcgaggttatatccgagatgttcgacttgcaggagccaacatgcctccagacacgcctggagctctacaaacagggcctgagagggagcctcactaagctgaaggggcccctgactatgatggctagccactataagcagcactgcccaccgactccagagacatcctgtgccactcaaatcatcaccttcgaaagtttcaaggagaacctgaaggattttcttctggtgataccattcgactgttgggaaccagtgcaagag

SEQ ID NO: 9693 - DNA, 432 bp, Artificial Sequence
  Description of Artificial Sequence: Synthetic coding sequence
atgtggttgcaatctctgctcctgctgggaaccgtcgcctgctctatcagcgcgcccgcaagaagtccgtccccgagcacccagccatgggagcacgtgaatgccatccaagaggcgcggcggttattgaatctgagtcgggatactgccgccgagatgaacgaaactgtggaggtaattagcgagatgtttgatttacaggagcctacctgccttcaaacacggctggaactgtataagcagggccttaggggtagtctgaccaaattgaaaggccctctcacgatgatggcttcccattacaaacaacactgtccaccaacccccgagacctcatgtgctacacagatcatcacatttgagagctttaaggaaaatcttaaggacttcctgctagttattcccttcgactgttgggaacccgttcaggag

SEQ ID NO: 9694 - DNA, 432 bp, Artificial Sequence
  Description of Artificial Sequence: Synthetic coding sequence
atgtggttgcagtccctattgctgctcggtaccgtggcctgtagcatatctgccccagccaggtctccatctccgtcaacccaaccctgggagcatgtaaatgccattcaggaagcccgtcggttacttaatctgtcccgcgacactgccgcggagatgaatgaaaccgtggaggtgataagcgaaatgttcgacctgcaggagcccacctgtctacagaccagactggaattgtacaaacagggtttgcgaggttcactgacgaagctgaaagggccattgacaatgatggcatcccactacaagcagcactgcccgccaacgccggagactagctgcgccacacaaatcatcacattcgagtctttcaaggagaatttaaaagatttcttgctggtcatcccgtttgactgctgggagccagtccaggag

SEQ ID NO: 9695 - DNA, 432 bp, Artificial Sequence
  Description of Artificial Sequence: Synthetic coding sequence
atgtggctgcaatcccttctgcttcttggaaccgtggcatgcagcatcagcgcacctgcacgctcacctagccctagcactcagccgtgggagcatgtgaacgccattcaggaggcgcggcggctgctcaacttgtcgagagataccgcagccgaaatgaatgaaaccgtggaagtcatctccgaaatgttcgatctccaagagccaacgtgtctgcaaacgaggttggaactgtacaagcaaggccttcgcgggagcctcaccaaacttaaaggtcctctgactatgatggcgtcgcactacaagcaacactgccccccaacgcccgaaacctcatgtgcgacccagatcatcaccttcgaatccttcaaggaaaacctgaaggatttccttcttgtcatcccttttgattgctgggagcctgtccaggaa

SEQ ID NO: 9696 - DNA, 432 bp, Artificial Sequence
  Description of Artificial Sequence: Synthetic coding sequence
atgtggctacagagcttactgctgctgggcacagttgcatgcagcattagcgccccggcccggtcaccaagtcctagcactcagccatgggagcatgtgaatgctatccaggaggcacgaaggcttctgaatttgtctcgagacacagctgccgaaatgaatgagactgtggaagtgatcagcgaaatgtttgacctgcaagaacccacttgcctgcagactcggcttgagctatacaaacagggcctgcggggctctctaacgaagctgaaggggcctctaacaatgatggccagccattacaagcagcactgtccccccacacctgaaaccagttgcgcaacccagatcatcacatttgaaagtttcaaagagaatctaaaggacttcctcctggttattccgttcgattgttgggagccagtgcaggag

SEQ ID NO: 9697 - DNA, 432 bp, Artificial Sequence
  Description of Artificial Sequence: Synthetic coding sequence
atgtggcttcagagtctcctgctgttaggaacagtggcttgtagcatctcagcgcccgctcgcagcccatctccaagcacacaaccatgggagcacgtgaacgccatccaggaggctcggaggcttctcaacttatcccgggatactgctgccgagatgaatgagactgtggaggtgatttccgagatgttcgatttgcaggaacccacttgtctccagaccaggcttgaactttataaacagggacttcggggcagcctcactaaacttaaagggcctctgacaatgatggcttcacactataaacagcattgcccgccgacaccagagacatcctgcgccactcagatcatcaccttcgaatctttcaaggagaaccttaaagatttcctcctcgtgatcccgttcgattgttgggaacccgtgcaggag

SEQ ID NO: 9698 - DNA, 432 bp, Artificial Sequence
  Description of Artificial Sequence: Synthetic coding sequence
atgtggcttcagtccctcctgttgctggggaccgtggcatgttctatttccgcccctgctcggagcccctccccctctacccagccttgggagcatgtgaacgccatccaagaggcgcgacggcttttgaatctaagcagggacacggctgcggagatgaacgaaactgtggaggtcatttcagagatgttcgacctgcaggagccgacatgtctgcagaccaggttggaactgtataagcagggactaaggggtagcctcaccaaacttaaagggccgttgactatgatggcatcccattataagcagcactgtcctcctacccctgagacatcttgcgctacccagataatcacatttgaatcatttaaagagaacctgaaagattttcttctagttatccccttcgactgctgggagccagttcaggaa

SEQ ID NO: 9699 - DNA, 432 bp, Artificial Sequence
  Description of Artificial Sequence: Synthetic coding sequence
atgtggctgcaaagcttgcttctgctcggcacagtggcatgtagtataagcgctcctgccaggtctccatcaccatctacacagccatgggaacatgttaacgcaatccaggaagctcggcgtctgcttaacttgtcccgcgataccgccgccgaaatgaatgagacagtggaagttatctcagaaatgtttgatcttcaggagcccacatgcttgcagactaggctggagctctataagcagggtcttagaggatcccttacgaagttaaagggacccctgaccatgatggcatcacactataaacaacactgccctccgactccagagacatcttgcgccacacagatcattaccttcgagagtttcaaagaaaacctgaaggacttcttactcgtcatcccatttgactgttgggagcctgtgcaggag

SEQ ID NO: 9700 - DNA, 432 bp, Artificial Sequence
  Description of Artificial Sequence: Synthetic coding sequence
atgtggcttcagtctctcttactgcttggcacagtggcatgctccatcagcgccccggcacggagtcccagcccgtctacacaaccttgggagcacgttaacgccatccaggaggctcgtagactgcttaatctcagtcgggataccgcggctgagatgaatgagactgtagaagtaattagcgagatgttcgacctccaagaaccaacatgccttcagacccggttggagctctataaacagggtctgaggggatctctcacgaagttgaaaggccctctgacaatgatggcgtctcactataaacagcactgcccccctacccccgagacctcatgcgccactcagatcattacctttgagtccttcaaagagaaccttaaggatttcctgctcgtgatcccattcgattgctgggagccggtgcaagaa

SEQ ID NO: 9701 - DNA, 432 bp, Artificial Sequence
  Description of Artificial Sequence: Synthetic coding sequence
atgtggctgcagtcgctgctgttgctcggaaccgtcgcttgctctatctccgcgcctgcaagatccccaagcccgtcaacccagccgtgggaacacgtgaatgcaatccaggaggcgcggcgccttctgaacctgagccgggacaccgccgctgagatgaacgaaacggtggaagtgattagcgagatgttcgatctgcaggaaccaacttgcttgcagaccaggctcgagctctacaagcaaggactgcgcgggtcgctcactaagctgaaaggcccgctcaccatgatggcctcacattacaagcaacactgcccgccgactcctgaaacctcctgcgccactcaaatcatcactttcgagtcgttcaaagaaaacctgaaggatttccttctggtgatcccatttgactgttgggaacccgtccaggag

SEQ ID NO: 9702 - DNA, 432 bp, Artificial Sequence
  Description of Artificial Sequence: Synthetic coding sequence
atgtggcttcagtcacttctgcttttggggaccgtggcctgctccatcagcgcccctgcacggtcaccctcgccatcaacccagccttgggaacacgtgaatgcaatccaggaggcaaggcgactgctgaacctttcgcgagacaccgcagcagagatgaacgaaactgtggaagtgatatccgagatgtttgatctgcaggaacccacctgcttgcagactagactggagctgtataaacaaggcctcaggggatcgcttaccaaactcaagggccccctgacgatgatggcatcccattacaaacaacattgtccaccaacccctgagacttcttgtgcaacgcagataatcacttttgagtcattcaaagaaaacctgaaagacttccttctcgtcatcccgtttgattgttgggaacctgtccaagaa

SEQ ID NO: 9703 - DNA, 432 bp, Artificial Sequence
  Description of Artificial Sequence: Synthetic coding sequence
atgtggctgcagtctctgctattgcttgggaccgtggcgtgcagcatcagcgcaccagcgcgcagtcctagtccctcgacacagccttgggaacacgtcaatgccatccaggaggctcgtcggctgctgaacctctcacgggataccgcagctgaaatgaacgaaacagtggaggttatatcagaaatgttcgacctacaggaaccgacatgtctacagactaggctcgagctgtataagcagggcctccgcggaagtctaacaaagctcaagggtccattgactatgatggcttcacattacaagcagcactgtcctcccactcctgagacaagctgtgccacacagatcataacttttgagagctttaaggaaaacctaaaggattttctgttggtaatcccttttgattgttgggaacccgtccaggag

SEQ ID NO: 9704 - DNA, 432 bp, Artificial Sequence
  Description of Artificial Sequence: Synthetic coding sequence
atgtggctgcagtccctgctgcttctggggacagtggcttgttcaatttccgccccagcgcgatctccaagcccctcaacgcaaccatgggagcacgtgaatgccatccaggaagcccggcgactactcaacttatcccgcgataccgccgcggagatgaatgaaactgtagaggtcataagcgagatgttcgacttacaggagccaacttgcctgcagacccggctagagttgtataagcagggccttcgagggtctctgactaagctcaagggacctctcactatgatggcctcccactacaaacaacactgcccacccacacccgagacaagctgcgcaacccagattatcacctttgagagttttaaagaaaacctgaaagatttccttcttgtaatcccattcgattgctgggagccggtgcaggag

SEQ ID NO: 9705 - DNA, 432 bp, Artificial Sequence
  Description of Artificial Sequence: Synthetic coding sequence
atgtggctgcagtccctgcttctccttggtaccgtcgcatgttcgatttccgctcctgctagaagcccaagcccatccacccaaccatgggagcacgtcaatgccattcaagaagcaaggaggcttcttaacttgtcccgtgacaccgcggcggaaatgaacgaaaccgtggaagtcatttcagaaatgttcgatctccaggagcctacctgtctgcaaacccggctggaactgtacaaacagggtctgcggggtagccttaccaagctgaaggggcctctcaccatgatggcatcgcattacaagcaacattgtccaccgactccagaaacttcatgtgccacgcagatcattacgttcgaatcgtttaaggagaacctcaaagactttcttctggtgatcccttttgactgctgggaacctgtgcaggag

SEQ ID NO: 9706 - DNA, 432 bp, Artificial Sequence
  Description of Artificial Sequence: Synthetic coding sequence
atgtggctgcaatcgctgttgctgctgggcaccgtggcatgttcaatttccgccccagccagaagcccatccccatcaacccagccatgggaacatgtgaacgccatccaggaggcacgccggctgctgaacctgtcccgcgacaccgcagcagagatgaacgagactgtggaagtgattagcgagatgttcgacttgcaggaacccacttgtctgcaaacccgacttgaactgtacaagcaaggacttaggggtagccttaccaaacttaagggaccacttaccatgatggcgtcccattacaagcaacattgtccacctacccctgagactagctgtgcgactcagatcattacctttgaatccttcaaggagaatcttaaggattttctgcttgtcattccgtttgattgttgggagcccgtgcaagag

SEQ ID NO: 9707 - DNA, 432 bp, Artificial Sequence
  Description of Artificial Sequence: Synthetic coding sequence
atgtggctgcagagcttgttacttcttggaactgttgcatgtagcatttcggcaccagcccgatccccatccccttcgacccagccttgggagcatgtcaatgcaattcaggaggcccgtcggcttctaaatttgtcgcgtgataccgccgctgagatgaacgaaaccgttgaggtcatctcagaaatgttcgatttacaagagccgacctgcttgcagacccgactcgagctgtataagcaaggcctccgtggttccttgacgaagttaaaaggacctctaacgatgatggcttcgcattacaaacagcactgtccaccgaccccagagacctcatgtgctacccaaatcattaccttcgagtcgttcaaggagaatttgaaagattttttgcttgtgattccattcgattgttgggagccagtccaggaa

SEQ ID NO: 9708 - DNA, 432 bp, Artificial Sequence
  Description of Artificial Sequence: Synthetic coding sequence
atgtggttgcagtccctgctgctgttgggcaccgtcgcctgcagtatttcagctcccgccagaagcccttccccctctactcagccatgggagcacgtgaatgcgatccaggaggcgaggaggttgctaaacctgagtcgagatacagccgccgagatgaacgagacagtcgaagtgatctcagaaatgtttgacctacaggaacccacatgtctccagaccaggctggagttgtacaaacaaggcctgaggggaagcctcacaaagctcaaaggcccgctgacaatgatggcgagccactataaacagcactgccccccaacccccgagacgtcttgcgcaacccagatcatcacctttgagagtttcaaagagaacttgaaggattttttgttagtgatcccctttgactgctgggagcccgtccaagaa

SEQ ID NO: 9709 - DNA, 432 bp, Artificial Sequence
  Description of Artificial Sequence: Synthetic coding sequence
atgtggctgcaatcgctgcttctgctgggcacagttgcgtgttcaatttcggcaccggctcgctctcctagtcctagtactcagccttgggagcacgtcaatgctattcaagaggcccgccgcctattgaatttgtccagagatactgcagcagagatgaacgaaacagtggaagtgatatctgagatgtttgacttgcaagaacctacctgtctgcagacaagattggaactctacaagcaagggctgagaggcagcctgaccaagctgaaggggccactgactatgatggcgtctcactataagcaacattgtccaccaaccccagaaactagctgtgctactcagataatcacttttgagagcttcaaggagaacctcaaggattttcttctcgtgataccctttgactgttgggaaccagtccaggag

SEQ ID NO: 9710 - DNA, 432 bp, Artificial Sequence
  Description of Artificial Sequence: Synthetic coding sequence
atgtggctccagtccctcctcctgctgggtaccgtcgcctgttccatttccgcacctgccagatctccttcaccttctacgcaaccatgggaacacgttaacgccattcaagaggccaggcgactcctcaacctttcaagggacacagctgcagaaatgaacgagaccgtggaggtcatatccgagatgttcgatctccaagaaccaacgtgtctacagacccgcttagaactgtacaaacagggtcttaggggttccttgaccaaattaaaaggccctctcactatgatggcttcacattacaaacagcattgccccccgacccctgaaacatcctgtgctactcagattataactttcgaatcgttcaaagagaacctgaaagacttccttttggtgatcccgttcgactgctgggagcctgtgcaagag

SEQ ID NO: 9711 - DNA, 432 bp, Artificial Sequence
  Description of Artificial Sequence: Synthetic coding sequence
atgtggctgcagtcactgctgttgctgggtactgttgcgtgtagcatcagcgcgcccgcccgctctccatctccttcaacgcagccttgggaacatgtcaacgcaatacaagaagcacggcggctcctaaatctgagccgggataccgctgcagaaatgaatgaaaccgtggaggtgatctccgagatgttcgacctgcaggaacctacgtgtctgcagacacgcctcgagctgtacaaacaaggtctgagagggtccttaacgaaactgaagggaccactgacgatgatggcctctcactacaaacagcattgtccgccgaccccggagactagctgtgcaacccagatcattacgttcgagagctttaaagaaaacctgaaagacttcctgctcgtaatccctttcgattgctgggaaccggttcaggaa

SEQ ID NO: 9712 - DNA, 432 bp, Artificial Sequence
  Description of Artificial Sequence: Synthetic coding sequence
atgtggctgcaatcactgctgctactggggaccgtggcctgctcaatatccgcccccgcccgcagtccgtcaccttccacacaaccatgggagcatgtgaatgcaattcaggaggcaagacgcctactgaatctgagtagagatactgctgctgaaatgaatgaaactgttgaagtgatctcggaaatgtttgatctccaggagcccacctgcctgcaaaccagactggaactctataagcagggcctccggggctcactgaccaaactcaagggtccactcactatgatggcctctcactacaagcagcactgcccgcccacacccgaaactagttgtgcaacacagatcatcacattcgagtctttcaaggagaacttaaaggatttcctgcttgttatcccgtttgattgttgggaacccgtgcaggag

SEQ ID NO: 9713 - DNA, 432 bp, Artificial Sequence
  Description of Artificial Sequence: Synthetic coding sequence
atgtggttgcagagcctgctgctgctcgggactgtggcctgttccattagtgcccctgctagatcgccctccccttcaacccagccatgggaacacgtgaatgcaattcaagaagcaagacgtctcctgaacctgagccgagatactgcagccgaaatgaacgaaaccgtggaagtcatttccgaaatgtttgatcttcaagaacctacttgccttcagacccggcttgagctctacaagcagggtttgcggggaagcctcaccaagctgaagggaccactcactatgatggcgtcccactacaaacaacactgtcctcccacccccgagacttcatgtgcaacccaaatcataactttcgaatcgtttaaggagaacttgaaggattttctgctggtgatcccattcgactgttgggagcctgttcaagaa

SEQ ID NO: 9714 - DNA, 432 bp, Artificial Sequence
  Description of Artificial Sequence: Synthetic coding sequence
atgtggctgcagtccctgctgctgctcggcacggttgcctgctcgatctcagcgcctgccagatccccgtccccgtccacgcagccgtgggaacacgtgaatgcgatccaagaagcacggcggctgctgaatctcagccgcgacaccgcagccgagatgaatgaaactgtggaagtgatctcggaaatgttcgatctgcaagaaccgacttgtctgcaaactaggctggaactctacaaacaggggctgagaggatcgctgactaagctgaaaggtcctctgactatgatggcctcgcactacaagcagcactgtccaccgacccccgaaaccagctgcgctactcagatcatcactttcgagagcttcaaggagaacttgaaggatttccttctggtgatccctttcgactgctgggagcctgtgcaggag

SEQ ID NO: 9715 - DNA, 432 bp, Artificial Sequence
  Description of Artificial Sequence: Synthetic coding sequence
atgtggctacagtcactactgctcctcggtacggtagcttgtagcataagcgcgcctgccaggtcgccctcgccatcaacccagccatgggaacatgttaacgccatccaggaggcgcggcgacttttaaatctctctcgggacactgccgctgagatgaacgagactgtcgaggtgatcagtgagatgtttgacctgcaagaacccacctgtctgcagacccggttggaactgtacaagcagggcttacgcgggtcgcttactaaattgaagggtccactcaccatgatggcaagccactataagcaacactgccctcctaccccagagactagctgcgccacacagattatcactttcgaatcgtttaaagaaaaccttaaggactttctcctagtgattcccttcgactgttgggaacccgtacaagag

SEQ ID NO: 9716 - DNA, 432 bp, Artificial Sequence
  Description of Artificial Sequence: Synthetic coding sequence
atgtggctgcagtccctcttgctgctgggcactgtagcttgctccatttcagcccctgcccgctcaccctccccctccactcagccttgggagcacgtgaatgctattcaggaggcccgcaggcttctgaatctgagtcgtgacacagccgctgaaatgaacgaaaccgtggaggtgattagcgaaatgttcgacctgcaagagcctacctgcctgcagacaaggttggagttgtataaacagggtcttcgcggctctcttacaaaacttaaaggacctcttacaatgatggccagtcactataagcagcattgccctcccacccccgagacttcctgtgctactcagatcattacatttgagagctttaaagaaaatctgaaggactttcttttggtcattccattcgattgctgggagcctgtacaggag

SEQ ID NO: 9717 - DNA, 432 bp, Artificial Sequence
  Description of Artificial Sequence: Synthetic coding sequence
atgtggctgcagtctctgctactgttgggtaccgtggcatgctctattagcgccccagcccggtccccatcaccttcaacccaaccctgggagcacgtcaacgccattcaagaggctagacgcttgctgaacctgtccagagacaccgcagccgaaatgaacgagaccgtcgaagtgatttccgaaatgtttgatctccaggaacccacatgcctacaaactcgattggaactgtacaagcagggactcagaggatctctgacaaaacttaaaggcccgctcacaatgatggcgagccactataagcagcactgcccccccacccctgagacctcttgtgccacccagatcattacctttgagtctttcaaagagaatctgaaagattttttattggtgataccttttgattgctgggagccagtacaggaa

SEQ ID NO: 9718 - DNA, 432 bp, Artificial Sequence
  Description of Artificial Sequence: Synthetic coding sequence
atgtggttacaatcgctattattattaggtacggtagcgtgttcgatatcggcgccggcgcgttcgccgtcgccgtcgacgcaaccgtgggaacatgtaaatgcgatacaagaagcgcgacgattattaaatttatcgcgagatacggcggcggaaatgaatgaaacggttgaagtaatatcggaaatgtttgatttacaagaaccgacgtgtttacaaacgcgtctagaactatataaacaaggtttacgaggttcgctaacgaaattaaaaggtccgttaacgatgatggcgtcgcattataaacaacattgtccgccgacgccggaaacgtcgtgtgcgacgcaaataataacgtttgaatcgtttaaagaaaatctaaaagattttctactagtaataccgtttgattgttgggaaccggtacaagaa

SEQ ID NO: 9719 - DNA, 432 bp, Artificial Sequence
  Description of Artificial Sequence: Synthetic coding sequence
atgtggttgcagtcactcctattattaggtacggtggcctgctctatctcggctccagcacggagtccgtcaccatccactcagccatgggagcacgtgaacgccatccaggaggctagacggctcctgaacctcagccgagacactgccgctgagatgaacgaaaccgttgaggtgattagtgagatgttcgacctccaggaaccaacatgtctgcagacccgcctcgaactgtacaagcagggtctccgaggatcactcaccaagcttaaaggacccttgacaatgatggctagccattacaagcaacactgtccccctactccagagacttcatgcgctacccagatcatcacattcgaatctttcaaggaaaatctcaaggattttctgctggtcatcccattcgattgctgggagcctgttcaagaa

SEQ ID NO: 9720 - DNA, 432 bp, Artificial Sequence
  Description of Artificial Sequence: Synthetic coding sequence
atgtggctccaatccttacttcttcttggaaccgttgcctgttcaatttctgcgccagcaaggtcgccatctccatcgactcaaccctgggaacatgtcaacgcaattcaagaggcccgtcgtttactaaatttgagtcgagatacagcggccgaaatgaatgaaacggtagaagttatttcagagatgttcgatttacaagagcctacttgcctgcaaacgcgtctagagctctataagcagggtctaagaggatctttgactaaattaaagggaccactgactatgatggcttcacattataagcaacactgtcctccaacaccagaaacatcttgcgctacacaaatcataaccttcgaaagcttcaaggaaaatctcaaggatttcctgcttgttattccttttgattgctgggagccagtgcaggag

SEQ ID NO: 9721 - DNA, 432 bp, Artificial Sequence
  Description of Artificial Sequence: Synthetic coding sequence
atgtggttgcagtcattactgctgctgggcactgtagcatgtagcatcagtgcccccgccagatccccaagtcctagtacgcagccatgggaacacgtgaatgcaatccaagaggcgcggagattgcttaacctgtcccgggacactgctgccgaaatgaatgagaccgtggaggttatcagtgaaatgttcgaccttcaagaacccacatgtctccaaactcggcttgaactgtacaagcaggggcttcgcgggtctcttaccaagctaaaagggcctctgactatgatggcatcccattataagcaacattgtccacctaccccagaaaccagctgcgcaacccagataattacctttgaatcgttcaaggagaacctgaaggactttttgttggtgattccattcgactgttgggagcccgtgcaggaa

SEQ ID NO: 9722 - DNA, 432 bp, Artificial Sequence
  Description of Artificial Sequence: Synthetic coding sequence
atgtggctgcaatcacttctgctgctgggcactgtggcctgttcaatcagcgcaccggccagatccccgtccccatcgacccagccatgggaacatgtgaatgcgatccaggaggcgcgcagactgttgaacctctcccgagacaccgctgcagagatgaacgaaactgtggaagtcatatcggaaatgttcgatctgcaagaaccaacttgcctccagacgcggctggaactctacaaacagggactgaggggttcgctcactaagttgaagggcccacttaccatgatggcctcgcactacaagcagcactgtccaccaactccggaaacctcctgcgcaacccagatcattactttcgaatccttcaaggaaaacttgaaggacttcctcctcgtgattccatttgactgctgggaaccggttcaggag

SEQ ID NO: 9723 - DNA, 432 bp, Artificial Sequence
  Description of Artificial Sequence: Synthetic coding sequence
atgtggttacagtccctgctgctattggggactgttgcgtgcagcatctccgctcccgcccgcagcccaagcccctccacccagccatgggagcatgtgaacgccatccaagaagcccgccgactcttaaatttgtcacgggacactgcagcagagatgaacgagaccgtggaagtgatcagcgagatgttcgatttacaggaaccaacctgtctacagaccagactggagctctacaagcagggattgcgcggatccttgactaagttgaaaggacccctcaccatgatggcctcccactacaaacagcactgtccaccaacccccgagacctcatgcgcgactcagataataacctttgaatcctttaaggagaatctgaaggattttttgcttgtcatccccttcgattgctgggagccggtgcaagag

SEQ ID NO: 9724 - DNA, 432 bp, Artificial Sequence
  Description of Artificial Sequence: Synthetic coding sequence
atgtggcttcagagtctgctcctgttgggtactgtcgcatgctcaatcagcgcccccgctcgaagtccctcaccttccacccagccttgggaacacgtgaacgcaattcaggaggctagaaggttgctcaatctgagtagagacacggctgccgagatgaacgagacagtagaagtaatctccgagatgtttgaccttcaggaaccaacatgtctgcaaacccgcttggagctctataagcaaggcctcagaggctctctcaccaagctgaagggtccgctcactatgatggcctcccactacaaacagcactgtcctcccacacccgagacttcctgcgctacccagatcatcacgttcgaatcattcaaggaaaatctgaaagacttcctgctggtcatacctttcgactgttgggagcctgtccaggag

SEQ ID NO: 9725 - DNA, 432 bp, Artificial Sequence
  Description of Artificial Sequence: Synthetic coding sequence
atgtggctccagagtctgctgctgctcggcacggtggcatgttccatctcggccccagcaagatctccatccccaagtactcaaccatgggaacacgtgaacgcgatacaggaggctcgccgcttgttgaatctcagccgcgacactgccgcggagatgaacgaaaccgttgaggttatctctgagatgttcgacctgcaggagcctacctgtctgcagactagattggaactgtataagcaaggattacgcggatctttgacaaaactgaagggccccctcactatgatggcctcccactacaaacagcattgcccacctacacccgaaacctcgtgtgcaacccagatcattacctttgaatcttttaaggagaaccttaaagactttctcttagtgattccttttgattgctgggaacctgttcaagag

SEQ ID NO: 9726 - DNA, 432 bp, Artificial Sequence
  Description of Artificial Sequence: Synthetic coding sequence
atgtggttgcaatccctcctgctgctgggaactgtggcatgcagcatctcagcgcccgcccggagtccgtcgccgtccactcaaccatgggagcacgttaacgccatccaagaagccagacggcttctgaatctgagtcgggacactgccgctgaaatgaatgaaaccgtggaggtgatcagcgaaatgtttgatctgcaggagccgacctgcctccagactcgcctcgagctttacaagcagggtttgaggggctccctgaccaagttgaaaggacctctcactatgatggcatcgcactacaaacagcattgtccgccgacgccggaaacgtcctgtgcgacccagattatcactttcgaatctttcaaggaaaacctgaaggactttttgctcgtgattccattcgactgctgggagccggtccaggaa

SEQ ID NO: 9727 - DNA, 432 bp, Artificial Sequence
  Description of Artificial Sequence: Synthetic coding sequence
atgtggctgcagtccctactgctgcttggaactgtagcgtgctccattagcgctccagcccgctccccttccccatccacgcagccgtgggaacacgtcaacgcgattcaggaagcacgaagattgttgaacctgtccagagacactgcagcagagatgaacgagacagtggaagttatttctgaaatgttcgatctccaggaacctacttgcctgcaaacccggttggaactttacaaacagggcttgagaggttctctgacaaagttgaaggggcccctaaccatgatggcatctcattataaacagcactgcccacctacccccgagacctcatgtgccacacaaattatcacgttcgagtcgttcaaggagaaccttaaagatttcctcttggtgatcccattcgactgctgggaacctgtgcaggaa

SEQ ID NO: 9728 - DNA, 432 bp, Artificial Sequence
  Description of Artificial Sequence: Synthetic coding sequence
atgtggctccagagcctcctcctcttggggaccgtcgcatgctctattagtgcccccgccagatctccttccccttcaacccagccttgggagcacgtgaacgctattcaagaggcccggcgcttgctgaatctgagtcgagacacagcagcggagatgaacgagactgtggaagtcatatctgaaatgtttgatctgcaggagccaacttgtctccagacccggctggagctctataagcaggggctgaggggcagcctgacgaagctgaaaggcccactgaccatgatggctagccattataagcaacattgtcccccaacacctgagacatcttgtgccacacagatcatcaccttcgagagctttaaggagaaccttaaggatttccttctggttatccccttcgactgctgggagcctgtgcaggaa

SEQ ID NO: 9729 - DNA, 432 bp, Artificial Sequence
  Description of Artificial Sequence: Synthetic coding sequence
atgtggttacagagcctgctgctgcttggcaccgtggcttgtagcatcagcgctccagcaagaagccccagtccaagtacgcagccctgggaacacgtgaacgcaattcaggaggctcgtagactcctgaacctcagcagagatactgcagctgaaatgaacgaaactgtcgaagtcataagtgagatgtttgatcttcaagaacccacatgtctgcagacccgcctcgaactctataagcagggccttcgcggtagtttaacaaagctgaagggcccactgacaatgatggcttcacactataaacagcattgtcctccaacacctgaaacatcatgtgctacacagatcattacattcgaaagctttaaagaaaacttgaaggactttcttctggtgatacctttcgactgttgggagcctgtgcaagaa

SEQ ID NO: 9730 - DNA, 432 bp, Artificial Sequence
  Description of Artificial Sequence: Synthetic coding sequence
atgtggctccaatccctgctcctcctcggtaccgtggcctgctcgatttccgccccggcacggtcgccttcgccgtccacccaaccgtgggaacacgtgaacgcgatccaagaagcgcggcgactgctcaacctctcccgcgacactgcggcggagatgaatgagactgtagaggtgatctccgaaatgttcgatctgcaggagcctacttgcctgcagacccgccttgaactctacaagcagggactgcggggttcattgactaaactgaaaggaccactgaccatgatggcctcacattacaagcagcactgccctccgacccccgaaacgagctgcgccactcaaatcatcacttttgagagcttcaaggaaaacctgaaggatttcctgctggtcatcccatttgactgttgggaaccagtccaggaa

SEQ ID NO: 9731 - DNA, 432 bp, Artificial Sequence
  Description of Artificial Sequence: Synthetic coding sequence
atgtggttgcagtcactgctattgctgggcaccgtcgcatgctctatcagcgccccagctagatccccaagcccctccacacagccttgggagcatgtgaatgccatccaggaggcacgacgcctgctgaatctgagtagagatacagctgccgaaatgaacgaaaccgttgaagtgatttccgagatgtttgaccttcaggagcccacctgtttgcagacacgcctcgagctgtataaacagggcctccgcggaagcctgaccaagctgaaggggccactgaccatgatggcatcgcactataagcagcattgtccacccacaccagaaacatcatgcgcaacacagattattacattcgagagtttcaaagagaacctgaaggatttcctgttggtcatcccattcgactgctgggagcccgtacaggaa

SEQ ID NO: 9732 - DNA, 432 bp, Artificial Sequence
  Description of Artificial Sequence: Synthetic coding sequence
atgtggctgcaatccctccttctcctgggtaccgtggcttgctcaatttccgcgccagcgaggtccccgagcccatcaacgcagccgtgggaacacgtcaatgctatccaggaagcacggagactgctgaacctctcgcgcgacaccgcggcagaaatgaacgaaactgtggaagtgatctccgagatgtttgatctgcaggagccgacgtgtttgcagacccggttggaactgtataagcagggactgcggggaagcctgaccaagttgaaggggccacttaccatgatggcctcgcattacaagcagcactgtccgcctacgccagaaacctcatgcgcgacccaaatcatcactttcgaatcattcaaagaaaatctcaaggactttttgctggtgattccatttgattgttgggagccggtgcaggaa

SEQ ID NO: 9733 - DNA, 432 bp, Artificial Sequence
  Description of Artificial Sequence: Synthetic coding sequence
atgtggttgcagagcctgctgctgctggggaccgtggcttgctccattagtgccccggccagatctccttcaccctctacacagccatgggaacatgtgaacgcaattcaggaggccaggagactgcttaacctttcccgggacaccgcagctgagatgaacgagactgttgaggtgatcagcgagatgttcgacctgcaagagcccacctgcctgcagacccggctggaactgtacaaacaggggctgcggggcagcctgacaaagctcaaagggcctttgactatgatggcgtctcattataagcaacactgcccacctacccccgagacttcttgcgcaactcagatcattacatttgaatcattcaaagagaatctcaaggactttctgctggtgatcccctttgactgctgggagcccgtccaggag

SEQ ID NO: 9734 - DNA, 432 bp, Artificial Sequence
  Description of Artificial Sequence: Synthetic coding sequence
atgtggttgcagagcctgcttctcctgggaaccgtcgcatgctcgattagcgcaccagcacgatcgccatcaccatccactcaaccgtgggaacacgtgaacgccattcaggaagcacgcagactgcttaacctctcaagagataccgcagcagaaatgaacgaaactgtcgaggtgatctccgagatgttcgacctccaagaacctacctgccttcagactcggctggaactgtataagcaaggacttagaggatcgcttacgaagttgaagggacctttgaccatgatggcctcccattacaaacagcattgtccccccacgcctgagacgtcctgcgcaacccaaatcattacttttgagtccttcaaagagaacttgaaagatttcctgctcgtgatcccttttgattgttgggagcctgtgcaagaa

SEQ ID NO: 9735 - DNA, 432 bp, Artificial Sequence
  Description of Artificial Sequence: Synthetic coding sequence
atgtggttgcagtcgcttcttcttcttggtactgtggcatgtagcattagcgctccagcaagaagcccttccccgtccacgcaaccatgggaacatgtcaacgcaatacaggaggcacgtcgactgctgaatttgtcgcgtgatactgccgcagaaatgaatgaaactgttgaggtgatttcggaaatgttcgacctgcaggagcccacctgcctgcagactcgcctggaactttacaagcagggacttagaggatcccttactaaactgaagggtcctctgaccatgatggcctcacactacaagcagcactgcccaccaactccagaaacttcctgtgcaacccaaatcatcacttttgaatcctttaaggaaaacctgaaagatttccttcttgtgatcccctttgactgttgggaacccgtgcaagag

SEQ ID NO: 9736 - DNA, 432 bp, Artificial Sequence
  Description of Artificial Sequence: Synthetic coding sequence
atgtggctccagagcctgctactcttgggaactgtggcatgttccataagcgccccagctaggagtccaagtccatcaacgcagccatgggaacacgtaaatgctattcaggaggccagacgcctcctgaacctgagtcgcgacaccgcagcagaaatgaatgaaaccgtggaggtcatatccgaaatgtttgatttacaagagccaacttgtctgcagactaggcttgaattgtacaagcaaggactcaggggatccctgacaaagctgaaaggtccactgactatgatggcctcacactacaagcaacattgcccccccactcccgaaacctcgtgcgccacccagattattactttcgaaagtttcaaagagaatctcaaagactttctgcttgtcatcccctttgactgttgggagccagtccaggaa

SEQ ID NO: 9737 - DNA, 432 bp, Artificial Sequence
  Description of Artificial Sequence: Synthetic coding sequence
atgtggctgcagagtttgctcctgttgggcaccgtggcttgcagtatctcagctcctgctcggtctccaagtccttctacccagccatgggaacacgtgaacgccatccaagaggcccgacgcttgttgaacttgagccgcgacacagccgccgaaatgaatgagacggtggaagttataagcgaaatgttcgatcttcaggaacctacctgcctccagacccggctggaactctataagcagggcttgcggggatctctgacaaaactcaaaggacctctgacgatgatggcctcacattacaaacagcactgcccacctaccccagaaaccagctgtgccacccaaataattaccttcgagtcatttaaggagaatcttaaagatttcttgctcgtgatcccttttgactgctgggaaccagtacaggaa

SEQ ID NO: 9738 - DNA, 432 bp, Artificial Sequence
  Description of Artificial Sequence: Synthetic coding sequence
atgtggttacaaagcttgctccttcttggcaccgtcgcttgctctatatccgccccagcaaggtctcccagcccaagtacacagccctgggagcatgtgaatgctatccaggaagccagaagactgttaaacttgagtagagacaccgccgctgaaatgaacgagactgtcgaggtcatcagcgaaatgttcgatctgcaagaaccaacttgccttcaaacccgcttggaactttacaagcaagggctgcggggtagcctgactaaacttaaaggcccgctcactatgatggcgtcccactacaagcaacactgcccacccacacctgagacctcctgcgcgactcagatcatcacatttgagagcttcaaagagaacctcaaggacttcctcttggttatcccttttgactgttgggagcccgtgcaggaa

SEQ ID NO: 9739 - DNA, 432 bp, Artificial Sequence
  Description of Artificial Sequence: Synthetic coding sequence
atgtggttacagtcattgctactcctcgggactgtggcgtgttccatttccgcacccgcgcgaagccccagtccttcaactcaaccttgggaacacgtaaacgccattcaggaggctcgcaggttactgaatctatctagagacacagctgcagaaatgaacgagacagtggaggtcatatctgaaatgttcgatctgcaggagcctacttgtctacagacccgattagaactatacaagcagggcctgcggggatctctcaccaagttgaaaggccccctcactatgatggcatcccactacaaacagcactgcccacctacgccggagacctcctgcgctacccagatcatcaccttcgagagtttcaaggagaatctgaaagactttctgctggtgatcccatttgactgttgggagcccgtgcaggag

SEQ ID NO: 9740 - DNA, 432 bp, Artificial Sequence
  Description of Artificial Sequence: Synthetic coding sequence
atgtggctccaatccctgctcctccttggcacagttgcatgtagcatttccgcccccgcacgaagtccttcaccgagcacccagccctgggagcacgttaatgcaatccaggaagcccggagactcctcaatctgtctcgcgacaccgccgccgaaatgaacgagactgttgaggtgatatcagaaatgtttgatctgcaagaacctacttgcctgcaaactcggctggaactgtacaagcaggggctgcggggctctctgacgaagttaaaagggcctctgaccatgatggcgagccattataaacagcactgccctccaaccccagagacgagctgcgccacccagattatcactttcgagagcttcaaggaaaacctgaaggactttttgttggtcatcccctttgactgttgggagcctgtgcaggaa

SEQ ID NO: 9741 - DNA, 432 bp, Artificial Sequence
  Description of Artificial Sequence: Synthetic coding sequence
atgtggttgcagtccctgctgctcttaggaactgtagcatgtagtatcagcgcgcctgctcgttcaccctcaccttcaacgcaaccttgggaacacgtgaacgctatacaggaggcgcggcgcttgctgaatctttcccgggacacagctgccgagatgaacgaaacggtcgaggtcatatccgagatgttcgacctccaagaaccaacctgtctccagaccagactagagctttacaaacagggcctgcggggcagcctcacaaagctcaaaggaccacttactatgatggcctcacattataagcagcactgcccacctacaccagaaacctcttgtgctacgcaaataataactttcgaaagtttcaaggagaatttaaaagatttcctgttggtaatcccctttgactgttgggagccagtgcaggag

SEQ ID NO: 9742 - DNA, 432 bp, Artificial Sequence
  Description of Artificial Sequence: Synthetic coding sequence
atgtggctccagtcactattactcctcggcaccgtggcctgttcgattagcgcccctgccagaagcccttccccttccactcagccgtgggaacatgtgaacgccatccaggaggctcggcgactgttaaatctatctcgtgatacagcagcagaaatgaatgagacagtggaggtgatcagtgagatgtttgatctgcaggagccaacatgccttcaaaccaggctggagttgtacaagcaaggactcaggggttccctgactaagctgaaaggacccctcacaatgatggcatctcactacaagcagcattgtcctcccacacccgagacctcgtgtgcaacccagatcatcacctttgaaagcttcaaggaaaacctcaaagattttctactggtcatcccttttgattgttgggaacctgtgcaagag

SEQ ID NO: 9743 - DNA, 432 bp, Artificial Sequence
  Description of Artificial Sequence: Synthetic coding sequence
atgtggttacaaagtctgctgttgctcgggactgtggcttgttccattagcgcaccggcccgaagtccttctcccagcacccaaccatgggagcatgtaaatgccattcaggaggcaaggcggttgctgaacctctctagggatactgccgctgagatgaacgagacggtcgaggtaataagcgaaatgtttgatttacaggaacctacatgtctgcagacgagactggagctgtacaagcagggcctgcgcggttctctgaccaagctgaaaggccctcttacaatgatggcctcgcactacaaacagcactgcccgcccaccccagaaacgagctgtgcgacacagatcataacctttgagtcttttaaggaaaacctgaaagattttcttctcgtcatcccttttgactgctgggagccagtgcaagag

SEQ ID NO: 9744 - DNA, 432 bp, Artificial Sequence
  Description of Artificial Sequence: Synthetic coding sequence
atgtggctccagagtttactgctattgggaacagtcgcctgctccataagcgccccagcccgctctccgagcccctcaacacagccctgggagcacgtaaacgcgatccaggaggcccgcaggcttcttaacctttcccgggacaccgccgccgaaatgaatgagacggtcgaggtcatctccgagatgtttgatctccaggaaccgacctgcctgcagacaaggctggaactgtacaagcaaggcttgaggggaagcctgaccaaactgaagggccccctgacaatgatggcttcacactataaacagcactgtcctccaactccggagacaagctgtgccacacaaattatcactttcgaatcctttaaagaaaacctgaaggactttctgttggttatcccttttgattgctgggagccagtacaagaa

SEQ ID NO: 9745 - DNA, 432 bp, Artificial Sequence
  Description of Artificial Sequence: Synthetic coding sequence
atgtggctgcaaagccttcttctgctcggaactgtcgcatgctctatttcagcacccgcgcgcagcccctcgccatccactcagccttgggaacacgtcaacgcaattcaggaagccaggagactgcttaaccttagcagggacaccgccgctgagatgaatgagacggtggaagtcatctcggaaatgttcgatcttcaagagcccacctgtctgcagacgcggctggaattgtacaagcaagggcttcgtggcagccttaccaaactcaagggtcctctgactatgatggcatcgcattacaaacagcattgtcctcctactcctgaaacctcgtgtgcaactcagattatcacctttgagtcctttaaggagaacctcaaggattttcttcttgttataccgttcgattgttgggagccggttcaagaa

SEQ ID NO: 9746 - DNA, 432 bp, Artificial Sequence
  Description of Artificial Sequence: Synthetic coding sequence
atgtggctgcagtcgctgctccttctcggaactgtggcctgctccatctcagcgccagcacgaagcccgtccccttctacccagccatgggagcacgtgaacgcgatccaggaagccaggcggcttctgaacctgagccgcgataccgcggctgaaatgaatgagactgttgaagtaatctccgagatgttcgacctccaagaacccacttgcttgcaaactcggctcgagctgtacaaacaggggctccgcggatccctcactaaacttaagggcccgttgaccatgatggcatcccattacaagcaacattgtcctccaacccctgagacgagctgcgccactcagatcatcacctttgagtctttcaaggaaaatctgaaggactttctgttggtgattccgttcgactgttgggaaccagtgcaggag

SEQ ID NO: 9747 - DNA, 432 bp, Artificial Sequence
  Description of Artificial Sequence: Synthetic coding sequence
atgtggctccagtctttactcctgctcgggactgtggcctgctcaatcagtgccccagctcgttcaccctccccctctacccagccctgggagcacgttaacgcgattcaggaggcaaggcggctcctaaacctgtcccgggacacggccgcagagatgaacgagaccgtcgaggtcatctctgagatgttcgatctgcaggagccgacatgcttacagacccggttagaactgtataagcagggactcaggggttccttgaccaagctaaagggtcctcttacaatgatggccagtcactacaagcagcactgtccccccacacccgagacgagctgcgccacccagatcatcactttcgagagctttaaagagaacctcaaagattttcttcttgttatccctttcgactgctgggagcctgtgcaggag

SEQ ID NO: 9748 - DNA, 432 bp, Artificial Sequence
  Description of Artificial Sequence: Synthetic coding sequence
atgtggctacaatccctgctcctcctgggaacggtggcttgttctatttcagctccggcccgaagccctagccccagcacgcagccctgggagcatgtaaacgccattcaggaggctcgccgccttctcaatctgagccgagatacagccgccgaaatgaatgagaccgtggaggtcatttccgagatgttcgatctccaggaaccaacatgtctccagacaaggctagagctgtacaaacagggcttaagagggagtctgacaaagttaaagggccccttgaccatgatggcttcccactacaagcaacactgccccccgacacccgaaacaagctgtgctacacagattattaccttcgaatccttcaaagagaacttgaaagatttcctgctcgtgatcccgtttgactgctgggaaccagtgcaagaa

SEQ ID NO: 9749 - DNA, 432 bp, Artificial Sequence
  Description of Artificial Sequence: Synthetic coding sequence
atgtggctacagagcctactgctgctagggactgtagcgtgctccataagcgcaccggccaggagccctagccccagcacccagccgtgggagcacgtcaatgcaattcaggaagctaggagacttttgaacttgtctagagacaccgccgctgagatgaatgaaaccgtggaagttattagcgagatgtttgatctccaagaacctacttgcttgcaaacccgactcgaactgtacaaacagggcctcaggggatcactgaccaagctgaaggggccccttacaatgatggcaagtcattataaacagcactgtcctcccacaccggagacctcctgcgcgactcagatcatcactttcgaatcttttaaagaaaatctgaaagacttcctgctcgtgattccttttgactgctgggagcctgtccaggag

SEQ ID NO: 9750 - DNA, 432 bp, Artificial Sequence
  Description of Artificial Sequence: Synthetic coding sequence
atgtggcttcagagccttctcctgctgggcaccgtcgcatgctcgatctctgcgcctgcgagatcaccgagcccttcaacccaaccgtgggagcacgtcaatgctattcaagaagccaggcggctgctgaacctctcgcgcgacactgccgccgagatgaacgaaaccgtcgaggtcatctcagaaatgttcgatctgcaggagccaacctgcttgcagactagactcgaactgtacaagcaaggcctgcgtggatcgctgaccaagctgaagggtccgctgactatgatggcgagccactacaaacagcattgcccgcctaccccggaaacctcgtgtgcaactcagataatcacttttgaatcgttcaaagaaaatctgaaggattttcttctggttatcccattcgactgctgggagcccgtgcaagaa

SEQ ID NO: 9751 - DNA, 432 bp, Artificial Sequence
  Description of Artificial Sequence: Synthetic coding sequence
atgtggctgcagagtctcctcttgcttggcactgtggcttgctctatatcggctccagccaggtccccctctccatcaactcaaccatgggagcacgtgaacgcgatccaagaggcccggcgactcctgaacttgtcccgagacaccgcagccgaaatgaacgaaaccgtcgaagtcatctccgaaatgttcgaccttcaggagccaacatgcctgcagactcgcctcgaactgtataagcaaggactcagaggttccctgaccaaactgaaggggcctctgacgatgatggctagtcattacaagcagcactgtcccccaacaccagaaacctcatgcgctacccagatcatcaccttcgaaagctttaaagagaacttgaaggacttcttgttggtcatcccctttgattgttgggagccggtccaggag

SEQ ID NO: 9752 - DNA, 432 bp, Artificial Sequence
  Description of Artificial Sequence: Synthetic coding sequence
atgtggcttcaatcactcctgctgctgggtacagtagcatgcagcatttcggcacctgctcgctcgccttcaccatcaacacagccgtgggaacatgtgaacgcgattcaagaggctcgacgtttgctcaacctgtctcgtgacaccgcggcagaaatgaatgaaaccgtcgaagtaatctcagaaatgtttgatcttcaggaaccgacatgcctacaaacgcgactggaactctataaacaaggcctgcgtggtagtctcacaaaacttaaaggtccgctgaccatgatggcgagccattataaacaacattgtccaccgacgccggaaacctcatgcgccacacaaattattacattcgaatcatttaaggagaacttaaaggattttttgcttgtaatccctttcgattgctgggaaccggtccaagaa

SEQ ID NO: 9753 - DNA, 432 bp, Artificial Sequence
  Description of Artificial Sequence: Synthetic coding sequence
atgtggctccaaagtctgctcctgctaggaaccgttgcgtgttcaatctctgctcccgcacggtctcctagcccatccacacagccatgggagcatgtgaacgccattcaggaggccagacggctcttgaaccttagccgcgacacagctgctgagatgaacgaaaccgtggaagtgatcagcgagatgttcgacttacaggagcccacctgcctgcagacccgcctcgagctgtataaacagggtctaagaggatcattgaccaagctcaaggggcctctgaccatgatggccagccactataagcagcactgcccacccactcctgagacgtcatgcgccactcagattatcactttcgagagctttaaggaaaatctgaaagacttcttattggtaatcccttttgattgctgggagccggtgcaggaa

SEQ ID NO: 9754 - DNA, 432 bp, Artificial Sequence
  Description of Artificial Sequence: Synthetic coding sequence
atgtggctgcagtcactgttgctgctgggaacagtcgcatgctcaatcagtgctccagccagaagccctagcccctctacgcagccttgggaacacgtcaatgccatacaggaggcccgcaggctgttgaatttgtcacgcgatacggccgcggaaatgaacgaaactgtagaagtcatatctgagatgttcgacctgcaggaaccaacctgcctgcagactagactcgaattgtataagcaaggcctgaggggatcactcacaaagctgaagggtccactgacgatgatggcttcacattataagcagcactgccccccgacaccagagacttcttgcgccactcagatcattaccttcgagtctttcaaagaaaatcttaaagattttctgcttgtcataccgttcgactgctgggagcctgttcaggaa

SEQ ID NO: 9755 - DNA, 432 bp, Artificial Sequence; identical to SEQ ID NO: 9694
  Description of Artificial Sequence: Synthetic coding sequence

SEQ ID NO: 9756 - DNA, 432 bp, Artificial Sequence
  Description of Artificial Sequence: Synthetic coding sequence
atgtggctgcagagtctgctcctgctgggtacagtcgcttgttccatttccgctcccgccaggtctccatcacccagtacgcaaccctgggaacacgtcaacgctattcaagaagcacgcagacttctgaatttgagcagggataccgcagccgagatgaacgagactgtcgaagtcatttctgagatgttcgacctgcaagaacctacttgtctgcaaacaagactggaactgtacaaacagggtttgaggggcagcctcactaagcttaaaggtcctttgacaatgatggcctctcactataagcagcactgcccgcccactcctgaaacctcctgtgccacccagatcatcacgttcgagtcctttaaagaaaatctgaaagactttctcctggtcataccgttcgattgctgggagccagtgcaggag

SEQ ID NO: 9757 - DNA, 432 bp, Artificial Sequence
  Description of Artificial Sequence: Synthetic coding sequence
atgtggctgcagagcttgctgttgcttggcaccgtggcttgttccataagcgcgcccgccagaagccctagcccctcaacacagccctgggagcatgttaatgctattcaagaggcacgtcgcctgttgaatctgtctcgagacaccgctgccgagatgaatgagacagtcgaggtgatctccgaaatgtttgaccttcaggagccgacatgcctgcagaccaggctagaactttataagcagggcttgagaggaagcttgacgaagctaaaaggtccactgacgatgatggctagccactacaagcagcactgtcccccaaccccagagacaagttgtgccactcagatcatcacattcgagtcttttaaagagaatctcaaagattttctgctcgtaattccattcgattgttgggaacccgtgcaggaa

SEQ ID NO: 9758 - DNA, 432 bp, Artificial Sequence
  Description of Artificial Sequence: Synthetic coding sequence
atgtggctccagtcactgctccttctcggcactgtcgcctgcagcatctcggctccggcgcgctcaccatcgccatcgacccaaccgtgggaacatgtgaatgcgatccaggaagctaggaggttgttgaatctcagcagagataccgctgccgagatgaacgaaactgttgaggtgatttcggagatgtttgatctgcaagagccaacctgcctccagaccaggcttgagctctacaagcaggggctgaggggatccctgaccaaactgaagggccctctcactatgatggcgtcgcattacaagcagcactgtcctccaaccccggaaacgtcctgtgcaactcagattatcactttcgagtccttcaaagaaaacctgaaggacttcctgctggtcatccctttcgactgctgggaaccagtgcaagag

SEQ ID NO: 9759 - DNA, 432 bp, Artificial Sequence
  Description of Artificial Sequence: Synthetic coding sequence
atgtggctgcagtcactgcttcttcttggtaccgtggcatgtagcatttcagcacctgcccgctcgccatcgccatcgacccagccttgggaacatgtgaatgccattcaagaggcgcgtagacttttgaacctctcaagagataccgcagcggagatgaacgagactgttgaagtcatctcggaaatgtttgaccttcaagagcccacttgtctgcagacccggctggaactctacaagcaagggctccgcggttcccttaccaaactcaagggaccccttacgatgatggcttcgcactacaaacaacattgccccccaacccccgaaacttcgtgcgccactcagataatcacgtttgaatcctttaaagaaaaccttaaggatttcctgttggtgattcccttcgactgttgggagcccgtccaggaa

SEQ ID NO: 9760 - DNA, 432 bp, Artificial Sequence
  Description of Artificial Sequence: Synthetic coding sequence
atgtggttgcagagcctacttctgcttggaaccgtcgcctgctccatcagcgccccagcccggagtccttcaccaagcacccaaccgtgggaacatgtcaacgccatacaggaggcgcggagactgttgaatttgtcccgcgatacagcggccgagatgaacgaaaccgtggaggttatttccgagatgttcgatctccaggagcccacctgcctgcaaacccggctcgagttatacaagcagggcttgcggggctcgctcacaaagttgaaaggcccgctgaccatgatggcctcgcattataagcagcactgccccccgacgcccgagacttcgtgtgccacgcagatcattacgttcgagagttttaaggaaaacctgaaggattttttgctagtgatcccctttgactgttgggagccagtccaagag

SEQ ID NO: 9761 - DNA, 432 bp, Artificial Sequence
  Description of Artificial Sequence: Synthetic coding sequence
atgtggctccagtctctgctcctcctgggcactgtggcttgctcaatttcggcgcctgcacggagcccaagcccgtctacgcaaccgtgggaacacgttaatgcaatccaagaagcgaggaggctcctgaacttgtcgagagatactgcagccgagatgaacgaaaccgtggaggtcatctcggaaatgttcgaccttcaagaaccgacttgtctccaaacgcgcctggagttgtacaagcagggacttcgcggttcgctcactaagttgaagggccccctgaccatgatggccagtcattacaaacagcactgcccgcccacccctgaaaccagctgcgccactcagatcattaccttcgagagctttaaggagaatttgaaggatttcctgttggtgatcccgtttgactgctgggaaccggtgcaggag

SEQ ID NO: 9762 - DNA, 432 bp, Artificial Sequence
  Description of Artificial Sequence: Synthetic coding sequence
atgtggctgcagtccctcctgctgttaggcactgtggcctgcagcatttctgcccccgctagaagtccaagtcccagcactcagccatgggagcacgttaatgcgatccaggaagctcggcgattgttgaatttatcaagggatacagctgctgagatgaatgaaaccgtcgaggtgataagcgagatgtttgacctccaggagcccacatgccttcagacacgccttgaattgtataagcagggcctgcggggcagtctaactaagctgaaaggccctcttaccatgatggcttcccactacaagcagcattgtccacccacacctgagacatcctgcgctacccaaattattactttcgaatcttttaaagagaatctgaaggattttctgttggtgatccctttcgattgctgggaacctgtgcaagag

SEQ ID NO: 9763 - DNA, 432 bp, Artificial Sequence
  Description of Artificial Sequence: Synthetic coding sequence
atgtggcttcaatctttgttgcttcttggtacagtcgcttgttctatcagcgcaccagctcgtagcccaagccccagtacacaaccttgggagcatgtcaatgccattcaagaagccagaagacttttgaacttatcaagggataccgcggctgaaatgaacgagactgtggaggtgatatcagaaatgtttgaccttcaggagcccacctgcttacaaactaggctagaactctacaaacaaggtctccggggttctcttacaaagttgaaggggccccttactatgatggcaagccactataaacagcattgtccccctacacccgaaacctcgtgcgccacacagattatcaccttcgaatcattcaaggaaaacctaaaggattttttgttggttattccatttgactgctgggagcctgtgcaagaa

SEQ ID NO: 9764 - DNA, 432 bp, Artificial Sequence
  Description of Artificial Sequence: Synthetic coding sequence
atgtggctgcagtctcttcttctgctgggaacagtcgcatgttctatttccgctcctgccagatcccctagtccttccacgcagccctgggaacacgtgaatgccatccaggaagctcggagactactgaacctgtccagagatactgctgcagaaatgaatgagactgtggaagtgatctctgagatgttcgatctgcaggaaccaacatgtctgcagacacggttggaactctataaacagggactaaggggatccctcactaaactgaaaggacctctgacaatgatggcatcccactataaacagcactgtcctccaacacctgaaacatcctgtgccactcagataatcactttcgagtcattcaaggaaaaccttaaagatttcttactcgttattcccttcgattgctgggagcccgtgcaggaa

SEQ ID NO: 9765 - DNA, 432 bp, Artificial Sequence
  Description of Artificial Sequence: Synthetic coding sequence
atgtggcttcaatccctgcttctgctcgggactgtggcttgctcgatttcggcgcctgcgcgaagcccttcgcctagcactcagccatgggagcatgtcaacgctatccaggaggcaagaaggctcttgaatctgtctcgcgacactgcagccgaaatgaatgaaaccgtcgaggtaattagcgagatgtttgatttgcaggaacctacgtgcctccagactagacttgaactgtacaaacaaggacttaggggatcccttaccaagctgaagggacccctgacgatgatggcatcgcattacaagcaacactgtccaccgacccctgaaacctcgtgcgccacccaaatcattacttttgagtcgtttaaggagaacctgaaggatttcctcctcgtgatcccattcgactgttgggaaccagtgcaggaa

SEQ ID NO: 9766 - DNA, 432 bp, Artificial Sequence
  Description of Artificial Sequence: Synthetic coding sequence
atgtggctgcagagtctgctcctcctaggtacggtggcctgctctatcagcgcgcctgcaaggtccccgtcccccagcacccagccgtgggaacacgtgaacgcaatccaagaggcaaggcgactgctcaatctctctagagacaccgccgccgaaatgaatgagaccgttgaagtcatttcagagatgttcgatttgcaggagccaacctgtctccagacgaggctggaactatataagcaaggtctgaggggatcactaactaagctcaaaggccctttgacgatgatggcttcacactacaagcagcattgtccccccacccctgagacctcatgtgccacccaaatcatcaccttcgaaagtttcaaagaaaatctcaaggattttctcctggtaatcccttttgactgctgggagcccgtgcaggag

SEQ ID NO: 9767 - DNA, 432 bp, Artificial Sequence
  Description of Artificial Sequence: Synthetic coding sequence
atgtggctgcagagtctgctactacttggcacggtggcttgctccattagcgctccagcaaggtctccaagtccatctacccaaccctgggaacacgtaaacgccattcaggaagcccgtaggctgctgaacctatcaagggacaccgcagcggaaatgaatgagactgtagaggtcattagtgaaatgttcgaccttcaggaaccgacttgtctgcaaacacgtctcgagttgtataagcaggggctgcgcggttctctgacgaagctgaaaggcccactgactatgatggcgagtcattacaagcagcattgtcccccaaccccggagacttcctgcgccacccagattatcaccttcgagtcattcaaagaaaacctcaaagattttctgttagttatcccatttgactgctgggaacccgtgcaggag

SEQ ID NO: 9768 - DNA, 432 bp, Artificial Sequence
  Description of Artificial Sequence: Synthetic coding sequence
atgtggttgcaatcgctgctcctgttgggcacggttgcctgttcaatttcagcaccagcgcgctcgccttctccttccactcaaccttgggagcatgtgaacgcaattcaggaggctcggaggcttctgaacctctcgagagatactgcagcagaaatgaatgaaaccgtggaggtgatctcggagatgtttgatctgcaggaaccgacctgtctgcaaacgcgtcttgaactgtataagcaaggcttgagaggttccctcaccaagctcaagggaccactgaccatgatggcctcacactacaagcagcattgcccaccgacccctgaaacctcctgtgcaacccagattatcactttcgaatcatttaaggagaatctgaaggatttcctgctggtgattcctttcgactgttgggagcctgtgcaggag

SEQ ID NO: 9769 - DNA, 432 bp, Artificial Sequence
  Description of Artificial Sequence: Synthetic coding sequence
atgtggttgcagtccctcttactgttagggaccgtcgcatgcagtatctccgcccccgcccggtctccaagtccctccacacagccgtgggaacatgtcaacgccattcaggaggctcgaagattgctgaatctttcgagggacacggctgctgaaatgaacgagactgtggaggtgatttccgaaatgtttgatctgcaagagccaacttgtctgcagacgagactcgagctttacaaacaggggttgaggggctcgctgacgaaactgaaaggccctttgacgatgatggcctcccactacaaacagcattgtccaccaacccccgaaacatcctgcgccacgcagatcattactttcgagagttttaaagaaaatctgaaagatttcctgctggtcatcccatttgattgctgggagcctgtgcaggaa

SEQ ID NO: 9770 - DNA, 432 bp, Artificial Sequence
  Description of Artificial Sequence: Synthetic coding sequence
atgtggctgcagagcctgctgctgctgggaaccgtggcttgttccatatcggcgccagcaaggtctcctagtccaagcacacagccatgggaacatgtgaacgcaatccaagaagcgaggagacttctcaacctttcgagagacactgccgctgagatgaacgagaccgtggaagtcatctctgagatgttcgatctccaagagccaacctgtctccagacaagactggagctgtataagcaggggctgagaggtagtctgaccaaactgaaaggtcctttaacgatgatggcctcgcattacaaacaacactgtcctcccaccccagagaccagttgtgcaacccaaattataaccttcgagtctttcaaggagaaccttaaggattttctcctagtgatccctttcgactgctgggagcccgtccaggag

SEQ ID NO: 9771 - DNA, 432 bp, Artificial Sequence
  Description of Artificial Sequence: Synthetic coding sequence
atgtggctacagtctctgctgctcctgggcacagtggcatgttccatcagcgctcccgctagatcccctagcccatctacccaaccatgggaacacgttaacgcaatccaggaagctaggagactactcaacttaagcagggacacagccgctgagatgaacgaaactgtggaggtgatttctgagatgtttgatctacaggaacctacttgcctacagacccggctagagctgtacaagcagggacttaggggctccctcactaaactgaagggccccctgactatgatggcctcacactacaagcaacactgtccccctaccccagaaacctcctgtgcaacacaaatcatcacattcgagtcatttaaggagaacttaaaggacttcttgctcgtgataccttttgattgttgggaacctgttcaggaa

SEQ ID NO: 9772 - DNA, 432 bp, Artificial Sequence; identical to SEQ ID NO: 9653
  Description of Artificial Sequence: Synthetic coding sequence

SEQ ID NO: 9773 - DNA, 432 bp, Artificial Sequence
  Description of Artificial Sequence: Synthetic coding sequence
atgtggctacaaagcctactcctcctgggcacggtagcatgctccatctcagcaccagcccgctccccttcccccagtacccaaccctgggaacacgtcaacgccatacaggaggctagacgactgctgaatctgtcacgagatactgcagccgagatgaatgagacagtagaggtcatctccgagatgtttgatcttcaggagccaacgtgtctacagactcgcctagagctgtacaagcaaggtcttcgaggtagtttgacaaagctgaaggggcccctgacaatgatggccagccactacaagcagcactgcccccccaccccggaaaccagctgcgctacgcagattatcaccttcgaaagtttcaaggagaatttgaaggacttcctcttggttattccatttgattgctgggaaccagtgcaggag

SEQ ID NO: 9774 - DNA, 432 bp, Artificial Sequence
  Description of Artificial Sequence: Synthetic coding sequence
atgtggctgcagtcacttctattactgggcactgtagcctgttctatctcggccccagctcgtagcccaagtccgagtacccagccatgggaacacgtcaatgcaatccaggaagcgcgaaggcttctgaacctgagcagggatacggccgctgagatgaatgaaacagtggaagttatttctgagatgttcgatctgcaggagccgacctgcctgcagaccagactcgaactttataagcaggggttgcgagggtccttgacaaaactgaaaggacctctgactatgatggcctctcattataaacagcactgtcctcctacaccagaaacttcctgtgcgacgcagattataaccttcgaatcctttaaagaaaacctgaaggatttcctgctagttatcccattcgattgttgggaaccagtccaagag

SEQ ID NO: 9775 - DNA, 432 bp, Artificial Sequence
  Description of Artificial Sequence: Synthetic coding sequence
atgtggctccagtccctcctcctgttgggaactgtggcctgtagtatctctgccccagctagatcaccttcaccgtccacacagccctgggagcacgtgaatgctatccaggaagccagaaggcttctaaatctctctcgcgatacagccgccgagatgaatgaaactgtcgaggtgatttcagaaatgttcgacttgcaggaaccaacatgtcttcagacaaggttggaactctataagcagggactccgggggtcgcttacaaaactgaaaggaccactgacaatgatggcttcacactataaacagcattgtcctcctactcccgaaacttcttgcgctactcagatcatcacatttgagtccttcaaagaaaacctgaaagatttccttcttgtcattccctttgattgctgggaacctgtgcaggag

SEQ ID NO: 9776 - DNA, 432 bp, Artificial Sequence
  Description of Artificial Sequence: Synthetic coding sequence
atgtggctccagagcctgcttctcttgggtactgtggcctgtagcatttccgccccggcaaggagcccctccccttcgacccaaccgtgggaacatgtgaacgcaattcaagaagcaagaagattgcttaatctgagcagagataccgcagcggaaatgaacgaaaccgtggaggtcatttcggagatgtttgaccttcaagagcctacctgtctgcagacccgccttgagctttacaagcaaggtcttagaggttcgctgaccaagctcaaagggccacttacgatgatggcatcacactacaagcaacattgtcccccaactcccgaaacttcatgcgctactcagattatcactttcgagtcatttaaggaaaatctgaaggatttcctcctggtgatcccattcgattgttgggagcctgtgcaggaa

SEQ ID NO: 9777 - DNA, 432 bp, Artificial Sequence
  Description of Artificial Sequence: Synthetic coding sequence
atgtggcttcagtccctactgttgctgggaacggtggcttgttccatctctgcccccgctcgctcaccctctccttctactcagccttgggaacacgtgaatgcaatacaggaagcgcgcaggctccttaacctttctagggatactgccgcagaaatgaatgaaacagtggaagtcatcagtgaaatgtttgacctgcaggagcccacatgcctccagacaagactggaactctataaacaagggttacggggaagtctcacaaaactaaaaggacccctgacaatgatggcatcacattataaacagcactgcccgcctacacctgaaacttcttgcgctacacagataataacatttgagtcatttaaagaaaatctcaaagattttcttctggtcattcctttcgattgttgggaacccgtccaggag

SEQ ID NO: 9778 - DNA, 432 bp, Artificial Sequence
  Description of Artificial Sequence: Synthetic coding sequence
atgtggcttcaatcgcttttgcttttgggtacagtggcttgcagcatatctgcccctgcccgcagcccctccccgtcaactcaaccctgggagcacgtcaacgcaatacaggaggcaagaaggctattaaatctttcgagagatacagccgcagaaatgaatgaaacggttgaagttatctccgagatgttcgatctccaagagcccacttgtctccaaaccagattagagctgtacaaacaagggcttagaggttctctaactaaacttaagggtcccttgactatgatggcatcacattataagcagcactgcccaccaactccagaaacttcatgcgccacccaaattataacattcgagtcattcaaagagaatttgaaggacttcttgctcgtcattccgttcgactgttgggagcctgtgcaagag

SEQ ID NO: 9779 - DNA, 432 bp, Artificial Sequence
  Description of Artificial Sequence: Synthetic coding sequence
atgtggctccagtctctgctactgttggggactgtcgcttgctcgattagcgcacctgccagatccccttccccctccacacagccctgggagcatgtgaacgctatccaggaggcacgccgcctgcttaatctgtctcgggacacagcagccgaaatgaacgagaccgtagaggtgatttccgagatgttcgatttacaggagccaacctgtctgcagacaagactcgagctgtacaagcagggtctacgggggtccctcactaagcttaaggggcctctgaccatgatggctagccactacaagcagcattgtccacctactcccgagactagctgcgccacccagattatcactttcgagagtttcaaggagaatctcaaagactttcttctggtcatcccattcgactgttgggaacctgtccaggaa

SEQ ID NO: 9780 - DNA, 432 bp, Artificial Sequence
  Description of Artificial Sequence: Synthetic coding sequence
atgtggctgcagtcgctgcttctgttgggaaccgtggcctgttcgatctcagccccagcccggagcccgtccccgagcacccagccgtgggaacacgtgaacgcgatccaggaggctcgccgactcctgaacctctcccgcgataccgcggccgaaatgaacgaaactgtggaggtcatcagcgaaatgttcgacctccaggagccaacttgccttcaaacccgcctggaactgtacaaacaaggtttgcgcggatcactgactaaactgaagggtccgctgaccatgatggcctcacactacaaacaacactgccctcctactccggagacttcatgcgccacccagattatcactttcgaatcgttcaaggaaaacctgaaggactttctgctggtgatcccgttcgattgctgggaacctgtgcaggaa

SEQ ID NO: 9781 - DNA, 432 bp, Artificial Sequence
  Description of Artificial Sequence: Synthetic coding sequence
atgtggctgcagtcactcctgctcctcggcactgtagcctgcagtatttctgctcctgcccgctctcctagtccatctacccagccatgggaacacgtgaatgccatacaggaagcccggcgcctcctgaatctgagccgagatactgcagcagaaatgaacgagaccgtggaggtgatcagcgagatgttcgatctccaggagcctacctgcctgcagacccggctggaattgtataaacagggcctaaggggctctctgaccaaactaaagggtcctctaaccatgatggcatctcactacaaacagcactgcccgcctactcctgagacctcctgtgctactcaaataatcacatttgagtcttttaaagagaatctgaaagactttcttttggttatcccctttgactgctgggaaccggttcaagaa

SEQ ID NO: 9782 - DNA, 153 bp, Artificial Sequence
  Description of Artificial Sequence: Synthetic coding sequence
atggcaggccctgccacacaaagtcccatgaagttaatggccttacagctgttgctgtggcattctgcattatggaccgtgcaggaggcaaaactgttacttctgaagctattactgctgaagttgctcttactaaaactactgctgctgaaa

SEQ ID NO: 9783 - DNA, 153 bp, Artificial Sequence
  Description of Artificial Sequence: Synthetic coding sequence
atggccggccctgcaacccagagcccaatgaaactcatggcgctccaactgctgttgtggcactcggccctgtggacggtgcaggaagcaaagctgctgctgttgaaactgctgctgctgaaacttttgctgttgaagttgctgttgctcaaa

SEQ ID NO: 9784 - DNA, 153 bp, Artificial Sequence
  Description of Artificial Sequence: Synthetic coding sequence
atggccggtccggcgactcaaagccccatgaagctgatggcactgcagctcctgctgtggcactccgcgctctggaccgtgcaagaagctaagctcttgctcttgaagttgcttctcctgaaacttttgctgctcaagttgctgcttctgaaa

SEQ ID NO: 9785 - DNA, 153 bp, Artificial Sequence
  Description of Artificial Sequence: Synthetic coding sequence
atggccggtccagccacccagagcccaatgaagctgatggcgctgcagctcctgctctggcactcggcactgtggactgtgcaagaagcaaagctgttgttgttgaaactcctcctgcttaagttgctgcttctgaaacttctcctgctgaaa

SEQ ID NO: 9786 - DNA, 153 bp, Artificial Sequence
  Description of Artificial Sequence: Synthetic coding sequence
atggccggaccagccacccagagccctatgaagctgatggcgctgcaactcttgctttggcattccgccctttggactgtgcaagaggctaagttgctgctcctgaagctgctgctgctgaagctcctgttgttgaaactgctgctgctcaaa

SEQ ID NO: 9787 - DNA, 153 bp, Artificial Sequence
  Description of Artificial Sequence: Synthetic coding sequence
atggcgggacctgcaacccaatcccccatgaagctcatggcactccaactccttctctggcattcggccctttggactgtgcaggaagctaaactgcttctgcttaagttgctgcttcttaagctgttgcttctgaagctccttttgctcaag

SEQ ID NO: 9788 - DNA, 153 bp, Artificial Sequence
  Description of Artificial Sequence: Synthetic coding sequence
atggcgggaccagctactcagtctccgatgaaattgatggccctgcagctgctcctttggcactcggcgctgtggaccgtgcaagaggcaaagttgctgctcttgaagctcctcctgctgaaactgcttctcctcaagctgttgctgctgaag

SEQ ID NO: 9789 - DNA, 153 bp, Artificial Sequence
  Description of Artificial Sequence: Synthetic coding sequence
atggccgggccggccacccaaagtcctatgaagctgatggcactgcagttgctgctgtggcatagcgctttgtggaccgtgcaggaggccaaactcttattgctgaagctgctcctcctgaaactgctgttactgaaactgctgctccttaag

SEQ ID NO: 9790 - DNA, 153 bp, Artificial Sequence
  Description of Artificial Sequence: Synthetic coding sequence
atggccggacccgccactcagagcccaatgaaactgatggcccttcaactgctcctgtggcactcggccctgtggaccgtgcaggaagcaaagctcctccttctcaaactgctgctgctgaagttgctcctgttgaagctgcttctgctcaag

SEQ ID NO: 9791 - DNA, 153 bp, Artificial Sequence
  Description of Artificial Sequence: Synthetic coding sequence
atggctggaccagctacgcagtctcccatgaaacttatggctttacagctcttgttgtggcactcggctctgtggacagtgcaggaagctaaactcttacttttgaaacttttgcttttgaaacttttgcttttgaagctcctattgcttaag

SEQ ID NO: 9792 - DNA, 153 bp, Artificial Sequence
  Description of Artificial Sequence: Synthetic coding sequence
atggccggcccggccacacagagccctatgaagctgatggccttgcagctgcttctgtggcactcggctctctggactgtgcaggaagccaaattgttattgctaaaacttctgctcttgaaactgctccttctgaagttgctgcttctcaaa

SEQ ID NO: 9793 - DNA, 153 bp, Artificial Sequence
  Description of Artificial Sequence: Synthetic coding sequence
atggcaggccctgctacccaatctccaatgaagctaatggcactccaactgctgttgtggcattctgccttgtggaccgtccaggaggctaagctgcttttgcttaagctgctcctcctcaagctcctgctcttaaagctgctacttttgaaa

SEQ ID NO: 9794 - DNA, 153 bp, Artificial Sequence
  Description of Artificial Sequence: Synthetic coding sequence
atggctggacctgcgacccagagcccgatgaagctcatggcactccagttgctcctctggcactcggccctctggactgtgcaagaggcgaagttgctgctcctgaagttgttgctgctgaaactcctgctgctgaagctgctcctgctcaaa

SEQ ID NO: 9795 - DNA, 153 bp, Artificial Sequence
  Description of Artificial Sequence: Synthetic coding sequence
atggcaggccctgcgacccaatccccgatgaagctgatggccctccagctcctgctgtggcacagcgctttgtggactgtgcaggaagcgaagctcctgctcctgaagctgctgctcttgaaactgctgttgctgaaactgcttctgcttaag

SEQ ID NO: 9796 - DNA, 153 bp, Artificial Sequence
  Description of Artificial Sequence: Synthetic coding sequence
atggcgggccctgcgacccagtcccccatgaagctgatggcccttcagcttctgctctggcacagcgccctgtggacggtccaggaggcaaagctcttgctgctcaagctgcttctgctgaagctgctgctcctaaagctccttctgttaaag

SEQ ID NO: 9797 - DNA, 153 bp, Artificial Sequence
  Description of Artificial Sequence: Synthetic coding sequence
atggccgggcctgccacacagtccccaatgaagctcatggcactgcagctcctgctgtggcactcagcactttggaccgtccaggaggcgaagttgttgctgctcaagctactccttctgaagttgttacttctgaaactcctcctgttgaaa

SEQ ID NO: 9798 - DNA, 153 bp, Artificial Sequence
  Description of Artificial Sequence: Synthetic coding sequence
atggccggccctgcgacccagtcacccatgaagctgatggcacttcagctgctgctgtggcacagtgccctctggacagtgcaggaggccaagctgctattactgaagctgctactcctcaagctcttgctgctgaaacttctgcttttaaag

SEQ ID NO: 9799 - DNA, 153 bp, Artificial Sequence
  Description of Artificial Sequence: Synthetic coding sequence
atggcgggcccagcgacccagtccccaatgaaactaatggccctgcagttactcttatggcacagtgctctctggaccgtgcaggaagccaagttgttactgctgaagctgcttttacttaagcttctgctgctcaaactgctcctcctgaag

SEQ ID NO: 9800 - DNA, 153 bp, Artificial Sequence
  Description of Artificial Sequence: Synthetic coding sequence
atggcaggccccgctacacagagccccatgaaacttatggccctgcagctgctgctgtggcactctgccctgtggaccgtgcaggaagccaaacttctgttgctgaagctgctcctgcttaagctcctcctgctgaagcttctgctcctcaaa

SEQ ID NO: 9801 - DNA, 153 bp, Artificial Sequence
  Description of Artificial Sequence: Synthetic coding sequence
atggcaggcccagcgactcaatcccctatgaagttgatggcacttcagcttctcctttggcactccgccctctggaccgtccaggaagctaagctgctgcttctgaaacttcttttgctgaagctgcttctgctcaagctcctgctgctgaaa

SEQ ID NO: 9802 - DNA, 153 bp, Artificial Sequence
  Description of Artificial Sequence: Synthetic coding sequence
atggcaggtccagcaacgcaatcgcctatgaaactgatggcgctgcaactgctgctgtggcactccgctctttggaccgtgcaggaagcaaagctcctgcttcttaaacttcttcttctgaagctgctgcttctgaagttgctcctccttaag

SEQ ID NO: 9803 - DNA, 153 bp, Artificial Sequence
  Description of Artificial Sequence: Synthetic coding sequence
atggcaggaccggccacccagtcccctatgaaactcatggccttgcagctgctcctttggcacagcgcgctctggactgtgcaagaggctaagttgctgctgctcaaactcctgctcctgaaattgctgctcctcaagctgctcctgctgaaa

SEQ ID NO: 9804 - DNA, 153 bp, Artificial Sequence
  Description of Artificial Sequence: Synthetic coding sequence
atggcaggacctgcaacacaatcaccaatgaaacttatggcattacaacttcttttatggcactctgctctttggacagtacaagaagctaaacttcttttgttaaagttattattattaaaattacttcttttaaaattgttattacttaag

SEQ ID NO: 9805 - DNA, 153 bp, Artificial Sequence
  Description of Artificial Sequence: Synthetic coding sequence
atggctggtccagcgacgcaaagcccgatgaaactcatggcactgcagttgctactctggcactctgcactatggactgtgcaggaagctaaattactcctactgaaattacttcttcttaaactgctgcttctcaagttgctgctacttaaa

SEQ ID NO: 9806 - DNA, 153 bp, Artificial Sequence
  Description of Artificial Sequence: Synthetic coding sequence
atggcaggccccgcaacccagagccccatgaagctcatggcgctgcagcttctgctgtggcattcggccctgtggacagtgcaagaggccaaactgttgctactgaaactgcttctgcttaagcttctgttactgaagctcctgctcttgaag

SEQ ID NO: 9807 - DNA, 153 bp, Artificial Sequence
  Description of Artificial Sequence: Synthetic coding sequence
atggctggcccagctacccaaagtcccatgaagctgatggcccttcagctcttgctctggcactccgctttgtggacagtacaagaggctaagttgctcctgctgaaacttctgctgctgaagctgctgctcctcaagctgttgctgctgaag

SEQ ID NO: 9808 - DNA, 153 bp, Artificial Sequence
  Description of Artificial Sequence: Synthetic coding sequence
atggcaggtccagccacacagtcccctatgaaattgatggcccttcagttactattgtggcatagcgctctttggactgttcaagaagcgaaacttttacttttaaaactccttcttctcaaattacttctgcttaagctgctgttgctgaaa

SEQ ID NO: 9809 - DNA, 153 bp, Artificial Sequence
  Description of Artificial Sequence: Synthetic coding sequence
atggccgggccagcaactcagtctcccatgaagctgatggcgttgcaattgctcctttggcactctgccctgtggaccgtgcaggaggctaagctgctgcttctcaagcttttgttgctgaaactgctcctccttaagctgctgttgctgaag

SEQ ID NO: 9810 - DNA, 153 bp, Artificial Sequence
  Description of Artificial Sequence: Synthetic coding sequence
atggccggcccagcaacccaatcgccgatgaagctgatggcactccagctgctgctgtggcatagcgcactttggactgtgcaggaagcaaaactgctgctgttgaagctcctcctgctgaagctgcttcttctgaagttgctgcttctgaag

SEQ ID NO: 9811 - DNA, 153 bp, Artificial Sequence
  Description of Artificial Sequence: Synthetic coding sequence
atggccggccccgccacccagtccccaatgaaactcatggcgttgcagctgctcctgtggcactctgctttgtggacagtgcaggaggccaaactcctgctgcttaaacttctgctgctgaaacttcttttgctgaaactgctcttgttgaaa

SEQ ID NO: 9812 - DNA, 153 bp, Artificial Sequence
  Description of Artificial Sequence: Synthetic coding sequence
atggccgggccagctacccagagtcctatgaagctgatggccctgcagctgttgctgtggcatagcgctctatggaccgttcaggaggcgaagctgctgctcctcaagctgctgcttctgaagctgctgctcttgaaactcctgctgctgaaa

SEQ ID NO: 9813 - DNA, 153 bp, Artificial Sequence
  Description of Artificial Sequence: Synthetic coding sequence
atggcgggtcctgcgactcagtcgccgatgaagttgatggccctgcaacttcttctttggcattcagcactttggacggtgcaagaagcaaagctgttgctcctgaagctgcttcttcttaagctcctgttgctgaaactcctgcttcttaaa

SEQ ID NO: 9814 - DNA, 153 bp, Artificial Sequence
  Description of Artificial Sequence: Synthetic coding sequence
atggcgggacccgcaactcagagcccaatgaagttgatggcacttcaattgcttctgtggcactccgctctgtggacggtgcaggaggcaaaactcctgttgcttaaacttctgctgctgaagctgcttcttcttaaactcctcctgctgaaa

SEQ ID NO: 9815 - DNA, 153 bp, Artificial Sequence
  Description of Artificial Sequence: Synthetic coding sequence
atggctggacctgcgacccagtcgccgatgaagttgatggccttgcaacttttgctgtggcactccgccttgtggactgtgcaggaagcaaaattgctgctcctcaagctgttgctgcttaaactgctcctgctcaagctcctcctgctgaag

SEQ ID NO: 9816 - DNA, 153 bp, Artificial Sequence
  Description of Artificial Sequence: Synthetic coding sequence
atggccgggccagcaactcagtctcctatgaaactcatggcactgcagttactgctctggcactctgctctctggactgtgcaggaagcaaaactgctgttactgaaattgctcctcctgaaattgcttctgctcaaactattgctcctgaaa

SEQ ID NO: 9817 - DNA, 153 bp, Artificial Sequence
  Description of Artificial Sequence: Synthetic coding sequence
atggcaggccccgcgacgcagtcgccgatgaagctgatggccctgcagctgctgctgtggcactccgccttgtggaccgtgcaagaagcgaaactcctccttcttaagctgctgctgctcaaactgctgctgctgaaactgctgcttctgaag

SEQ ID NO: 9818 - DNA, 153 bp, Artificial Sequence
  Description of Artificial Sequence: Synthetic coding sequence
atggctggccctgccacccagagccccatgaagctcatggccctgcagctcctgttgtggcactcggccctctggaccgtgcaagaggccaagttgctgctcctgaaactgttgctgttgaagctgctcctgctgaaacttctgctgcttaag

SEQ ID NO: 9819 - DNA, 153 bp, Artificial Sequence
  Description of Artificial Sequence: Synthetic coding sequence
atggcgggacccgcgacacaatcccccatgaagctgatggcactgcagttactcctctggcactccgccttgtggaccgttcaggaggccaagttgcttctgttgaaactattgctgctgaagctgctgttactgaagctcctcctattgaag

SEQ ID NO: 9820 - DNA, 153 bp, Artificial Sequence
  Description of Artificial Sequence: Synthetic coding sequence
atggcagggcctgccacacagtcacctatgaagttgatggccttacagctccttttgtggcatagtgctttgtggaccgttcaggaggccaaattgcttttgcttaagctactgctcctgaagctgctcttgctgaagctgctcctcctcaaa

SEQ ID NO: 9821 - DNA, 153 bp, Artificial Sequence
  Description of Artificial Sequence: Synthetic coding sequence
atggcagggccggccacccagagccctatgaaactcatggccctccagctcctgctgtggcatagcgcactctggaccgtgcaggaggcaaaactgctgctgttgaaactattgctgctgaaactgctgctccttaaacttctgctgctgaaa

SEQ ID NO: 9822 - DNA, 153 bp, Artificial Sequence
  Description of Artificial Sequence: Synthetic coding sequence
atggcaggtcccgcaacgcagtcgccaatgaaacttatggcacttcaactcctgctctggcattccgcgctgtggaccgtccaggaagctaagctgctgctccttaagttgctcctcctcaaacttcttcttcttaagctcctgctgcttaaa

SEQ ID NO: 9823 - DNA, 153 bp, Artificial Sequence
  Description of Artificial Sequence: Synthetic coding sequence
atggccggccccgctacgcaaagtcccatgaagctaatggccctgcagctgctgctgtggcacagcgcactgtggaccgtccaagaggccaagctgcttctgctcaaactcctcctattgaagcttctactcctaaaactattgctcctaaaa

SEQ ID NO: 9824 - DNA, 153 bp, Artificial Sequence
  Description of Artificial Sequence: Synthetic coding sequence
atggccggcccagctactcagtcacccatgaagctcatggcgctgcagttgctcctatggcatagtgcgctgtggaccgtccaggaggccaagctgctgctgctgaagctcctcctgctgaagctcctgctgctcaagctgctactgctgaag

SEQ ID NO: 9825 - DNA, 153 bp, Artificial Sequence
  Description of Artificial Sequence: Synthetic coding sequence
atggctggacctgccactcagtctcccatgaaactgatggcacttcagttattgctgtggcattctgcgttgtggaccgtgcaggaggccaaattgcttctgctgaaactgttgctactgaaactgcttctgcttaaattgctcctgctgaaa

SEQ ID NO: 9826 - DNA, 153 bp, Artificial Sequence
  Description of Artificial Sequence: Synthetic coding sequence
atggctggacccgcaacccagtctccaatgaagctcatggccttacaactcctgctgtggcacagcgctctgtggacggtccaggaagccaaattgctcttgctgaagctcctcttactaaaactgctgctgctcaagctcctgcttctgaaa

SEQ ID NO: 9827 - DNA, 153 bp, Artificial Sequence
  Description of Artificial Sequence: Synthetic coding sequence
atggcgggtccggcgacgcaatcgccgatgaaactaatggcgctacaactattattatggcattcggcgctatggacggtacaagaagcgaaattactattactaaaattactactattaaaactattactattaaaattattactattaaaa

SEQ ID NO: 9828 - DNA, 153 bp, Artificial Sequence
  Description of Artificial Sequence: Synthetic coding sequence
atggcaggcccagccactcagagtcccatgaaactgatggccctccagctgttattgtggcatagtgcactgtggaccgtgcaggaggctaaactccttttgctgaagcttctgctcctgaagctgcttctgctcaagttgttgcttctgaaa

SEQ ID NO: 9829 - DNA, 153 bp, Artificial Sequence
  Description of Artificial Sequence: Synthetic coding sequence
atggctggtccagctactcagagcccaatgaaactgatggccttgcagttactgttgtggcattctgccctgtggactgttcaagaggctaaacttcttctgcttaaactactgctcctgaagttactccttctaaagctgctcctccttaag

SEQ ID NO: 9830 - DNA, 153 bp, Artificial Sequence
  Description of Artificial Sequence: Synthetic coding sequence
atggcgggacctgccacgcaatcgccaatgaaacttatggccctgcaactgttgctgtggcattcagcactttggaccgtccaggaagcgaaactccttctgctgaagctgctcctgcttaaacttctgctccttaagctgcttctgctgaaa

SEQ ID NO: 9831 - DNA, 153 bp, Artificial Sequence
  Description of Artificial Sequence: Synthetic coding sequence
atggcggggccggccacgcagtcccccatgaaacttatggcattgcaactccttctttggcactcggcactttggactgtgcaggaagcaaagctgctcctcctgaaactgctgctgctcaagctgcttctgctcaaattgttgttgctgaag

SEQ ID NO: 9832 - DNA, 153 bp, Artificial Sequence
  Description of Artificial Sequence: Synthetic coding sequence
atggcaggcccggctacgcagagtcccatgaagctgatggcactccaactgctgctgtggcatagtgctctctggacggttcaggaggctaaactcctgcttcttaagttgcttctgctgaaactgctgctcctgaagctcctcctgttgaag

SEQ ID NO: 9833 - DNA, 153 bp, Artificial Sequence
  Description of Artificial Sequence: Synthetic coding sequence
atggcggggcctgcaactcagagtccaatgaaactgatggccctccagctgctcctgtggcattccgcactgtggacagtacaggaagccaagttgctgctgctgaagctgctgctgctgaagttgctactactaaagttactgcttctgaaa

SEQ ID NO: 9834 - DNA, 153 bp, Artificial Sequence
  Description of Artificial Sequence: Synthetic coding sequence
atggccggcccagccacccaaagccctatgaagcttatggcccttcagctcctgctgtggcactccgccttatggacagtccaggaagctaagttgctcctgctcaagctgctcttactgaagctgctcctcctgaagctcctactacttaag

SEQ ID NO: 9835 - DNA, 153 bp, Artificial Sequence
  Description of Artificial Sequence: Synthetic coding sequence
atggcgggacccgctacccaaagccccatgaaactcatggccctccagttactgctgtggcactccgctttgtggaccgtgcaggaggcaaagctgttattgctgaagctcctgcttcttaagttacttctgttgaaactcctgctgctgaag

SEQ ID NO: 9836 - DNA, 153 bp, Artificial Sequence
  Description of Artificial Sequence: Synthetic coding sequence
atggccggacctgccacccagtctccgatgaagctgatggctctgcaacttctcctgtggcatagcgccttgtggacagtgcaagaggctaagctgctcctgcttaagctactcctccttaagctgctgcttcttaaactgctgcttctgaaa

SEQ ID NO: 9837 - DNA, 153 bp, Artificial Sequence
  Description of Artificial Sequence: Synthetic coding sequence
atggccggacctgcaactcagtcgccgatgaagctcatggcactgcaactgctcctctggcactcagccttgtggaccgtgcaggaagcaaaactgcttttgcttaagctcctgctcctcaaactgctgctgctgaagttgctcctgctgaag

SEQ ID NO: 9838 - DNA, 153 bp, Artificial Sequence
  Description of Artificial Sequence: Synthetic coding sequence
atggcagggcccgctactcagagcccgatgaagctgatggcactgcagctcctgctgtggcactccgccctgtggactgtgcaggaggcgaaactgctgttgttgaagctgctcctcctgaagttgctgctccttaagctgcttctgctcaag

SEQ ID NO: 9839 - DNA, 153 bp, Artificial Sequence
  Description of Artificial Sequence: Synthetic coding sequence
atggcaggcccagccactcaaagtcccatgaaactcatggccttgcaattacttctttggcatagcgctctttggaccgtgcaagaggccaaattgctgctcctgaaacttctcctccttaagcttttgttactgaagctgctgctgctgaaa

SEQ ID NO: 9840 - DNA, 153 bp, Artificial Sequence
  Description of Artificial Sequence: Synthetic coding sequence
atggcgggaccggccacgcagagcccgatgaagctcatggcacttcagctcttgctgtggcactccgccctttggactgtgcaagaagccaaactgctccttttgaaactgctcctcctcaaactccttctgctgaagttgctgctgctgaaa

SEQ ID NO: 9841 - DNA, 153 bp, Artificial Sequence
  Description of Artificial Sequence: Synthetic coding sequence
atggccggcccagcgacacaatctccgatgaaacttatggcactgcagcttctcttgtggcatagcgctctctggactgtacaagaggctaagctgcttcttctcaaactcttgctcctgaaactcttgctgctcaagttgttgttgttgaaa

SEQ ID NO: 9842 - DNA, 153 bp, Artificial Sequence
  Description of Artificial Sequence: Synthetic coding sequence
atggctggacctgccacccagtcccccatgaaactgatggcacttcaactgctcctgtggcattcggcactctggactgtgcaagaagcgaagctcttgttgcttaaactcctgctgctgaagctccttcttttgaagctgttgctgctcaag

SEQ ID NO: 9843 - DNA, 153 bp, Artificial Sequence
  Description of Artificial Sequence: Synthetic coding sequence
atggccggaccagcaacccagtccccgatgaagttgatggccctgcaattgttgctttggcattccgctctttggaccgtccaagaagcgaagctgctgctgcttaagctgcttctgctcaaactcctccttttgaaactccttctgcttaag

SEQ ID NO: 9844 - DNA, 153 bp, Artificial Sequence
  Description of Artificial Sequence: Synthetic coding sequence
atggctggtcccgcaactcagagccctatgaaacttatggcgctgcagctcctgttgtggcatagtgccttatggacggtccaagaagccaaactgctgctgctgaagttgctgctccttaaactgttgctgttaaagctactactcctgaag

SEQ ID NO: 9845 - DNA, 153 bp, Artificial Sequence
  Description of Artificial Sequence: Synthetic coding sequence
atggcagggcctgctacacagtctccaatgaaacttatggctctccaactacttctctggcactctgctctctggactgttcaggaagccaaacttcttctattaaaactgttactgttaaaactcctgctcttgaagctcctattgctaaaa

SEQ ID NO: 9846 - DNA, 153 bp, Artificial Sequence
  Description of Artificial Sequence: Synthetic coding sequence
atggcgggtcctgctacccaatcacctatgaagctgatggcactccagctgcttctttggcacagcgccttgtggacagtccaggaagcaaagctactcctgctgaagctattacttcttaaactcctgctgttgaagctgctcctcttgaaa

SEQ ID NO: 9847 - DNA, 153 bp, Artificial Sequence
  Description of Artificial Sequence: Synthetic coding sequence
atggctgggccagccacacaaagccccatgaagctaatggcgttgcaactgctcctctggcactccgccttgtggaccgtgcaggaggccaagttactcctgcttaagttgcttctgcttaaactcctgctcttgaaactgctcctactgaag

SEQ ID NO: 9848 - DNA, 153 bp, Artificial Sequence
  Description of Artificial Sequence: Synthetic coding sequence
atggccggaccggcgactcagtctcccatgaaactcatggcgctgcagttgcttttgtggcactctgcgctttggacggtgcaggaagccaagctgctcctcctgaagctcctactgctgaaactgctgctgctgaagttgttgttgctgaaa

SEQ ID NO: 9849 - DNA, 153 bp, Artificial Sequence
  Description of Artificial Sequence: Synthetic coding sequence
atggccggacccgcaacacagtcaccaatgaaactcatggcattacagcttctcctgtggcactcagccctttggacagtgcaggaagccaaactactcttgctgaagctgttgctgcttaaactgttactcttaaaactcctcttactgaag

SEQ ID NO: 9850 - DNA, 153 bp, Artificial Sequence
  Description of Artificial Sequence: Synthetic coding sequence
atggctgggcctgccacgcaatctcctatgaagcttatggccctccagctgctgctgtggcatagtgctttgtggacagtgcaagaggctaaactactgctcctaaaactgctgctgttgaagctcctgcttctcaaactactgctcttgaaa

SEQ ID NO: 9851 - DNA, 153 bp, Artificial Sequence
  Description of Artificial Sequence: Synthetic coding sequence
atggccggaccggcaactcagtccccaatgaaactgatggctttgcagttgctgctgtggcactcggcgctttggaccgtgcaagaagccaagctcctgctcctgaagctgctgcttctgaagttgctcctgctgaaactcctcctgctcaag

SEQ ID NO: 9852 - DNA, 153 bp, Artificial Sequence
  Description of Artificial Sequence: Synthetic coding sequence
atggctgggccagcaactcaatcgcctatgaaactgatggcgctccaactgctgctgtggcacagcgcactgtggaccgtccaggaagcaaagctcctcttgcttaaacttcttctccttaaactccttcttctgaaattgctgctgctgaag

SEQ ID NO: 9853 - DNA, 153 bp, Artificial Sequence
  Description of Artificial Sequence: Synthetic coding sequence
atggccggaccagcgactcaaagccctatgaagctgatggccttgcagctgctgttgtggcattctgcactgtggaccgtgcaggaagctaaactccttttgctgaagttgctgctgcttaagctcctgctgctcaagctcctcttgctgaaa

SEQ ID NO: 9854 - DNA, 153 bp, Artificial Sequence
  Description of Artificial Sequence: Synthetic coding sequence
atggctggacctgctacacagtcaccaatgaagctgatggcgctgcagctcctcttatggcacagcgctttatggactgtccaggaagccaagttgctgttgctaaagcttttgcttttaaagttactgctcctcaagctgctgctcctgaag

SEQ ID NO: 9855 - DNA, 153 bp, Artificial Sequence
  Description of Artificial Sequence: Synthetic coding sequence
atggctggccctgcgacccagagcccgatgaagttgatggccttgcagctgctgttgtggcattcggccctgtggactgtgcaagaagcaaaactcctgctgctgaagctccttctcctgaagctgctccttctgaaactcttgctgttgaag

SEQ ID NO: 9856 - DNA, 153 bp, Artificial Sequence
  Description of Artificial Sequence: Synthetic coding sequence
atggcgggacctgcaactcagtcacctatgaaactgatggcattgcaactgctgctttggcatagcgctctttggactgtccaagaagcaaagctcctcctgctcaagttgctcttgcttaaactgcttctgcttaagttgctcctgctgaag

SEQ ID NO: 9857 - DNA, 153 bp, Artificial Sequence
  Description of Artificial Sequence: Synthetic coding sequence
atggcagggccagctacccagtcacccatgaaactgatggcattgcagctacttctgtggcacagtgccctctggaccgtgcaggaagctaagttgctcctgttgaagctgctgcttctgaagctgttgctcctgaaactgctgctgctcaag

SEQ ID NO: 9858 - DNA, 153 bp, Artificial Sequence
  Description of Artificial Sequence: Synthetic coding sequence
atggccggccctgcaacccagtcccctatgaagctcatggcactgcagctgttgctgtggcactccgctctgtggacagttcaggaagctaaacttctcctgctgaagcttctgctgctaaaattactgttattgaagctcctgcttctaaag

SEQ ID NO: 9859 - DNA, 153 bp, Artificial Sequence
  Description of Artificial Sequence: Synthetic coding sequence
atggccgggcccgcgacacagtctcctatgaagctaatggcattgcagctcttactgtggcattcggccctgtggaccgtgcaagaggcaaagctgttactattgaagcttctgttgttgaagctgctgctcctcaaactgttgctcctcaag

SEQ ID NO: 9860 - DNA, 153 bp, Artificial Sequence
  Description of Artificial Sequence: Synthetic coding sequence
atggctggtccggcaacccagtccccgatgaaactgatggcgctgcaacttcttctgtggcattcggcactgtggaccgtgcaagaagcaaagctcctccttctcaaacttttgctgctgaaactgcttctgctcaaacttctgcttctgaag

SEQ ID NO: 9861 - DNA, 153 bp, Artificial Sequence; identical to SEQ ID NO: 9797
  Description of Artificial Sequence: Synthetic coding sequence

SEQ ID NO: 9862 - DNA, 153 bp, Artificial Sequence
  Description of Artificial Sequence: Synthetic coding sequence
atggccggccccgcaacccaaagccccatgaagctcatggccttacagctcctcctgtggcactccgctttgtggacagtgcaggaggcaaaacttcttctacttaagctgttgttactgaagttgcttttgctgaagttgctgttgctgaaa

SEQ ID NO: 9863 - DNA, 153 bp, Artificial Sequence
  Description of Artificial Sequence: Synthetic coding sequence
atggcaggtccggccactcaatccccaatgaagttgatggcactgcagctgctcctgtggcacagtgccctgtggaccgtccaggaggccaagctgctgctcctgaaattgctccttcttaagctgctgctgttgaaacttctgctgctgaag

SEQ ID NO: 9864 - DNA, 153 bp, Artificial Sequence
  Description of Artificial Sequence: Synthetic coding sequence
atggcaggcccagccacacagtcccccatgaaactgatggcgctgcagctgctcttgtggcactcagccctgtggacggtgcaagaagccaaattgttactgctcaaacttcttcttctgaagcttctgctcctaaagctcctgctgctcaag

SEQ ID NO: 9865 - DNA, 153 bp, Artificial Sequence
  Description of Artificial Sequence: Synthetic coding sequence
atggccggcccagcgacccaatcaccaatgaagctcatggccctgcaactgcttctgtggcattccgccctttggactgtgcaagaagcaaaactgcttctgcttaaactcctgctcctgaagctgttgctgcttaaacttcttctgctgaag

SEQ ID NO: 9866 - DNA, 153 bp, Artificial Sequence
  Description of Artificial Sequence: Synthetic coding sequence
atggccggacctgcaacccagtcgcctatgaaactgatggcacttcaactcctgctgtggcactcggccctgtggactgtccaagaggcaaaactgctgctccttaagctgctgcttcttaaacttcttcttctcaagttgcttctgcttaag

SEQ ID NO: 9867 - DNA, 153 bp, Artificial Sequence
  Description of Artificial Sequence: Synthetic coding sequence
atggccggacctgcgactcagagccccatgaaacttatggcacttcagctcctcctctggcactccgccctttggaccgtgcaagaagcgaagctgcttctgctcaagctcctgctgctcaagctgctgctgcttaaacttcttcttctgaag

SEQ ID NO: 9868 - DNA, 153 bp, Artificial Sequence
  Description of Artificial Sequence: Synthetic coding sequence
atggcaggtcctgcaacgcagtccccaatgaagttaatggcgctgcaactgctactctggcactcggctttgtggacagtccaagaggctaaactgctgcttcttaaattgctgcttcttaaactactattactcaaattgttgctgttgaaa

SEQ ID NO: 9869 - DNA, 525 bp, Artificial Sequence
  Description of Artificial Sequence: Synthetic coding sequence
atggcccctctcggaccaactggtccgctgcctcagagctttctgctcaagtgtctggaacagatgcgcaaggtgcaggccgacggcacagctctccaggagacactgtgcgcaacacaccagctgtgtcaccccgaagaactggtcctgctgggccacgccctgggcattccacagcctcccctctcctcttgttccagtcaggccctgcagctgatggggtgtctccggcagcttcactctggcctgttcctctaccagggactgctgcaggccctggcaggaatttctcctgagcttgcccctacgcttgacactctgcagttggacaccaccgattttgccattaatatctggcagcagatggaggatctgggaatggcacctgcagttccaccaacccagggcacaatgcctgcctttacgagtgcattccagcgacgcgctggcggggtgctggtggcctctaatctccagagttttctcgaactggcatacagggcactcaggcatttcgctaaaccg

SEQ ID NO: 9870 - DNA, 525 bp, Artificial Sequence
  Description of Artificial Sequence: Synthetic coding sequence
atggctcctctgggtccaactggtccgctcccccaatctttcctgcttaagtgcctggagcagatgagaaaggtccaagccgatggcaccgccttgcaggaaaccctttgtgcgactcatcaattgtgccatccagaagagttggttctgctgggacacgccctgggcattccgcaaccccccctcagctcctgctcatcccaggcgctccagttgatgggctgtctgaggcagttgcattccggcctcttcctgtaccaaggcctgctccaggccctggcgggtatttcccctgagctggctccaaccctcgataccctacaacttgacacgactgacttcgctatcaatatctggcaacagatggaggacctcggcatggcccctgctgtcccccctactcaaggtactatgcccgccttcacgtctgcgttccagaggcgtgctgggggcgtccttgtcgctagcaacttgcaaagcttcctggagcttgcgtaccgggcgctgcggcattttgctaagcca

SEQ ID NO: 9871 - DNA, 525 bp, Artificial Sequence
  Description of Artificial Sequence: Synthetic coding sequence
atggccccccttggccccaccggtccattgccccaatccttccttttgaaatgcctcgaacaaatgagaaaggtgcaggccgatggtaccgctctgcaggagaccctctgcgctacacaccaattgtgccaccccgaggagctggtgctgctgggccatgcactgggaatccctcagcctcccctctcttcatgctccagccaagctcttcagcttatgggttgcttgaggcagctgcattctggtttgttcttgtaccaaggcttgttgcaggcactggctggaatctccccagagctggcccccaccctggacactctgcagttggacacaactgatttcgctatcaatatttggcagcagatggaggatcttggcatggctccagcagttccacccacccagggaaccatgcccgctttcacctcagcattccagcgtagagcaggcggtgtgcttgtagctagcaatctccaatcctttctggaactggcttatagggccctccgccacttcgctaagcca

SEQ ID NO: 9872 - DNA, 525 bp, Artificial Sequence
  Description of Artificial Sequence: Synthetic coding sequence
atggcaccgctgggtcccacgggaccgctgccacaatcgtttctgctcaagtgcctcgagcaaatgcgaaaagtccaggctgatggcacggcactccaggaaaccctgtgtgcgactcatcagctgtgtcacccagaagagctcgtgctcctcggacacgcactcgggatcccccagccccctctgtcgtcatgctcaagccaggctctgcagctcatggggtgcttgaggcagctgcactctgggttgttcttgtaccaaggcctgctccaagcactcgctggaatatcccctgaactggccccgactctggacaccctccaattggacaccactgacttcgcgatcaacatctggcagcagatggaagatcttggcatggccccggccgtgccgccaacccaggggaccatgccagccttcacttcggccttccagcggcgcgccggaggagttctggtggcaagcaatctccaatcgtttcttgagcttgcgtaccgcgcgctgcggcatttcgctaagcca

SEQ ID NO: 9873 - DNA, 525 bp, Artificial Sequence
  Description of Artificial Sequence: Synthetic coding sequence
atggcgccgctaggtccgacgggtccgttaccgcaatcgtttttactaaaatgtttagaacaaatgcgaaaagtacaagcggatggtacggcgttacaagaaacgttatgtgcgacgcatcaattatgtcatccggaagaattagttttactaggtcatgcgttaggtataccgcaaccgccgttatcgtcgtgttcgtcgcaagcgttacaactaatgggttgtttacgacaactacattcgggtctatttctatatcaaggtctactacaagcgttagcgggtatatcgccggaactagcgccgacgttagatacgctacaactagatacgacggattttgcgataaatatatggcaacaaatggaagatctaggtatggcgccggcggttccgccgacgcaaggtacgatgccggcgtttacgtcggcgtttcaacgtcgagcgggtggtgttttagtagcgtcgaatttacaatcgtttttagaactagcgtatcgtgcgttacgtcattttgcgaaaccg

SEQ ID NO: 9874 - DNA, 525 bp, Artificial Sequence
  Description of Artificial Sequence: Synthetic coding sequence
atggccccactgggtcctacggggcccctgccccagtccttcctgctgaaatgtctcgaacagatgcgtaaggtccaagcggacggaaccgcactgcaagaaaccctgtgcgctacccaccaactttgccaccctgaagagctggtgcttctcggacatgccctcggaatcccacagccgccgctgtcaagctgctcgagtcaggccctgcaactcatgggctgcttgaggcagctccattcaggcctgttcctctaccagggcctgctgcaggccctcgcaggcattagcccagagctcgcgcctacccttgacacgttgcaactggacacgaccgattttgctataaacatctggcaacagatggaggatctcggaatggccccagccgtgcctcccactcagggaactatgccagcctttacctccgccttccagcgccgggcgggtggagtcctggtggcctcgaatctgcaatcgttcctcgaacttgcatacagagcgctccgccacttcgcgaagcct

SEQ ID NO: 9875 - DNA, 525 bp, Artificial Sequence
  Description of Artificial Sequence: Synthetic coding sequence
atggctccactgggacctacggggccactcccacagagctttctgctgaaatgtttggagcagatgaggaaagtgcaagccgacgggactgctctgcaggaaacactgtgtgccacccatcagctgtgtcaccccgaggaactggtgttgttgggccacgctctgggcattccgcagccgcccctgtcatcctgctcctctcaggccctgcagttgatgggttgtctgcgacagcttcactcgggcctgttcctctaccagggcctactgcaggccctcgctggaatatcacctgagctggccccaaccctcgacaccctccagctggacactaccgatttcgccattaatatatggcagcagatggaggatttagggatggccccagcggtgccacccacgcaagggaccatgcctgcattcacatccgccttccagcgccgtgcagggggcgtgctggtggcaagtaatctccagtccttcttagagttggcatatcgagccctccgtcacttcgccaagccc

SEQ ID NO: 9876 - DNA, 525 bp, Artificial Sequence
  Description of Artificial Sequence: Synthetic coding sequence
atggccccactgggacctactggaccattgccccagagctttcttcttaaatgtctggagcagatgagaaaggtgcaggctgatggtactgcattgcaagaaactctttgcgcgacccaccagctctgccatccagaggaactggtgctcctcggacatgccctgggaatcccacaaccaccactgagctcatgttcatcgcaggctctgcagctgatgggctgcctgagacagctgcatagcggactgttcctgtaccagggcctcctgcaggccctggccggaatcagcccagaactggccccaaccctcgacaccctccagctcgacactaccgacttcgccatcaacatctggcagcagatggaggacttgggaatggcgccagcggtgccgccgacccaggggactatgcctgccttcacctcagccttccagagacgcgccggcggagtccttgtcgcttccaacctgcaatcgttcctggaactcgcgtaccgggctctgcgccacttcgcgaagccg

SEQ ID NO: 9877 - DNA, 525 bp, Artificial Sequence
  Description of Artificial Sequence: Synthetic coding sequence
atggcccccctcggtcccaccggccccctgccacagtctttcctgctgaagtgtttggagcagatgcggaaagtgcaagcagacggcaccgcgctgcaggagactctgtgcgccacccatcagctgtgtcaccctgaggaactggtactcttaggccacgcgcttgggataccccagccacctctgtcctcttgcagctcccaggcccttcaacttatgggttgccttagacagctgcatagtgggttgttcttgtatcagggtcttctgcaggctttggcggggatttctcccgagctggcccctaccctggacaccctgcagctagatacaacagacttcgctatcaacatctggcagcagatggaggatctgggtatggccccagccgtgcctccaacccaggggactatgcctgcttttacaagcgctttccagagacgggccggaggcgtgctagttgcctccaacctgcagtctttcctcgagcttgcctaccgcgcactgagacacttcgccaaacct

SEQ ID NO: 9878 - DNA, 525 bp, Artificial Sequence
  Description of Artificial Sequence: Synthetic coding sequence
atggcaccgctgggtccaacgggcccacttcctcagtcgttcttgcttaagtgcctggaacagatgcggaaagtccaagcagacggaaccgcactgcaggaaacgctttgcgctacccatcaactgtgtcaccctgaagaacttgtcctccttggccatgcactcggtattcctcaacctcccctctcgagctgcagcagccaggctttgcaactgatgggttgccttaggcagttgcatagcgggctgtttctgtaccagggcctccttcaagccctggcgggaatctccccggaacttgcccccactctcgatactctgcagcttgatacgacggatttcgcgatcaatatctggcaacagatggaggatctgggtatggcaccagctgtccctcccactcaagggaccatgcctgcatttacctcggcctttcaacgtagggcgggaggcgtgctcgtggcatcaaatctccagagcttcctggagcttgcatacagagcccttcgccacttcgccaagccg

SEQ ID NO: 9879 - DNA, 525 bp, Artificial Sequence
  Description of Artificial Sequence: Synthetic coding sequence
atggcaccccttggacctacgggtccacttccacagtctttcttgctgaagtgtctcgaacagatgcgcaaggtgcaggcagatggcactgccctgcaagaaactctgtgtgcaacccaccaactctgccatcccgaagaacttgtcctccttggacacgcactgggaatcccacagcctcctctcagctcctgctcctcccaggcacttcagcttatgggttgcctcagacagcttcattcagggctctttctgtatcaaggccttcttcaagctctggcaggcatcagccctgagctggcacctaccctggatactcttcagctggatactaccgattttgcgattaacatatggcagcaaatggaagatctgggtatggctcccgcagtcccacctacccaaggtacgatgcctgcatttacttcggcctttcaaaggcgtgcaggtggcgtcctcgtcgccagcaaccttcaatcattccttgagttggcatacagagcgcttagacattttgcaaaacct

SEQ ID NO: 9880 - DNA, 525 bp, Artificial Sequence
  Description of Artificial Sequence: Synthetic coding sequence
atggcccctctggggccaactggcccactgccacagtcgttcctcctgaaatgcctggaacagatgaggaaggtgcaggcggatggtaccgcactgcaggaaaccctgtgtgcaacgcaccagctctgccaccccgaagagttggtgctcctcggacatgcgctcggaataccccaaccgcccctctcatcatgctcaagccaagcacttcagctgatgggatgcctcagacaactccactccggactgttcctgtaccagggccttttgcaagcactcgcgggtatctctcctgaattggctccaactctggacactctgcagttggatactaccgactttgccatcaacatttggcaacagatggaggacctcgggatggcgccggccgtcccgccgacccaaggaaccatgccggccttcacttctgccttccagagacgggccggtggcgtgctggtagcttcgaatctgcagtcgtttctggagctggcctaccgagcgctgcggcatttcgccaagccg

SEQ ID NO: 9881 - DNA, 525 bp, Artificial Sequence
  Description of Artificial Sequence: Synthetic coding sequence
atggcccccctgggccctaccgggcccctgccgcagtcattcctgctgaagtgtctggagcagatgagaaaagtgcaggccgatgggaccgcgctgcaagagaccctctgcgccacccaccagctgtgccatcccgaggagttggtgttgctcggccatgctctgggcataccacagccaccgctgtcatcttgctcttcgcaagctctccaacttatggggtgtttgagacagttacacagtggcctgtttttgtaccagggactgctccaggccttggctggaattagccccgagcttgctcctacccttgacacactccagctggacactacagactttgcgattaacatttggcaacagatggaggacctgggcatggcacccgcagtaccccccactcaaggaacgatgcccgccttcacctccgcattccagcgtcgggccgggggggtccttgtagctagcaatctccaatcgttcctagagctcgcatatcgggctctccgccattttgcaaagccc

SEQ ID NO: 9882 - DNA, 525 bp, Artificial Sequence
  Description of Artificial Sequence: Synthetic coding sequence
atggcaccgctcgggcctactggccccctgccccaaagtttcctcctgaagtgcctagaacagatgagaaaagtgcaggccgatggcaccgcactgcaggagaccctgtgtgctacccaccagctctgccatcctgaagagcttgtcctgttgggccatgccttaggcataccgcagccaccgctgagttcgtgcagtagccaggctttacagctgatggggtgcctgcgacaactgcactcgggacttttcctgtaccaagggctcctccaggcactggctgggatctcccccgagttggccccgaccctggatactctgcagctcgacactactgactttgctataaatatttggcagcagatggaagatcttggtatggcaccagcagtaccgcccactcaaggtactatgcctgccttcacatccgccttccagagacgagctggtggagtcttagtggccagcaacctgcagtcgtttctggaattggcctatagggcgctgaggcattttgccaagccc

SEQ ID NO: 9883 - DNA, 525 bp, Artificial Sequence
  Description of Artificial Sequence: Synthetic coding sequence
atggcccccctgggacccactggtccactgccgcaatcctttctcctcaagtgcctcgaacaaatgcgcaaggttcaagcggatggaacggcgttgcaggaaaccctgtgcgccacccatcagctctgtcaccccgaagaactggtcttgcttgggcatgctcttggtatcccccaacctcctctctcgtcatgctcgagccaggcactgcagctcatgggatgcttgcggcaactgcattccggcttgttcctgtaccagggcctgctgcaggcccttgcaggcatcagcccggaattggcccctacgcttgacaccctgcaacttgacaccaccgactttgcgatcaacatctggcagcagatggaggacctgggcatggcgccagctgtgccaccaactcaaggtaccatgcctgccttcacctcggccttccagcgacgggcgggaggagtcctggtcgcatctaatctgcaatcgttcctcgaactggcctaccgggcccttcgccacttcgctaagcca

SEQ ID NO: 9884 - DNA, 525 bp, Artificial Sequence
  Description of Artificial Sequence: Synthetic coding sequence
atggcgcctctcggtccgactggcccgttgccgcaatccttccttttgaagtgcctcgaacaaatgcgcaaagtgcaggctgatggtactgccctccaggaaaccctgtgcgctacccaccagctgtgtcacccggaggaactggtccttctcggccacgccctggggatcccgcaaccaccgctgtcgtcctgctcgtcgcaagccctgcagctgatggggtgccttaggcaattgcattccggcctcttcctctaccagggattgctgcaggcattggcgggaatctcaccagaactggcaccgactctcgataccttgcagctggacactacggacttcgcgatcaatatctggcaacagatggaggacctcggaatggcccctgccgttcctccaactcagggaaccatgccggcattcacgtcagcttttcagagacgggcgggaggggtgctggtggcgtcaaatctgcagtcgttcctggaactggcatacagagccctgcgccacttcgcgaagccc

SEQ ID NO: 9885 - DNA, 525 bp, Artificial Sequence
  Description of Artificial Sequence: Synthetic coding sequence
atggcgccgctgggaccgactggtccactcccacagtcgttcctgctgaaatgcctggagcagatgcgcaaagtgcaggctgacggaacggcgcttcaggaaactctgtgcgccacgcaccaactttgccatccagaagagctggtcctgctcgggcacgccctgggcatcccgcagcccccgctctcgtcctgttcctcccaagctcttcaactgatggggtgtctgcgccaactccattcgggactttttctgtaccaaggactcctccaggcgctggccgggatctctcccgaactggcccctactctcgatacgctgcagctggacactacggacttcgccatcaacatctggcagcaaatggaagatctcggcatggccccagcggtcccaccgactcagggtaccatgccggctttcacctcagcgttccagcgccgcgccggtggcgtcctcgtggcgtccaatctgcagtcattcttggagctggcttacagggccctccggcacttcgccaagcca

SEQ ID NO: 9886 - DNA, 525 bp, Artificial Sequence
  Description of Artificial Sequence: Synthetic coding sequence
atggccccacttggcccgacaggtcccctaccgcagagcttcctgctaaagtgcctggagcagatgcgcaaagtgcaggcggatggcaccgccctgcaggaaacgttgtgtgccacacaccaactctgccatcctgaagaactagtactgttgggtcatgcgctagggatcccacagccacctctttcttcctgcagcagtcaggccttacagctgatgggttgtctgcgacagctacatagcggcttgttcctgtatcagggactcttacaggccctggccgggatttctcctgagttggccccaacactggataccctgcagttagatactaccgacttcgccataaatatctggcagcagatggaagacctaggaatggcccccgccgtgccgccgactcaggggacgatgcccgcctttacaagcgcctttcagcgacgcgcgggcggtgtcctagtggcgtctaacctgcagtccttcttggaactggcgtatcgagcgttgcggcactttgctaagccg

SEQ ID NO: 9887 - DNA, 525 bp, Artificial Sequence
  Description of Artificial Sequence: Synthetic coding sequence
atggctccgcttgggcctactggacccctgcctcaatctttcctcctgaagtgtcttgaacagatgagaaaggtccaggcggatggaacagccctgcaggagaccctgtgcgctacccaccagctgtgccatcctgaggagctggtgctcctgggccacgctctgggaattccacaaccgcctctgagctcttgttcttcacaggcattacagctgatgggatgtcttaggcagctccactcgggattattcctgtaccagggtcttctgcaagccctggccggcatatctccggagctggcccccacactagacacccttcaacttgacacgaccgatttcgccatcaatatttggcagcagatggaagatctgggaatggccccggcggtgcccccaacccaggggacgatgccagcctttaccagtgcttttcagaggcgcgcagggggagtcctcgtagccagcaacttgcagagctttctggaactggcctacagggcccttaggcactttgccaagccc

SEQ ID NO: 9888 - DNA, 525 bp, Artificial Sequence
  Description of Artificial Sequence: Synthetic coding sequence
atggcccccttgggccccactggccccctgcctcagtcgttcctgttaaagtgtctggagcagatgcggaaagtgcaagccgatggaacagctttgcaggaaaccctctgcgcaactcaccagctgtgccatccagaggaactggtcctgctagggcatgccctggggatacctcagccccctctctcctcttgtagttcccaggccctgcagctgatgggctgcctgcggcagttgcacagtggtctgttcttataccagggactgctgcaggccttggccggaatcagcccagagctggcccccacactagatacccttcagttagatacgacggacttcgcaattaacatctggcagcagatggaggacctgggtatggctccagccgttccacccacacagggcaccatgccggcttttactagcgccttccagagacgcgctggaggggtgttagttgcatcgaacctacaatcttttctggagctcgcatatcgggcgcttcgccattttgcgaagccg

SEQ ID NO: 9889 - DNA, 525 bp, Artificial Sequence
  Description of Artificial Sequence: Synthetic coding sequence
atggccccactgggaccgacggggccgcttccacagtcctttctgctcaagtgcctcgagcagatgcggaaagtgcaggcggatggaactgcattgcaggaaaccctctgcgctactcatcagctgtgccaccccgaagaactggtgctgctcggccacgcccttggaatcccacagcctccgttgagctcgtgttcctcccaggctctgcaacttatgggctgcctccgccaactgcactcaggactgttcctgtaccaagggctgctgcaagcactggctggaatttcgcctgaactggcaccgactttggataccctccagctcgacaccactgacttcgcgatcaatatctggcaacagatggaggacctcggcatggcaccggccgtcccaccgactcaaggaaccatgcctgccttcacctcggccttccagcggagagcgggtggtgtcctggtggcgagcaacctgcagtcatttctggagctcgcgtacagggccttgcgccatttcgccaagccc

SEQ ID NO: 9890 - DNA, 525 bp, Artificial Sequence
  Description of Artificial Sequence: Synthetic coding sequence
atggctcccctgggaccaaccggccccctaccccagtcctttttgcttaaatgcctcgaacagatgcgcaaagttcaggcggatgggactgcacttcaggaaacgctgtgcgccacccatcagctctgccatcctgaggaactcgtcttattgggacacgccctcgggatcccccagccaccattaagcagttgcagttcgcaggccttacagctgatgggctgtctcagacagctccatagcggattgttcctataccaggggctgttacaagcccttgctggaatctctcctgagttggcgccaaccctggatacattgcagctggatacgacagacttcgcgatcaatatttggcagcagatggaggacttagggatggcccctgccgttcctcccacccagggaacaatgcccgcgttcacatcggctttccagcgtcgggccggaggagtattggtagcttcgaacctccaatcttttttagagctcgcatacagggcgctgcgacatttcgctaaaccg

SEQ ID NO: 9891 - DNA, 525 bp, Artificial Sequence
  Description of Artificial Sequence: Synthetic coding sequence
atggcaccattgggacctacaggacccctcccccaatcttttctccttaaatgcctcgagcagatgcgcaaggtgcaggccgacggcaccgccctccaggaaaccctgtgtgctacacaccagctgtgccatccagaggaactagtgttgctgggacacgctttggggattccgcaaccccccctcagctcctgtagtagccaggctctgcagctgatggggtgcctgaggcagttgcattccgggttgtttctttaccaggggctgttgcaagcactggccgggatctcccctgagctcgctcccaccctcgatactcttcagctcgacacaactgattttgccattaatatttggcagcagatggaagatttgggaatggctccggccgtcccaccaactcaagggacaatgccggcatttacgtctgctttccagaggagggcgggaggagtcttggtggcctctaacctgcagtcatttctcgagttagcctatcgggctctgcggcactttgccaagcct

SEQ ID NO: 9892 - DNA, 525 bp, Artificial Sequence
  Description of Artificial Sequence: Synthetic coding sequence
atggctcctctgggacccaccggacctttgccacaatcttttcttctgaagtgtctagaacagatgcgaaaagtccaggctgatggcaccgctctgcaggaaaccctttgcgctacacaccagctgtgtcaccctgaggagctggttctgctgggccatgccctgggcatcccccagcccccgctatcctcctgcagctctcaggccctacagctgatggggtgtctgaggcagcttcacagcgggctttttctgtaccaggggttactccaggcactggcaggaatcagtcccgaattggcacccactctggatacactgcagctcgatacaacggactttgccatcaacatctggcagcagatggaggatctcggcatggctccagccgtgccccccacgcagggcaccatgcctgccttcactagcgcatttcagaggcgagctggtggggtgttggtggcgagcaatttgcagtcatttctagagctggcctacagggcactgcgacactttgctaagcca

SEQ ID NO: 9893 - DNA, 525 bp, Artificial Sequence
  Description of Artificial Sequence: Synthetic coding sequence
atggcacccttgggcccaacaggacctctaccccagtcgttcctcctgaaatgcttagagcagatgcggaaggttcaagccgacggtacagcgctgcaagagacgctgtgcgcaacccaccagctgtgtcaccccgaggaactggtgttgctcggacacgccctgggcatacctcagccacccctctcatcctgctcgtctcaagcgctccagttgatgggctgcctgagacagctgcattctggcttattcctgtaccagggacttcttcaggccctggcaggcatatccccagagctggctccaactttagatacactccagttggacacgaccgactttgctattaacatatggcagcagatggaggatctaggtatggcccccgccgtcccccctacccaggggaccatgccggctttcacgtccgcttttcaacggcgcgccggaggcgttctggtggcctctaacctgcagtcctttctcgaactggcctaccgtgcactgaggcactttgctaaacca

SEQ ID NO: 9894 - DNA, 525 bp, Artificial Sequence
  Description of Artificial Sequence: Synthetic coding sequence
atggctcctttaggacctacaggaccactgcctcaatcttttctgctgaagtgtttggagcagatgagaaaagtccaggcagacggtaccgctttgcaagaaaccctgtgcgcaacccatcagttgtgtcatcctgaggaacttgttctccttgggcacgccctgggcatcccgcagccacccttatccagttgctcttcgcaggccctgcagttaatgggatgtctcaggcaacttcatagcggcctgtttttatatcagggactgctgcaggctctggcaggtatatctcctgaactggcccctaccctggacactttgcagctggataccacagacttcgcaataaacatctggcaacaaatggaggacctgggaatggcacccgctgtcccacctacacagggaacgatgccggcgttcacatctgcattccaaagacgggccggcggcgtgctggtggcgtcaaatcttcagagcttcctcgaattggcctacagagctctcaggcactttgccaaaccc

SEQ ID NO: 9895 - DNA, 525 bp, Artificial Sequence
  Description of Artificial Sequence: Synthetic coding sequence
atggcacccctgggtcctaccggacctctccctcaaagtttcttgttgaaatgtcttgaacagatgcggaaagtgcaggccgacgggaccgccctccaggaaaccttgtgtgccactcatcagctctgtcaccccgaagagctggtgctcctcgggcatgctctcggcattccacagcccccccttagcagctgcagctcccaggccctccagttaatgggttgtctcagacagctccactctggactatttctataccaggggttgcttcaggccctggcaggcatatcgcccgagttagccccgacgctggacactttacagttggataccactgactttgccatcaatatatggcagcaaatggaggatctcggaatggccccggccgtgccacctacgcaaggcactatgcccgctttcacatccgccttccaacgccgtgccgggggggtgttagtagcatcaaacctgcagtcctttttggagctagcttatcgggccttgcgtcacttcgctaagccg

SEQ ID NO: 9896 - DNA, 525 bp, Artificial Sequence
  Description of Artificial Sequence: Synthetic coding sequence
atggccccactcggaccgactggcccgcttcctcagtcctttctccttaaatgtctcgagcagatgcggaaggtccaggcggatggtacggcgctgcaagaaaccctgtgtgcgacccatcaactttgtcatcctgaggaactggtgctcctggggcatgccttgggaattcctcagcccccactgagttcgtgctcctcccaagccctgcaactcatggggtgtttgagacagctccactctggtcttttcttgtaccagggactccttcaagcccttgccggtatctcgccggaacttgcacctactctcgacactctgcaactggacaccactgatttcgcaattaacatctggcagcaaatggaggatctcggaatggcacctgccgtcccacccacccaaggaacgatgccggcatttacctcggcatttcagcgacgcgcaggcggcgtgcttgttgcttctaatctgcagagctttcttgaactggcgtaccgtgcattgcgacatttcgcgaagccg

SEQ ID NO: 9897 - DNA, 525 bp, Artificial Sequence
  Description of Artificial Sequence: Synthetic coding sequence
atggctcccctggggcctaccggaccgcttccacagagctttttattgaaatgtctggagcagatgaggaaggtgcaggccgacggaactgccctgcaggaaacactgtgcgctacacaccagctgtgccacccagaagagctggttcttctggggcacgcccttggcattcctcagcctccactcagttcctgtagcagccaggctctgcagcttatggggtgtctgcggcagcttcattctggtctatttctctaccagggcctccttcaggctcttgccggtatcagtcccgaattagcccccaccctcgatacattacaacttgatacaactgacttcgcaattaacatatggcagcagatggaagatcttggaatggctccagcagtgccacctacacaaggtaccatgcccgcttttacctctgcctttcagcgcagagccgggggcgtccttgtggcctccaacctgcaatcctttttggaattggcctatcgggcgttaagacatttcgctaagccc

SEQ ID NO: 9898 - DNA, 525 bp, Artificial Sequence
  Description of Artificial Sequence: Synthetic coding sequence
atggcgcctcttggaccgaccggaccgctgccgcaatcatttctcctcaagtgcctcgaacagatgagaaaagtgcaggccgacggaactgctctccaagaaaccctgtgcgcgacgcatcagctctgccacccagaagagctggtgctgctgggccacgctctcggaatcccgcagccgccactctcctcgtgctcgtcgcaagccctgcagctcatgggatgcttgcgccagctgcacagcggactgtttctctaccagggactcctgcaagcgctggctggcatctccccggaactggcgccgaccctcgacaccctgcaactcgacactactgatttcgccatcaatatctggcaacagatggaggacctgggaatggcgccagccgtcccacctacccaggggactatgccggctttcacctcggccttccagcggcgggcaggaggagtgcttgtggcgagtaacctgcaatcattcctggagctggcataccgggctctgcgacacttcgcgaagccg

SEQ ID NO: 9899 - DNA, 525 bp, Artificial Sequence
  Description of Artificial Sequence: Synthetic coding sequence
atggcgcccttaggtcccaccggccctctgcctcagagctttctcttaaagtgcctggaacagatgcgaaaggtgcaagcagatggaacagccttgcaggaaactttatgtgccacgcaccagttatgtcatcccgaagagctggtgttgttaggccatgctcttggaatcccccagcccccgctaagttcatgttctagtcaggccctgcagcttatgggctgcctgaggcagctgcatagtggactgttcctctatcagggactcttgcaggctctcgcgggaattagtccagagctcgcccctactctggatactttgcagctggacactactgacttcgccattaacatttggcaacaaatggaggatcttggaatggcgcccgccgtaccaccgacacaaggcaccatgccagccttcacgagtgctttccagcggcgtgccggcggagttctggttgcctctaacctccagtccttcctggagctggcgtatagagctttgcgtcacttcgcaaagcct

SEQ ID NO: 9900 - DNA, 525 bp, Artificial Sequence
  Description of Artificial Sequence: Synthetic coding sequence
atggcgccgttgggccctactggacctctgcctcaatcctttctgctgaagtgcttggagcaaatgagaaaggtccaggctgacgggaccgctttgcaggaaacattgtgtgccacccaccaactctgtcatccagaagagctagtactgttaggtcatgcactgggtataccacagcccccactgtctagttgtagtagccaggcgcttcagctgatgggctgtcttaggcagctccacagcgggctcttcttgtaccagggcctacttcaggcgttggctgggatcagccctgaattggcaccaaccttggatactctgcagctggatactactgactttgccataaacatctggcagcagatggaagacttaggtatggcaccagcagtcccacctacacaaggaaccatgcccgcttttaccagcgcttttcagaggcgagcgggaggggtccttgtagcatctaatttgcagagtttccttgaattagcttaccgggcgttgagacacttcgccaagccg

SEQ ID NO: 9901 - DNA, 525 bp, Artificial Sequence
  Description of Artificial Sequence: Synthetic coding sequence
atggcccctctgggccctacaggacccctcccgcagtcctttcttctgaaatgcctcgaacagatgagaaaagttcaggctgacgggacagccctccaggagaccttgtgcgccacccaccagctgtgtcatccagaggagcttgtcctgcttggtcacgcgctgggaattcctcagccacctctgtcctcatgcagctcccaggctcttcaactgatggggtgtcttagacagcttcattccggactgtttttgtatcaaggattactgcaggcactcgccggaatctctccggagttggctccgacacttgataccctgcaacttgacacaaccgacttcgctatcaatatttggcaacagatggaggacttgggcatggcccctgcagtgcctcctacccaaggtacaatgccagcatttacaagtgcatttcagagaagagctggaggagtactcgtcgcaagcaaccttcagtccttcctcgaactggcatacagggctctgaggcatttcgcaaaacct

SEQ ID NO: 9902 - DNA, 525 bp, Artificial Sequence
  Description of Artificial Sequence: Synthetic coding sequence
atggctcctctgggacctactggacctcttccacagtcgtttctcctgaaatgcctggagcaaatgcggaaagtgcaagcggacggtaccgcccttcaagaaaccctgtgtgccacgcatcagctgtgtcatcccgaagaattggtcctgcttggacatgcactcggtattcctcaacctccacttagctcatgcagcagccaggccctgcaactcatggggtgccttcggcagctgcatagcggtctgtttctgtaccaaggtcttttgcaggcacttgctggcatttcgcctgagcttgccccgactctggacactcttcagctggacaccaccgattttgcgattaacatctggcaacagatggaggatcttggaatggctccagcagtcccaccaactcagggcactatgcccgcctttacttccgcgtttcagcggcgagcagggggagtgttggttgcgagcaatctgcaatcatttcttgaactggcgtaccgtgcactccgtcacttcgccaagccc

SEQ ID NO: 9903 - DNA, 525 bp, Artificial Sequence
  Description of Artificial Sequence: Synthetic coding sequence
atggccccactcggcccgactggaccgctgccgcagagctttctgctgaagtgcctcgagcagatgcgaaaagtgcaagccgacggaactgcattgcaggaaactctgtgcgcaacccaccagctttgtcatccagaagaacttgttctgctgggacatgctctggggatcccgcagccacccctctcgtcatgctcgtctcaggcactgcagttgatgggatgcctcagacagctccactccggactgttcctgtatcaggggttgctgcaggctctggccggcattagcccagagctcgcgccgaccctcgacacgctgcaactcgacactacggatttcgctatcaatatctggcagcagatggaagatctcgggatggctccggcggtccctccgacccaaggaaccatgccagctttcaccagtgcgttccaacgtcgggcgggtggcgtgctggtggccagcaacctccagtcgttcctcgagctggcgtaccgcgccctgcggcattttgcaaagccg

SEQ ID NO: 9904 - DNA, 525 bp, Artificial Sequence
  Description of Artificial Sequence: Synthetic coding sequence
atggctccacttggcccgaccggaccgctgccgcagtccttcctgctgaaatgccttgaacaaatgagaaaggtgcaggcggatggcactgccctccaggagactctgtgtgcaacccaccaattgtgccacccggaggaacttgtcctccttggacatgcactgggaatcccgcagccaccgctctcttcatgctcgagtcaggccttgcagttgatgggatgtctgcgacagctccactcaggactgttcctgtaccagggtctgctgcaggcgttggctggaatttcgccagaactcgcacctacgctggatacgctccagctggatactaccgatttcgcgatcaacatttggcagcagatggaggacttggggatggcgccagcggtccctccgactcaggggaccatgccggcattcacgtccgccttccagcgcagagctggaggggtgctggtggcctcaaatctgcaatcgtttcttgaactggcctaccgggccctgcggcattttgccaaacca

SEQ ID NO: 9905 - DNA, 525 bp, Artificial Sequence
  Description of Artificial Sequence: Synthetic coding sequence
atggcacctctcggacccactggacccctgccacagagctttctcctgaaatgtcttgaacaaatgcgcaaggtgcaggcagatggaaccgcactccaggagactctttgtgctacccaccagctttgccacccagaagaactggtgctgcttgggcatgcgctcggcatcccacaaccgccccttagttcatgttcgagccaagcactccagctgatgggatgccttcggcagcttcattcgggcctctttttgtaccagggcctcctccaggcactggccggcatttctccagaactggcgcctacccttgatactctgcaattggacactaccgactttgccattaacatctggcaacaaatggaggatctgggaatggcccctgcagtgccccctacccaaggaacgatgcctgcattcacctcggccttccagcgaagggcaggtggagttctggtagcatcaaatcttcaatcatttctggagcttgcctatagggctcttagacatttcgcaaagcct

SEQ ID NO: 9906 - DNA, 525 bp, Artificial Sequence
  Description of Artificial Sequence: Synthetic coding sequence
atggccccactcggaccgactggaccactcccgcaatcgttcctcctcaagtgccttgaacagatgagaaaagtccaagcggacggcactgctctgcaggagactctctgcgcgactcatcaactgtgccatcctgaggaactggtgctgctgggccatgccttggggatcccgcagccgcctttgtcctcatgctcatcgcaagctctgcaactcatgggctgcctgagacagcttcacagcggcctttttctctatcagggactgctgcaagcgctcgctggaatctcgccggagctggccccaacgctggataccctgcagctggataccaccgattttgccatcaatatctggcagcagatggaggacctgggaatggcgccagccgtcccgccgacccagggtactatgccggccttcactagcgctttccagagaagggcaggaggggtcctggtggcatcaaacctgcagtcgttccttgaactcgcctaccgcgccctgagacacttcgccaaaccg

SEQ ID NO: 9907 - DNA, 525 bp, Artificial Sequence
  Description of Artificial Sequence: Synthetic coding sequence
atggctccgcttggacccaccggccctctgcctcagtctttcctgctgaagtgcctggaacagatgcggaaggtccaggcagacggcaccgctctgcaagagacactctgtgccacgcaccaactctgccatccagaggagctcgtgcttctgggccatgcattgggaattcctcaaccacctctctctagctgtagttcacaggccctgcagttgatggggtgtctgcgccaactgcactctgggctgtttctgtaccagggacttcttcaggccctggccggcatatccccagaactggctccaacacttgatacgttgcagctggacactaccgatttcgctatcaatatctggcagcaaatggaggaccttgggatggcccctgcggtgccgccaacccagggaacaatgcccgccttcacctccgcttttcaacgcagggctggcggtgttttggtggcatctaatctgcagtccttcctggaactggcttatcgggccttgagacatttcgcaaagcct

SEQ ID NO: 9908 - DNA, 525 bp, Artificial Sequence
  Description of Artificial Sequence: Synthetic coding sequence
atggcgccccttgggcctaccggtcctctcccccagtcttttctgctgaaatgtctcgagcaaatgaggaaagtgcaagctgacggtaccgcattgcaggagaccctgtgtgctactcatcagctctgccaccctgaggaacttgtgctgctgggacatgctctgggaataccacaaccgcctctgagttcatgctcaagccaggctttgcagctcatgggctgcctgaggcagctgcatagcggcttgttcctataccagggtctactgcaggccctcgcaggaatttcccccgaactcgctcctactctcgatactctccagttggataccactgatttcgcaatcaacatttggcagcagatggaagatctggggatggcgcccgccgttccgccgacacagggaactatgccggctttcacttccgcttttcaaagaagggccggtggtgtgctcgtagccagcaaccttcagagctttctagaactcgcatatcgagctcttcgacactttgccaaaccc

SEQ ID NO: 9909 - DNA, 525 bp, Artificial Sequence
  Description of Artificial Sequence: Synthetic coding sequence
atggcgcccctcggtccgactggtccccttccacaatccttcctccttaagtgccttgagcaaatgagaaaagtacaagcggatggcactgctttgcaagaaaccctgtgcgctacccatcaactttgtcacccagaagagcttgtgctgctgggccatgctctcgggatccctcaacccccactgagctcctgctcctcgcaagcgcttcaactcatgggttgtttgagacagctgcactccgggctgtttctgtaccaaggccttctccaggcactggcaggcatttcacctgagttggcaccaactctggatactctgcagctcgataccaccgacttcgcgatcaacatttggcaacagatggaggaccttggtatggcccctgccgtgccgccaacgcagggaaccatgcccgcctttacctcggcctttcagcgacgcgccgggggcgtcctggtggcatcaaatctgcagtcttttcttgaacttgcatacagggcactccgtcattttgcaaagcca

SEQ ID NO: 9910 - DNA, 525 bp, Artificial Sequence
  Description of Artificial Sequence: Synthetic coding sequence
atggctccccttggacctacaggacccctgcctcagagcttcctgctgaagtgcctggagcagatgaggaaagtccaggcagatggtactgctctccaagaaactctgtgcgctacacaccagctgtgtcaccccgaggaactggtactcctcggacacgctttgggtattccccagccacccctttccagctgtagctcacaggcattgcagctcatgggttgcctcagacaactgcatagcggcttgttcctctaccagggcctcctgcaagctttggcaggaatatcccctgagttggccccaactcttgatactctgcagctcgacacaaccgactttgctatcaacatttggcagcagatggaagacctgggcatggctcccgcggtgccaccgacacaaggaaccatgcccgccttcactagcgctttccagagaagagccggcggcgtgctggtggcgtctaacctgcaatcttttctggagctggcttacagagcactccgccatttcgcgaagcct

SEQ ID NO: 9911 - DNA, 525 bp, Artificial Sequence
  Description of Artificial Sequence: Synthetic coding sequence
atggcgccgctaggcccaaccggaccgctgccccagagttttttgctgaaatgcctggagcagatgcgtaaggtgcaggccgacggcaccgcgctgcaggagacactgtgcgcaacgcatcaactatgccaccccgaggaactggtgctgctgggacacgcactcggcataccccagccaccgctgagcagctgtagcagtcaggctctgcagctgatgggctgccttcggcaactgcactcaggactgtttctgtatcagggactgctgcaagctctggccggcatatccccggagctcgctcctactttggacacgctgcaactcgacaccactgactttgcaatcaacatctggcagcaaatggaggacctggggatggccccggctgtgccacccacgcaagggaccatgccggcattcacaagtgcctttcagcgacgcgccggaggcgtcttggtagctagtaatttgcaaagcttcctagagctagcctaccgtgcactgcgacatttcgccaagcct

SEQ ID NO: 9912 - DNA, 525 bp, Artificial Sequence
  Description of Artificial Sequence: Synthetic coding sequence
atggcgccactgggcccaaccggccccctgccacagagcttccttctcaagtgcctggaacagatgcgtaaggtgcaagcagacggaaccgccctgcaggaaaccctgtgtgccactcatcagctgtgccaccccgaagagctcgtccttctcgggcatgcactgggcatcccccagcccccactgtcgtcgtgctcatcccaggcactccagctgatgggctgcctgcggcaacttcactcgggtctgttcctctaccaagggctcctgcaagctctggcaggcatcagcccggaacttgccccgacgctggatactttgcaattggataccacggactttgccataaacatctggcagcagatggaggacctcggaatggctccggcagtcccccctactcaagggaccatgcctgcgttcaccagcgcttttcagcgccgcgctggaggagtgctcgtcgcctctaacctccagtccttcttggagctggcgtacagggccttgcggcatttcgccaaaccg

SEQ ID NO: 9913 - DNA, 525 bp, Artificial Sequence
  Description of Artificial Sequence: Synthetic coding sequence
atggctccgctagggcctactgggccccttccacagtcattccttctgaaatgtttagagcagatgaggaaagtacaggctgatgggactgccctccaggagactctgtgtgccactcaccaactgtgtcatcctgaggagctcgtgctcctcgggcatgcactagggatacctcagcccccgctgtcttcttgttcatcccaggctctgcaactgatggggtgcctgcgacagctgcactctggactcttcttgtaccaggggctacttcaggccttggctggaatctcacccgaactcgctccaactcttgacacacttcagctcgatactactgactttgctatcaacatatggcagcagatggaagacctagggatggctcctgctgtgccccccacacagggaacaatgccagcctttactagtgctttccagaggcgagctgggggagtcttagttgcaagtaatctccagtcatttcttgaactcgcttatagggcattgcgacatttcgctaaaccc

SEQ ID NO: 9914 - DNA, 525 bp, Artificial Sequence
  Description of Artificial Sequence: Synthetic coding sequence
atggctcctttaggccctactggtccactgccacagtctttccttctaaagtgtcttgaacaaatgagaaaagttcaagctgatgggaccgcgcttcaagaaaccctttgtgctacccatcaactgtgccatcctgaggagcttgtgttacttgggcatgctttaggaatccctcaacctcccttatcctcttgctcatctcaagcattacagcttatgggatgtttaagacagcttcattcaggcctattcctttatcagggattgcttcaagcattggcgggaatatcgccagaattggccccgacactcgacaccttacaattggatacgaccgacttcgctattaatatctggcaacagatggaagatctcggcatggcacctgccgtaccccctactcagggtacgatgcctgcattcacctctgctttccaacggagagcaggtggtgtgcttgttgcgtcaaatctacagtcctttcttgaacttgcatacagagccctcaggcatttcgccaaacca

SEQ ID NO: 9915 - DNA, 525 bp, Artificial Sequence
  Description of Artificial Sequence: Synthetic coding sequence
atggcacctctgggacctaccggacccctgccacagtcgttcctgctgaagtgccttgaacaaatgagaaaggtgcaggcagacggcaccgcactgcaggaaactttgtgtgcaactcatcaactgtgccacccagaggagctggtgctgcttggccacgcccttggaattccacaacctccactctcatcttgctcaagccaagctctgcaacttatgggttgtctcagacaacttcactcgggactgtttctgtaccagggtctgcttcaagccctggcaggaatctcgcctgagttggccccgactcttgacacccttcagctcgacactacggatttcgcgattaacatttggcaacaaatggaagatctgggcatggcaccggccgtgccccctactcagggtaccatgccagcattcacttcagcatttcagaggcgggcaggcggagtcctggtcgcaagcaatcttcagtcctttctcgaactggcatacagagcactgcgacatttcgcgaaaccg

SEQ ID NO: 9916 - DNA, 525 bp, Artificial Sequence
  Description of Artificial Sequence: Synthetic coding sequence
atggcgcccctcggaccgaccggcccgcttccgcagagcttcctgctgaagtgccttgaacaaatgcgcaaagtccaggccgatggcaccgccctgcaagaaaccctgtgcgcaacccaccagctgtgtcatccggaggaactggtccttctgggtcacgccctgggtatcccccaaccacctctgtcctcctgctcatcacaggccctgcagctcatgggctgtctgagacagctgcattcaggcctcttcttgtaccaaggcttgctgcaagcactcgctggcatcagcccagagctggcaccgacgttggacactctccagctggataccactgatttcgctatcaacatctggcagcagatggaggacctcggcatggcaccggcggtgccaccgacgcaggggactatgccggccttcacctcagctttccaacgccgcgcgggaggagtgctcgtcgcgtcaaacctccagtccttcctggagctcgcttacagagcgctccggcacttcgcgaaacca

SEQ ID NO: 9917 - DNA, 525 bp, Artificial Sequence
  Description of Artificial Sequence: Synthetic coding sequence
atggctcctttaggaccgacggggccattacctcaatctttcttactgaagtgtctggaacagatgcgtaaggtacaggccgacggtaccgctctacaggaaacactgtgtgctacacatcagctgtgccacccggaagaattggtcctcctcggacacgccctggggattcctcaaccccccctatcgtcatgctcatcgcaagccctacaacttatgggttgcctgcgccagttgcacagcggtttgttcctatatcaaggcttgctgcaggcactcgccggcatatctcctgagctcgctcccactctggataccttacagttggacacaactgactttgcaataaatatctggcagcagatggaggacctgggtatggcaccagccgttccccccacgcaagggacaatgcctgctttcaccagcgcattccaaaggcgggccggcggcgtgttggtcgcgagcaacctgcagagcttcctcgaattggcctaccgggcgcttagacatttcgccaagccc

SEQ ID NO: 9918 - DNA, 525 bp, Artificial Sequence
  Description of Artificial Sequence: Synthetic coding sequence
atggcgcccctgggacccacgggtccacttccccagtcctttttgctgaaatgcttagagcagatgagaaaagttcaagccgacggaacggctctgcaggagaccctgtgtgcgactcaccaactgtgtcaccctgaagaactagtcctgctagggcatgctttgggcatcccccagccaccactgagttcctgttcctctcaagctctgcagcttatgggctgcctcaggcagctgcattccggcctttttctataccagggcctcctgcaggctcttgccggcattagcccagagttggctcccacactggatactctgcagctcgatacaacggattttgccatcaatatttggcaacaaatggaggatctcgggatggctcccgctgtgcctcccacccaggggactatgcccgcctttacctccgcctttcagaggcgcgctggaggtgttcttgtggcctctaacctccaatcctttctggaactggcgtatcgagcactgaggcactttgcgaaaccg

SEQ ID NO: 9919 - DNA, 525 bp, Artificial Sequence
  Description of Artificial Sequence: Synthetic coding sequence
atggctcccttaggtcccaccggccccctcccccagtctttcttgctcaaatgcctagaacaaatgcgaaaggttcaggcagacggaacagctttacaagagaccctctgcgctactcatcagctgtgccaccccgaggagttagtcctgctgggacacgctctggggatcccacagccacctctgtccagttgctcgtcccaggcccttcagcttatgggatgtctccgtcaactgcactccgggctctttctctaccagggtctgctccaggccctggctggcatcagccctgaactcgctccgactctagataccctccagttggacactacggacttcgccattaatatctggcagcaaatggaggatttaggcatggcgcccgcagtgccacctacccagggaacgatgcccgcttttaccagtgctttccaaagaagggccgggggagttcttgtggctagtaaccttcagagcttcctggagctcgcgtatagggccttacgacacttcgccaaaccg

SEQ ID NO: 9920 - DNA, 525 bp, Artificial Sequence
  Description of Artificial Sequence: Synthetic coding sequence
atggcaccattgggtcctacgggaccactgcctcagagcttcctcctgaagtgtctggaacagatgcggaaggttcaagcagatggaactgcactgcaggaaaccctttgtgctacccatcaactttgtcaccctgaagaactggtcctgctcggccatgctcttggaatcccgcaaccacctctgtcgtcatgtagctcacaggctctgcaactgatgggatgtctgcgacaattgcattccggtctgtttttgtaccaaggtctgcttcaagcactcgcaggtattagcccagaactcgcaccgaccctcgataccctgcaacttgatacgactgactttgcaattaacatttggcagcagatggaggatcttggaatggcccccgcagtcccaccaacccagggtaccatgccagccttcacttcagcctttcaaaggcgtgcagggggcgtcctggtggcgtccaacctgcagtcgttcctcgaacttgcataccgagcacttaggcattttgccaaacca

SEQ ID NO: 9921 - DNA, 525 bp, Artificial Sequence
  Description of Artificial Sequence: Synthetic coding sequence
atggcaccactgggacctaccggacccttaccacaaagcttcttacttaagtgcctcgaacagatgcgaaaagtccaggctgatggcactgccctgcaggagacactctgcgcgactcatcagctgtgccaccccgaagagctggtcctgttgggccacgctttgggcatccctcagcctcctctttctagttgtagctcccaggctctccagttgatgggctgtttgcggcagttgcattctgggctgttcctatatcagggactgctgcaggccttagcaggaatttccccggaacttgcccctacactggacacactccagctggataccaccgatttcgcgattaatatatggcagcaaatggaagacctggggatggctcccgctgtccccccaacgcaggggacgatgcccgcgtttacaagcgctttccagagaagggccggaggggtgctagtggcctccaacctacagtctttcctggagctggcatacagagcactgagacatttcgcaaagcct

SEQ ID NO: 9922 - DNA, 525 bp, Artificial Sequence
  Description of Artificial Sequence: Synthetic coding sequence
atggccccactcggacccaccgggcccttgccccaatccttcctactaaagtgtctagaacagatgagaaaggtgcaagcggatggcacagcactgcaggagactttgtgcgccactcatcagctctgtcatcctgaggagctagtgctgctcgggcatgcactgggtatacctcagcctccactatcttcttgttcaagccaggcgctacagctgatggggtgcttgagacaattgcatagcggcctgttcctgtatcagggcctgctgcaggccttggctggcatatcccccgaactcgcaccgaccctcgacacactgcagttggataccaccgacttcgcaatcaatatttggcagcagatggaggatcttggcatggcacctgccgtgcccccaacccaaggtacaatgcctgcctttacctcagcctttcaacggcgcgccggaggagttttggttgcctccaatctgcagtcctttctggagctcgcgtacagggccctgcggcattttgctaaacca

SEQ ID NO: 9923 - DNA, 525 bp, Artificial Sequence
  Description of Artificial Sequence: Synthetic coding sequence
atggcccccttaggacccacggggccactgccacagtcatttctcttgaagtgtttggaacagatgaggaaagtccaggccgacgggactgcactgcaggaaacactctgtgctactcaccagctctgtcaccccgaagaacttgtgcttctggggcatgccttggggatacctcagcctcctctttcctcgtgctcatctcaggcattacagctgatggggtgcctcagacagctacactccgggctgtttctctatcagggattactccaggctctcgctggaatctctcccgaactagcacccactcttgatacactccaactcgatactacagatttcgctataaatatatggcagcagatggaagatcttgggatggcacctgcggtacctcctacacaagggacaatgcctgcttttacatctgccttccagaggcgggccggaggagtcctggtggcatctaaccttcaatcattcctagaactcgcctatcgcgcactcagacactttgctaaaccc

SEQ ID NO: 9924 - DNA, 525 bp, Artificial Sequence
  Description of Artificial Sequence: Synthetic coding sequence
atggcaccattgggccccactggaccacttcctcagagcttcctgctgaagtgtctcgaacaaatgagaaaagtgcaggctgatgggactgcccttcaggaaaccctctgtgcaactcaccagctttgtcaccccgaagaactggtgcttcttggccacgctcttggtattccccagcctcctttgtcgtcttgcagctcacaggcactgcaacttatggggtgcctccgccaactgcattcagggctttttctttaccaaggtcttttgcaggcactcgcgggaataagcccagaactggcacctacgcttgatacgcttcaactggacactacggactttgcgattaacatttggcaacaaatggaggatctggggatggcacctgcagtgcctccaactcagggtactatgccggcctttacctcagctttccagcggcgggcaggaggggtcctggtcgcgtccaacctgcaaagttttctggagctcgcctacagagcccttcgacactttgcaaagcct

SEQ ID NO: 9925 - DNA, 525 bp, Artificial Sequence
  Description of Artificial Sequence: Synthetic coding sequence
atggctccactggggccaacgggtcctctcccacaatcgtttcttcttaagtgcctcgagcaaatgagaaaagtgcaagcagacggtactgcattgcaagaaactctctgtgccactcatcaactttgtcatcctgaggagttggtgcttctgggccatgcactgggtatcccccaaccacctctgtcctcctgttcatcgcaagcacttcaactgatggggtgtctccgacagctccatagcggcctttttctttaccaaggactcctgcaggcgcttgccggcatctccccggaactcgctcctaccctcgacaccctgcaattggataccaccgactttgctataaacatctggcagcaaatggaagatctgggcatggctcctgcagtgccacctacccagggaaccatgccggcatttacgtcggcattccaaaggcgtgcgggtggagtgctggtggcatctaaccttcaatcgtttctggaactggcttaccgcgcactcaggcatttcgcaaagcca

SEQ ID NO: 9926 - DNA, 525 bp, Artificial Sequence
  Description of Artificial Sequence: Synthetic coding sequence
atggcccccctgggccccaccggaccattgcctcagtcttttttactcaaatgtcttgaacagatgagaaaggtgcaagcggacggtaccgctctgcaagaaactctttgcgccactcatcaattgtgtcaccctgaggaattagtcctgcttggccacgcgttgggcatccctcagcctcccctgtcatcctgctccagccaggctctgcagctaatgggatgcctacggcagctgcattctggcctgttcctgtaccaaggcctcctccaggcattggccggaatctcaccagagctagcccccaccctggacacactacagttggatacaaccgacttcgctatcaatatctggcagcagatggaagacctcggcatggccccggcagttccgcctactcaggggacgatgcctgcttttacaagcgccttccagcggcgggcaggaggcgttctggttgcctcaaatttgcagtcttttttggaactcgcctaccgggcgcttcgccactttgcgaagcct

SEQ ID NO: 9927 - DNA, 525 bp, Artificial Sequence
  Description of Artificial Sequence: Synthetic coding sequence
atggcacctctgggaccgacgggccccctccctcagtcattcctgctgaaatgcctggagcaaatgcgcaaagtgcaagccgatggtaccgcccttcaagagacgctgtgcgcaacccatcagctctgtcaccccgaagagctggtgcttcttggtcatgccctcggaatacctcagccaccattgtccagttgttcgtcgcaagccctgcaactgatgggctgtttgagacaattgcactctgggctttttctctaccaaggcctgctccaggcgcttgcgggtatctcccccgagctggcacctactctcgatacccttcaactggataccaccgatttcgcaattaacatttggcaacaaatggaggacctcggaatggcacctgcagtccctccgactcaaggtaccatgcctgcatttacttcggcatttcagaggcgagcgggcggtgtgctggtcgcctccaacctgcagtcattcttggaactcgcgtaccgcgctctccgccactttgcaaagcct

SEQ ID NO: 9928 - DNA, 525 bp, Artificial Sequence
  Description of Artificial Sequence: Synthetic coding sequence
atggcccctttgggaccaactggtccgctgcctcagagcttccttttaaaatgcttggagcagatgaggaaagtgcaggctgacggtacagcactccaagagaccttatgcgccacgcatcaactctgccaccccgaagaattagtgctccttggtcatgccttgggaattcctcaaccgccgctatcttcgtgctcttcgcaggcgcttcagcttatgggatgcctccgccagctacattccgggctcttcctctatcaaggtttgctacaagcactggctggtatttcacccgagttggcacccaccctggataccctccagcttgatacaaccgatttcgcaatcaacatctggcaacaaatggaggacttgggcatggcgcccgcagttcccccgactcagggcacaatgccagcctttacaagcgcattccagagaagggccggcggcgtgctagttgcatccaacctccagtcgtttttggagctcgcttaccgcgcgttgaggcattttgcaaaacct

SEQ ID NO: 9929 - DNA, 525 bp, Artificial Sequence
  Description of Artificial Sequence: Synthetic coding sequence
atggctccgcttggaccaactggacccctgccgcaatctttcctgcttaaatgtcttgaacaaatgcgaaaggtccaggctgacggcacggcgctccaagaaaccctgtgcgcaacccaccaactgtgccatcctgaggaactcgtccttcttgggcacgcactgggtattccgcagccgccgctctcctcgtgctcgtcacaggctctccagttgatgggttgcctccgccagctccatagtggcctgttcctctaccagggacttctgcaggcgctggctgggatctcgccggagctcgcgccgactctcgatactttgcagctcgataccacggactttgcaatcaacatttggcagcaaatggaggacctgggaatggcacctgccgtgccgccaacgcaaggtactatgccagccttcacctcggcgttccaaagaagggccggaggggtgctggtagcttcaaatctccaatcattcctcgaattggcgtaccgcgccctgcgccactttgccaagccg

SEQ ID NO: 9930 - DNA, 525 bp, Artificial Sequence
  Description of Artificial Sequence: Synthetic coding sequence
atggcacccctgggaccaactggcccgttgcctcagagcttcctgttgaagtgcctcgagcagatgcgcaaggtccaggcagatggaactgccctgcaagaaactctctgtgcgactcaccagttgtgccatccagaagaactcgtcctgctgggacatgccttgggaatcccgcaaccacctctgtcaagctgctcaagccaagcgctccagttgatgggatgtctgcgccagctgcactcgggactgtttctctaccagggtttgctgcaggccctggccggaatcagccccgagcttgcgccaacgctcgacaccctgcaactcgacaccactgacttcgccattaacatttggcaacaaatggaggacctgggaatggcgccagctgttccacctacgcagggaaccatgccggcttttacctccgcgtttcaaagacgggcaggcggtgtgctggtggcgtccaacctgcagtccttccttgaactcgcgtaccgcgccctgcggcacttcgcgaagcct

SEQ ID NO: 9931 - DNA, 525 bp, Artificial Sequence
  Description of Artificial Sequence: Synthetic coding sequence
atggctccactggggccaactggacccctgccccagtcctttctgctcaagtgtctggagcagatgaggaaagtgcaagcggatggtaccgcattgcaggaaactctgtgtgcaactcaccagctttgtcatccagaagaacttgtcctgcttggtcacgccctgggaattcctcaacccccgcttagctcctgctcgtcgcaggcactccaactcatgggatgcctgaggcagctgcactcgggtttgttcctgtaccagggactgctgcaggcacttgccgggatctcgcccgaacttgcaccaactctcgacaccctgcaactggacactaccgatttcgcaataaacatctggcaacagatggaagatcttggaatggcaccagcggtgccccctactcagggaaccatgcccgcatttacctcggccttccagagacgagcaggtggggtgctggtggcttcaaatcttcagtcctttctcgagctggcgtacagagcccttagacattttgccaagcca

SEQ ID NO: 9932 - DNA, 525 bp, Artificial Sequence
  Description of Artificial Sequence: Synthetic coding sequence
atggcacctctggggcccaccggtccacttccccaatcctttctccttaagtgtcttgaacagatgagaaaggttcaggcagatggaactgccctccaagaaactctttgcgccacccaccagttgtgtcatcctgaagagctcgtcctgctgggccatgcactgggaatacctcagccgcccctttccagctgcagctcccaggccctgcagttgatggggtgcctgaggcagctccactccggactgttcttgtaccagggactgttgcaagcattggcaggcatttcgcccgaacttgcccccactctggataccctccaacttgatactactgactttgcgatcaatatctggcagcaaatggaggaccttggtatggcacctgcagtgcctccgacgcaaggtactatgcctgcttttactagtgcattccagcgccgggctggtggagtgcttgtggcaagcaacctgcagagctttctcgagcttgcgtaccgggcacttcgtcatttcgccaagccg

SEQ ID NO: 9933 - DNA, 525 bp, Artificial Sequence
  Description of Artificial Sequence: Synthetic coding sequence
atggccccactggggcctaccggtccactgccacagagctttcttttgaaatgtctggagcagatgcggaaggtacaggctgatggaactgccctacaagaaactctgtgcgcaacccaccagttgtgtcaccccgaggagctcgtcctcctcggtcacgccctgggtatccctcagccaccattgtcgagttgttcttcccaggctctgcagctaatgggctgcctccgacagctacattccgggctttttctctaccaggggctgcttcaggctctcgctgggatctcgcccgaattggcccccacgcttgatacattgcagctggatactaccgactttgccattaatatatggcagcaaatggaagacctggggatggccccggcggtgccccctacgcaaggcacgatgcctgcattcaccagcgctttccaacggcgcgccgggggagtgctcgtggctagtaatttgcagagtttcctggaactagcctatcgggccttgcgccatttcgcgaaaccc

SEQ ID NO: 9934 - DNA, 525 bp, Artificial Sequence
  Description of Artificial Sequence: Synthetic coding sequence
atggcacctctcggcccaaccggacctctcccccaatctttcctgctgaagtgcctcgaacagatgcgcaaggtccaagctgatggcaccgccctgcaggaaactttgtgcgcaactcatcagctctgtcaccctgaggagctggtactcctgggccatgctctgggcattccgcagcccccactgtcaagctgtagcagtcaggctcttcagctcatgggctgtttgcgccagttgcactccggactctttctgtatcaggggctgctccaggcgctggccggtatcagtccagaactcgcacccacactggacacactgcagctcgatacgaccgattttgcaattaatatctggcagcagatggaggacctgggcatggcccctgcagtaccaccgactcaaggcacaatgccggctttcaccagtgcttttcagagaagagctggaggtgtgctggtggcttcaaacctccaatcttttctcgagctggcgtaccgcgccctgcggcatttcgccaagcca

SEQ ID NO: 9935 - DNA, 525 bp, Artificial Sequence
  Description of Artificial Sequence: Synthetic coding sequence
atggctcctctgggcccaactgggcccctgccccaaagtttcctgcttaaatgcttggaacaaatgcgtaaggtacaagctgacgggactgccctgcaggagactctgtgcgccacccatcaactatgccaccccgaagaactagttctcctgggccacgcactgggtataccacagccacccctgagtagctgcagctctcaagccctacagctaatgggatgcctgcgtcagttgcatagtgggcttttcctgtatcagggcctactgcaggcactggctggcatcagccctgaacttgctcccaccctggacactctgcagctggacacaactgattttgctattaacatctggcagcagatggaagatttaggcatggctcctgccgtcccacccacccagggtacaatgccagcttttacaagcgcctttcagaggagagccggcggggttctggtggcctcaaatctgcagtcttttctagaacttgcctacagagctctgaggcacttcgctaaacca

SEQ ID NO: 9936 - DNA, 525 bp, Artificial Sequence
  Description of Artificial Sequence: Synthetic coding sequence
atggctccactcggacctactggtccacttcctcaatcgtttctgctgaagtgcctggagcagatgcgtaaggtgcaagcagacggcactgcactgcaggaaaccctttgtgcaactcatcaactgtgccacccggaagaacttgtgctgttgggacatgcactgggtattccgcaacctcccctttcgtcttgttcctctcaagctcttcaactgatgggatgtctgcggcaattgcattcagggctgtttctttaccaaggcctgcttcaggcgcttgcgggaatcagcccagagctcgcgcctactctggacacgctccaactggacaccacggattttgcaattaacatctggcagcagatggaagatctggggatggcgccagcagtgcccccaactcagggaaccatgcccgccttcaccagcgcattccaacgaagagcaggtggggtgcttgttgcctcaaatttgcaatcatttttggaactcgcataccgcgcgcttagacatttcgcaaaacct

SEQ ID NO: 9937 - DNA, 525 bp, Artificial Sequence
  Description of Artificial Sequence: Synthetic coding sequence
atggccccactgggtcccacgggtccgctgcctcagtcattccttcttaagtgcctggaacaaatgcgcaaagtgcaagccgatggtaccgcgctgcaggaaaccttgtgtgcaactcatcagctttgccacccggaggagcttgttttgctgggccacgctcttgggattcctcagccgccactgagctcatgttcgtcgcaggcactgcaacttatgggctgcctgcggcagctgcatagcggattgttcttgtaccaaggattgctccaggctctcgccggcatctcgccggaattggctcccaccttggacacgctccagctggacactaccgattttgccatcaacatctggcaacagatggaggacctgggcatggcaccagctgtgcccccgacgcagggaaccatgcctgcttttacttccgcctttcaaagacgcgcaggcggagtgctcgtcgcctccaatctgcaatccttcctcgaattggcgtaccgggcccttcgacacttcgccaagccg

SEQ ID NO: 9938 - DNA, 525 bp, Artificial Sequence
  Description of Artificial Sequence: Synthetic coding sequence
atggcaccgctaggaccgacgggcccgttgccgcaatctttccttttgaaatgccttgaacaaatgaggaaggttcaggcagacggcaccgcactacaagaaacactctgcgctacacatcaattatgccacccggaggagttggtcttgttaggtcatgctctgggtatcccgcaacctccacttagctcttgctcaagtcaagcgctccaactaatgggatgcttgagacagcttcactcaggattgttcctgtatcagggcttacttcaggccttggcgggtatctctcctgaacttgcaccgacactagatacactgcagttggatacaactgattttgcaataaacatctggcaacagatggaagatcttgggatggcacctgctgttccccctacacaaggcacgatgccggcattcacgtcagcgtttcagaggcgggcagggggagttttagtcgcaagcaacttacagtcatttcttgaattagcttatcgcgctttacggcattttgctaaaccg

SEQ ID NO: 9939 - DNA, 525 bp, Artificial Sequence
  Description of Artificial Sequence: Synthetic coding sequence
atggcccccctagggcccaccggacccttgcctcagagcttcctgctcaaatgcctcgagcagatgcgtaaagtccaggccgatgggacagctctccaggaaacactgtgcgctacacaccagctttgtcatccagaagagttggtcttgttggggcatgctctaggaatacctcagcctccattaagcagctgttcttcccaagcactccagttgatggggtgtctgaggcagctccactccggcttattcctgtaccagggtctattgcaagcactggcaggcattagccccgaactggctccaactctagatacccttcagctcgacacaactgattttgccatcaatatatggcagcagatggaggacctcgggatggccccggctgtgccacctacgcagggcacaatgcccgctttcacctctgcgttccagcgtagagccggaggggttttggtcgcttcaaacctccagtccttcctagagttggcttatcgcgcccttcggcacttcgctaagccc

SEQ ID NO: 9940 - DNA, 525 bp, Artificial Sequence
  Description of Artificial Sequence: Synthetic coding sequence
atggcacctcttggccccactggtcctttgccacaatcctttctcctcaagtgtctggaacagatgaggaaggtgcaagccgatggtaccgctcttcaggaaaccctctgtgcaactcatcaactgtgtcatccagaagaactggtgctgctcggacacgcacttggtattcctcaacctcctctctcgagctgctcgtctcaggcacttcagcttatggggtgccttcgccaactgcactcgggtctttttctctaccaaggactcctgcaagcactggcaggcatctcccccgaacttgctcccacccttgatacccttcagctggataccactgatttcgccatcaacatctggcagcagatggaggacttgggaatggcaccggcagtgccaccaactcaaggcaccatgccagcatttacctcggcattccaaagaagggcaggaggagtgcttgtcgcgtccaacctccaatccttcctcgaactcgcataccgtgcgcttcggcactttgccaagccc

SEQ ID NO: 9941 - DNA, 525 bp, Artificial Sequence
  Description of Artificial Sequence: Synthetic coding sequence
atggcgccgctgggccccaccggtccgctcccgcagtcttttctgctgaaatgtctggagcaaatgcgcaaggtgcaagcagatgggactgcgctccaggagacgctgtgtgctacccatcaactgtgccaccctgaagagctggtccttctgggtcacgcattgggaattcctcaaccgcctttgtcgtcctgtagctcccaggccctgcagctgatgggttgtctgcgccagctgcacagcggcctcttcctgtaccagggccttctccaggcgttggctggaatctctcctgagctcgcccctaccctggataccctgcagctagatacgacggatttcgctatcaatatctggcaacagatggaggacttgggcatggccccggcagttccacctacccagggtacaatgccagcattcacctcagcgtttcagcgtcgggcgggaggggttctggtcgcttcaaatctgcagtctttcctggagctcgcatacagggcgctgcgccattttgcgaagccc

SEQ ID NO: 9942 - DNA, 525 bp, Artificial Sequence
  Description of Artificial Sequence: Synthetic coding sequence
atggcgccgctcggacctaccggcccgcttccacaatcattcctgcttaagtgcttggagcaaatgcggaaggtgcaggctgatggcactgctctgcaagaaacgctgtgcgcaacccatcagctttgccatccggaggagttggtgctgctgggacatgccctcggcatccctcaaccgccgctgtcgtcatgtagctcgcaagcattgcagctgatggggtgcttgcggcaactgcactccggactgtttctgtaccagggcctccttcaagcactggcgggaattagccctgagctcgcaccaacgttggatactctccagctggacaccaccgatttcgccatcaacatctggcaacaaatggaggacctgggcatggcccctgcagtgccgccgactcaagggactatgcctgcgttcacctcggcctttcaaaggagagccggcggagtgctcgtcgccagcaaccttcagtccttcctggaactggcctaccgggccctgcgccatttcgccaagcct

SEQ ID NO: 9943 - DNA, 525 bp, Artificial Sequence
  Description of Artificial Sequence: Synthetic coding sequence
atggccccattgggccctacagggcctctgcctcagagcttccttctgaaatgtctggagcaaatgagaaaggttcaggctgacgggacggcactccaggagaccttgtgcgctacccatcagctctgccaccccgaagagctggtactgctgggccacgcccttgggatcccgcaacctcccctgagctcatgcagttctcaagctctgcagcttatgggctgcctgcgccagctgcactccgggttattcctgtaccaaggtctactgcaagccctcgcaggcatcagtccagaacttgctccaaccttggatactttgcaactcgacaccaccgattttgcgatcaacatatggcaacaaatggaggacctgggaatggctcccgccgtcccgccaacccaggggaccatgcctgcattcacatctgccttccagagacgcgctggaggagtattggtggctagcaatctgcagagcttcctcgaactggcttaccgggcactccgtcatttcgccaaacca

SEQ ID NO: 9944 - DNA, 525 bp, Artificial Sequence
  Description of Artificial Sequence: Synthetic coding sequence
atggcacccctaggtccaacaggaccactacctcagtctttcctcctgaaatgtttagagcagatgcgcaaggtgcaagctgacggtacagccctacaggagactctctgtgctacccatcagctgtgtcaccccgaagagctggtgctattagggcacgccctcggaatcccccagcctcccctttcttcctgcagttcacaggctttgcaattaatgggctgcctcagacagcttcattctgggctgttcctctaccagggactcctgcaggccctggccggaatctcaccagaactggcccctactctcgatactctccagctggatactaccgactttgccattaatatttggcaacagatggaggatctgggcatggccccggccgtccctcctacacaggggaccatgccagcattcactagcgcttttcaaaggcgggcaggaggtgtcctcgtggccagcaatctgcaaagcttcttggaattagcctacagagctttgcgtcactttgcaaagcca

SEQ ID NO: 9945 - DNA, 525 bp, Artificial Sequence
  Description of Artificial Sequence: Synthetic coding sequence
atggcgccccttggtcccactggtccccttccgcaatcgtttttgctgaaatgtcttgaacagatgcgcaaagtgcaagcagatggtaccgcgttgcaagaaaccctctgtgccactcatcaactttgtcaccctgaagagctcgtgctcctgggacatgcgctcgggattccgcagcctcccctttcgagctgctcgtcccaagctctccaactgatgggatgtctccggcagcttcattcaggactgtttctttaccaagggcttctgcaagcgctcgcagggatatctccagagcttgcgcccaccctggatactctgcaactggataccacggattttgcaattaacatctggcagcagatggaagatcttggcatggcgcctgcagtgccacctacccagggaaccatgcccgcattcaccagcgcatttcagcggagggcaggaggggtccttgtcgcatcgaacctccagtccttcctcgaactggcataccgggccctgaggcacttcgccaagcca

SEQ ID NO: 9946 - DNA, 525 bp, Artificial Sequence
  Description of Artificial Sequence: Synthetic coding sequence
atggccccgttgggaccaactggacctcttccgcaatccttcctcctcaaatgccttgaacagatgaggaaagttcaagcggatggaactgctttgcaggaaaccctgtgtgccacacatcaactatgtcatccagaagagttggttttacttggacacgctttggggattccccaaccaccactatcatcatgctccagccaggccttgcaacttatgggatgtctccggcagcttcactcggggctctttctctatcagggtcttttacaggctctggcaggaatttcgccggagctagctccaacattggatacgttgcaattggatacaactgatttcgcgattaatatttggcaacaaatggaggaccttggaatggctcctgccgtaccaccaacgcaggggacaatgccggcatttacttcagctttccagagaagagcaggtggagttcttgtggcgtctaatttgcagtcattcctggaattggcttacagagctttgcgtcatttcgctaagccg

SEQ ID NO: 9947 - DNA, 525 bp, Artificial Sequence
  Description of Artificial Sequence: Synthetic coding sequence
atggccccgctcggacccactggccccctcccacagtcatttttgttgaaatgcttggagcagatgagaaaggtgcaagcggacggaactgcactccaggaaaccctgtgcgccacccatcagctttgccaccccgaggaactggtgctgctgggccacgctctgggaatccctcaaccaccgcttagctcgtgctcgagccaggccctccagctcatgggctgtttgaggcagctgcatagtggattgttcctctaccagggtctgctgcaggccctcgcggggatctcgccggaactcgctcctaccctggataccctgcaacttgacactactgacttcgcgattaacatctggcaacaaatggaagatctggggatggccccagcagttccgccgactcagggtaccatgccagcatttacgtcagctttccagcggagagcaggaggtgtcctggtggcgtctaacctgcaatcattcttggagttggcttaccgggcactgcgacacttcgccaagccg

SEQ ID NO: 9948 - DNA, 525 bp, Artificial Sequence
  Description of Artificial Sequence: Synthetic coding sequence
atggccccactgggaccaactgggcctcttccacagtcttttctgttaaagtgcctggagcagatgaggaaagttcaggcggacggtacggccctgcaggaaaccttgtgtgcaacacaccagctgtgccaccccgaagagctcgtgcttctgggccacgctttgggcataccccaaccacccctttcgagttgtagcagccaggccctacagctgatgggatgtctgcgccagctacactccggacttttcctttaccagggtctcctgcaggctctagccgggattagtccagaattggctcccacactcgacactctgcaactcgacactacagatttcgcaatcaacatctggcagcagatggaggatctgggaatggctccagcggtgcctccaacgcagggcacaatgccggcttttacttcggccttccagcgaagagccggaggcgtactggtggctagcaacctgcagagcttcttggaactcgcctaccgcgccctgcgccattttgcgaagcca

SEQ ID NO: 9949 - DNA, 525 bp, Artificial Sequence
  Description of Artificial Sequence: Synthetic coding sequence
atggccccactgggtcccacaggtccactccctcagtctttcctgctgaagtgtctggagcagatgcggaaagttcaggctgatgggaccgcactgcaggagaccctatgcgccacccatcaactgtgtcaccccgaggaactggttctgttgggtcacgccctaggcataccacagcccccgctgtcatcctgcagttctcaggctctgcagcttatggggtgcctgaggcagttgcactctggtttgtttctgtaccagggcttgctccaggccttagcaggtatatccccagaattagcccccaccctcgacactttgcagcttgatacgactgatttcgctataaatatttggcagcagatggaggatctgggcatggcaccagcggttcctcccacccagggcacgatgcctgccttcacatcagcctttcagagacgggctggaggtgtacttgtcgcctcgaatctgcagtcgtttttggagctcgcctatagggccctgcggcacttcgccaaacca

SEQ ID NO: 9950 - DNA, 525 bp, Artificial Sequence
  Description of Artificial Sequence: Synthetic coding sequence
atggctcctcttggaccaacaggacctcttccacaatcatttttacttaaatgtttagaacaaatgagaaaagttcaagctgatggtactgctttacaagaaactctttgcgcaacacaccaattatgtcaccctgaagaacttgtattgttaggacatgctcttggtataccacaaccacctttatcatcatgtagttcacaagcattacaattaatgggttgtcttagacaactacatagtggtctttttctttaccaaggattgcttcaagcattagcagggatttctccagaacttgcaccaacattagatactcttcagcttgatactacagattttgctattaatatttggcaacaaatggaagatttaggtatggcaccagcagttccaccaacacagggtacaatgcctgcttttactagcgcttttcaacgtcgagctggaggagttcttgttgcttcaaatctacaaagttttttagaacttgcttatagagcattgagacattttgctaaacca

SEQ ID NO: 9951 - DNA, 525 bp, Artificial Sequence
  Description of Artificial Sequence: Synthetic coding sequence
atggcccctcttgggcccacgggccctttgccacaatcttttctattaaagtgtctggaacagatgaggaaagtccaggccgatggcacagcattgcaggagaccctgtgcgcgacgcatcaactctgccacccggaggaactggtccttctgggacatgccctaggcattccccagcccccattgtcctcctgcagttctcaggccctgcagctcatgggttgtctcagacaactccattctggcctctttctgtatcagggactgctccaggccctggccgggatctcgccagaattggctcccacgttggataccctccaactggacacgaccgactttgccataaacatctggcaacaaatggaggacctcggcatggccccagcagtgcccccgactcagggcacaatgcctgcctttacaagcgcgttccagagaagggctgggggagtcctggttgcctccaatctgcagtcctttctcgagctagcctacagggccctccggcatttcgccaaacct

SEQ ID NO: 9952 - DNA, 525 bp, Artificial Sequence; identical to SEQ ID NO: 9888
  Description of Artificial Sequence: Synthetic coding sequence

SEQ ID NO: 9953 - DNA, 525 bp, Artificial Sequence
  Description of Artificial Sequence: Synthetic coding sequence
atggcacctctgggacctaccggtccgctgccgcagagcttcctgttgaagtgtctggaacagatgcgaaaagtgcaggcagatggcaccgctctgcaggaaacactgtgcgctacccaccaattgtgtcaccccgaggaacttgttctcctggggcacgccctcgggatcccacagccccctctatcctcttgcagcagtcaggctcttcagttaatgggctgcctgcggcagctacattcaggactcttcctctaccaggggctgctacaagcactagctggaatttccccggaactggcccctaccttagacacactgcaactggatacaaccgactttgcaatcaatatctggcagcaaatggaggatctcggtatggcacccgcagtgccaccaacgcaaggcacgatgccggcatttacctcggccttccagcgccgagccggtggtgtactcgtcgcctcgaacttgcagagtttcctggaactcgcttaccgggccctaaggcacttcgctaaaccc

SEQ ID NO: 9954 - DNA, 525 bp, Artificial Sequence
  Description of Artificial Sequence: Synthetic coding sequence
atggcaccgctgggtcccaccggacccttgccacagtcttttctcctgaaatgcctggaacagatgagaaaggtccaggccgatggtacagccctgcaggagacactgtgtgccactcaccagctctgccaccccgaagaattggtgcttctggggcacgcactgggaataccccaaccgcctctgagttcgtgttctagccaggcactgcagctcatgggatgcctccgtcagctccatagcggactgttcctttaccagggcctgcttcaggcccttgcaggaatttctcctgagctagcgcccaccttggatacccttcagctggacaccacggactttgcgataaacatttggcaacagatggaagacctgggcatggcccctgctgtgccacctacgcagggcacgatgcctgccttcacatcagcattccagagacgggcgggaggcgttctggtcgctagtaacctgcagagtttcctggaactcgcctatcgcgccttgcggcactttgccaaaccg

SEQ ID NO: 9955 - DNA, 525 bp, Artificial Sequence
  Description of Artificial Sequence: Synthetic coding sequence
atggcacccttgggacctactgggccccttcctcagtcctttttgcttaaatgcctggaacaaatgcggaaggtgcaggccgacggcactgcactccaagagactttgtgtgcaacccatcagctgtgtcatcccgaagaacttgtgctgctcggtcatgccctgggaatcccacagccaccccttagctcctgttcgtctcaggccttgcaacttatgggttgcctccgccaacttcacagcggtctgttcctttaccagggattgctgcaagcactggcaggcatctcaccagaacttgcacccacccttgatactcttcaactcgatactaccgactttgcaattaacatttggcagcaaatggaagatcttgggatggcacctgcagtgcctccaacccagggaactatgcctgcttttacctcagccttccagagaagggccggtggggttctcgttgccagcaatctgcaatcgttcttggaactcgcataccgtgcactgcgccattttgctaagcca

SEQ ID NO: 9956 - DNA, 612 bp, Artificial Sequence
  Description of Artificial Sequence: Synthetic coding sequence
atggcaggaccagcaacgcaatcgccaatgaagctgatggcacttcaattgctcctgtggcattcggccctttggactgttcaggaggcaacccctctgggacccgcatcatccctccctcaatcatttctgctcaagtgtctcgagcaggtgagaaagatccaaggcgacggcgcagcactgcaggagaagctctgcgcaacgtacaaactgtgtcatccagaagagctggtccttctggggcactcacttggcataccttgggctcctttgtcctcttgtccctcacaagccctccaactggcaggttgtctgtcgcagctgcactcgggactgtttctttaccaaggtctgctccaagccctcgagggtatttctccagagcttggcccaacccttgataccctgcaacttgatgttgcagacttcgcaactacgatatggcaacaaatggaagaactcgggatggcacctgcacttcaacccactcagggtgcgatgcctgcttttgcctcggcgttccaaagacgagcgggaggtgtgttggtggccagccacctgcagtcctttctcgaagtgtcgtaccgcgtgctgaggcatctggcccaacca

SEQ ID NO: 9957 - DNA, 612 bp, Artificial Sequence
  Description of Artificial Sequence: Synthetic coding sequence
atggcaggccccgcaacccaaagccccatgaagctgatggcattgcaactgctcttgtggcactcggcactttggactgtgcaagaagccactccccttggccctgcatcgtccctgcctcaatcgttccttcttaaatgtctggaacaagtgagaaagatccagggggatggtgcggccttgcaggaaaaactctgtgcgacttacaagctctgccatccagaggaactggtgttgcttggtcattcgctgggaattccgtgggcacccctgtcgtcgtgtccgagccaggctctgcaacttgcaggatgtttgtcccagctccactctggacttttcctgtaccaaggactcctgcaggccttggagggaattagcccagaactcggaccaactcttgataccctgcagctggacgtggcagattttgcaactaccatttggcagcaaatggaagaattgggtatggcacctgcactgcaacctactcagggcgcgatgccagcatttgcatccgcttttcaaagaagggccgggggcgtgctcgtcgcaagccacctgcaatcatttctggaagtgtcgtacagagtgctgagacatctggcacagcca

SEQ ID NO: 9958 - DNA, 612 bp, Artificial Sequence
  Description of Artificial Sequence: Synthetic coding sequence
atggcagggccagccacccagtcccctatgaaactgatggcattgcaactccttctctggcactcggccctttggaccgtgcaagaagccacccctctgggacccgcgagcagccttccacaatcgttccttctgaagtgtctcgagcaggtccgcaaaatccaaggagacggagcggcgcttcaagaaaagctctgcgccacttacaaactttgtcatccagaggaactggttctgctcggccactccttgggtataccttgggcgcccctgtcgtcatgcccaagccaggcactgcagctggcaggttgtctgtcccagttgcactcaggcctctttttgtaccaagggctcctgcaagcactggaaggaattagccctgagttgggtccaaccctggatacgctgcagttggacgttgccgattttgcaaccaccatctggcaacagatggaggagcttggtatggcgcccgcactccaacccactcaaggggctatgccagcctttgcatcggcatttcaacgacgggccggtggtgtccttgtggcttcgcatcttcaatcctttctggaagtgtcgtaccgcgtccttaggcaccttgcccaaccc

SEQ ID NO: 9959 - DNA, 612 bp, Artificial Sequence
  Description of Artificial Sequence: Synthetic coding sequence
atggccggaccggcaactcaatcacctatgaaactgatggcccttcagcttctcctttggcattcggcgctttggactgtgcaagaggccaccccgcttggtccggcatcctcccttcctcaatctttcctgctcaagtgtctggagcaggtccggaagatccaaggtgacggagcagcgctccaggaaaagctgtgtgcaacctacaagctgtgccatccagaagagcttgtcctgctgggacactcgctcggaattccctgggcgccactctctagctgcccttcacaagccctccagctggcaggttgtctgtcccaactgcacagcggactgttcctgtaccaggggcttttgcaggccctcgaaggaattagcccagagctcggccccactcttgatacgctgcaactggatgtggctgatttcgcaacgactatatggcaacagatggaagaactcggcatggcccccgcactgcagccaactcaaggcgcgatgcccgcatttgcatccgcttttcaacggagagcaggcggggtgcttgtggcgtctcatcttcagtcgtttcttgaagtgtcctacagagtgctgcgccatctggcccagccc

SEQ ID NO: 9960 - DNA, 612 bp, Artificial Sequence
  Description of Artificial Sequence: Synthetic coding sequence
atggctggccctgctacccagagcccgatgaaactaatggccctgcaactgctgctgtggcattcagcgctttggactgtacaagaggctactccattggggcctgcatcatcactcccccagtccttcctgctgaaatgtttggagcaggtccgcaaaatccagggcgacggagctgcccttcaggaaaagctgtgtgcaacatacaagctgtgtcatccggaagaactggttctcctagggcacagtcttgggataccttgggcccccctgagttcttgccctagtcaggctctccagctcgccggctgtctctctcaactccacagcggtctgttcctatatcaggggctgctccaggctctcgaaggtatttccccggagctgggccctacactggatacactgcaactcgatgtagcagattttgctacgacaatctggcaacaaatggaggaactcggtatggcaccagccctgcagccaacccaaggtgctatgcctgcttttgcgtctgcctttcagagacgcgctggaggggttctcgtggcgtcccacctacagagcttcttggaagttagctatcgcgtgctcagacacctcgctcagccc

SEQ ID NO: 9961 - DNA, 612 bp, Artificial Sequence
  Description of Artificial Sequence: Synthetic coding sequence
atggccggaccggccacccaatcgccaatgaaactgatggcacttcaactgctcctgtggcactcagccctctggaccgttcaggaagcgactcctctgggaccggcctccagcctgcctcaatcctttctgctcaagtgcctggagcaggtccggaagatccagggagatggagccgccctgcaagagaaactttgcgcgacttacaagctctgtcatccggaagagttggtgctccttggtcatagcctgggcattccgtgggccccgcttagctcatgcccgagccaggctcttcaactggcagggtgcttgtctcagctccattcgggactgtttctgtaccaaggattgctccaagcgctcgaaggtatctcgcccgagctcggcccgaccctcgacaccctgcagctggatgtggcagactttgcaactacgatctggcagcagatggaagagctgggaatggcccctgccttgcagccaacgcaaggtgcaatgccggcgttcgcgtccgccttccagcgccgggctgggggagtgctggtggcctctcacctccagtcgttcctcgaagtgtcatacagagtcttgcggcatcttgcccaaccc

SEQ ID NO: 9962 - DNA, 612 bp, Artificial Sequence
  Description of Artificial Sequence: Synthetic coding sequence
atggcaggacccgccacccaatctcccatgaaactcatggcactccagctcctcctgtggcatagtgccctttggaccgtgcaggaagctacccctttaggacccgcaagcagcctgccccagagcttcctgctgaaatgcttggaacaggtcaggaaaattcagggggacggcgcagctcttcaggaaaagctgtgcgcaacatataagctttgtcatcctgaggagcttgttctgctgggccacagcctggggataccctgggctccactgtcaagctgcccctctcaggcgctgcagttggctggttgcctgagccagctccactccggcctgtttttatatcaagggctcttgcaggcactcgaaggcatcagcccagagctgggaccaaccctggataccctgcagctggatgtagctgactttgctaccacaatctggcagcaaatggaagagttgggaatggctcccgctcttcagcctacccaaggagccatgcctgcatttgcttctgctttccagcgccgcgctgggggggtgttggtcgctagccatttgcagtccttcttggaagtctcgtacagggtcttgagacacctggcccaacca

SEQ ID NO: 9963 - DNA, 612 bp, Artificial Sequence
  Description of Artificial Sequence: Synthetic coding sequence
atggcagggcctgcaacccagtcacctatgaagttaatggctttacaactcctcctgtggcactccgccctttggactgtgcaggaagccacacctttggggcctgccagcagtttgccacaatcttttctgctgaaatgtcttgagcaggtgagaaagatccagggcgatggcgcggcactgcaggagaaactgtgtgcgacatataagttatgtcacccagaggaactggtccttctcggacactccctcgggatcccatgggcccctctctcttcctgcccatcccaagctcttcaattagctgggtgtctgtctcagctccatagcgggctgttcctgtatcagggactgctgcaggctctcgagggcattagtcccgaactcggcccaacgctggacactctccagctggatgttgctgactttgctaccaccatctggcagcagatggaggagctcggaatggcccctgccctccagccgacgcagggagcaatgccagccttcgcatccgcttttcaacgtcgcgcaggtggcgtgctagttgcctcccatttgcagtcgttcctggaggtgtcttaccgcgtactgagacatctcgcgcagccc

SEQ ID NO: 9964 - DNA, 612 bp, Artificial Sequence
  Description of Artificial Sequence: Synthetic coding sequence
atggctgggcctgctacccaatccccgatgaagctgatggctctgcaattattactctggcactcggccctgtggactgtccaggaagctaccccactcggacccgcttcttccctgccccaatccttccttcttaagtgcctggagcaagtgagaaaaattcagggagacggagcagccctccaggagaagctctgtgccacctacaagctgtgtcaccccgaggaattggtcctgttgggccattcactggggataccttgggcccccctgagctcttgtccatcacaggccctgcagctggcgggctgcctgtctcagctccattccggcctgtttctgtaccagggcttgctgcaggctctggaaggtatatcccccgagctgggacccacactggacactctgcagctagacgtggccgattttgcaacaactatctggcaacagatggaagagcttggcatggcccctgctcttcagccaacacagggcgcaatgccagccttcgccagcgccttccagagacgggctgggggggtgctggtggcctcccatctccagtcttttctcgaggttagttaccgtgtcctgaggcacctggcgcagccc

SEQ ID NO: 9965 - DNA, 612 bp, Artificial Sequence
  Description of Artificial Sequence: Synthetic coding sequence
atggcggggccggcgactcaatcgcctatgaagttgatggcactgcagctgctgctgtggcactcggcgctctggaccgtgcaagaggctactcccctgggccccgcctcatctctgccacaatccttcctcctcaaatgcctggaacaggttagaaagatccagggagatggagccgcactgcaggagaagctgtgcgccacctataaactgtgccacccggaagaactcgtcctcctcggtcatagccttggaatcccgtgggctccactgtcgagctgcccatcccaggccctgcagcttgccgggtgtctgtcccaactgcattcagggctttttctctaccaaggcctgctgcaagcccttgagggaatctcaccggagctcggcccaactttggacaccctgcagttggatgtcgcagacttcgccaccactatttggcagcagatggaagaactcggaatggctccagcgcttcagccaacccagggagcaatgccggctttcgcaagcgcgttccaaagacgggctggtggcgtgttggtggctagtcacctgcagtccttcctggaagtgtcgtaccgtgtgctgaggcacctcgcacagcca

SEQ ID NO: 9966 - DNA, 612 bp, Artificial Sequence
  Description of Artificial Sequence: Synthetic coding sequence
atggcaggtccagccacgcaatcgcctatgaagctgatggccctgcaactgcttctctggcactcagccctctggaccgtacaagaagcaaccccgctcggacctgcgtcctccctgccccaatcgttcctgctcaagtgtcttgaacaggtgcgtaagattcagggcgacggagcagcgctccaggagaagctgtgcgcaacttacaaactgtgtcatcccgaagagctggtgctgctcgggcactcacttggtattccctgggcacctctctcgtcatgcccttcgcaagcgctccagcttgcgggctgtctgagccaactgcattcggggctctttctttaccaaggacttctccaagccctggagggtatttcaccggaacttgggccaaccttggatactctccaactggatgtggcggattttgctaccactatatggcagcaaatggaggaacttggcatggcacccgcattgcagcctacccaaggagcaatgcccgcctttgcatcggcatttcagagacgcgctggaggagtgttggtggcctcccacttgcagtcattcctggaagtgtcctaccgcgttctgagacatcttgcacaacct

SEQ ID NO: 9967 - DNA, 612 bp, Artificial Sequence
  Description of Artificial Sequence: Synthetic coding sequence
atggctgggccagcaactcaaagtcccatgaagctcatggccctgcagctgctgttgtggcacagcgccctgtggacagtccaggaagctactcctctgggacccgcctcatcactgccccagtctttccttctgaagtgcctggagcaggttcgcaagatccaaggtgacggagctgctctccaggagaaactctgtgcaacatataaactatgccaccccgaggagttggtcttgttgggccattctctgggtatcccctgggccccgctgtccagctgtccttcccaggcacttcagctggcagggtgcttgagccagctgcactctgggctgttcctgtaccaaggccttcttcaagcattggagggtatctctccggagctgggcccaaccctggatacactgcagttggacgtagcagacttcgccacaactatctggcagcagatggaagagctgggcatggcccccgcgctgcagcccacccagggcgccatgcccgcgtttgccagcgccttccagagacgagctggaggcgttctcgtcgcatcccacctgcagtcattcctggaggtttcctatcgagtactccgccacctcgctcagccg

SEQ ID NO: 9968 - DNA, 612 bp, Artificial Sequence
  Description of Artificial Sequence: Synthetic coding sequence
atggcagggcctgcaacgcagtcgcccatgaagctcatggcactccaactgcttctgtggcattccgcactctggaccgtgcaggaagcaacccctctgggtcccgcctcctcgctgcctcagtcatttcttcttaaatgtctggagcaagtgcggaagatacaaggagacggagcagccctgcaggaaaagctctgtgcaacttacaaactttgtcacccagaagaactcgtgctgctgggtcattcactcggtataccttgggcaccgctctcatcctgcccctcccaagcgctgcaattggcaggttgcttgagccagcttcatagcggacttttcttgtaccaagggctgcttcaagcacttgaaggaatttcgcctgaacttggacctaccctggataccctgcagctggatgtggcagactttgccacgaccatttggcagcaaatggaagagctcggcatggcacctgcgcttcagccaacccagggtgcgatgccagcgttcgcgtccgcttttcagagacgggccggcggggtcctcgtcgcatcgcacctccaatccttcctggaagtttcctaccgagtgcttagacatcttgcgcagcct

SEQ ID NO: 9969 - DNA, 612 bp, Artificial Sequence
  Description of Artificial Sequence: Synthetic coding sequence
atggcagggccagcaacacagtccccgatgaaactgatggccctgcagcttctcctgtggcactccgcactgtggacggtgcaggaggccacacccttgggcccagcttcaagcctgcctcagtcatttctgttgaaatgcttagagcaggtacgcaagatccaaggcgacggggccgcgctccaagagaagctgtgcgccacttataagctctgccaccccgaagaactggttctgctgggacacagtctggggataccctgggcccctctctctagctgcccgagccaggccctgcagcttgcaggctgtctgtcccagctacactccggcctgtttctgtatcaaggcttgttgcaggctctggaggggatctcccccgaattgggtcctacgcttgataccctgcaactcgacgtggccgacttcgctacaactatttggcagcaaatggaggaactgggaatggcacccgcattgcagcctacccagggggccatgcccgcctttgccagcgcttttcaacgaagggccgggggggttctcgttgccagccacctgcagtcgtttctcgaggtcagctaccgggtccttagacatctggctcagcct

SEQ ID NO: 9970 - DNA, 612 bp, Artificial Sequence
  Description of Artificial Sequence: Synthetic coding sequence
atggccggacccgctactcaatccccaatgaagcttatggctctgcaactcctcctatggcattctgctctttggactgtgcaggaagcaacacctctaggacctgctagttctcttcctcagagttttctgcttaaatgcctcgaacaggtacggaagattcagggggatggggctgcactgcaggaaaaactgtgtgcgacttataaactatgtcaccctgaggagttagttctgctgggacattctctggggataccctgggcacctctttcatcttgccctagtcaggccctccagctcgccgggtgcctgtcacaacttcactctgggctcttcctttatcagggactcctccaagctctggaagggatatctccagaacttggacctactctcgatacactccagctggatgtagcggacttcgctacaactatatggcagcagatggaagaactgggaatggcccccgccctgcagccaacgcagggagcaatgcccgctttcgcctccgcttttcagaggagagcggggggagttctggttgcatcacacctacagtctttcctcgaagtgtcgtatcgcgtgttaaggcacctcgctcagcct

SEQ ID NO: 9971 - DNA, 612 bp, Artificial Sequence
  Description of Artificial Sequence: Synthetic coding sequence
atggccggccctgccacgcagtcgcctatgaagctgatggcgctgcaattgctcctgtggcacagcgccctctggacggtgcaggaggccaccccactgggaccggccagtagcctgccacaatcattcctgctgaaatgcctcgagcaggtgcggaagatccaaggagatggagctgcgctgcaggaaaagctgtgcgcaacctacaagctgtgtcaccccgaggaactggtcctgctgggacactccctgggaatcccttgggccccgctttcatcctgtccgtcgcaggcactccaactggcgggatgtctgtcacaactgcattcgggactttttctgtatcagggcctgctgcaagcgttggaaggaatctccccagaactgggaccgactctggataccctccaactggacgtcgctgacttcgcaactaccatctggcagcaaatggaggaattgggcatggcaccggcgctgcagccaactcaaggcgccatgccggccttcgcatccgcgtttcagagaagggccgggggcgtgctcgtcgcctcccatctccaatcgttcctggaggtgtcctaccgcgtcttgcggcacctggcgcagcca

SEQ ID NO: 9972 - DNA, 612 bp, Artificial Sequence
  Description of Artificial Sequence: Synthetic coding sequence
atggctggccccgctacccagagccccatgaaattgatggccttacagctgctgttgtggcatagcgccttgtggaccgtccaggaggccactccccttggcccagcgagttcacttccccagtcttttctcctgaagtgcctggagcaggtcagaaaaatacagggagacggcgccgcattgcaggagaagctgtgcgccacatataagctctgccaccccgaggagctcgtgctcttgggccatagtttggggattccatgggctcctctgagttcttgtccctcgcaagctctacaactagctggatgcctctcacagcttcatagcgggctattcctgtaccagggcctgttacaagcactcgaggggatctctccagagctaggaccaaccctggatactttgcaactggacgttgccgacttcgcgactaccatttggcaacagatggaggagctgggcatggcacctgcactacaaccaacgcagggggcaatgcccgccttcgcgtcagctttccagcgcagagctggtggggtgctcgttgcttcacacctccagtcattcttggaagtatcttacagggtgctgcggcacctcgcccaacct

SEQ ID NO: 9973 - DNA, 612 bp, Artificial Sequence
  Description of Artificial Sequence: Synthetic coding sequence
atggcgggacctgccacgcagagcccgatgaaacttatggcgctccagcttcttctgtggcactcagcgctgtggactgttcaggaggctaccccgctcggacccgcctcttcactgccgcaatcgttcctcctcaagtgcttggagcaggtgcgcaagattcagggggacggtgccgccttgcaggaaaagctgtgcgcaacttacaaactgtgccacccagaggaattggtgctgctcggacattcgctcggcatcccttgggcaccgctttcgagctgcccttcccaggctcttcaactggcgggttgtctctcccagctccattccggcttgttcctgtaccagggcctgctgcaggctctggaaggcatctccccagaactcgggccaaccctcgatactctgcaactggacgtggccgatttcgcaactaccatctggcagcagatggaagagctgggaatggcacccgccctgcaaccaacccagggagccatgccggcctttgctagcgccttccaaagaagggcgggaggagtcctggtggcaagccacctccaatcgtttctggaggtgtcataccgggtcctgcgccacctggcgcaaccg

SEQ ID NO: 9974 - DNA, 612 bp, Artificial Sequence
  Description of Artificial Sequence: Synthetic coding sequence
atggcaggcccggcaacccagtcgcctatgaagcttatggccctccagctactattatggcatagcgcactatggacagtgcaagaggctaccccacttgggcccgccagctccctgcctcaatctttcctgttaaaatgtctggagcaagtgcggaaaatccagggagatggtgcggctctgcaggaaaaactctgtgcgacgtacaagctgtgccacccagaggagctggtcctgctgggccatagtctggggattccatgggccccgctgagctcttgccccagtcaggctctgcagttggcggggtgtctgagccagctccattcggggctgttcctctatcagggcctattacaggctttggaggggattagtcccgaactgggccctaccctagatacccttcagctagacgtggcggatttcgccaccactatttggcagcagatggaagagttgggcatggcccctgctcttcagcctacccagggggcgatgcccgcttttgcctccgccttccaacgcagggctggaggcgtactcgttgcttcccatttgcagtcgtttctagaggtgtcgtatagggtgctgcgccaccttgctcagcca

SEQ ID NO: 9975 - DNA, 612 bp, Artificial Sequence
  Description of Artificial Sequence: Synthetic coding sequence
atggccggacccgcaacccagagccccatgaaattgatggcgttacagcttcttctgtggcactcagctctttggactgtgcaagaagcaacgccgctggggcccgcttcatccttaccacagtcttttctcctgaagtgccttgagcaagtacggaagattcagggggacggggccgctttgcaagagaagctctgcgctacctataagctgtgccacccagaggagctggtgctgttaggccactcactcggcataccctgggctccattatcaagctgccccagtcaggctttacagttggcaggctgcctttcacaactgcacagcgggttgttcctctaccaagggctcctgcaggctctggaaggcatttctccagaactcgggccgacacttgacaccctgcaacttgatgttgccgactttgccaccacaatctggcagcaaatggaagagctggggatggcaccagccttgcagcctacgcagggcgccatgcccgcttttgcgagtgcattccaaagacgggcaggaggagtccttgtcgctagtcaccttcagtcttttttggaagttagctatcgtgtgctgaggcatctggcccaaccc

SEQ ID NO: 9976 - DNA, 612 bp, Artificial Sequence
  Description of Artificial Sequence: Synthetic coding sequence
atggccggccctgcgactcagagccctatgaaactgatggcgctgcagctgcttctctggcactcagctctgtggacggtccaagaagcaaccccactcgggccagcttcaagcctcccccaatcgtttctgctgaagtgtctcgagcaagtgagaaagattcaaggagacggcgcagcactccaggagaagttgtgtgctacctacaagctctgccatccagaggaactggtcctgcttggccacagccttggaataccgtgggcacctctctcctcctgcccgtcgcaagcgctgcaacttgcgggatgtctttcccaacttcactccgggctgttcctttaccagggacttctgcaagcgctcgaaggaatctccccggagcttggacccactctcgataccctgcaacttgacgtggcagattttgccactaccatctggcaacaaatggaagaactgggaatggccccagccttgcagccgacccagggcgccatgcctgcatttgcttcagctttccaacggagagcaggtggtgtcctggtggcatcccatctgcagagcttcttggaagtgtcatacagggttctgcgacatctcgctcagcca

SEQ ID NO: 9977 - DNA, 612 bp, Artificial Sequence
  Description of Artificial Sequence: Synthetic coding sequence
atggcaggccctgccactcagtccccaatgaaacttatggcactgcagctactgctgtggcattccgccctgtggaccgtgcaagaggctactccacttggacccgcatccagcctgcctcagtctttcctcttaaagtgtcttgagcaggtgcgaaagatacagggggatggcgccgctctgcaagagaagctctgcgccacctacaagctgtgccaccctgaagaattggtgctgctcggtcactctctgggcataccatgggctcccctcagtagctgccctagccaagccctccaactggctggctgcttatcacagctgcacagcggcctcttcctataccagggcctgctgcaggcactcgagggcatctcaccagagctcgggcctaccctggatactcttcagttagatgtggcagacttcgcaacaacaatctggcagcagatggaggagttaggcatggctcctgctctgcagccaacacaaggtgccatgcccgccttcgcttccgcttttcagaggagagccggcggcgtgttagtggcatctcacctgcagtcatttctggaggtgtcctaccgcgttctgaggcacctggcccagcca

SEQ ID NO: 9978 - DNA, 612 bp, Artificial Sequence
  Description of Artificial Sequence: Synthetic coding sequence
atggctgggcccgccacgcagagtcctatgaaactgatggccctccagttacttctgtggcacagtgccctgtggaccgtgcaggaggccactcccctgggcccagccagttctctgccccagtctttcctgctgaagtgtcttgaacaggtaaggaaaatccagggcgatggtgccgcgctgcaagagaaattgtgtgccacctacaaattatgccaccctgaagaactcgtgctgctgggacattccctcggcatcccctgggcccccttgagttcgtgtccttctcaggcacttcagctcgccggttgcctctcccagctacacagcggactattcctgtatcagggactactgcaagccttggagggcatttcccctgaactgggccctactctggatacactgcagttagatgttgccgactttgctactacaatttggcagcagatggaagagcttggaatggcacctgcccttcagcctacgcagggcgcaatgccagccttcgcatctgcatttcaacgccgggcgggtggcgttctggtggcttcccatctccaatctttcctggaggtatcctaccgcgttctgcggcatctggcacagcca

SEQ ID NO: 9979 - DNA, 612 bp, Artificial Sequence
  Description of Artificial Sequence: Synthetic coding sequence
atggctggaccagccactcagtcaccaatgaagctgatggccctccaactgctcctctggcattcggccctttggaccgtccaggaggctactcctctggggccggcctcatccttgcctcagtccttcctgctcaagtgcctggagcaggtcaggaaaatccaaggagacggagccgcgctgcaagagaagctgtgcgcaacttacaagctctgccatcctgaagaactggttcttctcggtcacagcctgggcatcccgtgggccccgctctcttcctgcccttcacaggccctgcagctggccggatgcctgagccagctgcactcggggctgttcctgtaccagggactcctgcaagctctggaaggaatttcaccagagctggggccaaccttggataccctccagctcgacgtggcagactttgcaaccacgatctggcaacaaatggaagaactgggaatggcaccggccctgcagcctactcagggggccatgccagcgttcgcatctgctttccaacggcgggctggaggagtgttggtggcaagccacctccaatcctttctggaggtgtcttaccgcgtcctgcggcacctcgcccagccg

SEQ ID NO: 9980 - DNA, 612 bp, Artificial Sequence
  Description of Artificial Sequence: Synthetic coding sequence
atggccggccccgccacccagtcacccatgaaactcatggctctacagttgttgctgtggcacagtgcactatggacggtccaggaggccacacctttgggccccgcctcctccctgccgcaatcttttctgctgaagtgcctggagcaagtccgtaagatccagggagacggcgctgccctacaggagaagctttgcgcaacctataagctgtgccacccggaggaactggtgctcttggggcattctttgggcatcccatgggctccgctgtcgtcatgcccaagtcaggccctgcagctcgccggctgcctaagccaacttcactcaggactgttcttataccaggggttgctccaggccctggaagggatctccccagaattaggacctactttagacaccctccagctggacgtggccgattttgcgactactatttggcagcagatggaggagcttggcatggcacccgctctccagcctacgcagggagctatgccggctttcgcatctgctttccaacggcgggccggcggggtgttggtggccagtcatctgcagtcgttcctggaggtgtcatatcgggtcctgaggcacctggcccagcct

SEQ ID NO: 9981 - DNA, 612 bp, Artificial Sequence
  Description of Artificial Sequence: Synthetic coding sequence
atggcaggtcctgcaacccagtcacctatgaaactgatggcattgcaactgctgctgtggcattccgcactctggaccgtgcaggaagcaactccgctgggaccggcgtcctcacttccccagtcatttcttctgaagtgccttgagcaggtgaggaagattcaaggtgatggagcagcactgcaggaaaaactctgtgcaacgtacaaattgtgccatccagaagagctggtgctgcttggccatagcttggggataccttgggcaccgcttagctcgtgtccaagccaagcacttcaactggccggttgcttgtcccaacttcattctggattgttcctgtaccagggacttcttcaggcattggaagggatctcacctgaacttggacctacgcttgatactctgcagctggatgttgcggattttgctactactatctggcagcaaatggaagagcttgggatggccccagcgttgcagccaacccaaggcgccatgcccgcatttgcttcggcctttcaacgtagagcaggtggtgtgctggtggcttcgcacctccagagcttcctggaggtgagctaccgcgtgctgcgccatcttgcacagcca

SEQ ID NO: 9982 - DNA, 612 bp, Artificial Sequence
  Description of Artificial Sequence: Synthetic coding sequence
atggcaggaccagcaacccagtcgcctatgaagctgatggcactccagttgctgctgtggcactcggctctgtggactgttcaagaggcaaccccgctgggcccggcaagctcattgccgcagtcgttcctgttgaagtgtctcgagcaagtccgaaaaatccaaggtgatggggcagctctgcaggagaaactgtgcgcaacttacaagctgtgtcatcctgaagaattggtgttgcttggtcattccctgggtatcccttgggccccgctttcctcgtgccctagccaggcactgcaacttgctggttgtctctcccaactgcattccgggctgttcctttaccagggactccttcaagcgctcgaaggtatttccccagaactgggcccaaccctcgacacccttcaactggatgtcgcagactttgcaacgactatttggcagcagatggaagagttgggaatggccccggcacttcaaccaactcaaggagctatgccggcattcgcgtcagcattccaaagacgcgccggaggagtgctcgtggcctcccatctccagtcgtttctggaggtgtcgtatcgggtgctcagacaccttgcccagcct

SEQ ID NO: 9983 - DNA, 612 bp, Artificial Sequence
  Description of Artificial Sequence: Synthetic coding sequence
atggcaggtccagccacccaatcgccaatgaagctgatggcactgcaactgctgctgtggcattccgccctgtggaccgtgcaggaagcaactccgctgggaccagcgtcgtccctgccgcagtcctttctgctcaagtgccttgaacaggtgcggaagatccaaggagatggggccgccctgcaggaaaaactttgcgcgacctacaagctctgccacccggaggagttggttctgctgggacactcactgggaatcccgtgggctccactgagctcatgtccatctcaggcactccagctcgccggttgcttgtcgcagctgcattcaggactgttcctgtaccagggacttttgcaggctttggagggcatctcgcctgaactgggcccgaccctggacacgctgcagctggatgtggcagactttgccactactatctggcagcaaatggaggaactcgggatggcacctgccctgcagccaactcaaggagccatgccggccttcgcgtccgccttccagcgccgggccggaggagtgcttgtggcgtcgcacctgcaaagtttcctggaggtgtcgtaccgggtcctgcggcaccttgctcagccg

SEQ ID NO: 9984 - DNA, 612 bp, Artificial Sequence
  Description of Artificial Sequence: Synthetic coding sequence
atggcgggaccggccacccagtctccgatgaaactgatggctctgcaactgctgctttggcattccgccttgtggaccgtgcaagaagcgacccctctcggaccggcctcgagcctgccccagtcctttctgctgaagtgtctcgaacaggtgaggaagatccagggagacggtgccgccttgcaggagaaactgtgtgcaacctacaagctctgccacccggaggaactcgtcttgctcggtcactcgctgggcataccctgggcaccactctcatcatgccctagccaggccctgcagctggcgggatgcttgtcccaactgcactcgggcctgttcctctaccagggcctcttgcaagcccttgaaggaatttcccctgagctcgggccgacgcttgacactcttcaactggatgtggccgacttcgcaactaccatctggcaacaaatggaagaacttgggatggcaccggctctccagccgactcagggagcgatgccagcgttcgcttcagcttttcagcgccgggcgggaggtgtgcttgtcgcctcgcacttgcagagtttcctggaggtgtcttaccgggttttgcgccatctcgcccaaccg

SEQ ID NO: 9985 - DNA, 612 bp, Artificial Sequence
  Description of Artificial Sequence: Synthetic coding sequence
atggccggaccagccactcagtctcctatgaaacttatggccctgcagctcctcttgtggcactcagcactttggactgtccaagaggcaacgccgctgggaccggcttcatcactgccgcagtcatttctcctcaagtgccttgagcaagtgcgcaaaatccaaggagacggcgcagcgctgcaggagaagctgtgtgccacttacaagctctgtcatccggaagaactggtgcttctgggccatagcctcggtattccctgggcccccctgtcatcgtgcccttcgcaggcactgcagctggcaggatgcttgtcgcaactccacagcggactgtttctgtaccaaggattgctgcaggcactcgagggcatttcaccggaactcggccccacccttgacaccttgcaattggacgtggctgatttcgcgactaccatctggcagcagatggaggaactggggatggctccggctcttcaaccaacccagggtgcaatgccggcttttgcctcagccttccaaagacgcgccggtggagtcctcgtggcctcccacctgcaatcttttttggaagtgtcctaccgcgtcctgcggcacctggcccaaccg

SEQ ID NO: 9986 - DNA, 612 bp, Artificial Sequence
  Description of Artificial Sequence: Synthetic coding sequence
atggctggtccagccactcagtctcccatgaagctgatggccctgcagctgctgttatggcattcagccttgtggactgtgcaggaggcaacaccactcggcccagcgtcttcgttacctcaatccttcttactgaagtgcctcgaacaagtcaggaagatccagggcgatggcgcagccctccaggaaaaactgtgcgctacgtacaaactgtgccatcccgaggagctggtgctcctgggccattcactgggtatcccttgggcccccttatcctcatgcccttcacaggcccttcagcttgccggttgtctgtcccagctgcacagtggactgtttctgtaccagggactgttgcaggccctggagggtattagccccgaactgggaccaaccctggacaccctccagctggacgtcgccgattttgcgactactatatggcagcagatggaagaattgggtatggcaccagctcttcagccaacgcagggggctatgccagcctttgcttccgccttccaacggcgcgccggcggcgtactggtggcctcacacttgcagtcttttctggaggtgtcttatcgcgttctaagacatctggcacagcct

SEQ ID NO: 9987 - DNA, 612 bp, Artificial Sequence
  Description of Artificial Sequence: Synthetic coding sequence
atggctggacctgctacgcaatctccaatgaaacttatggcattacaattacttctttggcatagtgcattatggactgttcaagaagcaacaccattaggtccagcaagttcacttccacaatcttttttattaaagtgtcttgaacaagtcagaaaaattcagggagatggagcagcattacaagaaaaactttgtgctacttataaattatgccacccagaagaattagttttgttaggacattcattaggaattccttgggctccattaagttcttgtccatcacaagcactacaattagctggatgtttaagtcaacttcattcaggactttttctttatcaaggactcttacaagcacttgaaggaatttctcctgaacttggtccaacactagatactttacaattggatgttgcagattttgcaactactatttggcaacaaatggaagaacttggaatggctccagcattacagccaactcaaggagcaatgccagcttttgcaagtgcttttcaaagaagagcaggaggagttttagttgcttcacatttgcaaagttttttagaagttagttatcgtgtattaagacatctagcacaacca

SEQ ID NO: 9988 - DNA, 612 bp, Artificial Sequence
  Description of Artificial Sequence: Synthetic coding sequence
atggctggaccggctactcagtccccgatgaaattgatggccctccaattgctcctctggcattccgctctgtggactgtacaggaagccaccccacttggaccggcgtcaagcctgcctcagtcgtttctcttgaagtgcctcgaacaggtcagaaagatccagggagatggtgcagcactgcaggaaaaactttgcgcgacttacaagctgtgccatcctgaggaacttgtcctgctcggacactcgctgggaatcccatgggcccccctctcatcatgcccgtcgcaagctctgcaattggctggatgtctgagccagctccatagcggcctttttctctaccagggcctgctccaggctctggagggaatctctcctgaactcgggccaaccctggataccctgcagttggacgtggcggacttcgccaccaccatttggcaacagatggaagagctgggtatggctccagcattgcaacctactcagggggcaatgccggctttcgcctcggcgttccagcggcgcgccgggggcgtgcttgtggcttcacatcttcaatccttcctggaggtgagctatagagtgctgaggcacttggcacagccg

SEQ ID NO: 9989 - DNA, 612 bp, Artificial Sequence
  Description of Artificial Sequence: Synthetic coding sequence
atggccggcccggctactcaatctccaatgaagcttatggctcttcagttgcttttatggcactcggctctatggaccgtccaggaagccacaccgctggggcctgcaagttcgttaccccaatcgttcttgctgaaatgtcttgagcaggttagaaagatccagggggatggcgccgcgctccaggagaagctgtgcgcgacatacaaactttgccacccggaggagttggtgctgctggggcatagcctaggaataccttgggccccgctgtcaagctgtcccagccaggcactgcagctggccgggtgtctttctcagttgcactctggcctctttctctaccagggactgctgcaagccctcgaaggcattagccccgaactcggcccgactctggatactctccaacttgacgtggcagattttgccacgactatatggcagcagatggaggagttgggcatggcacccgcactgcagcccactcagggagccatgccggcttttgcatcagccttccagcgcagggctggcggggtgctcgtggctagccacctccaatcttttctggaggtgtcatacagagtgctgcggcacctcgcccagcct

SEQ ID NO: 9990 - DNA, 612 bp, Artificial Sequence
  Description of Artificial Sequence: Synthetic coding sequence
atggcggggccggctacccaatcaccgatgaagctgatggcgttacagcttcttctgtggcactctgcgttgtggactgttcaagaagcgaccccgttggggccagcatcatcacttcctcaatcttttctgctcaaatgtctagaacaagtgaggaaaattcaaggcgatggcgcggccttacaggaaaaactgtgtgcgacttataagttgtgccacccggaggagttggtgttgttaggccatagtctaggaatcccatgggctccgttgtcatcgtgcccaagtcaagcactgcagctggccgggtgtctttctcagctgcactcgggccttttcttatatcaaggactgcttcaagcgctggagggtatctcccctgagctaggcccgactttggatacgcttcagcttgacgtagcagattttgctacgacgatttggcaacaaatggaagaattaggtatggcaccggcgttacaaccaacgcagggagcaatgcctgcgtttgcgtctgcgtttcaacgtcgtgcaggcggtgttttagttgcctctcacctgcaatcttttctggaggtctcataccgcgtcttgaggcacttagcacagcct

SEQ ID NO: 9991 - DNA, 612 bp, Artificial Sequence
  Description of Artificial Sequence: Synthetic coding sequence
atggcaggccccgcaacgcagagcccaatgaagctgatggctctgcagttgctgttgtggcactctgctctgtggacggttcaggaggctacccccctgggcccggcaagcagcctgccacagtctttcctcctgaagtgccttgaacaggttaggaaaatccagggcgacggcgctgctttgcaggagaagctttgtgcgacctacaagctgtgccacccagaagagctcgtgctgttgggtcactccctgggaatcccctgggccccacttagcagctgcccaagccaggctctccaactggctggttgtctgtctcagcttcattctggtcttttcctttatcagggcctgcttcaagctcttgaaggaataagccctgagctgggaccgacactggacacactgcagctggatgtagccgacttcgctacgactatctggcagcaaatggaagaactcgggatggccccggctctgcagccaacccagggtgcgatgccagccttcgcatcagctttccagcgcagggccggcggggtgcttgttgcgagtcaccttcaatcctttctggaagtatcatatagggtcctcaggcatctggcgcagcct

SEQ ID NO: 9992 - DNA, 612 bp, Artificial Sequence
  Description of Artificial Sequence: Synthetic coding sequence
atggcaggtccagccactcagtcaccaatgaaactgatggcgctccagctcctgctgtggcacagtgccttgtggaccgtgcaggaagctactccattaggtccggccagctccctgccacagagctttctgcttaagtgcctcgagcaggtgcgcaagatccaaggtgacggtgctgccctgcaagaaaaactgtgcgcaacatataaactttgtcatcccgaagaactggtactgctggggcacagcttgggtataccatgggccccgctgagctcctgccctagccaggctctgcaactggcgggttgcctgagccagctgcactctggtctgttcttgtatcagggattgttgcaagccctggaaggcattagcccagagcttggcccaacccttgacactttgcagctggacgtggccgacttcgcaaccacaatttggcaacagatggaggaactcggcatggccccggcactccaaccaactcagggtgccatgcctgcatttgcatcagcgtttcagcggcgtgccggcggggtgctggttgcaagccatctccagtcttttctcgaggtgtcctaccgtgtcctgcgtcatctagctcagcca

SEQ ID NO: 9993 - DNA, 612 bp, Artificial Sequence
  Description of Artificial Sequence: Synthetic coding sequence
atggctggccctgccacgcagtcccccatgaagctgatggcccttcaattactcctctggcattccgcactgtggacagtgcaggaagcgacaccgctcggacctgcctcttcactcccccaatccttcttgctcaaatgcctcgaacaggtgaggaagatccagggcgatggcgccgcactgcaggaaaagctgtgcgccacatataagctctgccaccctgaagaactggtcttgctgggacattctcttggaattccctgggcacctctatcatcttgtccctctcaggcactacagttagccgggtgtctgtcccagctccacagcggtctcttcttatatcaaggccttctgcaggcgctggaagggatctctcctgagcttgggcctaccctcgatacactgcagttagacgtggccgacttcgccaccaccatatggcagcaaatggaagagcttggcatggcacctgccttacagcccacccagggtgccatgcctgcctttgccagcgcatttcagcggcgggctggtggcgtgttggtagcctctcacttgcagtcatttctggaggtaagctatcgtgtacttaggcatctcgcccagcca

SEQ ID NO: 9994 - DNA, 612 bp, Artificial Sequence
  Description of Artificial Sequence: Synthetic coding sequence
atggccggcccggccactcaatcgccaatgaagctcatggctctgcagcttctcttgtggcactccgctttgtggaccgtccaagaagcgaccccgctgggtccggcctcctctcttcctcagtccttcttgctcaagtgcctcgagcaagtgcgcaagattcaaggggacggagccgctctccaggaaaagctctgtgccacgtacaaactctgccaccccgaggagctggtcctcctggggcatagcctgggcatcccatgggcgcctctgtcatcttgcccctcgcaagctctgcaactggccggttgtctgtcgcagttgcatagtggactcttcctgtaccaggggctgctgcaggccctggagggaatcagccctgagcttgggcccaccctcgacactcttcagctggatgtggcggatttcgcgactaccatctggcagcagatggaggagcttggcatggcgccagcgctgcagccgacccagggtgctatgccggcatttgcctcggcatttcaacgacgtgcgggtggagtgctggtggcctcccatctccagtccttcctggaagtctcataccgggtgctgcggcacctggcccaaccc

SEQ ID NO: 9995 - DNA, 612 bp, Artificial Sequence
  Description of Artificial Sequence: Synthetic coding sequence
atggctggccctgctacacaatcacctatgaagctgatggcccttcagttgctgctctggcactccgccttgtggacagttcaggaggccacacccctggggcccgcttcctcgctgccgcagtcgtttctattaaagtgccttgaacaagtaagaaagatccagggagatggcgcagctcttcaggagaaactttgcgctacctataagttgtgccatcctgaggagctggttctactcggccattcgttaggcataccctgggctccactgagtagctgtccaagtcaagcccttcagctagctggttgcctgtcccagctgcactccggcctgtttctctatcagggcctgttgcaggccctggagggcatctctccagaactgggaccaaccctggatacactgcagttggacgtggccgacttcgcgacaacaatctggcagcagatggaggaactgggtatggctcccgccctgcagcccacacaaggcgctatgccggcatttgccagcgccttccagcgaagggcagggggggtgcttgtcgcctcccacctgcagtcattcctcgaagtgtcatatcgggtactacgccacttagctcagcca

SEQ ID NO: 9996 - DNA, 612 bp, Artificial Sequence
  Description of Artificial Sequence: Synthetic coding sequence
atggcgggtcctgccacccagtcgcctatgaaactaatggcgcttcagttgttgctctggcactccgcactgtggaccgttcaggaagctacccctctcggaccggcttcttccctgccgcagtcgttcctgctcaagtgcttggagcaagtgcgaaagattcagggagacggagccgctctacaagagaagctttgcgccacctataaactgtgccatcctgaggagctggtgttgctcggccattcgttggggatcccctgggcgcccctcagttcctgcccatcccaagcactgcagctcgccggttgcctgagccagctccattctggcttgtttttgtaccagggcctgctgcaggctctcgaaggaatctcccccgaactgggtcccacactggataccctccagctggacgtggctgatttcgctaccaccatctggcagcagatggaagagcttggtatggcccctgctctccagccgacccagggtgctatgccggcattcgcctctgcattccagcgtagggcggggggggttcttgtggccagccacctgcagtccttcctggaggtgagctaccgcgtcctgcgtcacctggcccaacct

SEQ ID NO: 9997 - DNA, 612 bp, Artificial Sequence
  Description of Artificial Sequence: Synthetic coding sequence
atggccggccctgcaactcaatcacctatgaagctcatggcattgcagttgctcctctggcactcggcactttggaccgtgcaggaagcgacccccctgggacctgcaagctcgctgccacaatcgtttctgctcaagtgccttgaacaggtgagaaagatacagggagatggagccgcacttcaagaaaagctctgtgcgacgtataaactgtgccacccagaggaacttgtgctgctgggtcacagcctgggaattccctgggcacctctgtcctcttgcccttcccaagcacttcagcttgctggttgtctttcccaactgcattccggtcttttcctttaccagggactcctgcaagcactggaagggatttcaccggagctcggtcccaccctcgacaccctgcaacttgatgttgcagactttgccaccactatctggcaacaaatggaggaactcggaatggcacctgcactgcaacccacccagggcgccatgccagcatttgccagcgccttccagcgccgcgccggaggtgtgctggtggcctcccatttgcagagctttttggaggtgtcgtaccgcgtgctgagacacttggcccagcca

SEQ ID NO: 9998 - DNA, 612 bp, Artificial Sequence
  Description of Artificial Sequence: Synthetic coding sequence
atggcggggccggccactcagtcaccaatgaaactcatggcactgcagcttctcctctggcattccgcgctgtggacggtgcaagaggcgactcctctgggaccggcctcatcgctgccacaatcttttctcctgaaatgtctggagcaagtgcggaaaatccagggagacggcgccgctctccaagagaagctgtgcgctacctacaagctgtgccacccggaggaactcgttctgctcggccactcgctcggtatcccgtgggctcctctcagctcgtgcccgtcgcaagcgttgcaactggcaggctgcctgtcgcagttgcactcgggactcttcttgtatcagggcctgctccaggcactggaagggatcagcccggaactcggaccaactctcgacactctgcagctggacgtcgctgattttgctaccaccatctggcagcagatggaggagctgggtatggcgccggctctgcagccaacccaaggagccatgccggccttcgcgtcggccttccaacggcgggccgggggagtgctggtggcctcccacctgcagagctttctggaggtgtcgtacagggtgctgcgccacttggcacagccg

SEQ ID NO: 9999 - DNA, 612 bp, Artificial Sequence
  Description of Artificial Sequence: Synthetic coding sequence
atggccggacccgcgactcagagcccaatgaagctgatggctcttcagctgctgctgtggcattccgccctgtggaccgtccaggaggctactccgctgggaccggcatccagcctcccacagtcgtttcttctcaagtgcctggagcaggttcggaagatccagggcgacggagcagctctccaggaaaaactctgcgccacctacaagctctgtcacccggaggagctggtcctgctgggacactcgctggggattccctgggctccgctgtcgtcctgcccttctcaggcgctgcagctcgctggttgcctgagccagctgcactcgggactgttcctgtaccagggcttgcttcaggcactggaaggcatctcgcctgaactgggaccaaccctggacacgttgcagctggatgtggcagacttcgcgactactatctggcagcagatggaggaactgggaatggcgcccgccctgcagccgacccagggagcgatgcccgccttcgcctcggcgttccaaaggagagctggaggtgtgctggtcgcctcacacctgcagagctttctcgaagtgagctacagagtcctgcgccatttggctcagcct

SEQ ID NO: 10000 - DNA, 612 bp, Artificial Sequence
  Description of Artificial Sequence: Synthetic coding sequence
atggcagggcccgcaacccaatcaccgatgaaactgatggccctccagcttctcctgtggcattcagccctgtggacagtacaggaggcaacacctctggggcccgcaagtagtctgccccagagttttctgttgaagtgtttggagcaagtgagaaaaattcaaggcgacggtgccgcccttcaggagaagctctgcgctacatacaaactgtgtcacccagaggaactcgtgctgctgggacactcgctgggaattccctgggccccactctcttcctgccctagtcaggcactgcagctggctggttgtctgtcacagttacactccggacttttcctctaccaggggcttctgcaggcactagagggcatatctcctgagcttggacccaccttagatacgttgcagcttgatgtggccgacttcgccacgactatctggcagcagatggaggagctgggtatggcgccagcattgcagccaacacagggcgccatgcctgcctttgcatctgcctttcagcggcgcgctggcggcgtgctagtagccagccacctccagagtttcctggaagttagctatcgggtgctgcgccatctggcccagcct

SEQ ID NO: 10001 - DNA, 612 bp, Artificial Sequence
  Description of Artificial Sequence: Synthetic coding sequence
atggctggaccggccacccaatcccccatgaagctgatggctctccagctgcttctttggcactcggcgctgtggaccgtccaggaggccactccgctgggaccggcctcctccttgccacagtccttcctcctgaaatgcctggaacaagtccgcaagatccagggagacggagccgccctccaagagaaactctgtgcaacctacaagttgtgccacccagaggaactggttctgctcggacactcgcttggcatcccatgggcgccattgagtagctgcccttcgcaggccctccagctcgcgggctgcttgagccagctgcattcggggctgttcctctaccaggggctgctgcaggctttggagggaatcagcccggaactgggaccgaccctggatactctccagctcgacgtcgctgatttcgctactactatttggcaacaaatggaggagctcggcatggcccccgccctgcaaccgactcaaggcgcgatgcccgcttttgcgagcgctttccagaggagggccggaggggtgctggtcgccagccacctgcagtcgttccttgaagtgtcataccgcgtgctgcgccacttggcacagccg

SEQ ID NO: 10002 - DNA, 612 bp, Artificial Sequence
  Description of Artificial Sequence: Synthetic coding sequence
atggccggcccggctacccaaagtcctatgaagctgatggcattacagttgcttctgtggcactcagcgctctggacggttcaagaagctaccccccttggtcccgcttctagtctaccccaatcctttcttttgaagtgcttggagcaagttagaaaaatccagggtgatggcgctgcattacaggagaagttgtgtgcaacttataaattgtgccatccagaggagctggtgctcttgggtcattcccttgggatcccatgggccccgctttcaagttgtccaagccaggctttgcaactcgctggctgcctttcacaattgcattcgggtttgtttttgtatcagggattgttgcaggctctggaaggtattagcccagagcttgggcctaccctcgacactctccaactagatgtagccgactttgcgacgaccatttggcaacaaatggaagagttgggtatggcccctgccttgcagcctacacaaggagctatgcctgcatttgcttcagcttttcagagacgtgccggtggtgtcttagtggcaagccacttgcaatctttcttggaagtgtcatatagggtgctcagacatttggcccaaccg

SEQ ID NO: 10003 - DNA, 612 bp, Artificial Sequence
  Description of Artificial Sequence: Synthetic coding sequence
atggcaggacctgcaacccagtcaccgatgaagctgatggccctccaactgcttctttggcactcagcgctttggactgtgcaggaagctacccctctcgggcctgcaagctcactgccacaatcgttcctgctcaagtgcctggaacaggtgaggaagatacaaggggatggggcagctcttcaggagaagctgtgcgcgacttacaaactttgtcatcctgaagaacttgtgctcttgggacacagcttgggaattccatgggccccactctcgagctgtcccagccaggctctgcaactggctggctgcctgtcccagttgcattcgggacttttcctttatcaaggacttctgcaagcactggagggaatttcccctgaactgggtcctactcttgatactcttcaacttgacgtggcagattttgccaccactatatggcagcagatggaagagctcggtatggcacctgcactccaaccaacccagggggcaatgcccgcatttgcctcagcatttcaaaggcgggccgggggcgtccttgtcgcctcacatttgcaaagttttttggaggtgtcctaccgagtgcttcgccacctcgctcaacct

SEQ ID NO: 10004 - DNA, 612 bp, Artificial Sequence
  Description of Artificial Sequence: Synthetic coding sequence
atggctggaccagccactcagagtcctatgaagcttatggccctgcagctgctgttgtggcactctgctttgtggaccgtgcaggaggcaacccctctgggaccagcctcaagcctgccacagagtttcctgctgaaatgcctggagcaggttagaaaaatacagggagacggcgctgcgctgcaagagaagctgtgcgctacatataagctgtgtcatccagaggagctggtcctgctcggccacagtcttggaatcccatgggcacccctgtcatcttgcccttcacaggctctgcagttggctggctgtctctctcagctgcacagtggtctgttcctgtaccagggccttctccaagctcttgagggaatctctcctgagcttggcccaacactggatacactccaattggatgtggccgattttgcaactaccatctggcaacaaatggaggagcttggaatggcacctgccctgcagcctacccagggcgcaatgccagccttcgcctccgcctttcagcgtagagctggtggcgttctggtggcttcgcatcttcagagcttcctggaggtgagctaccgggtgcttagacacctggctcagccg

SEQ ID NO: 10005 - DNA, 612 bp, Artificial Sequence
  Description of Artificial Sequence: Synthetic coding sequence
atggcaggccctgccactcagtctccaatgaagctcatggcactccagttactgctgtggcacagcgcgttatggaccgttcaggaggccacaccactcgggccagcttcatctttgccccagagtttcctgttaaagtgtctggaacaggttcgcaaaatacagggcgatggcgctgccctgcaggaaaagctgtgtgccacctataaactctgccaccccgaggaactggtgttgctgggccattcgctgggcataccctgggctccactgagctcttgccccagccaggccttgcagctcgccggatgtctgtcacagcttcacagcggacttttcctgtatcagggactgttacaggccctggaggggattagtcccgaattgggccccacgctcgacactctgcaactagacgtggccgactttgcgactactatttggcagcagatggaggagcttggcatggctcccgccctccaaccaacgcagggtgccatgcccgcctttgcatccgcattccagcgtagagctggcggtgtcctggtagcctcccatttgcagtctttcctggaagtctcttacagggtcttacggcatctcgcgcagccc

SEQ ID NO: 10006 - DNA, 612 bp, Artificial Sequence
  Description of Artificial Sequence: Synthetic coding sequence
atggccggccctgctacacaaagtcctatgaagctgatggccctccagctgctcctctggcatagcgctttgtggaccgtgcaagaagccaccccgttgggacctgcgtcctcactgcctcaatcttttctgcttaagtgcttagaacaggtccgaaaaatccagggagatggcgcagcactacaagaaaagctctgcgcaacttacaagctctgtcatcctgaagagctggtgctactcggacatagccttggtattccctgggctcccctttcttcctgccccagccaggcactgcagctggcagggtgtctcagccagcttcacagtggactcttcctgtatcagggcctcctgcaggctctcgaggggatttcacccgagctgggaccgaccttggacacattacagttggatgtggcagacttcgctacgacaatctggcagcaaatggaggagctggggatggcgcccgctttgcagcccacgcagggcgccatgcccgccttcgcatctgcatttcaacgtagggctggcggtgtgctagtggcttcccatctgcagtctttcctggaagtctcttacagggtactccgccatctggcacaacct

SEQ ID NO: 10007 - DNA, 612 bp, Artificial Sequence
  Description of Artificial Sequence: Synthetic coding sequence
atggcaggtccagccacccagtctcccatgaaactgatggctctgcagcttctgctatggcactcagccctgtggacggtgcaagaggccacccccctgggaccggctagcagtcttccccaatccttcctcctcaagtgccttgagcaggtgcggaaaatccagggagatggagccgctctgcaagaaaaactttgcgccacctacaagttatgtcatcctgaggaacttgtacttctgggacacagcctgggtattccatgggcccccctgtcaagttgcccttcccaagcccttcagcttgccggttgcctgtcacagctgcactccgggcttttcctctaccagggcctgcttcaggcgctggagggtatttcacccgagttggggccaaccctggatacactccagctcgatgtggcagattttgcgactaccatctggcagcagatggaagaattggggatggcccctgccctacaacccacgcagggcgccatgcctgcgttcgcaagtgcctttcagaggcgggctggaggcgtactcgtggccagtcacctccagtcattcctggaggtgagctaccgggtgttacgccacttggcccaacct

SEQ ID NO: 10008 - DNA, 612 bp, Artificial Sequence; identical to SEQ ID NO: 9980
  Description of Artificial Sequence: Synthetic coding sequence

SEQ ID NO: 10009 - DNA, 612 bp, Artificial Sequence
  Description of Artificial Sequence: Synthetic coding sequence
atggcgggacccgctacccagtctccgatgaagctcatggctttgcagctcttactgtggcatagtgccctttggaccgtgcaagaagccaccccactgggccctgcaagctctctgccacaaagtttcctcctcaagtgcttagagcaggtacggaagattcaaggcgatggtgcagccctgcaggagaagctgtgcgctacttacaaactctgccaccctgaagaactcgtcctgctgggccattcacttggaattccctgggcgccactatctagttgtcctagccaagcactgcaactcgccggttgcctcagccagttgcattctggcctgtttctttatcagggattgcttcaggcacttgaagggatcagtccagagttaggcccaactctcgacaccttacagctcgatgtggccgactttgccaccactatctggcagcaaatggaggagctggggatggccccagcactgcagcctacccaaggggccatgcctgccttcgcttccgcttttcagcgcagagccgggggcgtgcttgtggcttcacacctgcagtcgtttctcgaggtctcctatagggtactgagacacctcgcacaaccc

SEQ ID NO: 10010 - DNA, 612 bp, Artificial Sequence
  Description of Artificial Sequence: Synthetic coding sequence
atggcgggtccggcgacgcaatcgccgatgaaactaatggcgctacaattattactatggcattcggcgttatggacggttcaagaagcgacgccgctaggtccggcgtcgtcgttaccgcaatcgtttctattaaaatgtttagaacaagttcgtaaaatacaaggtgatggtgcggcgttacaagaaaaattatgtgcgacgtataaactatgtcatccggaagaattagtactactaggtcattcgctaggtataccgtgggcgccgctatcgtcgtgtccgtcgcaagcgctacaattagcgggttgtttatcgcaattacattcgggtttatttttatatcaaggtttattacaagcgttagaaggtatatcgccggaattaggtccgacgttagatacgttacaactagatgttgcggattttgcgacgacgatatggcaacaaatggaagaattaggtatggcgccggcgctacaaccgacgcaaggtgcgatgccggcgtttgcgtcggcgtttcaacgtcgtgcgggtggtgttttagtagcgtcgcatttacaatcgtttttagaagtatcgtatcgtgtactacgtcatctagcgcaaccg

SEQ ID NO: 10011 - DNA, 612 bp, Artificial Sequence
  Description of Artificial Sequence: Synthetic coding sequence
atggccggacctgccacccagagcccgatgaaactgatggccctgcaactgctgctgtggcactcggctctgtggaccgtgcaagaggccactccactggggccggcgagcagcctcccgcaatcattcctgctcaagtgccttgagcaggtgcgcaagatccagggtgacggtgccgcactgcaggaaaagctgtgcgctacttacaagctgtgccaccccgaggagctcgtgctcctgggacattccctcggcatcccgtgggctccgttgtcgtcatgcccgtcgcaggctctccagctcgcgggctgtttgtcgcaactgcactctgggctgttcctctatcaaggactgttgcaggcccttgaggggatcagccccgaactgggtccgactctggacaccctgcagctcgatgtggccgattttgcaaccaccatctggcaacagatggaagagctgggaatggcaccagcgctccagccaacccagggcgccatgccggctttcgcctcggcgtttcaacggcgcgcgggcggagtgcttgtcgcttcgcatttgcagtccttccttgaagtgtcgtaccgggtgctgagacacctggcacaacct

SEQ ID NO: 10012 - DNA, 612 bp, Artificial Sequence
  Description of Artificial Sequence: Synthetic coding sequence
atggcaggtcccgctacacagagccccatgaaactgatggctttgcaactcctgctgtggcattcagccctgtggaccgttcaggaggctacccccctgggtcctgcttctagccttcctcaatcatttctgctcaagtgtctcgaacaagtaagaaagatccagggtgatggagctgccctgcaagaaaagctgtgtgccacttataaactttgccatcccgaagagctggtgttgctgggccattcccttggcataccctgggctccacttagttcatgcccttcacaagctctccagttggctggctgcctgtcacaacttcattcaggactctttttgtaccaaggcctgctgcaggccctggagggtatctcccctgagctgggccccacactggacacactgcagctggatgttgctgactttgccactaccatctggcagcagatggaagaactgggtatggctccagccctgcagcccactcagggcgctatgcctgcattcgctagtgccttccaaaggagagcaggcggtgtgctggtggcctctcatctgcaatcattcctggaagtgtcttaccgtgtgctgcgccatttggcccagccc

SEQ ID NO: 10013 - DNA, 612 bp, Artificial Sequence
  Description of Artificial Sequence: Synthetic coding sequence
atggctggccccgccacgcagagtccaatgaagttgatggcgctgcagttgctcctgtggcactccgccctttggactgtgcaggaggctacccctttggggccggcatcctctctcccgcagtcgtttctgcttaagtgtctcgaacaggtccgaaagattcagggggacggagccgccctgcaggagaaactctgtgccacctacaagctgtgtcaccctgaggagcttgtacttctgggccactcgctgggaatcccctgggcgcctctcagttcttgcccatcacaggcgttgcagttggcaggctgcctgagtcagctgcatagcggtctgttcctctaccaggggctgttgcaggccctggagggaatatcacctgaactcggccccacgctcgataccttgcagctcgatgttgctgacttcgcaaccacgatttggcaacagatggaggagctaggtatggcacctgctctccaaccaacccagggagcgatgccagctttcgctagcgcattccagagacgggctggcggggtcctggtggcatctcatctgcagtcatttctcgaagtaagttaccgcgtactcagacacctggcccagcct

SEQ ID NO: 10014 - DNA, 612 bp, Artificial Sequence
  Description of Artificial Sequence: Synthetic coding sequence
atggcaggtcctgcaacccaatcccccatgaagttgatggcgctgcaacttcttctgtggcactcagcactctggactgtgcaggaagcaactcctctcggtcctgcttccagccttccgcaatccttccttttgaaatgcctggaacaggtcaggaaaatccagggtgatggggcagcgctgcaagaaaagctgtgtgcaacgtacaagttgtgccaccccgaggagctcgtgcttttgggacattctcttgggattccttgggctccactctcatcgtgtccatcccaagcccttcagctggctggatgtctcagccagcttcactccggcctttttctgtaccaaggattgctccaggcgcttgaaggtatttcgccagaactgggtcccaccctggacaccctgcagcttgatgtcgcagattttgccaccactatctggcaacagatggaggaactgggaatggcaccagccctgcagcccacccaaggcgcaatgcctgcatttgcgtctgcgttccaacgaagagccggtggggtgcttgtcgcaagccatctgcaatcctttcttgaggtgtcttaccgcgtgcttcgccacctggcacagcct

SEQ ID NO: 10015 - DNA, 612 bp, Artificial Sequence
  Description of Artificial Sequence: Synthetic coding sequence
atggcaggacctgcaactcagtcacctatgaagctgatggcactgcaattgctcctttggcattccgccctgtggaccgtgcaggaagccactcctcttggacctgcatcaagcctgccacaatcctttctgctcaagtgtctcgaacaagtcaggaagattcaaggagatggagccgcattgcaggaaaagctgtgtgctacctataagctgtgccaccctgaagaacttgtccttcttggtcattcgttgggtatcccgtgggcaccactgtcgtcctgtccatcccaggccctgcaacttgctggatgtctctcccaattgcattcgggactttttctgtaccaggggctgcttcaggcacttgaaggtatttcacccgaacttggacctaccctggacacccttcaacttgatgtcgcagattttgcaaccaccatctggcaacagatggaagaacttggtatggccccagccctgcaacctacccagggggcaatgcccgcatttgcaagcgctttccaaagacgggcaggtggagtgctggtggcatcgcaccttcagtcctttttggaagtgagctaccgcgtcctgagacatctggcgcaaccc

SEQ ID NO: 10016 - DNA, 612 bp, Artificial Sequence
  Description of Artificial Sequence: Synthetic coding sequence
atggccggtcccgccactcagtcccctatgaagttaatggccttacaattgctgctttggcactcagctttgtggaccgtgcaggaggccacaccgctcgggccggcaagctctttgcctcagtcattcttattaaagtgtctggagcaggtgcggaaaatccagggagacggtgctgcccttcaggaaaaactgtgtgcgacttataagctgtgtcaccctgaggaacttgtcttgttaggccacagcttaggaatcccctgggctcctttaagcagttgtcccagccaggccttgcagttagcagggtgtctcagtcagctccactccggattattcctgtatcaggggctgctgcaggctctcgaagggatctcgcctgagcttgggcccacactcgatactctgcagctcgatgtggccgacttcgcgactactatctggcagcagatggaggaactgggcatggcacccgctctgcagcctactcagggggccatgcctgcctttgcttccgcctttcaaaggagagcgggtggtgtgcttgtggccagtcatcttcagagtttcctggaggttagctaccgagttctgagacacctcgcacagcca

SEQ ID NO: 10017 - DNA, 612 bp, Artificial Sequence
  Description of Artificial Sequence: Synthetic coding sequence
atggccggaccagccactcaaagccccatgaagttaatggcgttgcaactgctgctgtggcacagtgcgttgtggacagtccaagaagccacccccctaggaccagctagctccctccctcagtccttcctgttgaaatgtctcgagcaggtgcgcaaaatccagggagacggtgccgcccttcaggagaaactgtgcgctacgtacaagctttgtcatccagaagagcttgtcctgctgggtcattcgctcggtatcccctgggcccctttaagctcttgtccctctcaggcactccaactcgctggatgtttgtctcagctgcactccggattgttcctgtatcaaggactgttgcaagctctggaggggatctcgccggagctgggtccaaccctggacacactgcagctcgatgtagctgattttgctactaccatctggcaacagatggaggagctgggcatggctccggccctccagccaacacagggagcaatgccggcatttgcgtctgcgttccaacggagggcgggtggcgtgctcgtagcctcccacttgcaaagcttcctggaggtatcctatcgggtgctgcgtcatctggcacaacct

SEQ ID NO: 10018 - DNA, 612 bp, Artificial Sequence
  Description of Artificial Sequence: Synthetic coding sequence
atggcaggtcctgcgacccagagcccgatgaagctgatggccttgcagctcctgctctggcactctgcactgtggaccgttcaggaagctacgccgctcggacccgcttcctcactccctcagtctttcctcttgaagtgcttggaacaagtgagaaagatacaaggagatggagccgctcttcaggagaagctgtgcgcgacatacaagctttgccacccagaggagttggtccttcttggacattctctgggcatcccctgggcaccgttgtcttcatgcccctcccaggccttgcaactggcgggttgtttgtcccaactgcacagcggactgttcctctaccagggtctcttgcaggctttggaaggaatttctccggagctcggacctactttggatacgcttcaactcgatgtggccgacttcgccacaaccatatggcagcagatggaagaattgggaatggcaccagctctccagcctacccaaggcgctatgccagcgtttgcctctgctttccaaagacgcgcgggcggcgtcctggttgcttcccacctgcaatctttcctcgaggtgagctaccgcgtcctcagacacctggcacaaccc

SEQ ID NO: 10019 - DNA, 612 bp, Artificial Sequence
  Description of Artificial Sequence: Synthetic coding sequence
atggctgggccggccacccagtccccaatgaaactaatggccttgcaactcctgctgtggcattcagcgctgtggaccgtgcaggaagcaacccccctgggccctgcttcttctcttccgcagtcttttctgctgaagtgcctggaacaagtccggaagattcaaggagacggtgcggcactgcaggagaaattgtgcgccacatacaaactgtgtcatccagaggaattggttctcctgggccactctctgggaattccctgggctccactgtcctcatgcccaagccaggctctccagctagctggatgtctgtcacaactgcattctggactgttcctgtaccaaggtcttctgcaggctctcgaaggaattagtcccgagctggggcctacgctggatactctgcagcttgacgtcgctgatttcgccactacaatttggcagcagatggaagagttagggatggctccagccctgcagcctacccagggcgccatgcccgcttttgcatctgcatttcagagaagagctgggggcgtactggtggctagccacctgcagagctttcttgaggtcagctacagagtgctgcggcacctggcacagccc

SEQ ID NO: 10020 - DNA, 612 bp, Artificial Sequence
  Description of Artificial Sequence: Synthetic coding sequence
atggccggccctgctacccaatctcccatgaagctgatggccttgcagctgctcctgtggcacagcgctctgtggaccgtccaggaggcgacacccctaggtcccgccagtagccttccacaatctttcctcctcaaatgcttggaacaggtgaggaagatccagggtgatggagccgccctccaggagaagctatgtgctacatataagctctgtcacccagaggagttggtccttctggggcatagcctaggaataccatgggctcccctgagttcctgcccttctcaggccctgcagctggctggttgcctcagtcagctacactcaggactgtttctataccagggcctgctgcaggcactcgagggcatcagtcccgagctgggtcccacactggacacgcttcagctcgatgtggccgactttgctactacaatatggcagcagatggaggaattaggcatggctcccgccctccagcctacccaaggcgccatgcctgcctttgcaagcgcatttcagcggcgcgccggtggtgtgttagtggcaagccaccttcagtcttttctggaagtttcttatcgcgttctgaggcatctcgctcagcct

SEQ ID NO: 10021 - DNA, 612 bp, Artificial Sequence
  Description of Artificial Sequence: Synthetic coding sequence
atggcgggacccgccacccagtcccctatgaagctcatggctctgcaattgctgctctggcactctgctctctggaccgtccaggaagcgactcccctcggaccggcgtcatcgctgccacagtcatttctgctgaagtgcctggagcaagtcagaaagatccagggagacggagcggctcttcaggagaaactgtgtgcgacctacaagctgtgccacccggaagaactggtgctgctgggtcactcactgggcatcccgtgggcaccactgtcatcatgcccgtcgcaggctctgcagcttgcgggatgcctgtcccagctgcattctggcctgttcctctatcagggactcttgcaggcccttgaggggatctcgccagaactgggtccgaccttggacaccttgcagctggatgtggcggatttcgcgaccaccatttggcagcagatggaggaactgggaatggcacccgccctccagccaacccaaggtgccatgccggcattcgccagcgcctttcaacgccgggctggaggagtcctggtcgccagccatctccagagcttcctggaagtgtcctaccgggtgcttaggcacctggcacagccc

SEQ ID NO: 10022 - DNA, 612 bp, Artificial Sequence
  Description of Artificial Sequence: Synthetic coding sequence
atggctggtccagcgactcaatcaccgatgaagctcatggcactgcaactacttctctggcattcggcgctgtggacggttcaagaggctaccccgttgggtccggcttcttccctcccacagagtttcctacttaagtgtctcgagcaagttcgcaaaatccaaggcgatggggccgcgctgcaggagaagttatgtgcaacctacaagttatgccatccagaggaactcgttctcctcggccattccctgggcatcccctgggcgcctttatccagctgcccaagtcaggcgctacaattagcaggctgcctgtcacagttacatagtggcctcttcctttaccagggattacttcaggcgctggaaggcataagtcctgagctcggccccactctggatactcttcaattagatgtggcagattttgccaccacgatttggcaacagatggaagaattgggtatggctcctgctctccagcccacacagggggcaatgccggcctttgcctccgctttccagaggcgagcgggtggagtcctggtcgcctcccatctgcaaagctttctggaagtatcttacagagtgttacggcatctggcccaacca

SEQ ID NO: 10023 - DNA, 612 bp, Artificial Sequence
  Description of Artificial Sequence: Synthetic coding sequence
atggccggaccagccacccagtcgcctatgaagctcatggcattgcagcttctgctttggcatagcgcactgtggaccgtgcaggaggcgaccccgttggggccagctagctcgctgccgcaatctttcctgcttaaatgcttggaacaggtgcgcaagatccagggcgacggagcagctctccaggaaaaactttgcgccacttacaagctgtgccacccagaggagctggtgctgctgggacattcactgggtatcccgtgggccccgctttcctcatgcccgtcgcaggcgctccaacttgcagggtgtctctcacagttgcactcgggtctgtttctctaccagggactgctgcaggcgctcgagggaatctctccggaactgggaccgacgctggacacccttcaactcgatgtcgctgatttcgccactactatttggcaacagatggaagaactcggcatggcacccgccctccagcccacccaaggcgcaatgcctgcattcgcctcggctttccaacgcagggctggcggtgtactcgtggcctctcacctgcaatcctttctggaggtgtcctaccgagtcctgagacaccttgctcaacct

SEQ ID NO: 10024 - DNA, 612 bp, Artificial Sequence
  Description of Artificial Sequence: Synthetic coding sequence
atggccggtcctgccacccagagccccatgaagctgatggcattgcagcttttgctttggcattccgcgttgtggaccgtgcaagaagcaaccccactcgggccagcatcttcgttgccacagtcattcctgctcaaatgtcttgaacaggtgcggaagatccaaggagatggagcagcacttcaagagaaactttgcgccacctacaagctgtgccatcctgaagagcttgtgctgcttggacattcactgggcattccatgggcacccctcagctcctgcccatcgcaggcactgcaactcgctggatgtctttcgcagctgcattcgggtctgttcctttaccaaggactcctccaggctctggagggaatcagcccggagctgggaccaaccctggataccctccagctcgacgtcgcagactttgccaccactatttggcaacagatggaggaactcggaatggcacccgccctgcaaccaacccagggagcaatgccagcttttgcaagcgcatttcaaagacgagcaggaggcgtcctcgtggcgtcgcatcttcagtcgttcctcgaagtgagctacagagtgctgcgtcatctggcgcagcct

SEQ ID NO: 10025 - DNA, 612 bp, Artificial Sequence
  Description of Artificial Sequence: Synthetic coding sequence
atggctggccccgcaacccagagccctatgaagctgatggcgctccagctgctcctctggcacagtgccttgtggaccgtgcaggaagccacaccactggggcccgcgtcctcactgcctcagagtttcctgctcaagtgtctcgagcaggtgcgtaagatacagggtgatggggctgcccttcaagagaagctttgcgccacatataagctctgccatccagaggagctggtcctgttggggcacagcttgggtattccctgggctcccctgtcaagctgcccctcgcaggctttgcaactggccgggtgcctgtctcagctgcacagcggcctttttctgtatcagggcctcttacaggcactggagggaatcagtccagaactggggcctacgctggacacccttcagctggatgtggccgattttgctactacaatatggcagcagatggaagagctgggcatggcccccgccctccagccgacccagggtgcaatgccggcattcgcaagcgcattccaaagaagggcgggcggggttttagtggcaagccatctgcagtccttccttgaagtgtcctatcgcgtgctcaggcatctcgctcaacct

SEQ ID NO: 10026 - DNA, 612 bp, Artificial Sequence
  Description of Artificial Sequence: Synthetic coding sequence
atggccgggcctgctacccaatccccaatgaagctgatggcactccaactgctgctctggcattcggcgctgtggaccgtccaagaggcaacccctctcggacctgcgagcagccttccacagagttttctccttaagtgtttggagcaagtcaggaagatccagggggatggagccgcactgcaagagaaactttgcgcaacctacaaactgtgtcatcctgaagagctggtgcttctcggacactcgcttgggattccctgggcacccctgtctagctgtccatcccaggcgctgcagctcgctggatgtctcagccagctccattcaggtctgtttctttaccagggactgcttcaggcccttgaaggaatctcacccgaacttggacccacgcttgatactctccaactcgatgtcgccgacttcgcaacgacgatttggcaacaaatggaagaacttggtatggccccggcgttgcaaccgactcaaggtgcaatgccagcatttgcgtctgcattccagaggagagccgggggcgtgctggtggcttcgcatcttcaatcttttctcgaagtttcctaccgcgtgcttcgtcacctggcgcagcct

SEQ ID NO: 10027 - DNA, 612 bp, Artificial Sequence
  Description of Artificial Sequence: Synthetic coding sequence
atggctggacctgctactcagagtccgatgaagctgatggccctgcagctgcttctgtggcactccgctctctggaccgtccaagaggccacaccacttgggccagcctcctccctgccgcaatcttttttgctgaagtgcctggagcaggtgcgcaaaatccagggggatggcgctgcactccaggagaaactttgtgctacttacaagctgtgccatcctgaggagctcgtccttctcggccattctctcgggattccgtgggctcctttgtcctcctgcccttcccaagcactccagctggctggttgcctgtctcaactgcacagcggactgttcctctatcaaggtctgctccaggccttggagggtatttcacctgaactcggccctacgctggacacactgcagctggatgtggctgacttcgcaacaacaatctggcagcaaatggaggaactgggcatggcacccgctctccagccaacgcagggggcaatgcctgcattcgccagcgcgttccagaggcgggccggcggcgtactggtggcttcccacttgcagagctttcttgaggtgtcctatagggtgctccggcacttggcccagccc

SEQ ID NO: 10028 - DNA, 612 bp, Artificial Sequence
  Description of Artificial Sequence: Synthetic coding sequence
atggccggccccgcaacccaatcacccatgaaacttatggcacttcagttacttttgtggcattctgcgctgtggaccgtgcaggaggccaccccgcttggtcctgcatctagtctgccccagtcctttttactgaaatgcctggagcaggtgcgaaaaatacagggggatggtgccgcacttcaggaaaagctgtgcgctacgtataaattgtgtcatccagaggagctagttctgttgggacattccctgggcatcccgtgggcacccctgtcctcctgcccttcacaggccctgcagcttgcagggtgcctgagtcagctgcattccggcctctttctctatcagggtttactccaggccctggagggaatcagccccgagttggggccgaccctggatacgctccagctcgacgtcgccgacttcgctactaccatttggcagcagatggaagaactggggatggctccagccctgcagccaacacagggtgctatgcccgcgtttgccagtgcgttccagagacgcgctgggggagtactagtagcaagccacctccagtcgttccttgaggtctcttacagggtgttgcggcatcttgctcagcct

SEQ ID NO: 10029 - DNA, 612 bp, Artificial Sequence
  Description of Artificial Sequence: Synthetic coding sequence
atggctggtcccgccacacagtcgcctatgaaactgatggcactacagctgttactgtggcactcagccctttggacggttcaagaagccacgcccctcggccccgcatcttcgcttccacaatcttttctgcttaagtgcctggaacaggtacgaaagattcaaggagatggcgccgccctccaggagaagttgtgcgccacgtacaagttatgccaccccgaggaattggtgcttctgggacattcgctcggtataccatgggcgccgctctccagctgcccctcccaagcactccagctggccggctgcttgagtcagctgcacagcggtttgttcctataccagggattgctccaagcacttgaggggatttcgccggaactaggcccgaccctggatacgttgcaactcgatgtggctgattttgcaacgacgatctggcagcagatggaggagttgggcatggccccggccctgcagccgacacagggcgcgatgcccgccttcgcatccgccttccagcgacgcgctggaggcgtcctggtcgcctcgcatctgcagagcttcctggaggtcagctacagagttcttcgacatctggcccagccg

SEQ ID NO: 10030 - DNA, 612 bp, Artificial Sequence
  Description of Artificial Sequence: Synthetic coding sequence
atggccggaccagccacccaaagccccatgaagctcatggcgttacaactcctcctctggcactccgctttgtggacggtgcaagaggcgactccactgggaccagcatcatcgctcccacaatcgtttcttttaaagtgcctcgaacaagttcgaaaaatccaaggcgatggtgcagctttgcaagagaagctctgtgcgacatataagctttgccatccggaagaacttgtgttgctgggtcatagcctgggaattccgtgggcgcctctatcatcgtgcccatcacaggccctgcagctcgcaggatgtctttcacaactacattcgggattgtttttgtaccaaggtttgctacaagcgctagaagggatttccccagagctcggaccaacccttgacacattgcaacttgatgtggctgattttgccacaaccatctggcagcagatggaggagcttggtatggctccagcactacagccaactcaaggtgcgatgccagcgttcgcatcagcttttcaaagacgagcaggaggcgttttggtggcttcgcatctacaatcatttttggaagtcagctatcgagtcttgaggcatcttgctcagcca

SEQ ID NO: 10031 - DNA, 612 bp, Artificial Sequence
  Description of Artificial Sequence: Synthetic coding sequence
atggcaggccctgcaactcaatctccaatgaagctcatggcccttcagctgctgttgtggcactcggcactttggaccgtgcaagaggcaacccccctcggaccagcgtcgtcgctgcctcagtcgtttctgctgaagtgtcttgaacaagtgagaaagatccaaggagacggtgccgccctgcaggaaaagctgtgtgccacttacaagctctgccatccagaagaactggtgcttcttggccattctcttggtattccgtgggcgcccctttcgtcatgtccttcccaagcactccaacttgcagggtgtctctcgcaactgcattccggactgtttctctaccagggccttcttcaggcactggagggaatcagccctgaactgggacctaccctggacactctgcagctcgatgtcgcggatttcgccacgactatatggcaacaaatggaggaactcgggatggctcctgcgcttcaacctactcagggggcaatgcctgccttcgcatcggcatttcaacgcagggcaggtggtgtgcttgtcgcaagccatcttcaatcttttctggaagtgtcatatcgggtgttgagacaccttgctcagcca

SEQ ID NO: 10032 - DNA, 612 bp, Artificial Sequence
  Description of Artificial Sequence: Synthetic coding sequence
atggctggacccgcgacacagtcccctatgaaactgatggccctccagcttttactgtggcactctgccctgtggactgtgcaggaagcgactccactgggaccagcttcatcactccctcagagtttcctattgaaatgcctagaacaggtgcgaaagatccagggagatggggccgctctccaggaaaaactttgtgcaacttacaaactgtgtcatcccgaggaattagttttacttgggcactccctgggaattccttgggccccactgtcctcttgtccaagtcaggcacttcaattggcaggatgtctttcccagctccactcaggactttttctctaccaggggttgttgcaggcactggaagggatctcccccgagctggggcccactttggacacactgcagctcgatgtcgctgactttgctactacaatatggcagcagatggaggaactggggatggcccccgccctccagccaacacaaggggctatgcctgctttcgcctcagcttttcagcggcgggcagggggggttcttgtggccagtcaccttcagtccttcttagaagtctcctaccgcgtactccgccacttagcacagcca

SEQ ID NO: 10033 - DNA, 612 bp, Artificial Sequence
  Description of Artificial Sequence: Synthetic coding sequence
atggctgggcctgccacccagtcaccgatgaagctgatggcccttcagctcctcctgtggcactctgctctgtggaccgttcaggaggcaaccccactgggtccagcatcttctctcccacagtcgtttcttctgaaatgtctggagcaggtccggaaaatccaaggagatggcgccgccctgcaggagaagctgtgcgccacttataagctctgtcaccccgaggagctggtgctactgggccactcccttgggatcccgtgggctcccctttcgagctgtccgagccaagccctccagttggctggctgtctctcccagcttcatagcggtctgttcctctaccaggggctgctgcaggctctcgaaggaatctctcccgagctcggtccaactctggacaccctgcagctggacgttgccgacttcgccaccactatctggcagcagatggaagagctgggcatggccccagccctgcagcccactcagggagcgatgcctgcctttgcttctgcctttcagagacgcgccggcggcgtgctggtggcatctcatctccaatccttcctggaagtatcctaccgggtgctccggcacctggctcagccg

SEQ ID NO: 10034 - DNA, 612 bp, Artificial Sequence
  Description of Artificial Sequence: Synthetic coding sequence
atggccggacctgctacgcagtccccaatgaagctcatggcactgcagctgttgttgtggcacagcgctctttggaccgtgcaggaggcaacacctctcgggcccgcttcatccctgccacagagttttctgctgaagtgtctggaacaggtaaggaaaatccagggagatggcgccgccctccaggagaaattgtgcgcgacttacaagctgtgccaccccgaggagctggtgcttcttggacactctctcggtataccctgggctccattgtcctcttgtcctagccaggccctccagctcgccggctgcctgagtcagttgcactccggtctgtttttgtaccagggactcctgcaggccctggaggggattagcccagagttgggtccgacactcgacaccctgcagttggacgtcgccgatttcgccacgacaatctggcaacagatggaagaactgggtatggcgccagctctccagcccacgcaaggtgctatgccagctttcgccagtgcttttcaacgccgcgctggtggggtgctggtggcaagtcacctgcagagtttccttgaggtgagttacagagtgcttcgacatctcgctcaacca

SEQ ID NO: 10035 - DNA, 612 bp, Artificial Sequence
  Description of Artificial Sequence: Synthetic coding sequence
atggccggacctgctacccagtcccccatgaaactcatggccctgcagttattactctggcactcggccttgtggaccgtccaagaggcaaccccactcggccctgcctcatcgttaccccaatcttttctcctcaagtgtctagaacaggttcgtaaaattcagggagacggggccgctctgcaagagaaactgtgtgcgacttataagctgtgtcacccagaggaactcgtgctgctgggacattcactcgggataccttgggcaccattgtcgagttgtcccagccaggcactgcagcttgctggctgcctgagccagctgcactctggactttttctctatcaagggctgctgcaggcactggagggcatcagccctgagttaggtcctacgctcgacactttgcagctggatgtggctgactttgcaacgacaatatggcagcagatggaggagctgggcatggccccagctttacagccaacccagggggcaatgcctgccttcgcctcagcttttcagcggagggctggaggggtcctggttgctagccatctccagtccttcctggaggtgagttatcgggtgttacgccatctcgctcagcca

SEQ ID NO: 10036 - DNA, 612 bp, Artificial Sequence
  Description of Artificial Sequence: Synthetic coding sequence
atggcaggcccggccacccaatccccgatgaagttgatggcactgcaactgctcctttggcactcggcactttggactgtgcaagaagctacccctcttggcccagcatcgtcgctccctcaatcctttcttcttaaatgcctggagcaggtccgtaagattcaaggagatggagcagcccttcaagaaaagctgtgtgctacctacaagctgtgtcatcccgaagagctcgtgctgctcggacattcgctgggcatcccttgggcacccctctcttcatgccctagccaggcgctgcagctggccggttgtttgtcccaattgcactcgggtttgtttctgtaccaggggctgcttcaggcgttggaaggaatcagccctgagctcggtcctaccctcgatactcttcaactcgatgtggcagactttgcaaccactatatggcaacagatggaggaactggggatggcgcctgccctccagcctactcaaggggcaatgcctgcatttgcctcggcatttcagagaagagctggcggggttctggtggcatcgcatcttcagagcttccttgaagtgagctacagggtgcttcgccatctggcccaacca

SEQ ID NO: 10037 - DNA, 612 bp, Artificial Sequence
  Description of Artificial Sequence: Synthetic coding sequence
atggcggggccagcaacccagagcccaatgaagctcatggcgctccaactgctgctttggcattccgcactctggacagtacaggaggcaactccccttggccctgcttcctctctgccccagtcgttcctgctcaagtgtttggaacaggttaggaaaattcagggagacggtgccgctctgcaggagaaactttgcgccacctacaagctctgccatcccgaggaattggtcctgctcgggcacagcctgggtataccctgggcacctttgtctagctgccccagtcaggcactgcagctggctggatgcctctctcagctgcactcgggactttttctctatcagggcttgctccaggcccttgaaggcatctctcctgagctgggacctactctggacaccctgcagctggatgtcgcggacttcgcaacgaccatctggcaacagatggaggagctgggaatggcacctgcacttcagccaacacaaggagctatgcccgcatttgcgtcggcctttcagaggagagcgggaggggtgctggtagctagccatctccaaagtttccttgaggtgtcttacagagtgttaagacacctggcacagcca

SEQ ID NO: 10038 - DNA, 612 bp, Artificial Sequence
  Description of Artificial Sequence: Synthetic coding sequence
atggccgggcccgccacacagtctcctatgaagctgatggcgctgcagctcctgctttggcacagcgcgctctggaccgttcaggaggcaactccactgggtcctgcgtcttctttgccccagtccttcctgctcaagtgcttggagcaggtccggaaaattcagggagatggcgctgccctacaagaaaaattatgtgcgacatataagctgtgccaccctgaggagctggtgctgttaggccactccctgggcatcccctgggcgccgttgtcctcctgccccagccaagccctccaactcgcaggttgtctctctcagttgcactctgggctgtttctttaccagggactgctccaggccctggaggggatctcgcctgagctgggtcccaccctggacacattgcaattggatgttgctgattttgccacaacaatctggcagcagatggaagaactgggcatggcccctgcactgcagccaactcagggcgcaatgcccgcgttcgcctccgcctttcagagaagggccggaggggtccttgtcgcctcccatttacagtccttcctggaggtgtcttacagggtcctcagacatcttgcacaaccc

SEQ ID NO: 10039 - DNA, 612 bp, Artificial Sequence
  Description of Artificial Sequence: Synthetic coding sequence
atggcaggcccggcgacccagtctccgatgaaactcatggcactgcagctccttctgtggcattccgctctgtggactgtgcaggaagccaccccgctgggaccagcctcctcactcccacaatcgtttctgctcaagtgcctcgaacaggtgagaaaaatccaaggtgacggcgctgccctgcaggaaaaactgtgcgcaacgtacaaactctgccaccctgaggaacttgtgctgctgggacactcgttggggattccgtgggctccactcagctcctgcccttcccaggccctgcaactggcaggatgcctgagccagctgcactcggggctgttcctgtaccagggcctgctgcaagcgcttgagggtatcagcccggagctggggccgactctcgacaccctccaactggacgtggccgacttcgcaactactatctggcagcaaatggaagagctcggaatggccccggccctgcagcctacgcagggggcgatgccggcgttcgccagcgcgttccaaaggagggccggaggtgtgctggtggccagccacttgcaatctttcttggaagtgtcctaccgcgttctccggcatctggcacagcct

SEQ ID NO: 10040 - DNA, 612 bp, Artificial Sequence
  Description of Artificial Sequence: Synthetic coding sequence
atggcgggcccagcaacccagtctcccatgaagctgatggcactccagttgctcctctggcacagtgccctgtggacagtgcaggaggctacccctctgggccccgcttccagtctgccgcagagtttcctgctgaaatgtctagagcaggtcaggaagattcagggggacggtgcggcgctccaggagaagttgtgtgctacatacaaattgtgtcatccagaggagttggtgctcctcgggcactcgctgggcattccctgggcccctctgagctcgtgtcctagtcaggcactgcagctcgctgggtgccttagtcaacttcattctggcctattcctttaccaggggctgctgcaggcactggagggcatatccccagagcttggccctaccctggatacactgcaactggatgtggccgactttgcaactaccatttggcagcagatggaggaactggggatggcccccgccctacaaccaacccagggcgccatgccagcgttcgcctccgcctttcagcgcagagcaggcggcgtgttggtcgccagccatctgcaatccttccttgaggttagttatagagtgctgcgccacttagctcagcct

SEQ ID NO: 10041 - DNA, 612 bp, Artificial Sequence
  Description of Artificial Sequence: Synthetic coding sequence
atggcagggccggcgactcagtcgccgatgaagctcatggccctgcagctgttgctttggcactcagctctgtggaccgtgcaagaggcaactccactgggccctgcctcctcgctcccccaatcgttcctgctcaagtgccttgaacaagtgcgcaaaatacagggtgatggtgctgctctgcaggaaaaactgtgtgccacctacaagctgtgccacccggaggagctggtcttgctgggacattcgctgggcatcccgtgggcgccactctcgagctgtccttcccaagcgctgcagttggcaggttgcctgagccagcttcactcgggactgttcctgtaccagggcttgctccaggccttggagggaatctcgccggaactcggcccaactctcgatactctccaactggacgtcgccgacttcgccacgacgatctggcagcagatggaagaactcggtatggccccagctctgcagcctacccaaggcgctatgcccgcattcgcttcggccttccagagaagggctggcggagtgctggtggcgtcccacctccagtctttcctcgaagtgagctaccgcgtgctccggcacctggcacagccg

SEQ ID NO: 10042 - DNA, 612 bp, Artificial Sequence
  Description of Artificial Sequence: Synthetic coding sequence
atggccgggccggccacccaatcacctatgaagctgatggctcttcagctccttctgtggcacagcgcgctctggactgtgcaagaggcgacgcctctgggaccggcgtcctctctgccacagtccttcctgctgaaatgcctggaacaggtccgcaaaatccagggcgatggtgctgcgctgcaagagaagttgtgcgccacttacaagctgtgccacccagaggagctggtgcttctggggcattcgctgggaatcccgtgggctccactgtcaagctgtccgtcccaggccctccagctcgccggctgcctttcgcagttgcacagcggtctgttcctctaccaaggattgctgcaggccttggaaggaatctcgcccgaactgggacccactctcgacacgctccagctggatgttgcagacttcgccaccaccatttggcagcagatggaagaactcggaatggcacctgcgctccagccgactcagggtgcgatgccggctttcgcctcggcatttcaacgcagggccggaggagtcctcgtggcatctcatttgcaatcctttctggaagtgagctacagggtgctccgtcacttggcgcaaccg

SEQ ID NO: 10043 - DNA, 570 bp, Artificial Sequence
  Description of Artificial Sequence: Synthetic coding sequence
atggcggccggcgaacttgagggcggaaaacccttgtcaggacttttaaatgctctggctcaggacaccttccacggctacccgggcatcactgaggaactgttgcgaagccagctgtaccctgaagtgccccccgaggagtttagacccttccttgctaaaatgcgtgggatactaaagtccatcgcctccgcagacatggactttaatcaactcgaagcattccttactgcccagacaaagaaacagggaggaatcacttcagaccaggccgccgttatctctaagttctggaaatcgcacaaaacgaaaatcagagagtccttaatgaaccagtcaagatggaattcagggctcagaggtctaagttggcgcgtagatggcaaatctcagagtcggcactctgcgcaaattcatactccagtggcaatcatcgaactagagctggggaaatatggacaggagtccgaattcctttgcctggagtttgacgaggtcaaggtcaatcagatcctcaagacgctgagtgaagtcgaggagagcatctccaccctgatctctcagccaaat

SEQ ID NO: 10044 - DNA, 570 bp, Artificial Sequence
  Description of Artificial Sequence: Synthetic coding sequence
atggcggcgggagaactggaaggaggaaagcctctttcaggactgctgaacgcactggcacaggacacgttccacgggtatcccggtattaccgaggagcttctccggtcccagttgtaccctgaggtccctccagaggaattccgtccatttctggcaaagatgcgcggcattcttaagtcgatagcctccgcagacatggactttaaccaattggaggcctttcttaccgcacaaactaagaaacaaggaggtataacctcagaccaagcagcagtcatctcgaaattctggaaaagccacaagacgaagatcagagaatcgctgatgaatcagtcccggtggaattccggacttagaggtttgagctggagggtggatggtaagagtcagagcagacattcggcccagatccacactcctgtcgccatcattgaactcgaacttggcaagtacggtcaagaatcggaatttctgtgtctcgaatttgatgaggtgaaggtgaatcaaatcctcaaaaccctctccgaggtcgaggaaagtatatcgactcttatcagccaaccaaac

SEQ ID NO: 10045 - DNA, 570 bp, Artificial Sequence
  Description of Artificial Sequence: Synthetic coding sequence
atggctgctggggagctggaaggcggcaagccgctgagcggcctgctgaacgctctggctcaggatacctttcatggatatcctggtatcacggaagagctactgcgtagccagctgtaccctgaggtgccgccggaggaattccgcccattcctggcaaaaatgcgcggcattctgaaaagtatcgcgagcgctgacatggactttaatcagctagaagccttcctgaccgctcagaccaagaagcaaggcggtatcactagtgaccaagcagccgtcatttccaaattttggaaaagccacaagaccaagattcgcgagtcactgatgaatcaatcgcgttggaactcaggtctgcgcggtcttagctggcgcgtggacgggaaatctcaaagccgacactctgctcagattcataccccagtggcgattatcgagcttgaactgggcaaatacggtcaggaaagcgagttcctgtgcttggagtttgacgaggtgaaggtcaaccagattctaaaaactctgagcgaggttgaagagtccatctccactctgatttctcaaccgaac

SEQ ID NO: 10046 - DNA, 570 bp, Artificial Sequence
  Description of Artificial Sequence: Synthetic coding sequence
atggcagccggggagttggaaggcggaaagcctttaagcggactgctcaatgcgctagcccaggatacttttcacggctaccctggtatcacggaggagctgctccgtagccaactgtatccggaggttccgccggaggagttccgccctttcctggccaagatgcgcggcatcttaaaaagcatcgcctcagcagacatggacttcaaccagctggaggccttcttgaccgcgcagactaagaaacagggcgggatcactagcgatcaggccgcggtgatctctaagttttggaagtcgcacaagaccaagatccgtgagagtctgatgaaccagagcaggtggaactccggtcttcgcgggctaagctggagggtggacggcaagtcgcaatcccgtcattccgcccaaatacacacgcccgttgccattatcgagcttgagctgggtaagtatggtcaggagagcgagttcctgtgtttggagttcgacgaggtgaaggtcaatcagatcttgaagaccctttcagaagtcgaggagtctatttctacgctcatcagtcagcccaac

SEQ ID NO: 10047 - DNA, 570 bp, Artificial Sequence
  Description of Artificial Sequence: Synthetic coding sequence
atggcggcgggcgaactggaaggaggcaagcccttgtcgggactgcttaacgcgttggcacaagacactttccatggctatcctgggattaccgaagaactcctgcggtcccaattgtacccggaagtcccgccagaagagtttcgcccttttcttgccaagatgcgggggatactgaagtcaatcgcctctgcggacatggatttcaaccagctggaggcattcctcaccgcccagactaagaagcaaggtggtatcacgagtgatcaggctgctgtcatctcgaaattctggaaatcccacaaaaccaaaatcagagagtctctgatgaatcaaagtagatggaactcaggactcagagggctgtcatggcgggtggacggtaagagccagtctcgccactccgctcagatccatactccggtggctattatcgaactggagctgggaaaatacggccaggagtcagagttcctctgtcttgagttcgatgaggtgaaggtgaaccagatcctcaagactctttcagaagtcgaagagtcgatcagcaccctgatctcacaaccgaat

SEQ ID NO: 10048 - DNA, 570 bp, Artificial Sequence
  Description of Artificial Sequence: Synthetic coding sequence
atggccgccggggaactggaaggaggcaaacccctcagcgggctgctgaatgctctggcccaggataccttccatgggtaccccggtatcactgaagaactgcttcgctcgcagctgtacccagaggtcccccccgaagaatttaggccattcctcgccaaaatgcgagggatcctgaaaagcattgcctctgccgatatggacttcaaccagctggaagcttttctgacggcacaaacgaagaagcaaggcggtattacgtcagatcaggcggcagtcatcagcaagttttggaaaagccacaagacaaaaatccgcgaatcactgatgaaccagtccagatggaattctggcctaaggggacttagttggagagtagatgggaaaagccagtcaagacacagtgcacagattcacacccctgttgctatcatagagctggaacttggtaagtatggtcaggagagcgagttcctttgcctggagttcgatgaagtgaaggtgaaccagatcctgaagacgctgtctgaggtggaagagagcattagtacattgatcagccagccaaac

SEQ ID NO: 10049 - DNA, 570 bp, Artificial Sequence
  Description of Artificial Sequence: Synthetic coding sequence
atggcggcaggtgaactggaaggcgggaagccacttagcggactgcttaacgccctggcgcaggataccttccatggataccccggaataaccgaagaacttctccgcagccaactgtacccggaggtgccccctgaagaattccggccgttccttgcaaagatgcggggaatcttgaagtccatcgcctcggcagatatggatttcaaccagctggaagcattcctgaccgcacagacgaagaagcagggaggaattacttcggatcaagcggcggtgatttcgaagttctggaaatcccacaagaccaagatcagggaaagccttatgaaccaatcgagatggaatagtggactcagaggactttcgtggagagtggacgggaagtcccagtcacgccattcggcacagatacacactcctgtcgctatcatagagcttgaacttggaaaatacggtcaggagagcgaatttctttgcctggagtttgatgaagtgaaggtcaaccagattctcaagaccctgagcgaggtcgaagaaagcatcagcactctgatttcccaacctaat

SEQ ID NO: 10050 - DNA, 570 bp, Artificial Sequence
  Description of Artificial Sequence: Synthetic coding sequence
atggccgcaggtgagctggagggaggaaagcctctgtcaggacttctgaatgcgctggcgcaggatacctttcacggctatccaggaattactgaggagctgcttcggtcgcaactgtaccctgaagtgcccccagaagaatttagaccttttcttgcaaagatgagaggtattctgaaatcaattgcctctgcagatatggactttaatcaactggaagccttcctcaccgctcagacgaagaaacagggaggcattacgagcgatcaggcagcagtgattagtaaattctggaagtcgcataagaccaaaattcgcgagtctctcatgaaccagagcagatggaactccggacttcggggactctcctggcgggtcgacggtaaatcgcagtcgcgccacagcgcacaaatccatactcctgtggcaatcatagaactggaactcggaaagtacgggcaggaatcagaattcttgtgccttgaatttgacgaagtcaaagtgaatcaaatcctcaagaccctctcggaggtggaagaatctatctcaactctgattagccagccgaat

SEQ ID NO: 10051 - DNA, 570 bp, Artificial Sequence
  Description of Artificial Sequence: Synthetic coding sequence
atggccgccggggaactggagggcggcaaaccactgagtggtcttttgaatgccctggcacaggatacgttccatggttaccccggcattacagaggagctgcttcgtagccagctgtaccccgaggtgccaccagaggaattccggccattcctcgctaagatgagagggatccttaaaagcatcgcatccgctgatatggatttcaaccagctggaagcttttctgaccgcacagacaaagaagcagggcggcattacgagtgatcaagccgccgtgatttccaagttttggaagtctcataaaacaaaaatacgagagagtctgatgaaccaaagcagatggaattccggcctccgagggttatcatggcgtgttgatggcaaaagtcagagccgccactccgctcagatccatactccagtcgccattattgagttagaactaggtaaatacggtcaggaatctgaatttctatgcctggaattcgacgaagtgaaggtaaaccaaatactcaaaaccctgagcgaagtcgaagagagcatatctacgcttatctcgcaacccaat

SEQ ID NO: 10052 - DNA, 570 bp, Artificial Sequence
  Description of Artificial Sequence: Synthetic coding sequence
atggcggcgggagagctggaaggaggcaagccgctgagcggactcttgaacgccctggcccaagacaccttccacggatacccggggattactgaggaacttctgagatcgcaactctacccggaggtgcctcctgaagaattccgcccattccttgctaagatgcgcggcatcctgaagtcaatcgcatccgccgatatggactttaaccagctcgaggcatttctcactgcgcaaaccaaaaaacaggggggaatcacgtctgatcaagccgccgtgatctcgaagttctggaagtcccacaagactaaaatcagagagagtttgatgaatcagtcacgatggaactcgggattgcggggcctgtcctggagggttgacggtaagtcccagtcgcggcattcagcacagattcatactcccgtcgctatcatcgaactggagctgggtaagtacggacaggaaagcgagttcctctgcctggaattcgacgaagtgaaagtcaatcagatcctcaagaccctgtcggaagtggaggaatccatcagcaccctgattagccagccaaac

SEQ ID NO: 10053 - DNA, 570 bp, Artificial Sequence
  Description of Artificial Sequence: Synthetic coding sequence
atggcagcaggcgagttagaaggcggtaaacccctgtcaggtctactaaacgcactcgcacaagatacatttcatggctacccaggtattacagaggaattgctcaggtcacagctgtatcccgaagtgccacctgaggaattccgaccattcctggctaaaatgcgcggaattctgaagtctattgcctctgccgacatggactttaatcagctggaggcctttctgaccgctcagactaagaagcaggggggcataacttctgaccaggccgcagttatatcaaaattctggaagtctcacaaaactaagatccgcgaatcactgatgaatcagagccgctggaacagcggtctgagagggctgtcctggcgtgttgatggaaaaagccagagtcgccatagcgcacagattcacacccctgtcgcaatcatcgaactcgagctgggcaaatatggccaagaatctgagttcctgtgtttagagtttgatgaggtgaaggttaaccagattcttaagacactgtccgaggtggaagaatctatttctactcttatttcccagcctaac

SEQ ID NO: 10054 - DNA, 570 bp, Artificial Sequence
  Description of Artificial Sequence: Synthetic coding sequence
atggcggcgggagaactggagggtggaaagccgttgagcggactgctgaacgcactcgcgcaagacactttccatggatacccaggcatcaccgaagagctgcttcgctcccagttgtacccggaggtgccgccggaggagttcaggccgttcctcgctaagatgagaggaattctcaagagcatcgcttcggcagatatggatttcaatcaactggaagcattcctcaccgcgcagaccaagaagcaaggagggatcacgtcggaccaggccgccgtgatctcgaagttttggaagtcccacaagaccaagatccgcgagtcgctgatgaaccagtcccgctggaactcgggcctgagaggactgtcttggcgcgtggatggtaagtcccaatcccggcattcagcccaaatccatacccccgtcgccatcatcgagttggagctgggaaaatacggccaggaaagcgagtttctgtgtctggagttcgatgaagtgaaggtgaaccaaattcttaagaccctgtccgaagtggaggaatcgatctcgaccctgatttcacaaccgaat

SEQ ID NO: 10055 - DNA, 570 bp, Artificial Sequence
  Description of Artificial Sequence: Synthetic coding sequence
atggcagctggggaattggagggaggcaagcccttgagcgggctgctgaatgctttagcgcaggacacgttccatggttatccgggaatcaccgaggaattgctgagatcccaattgtacccagaggttcctcctgaggagttcagacccttcttggcgaagatgcgtggaatcctgaaatcaatcgcctccgcagacatggatttcaatcagctggaagccttcctgactgcccaaaccaaaaaacagggcgggatcacaagtgaccaggccgcggtcatcagcaagttttggaaatctcataagacgaaaatccgcgagagcctgatgaatcagtccagatggaacagcggtctcagaggactgtcatggagggtggatggcaagtcccagtcaagacattccgcacaaatccacaccccggtggctataattgagttggagctcggaaagtacggtcaggaatccgagtttctgtgtctcgaatttgatgaggttaaagtgaaccagatcttgaaaacgctgagtgaagtcgaagagagtatcagcacgttgattagccagccaaac

SEQ ID NO: 10056 - DNA, 570 bp, Artificial Sequence
  Description of Artificial Sequence: Synthetic coding sequence
atggctgctggtgagctcgaggggggtaagcctttgagcggtctactgaacgccttggctcaggacacctttcatgggtaccctggcatcacagaagaactgcttcgatctcagctatacccggaagtacccccagaagagttcaggccatttcttgccaagatgagggggattttgaagtcaatcgcatcagccgacatggactttaatcagttagaagccttcctcacagcccaaactaagaagcagggggggattacaagtgatcaggccgcggtgatcagcaaattctggaagtcacataaaaccaagatcagggagtcactgatgaaccaatcgcgttggaactccggactgaggggactctcctggagggtggatggaaaatcccaatcccgccattccgctcaaatccatactcctgtggcgattatcgagttggagcttgggaaatacggacaggagtccgagttcctttgtctcgagttcgatgaagtgaaggttaatcagatactgaagacgctcagtgaggtggaagagtctataagtaccttaatcagtcagccaaac

SEQ ID NO: 10057 - DNA, 570 bp, Artificial Sequence
  Description of Artificial Sequence: Synthetic coding sequence
atggccgccggggagctggagggggggaaacccttgtctggactgctcaatgctttggctcaggatacattccatggatatcccgggatcacagaggagctcctgaggtcacagctttaccccgaagtgccaccagaggaattcagacctttccttgcgaagatgaggggaatactcaagagtattgcctccgccgatatggatttcaaccagctcgaagcattcttgacagcgcaaacaaagaaacagggaggaatcacatcagatcaagcagccgttatctccaagttctggaaatcacacaaaacaaaaataagagaatcccttatgaatcagagtagatggaattccgggcttcgaggacttagttggcgagtcgacggaaagtcacaaagtaggcattcagcacagatacacactccagtagctatcatagaactggaactcgggaaatatgggcaggaaagtgaatttttatgcttagaattcgatgaagtcaaagtcaatcagatactgaaaacactatctgaagtcgaagagtcaatctccactctgattagtcagcccaac

SEQ ID NO: 10058 - DNA, 570 bp, Artificial Sequence
  Description of Artificial Sequence: Synthetic coding sequence
atggcggccggagagctcgagggtggaaaacccctttccggactcctcaatgcactggcgcaagatacttttcatggatacccaggaattacggaagaactgcttcgatctcagttgtaccctgaagttccaccggaggaatttaggccattcttggcgaagatgcgtgggattttgaaatcgattgcctctgcggacatggacttcaatcaattggaagcatttctcaccgcacaaacgaaaaaacaaggaggaatcacgagcgatcaagcagcagtcattagtaaattttggaaatctcacaaaacaaaaattagggaaagtttgatgaatcaatcacgatggaacagcggattgcgaggtctgagttggagagtcgatggaaaatctcagagccgtcattccgcacaaatacatacaccggtggccatcattgaacttgaactgggtaaatatggacaagagagtgaatttctttgtttggagttcgatgaagttaaggtgaaccagatcttgaagacgcttagtgaggtggaagaatctattagcaccttaatcagtcagccgaat

SEQ ID NO: 10059 - DNA, 570 bp, Artificial Sequence
  Description of Artificial Sequence: Synthetic coding sequence
atggctgctggcgagcttgagggagggaagcctctgtccggacttctaaacgcgctggcgcaagataccttccatggatatcccggtatcacagaggaactgctacgatctcaactttacccggaagtgccgcccgaggagttcaggccctttctggcgaagatgagaggaatactgaaaagtatcgcatcggcggatatggactttaatcagctggaagcgttcttgacggcgcagactaaaaagcagggcggtattacttcggatcaggccgccgtaatctcaaaattctggaaatcacataaaacaaagatcagagaaagtctgatgaaccagtcacggtggaatagtggcctacgaggtctctcatggcgtgttgatgggaagtcacagtcgcgccattccgcccagatccacacacctgtcgcaattatcgagctagaactgggcaagtatggacaggaatcagagttcctctgcctcgaattcgacgaggttaaagtgaatcagatcctcaaaactctgtcagaagtagaggagtcaatcagcaccctgatttcgcagccgaat

SEQ ID NO: 10060 - DNA, 570 bp, Artificial Sequence
  Description of Artificial Sequence: Synthetic coding sequence
atggccgcaggagagctggaggggggaaagccgctctcggggctcctcaatgctctcgcccaggatacctttcatggttacccgggaattactgaggaactgctgagatcccagctctacccggaggtcccaccagaggaatttcggccattcctggccaagatgcgcgggatcctgaagtcaatcgcctcggcagacatggatttcaaccagctggaggcgttcctgactgcccagaccaagaagcagggaggaatcactagcgatcaagcagccgtcatctccaagttttggaaatcacacaagactaagatccgcgagtccctcatgaatcaatccagatggaactcgggtttgcgcggattgtcgtggagggtcgacggaaagtcacaatcgcggcattccgctcagatccacaccccggtggccatcatcgaactggaactgggaaagtatggacaagagtccgagttcctgtgcctggaattcgacgaggtcaaggtgaatcagatccttaagaccctgtccgaagtggaagaatctatctcgaccctgatttcacagcctaac

SEQ ID NO: 10061 - DNA, 570 bp, Artificial Sequence
  Description of Artificial Sequence: Synthetic coding sequence
atggcagcgggggaactcgaaggcgggaagccattgagtggtttactaaatgcactagctcaagacacctttcacggctatcccggtataaccgaggagttgctaaggagccaactatatcccgaggtgccccccgaagaattcaggccattcctcgcgaaaatgcggggtatcctgaaatcgatagcatcggctgatatggactttaatcagttggaagcgttcctaactgcgcagacaaagaagcagggtggcatcacttcggatcaggctgctgtgatttcaaagttttggaaatcacacaagacgaagattagagagtcactgatgaatcagagccgttggaattccggactgcgtgggctgtcctggcgcgtcgacgggaagtctcagagtaggcactccgcacagattcataccccagtggcaatcattgagcttgagctcggcaaatacggccaggagagcgaattcttatgtctcgaatttgatgaagtgaaagtgaaccagatactgaagaccctctcagaggtagaagaaagcatctccacactgatttctcaacccaac

SEQ ID NO: 10062 - DNA, 570 bp, Artificial Sequence
  Description of Artificial Sequence: Synthetic coding sequence
atggctgccggcgagctggaaggtggaaagccgttgagcggccttctcaacgcactggcccaagacaccttccatggataccccggtatcactgaagaactgctgcggagccagctgtaccccgaagtgccacccgaggagttcagaccgttcctcgccaaaatgagaggcatcctcaaatcgatcgctagcgcagatatggatttcaatcaactcgaggcgttcctgactgcacaaactaagaagcaaggaggaatcacctcggaccaagccgctgtcatctccaagttctggaaaagccacaagactaaaatcagagaaagcctcatgaaccagtcacggtggaactcgggactccgcggactgtcatggcgcgtggacgggaagtctcagtcacgccactcggcacaaatccacacccctgtggccatcatcgagctggagctcgggaagtacggacaggagtcggagtttctctgcctggaattcgatgaagtgaaggtgaatcagatcctcaagactctgtccgaggtcgaggaatcgatcagcaccctcatctcgcagcccaac

SEQ ID NO: 10063 - DNA, 570 bp, Artificial Sequence
  Description of Artificial Sequence: Synthetic coding sequence
atggccgcaggagagctggaaggaggtaaacctctgagcggtctgctgaatgctctggcgcaggataccttccatggttaccctggaattactgaagaactgcttcgctcacaactgtacccagaagttccaccagaggagttcagaccatttctcgcaaagatgagagggatcttgaagtcgattgcgtccgcagatatggatttcaatcaacttgaagcgtttctcaccgcacagacgaaaaaacaggggggcattacttcagatcaggcagcagtaatctcgaagttttggaagagccataagactaagattcgcgaaagcctcatgaaccagtcgaggtggaactcaggacttcgaggtctgtcgtggcgcgtcgatggaaaaagccagagccgacattcagcccaaattcacactccggtcgcaatcatcgaactggaattgggtaagtacgggcaagaatccgaatttctctgtcttgaatttgacgaggtgaaggtgaaccagatccttaagacgctctcagaggtggaagaatctatttcgaccctgatttcccagcccaac

SEQ ID NO: 10064 - DNA, 570 bp, Artificial Sequence
  Description of Artificial Sequence: Synthetic coding sequence
atggccgcgggtgaactcgagggcgggaagcctctttcaggactgcttaacgctctggcacaagatactttccacgggtacccgggcattaccgaggaactgcttcgttcgcaactgtaccccgaggtgcctcctgaagagtttcgcccttttctggctaagatgagggggatcctgaagtcgatcgcgagcgccgacatggatttcaatcagctggaggcatttctgaccgcgcaaactaagaagcagggagggattacctccgatcaggctgcggtcatctctaaattctggaagtcccataaaaccaaaattcgggaatcactgatgaatcagtcgagatggaattccggactgcggggactcagctggcgtgtggatggcaagtcccaatcaaggcattcggcacagatccatacccccgtcgccattatagagcttgagttgggaaaatacggtcaggagtcggaatttctgtgcctggaatttgatgaggtgaaggtgaaccagattcttaagacgctgtcagaagtggaagaatcgatatctactttgatttcccaacctaat

SEQ ID NO: 10065 - DNA, 570 bp, Artificial Sequence
  Description of Artificial Sequence: Synthetic coding sequence
atggcagccggtgagctagagggtgggaagcctctgagtgggcttctgaatgcccttgctcaggacactttccacggatatcccgggattaccgaggagctcctccgatcgcagctgtatcccgaggtgccaccagaggagttccgtccttttctggcaaaaatgcgtggcatcctgaagagcattgcctcagcagatatggacttcaaccagctcgaggcttttctgacagcacagacaaaaaaacaggggggcataacgagtgatcaggctgccgtaatttccaaattctggaagagtcacaagaccaaaatccgagagagcctaatgaaccagagtcgatggaactcaggcttaagaggcctgtcatggcgagttgacggtaaaagccagtcaaggcacagcgcacagatccatacccccgtagcgataatcgagctggaactcgggaagtacgggcaggagagtgagttcctgtgtctcgagtttgatgaagtgaaagtgaaccaaatactcaaaactctgagcgaagtggaagaatctatctctacgctgatctctcagcctaac

SEQ ID NO: 10066 - DNA, 570 bp, Artificial Sequence
  Description of Artificial Sequence: Synthetic coding sequence
atggccgccggtgagctcgagggaggcaagcctttgagcggcctgctgaatgctttagcgcaggatacattccacggctacccaggcatcaccgaagagctgctacgttcccagctgtaccccgaggtgccgccggaggagtttcgcccctttttggccaagatgcggggcatcttgaagtccatcgcgagcgccgacatggatttcaaccagctagaggccttcctcactgcccagacgaagaagcagggcggcataacaagcgaccaggctgccgtgatttctaaattctggaagtctcataagacaaaaatccgggagtccctaatgaatcaatccaggtggaactcggggcttcgcggtctctcttggcgagtggatggcaagtcacagagcaggcattcggcccagatacacacgcccgtggctatcatcgagctggagctgggtaagtacggccaggagagcgagttcctttgcctggagtttgacgaggtaaaggtgaatcaaatcttgaaaacgttgtccgaagtggaagagtctatctccacgctgattagccaacctaac

SEQ ID NO: 10067 - DNA, 570 bp, Artificial Sequence
  Description of Artificial Sequence: Synthetic coding sequence
atggccgccggcgaactggaaggggggaagccactgtcgggtctgctgaatgcccttgcgcaggacacctttcacggataccccggaatcaccgaagaattgctgcgttcgcagttgtacccggaagtgccgccagaggagttccgaccgttcctggcaaagatgcgggggatcctcaaatccatcgcctccgcggacatggatttcaaccagctggaggctttcctgaccgctcaaactaagaaacagggaggtattacgtcggatcaagcagctgttatctccaaattctggaaaagccataagaccaagatcagagagtccctcatgaaccaatcgcgctggaacagcggactgcgcggtctgagctggcgggtggatggaaagtctcaatccagacactccgcgcagattcacactcccgtcgcgatcatcgaactcgaactgggaaaatacggacaggaatcggaattcctttgcctggaattcgatgaggtgaaggtcaaccagatcctgaaaaccctgagcgaagtggaagagtctatctcgaccctgatctcccagcctaac

SEQ ID NO: 10068 - DNA, 570 bp, Artificial Sequence
  Description of Artificial Sequence: Synthetic coding sequence
atggctgccggagagctggaaggaggcaaacccttgagcggcctgttaaacgctttagcccaggatacattccacgggtatccaggcatcacggaggagctgctcaggagccagctttatcccgaggtacccccagaggaattccgaccattcctagccaagatgcgggggatcctcaagagcatagcctccgccgacatggattttaatcagctagaggccttcttgacagcccaaaccaagaaacagggtggtatcaccagtgatcaagccgccgtcattagcaagttttggaaatcccacaagacaaagatcagggaatccctgatgaatcagtccaggtggaactctgggcttaggggacttagctggagagttgacggaaaatcccagtctcggcattctgcccagatccacacacccgtggcaatcatcgagctagaattggggaagtacggacaggaatctgaattcctatgcttagaattcgacgaggtgaaagtaaaccagattctgaagaccctatccgaagttgaggagtccatctccaccctgatcagccagccgaac

SEQ ID NO: 10069 - DNA, 570 bp, Artificial Sequence
  Description of Artificial Sequence: Synthetic coding sequence
atggccgcaggagagctggaaggaggaaagcccctttcgggattactcaacgctctggcccaggacaccttccacggttaccctggcattaccgaggaactccttcgtagccagctgtacccagaggtgccgcccgaggagttcagaccctttctggccaaaatgagagggatcctcaaatcaatcgccagcgctgacatggacttcaaccaactggaggcatttctcaccgcccagactaaaaaacagggcgggatcactagtgatcaggctgccgtcatatcgaagttctggaagagccataagactaaaattagagagtctctgatgaatcagagccgttggaattccggactccgcgggctctcctggagggtggatggtaagagtcagtcccgtcactccgctcagatccacactccagtcgccatcattgaattggagcttggcaagtatgggcaggagtctgaattcttatgcctggagttcgatgaggtgaaggtgaaccagattctgaagaccctgagtgaggtcgaggaaagcatatcaaccctcatctcacagccaaat

SEQ ID NO: 10070 - DNA, 570 bp, Artificial Sequence
  Description of Artificial Sequence: Synthetic coding sequence
atggcggcaggcgagctggagggaggaaagccactgtccggtcttttaaatgcacttgctcaggatacctttcacggataccctgggatcaccgaggagttgctccggagccagctttaccccgaggtcccgcccgaagaatttaggcctttcctcgcaaagatgagagggatacttaaatctattgcttcggcagacatggactttaaccaattggaagccttcctcaccgctcaaacaaaaaagcaggggggcatcacaagcgatcaggccgccgtcatttctaagttctggaaaagccataaaactaagatccgtgaatcgctcatgaaccagtcaaggtggaacagcggcctgcgcgggctttcttggcgtgtggacggaaaaagccagtcaagacatagcgctcaaatccatactccagttgctatcatcgaattagaattgggcaaatacggccaagaatcagagttcctgtgcctggaatttgacgaggtgaaagtgaaccaaatcttaaagacactgagtgaggtggaggagtccatcagcactctgatctcgcaaccaaac

SEQ ID NO: 10071 - DNA, 570 bp, Artificial Sequence
  Description of Artificial Sequence: Synthetic coding sequence
atggccgctggagagcttgaaggaggcaagcccttgtctggtctgttgaacgctctggcacaagatacctttcatgggtaccccggaatcaccgaagaactgctaaggagtcagctctaccccgaggtgcctcccgaggagttcaggccttttctggcgaagatgaggggtatactgaaatccattgcctctgcagacatggacttcaaccaactggaggcatttctgaccgcacaaacaaagaaacagggtggaattacatcagatcaagccgctgtcatttccaaattttggaagtcacacaaaactaaaatcagggaaagcctgatgaaccaatccaggtggaactctggtttgcgcggcttgtcatggagggtcgatggtaagagccaaagcaggcacagtgcccaaatccatactcctgtggctatcatcgaactggagctgggaaagtatggacaggaaagcgagttcctttgcctggagtttgacgaggtgaaggtgaaccaaattctgaagaccctgagcgaggtggaagagagtatctccacactgatcagccagcctaac

SEQ ID NO: 10072 - DNA, 570 bp, Artificial Sequence
  Description of Artificial Sequence: Synthetic coding sequence
atggcggcaggtgaacttgagggtggaaagcccctttccggcttgctgaacgcccttgcacaagataccttccacggataccctgggattacggaggaactgctccggagccaactgtatcccgaagtgccacctgaagaatttcgaccttttcttgccaaaatgaggggtattctgaaatcgatcgcatccgccgatatggactttaaccagctggaggcatttctcactgcacagaccaagaaacaggggggaattacgtcggatcaagcagcggtgatctccaagttctggaagagccacaaaaccaagatcagggaaagccttatgaatcaatcccgctggaacagcggattgcgcggcctcagctggcgggtcgacggaaaatcgcaatcgcggcattcggcacagatccacacgccggtggcgatcatcgaacttgaacttggtaaatacggacaagagtcggagtttctgtgcctggaattcgacgaggtcaaggtgaatcaaattctcaagaccctttccgaagtggaggaatccatatccacccttatctcccaaccaaat

SEQ ID NO: 10073 - DNA, 570 bp, Artificial Sequence
  Description of Artificial Sequence: Synthetic coding sequence
atggctgctggagaattggaaggtggtaagccactgtcaggactgctgaacgccttggcccaggacacattccacgggtacccaggcatcaccgaagagctcctgaggagccaactttaccctgaggtgccgcccgaggaatttcgcccattcctagccaagatgagaggaatccttaagtcaatcgcaagcgccgatatggacttcaatcaactggaggcctttctgactgcacaaactaagaagcagggcggtataacatccgaccaggccgccgtgatctccaaattctggaaaagtcataaaaccaagattcgtgaatctcttatgaaccagtctagatggaatagtgggcttaggggactctcttggcgagtagatggcaaatcccagagtagacatagtgcacagatacacacccctgtggctataatcgaactggagctgggaaaatacggacaggagagcgagttcttgtgcctagaatttgatgaagtgaaagtcaaccagattctgaaaacccttagcgaggtggaagaatcaattagcaccttgatcagccagcccaat

SEQ ID NO: 10074 - DNA, 570 bp, Artificial Sequence
  Description of Artificial Sequence: Synthetic coding sequence
atggctgccggcgagctggagggtgggaaacccctaagtgggttgctgaacgcgctggcccaggacacttttcacggctaccccggaatcacagaagagctgcttaggagccagttgtacccagaagtacccccagaggaatttcgacccttcttggctaaaatgcggggcatactgaaaagcatagcttccgctgatatggatttcaaccagctcgaggcctttctaactgcgcagactaagaagcagggcggcattacctctgatcaggcagccgtaatcagtaagttttggaaatctcacaaaaccaaaatccgcgaaagtctgatgaatcagtcacgttggaactcaggactccgcggcctgtcatggagagtggacgggaagagtcagtccagacacagcgcacagatccacaccccagttgctattatagaactggagctgggaaaatacggccaggagtctgaatttctgtgtcttgaattcgacgaggttaaggtgaaccagattctcaaaaccctctccgaagtcgaggaatcaattagcacactgatctcccagcctaac

SEQ ID NO: 10075 - DNA, 570 bp, Artificial Sequence; identical to SEQ ID NO: 10073
  Description of Artificial Sequence: Synthetic coding sequence

SEQ ID NO: 10076 - DNA, 570 bp, Artificial Sequence
  Description of Artificial Sequence: Synthetic coding sequence
atggctgccggtgagttagaaggcggcaaacccctgtcgggattgttgaatgccctcgcccaggatacgtttcacgggtatccagggattacagaggaactcctcaggagccagctatatcctgaagtgccccccgaggagtttcgacctttcctggctaaaatgcggggcatacttaagtctattgcgtcggccgatatggactttaatcagctggaggcatttcttacagcgcagaccaagaagcagggtggtatcacgagtgatcaggctgcggtcatttctaagttctggaaaagtcacaagaccaagatcagggaatctctcatgaaccaaagtaggtggaacagcgggctgcgggggctgtcctggcgggtagacggtaagtcccagtccaggcatagtgcgcagattcatactccagtcgccattattgaactggagctggggaaatatggacaggagagcgaatttctttgcctggaattcgacgaggtgaaagtgaatcagattctaaaaacactctcagaggtggaagaatccatctccaccctcattagccagcccaac

SEQ ID NO: 10077 - DNA, 570 bp, Artificial Sequence
  Description of Artificial Sequence: Synthetic coding sequence
atggcggctggggagttggaggggggaaaacctctgtctggccttttgaatgccttggctcaagatacattccatgggtacccgggaattactgaagaacttctacggagtcaactttaccccgaagtgcctcctgaagaatttagaccttttttggctaaaatgcgaggaattttgaagtctatagcaagtgcagatatggattttaaccagttggaggcatttcttactgcacagacgaagaaacagggtggtattacaagcgatcaggccgccgtcatctcaaaattttggaaatcgcataagactaaaatacgagagtccctaatgaatcaaagtagatggaattctggtctgcgtggattatcttggagggtggatggtaagtctcagagtcgtcatagtgctcaaattcatacccctgttgccattatagaacttgagttgggaaagtacggtcaagagagcgagtttctttgtctcgaattcgatgaggtcaaagtcaatcagatacttaaaacattatctgaggtcgaggagtctatctccactctaatttcacaacccaac

SEQ ID NO: 10078 - DNA, 570 bp, Artificial Sequence
  Description of Artificial Sequence: Synthetic coding sequence
atggccgccggcgagctggagggtggcaagcctctgtcagggctgctcaacgctctggcccaggataccttccacggctaccccggaattactgaggaactgctgcgctctcagctatatccagaggttcccccagaggagtttagacccttcctggccaagatgcgcggaatcctaaagtctattgcgtcagcagacatggacttcaaccagctggaggcttttcttaccgcccagacaaagaagcagggcgggatcacatcggatcaagccgccgttattagtaaattttggaaaagccacaagaccaaaattcgcgagagcctgatgaatcagagcagatggaactcaggcctgcgcggcttatcctggcgcgtggacgggaaaagccagtcgagacactctgcgcagatacacacgcctgtggcaattatcgaattagaactggggaaatacggccaggagtccgaatttttgtgtctagaattcgatgaagtaaaagtcaatcagattctcaaaacactgtctgaagttgaagagagcatatctacactgatctcacagccgaat

SEQ ID NO: 10079 - DNA, 570 bp, Artificial Sequence
  Description of Artificial Sequence: Synthetic coding sequence
atggcagctggagagctagaaggaggcaagccactgtccgggctgttgaatgcactcgcccaagatacctttcacggctaccccggcattaccgaagaactccttaggtctcagctctacccagaagtccctcctgaggaattccgcccttttctggctaagatgaggggtatactcaagagcatagcatctgcagatatggacttcaaccagttagaagccttcctcacggctcaaacaaaaaaacagggtggtatcacgtcagaccaagccgccgttatttccaagttctggaagtctcacaagactaaaatcagagaatctttgatgaatcaatctcgctggaattctgggttgagaggtctgtcatggcgcgtggatggcaagtctcagagtcgtcattctgcccagattcacaccccagtggccataatcgagcttgagcttgggaagtatggtcaagagtctgaattcctgtgcctggagtttgatgaggtgaaagtcaatcagatcctcaagactctttctgaggtggaagagagtataagcaccctgatctcccagcccaac

SEQ ID NO: 10080 - DNA, 570 bp, Artificial Sequence
  Description of Artificial Sequence: Synthetic coding sequence
atggcagcgggagagctagagggcggcaagcctctttcaggcctgctgaatgctctggcccaggacacttttcacgggtaccctgggatcacggaggaattactgaggtctcaactgtacccggaggtaccgcccgaggaattcaggccatttcttgcgaaaatgaggggtatcttaaaatccatcgccagtgcagacatggatttcaatcagctggaagccttcctcactgctcaaactaaaaagcagggtggaatcacaagcgatcaggcagccgtgatctctaagttctggaagtcccataagacgaagatacgcgaatcactgatgaatcagtccagatggaactccggcctgagaggattgtcctggagagtggatggaaagtcccagtcccgccactctgcccagatccacaccccggtggccatcatcgagctggaactggggaagtacggtcaggaatccgagtttctttgtcttgagtttgacgaggttaaagtgaatcagattctcaaaacgctgtctgaagtggaagagtctatctctactctaattagtcaaccaaat

SEQ ID NO: 10081 - DNA, 570 bp, Artificial Sequence
  Description of Artificial Sequence: Synthetic coding sequence
atggccgcgggagaactggaaggcggcaagccgctctccggactcctgaacgccctggcacaagacactttccacgggtaccctgggatcactgaggaactgctgcgctcacagctctacccggaggtccctccagaagagttcagaccgttcctggcgaaaatgcgcggaatcctcaagtcaatcgcgagcgctgatatggattttaaccaactggaagccttcttgaccgcccaaaccaagaagcagggcgggatcacgagcgaccaagcggcggtcatctcgaagttctggaagtcgcacaagaccaagatcagggaaagcctgatgaaccagtcccgctggaactcgggactccgcggcttgtcgtggcgcgtggatggaaagtcgcagtcgcgccacagcgcccagatccacaccccagtggcgatcatcgagctcgaattgggtaagtacggacaagaatccgaattcctgtgcctggagttcgacgaagtgaaagtgaaccagatcctcaagacgctgtcggaggtggaggaatcaatcagcaccctgatctcgcagccgaat

SEQ ID NO: 10082 - DNA, 570 bp, Artificial Sequence
  Description of Artificial Sequence: Synthetic coding sequence
atggctgctggagaactggaaggcggcaagccactgagcggtctcctcaacgccctggcccaggacacctttcacggctatcccggcatcaccgaggaacttctgaggtcccagctgtatccagaagtgccacctgaggaattccgtccttttctggctaagatgagaggaatcttgaagagtatcgcctccgcagatatggacttcaaccagcttgaggccttcttgactgcccagaccaagaagcagggcggtataaccagcgaccaggccgcagtgatctctaagttctggaagagccataagactaagatacgtgagtccttgatgaaccagtctcgctggaatagtggtctgaggggattgtcctggcgtgtggacggaaagagccagtcaagacacagtgctcagatccatacaccagtggccattattgaattggagctgggcaagtacggccaagagtctgaatttctgtgccttgagtttgacgaggtaaaagtgaatcagatcctcaagaccctgagtgaagtcgaagaaagcatcagtaccctgatctcccagccaaac

SEQ ID NO: 10083 - DNA, 570 bp, Artificial Sequence
  Description of Artificial Sequence: Synthetic coding sequence
atggccgcaggtgagctggaaggcggcaagccactctccggtcttctgaacgcgctggcccaagacaccttccacggttaccccggcatcactgaagagcttttgaggtctcaactttacccagaagtgcccccagaggaatttaggccattcctcgccaagatgagaggtattctgaagagcatcgcctctgccgacatggacttcaaccagcttgaggcattccttaccgctcagactaaaaaacaaggaggaatcacatcagaccaggccgctgtcatatctaagttttggaaatcacacaagactaaaatacgcgaatcactgatgaaccagagccgctggaattcaggcctgcgcggactctcatggagagtggacggtaaatcccagagtagacactctgctcaaattcacactcctgtggccatcatcgaactggagcttggtaagtacggtcaagagagcgagttcctgtgcctcgaatttgacgaggtgaaagtcaatcaaattctgaagactctgtccgaagtggaagagagcatttccaccctgatctctcagcctaac

SEQ ID NO: 10084 - DNA, 570 bp, Artificial Sequence
  Description of Artificial Sequence: Synthetic coding sequence
atggctgcaggtgagctggaaggcggtaagcctctgtcgggactcctgaatgccctcgcccaggacaccttccacggctaccccggcatcaccgaggagctgctcagatcccagctttacccggaggtgcctccggaagagttcagaccattcctggccaagatgagagggatcttgaaatccatcgcgagcgcggatatggactttaaccaactcgaagcctttctcactgcacagaccaagaagcagggcggcatcaccagcgatcaagcggccgtgatctcaaaattctggaagtcccataagaccaaaatccgcgagtcgcttatgaatcaatcgcgctggaactccggcctgcgaggactgtcttggcgggtcgacggtaagtcccagtcaagacactcagcgcaaatacataccccagtagcaatcatcgagctcgagttgggaaagtatggtcaggaatcggaattcctgtgcctggaattcgacgaggtcaaggtgaatcagatcctcaaaactctgtccgaagtggaagaatcaatttcgactctgatcagccagccgaac

SEQ ID NO: 10085 - DNA, 570 bp, Artificial Sequence
  Description of Artificial Sequence: Synthetic coding sequence
atggccgcgggtgagttagaaggaggtaagccactgtcagggctactgaatgcgctggcccaggacacctttcacgggtatcccggtatcacagaggaattgcttcggtcccagttgtatcccgaagtgccacccgaagaattcaggccattcctagctaagatgaggggaattctgaaaagtatcgcttctgccgacatggattttaaccagctggaagcattcctcaccgcacagacaaagaagcaaggtggaattacatctgaccaagcagccgtaataagtaagttctggaaatctcacaagacaaaaatcagggagtccctaatgaatcagtcacgatggaatagcggactgcgcggcttatcctggagggttgatggaaaatcccagtctaggcattctgctcagattcacactcctgtggcgattatcgagctggagctgggcaagtacggtcaggaaagtgagttcctctgtttggaattcgatgaggtcaaagtgaatcagatcctgaagaccctcagcgaggtggaggaaagcatatctaccctaatctcccagcctaac

SEQ ID NO: 10086 - DNA, 570 bp, Artificial Sequence
  Description of Artificial Sequence: Synthetic coding sequence
atggcagccggtgaactggaaggcggcaagccgttgtcgggtctgttgaacgcccttgcacaggatacctttcatggttacccaggaataaccgaggaactgctgagatcccaattgtaccccgaggtccctccagaggaattccgcccttttctggcaaagatgcggggcatactgaaatcgatcgcatcggctgatatggatttcaaccaactggaagccttccttaccgcccaaactaagaagcaagggggtatcactagcgaccaggcagcggtgatctctaagttttggaaatcccataaaaccaagattagggaaagcctcatgaaccagtcacgatggaactccggactgcgtggactgagctggcgtgtggacggtaaatcccaatcgagacactctgcacaaatacatactcctgttgctattatcgaattggaactcggaaagtacggccaagagtcagaatttctgtgtctcgaattcgatgaagtgaaggtgaatcaaattctcaaaacgctttccgaggtggaagaatcaattagcacccttatctcccaacctaac

SEQ ID NO: 10087 - DNA, 570 bp, Artificial Sequence
  Description of Artificial Sequence: Synthetic coding sequence
atggctgcaggagaactggaaggtgggaagcctctctcgggacttctcaacgcattggcacaagatacctttcacggatacccaggaattactgaggaacttcttagatcgcaactctatcccgaagtcccacccgaggagttccggccgttccttgccaagatgcgtgggattctgaagtcgattgcatcggcagacatggactttaatcaactggaggcctttctcactgcgcagactaaaaagcagggtgggataaccagcgaccaagccgctgtgatttcaaagttctggaaatcgcataaaactaagatccgagaatcgctcatgaaccaatcgcgatggaactccggccttcgcggtcttagctggagagtggatgggaagtcacagtcgagacattcagcacagatccatacgcctgtggcaattatcgagctggaacttggcaagtacgggcaggagagcgaattcctgtgccttgaatttgatgaggtcaaagtgaaccagatccttaagaccctttccgaggtggaagaatcaatcagcaccctgataagccaaccgaac

SEQ ID NO: 10088 - DNA, 570 bp, Artificial Sequence
  Description of Artificial Sequence: Synthetic coding sequence
atggctgcaggcgagctagaaggagggaaacccctatctgggctgcttaacgcactggcgcaggatacatttcacggctacccgggcatcactgaagaactcctgagaagccagctgtaccccgaggtccctccagaagagttcaggccatttctggctaagatgaggggcattctcaagagtatagcctccgctgacatggactttaatcagttagaagcatttctcacagctcagaccaagaagcagggcggaatcacgtcagatcaggctgctgtgatttctaagttctggaagtcacacaagactaagatacgcgagtccctgatgaaccagtcaagatggaattccggattgcgtggcctttcatggagagtggatggtaagtcccagtcaaggcacagtgcccaaatacacaccccagtggctataattgaactggagctcggtaagtacggccaggaaagtgagttcttatgtctggaattcgacgaggttaaagtgaatcagattctaaagaccctttctgaggtagaagagtccatttctacactaatttctcagccaaac

SEQ ID NO: 10089 - DNA, 570 bp, Artificial Sequence
  Description of Artificial Sequence: Synthetic coding sequence
atggctgctggagagctggagggcggcaagcctcttagcgggctgctcaatgccttggcgcaggatacttttcacggctacccaggaataacagaagagctgctgcgatctcagctctaccctgaggtgccaccggaggagttcagaccgtttctggctaaaatgcgaggaatactgaagtctattgctagtgcagatatggacttcaatcagctggaagcgtttctgactgctcaaactaaaaaacaaggcggaattaccagcgaccaggctgcagtaataagcaaattctggaaatcccacaagaccaagatccgcgaatctctgatgaatcagtcaaggtggaatagtgggttgagaggcctctcctggcgagtggacggaaaatctcagagccgacactcagcgcagattcacacccctgttgcaatcattgagctcgaactgggcaaatacgggcaggagagcgaattcttgtgcctcgaatttgacgaggtgaaggtaaaccagatcctgaagaccctgagtgaagtcgaggaatcaataagtacccttatttcccagccaaac

SEQ ID NO: 10090 - DNA, 570 bp, Artificial Sequence
  Description of Artificial Sequence: Synthetic coding sequence
atggctgccggcgagctggaggggggtaagcctcttagcgggctgctgaacgcgctggcgcaagatacttttcacgggtatcccggcatcaccgaggagctcctgagaagccagctgtatccagaggttccgcctgaagagttccggccctttctggctaaaatgcggggaatcctgaaatcaattgccagtgcggatatggacttcaaccagttggaggctttccttaccgcccagaccaaaaagcagggaggaattactagcgatcaagcagctgtgatatcaaagttttggaagagccacaagaccaagatccgagagtcactgatgaaccagagtaggtggaactccggacttcgcggtctgtcctggcgggttgacggcaaatcacagagtcggcactctgcccagatccataccccagtggcaattattgaactggaattgggcaaatatggacaagaaagcgagtttctgtgcctggagttcgatgaagtaaaggttaaccagatcctcaagacactttccgaagtcgaagaatcaatttccacgctgatctcacagcctaac

SEQ ID NO: 10091 - DNA, 570 bp, Artificial Sequence
  Description of Artificial Sequence: Synthetic coding sequence
atggcggcgggtgaattagaaggtggtaaaccgttatcgggtttattaaatgcgctagcgcaagatacgtttcatggttatccgggtataacggaagaactactacgttcgcaattatatccggaagttccgccggaagaatttcgtccgtttctagcgaaaatgcgaggtatattaaaatcgatagcgtcggcggatatggattttaatcaactagaagcgtttctaacggcgcaaacgaaaaaacaaggtggtataacgtcggatcaagcggcggttatatcgaaattttggaaatcgcataaaacgaaaatacgagaatcgctaatgaatcaatcgcgatggaattcgggtttacgtggtctatcgtggcgagtagatggtaaatcgcaatcgcgtcattcggcgcaaatacatacgccggtagcgataatagaattagaattaggtaaatatggtcaagaatcggaatttttatgtctagaatttgatgaagtaaaagtaaatcaaatactaaaaacgttatcggaagtagaagaatcgatatcgacgttaatatcgcaaccgaat

SEQ ID NO: 10092 - DNA, 570 bp, Artificial Sequence
  Description of Artificial Sequence: Synthetic coding sequence
atggcagctggggagcttgagggagggaaaccactcagtggacttttgaatgccctggcccaggatacttttcatgggtaccctggaattactgaagaactcctgcggtcccagctgtaccccgaagtcccaccagaagaatttcgcccgttcctggcaaaaatgcggggaattcttaagtcaattgcttcggcagatatggactttaaccaacttgaagcattccttactgcacaaaccaaaaagcagggcggaatcacttcagaccaggccgcggtgatatccaagttctggaagtcacacaaaaccaagatcagagagtcccttatgaaccaatcgaggtggaattccggactgcgaggactctcctggcgcgtggacgggaagtcgcagagccgacattccgcacaaattcatactcctgtggccatcatcgaattggaactgggcaagtacggccaggagtccgaatttctctgtctggagtttgatgaagtcaaggtgaatcaaattcttaaaacgctgtcggaagtggaagagagcatttcaaccttgatctcgcagcctaac

SEQ ID NO: 10093 - DNA, 570 bp, Artificial Sequence
  Description of Artificial Sequence: Synthetic coding sequence
atggccgccggggaattggagggaggcaagcctctgtcgggattgcttaatgcactggcacaggatacttttcacggataccccggaatcactgaagagctcctccggtcccagctgtacccagaagtgccaccagaggagttcagaccatttctggccaagatgcgggggattctcaagtcgatagcgtcggcagatatggatttcaatcaactcgaagcctttcttacggctcaaaccaagaaacagggcggaatcacttcagatcaggcagcagtgatatcaaagttctggaaatcgcacaagactaagattcgggaatccctgatgaatcaatcgagatggaactccggacttagaggtctttcgtggagggtggatggtaaatcgcaatccaggcattccgctcagatccacaccccagtggcaataatcgagctggagcttggtaaatacggacaagagtcggagtttctctgcctggaattcgacgaagtgaaggtgaaccagattcttaagaccctttcagaagttgaggagagcattagcactttgatctcacagccgaac

SEQ ID NO: 10094 - DNA, 570 bp, Artificial Sequence
  Description of Artificial Sequence: Synthetic coding sequence
atggccgcaggagaactggagggaggcaagccgttgagcggactcctgaacgcccttgcacaagacactttccacgggtaccctgggatcactgaggaactgctgcggtcacaactgtacccggaagttccgccagaagaatttcggccgtttttggccaagatgcgcggaatccttaagagcatcgcttcagccgacatggactttaaccagctggaggcattcctgactgcccagaccaagaaacaggggggaatcacctccgaccaggccgcagtgatcagcaagttctggaagtcgcataagacgaaaatccgcgagtctttgatgaaccagtcccggtggaattccggcctcagaggtttgtcctggagagtggatggaaagagccaatcccggcatagcgcacagatccacacccccgtcgccatcatcgaactcgagctgggaaaatacggacaagagagcgagttcttgtgtttggaattcgatgaagtgaaggtcaaccaaatcctgaaaaccctctccgaggtggaagaaagcatttccactctgatctcccagccaaac

SEQ ID NO: 10095 - DNA, 570 bp, Artificial Sequence
  Description of Artificial Sequence: Synthetic coding sequence
atggctgctggtgaactcgaagggggaaaacccctaagcggtctcctgaatgcactagcacaggatacatttcatgggtatcctggaataactgaggagcttctgagaagccagctctatcctgaagtgcctcccgaggaatttagacccttcttggccaaaatgcgaggaatcctcaagtcaattgcgagtgcagacatggacttcaaccagctggaagctttccttaccgcgcagacaaagaagcaggggggaataacgagtgatcaggccgcagttatcagcaagttctggaagagccacaagaccaagatacgggaatcccttatgaaccagagtaggtggaacagtggacttcgcggactgtcctggcgagtggatggtaagtcgcagagccgccactcagctcagatccacactcctgtggcaatcatcgagctcgagctcggaaagtatggacaggagtccgagttcctatgcctggagtttgatgaggtgaaggtcaatcaaatcctcaagactctgtccgaagtagaagaatcgatcagcacccttatttcgcagcccaac

SEQ ID NO: 10096 - DNA, 570 bp, Artificial Sequence
  Description of Artificial Sequence: Synthetic coding sequence
atggcagcaggcgaactggaaggcggaaagccccttagcgggcttcttaatgccctggcacaagatacctttcacggatacccagggatcactgaggaattgcttagatcacaactttacccagaagtcccaccagaagaatttcggccttttctcgccaagatgcgtggcattctgaagagcattgcgtctgcggatatggatttcaaccaactcgaagccttcctgacggcccagactaaaaagcaagggggtatcacttcagaccaagcagctgtgatcagtaagttttggaagagccataagactaagattagagaaagcctcatgaaccaatcacgttggaattccggcctccgcggactttcgtggagagtcgatggtaagtcacagtccaggcattcggcgcagattcatacccccgtggcgattatcgaactggagctggggaaatacggtcaggagtcggaatttctctgtctggaattcgatgaagtgaaagtcaaccagattctcaaaactctgtcagaagtggaggaatcaatctcgacgctcatttcacaacctaac

SEQ ID NO: 10097 - DNA, 570 bp, Artificial Sequence
  Description of Artificial Sequence: Synthetic coding sequence
atggccgccggagaactggaaggaggaaagccgctgtccggactgttgaacgcgcttgcacaagataccttccatggatacccgggaattaccgaagaactcctgagatcgcaactgtacccagaggtgccaccggaagagtttaggccattcctggctaagatgcgcggcatcctgaagtcaatcgcttctgccgatatggacttcaatcagctcgaagcgttcctcactgcacagacgaaaaaacagggcggtattacttcagaccaggccgctgtgatctcaaaattctggaaatcccacaagaccaagatccgcgagtccctgatgaatcagtcgcggtggaacagcggtctgcggggactctcctggcgtgtggatggaaaatcgcagtcaaggcattcggcacagatccatactcccgtggccatcatcgagctggagctgggcaagtacggtcaagagtcggaattcctctgtctggaatttgacgaagtgaaagtgaaccagattctcaaaactctgtccgaggtcgaggagtccatctccacgttgatctcacaaccgaac

SEQ ID NO: 10098 - DNA, 570 bp, Artificial Sequence
  Description of Artificial Sequence: Synthetic coding sequence
atggccgcgggagagctggaaggaggcaagccgctgtcggggctcctcaatgctcttgcccaggacaccttccatggctacccgggaatcaccgaggagctcctgaggagccaactgtacccagaggtgcccccagaagagtttcgcccgttcctggctaagatgcgcggcattcttaagtcaatcgcttccgctgacatggacttcaatcagctcgaagcgttcctgactgcccagactaagaagcaaggaggaatcacttccgatcaggccgccgtgatctccaagttctggaagtcgcacaagaccaagatccgggagtccctgatgaaccagtcacgctggaacagcggactcagagggctctcctggcgggtggatgggaagtcgcagagcaggcattcggcgcagatccataccccggtggcgatcattgaattggagctcggtaagtacggacaggaatcggagtttctctgcctggaattcgacgaggtgaaggtcaatcagattttgaaaactctgtctgaagtggaagaatccatctcaaccctcatttcccagccgaat

SEQ ID NO: 10099 - DNA, 570 bp, Artificial Sequence
  Description of Artificial Sequence: Synthetic coding sequence
atggctgccggagaactggaaggggggaaaccgctgtctgggttactcaacgccctagctcaagatacattccatggatatccaggaattactgaagaactcttgaggtcccagctgtatcccgaagtcccccctgaagaattcaggccctttctagcgaaaatgcggggaatcctgaaatctatcgcttctgccgatatggattttaaccagctagaggctttccttacagcacagactaaaaaacagggaggaataactagtgatcaggcagctgtgatatctaaattctggaaaagtcacaaaactaaaatacgcgagtctctgatgaatcagtcccggtggaactctggactaagaggactttcatggcgggtggatggaaagtcccagagtcgacattcagcacagattcatacacccgtggccattatagaattggaactggggaaatatgggcaggagtcggaatttctgtgtctcgaatttgatgaagtaaaagttaaccagattttgaaaacactgtctgaagtcgaggagtcaatctcaacactcatctcgcagcctaac

SEQ ID NO: 10100 - DNA, 570 bp, Artificial Sequence
  Description of Artificial Sequence: Synthetic coding sequence
atggctgccggcgagctcgaggggggcaagcctctgagtgggctgctgaatgccttggctcaagacacattccatggctacccaggaatcacagaagagctgcttagaagccagttataccctgaagtgcctcctgaagagtttcggccttttctggccaagatgagaggaatcctgaaaagtatcgcatcggccgatatggatttcaaccagctggaggcctttctaactgcccagaccaagaaacagggtggtatcacttcagaccaagctgctgtgatcagcaagttctggaaatcccacaagactaaaatcagggagagcctcatgaatcagtctaggtggaactctggcctccgggggctctcctggcgcgttgacggaaagagtcagagccgacattctgctcaaattcacacgcccgtggcgatcattgagctcgaactcggcaaatatggccaagagtcagaatttttgtgcctcgagttcgacgaggtgaaagttaaccagatcctgaagaccctttctgaggtcgaggagtccatctccactctgatatctcagcctaat

SEQ ID NO: 10101 - DNA, 570 bp, Artificial Sequence
  Description of Artificial Sequence: Synthetic coding sequence
atggcagccggagaactcgaagggggaaagcctttgtcggggctgctcaatgccctggcgcaggacactttccacggttacccgggcatcactgaagaactgctgcggtcacagctgtaccctgaggtcccaccggaagaattccgcccatttctggccaagatgagaggaatattgaaatcaattgcgtcagctgatatggatttcaaccagttggaggcattcctcaccgctcaaaccaagaagcaagggggtatcacctcagatcaggcggccgtgatttcgaagttctggaagtcacacaagaccaaaatcagagagtcgctgatgaaccaatcgagatggaattcgggactccggggactctcgtggcgggtggacggaaaatcacagtcccgccatagcgcgcagatccacactcccgtcgcgatcatcgagctggaactgggaaagtacggacaggaatcagaattcctctgcctggagtttgatgaggtgaaagtgaatcagatccttaagactctgagcgaggtggaagagtcgatctccacccttatctcccagcctaac

SEQ ID NO: 10102 - DNA, 570 bp, Artificial Sequence
  Description of Artificial Sequence: Synthetic coding sequence
atggctgcaggggagctcgaggggggcaagcccctgtccggcctgctgaacgcgctggcccaggatacatttcacgggtacccaggaatcactgaggagttgcttaggtcccaattatacccagaggttcctccagaggaattcaggccttttctggccaaaatgcgaggcatcttgaagtccatcgccagtgccgatatggacttcaatcagttagaagcattcctcacagctcagacaaagaagcagggcgggatcaccagcgaccaggcggccgtgatcagcaagttttggaagagtcataagactaagattcgcgagagtctcatgaatcagagcagatggaattctgggctgcgcggtctctcttggcgggtggacggaaaatcacagagccggcatagtgcacagatccacaccccggtggctatcattgaactagagctcgggaagtacggccaggaaagcgagttcctgtgtcttgagtttgatgaagttaaggtgaatcaaattctcaagactctgtccgaagtggaagagtccatttctactctaatttcacagccaaat

SEQ ID NO: 10103 - DNA, 570 bp, Artificial Sequence
  Description of Artificial Sequence: Synthetic coding sequence
atggctgcaggagaattagaaggtggaaagccattaagtggacttttaaatgcacttgctcaagacacattccatggatatccaggaattacagaagaattattacgttcacaactttatccagaagttccaccagaagaatttagaccattccttgctaaaatgagaggaattttgaaaagtattgcctcagctgatatggattttaaccaattagaagcatttcttactgctcaaactaagaagcaaggaggaattacttcagatcaagcagccgtaattagtaaattttggaaatcacataaaacaaaaattagagagtcattgatgaaccaaagtaggtggaattcaggtttgcgaggattatcatggagagttgatggtaaatcacaatcaagacattctgcacaaattcatacaccagttgctattatagaacttgagcttggtaaatatggacaagaatcagaatttttatgtcttgaattcgatgaagttaaggttaatcaaattcttaagacattaagtgaggtagaagaatcaatatcaactttaatctcacaaccaaat

SEQ ID NO: 10104 - DNA, 570 bp, Artificial Sequence
  Description of Artificial Sequence: Synthetic coding sequence
atggcagcgggagaacttgaggggggtaaacctctttccggacttctcaatgcactcgcacaggacactttccacgggtaccctgggattacggaagaacttctcaggtcacaactttaccctgaagtgcccccagaagaatttcggccttttctggctaagatgagaggaattcttaagagcattgcatcggcagatatggatttcaatcagttggaagcgtttctgaccgcgcagactaagaagcaaggaggaattacttccgaccaggcagcagttatttcaaagttctggaagtcgcataagaccaagatcagggagtcactcatgaaccagtcgcgctggaactccggattgagaggactgtcgtggcgagtggatggaaaaagccagtccagacattcggcgcaaattcacactcccgtcgccattatagaactggagctgggcaagtatggacaggaaagcgaatttctgtgtctggaattcgatgaagttaaggtgaatcaaatcctgaaaaccctttcagaagtggaggagtcgatttccactctcatctcgcagccgaac

SEQ ID NO: 10105 - DNA, 570 bp, Artificial Sequence
  Description of Artificial Sequence: Synthetic coding sequence
atggccgccggggaactcgaggggggaaaacctcttagtgggctgctgaatgctctggcccaagataccttccatggctaccctgggataaccgaagagctactcaggagccagctgtaccccgaggtgcctccggaggaatttaggccattcctggctaaaatgcgcggcattctcaagagcatcgccagcgctgacatggatttcaaccagctcgaagcctttttaaccgcacagacaaagaaacagggaggtatcaccagcgaccaggctgccgtcatttctaagttttggaagtcgcataagacaaaaataagggaatccctgatgaaccaatctcgatggaatagcgggctccgggggctttcatggcgggtcgacggcaagagccaaagtcggcactcagcccagatacacacaccggtggcaatcatcgagctggaactggggaaatacgggcaagaatctgaattcttgtgtctcgaatttgacgaagtaaaggtcaaccagattctcaagactctatccgaagtggaggagagtatttctacactaatttcccagccaaac

SEQ ID NO: 10106 - DNA, 570 bp, Artificial Sequence
  Description of Artificial Sequence: Synthetic coding sequence
atggcggcgggggagctcgaaggtgggaagccactgtccggccttttgaacgcccttgcccaggacactttccacggataccccggtatcaccgaggaacttctgcggtcccaactctaccctgaggttccgccagaagaattccgcccctttctggccaagatgaggggaatcctcaagtcaatagcatcagcagatatggatttcaaccagctggaggcgtttctcaccgcccaaaccaagaaacaaggaggaatcacttcagaccaggcggctgtgatctcgaaattctggaagtcccacaagactaagatccgggaatcactcatgaatcagtcacggtggaattccggattgagaggactctcgtggcgcgtggatgggaagtctcaatctaggcatagcgcgcaaattcatactccggtggcaatcattgagttggaactgggcaagtacggccaggaaagcgaatttctttgcctggaattcgacgaggtcaaagtcaaccagattttgaaaaccctgtcagaagtggaggagagcatctcgaccctcatctcgcagcccaac

SEQ ID NO: 10107 - DNA, 570 bp, Artificial Sequence
  Description of Artificial Sequence: Synthetic coding sequence
atggccgcaggggaattggaaggaggaaagccactgagcggactgcttaacgcactggcccaagacacttttcatgggtaccctggcatcaccgaagaattgcttcgcagccagctgtacccagaggtgccgccggaggaattcaggccgttcctggcgaagatgcgcgggatcctgaaatccatcgccagcgctgacatggactttaatcagctggaagcgttcctcaccgcccagaccaaaaaacaaggaggaattacctccgaccaagcggccgtgatctctaagttctggaagagtcacaagacgaagatccgcgagtcgctcatgaatcagtcgcgatggaactcggggctgcggggcctctcgtggcgggtggatggcaagtcgcagagccggcattcggctcagattcacactcccgtggcaatcattgaactggaattgggaaaatacggacaggagagtgagttcctctgcctggaattcgatgaggttaaggtcaaccaaatccttaagaccctgtcagaagtcgaggaatccatctcgaccttgatatcacaacccaac

SEQ ID NO: 10108 - DNA, 570 bp, Artificial Sequence
  Description of Artificial Sequence: Synthetic coding sequence
atggctgctggcgagcttgagggcggtaaacctctcagcggcttgttaaacgctcttgctcaagacaccttccatggttaccctggcataacggaggagctgttgcgaagccagctctatccagaggtgcctcctgaggaattccgcccttttctggccaagatgagaggtatactaaaatccattgcttcagccgatatggactttaaccaacttgaggctttcttgactgcgcaaaccaaaaaacaggggggcataacatccgatcaggctgcggttatcagtaagttttggaaatctcacaagaccaaaattcgggagagcctgatgaaccaatcccgctggaacagtggcttgagaggactctcatggcgcgtggatgggaaaagccagtctcgacattctgcccagatccacacaccagtggcaatcattgaactagagcttgggaaatatggccaggagagcgaatttctctgtctcgaatttgacgaagtaaaggtcaaccagattctgaagacattgtccgaagttgaagaatcgatttccaccttgatctctcagcctaac

SEQ ID NO: 10109 - DNA, 570 bp, Artificial Sequence
  Description of Artificial Sequence: Synthetic coding sequence
atggctgccggggagttagaaggcggaaaacctctgtccggcctgttgaacgcgctggcgcaggatacgttccacggataccctggtataacagaggaattactgagatcacagctctacccagaagtcccccccgaggaatttcggcccttcttagctaagatgcgggggatcttgaaatccatagcaagcgctgatatggacttcaatcagctcgaggcatttctgaccgctcagacgaaaaaacagggcgggatcaccagcgaccaggccgccgttataagcaagttctggaaaagtcacaaaaccaagattagggagtcactgatgaaccagtcaaggtggaatagcggtctacgtggattgtcttggcgtgtagatggcaagtcccagagtagacactcagctcagatccacactcccgtagcgataatcgagctggagttgggcaagtatggccaagagtccgaattcttgtgccttgagttcgatgaagtgaaagtcaaccaaatcttgaagacactgagcgaggtcgaggagtctatctcgactctgatttcccaacctaac

SEQ ID NO: 10110 - DNA, 570 bp, Artificial Sequence
  Description of Artificial Sequence: Synthetic coding sequence
atggcggctggggagttggagggcggtaagccactctccggcctgctgaacgctctggcccaggataccttccacggatacccgggcatcaccgaagagctgctgcgcagccagctgtaccccgaagtgcctcctgaggaattccggccgtttctggcgaagatgcgcggcattctgaagagcatcgcgagcgccgacatggacttcaaccaactggaagcgtttcttactgcgcagaccaaaaagcagggtggaattactagcgaccaggccgcagtgatcagcaagttctggaagtcccataaaaccaagatcagggagagccttatgaatcagagccgatggaacagcggactgcggggactgtcatggagggtcgatggaaagtcgcagagcagacactctgcccagatccatacccctgtggccatcattgaactcgagctcggtaaatacggacaagaatcggagttcctgtgcctggagtttgacgaggtgaaggtgaaccaaatactcaagacgctgtccgaggtggaagaatccatttccacgctgatctcacagcctaat

SEQ ID NO: 10111 - DNA, 570 bp, Artificial Sequence
  Description of Artificial Sequence: Synthetic coding sequence
atggccgcaggggagttggaaggagggaaacccctcagcgggctgctgaatgctttggcccaggatacctttcacgggtatccaggcatcactgaagagcttcttagaagccaactgtatccagaggtgcctcctgaagagtttaggccctttctggcgaaaatgcgcgggatcctgaaaagtattgcatctgctgatatggacttcaaccagctcgaggcattccttaccgcccagacgaagaagcagggcggcatcactagtgatcaggctgctgtcatcagcaagttttggaagagccataagacgaagattagagagtccctgatgaatcaatcaagatggaacagcggcctgaggggcctgtcctggagagtcgacggaaagagccaaagtcggcattctgcccagatccacacaccagttgctatcattgagctcgagttgggcaagtatggtcaggagagcgagtttctctgtcttgagtttgacgaggtgaaggtgaaccagattttgaagactttgtctgaagtggaagagtccatttctacactgatttcacagccgaac

SEQ ID NO: 10112 - DNA, 570 bp, Artificial Sequence
  Description of Artificial Sequence: Synthetic coding sequence
atggctgccggagagctagaaggagggaaacccctgagtggcctgttgaacgctctcgcccaggacactttccacggttatccgggaataacagaagagctgttgagaagccagttgtacccggaggtgcctcctgaagaatttcgacctttcctcgccaaaatgcggggcatacttaagtcaatcgcgtctgcggatatggacttcaaccagttagaagctttcctgaccgcgcaaacaaaaaagcagggcggtatcacatccgatcaagccgctgtaatctcgaagttttggaagagccataaaaccaagattcgcgagtccttaatgaatcagtcccggtggaactcaggcctccgcggtctttcctggagagttgacggcaagtcacagtcaagacactcagcacagatccacacccccgtggccatcattgagcttgagctgggcaagtacggccaggagagcgagttcctatgtctcgaattcgacgaagtgaaggtgaatcaaatcctgaagacactgagcgaagtggaggagagcatttctactctcatttcccaaccaaat

SEQ ID NO: 10113 - DNA, 570 bp, Artificial Sequence
  Description of Artificial Sequence: Synthetic coding sequence
atggcagctggtgagcttgaggggggaaagcccctgtccgggcttcttaacgctttggcccaagatacttttcatggatacccaggaataactgaagagctccttaggtcgcaactttacccggaagtccccccagaggaatttaggccatttcttgcaaagatgagaggtattcttaaatcaattgccagcgccgacatggatttcaaccagcttgaagcattccttactgcacaaaccaagaaacagggaggtataacttcggatcaagcagccgtgattagcaagttttggaagtcacataaaaccaagatccgtgaatcactgatgaatcaatccagatggaatagcggtctgagaggactgtcctggcgcgtggatgggaagtctcaatcgcgtcactcagctcagatccatactccagtcgcaatcattgaacttgagctgggaaagtacggtcaggaatcggagttcctgtgccttgaatttgacgaggtgaaggtgaaccaaattctgaaaactctgtcggaggtggaagaatccatttcaaccctgatttcccagccaaac

SEQ ID NO: 10114 - DNA, 570 bp, Artificial Sequence
  Description of Artificial Sequence: Synthetic coding sequence
atggcggccggggagctggaaggggggaagccactgtcgggactactgaacgctttggcccaagatacctttcatggatatccagggattacagaggaactgctcagatcgcagctctacccggaggtccctcctgaagaatttcgcccatttttagcgaagatgaggggcattttaaaaagtattgcgagtgcagatatggattttaaccagctggaagcattccttacagcgcagacaaagaaacaaggaggaatcacttcagaccaagctgctgtcatctcaaaattttggaaatctcataagacgaaaatccgtgagtcattaatgaaccagtcccgatggaatagcggacttagaggcttgtcatggagagttgacggtaaatcccagagtaggcacagcgcacaaatccatacgccagtcgccatcatcgaactggaactgggaaaatacggacaagagtcggagttcctgtgcctggagtttgacgaggtcaaggtgaaccaaatcctcaagacccttagtgaagtcgaagaaagcatatctacgctgatttcgcagcccaac

SEQ ID NO: 10115 - DNA, 570 bp, Artificial Sequence
  Description of Artificial Sequence: Synthetic coding sequence
atggcagcaggcgagcttgaaggcggaaaaccactgtccggcctcttgaacgcactggcacaagatacgtttcatggttaccccggtatcactgaagaacttctgagaagccaattgtacccggaggtgccccccgaggagtttcggccatttcttgccaagatgcgaggaattttgaagagtatcgcctccgcggacatggatttcaaccaactggaggcgttccttaccgcacagaccaagaagcaagggggtatcacgagcgaccaagcggcagtcatttccaagttctggaaaagccacaaaaccaagattagggaaagccttatgaatcagtcccgttggaactcaggacttagaggactgtcgtggagagtggatggcaagagccagtcccgccacagcgcacagattcatactccggtggctattatcgagcttgaactcggcaaatacggccaagaatcggagttcctctgtcttgagtttgacgaagttaaagtcaatcaaatcctcaagaccctcagcgaggtggaagaatcaatatctactctcatttcacagcctaac

SEQ ID NO: 10116 - DNA, 570 bp, Artificial Sequence
  Description of Artificial Sequence: Synthetic coding sequence
atggccgcgggcgagttggagggtggtaagcctctcagtgggctcctgaacgcgctcgcgcaggacactttccacggatacccgggaatcactgaggaattgctccgtagtcagctttaccccgaagtcccacctgaggagttccgtccattcctggctaagatgagaggaatcctgaagtcgatcgcttccgccgacatggatttcaatcaacttgaggcatttctgacggcacagactaagaagcagggaggaatcaccagcgaccaagccgcagtgatctcgaagttctggaagtcgcataaaaccaagatccgcgaatcgctgatgaaccagtcacgctggaatagcggactgcggggattgtcctggcgcgtggacgggaaatcacaatcgcgacattctgcccagattcacacgccggtggccatcattgaactggaactgggcaaatacggacaagaatcagagttcttgtgcctggagtttgatgaagttaaggtcaaccaaatcctcaagaccctcagcgaagtggaagaaagcatcagcaccctcatctctcagccgaac

SEQ ID NO: 10117 - DNA, 570 bp, Artificial Sequence
  Description of Artificial Sequence: Synthetic coding sequence
atggcagcgggggagttggagggtgggaaaccccttagcggtctgttaaatgccctggcccaggatacgtttcatggatacccgggcattaccgaggagttattgcgcagccagttgtatcctgaagtaccacctgaggagttcaggcccttccttgccaagatgagaggcatcctgaagtccatcgctagcgccgacatggacttcaaccagttggaagctttcttgactgcccagacaaaaaaacagggtggtattacttctgatcaggcagcagttatcagtaagttctggaaatcacataaaacaaagatacgcgagagtctgatgaaccaaagtagatggaatagcgggctgcgcggattgtcatggagggtcgacggcaagtcgcagtcacgccatagcgctcagatccacacacctgtggccataattgaacttgagttggggaagtacggccaggagtctgaattcctctgcctggaattcgacgaagtaaaagtgaatcagattctcaaaactttgtctgaggttgaggaatccatttctacgctcatttcacagcccaac

SEQ ID NO: 10118 - DNA, 570 bp, Artificial Sequence
  Description of Artificial Sequence: Synthetic coding sequence
atggcggcgggggagctggagggaggcaagccgcttagcgggctcttgaacgccctggcgcaggataccttccatggatacccgggaatcactgaggagctgctgagatcacagctctacccagaggtgccacccgaggaatttcgcccgttcctcgcgaagatgcggggaatccttaaatccatcgctagcgccgatatggatttcaaccaactcgaggcattccttaccgcgcaaactaagaagcaaggcggaatcacttcagaccaggccgccgtgatctcgaaattctggaagtcgcacaagaccaagatccgggagtcgctgatgaaccaatcccgctggaatagcggactccgcggactgtcttggcgcgtcgacgggaaatcccagtctcggcacagcgcacaaatccatactcccgtcgcgatcatcgaactcgaactcggcaagtacggacaagagtcggagtttctctgtttggagttcgatgaagtgaaggtgaaccaaatcctgaaaacccttagcgaagtggaggagtcgatctccaccctgatctcccagcctaat

SEQ ID NO: 10119 - DNA, 570 bp, Artificial Sequence
  Description of Artificial Sequence: Synthetic coding sequence
atggcagcaggcgaacttgagggaggcaaaccgctttcaggactgttgaatgcactggcacaggacaccttccacggataccccggtattaccgaagaactgttgcgaagccaactgtacccggaagtgcctccagaagaatttcgcccttttcttgctaaaatgaggggaatactgaagtcaatagcaagcgcagacatggactttaaccagctcgaagcatttctcactgctcagactaaaaagcaaggcggcattacttcggatcaggcagcagtcatttccaaattctggaaatcacataagaccaagatacgggagagcctcatgaatcagtcccgctggaattcggggctccgcggtctgtcatggagggtggacgggaagtcgcagtcgcgccatagcgcgcaaattcatacgccagtggcgattattgaacttgaactcggtaaatacggacaagagtcggaatttctctgcctggagtttgatgaggtcaaggtcaatcagatccttaagacgctgagcgaagtggaggagagcatctccactttgatttcgcaacctaac

SEQ ID NO: 10120 - DNA, 570 bp, Artificial Sequence
  Description of Artificial Sequence: Synthetic coding sequence
atggcagcaggcgagctcgaggggggtaaacctctgtccgggcttctgaacgcactggcacaagatacctttcacggataccctggaatcaccgaagaactgcttcgatcgcagctttaccccgaggtgccccccgaagaattccggcctttccttgcaaagatgcgaggtatcctcaagtccatcgcaagcgcagacatggatttcaatcagctggaggcttttcttaccgcccagaccaagaagcagggaggaattacctcagatcaagcagcagtcatttcgaagttttggaagagccataagaccaaaatccgcgaatctctgatgaaccagagtaggtggaattcaggcctgagaggcctttcgtggagggtcgatggaaagtcccaaagtagacattcagcacaaattcacacgccagtggcgataatagaactcgagcttggcaagtacggacaggagtcggagttcctgtgcctcgaattcgacgaagtgaaagtgaaccaaattctcaagactctgtcagaagtcgaggagtccatctccactttgatttcccaacctaac

SEQ ID NO: 10121 - DNA, 570 bp, Artificial Sequence
  Description of Artificial Sequence: Synthetic coding sequence
atggcagcaggcgagcttgagggaggcaagccactcagtggcctcctaaacgctctggctcaagatacctttcacggctaccctggcataacagaagagctcctgcgatcccagctgtacccagaggtgccccccgaagagttcagaccattccttgcgaaaatgcgggggatcctgaaaagcattgcatccgctgacatggatttcaaccaactggaggcgttcctgaccgcacaaacaaagaaacagggaggtatcaccagcgaccaagctgcagtcatttcgaaattttggaaatcccataagacgaaaataagagaaagtctcatgaatcagagtagatggaatagcggtctgcggggcctaagttggcgagtggatggaaagtctcaaagccgccacagtgctcagatccacacaccagttgccatcatagagttggagctaggcaagtacggccaggaaagcgagtttctttgccttgaattcgacgaagtcaaggtaaaccagattctaaaaaccctgagcgaagtggaagagagcatttccacgcttatttcccaacctaac

SEQ ID NO: 10122 - DNA, 570 bp, Artificial Sequence
  Description of Artificial Sequence: Synthetic coding sequence
atggctgctggggagcttgagggcggcaaaccactgagcggtctgctcaatgctttggctcaggatacctttcatggataccctggaatcacagaggagctattacgctcccagttgtatcccgaagtgccccctgaggagttccggccttttctggctaagatgcgcgggatcttaaaatccatcgccagcgcagatatggattttaaccaactcgaggccttcctgaccgcccagactaagaaacagggcgggattacctctgaccaggccgcggtcatctcaaaattctggaagtcgcataaaactaaaattagggaaagtctaatgaatcagtcccggtggaattctggactgaggggactgtcctggagggttgacggaaagtcccaaagtagacactctgcccagattcatacccctgtcgccattatcgagctcgaactgggcaagtatggccaggagagtgagttcctgtgtctggaattcgacgaggtaaaggtcaaccagattctgaagactttgtctgaagttgaagaaagtattagtacattaatctcgcagcccaat

SEQ ID NO: 10123 - DNA, 570 bp, Artificial Sequence
  Description of Artificial Sequence: Synthetic coding sequence
atggctgctggggagctggagggaggcaagccactatctggcctccttaacgcacttgcacaggacacgttccacggttatccaggtatcactgaggagctactccgaagccagttgtatcctgaggttcctccagaagagtttcgtccatttctagctaagatgcgggggatcctaaagagcattgccagtgccgatatggacttcaaccagctcgaggcattcttgaccgcccagacaaagaagcaaggcggtatcacttccgaccaagccgccgtgattagtaagttttggaagagtcataaaactaagatccgtgagtcactcatgaatcaatcgcgttggaacagcggactgcgtggattgagttggcgggtcgatggcaagtcacaatcacggcatagcgcacagattcatacccctgtcgcgataattgagctcgaactgggcaagtatggccaggagtctgagttcctctgccttgaattcgatgaagtcaaagtaaatcaaattctgaaaacgcttagcgaagttgaggagtcgatcagcacgctcatctcccaaccgaac

SEQ ID NO: 10124 - DNA, 570 bp, Artificial Sequence
  Description of Artificial Sequence: Synthetic coding sequence
atggccgcgggagaactggaaggcggaaaaccactgtcaggactcttgaacgccctggcccaagacacttttcatggctacccaggtataaccgaggagctgctccgctcccaactgtaccctgaagtcccgcctgaagagttcagacccttcctcgccaagatgcgcggaatcctgaagtcaatcgcatctgcggacatggacttcaaccagctggaagcgttcctgacggcccagaccaagaaacaggggggtatcacctcggaccaggctgccgtcatttcgaagttttggaagagccacaagacgaagattcgtgaaagcctgatgaatcaatcccggtggaactcgggccttcggggcctgtcctggagggtggatggaaagagtcagtcgcgccattcggctcagatccacactccggtggcaataatcgaactcgaattgggaaagtacgggcaggagtccgaattcctttgccttgagttcgatgaggtgaaggtgaatcagattctgaaaaccctttccgaggtggaggaatcgatctcgactcttatcagtcaaccgaac

SEQ ID NO: 10125 - DNA, 570 bp, Artificial Sequence
  Description of Artificial Sequence: Synthetic coding sequence
atggcagcaggtgaattggagggcgggaagccactttcgggactgcttaacgcgctggctcaggatactttccatgggtaccccggaattacggaagagttgctgagatctcaactgtaccctgaggtcccacctgaagaatttcgacccttcttggccaaaatgcggggtattctcaagtcaatcgcgagcgcagatatggactttaatcaactggaagcatttcttactgcacagacgaagaaacaaggtggaattacttcagaccaagcagccgtgattagcaaattctggaaaagccacaaaaccaagattagagagtcactgatgaaccagtcacggtggaactcgggacttcgagggttgtcttggcgggtggatgggaaatcgcagtcgagacactcggctcagatccatacgcctgtggccattatcgaacttgaacttggaaagtacggacaagaaagcgaatttctgtgtctggaatttgatgaagtcaaggttaaccaaatactcaagaccctctccgaggtggaagagtcaataagcactctgatcagccagccgaat

SEQ ID NO: 10126 - DNA, 570 bp, Artificial Sequence
  Description of Artificial Sequence: Synthetic coding sequence
atggccgctggggagcttgagggtggaaagccactgtccggtcttctgaacgcgctggcccaagacacgtttcatggctaccctggcattacggaggagctgctgagaagccagctctaccccgaagtgccccctgaggaattccgtcccttcctcgcgaagatgagggggatcctgaaaagcatagcttcagctgacatggattttaaccagttagaggccttcttaacagcccagaccaaaaagcagggcggaatcacaagtgaccaggccgccgttatctcgaaattctggaaatcacacaaaacgaaaatccgagagtctctaatgaatcagtcacggtggaactcgggacttagaggattgagctggcgtgtggatgggaagagtcaatctaggcactccgcacagatccataccccagtggctatcattgagttggaactaggcaagtacgggcaggagtctgaattcctgtgtcttgaattcgatgaggtaaaggtaaaccagatcctcaagaccctgtctgaggtcgaggaaagcatctccacactgatctcacagcctaac

SEQ ID NO: 10127 - DNA, 570 bp, Artificial Sequence
  Description of Artificial Sequence: Synthetic coding sequence
atggcggctggtgagctagagggtggcaagccacttagcggcctactgaacgcactggcacaggacaccttccacgggtaccccggcatcaccgaagaactcttgcggtcacaactgtaccccgaggtgcctcctgaggaattccgtccattcttagcaaagatgcgcggaatcctaaagagcattgctagcgctgatatggacttcaaccagttggaggctttcctgaccgcacagactaagaagcaaggcgggatcacttcagatcaggccgccgtaattagcaagttctggaagtcacacaagactaagatacgtgagtccctgatgaaccagagtcggtggaattctggccttcgtggtctttcctggagggtggacggaaaaagtcaaagtcgtcattcagctcagattcacactcctgtggcaatcattgaactcgaactgggaaagtacgggcaggaatcggaatttctgtgcttggaatttgatgaggtgaaggtgaatcagattctgaagaccctgtctgaggtggaggagagtatcagcactctgatatctcagcccaat

SEQ ID NO: 10128 - DNA, 570 bp, Artificial Sequence
  Description of Artificial Sequence: Synthetic coding sequence
atggccgccggggagctggagggcggaaaacccctgtcgggtttattgaatgcactggcacaggacacttttcatggctacccaggcatcacagaggagcttctgagatcacaactgtaccccgaagtgccccccgaagagttccgcccatttctggctaaaatgaggggaatccttaagagtatcgccagcgcggatatggatttcaatcaactggaggccttccttaccgcccaaaccaaaaaacaggggggaatcacctcagaccaggccgccgtgatttctaagttttggaaaagccacaagaccaaaatcagagaatcactgatgaaccaatcccgctggaattcagggttgcgagggctgtcttggcgggtggatggtaaatcgcagagcaggcactcagctcagatccacactcctgtggctattatagaacttgaactgggtaagtatggccaggaaagcgaatttctatgcctagaatttgacgaggtcaaggtgaaccagattctaaagactctttctgaggtggaagaatccatcagtactctgattagccaacccaat

SEQ ID NO: 10129 - DNA, 570 bp, Artificial Sequence
  Description of Artificial Sequence: Synthetic coding sequence
atggcggcgggagagctcgaagggggtaagcctctgtctggattgctgaacgcgctggcccaggacaccttccatggatacccggggatcaccgaagagctcctcagatcgcaactgtaccccgaggttccaccagaagagttccgcccgtttctcgcaaagatgcgcggaatcctcaaatccatcgcttcggccgacatggatttcaaccagctcgaagccttcctgaccgcgcaaaccaaaaaacagggcgggattacgtccgaccaagccgccgtgatttccaagttctggaagtcccacaagaccaagatcagagaatcactcatgaaccaatcacgatggaactcgggtctgcggggcctgtcctggcgggttgacggaaagtcccagtcgcgccattcagcgcagatccacacccctgtcgcaattatcgaactcgaactgggcaagtacggacaggaaagcgagttcctctgtcttgagttcgacgaggtgaaggtcaatcaaattctgaaaaccctctccgaggtcgaagagtccatttcgactctgatctcgcaaccaaat

SEQ ID NO: 10130 - DNA, 4440 bp, Artificial Sequence
  Description of Artificial Sequence: Synthetic coding sequence
atgcaaagatcccctttggagaaagcatcagtcgtaagcaagctcttcttttcctggactcggcccatcctgagaaagggctaccggcaacgtctagagctgagcgacatatatcagatcccttccgtggattctgcagacaacctctcggagaagcttgaaagagaatgggaccgggagttagcgtccaaaaaaaaccctaaattgattaacgccctccgcaggtgtttcttttggaggttcatgttttacggaatcttcctgtacctgggtgaggtgactaaagcagttcagcctttgctgctcggacgaattatcgctagttacgacccggataataaggaagagcggtctatcgctatttatttaggcatcgggctgtgcttgctgttcatagtgcggacattgctcctgcacccagccatcttcgggttgcaccacatcggaatgcagatgcgcatcgccatgttctcactaatctacaagaaaacactaaaactctcttctcgagtcctcgacaagataagcatagggcagctggttagcttactgagtaacaatctcaataagttcgatgagggattggccttggcccacttcgtttggatcgcccccctgcaagtggccctgctgatgggtctgatttgggagctcctccaggccagcgccttctgcgggctcgggtttctaatcgtgctggcactgtttcaggccggtttgggccgtatgatgatgaaatatcgagaccagcgagctgggaagatctcggagcgattggtcattactagcgaaatgatcgagaacattcagtcagtcaaagcctattgctgggaagaagccatggagaagatgatcgaaaacctacgacagacggagcttaagctcacacgaaaagctgcctacgtgcgttatttcaactcttccgctttctttttctccgggttcttcgtagtcttcctgtccgtgctaccttatgctttaataaagggaataatcctacgaaagatttttactacgataagcttctgtatcgtgctccggatggccgtcaccaggcagttcccctgggccgtgcaaacctggtatgactctctgggtgctataaacaagattcaggacttcctgcaaaagcaggagtataaaaccctcgaatataatttgaccaccaccgaagtggtgatggaaaacgtcacggccttctgggaagagggcttcggagagctgtttgaaaaggctaagcaaaataacaataatcggaaaaccagcaacggcgatgattctctatttttctccaatttctctctgctggggactccggtccttaaagacatcaatttcaagatagagaggggccagctgctggccgtggccggaagcaccggggcaggaaagacaagcttgctcatggtcatcatgggggaattagagccgtctgagggcaagatcaaacatagtggacggatctctttctgttcacagttctcttggatcatgcctggcaccataaaggaaaatattatctttggagtttcatatgacgagtatagatacaggagcgttatcaaagcatgtcagctggaggaggatatctccaagttcgcggagaaggacaatatcgtgttgggcgagggggggataacattgtcaggtggccagcgggctcggatcagcctggctcgggctgtgtataaagatgccgacttgtatctactagactccccctttggctatcttgacgtgctgactgagaaggaaatatttgaaagttgcgtttgtaagctgatggcaaataagacaagaatcctggtcacaagtaagatggaacatctgaagaaagccgacaagatcttgatacttcacgagggaagttcatacttttacggaacattttctgagctccagaacttgcaaccggacttctcctctaaattaatgggctgtgactcttttgaccagttttcagcggaacgacggaatagcattctgactgaaactctccacaggttcagtcttgaaggagacgctcccgtttcctggacagagacgaaaaaacagtcattcaagcaaactggagagttcggcgagaaaagaaagaactccattctgaatccaatcaatagcataagaaaattcagcatcgtgcagaaaaccccgctgcagatgaatggaattgaggaagactccgatgagccactcgagcgccgtctgtcactggtgcctgatagtgaacaaggcgaggccattcttccgagaatctccgttatttcaactggaccgaccctgcaggcacgcaggcggcagtccgtgttgaacctaatgacacactctgtaaatcagggccagaatatccaccgaaaaactacagcatcgacacgaaaggtgtccctagctccccaggcaaatctcacagagcttgatatctatagcaggcggctgagccaggagacaggcttggagatcagtgaggagatcaacgaggaagatttaaaagaatgttttttcgatgatatggaaagcataccagccgttaccacatggaatacatacctgagatacataaccgtacataaatcattaattttcgtgctaatatggtgtctggtgatattccttgctgaagtcgctgcctctttggtggtcctatggctcctgggcaacacccccctgcaagataaggggaatagcacccacagccgcaacaactcctatgcagtgatcatcacttccacctcatcctactatgtgttttatatctacgtgggtgtcgcagacactttgctcgcaatggggttctttcgggggctcccactagtgcataccctgattaccgtcagtaaaattctgcaccacaagatgctccactcagtactgcaggctccaatgagcactctgaatacactcaaagccggcggcatcctgaatcggttctcgaaggacatcgctatcctggatgacctcctgcccctgactatcttcgacttcatacaactgttgctcattgtcattggcgccatagccgtggtggccgtcctacaaccctacatatttgttgccactgtacctgtgattgtcgcttttatcatgctaagagcatattttctccaaacatcacagcagctgaagcagctcgagagtgaagggagatcgcctatttttacccaccttgtgacttctctgaaagggttgtggaccctacgcgctttcggccgtcagccctactttgagacactgttccataaagcccttaatttgcacacagcaaattggtttttgtatctgtcaacattgagatggttccaaatgcgcatagagatgatttttgtcatcttctttattgctgttacttttatctcgatcctgacaaccggagagggtgaagggcgtgttggcatcattctgaccctggctatgaatattatgtcaacacttcagtgggccgtgaactccagcatcgacgtagatagtctaatgcgatccgtgagcagagtatttaagttcatcgatatgccaactgagggtaaacccaccaaatccacaaaaccctataaaaacggacagctcagcaaggtgatgatcattgagaattcccatgtgaaaaaggacgacatctggccgtcaggtggtcagatgacagtcaaggaccttacagccaaatacaccgagggcggcaacgctattctggagaacatttcgttttccatctcacccggccagagggtggggctacttggtcgcaccgggtctggaaagagcacgctgctctccgccttcttacgcctattaaatacggagggtgaaatacagatagatggggtaagctgggacagcattactctgcagcaatggaggaaggcgttcggggtgatcccacagaaagtttttatattcagtggtacctttaggaagaacttggatccctatgagcagtggtcagaccaggagatctggaaggtggccgacgaggttggactgagaagcgtcattgagcagttccctggcaagctagattttgtgctggtggacggaggctgcgtgctcagtcacggccacaaacaactcatgtgtctggcaaggtccgtgctttctaaagccaaaatactcctattggacgagcctagcgcacacctagaccccgtaacttaccagattataagacggactctcaagcaggcttttgcagactgcacagtgattctctgcgagcaccggattgaggcaatgctggaatgtcagcagtttttggttattgaggaaaacaaggtgcgtcaatacgatagcattcagaagctgttgaatgaacgaagcctcttccggcaagcgatctcaccctctgatcgcgttaagttgttcccacaccgcaattcctctaagtgcaagtccaagccccagatagctgccttgaaagaagaaactgaggaagaggttcaggacactaggctt

SEQ ID NO: 10131 - DNA, 4440 bp, Artificial Sequence
  Description of Artificial Sequence: Synthetic coding sequence
atgcagcgctcgccgctggagaaggcttcggtcgtgtcgaagctgtttttctcctggacccggcctatccttcgcaaggggtaccggcaaagactggagctcagcgacatctaccagatccctagcgtggattcagctgataacctgtcggagaaattggaacgcgagtgggatcgcgagctggcatccaagaaaaacccaaagctcatcaatgcgctccggcgctgctttttctggcgcttcatgttctacggaatcttcttgtacttgggagaggtcaccaaggccgtccaaccgctgctgctcggaagaatcattgcaagttatgacccagacaacaaggaagagcgtagcatcgccatttacctcggtataggactctgcctcctcttcatcgtgaggactctcctgctgcaccccgcaatctttggtttgcaccatatcggtatgcagatgagaatcgccatgttttcgttgatctacaaaaagactctgaaactctcaagccgtgtgctcgataagatctccatcggacagctggtgtccctgctgagcaacaatttgaacaagttcgacgagggcctggccctggcccacttcgtctggattgcccccctccaagtcgctctgctgatggggctcatctgggaattgttgcaggctagcgctttctgcggtcttggcttcctgatcgtcttggcgctgtttcaggcaggactcggccgcatgatgatgaagtaccgggatcaacgtgctggaaagatctcggaacggcttgtgataactagcgaaatgattgagaatattcaatcggtgaaggcctactgctgggaagaagccatggaaaagatgattgaaaacctgagacagacggagctgaagctgacgcgcaaagccgcatacgttcgctacttcaacagctcggcatttttcttctccggattctttgtggtgttcctgtccgtcctgccatacgcgctcatcaaagggatcatcctgagaaagattttcaccactatcagcttctgcatcgtcctgcgcatggctgtcactagacagttcccgtgggcggtgcagacctggtacgactcgctcggcgcgattaacaaaattcaagactttcttcagaagcaggaatacaagaccctggaatacaatctcaccactaccgaggtggtgatggagaatgtgactgcgttctgggaggaaggattcggcgaattgtttgagaaggccaagcagaataacaacaataggaaaacgagcaacggtgatgatagcctgttcttctctaacttttcgctgttgggcactccggtgcttaaggatatcaatttcaagatcgaacggggacagctcctcgcagtggctggcagcaccggagcgggaaagacctcccttctcatggtgatcatgggagaattggaaccgtcagagggcaagataaagcacagcggaagaatctcgttctgttctcaattcagctggatcatgccagggactatcaaggaaaacatcatctttggagtgtcctacgacgagtacaggtaccggtctgtcatcaaagcctgtcagctggaagaggacatctccaagtttgcggagaaagacaacatcgtgctgggagaaggcggcattaccttgagcggtggacagcgagcaaggatctccctcgccagagccgtgtacaaagatgcagatctgtatctgttggactccccgttcggatatctcgatgtcctgaccgaaaaagaaatctttgagtcgtgtgtctgcaagctgatggcgaacaagacccgtatccttgtcacgtccaaaatggaacacctcaaaaaggcggacaagatcttgatcctgcacgaaggctcctcctacttctacgggaccttctcggaactgcagaatctccagcctgatttctcctcaaagctgatgggatgcgattctttcgaccagttcagcgccgagcgcagaaactccatcctcactgaaaccttgcatcgcttttcactggaaggagacgcgccggtgtcatggactgaaactaagaaacaatcctttaagcagactggagagttcggcgagaagcggaagaacagcattctgaatccgataaactccattaggaagttctcaatcgtccaaaaaacgccactgcagatgaacggaatcgaagaggattcggacgagcctttggaacggcggctgagccttgttccagattcggaacagggcgaggccattctcccaagaataagcgtcatcagcaccggtcctactctgcaagccagaagaaggcaatcggtcctcaatttgatgacccattccgtcaatcagggacaaaacatccaccggaaaaccaccgccagcacccgcaaggtttcgctggcgccgcaggccaatcttaccgagcttgacatctactcgcgccggctgagccaggagacggggctggagattagcgaggaaatcaacgaggaggacctgaaggagtgcttctttgatgacatggaaagcatcccagcggtcaccacttggaacacgtaccttcggtatatcaccgtgcataagtctttgatcttcgttctgatctggtgtctcgtcatcttcctggccgaagtggccgccagcctcgtggtgctgtggctgctgggtaacactcccctccaagacaagggcaactccactcactcgcgcaacaactcgtacgcggtgattatcacctccacttcttcatactatgttttctacatctacgtaggagtggccgacactctgttggcgatgggatttttccgcgggctcccgctcgttcataccctgatcaccgtctccaagatactgcatcataagatgctgcactccgtgctgcaggccccaatgtccacgctgaatacgttgaaagccggaggaatcctgaatagattctcgaaggacatcgcgatcctggacgacctgttgccactcacgatctttgacttcatccagctcctgctgatcgtgatcggagcaatcgcggtcgtcgcggtgctgcagccgtacatcttcgtcgcaactgtccccgtgattgttgccttcatcatgctgcgggcgtacttccttcaaacgtctcagcagctgaagcagctggagtcagaaggccgttcgcctatctttacccacctggtgacttcactgaagggactgtggactctgcgcgccttcggccgccaaccatactttgaaactctgttccataaggcgctgaatctgcatacggcaaactggttcctgtacctgagcaccctgaggtggtttcaaatgagaattgaaatgatcttcgtgatcttcttcatcgctgtgacctttatctcgatcctcactacgggagaaggggaagggagagtgggaatcatccttacccttgccatgaacatcatgtccaccctgcaatgggccgtcaactcctccatcgacgtggactcactgatgcggagtgtgtcacgcgtgttcaagttcattgacatgccgactgagggcaaaccgaccaagtccactaagccttacaagaatggacaactcagcaaagtgatgatcatcgaaaatagccacgtgaagaaagatgacatctggccaagcgggggacagatgactgtgaaagacttgacggcaaaatacaccgaagggggcaacgcaatcctggaaaacattagcttctcaatttcaccgggacagagagttgggttgctcgggcggaccggttcgggcaagtcaaccctcctttcagcattccttcgcctgcttaacactgaaggtgaaatccaaatcgatggtgtgagctgggatagcattactctgcagcagtggcgtaaggcgtttggcgtgatccctcagaaggtgttcattttcagcggaacttttaggaagaatctggatccgtacgagcagtggtcggatcaggaaatctggaaggtggcggacgaagtgggattgcggtcggtgatcgaacagtttccggggaagttggattttgtgctggtcgacggcggctgcgtgttgtcgcacggacacaaacaactcatgtgcttggcgcggagtgtcctgtcgaaggctaaaatccttctgctggatgagccctccgcacacctcgacccggtgacctaccagatcatcaggcgcaccctgaagcaggctttcgctgattgtacggtgatcctctgcgaacatcggattgaggccatgctggaatgccaacaattccttgtcatcgaagagaataaggtgcggcagtacgattcaatccaaaaactccttaacgagcggtccctctttcgccaggctatcagtccgtccgaccgggtgaaacttttcccgcaccgcaactcgtcgaaatgcaaatcgaaaccccagattgccgcactgaaagaggaaaccgaggaagaggtgcaagacacgcgcctg

SEQ ID NO: 10132 - DNA, 4440 bp, Artificial Sequence
  Description of Artificial Sequence: Synthetic coding sequence
atgcaaaggtctcctctggagaaggccagcgtcgtctcaaaattgttcttctcatggacccgccccatcctgcggaagggatatcgacagaggctggagctcagcgacatctaccaaataccgtcggtggatagcgcggataacttgagtgaaaaactggagcgcgagtgggacagagagctggcgtctaagaagaaccctaagctgatcaacgccctccgccgatgcttcttctggcgattcatgttttacggcattttcctgtacctgggggaagtgactaaagcagtgcagcccctcttgctgggacgcattatcgcctcgtatgaccccgacaacaaagaggagaggagtatcgctatatacctcggcatcggactttgtctgctctttatcgtgcggactctcctcttacaccccgcaatttttggactgcaccatatcggaatgcagatgagaattgccatgttcagcttaatttataagaagactctaaagctatcttctcgcgtgctggataaaattagcatcgggcagctggtgtccttgctgagcaataatctgaacaagttcgacgagggtctggctctggctcattttgtttggattgcccccttgcaggtcgctctactcatgggccttatttgggagctgctgcaggcctcagccttttgtggcctgggatttttgatcgtgcttgcgctgttccaggccggactggggcggatgatgatgaagtacagggatcagcgcgctgggaaaatctccgaaagactggtgatcactagtgagatgattgaaaacatccaatcagtgaaggcttactgttgggaagaggccatggaaaagatgatcgagaatctacggcagactgaactgaagctgacgcgcaaggccgcgtacgtgcggtattttaactcctccgcattcttcttctccgggttcttcgtcgtgtttctttccgtgctgccgtacgccctcatcaaaggaataattctgcgaaagatcttcaccacaatcagcttctgcatagtgcttcggatggctgtaactcgtcagttcccctgggctgtgcaaacctggtatgactccttaggtgcaatcaataaaatccaggatttcctgcagaaacaggagtacaagaccctggagtataaccttactacgactgaggtggtgatggaaaacgtgaccgcgttttgggaggagggatttggggagttgttcgaaaaggcaaaacagaacaacaataaccgaaaaacatctaacggagatgattccttgtttttctctaactttagtctgctggggactcctgtgctgaaggacattaacttcaagatagaacgcggacaattactggccgtggcgggttccaccggtgcaggaaagacctctctcctcatggttattatgggggagctggagcctagtgagggcaagatcaaacatagcggccggatctccttctgcagtcagtttagctggataatgcccgggaccattaaggagaatatcatattcggtgtgtcttacgacgaataccgctacagatctgtgattaaagcgtgccagctggaagaagacatttcaaagttcgcggagaaagacaacatcgtactgggagaagggggtatcactttgtcaggcggtcaaagggcgcgcatcagtctggccagggcagtttacaaagatgccgatctgtacctcctggatagtccattcggatacctcgacgtcctcacagaaaaggaaatctttgagagctgtgtctgtaagttgatggcgaataagacccgtatcctcgtgacctctaaaatggagcatctgaagaaggcagacaaaatcctgatcctgcacgaggggtccagctatttctacggaacttttagcgagcttcaaaacctccagcctgacttttcctccaaactgatgggatgcgactcttttgatcaattctcagcagagcggagaaactccattctgacagaaacccttcaccgcttctccttggaaggcgatgcgcccgttagctggacagaaacaaagaagcagagcttcaagcagactggagaatttggcgagaagcggaaaaactcgattctgaatcccatcaacagcatacggaagttctcaattgtccaaaagacaccgctccaaatgaatggtatcgaggaggatagtgacgaacctctggaacgacgactctctttggtgcctgattcagagcagggcgaggcaatcctgccaagaatttcggtgataagcaccggtcccacactgcaggctagaagaagacagtccgtcctgaatctcatgacccactcagtgaaccaggggcagaatatccaccgcaagactacggcatccacccggaaggtgagcttggcgccgcaggccaacctgacagagttggacatttacagtaggcggctctctcaggagacagggctagagatttcagaggagataaacgaagaagacctaaaggagtgcttcttcgacgatatggaaagtatccccgcagtcactacatggaatacttacctccggtatattactgtacataagagcctcatctttgtgttgatctggtgcctggtgatctttctggctgaggtggccgcctccctggtggtgctgtggcttctgggcaatacgccactgcaagataagggcaactctactcatagtcgcaataatagctatgccgtgatcattacaagcacatcttcctattacgttttctacatatatgtgggagtggccgatactctcctcgccatgggcttctttcgagggctccctttggtgcacacactgattacggtcagcaagatcttgcaccacaaaatgttacactcagttctgcaggcccctatgagtactttgaatacactcaaagctggcggtatactcaaccggttctccaaggacatagcaatcctggatgatttgctccccctaaccatctttgactttatccagctgctgctgatcgtgattggtgcgattgccgtagttgcggtcctccaaccctatattttcgttgctacagtccccgtgattgtggcatttatcatgctgcgagcctacttccttcagacctcccagcagctgaaacaattagaaagtgagggcagatcccccatctttactcacctggtgaccagcctgaaggggctctggactttgagagcctttggccgccagccttacttcgaaactttgttccataaggccctcaaccttcatactgcaaactggtttctctacctaagcaccttacgctggtttcaaatgcgcatcgaaatgatttttgtgatatttttcattgctgtaaccttcatctccatactgaccacaggcgagggtgaagggcgggttggtatcatactgacccttgccatgaacatcatgtcgacgctgcagtgggcagttaattcatctatcgatgtcgactctctcatgcgctcagtatcccgggtgtttaagttcatcgatatgcctacagagggaaagcccaccaagagtactaagccctacaagaatgggcaactatccaaggtgatgatcatagagaatagtcacgtgaaaaaggatgatatctggccctccgggggacagatgactgtgaaagacctcacagccaaatataccgagggtggaaacgctatcctggagaatatctctttctccatttctcctggccagcgggtgggtttgctgggacgtaccgggagcggaaaatccaccttgctctctgccttcctgcgcttgctaaatacagaaggggagatccagatcgatggggtgagctgggacagcatcacactgcagcaatggcggaaggctttcggcgttatcccccaaaaagtgtttatcttttccggaacttttagaaaaaacctggatccttacgagcagtggagcgaccaggagatttggaaagtggccgacgaagtggggctccgtagcgtgattgaacagttccctggtaaactggatttcgtgctggtggacggggggtgcgtgttgtcccacgggcataagcagctgatgtgtcttgcccgtagcgtcctgagtaaggcaaagatcctactccttgatgaaccttcagcacatctggacccagtgacataccagatcatccgccgcacactaaaacaggccttcgccgattgtaccgtgatactttgtgaacataggatcgaggctatgctcgaatgccagcagtttctggtgatcgaagagaacaaagtccggcaatacgactccatccagaaactgcttaatgagaggtcacttttccgccaggccatctctccaagcgatagggtcaagctttttccccatcgcaatagctccaagtgtaagagcaagccccagatcgccgcccttaaggaggagactgaggaagaagtccaggacacccggttg

SEQ ID NO: 10133 - DNA, 4440 bp, Artificial Sequence
  Description of Artificial Sequence: Synthetic coding sequence
atgcagcgcagcccactggaaaaagccagcgtggtatccaagctcttctttagctggacacggcctattcttcgcaagggatacagacaacgacttgagctctcagatatctaccagattccatccgttgactccgccgacaacctctcagaaaaactggaaagagagtgggatagggagttggctagcaagaagaaccccaagctcatcaacgccttgcgacgatgttttttctggcggttcatgttttacgggatctttctgtatttgggcgaggtcacgaaggcagtccagccgcttctcctcgggcggatcatcgcatcttacgaccccgataataaagaggaacgctccatcgctatttatctgggaatcggcctgtgtctgttgtttatcgttcggacgttgctgctgcaccctgcaattttcggtctgcatcacataggtatgcaaatgcgcattgctatgttctccctcatctacaaaaaaacactgaaactgtccagcagagttctggataaaatctctatcgggcagctggtgtcactgctgagcaacaacctcaacaaattcgatgagggactggcactggcacacttcgtgtggatcgctccactgcaggtcgctctcctgatggggctcatctgggaactgctccaagcttcagccttctgcgggcttggatttctgatcgtgctcgctctgttccaggccggactcggtagaatgatgatgaaataccgagatcagagggctggtaagattagcgagcgcctggtaattacaagcgagatgatcgagaacatccagtctgtgaaagcatactgttgggaagaagctatggagaagatgatagagaatctgcgccagaccgagctgaagctgacaaggaaagcagcctacgtgcgatatttcaacagttctgcattcttcttcagcggcttctttgttgtgttcttgagtgtgctgccctatgctttgattaaggggattatcctgcggaaaatttttacaacaatcagtttctgcattgtccttagaatggctgtgactaggcagtttccctgggccgtgcagacttggtatgactccctgggagccataaacaagatccaggatttcctgcagaagcaggagtacaagaccctggaatataatcttacaacgacagaagtggttatggagaacgttacagccttttgggaggagggcttcggtgaattgtttgagaaggccaagcagaataataacaatagaaaaacaagcaacggagatgacagtctttttttctctaacttctctctgctggggactcctgtgcttaaagatatcaatttcaagatcgaaagaggtcagctgcttgcggtcgctggctcaacaggggcaggcaagactagcctgctgatggtcataatgggagagctggagccatcagaagggaaaattaagcactcaggaagaatttctttctgttctcagttcagttggatcatgcctggcactattaaggaaaatataatcttcggggtgagctacgatgagtaccggtaccgatcagttatcaaagcttgtcagctcgaagaggatatttccaagttcgctgaaaaagataatatagtactgggggagggcggtatcacacttagcggcggccagagagcccggatatcactggccagggccgtatataaggacgctgatctctacctgctggattccccctttggatatcttgatgtactgacagaaaaggagattttcgagagttgcgtctgtaagctcatggccaacaagacccggattctcgtgacaagcaagatggagcatctgaaaaaggcagataaaatcctgattctgcacgaggggtcatcatatttttatggcaccttctccgaactccaaaatctccagcctgatttttcttccaaattgatgggatgtgacagcttcgaccagttcagcgcggagaggaggaacagcatcctgacggaaaccctccatcgattctccctcgagggcgatgcccctgtcagctggaccgagactaaaaagcagtccttcaaacagacaggtgaatttggagagaaacggaagaactccatcttgaaccccatcaactcaattcgaaaattttctatagtgcagaaaacacctcttcagatgaatgggatcgaagaggattctgatgagcctctcgagaggagacttagcctggtgcccgattctgagcagggggaggccatcctgcccagaatctctgtgatctctaccggccctaccctgcaagcccgacggcgccaatccgttctcaacctgatgacacacagcgtgaatcagggacagaacattcatcggaagactaccgcatctaccaggaaggtgagcctcgctccacaggccaatctgacagaattggacatctattcccgacggttgtctcaagaaaccggcttggagattagcgaagaaattaacgaggaagaccttaaagagtgttttttcgacgatatggagagcatccccgctgtaaccacctggaacacttatctgcgatatatcaccgtgcacaaaagcctgatttttgtacttatctggtgtcttgtcatattcctcgctgaggtggcggcgtccctcgtcgtgctgtggttgttgggtaacactcccctgcaggacaagggaaatagcacacactcacgcaacaatagttacgccgttataataacctccacatcaagctattacgtgttctatatctatgtgggagtggctgataccctcctcgctatggggttcttccggggcttgcccctggtgcatacgctgatcaccgtgagcaagatcttgcatcacaagatgctgcactccgtattgcaagctcccatgtctactctgaataccctgaaagcaggtggcatactgaataggttctccaaggatatcgccatactcgacgatctgcttcccctgaccatttttgacttcatccaactcctgcttatcgtaatcggcgctatcgccgttgtggccgtactgcagccatacatatttgtcgcaaccgtgcccgtgatcgttgcttttatcatgctccgcgcttactttctccagacatctcaacagctcaagcagctggagagcgagggacggtctcccatcttcacacatcttgtgacatctctgaagggtctttggaccctcagagccttcggtagacagccctacttcgaaactctgttccacaaggctctcaatctccatacagcaaactggtttctgtacctctctacgttgcgatggttccagatgaggatcgagatgatctttgttatcttttttatcgcagttacttttatttctattctgacaactggtgagggggaaggcagggttgggattattctgacgctcgcaatgaacatcatgtctacactgcagtgggcagtcaattcttcaatcgatgtagacagccttatgaggtccgtgagtcgggtgttcaaattcattgacatgcctactgagggaaagcccacaaaatctaccaagccttataagaatgggcagctgtccaaagtgatgataatagaaaactctcatgtgaaaaaagacgatatatggccctctggggggcaaatgacagtaaaagatcttactgccaaatacacagagggaggaaatgctatcctggagaatatctccttctctatttctcctggccagagagtgggcttgcttggacggactggaagcgggaaatccaccctgctgagcgcgtttctgagactgctgaacacagaaggagagatccagatcgatggcgtgtcttgggatagcataacactgcagcagtggcgaaaggcctttggtgtcatcccccagaaggtctttattttctcagggacattcaggaagaatctcgacccttatgagcagtggagtgaccaagaaatctggaaggtggctgacgaggtagggctgcgaagtgtgatagagcagtttcctggaaagctcgattttgtgctggtagacggcgggtgcgttctttcacacggacacaaacaactcatgtgcctggcacgcagtgtgctgagtaaggccaaaattctcctgctggatgagccttcagctcaccttgatcctgtcacttatcagattattcgccggacccttaaacaggcattcgccgactgtactgtgatcctgtgcgagcatcgaattgaggccatgctggaatgccagcaattcttggtcattgaagaaaacaaagtgcggcagtatgatagtatccagaagcttcttaacgagcggtcactgtttcgccaggccatcagtccctccgatcgcgtaaagctgtttccacacagaaattccagcaaatgcaaatcaaagccgcaaatcgcggctctgaaggaagagactgaagaggaggttcaggacactcgcctt

SEQ ID NO: 10134 - DNA, 4440 bp, Artificial Sequence
  Description of Artificial Sequence: Synthetic coding sequence
atgcagagatctcctctcgagaaggcttccgtggtcagtaagctctttttcagctggacaaggcctatcctcaggaagggataccgacaaaggttggagctctctgacatttatcagattcctagcgttgactccgccgacaatttgtccgagaaactcgaacgcgagtgggatcgggagctcgccagtaaaaaaaatccaaaactgatcaatgcgctgcggaggtgctttttctggagatttatgttctacggcatatttctttacctcggggaagtgactaaggccgtacagccactgcttttaggccgtattattgcttcctacgatcccgataataaagaagagaggtccatcgcaatttacttgggcatcggtctgtgtctgctcttcatcgttcggacgctccttcttcaccccgctatttttggcctgcaccacatcggcatgcagatgaggattgccatgttctcccttatttacaagaaaacattgaagctgagtagtcgcgtcctagacaaaattagtatcggccaactcgtcagtcttctctccaacaatctgaataagttcgacgaggggttggcacttgcccactttgtatggattgccccacttcaggtggcactgttgatgggcctgatctgggagctcctgcaggcaagcgcgttctgtggtctgggttttctcatcgtgctcgctttatttcaggcaggactaggccggatgatgatgaaatatcgggatcagagggccggcaaaatctccgagcggcttgtcattacatctgagatgattgaaaacatccaatccgtgaaggcttattgctgggaggaggccatggagaagatgattgagaacttgagacagacggagctcaagctgactcggaaggcagcatacgtccgttatttcaacagtagtgcttttttcttttcagggttcttcgtggtgttcctgagtgtgctgccgtacgccctgataaagggcattattctcagaaaaatctttaccacaattagcttttgtatcgtcctgaggatggctgtgacgcggcagttcccctgggcggttcagacttggtatgatagcctaggcgccattaataagatccaggattttctccaaaagcaagagtacaaaactctcgagtataaccttacaactaccgaggttgtcatggaaaacgtcacagcgttctgggaggagggctttggagaactctttgagaaggccaaacagaataacaacaacaggaaaacaagcaacggtgacgactctctgttcttctctaacttcagtttgctgggcactcccgtcctaaaggacataaatttcaagatcgagagggggcaacttctcgcagtggctggttcaacaggtgccgggaaaacctcgttgctcatggttatcatgggcgagttggaaccttccgagggcaagatcaagcacagcggccgcataagcttttgttcgcagttctcctggataatgccaggcactataaaggaaaatattattttcggagtctcttatgacgaatacaggtacaggtccgtcataaaggcatgtcagctggaggaagacattagcaaatttgcagagaaggataacatcgtgctgggtgagggggggatcacgctctcaggcggacagcgcgcgcgtattagcctcgcaagggctgtttataaagatgctgatctctacctgctggactctcctttcggatatctggacgtgctgaccgaaaaagaaattttcgagtcttgcgtgtgtaagttaatggctaacaaaacgcggattctagtcacttccaagatggagcatttaaaaaaggcggacaaaatcctgatcctgcacgaggggtctagctatttctacggcacattctcagagcttcaaaacctgcagcccgatttctcctctaagcttatgggttgtgacagctttgaccaattttccgctgagagacgtaactcgatcctcactgagaccctgcaccgtttcagcctggagggggacgcccccgtgtcttggacggagacgaaaaaacagagctttaaacagactggagagttcggcgagaagcgcaagaatagtatccttaatcccatcaactccattcggaaattcagcattgtccagaaaacccctcttcaaatgaacgggatcgaagaagattctgatgagccactggaaaggaggctctccctggtgccagacagtgagcagggagaagccattttgcctaggatcagtgtaatatccacgggccccacactgcaggctcgaaggcggcagtccgttctgaacctgatgacccacagcgttaaccagggtcaaaacatccaccggaaaacgacagctagtacgagaaaggtgtctctcgccccccaggctaatttgaccgaactggatatttattcaaggcgactctctcaggagacgggattagagatcagcgaggagattaacgaagaagatctgaaggagtgtttctttgacgatatggagtcaatacctgccgtgacaacctggaatacttatttgcggtacatcacggtgcataagtcacttatttttgttctgatctggtgtctggtgatttttttggctgaagttgcggccagcctagtcgtgctgtggctactcggcaacaccccactgcaagacaaaggcaacagcactcatagtcggaacaacagctacgccgtcattatcacaagcacttcatcctactacgtgttttatatctatgtgggagtggcggatactctcttagctatggggttcttccgcggcttgccgctggtacatactctcattaccgtgtctaagatcctgcaccataagatgctacacagtgtcctacaggccccaatgagcactctcaacaccctaaaggcaggcggaattctaaataggttcagcaaggatatagccattctggacgaccttcttcctctaacaatatttgactttatccagctccttctgatagtgattggagcgatcgcagtggtggctgtactccagccttacatctttgtggcaactgtccccgtgattgtagcattcataatgctccgggcctattttctccagacttctcagcagctaaagcagctagagagcgaaggtagatcccctatcttcacccatcttgtaactagtctgaaaggtctgtggaccctgcgtgccttcggacgccaaccctactttgagactctgtttcataaggcactgaacctccacactgccaattggttcctttacctttcaactctgagatggttccagatgcgaattgaaatgatcttcgtgattttcttcattgccgttacctttatatccatccttacgactggcgaaggggaggggagggtaggaatcattctgactctggcgatgaatatcatgtctacccttcagtgggcggttaatagttcaatcgacgttgattccttaatgcgatccgtgagccgcgtctttaaattcatagacatgcccacagagggcaagcccacaaagagcactaaaccgtacaaaaatggccaactcagtaaggtaatgataatcgagaacagtcacgtgaagaaagacgacatctggccgtccggtgggcagatgactgtgaaggacctgaccgccaaatacaccgaagggggtaatgcaatcctggagaatatcagcttcagtatatcacccggccaacgcgtaggactgctcggccgcactggaagcggaaagtcaacacttctatcagcattcctgcgcctgttgaacactgaaggcgagattcagattgacggcgtaagttgggattccattacattgcaacagtggcgcaaagcattcggagtgatcccacagaaggtctttattttcagcggcacttttcggaaaaatctggatccgtacgagcagtggagtgatcaggaaatatggaaagtcgctgacgaggtggggctgaggtctgttatcgagcagtttcccggaaagctggacttcgtgctagtagatggaggttgcgtgctatctcacggacacaagcagctgatgtgtctggccaggtcagtgctatccaaagctaaaatcctgctgctggacgagccgagtgctcacctcgacccagtgacttaccagattatccggaggacattaaagcaggccttcgctgactgcaccgtcattctgtgtgaacatagaattgaagcgatgctggagtgccagcagtttctggttatcgaagaaaataaggtccgccaatacgatagcatccagaagttactcaacgaacgcagtctctttagacaggctatttcgccaagcgatagggtgaaactgtttccgcacagaaattcctccaaatgtaagtccaagccccagattgcagcactcaaggaagaaaccgaagaagaggtgcaggacacccggctt

SEQ ID NO: 10135 - DNA, 4440 bp, Artificial Sequence
  Description of Artificial Sequence: Synthetic coding sequence
atgcagcggtcgcctctcgaaaaggcatcggtggtcagcaagctgttcttttcctggactcgcccaattctcagaaagggatacagacagagactcgagctgagcgacatctaccagatcccgtccgtggattcggccgacaacctctcggaaaaactcgagcgggaatgggatcgggagctcgccagcaagaaaaacccgaaacttatcaacgcgctccgccggtgctttttctggcgcttcatgttctacggcatcttcctgtacctgggagaagtcaccaaggccgtgcaacctctgctcctcggacgcatcattgcgtcatacgacccagataacaaggaagagagatccattgctatctacctcggaatcggcctctgcctcctgtttatagtgagaactctcctcttgcacccggcgatctttggactgcaccacatcggaatgcaaatgcggatcgccatgttttcgctgatctacaagaaaaccctgaagttgagctcaagagtgctggataagatcagcattggacaattggtgtcgctcctgtccaataatctgaataagttcgacgaagggttggctctggcccacttcgtgtggatcgcgccactgcaggtggctctgctgatgggactcatctgggaactcctgcaagcgtcggctttctgcggactgggattcctgattgtgctggccctctttcaagcaggactgggaagaatgatgatgaaatacagggaccaacgtgcggggaagatttccgagagactcgtcatcacgagtgagatgattgagaatatccaatcggttaaagcgtactgttgggaagaagcgatggagaaaatgatcgaaaacctgcgccaaacggaactgaaactcactcgcaaggctgcgtacgtgcgctactttaacagctccgcatttttcttctccggctttttcgtcgtgtttctgtcagtgctcccttacgccctcattaaggggatcattctgaggaagatctttactaccatctccttctgcatcgtgttgcggatggcagtcaccagacagttcccatgggcagtgcagacctggtatgactcgcttggagcaatcaacaaaattcaagacttcctccagaagcaggaatacaagaccctggaatacaaccttacgacgaccgaagtcgtcatggaaaatgtgacggccttctgggaagagggcttcggcgaactgttcgagaaggcaaaacagaacaataacaacagaaagacctcgaacggtgatgactccctgttcttctccaacttcagccttctcggtacgccggtgttgaaggatatcaacttcaagatcgaacgcggccagctgttggctgtggccgggtcgaccggagctggaaaaacttcccttctgatggtcatcatgggggagctggagccgtcggaagggaagatcaagcactccggacgaatcagcttctgtagccaattcagttggatcatgcctggaaccatcaaggagaatatcatttttggagtgtcatatgatgagtatcgctaccgctccgtcattaaagcctgtcaactggaggaggatatcagcaaattcgccgaaaaggataacatagtccttggagaaggcggaatcaccctctcaggaggacaaagggctcggattagcctggcacgcgctgtgtataaggatgcggacctctacctgctcgactccccgttcggttacctggacgtgctcactgaaaaggagatcttcgagtcgtgcgtgtgtaagctcatggcaaacaagacccgcattctggtgacctcgaagatggaacacctgaagaaggcagataagatcctcatcctgcatgaaggtagctcttacttttacggaaccttctccgagctgcagaatctgcagccggacttcagctcgaaactgatgggatgcgactcattcgaccagttttccgcagagcggcggaattcaatcctgactgaaacgctccacagattctcactggaaggcgacgcgcccgtgtcatggaccgaaaccaaaaaacagagttttaagcagaccggagagttcggcgaaaaacgtaagaactccatcctcaacccgatcaactcaatccgcaagttctcgatcgtgcaaaagacgccgctgcaaatgaatggaattgaggaggattcggatgagccgctggagcgaaggctttccctcgtccccgatagcgaacaaggtgaagctattctgccgcgcatctccgtgatctcaaccgggcccaccctccaggcccggaggcgccaatcagtcctcaaccttatgacccacagcgtcaaccagggccagaacattcacaggaaaaccactgcttcaactcgcaaagtgtccctggcgccccaagcaaatttgactgagctcgacatatactcgcggcggctgtcacaggaaactggacttgagatctcggaagagattaatgaggaggacctcaaggagtgttttttcgacgatatggaatccataccggccgtgaccacctggaatacctaccttcgctacatcaccgtgcacaagtccctcatcttcgtgttgatctggtgcttggtgatctttctcgcagaagtggcggcctccctcgtggtcctgtggctgctgggcaacacgcccctgcaggataaaggaaactccacccactctcgaaacaacagctacgccgtcatcatcacctctaccagctcgtattatgtgttctatatctacgtgggagtcgcagacactctcctcgcaatgggattcttccgcgggctgccgttggtccatacgctgatcactgtgtcgaagatactccaccacaaaatgctgcactccgttctgcaagccccaatgtctactctgaacaccctgaaagccgggggaatccttaatagattttctaaggacatcgcaattctggacgatctgctgccacttactatctttgacttcatccaacttctgctgatcgtgatcggagcaatcgcggtcgtggccgtgctccaaccctacattttcgtcgccactgttcctgtgatcgtggcgttcatcatgctgcgggcctactttctgcagacctcacagcaactcaagcaactggagtcggagggcaggtcaccgatcttcactcacctcgtgacttcgctcaagggcctgtggaccctgagagcattcggacgccagccttacttcgagactctgttccacaaggcgctgaatctgcacacggcaaattggttcctctacttgagcacgctgcgctggttccagatgcggatcgaaatgatcttcgtgattttcttcattgcggtgactttcatctcgatcctgaccaccggcgaaggtgaaggcagagtgggaatcatcctgaccttggccatgaatatcatgtcgaccttgcaatgggccgtgaattcgtccatcgatgtcgactcactcatgcgctcggtgtcccgcgtctttaagttcattgacatgcccaccgaaggaaagccgactaagtcgactaaaccatacaaaaacggtcaactgtccaaggtgatgatcatcgaaaactcgcatgtgaagaaggacgacatctggccaagcggcggtcaaatgactgtgaaagatctgactgcgaagtacaccgagggaggtaacgctatcctggagaacattagcttctccatttcccctggtcaaagggtgggactgctgggtcgcaccggatcaggaaagtccaccctgctgtccgctttcttgagattgctgaacaccgaaggcgagattcaaatcgacggagtgagttgggatagcatcacccttcaacagtggcggaaggcatttggcgtgatcccgcagaaagtgttcatcttctccgggactttccgtaaaaacctggacccgtacgaacagtggtcagaccaagagatttggaaggtggcggacgaggtcggcttgcggagcgtgattgagcagttcccgggaaagctggacttcgtcctcgtggacggtggctgcgtcctgtcacatggccataagcagttgatgtgtctcgcgcggagcgtgctgagcaaggctaagatccttctgctggacgaaccgtccgcacatcttgacccagtgacctaccaaatcatccgccggacgctgaaacaagcattcgccgactgcactgtgatcctctgcgaacacaggatcgaagcgatgctcgaatgtcagcaatttctggtgatcgaggaaaacaaggttcgccaatatgatagcatccagaagttgctgaacgaacggtcgctctttcgccaagcaatctcgccatcggatcgcgtgaaactgtttccacacagaaactcgtcaaagtgcaaatccaagccacagattgccgcgctgaaggaggaaactgaggaggaagtccaggacactcgtctg

SEQ ID NO: 10136 - DNA, 4440 bp, Artificial Sequence
  Description of Artificial Sequence: Synthetic coding sequence
atgcagcggagtcccctggagaaagccagtgtagtctccaaactgttcttttcctggactcggccaatcctccgcaagggctatcgccaaagactcgaacttagcgacatctaccagattcccagcgtggatagcgccgataacctctccgagaagctggagagggagtgggatcgagaactggccagcaaaaagaatcctaagctcatcaacgcactgagaagatgctttttctggcgattcatgttctacggtatcttcctgtacctcggtgaagtcacaaaggccgtgcagccactcctgctggggcggatcatcgctagctacgatcccgacaacaaggaggagaggagtatagccatttatctgggaatcggcctgtgtctgctgttcatcgtgcgcacactgctgctgcacccggctattttcggcctgcaccatataggaatgcagatgagaattgccatgttttctctgatctataagaaaacgctgaaacttagcagcagagttcttgacaaaattagcattggccagcttgtctccctcttgagcaacaatcttaacaaattcgacgaagggctggctcttgcccacttcgtatggattgcgccgctccaggtagcactgcttatgggcttgatctgggagctgctccaggcgtccgcgttctgtggacttgggttcttgattgttctggcccttttccaggcagggcttggcagaatgatgatgaagtatcgagatcaaagggccgggaagatttccgaaaggcttgttataacctccgagatgatcgagaacatccagtccgtgaaggcatactgttgggaagaagccatggagaagatgatcgaaaatttgaggcagaccgagctgaaattgacaagaaaggcagcctacgtgagatatttcaacagttccgccttcttcttttcaggcttttttgtggtgtttctcagcgtgcttccctacgctctgatcaaaggcatcattctgcgaaagatctttacgaccatcagcttctgcatcgtgttgcgaatggccgtgacccggcaatttccttgggcagtccagacgtggtatgattcacttggtgcaatcaacaagatccaggatttcttgcagaagcaggagtacaagaccctggaatacaacctcaccaccaccgaagttgtgatggaaaacgtaaccgccttctgggaggagggtttcggagagctgttcgagaaggccaagcaaaataataacaacaggaaaacctcaaacggagacgattcactgtttttttctaacttctccctgctcgggactcctgttctgaaagatatcaactttaaaatagaacggggacagctgctggccgttgccggttccactggggctggcaagacctctctgctgatggtcattatgggcgagctggagccaagcgagggcaagatcaagcactccggacgaatctccttctgctcacagttctcatggataatgcctggcaccattaaagagaacatcatcttcggagtatcatacgacgaataccggtaccgcagcgtgattaaggcctgccagctggaggaggacatctccaaattcgccgagaaggacaatattgtgctgggagagggggggataaccttgtctggtggtcagagggcgcggatctctctggccagagcagtgtataaagacgctgatctctatctgttggactctccatttggttacttggatgtattgacagaaaaggagattttcgagtcttgtgtgtgtaaacttatggctaataagacacggatcctggtgacatcaaaaatggagcatttgaagaaggcggataaaatcctgatcctgcacgaaggaagctcttatttctatgggacattttctgagctgcaaaatcttcagcctgacttttcctctaagctcatgggatgtgatagtttcgaccagttcagcgctgaacgccgcaactctatccttaccgaaacacttcaccggtttagcctggagggcgacgcgcctgtctcatggactgagaccaagaagcagagcttcaagcagactggcgagtttggagaaaagaggaagaacagtattttgaatccaatcaactccataagaaagttcagcatagtccagaaaactcctctccagatgaacggtatagaggaggattccgacgagccactggaaagacgattgagcctcgtgccggatagcgagcaaggagaagctattcttcccaggatcagtgtcatctccactggtcctaccctgcaggcccgccggaggcagtctgtgctcaacttgatgactcattccgtgaatcaggggcagaatattcaccgaaagactacggcctccacacggaaggtcagtctcgctccccaggctaacctcacagagcttgacatatactctagacggctcagtcaggaaacggggctggaaatctcagaggagattaacgaagaagacctgaaggaatgcttcttcgacgacatggagtctatccccgcggtgacaacttggaacacctatcttcgctacattactgtccataaaagtctgatttttgtactgatctggtgcttggtcatctttctcgcggaggtcgcagccagcttggtggtcctgtggctgctcggaaatacaccactgcaggataaaggcaatagcacacattctcggaacaacagttacgcagttataattacatccacctccagttactacgtcttctacatctacgttggcgtggccgatacgcttctggcaatgggattttttagaggcctgcccctggttcacacgttgatcacagtctctaaaattctgcaccacaaaatgcttcattccgtgttgcaagcaccgatgagcaccctcaatacgttgaaagccggcgggatcttgaacagattcagcaaggacatagcaattttggatgacctcctgccactgactatctttgactttatccagctgctgctcatcgtgatcggggcgatcgcagtggtggccgtcctccagccatacatctttgtggcgacagtgcctgtgatcgtagcttttatcatgctgcgagcttatttccttcaaaccagccaacagctcaaacagctcgaaagcgaggggcgctcacctatcttcacgcacctggtgacatccctgaaagggctttggaccctcagggcatttggcagacagccatactttgaaacgctgtttcacaaagcgctgaacctgcatacagctaactggttcctctatcttagtacccttcgatggttccagatgcggatagaaatgatctttgttattttctttattgccgtgacatttatcagcatactgaccacaggggaaggggagggcagggtcggaatcattttgacactggccatgaatattatgtcaaccctgcagtgggctgtcaattcctctatcgacgtggactctttgatgcgatctgttagtagggtattcaagttcattgacatgcctacagagggcaaaccaactaaatccacaaagccctataagaacgggcagctgtctaaggtgatgattatcgaaaattcacacgtgaagaaggatgacatctggccaagcggaggccagatgactgtgaaggacctcactgccaagtacacagaggggggcaacgcaatcctggaaaatatctccttctccatcagcccagggcagagggtgggcttgctgggcagaaccggctcaggaaagtccaccctcctgagcgctttcctgaggttgttgaatacggagggggagatacagatcgatggcgtctcttgggactcaattactctccagcagtggagaaaggccttcggtgtgattcctcagaaggtattcatcttctcagggacctttcgcaaaaacctggatccatatgagcagtggtcagaccaggagatctggaaggtggccgacgaggtgggtctcagaagtgttatcgaacagttcccaggcaagttggatttcgtgttggttgacggcgggtgcgtgctcagtcatggacacaagcaactgatgtgcctggctagatcagtactgtctaaagccaagatccttcttctcgacgaaccctctgcgcacctcgatcctgttacataccagataattcgcaggactctgaaacaggcattcgccgactgcacagtgatcctctgtgagcatcgcatcgaagctatgctggaatgtcaacagttcctggtgattgaagagaataaggttaggcagtatgattcaatccaaaaactgctgaatgaacggagcctgtttaggcaggctatctcccccagtgaccgggtgaaacttttcccccatcggaattcaagtaagtgtaaatctaagccccagatcgctgccctgaaagaagagactgaggaagaggtccaggatacccggttg

SEQ ID NO: 10137 - DNA, 4440 bp, Artificial Sequence
  Description of Artificial Sequence: Synthetic coding sequence
atgcagagatccccgttggaaaaggcgtctgtcgtctctaagctgttcttcagttggactaggcccatattgagaaaaggttataggcaaaggctcgagttaagcgacatatatcagatcccctctgtcgatagtgccgacaatctgtctgagaagctagagcgcgaatgggacagggaactggcaagcaagaagaatccaaagctgatcaacgctctgcgaaggtgtttcttctggcgctttatgttttacggtatatttctgtaccttggcgaagtcaccaaggccgtgcaacccctgctcttagggcggataatagcttcttatgaccccgataacaaggaggagcgcagtatcgccatctacctgggtatcgggctatgcttactgttcatcgttcggactctgctgcttcatcccgccatattcggactccaccatatcggtatgcagatgaggatagccatgttcagcttgatatataagaaaacactgaagctgagctcacgagtcctcgataagatctctataggccagctagtaagtttgctgagtaataatctaaataaattcgacgagggattggcattagcacactttgtgtggattgcccctcttcaggtcgcactgttgatgggtttgatttgggagttgttgcaggctagcgccttctgcggcttaggcttcctcatcgttctcgccctatttcaggccggactcggacggatgatgatgaaatatcgtgaccagcgcgctggcaagatctccgaacgcttggttataacgtcggagatgatcgagaacatccaatcagtaaaggcttactgctgggaagaagccatggaaaagatgattgagaatctccgccagaccgagctgaagctgacaagaaaagctgcctatgttaggtacttcaatagttctgcatttttcttttccggattttttgtggtattcttgagcgtgctgccgtacgctctgatcaaaggaataatcctgcggaagatttttaccactattagcttttgtatagtgttgaggatggccgtgacccgacaatttccatgggcggtgcaaacctggtacgactcattaggcgccatcaacaaaatccaggactttctgcagaagcaggaatataagaccctggaatacaatctaactaccaccgaggtcgtgatggagaatgttaccgcattctgggaggagggtttcggcgagctgttcgagaaagcaaagcagaataataacaacagaaagacttccaacggtgacgattcacttttcttttctaacttttcactcctgggcacaccagttctgaaggatataaattttaagatagagagaggtcagttgttggccgtggccggcagcacaggggccggtaagaccagcctacttatggtgattatgggtgagttggagccttccgaggggaagatcaaacacagcggtcgcattagcttctgctcacaattttcatggatcatgcctggcacaatcaaagagaatatcatcttcggcgtgagctacgacgaataccggtatcgcagcgtgatcaaagcatgtcaactggaggaggacatttctaagttcgctgaaaaagataacatcgtgctgggagagggcggaattacattaagtggaggccagcgcgctaggatctcattggcgagggctgtttataaggatgcagacttgtacctgttagactcccccttcggctacctggacgttctgacagaaaaggagatattcgagtcctgtgtctgcaagttgatggcaaataagaccaggatcctagtgacctcgaagatggagcaccttaagaaagccgacaaaatcctcattctccacgaggggtcctcatatttctatggcactttctcagagctgcagaatctccaacctgacttctctagcaagcttatgggttgtgattctttcgaccagttctccgcagagcggagaaactcgatccttaccgagactcttcaccggttcagcttagagggagatgctcctgttagttggacagaaactaaaaagcaatccttcaaacagaccggcgagttcggggagaagagaaagaactcaatactgaaccctatcaattctatccgcaaatttagcattgttcagaagactccactccaaatgaacggtattgaagaagattcggatgaaccattggaaagacgcttaagtctggttccagatagtgagcagggtgaggcgattttgcccagaatcagtgttatctccacaggccccacattacaggctcgcaggcggcaatcagttttgaatctcatgacccatagcgtgaaccagggacagaatattcaccggaagacaacggcttctacaagaaaggttagtctcgcgccccaggccaacctgacggagcttgatatttatagtcgtagactcagtcaggagacaggcttagaaatctctgaagaaatcaacgaagaagatctgaaagaatgcttttttgatgacatggaaagtatccccgctgtgacaacgtggaacacctacctgcgttatattactgtacataaatcattgatctttgtgctgatctggtgcctcgtaatattcttagcggaggtggccgcttcattggttgtcctgtggctgctgggaaacacccctctacaagacaaggggaattcaacacacagcaggaacaattcttacgcagtcattatcacttcaacgtcttcctactacgtcttttacatatatgttggggttgcagatacccttctggccatgggctttttcagagggttaccactggtccatacattgattacagtgtcaaaaatccttcatcacaaaatgctccactccgtgttacaagcccctatgtcgacactcaacactctcaaagcgggcgggatactgaatagattctcaaaagatattgcaatccttgacgatctgcttcccctcacaatctttgactttatccagcttctgttgatcgtgattggggctatagccgtggtcgcagtcctccagccatacattttcgttgctaccgtgcctgtcatcgtcgctttcattatgctgagagcgtacttcttgcaaacgagtcagcagctaaagcagctggaatcagagggccgttctcctatttttactcatttggtcacctcacttaagggactttggactctgagggcgttcggacgtcagccatattttgagactctattccataaagccctgaacctacatacagcaaattggttcctttacctgtcgacactgcgttggttccaaatgaggatcgagatgatattcgtgatatttttcatagctgttacatttattagtatactgaccactggcgagggcgaggggcgcgtggggataattcttaccctggccatgaacattatgagtaccttacagtgggccgttaactctagcattgatgtcgatagcctgatgcgatcagtaagccgggtttttaagttcattgatatgccaactgagggaaagcccactaagtccactaaaccctacaaaaacggacagcttagtaaggtcatgattatagaaaattctcacgtgaagaaggacgatatatggccgtctggagggcagatgaccgtcaaggaccttactgcaaaatacaccgagggcgggaacgctatccttgagaatatttcattttctatttctccagggcagagggtggggctgctggggagaacaggctctggcaaatcgacactgctctccgccttcctcaggttactaaacactgagggagagatccagatcgacggagtgtcctgggacagcatcacactgcagcaatggcgcaaggcttttggggtgataccccagaaagtctttatcttttctgggactttcagaaagaatctagatccttatgaacagtggtctgaccaggagatatggaaggtggcagacgaggttggcttgcggtccgtcatagagcaatttccaggtaagctcgatttcgttctggtggacggcggttgcgtgttaagccacggccataagcagctgatgtgcctggctagatcagtgctctctaaggcaaagatactgctgctggatgagccatccgcacacctggacccagtgacttaccagataatccgaagaaccctcaagcaagcctttgctgactgtaccgtgattctgtgcgaacaccgtatcgaggcgatgctggaatgccaacagttcctggtcattgaagaaaacaaggtgaggcagtacgattctatccaaaaactactgaatgagcgaagtcttttccgccaggcgatcagtcctagcgatcgggtgaaactgtttccgcaccgaaattcgagtaagtgtaagtctaagccgcagattgctgccctgaaggaggaaactgaggaagaggtgcaggacacccgcctg

SEQ ID NO: 10138 - DNA, 4440 bp, Artificial Sequence
  Description of Artificial Sequence: Synthetic coding sequence
atgcagagatccccactggaaaaggcaagtgtggtgtctaagctgttcttttcttggacgagaccaatcctccgaaaagggtaccgccagaggttggagctttcagacatatatcagatacctagcgtagatagcgccgacaatctcagcgaaaaattggagcgcgagtgggacagagaactggcctctaagaagaatccaaaattgattaatgctctgagaaggtgttttttttggcgctttatgttctacgggatctttctgtacctcggcgaggtgactaaagcagtacagcctctccttcttggtcgcattatagcatcttatgatcccgataacaaggaggagcggagtattgccatctatctcgggattggactgtgtctgctgttcattgtgagaacactgctgcttcatcctgctatcttcgggctgcaccatattgggatgcaaatgagaatcgcgatgttctccctgatttacaagaagacactcaagctgtcttctcgcgtgctggataaaatctctattggccagctcgtgagcctcctcagcaacaacctcaacaaattcgatgagggcctggcactcgcacattttgtgtggattgcacctctgcaggtggctttgctcatgggcctgatttgggagctgttgcaagcgtccgccttctgcgggttgggttttctgattgtcctcgcactcttccaagccggtctcggtcgcatgatgatgaagtatagggatcagcgcgccggaaaaatctcagagagactggtcatcactagtgagatgattgaaaacatccagtcagtgaaggcctactgctgggaggaagccatggagaagatgatcgagaacctcaggcagacagaactgaaactgactcggaaggccgcttacgtgaggtacttcaacagttccgctttctttttttccggcttcttcgtcgtgttcttgtccgtgctcccatacgcacttatcaagggcatcattctccggaagatcttcaccaccatctccttttgtattgtactccgcatggctgttacaaggcagtttccttgggctgtgcagacttggtatgatagtctgggcgcaataaataaaattcaggacttccttcaaaagcaggaatataagaccttggaatacaacctgaccactactgaggtggtgatggaaaatgtgactgccttttgggaagagggattcggagagctgttcgagaaagctaaacagaataataataaccgaaaaacctctaacggggacgattctttgttttttagtaatttcagcctgttgggcaccccagtgctgaaggatattaacttcaaaattgaaagagggcaactgctggcggtggctggatctaccggcgcgggaaaaactagcctgctgatggtgatcatgggcgagcttgaacctagtgaaggtaagataaagcacagtggcagaatctcattctgttctcagttcagctggattatgccagggactatcaaggagaacataattttcggcgtgtcttatgatgaataccgatatcggagcgtgataaaggcctgtcagcttgaggaggatatcagcaaatttgcagaaaaggacaacattgtcttgggcgaggggggcattacactcagcgggggacagcgagcccggatttccctggcgagggctgtctacaaagacgcagatctgtacctcttggacagcccattcggatacctggatgtcctcactgaaaaggagatatttgagtcctgtgtgtgcaaactgatggcgaacaaaacccggattcttgtcaccagtaagatggagcacttgaagaaagcggataagatcctcatcctccatgaagggtctagctacttttatggcacgttttctgagctgcagaatctccagcctgatttttcaagcaaactcatggggtgcgactcttttgaccagttttctgctgagagacgcaattcaatattgactgagacactgcaccgcttctccctggaaggtgacgcccccgtctcatggaccgaaaccaaaaagcaatctttcaagcagactggcgaattcggcgagaagcgcaagaatagcatcttgaaccctattaacagcattcgcaagttcagcatagtgcaaaagacacctctgcagatgaatggtatagaagaggactccgatgagcccctggagagaagacttagccttgtgcccgattccgagcagggggaagcgattctgcctcggatttccgtgatctctacgggcccaacactccaggccagaaggagacaatctgtgctgaacctgatgacacattccgtgaaccaggggcagaatatccaccgcaagaccaccgcctccacccgcaaagtttctctggcaccccaggcgaatctgaccgagctggatatctactctcgcagactctcacaggagaccggcctggagatttctgaagaaatcaatgaggaagatctgaaagaatgtttcttcgacgatatggaaagcatacccgccgtcacgacctggaacacatatctccgatacatcacggtgcacaagtctctcatcttcgtactgatatggtgcctggtcatttttctggcagaagttgcagccagccttgtcgtcctttggcttctgggaaacaccccactccaggataagggaaattccacacattccagaaacaactcttacgctgtgatcatcacctccacctcttcttactacgtgttttatatatacgttggggtggccgataccctgctggccatgggattcttcaggggtctgcccctcgtccatacgcttatcactgtgagtaagatcctgcaccataaaatgctgcacagcgtgcttcaagcacccatgagcactctcaatacactgaaagcgggcggcatcctgaaccgattctccaaagatattgcaatactggacgacctgcttccccttacaattttcgattttattcagctcctgcttatcgtgatcggagccatagctgtggtggccgttctgcagccgtatatctttgtggctacggtccccgttattgtcgctttcattatgttgcgggcgtatttccttcaaacatctcaacagctcaaacagttggagtcagagggtagatcaccaattttcacccatctggttacctcactcaaggggctgtggacacttcgcgcctttggtagacagccatactttgaaacgcttttccataaagctctgaatttgcacacggcaaattggtttctgtacctgtcaaccctgaggtggtttcagatgcggatcgagatgatctttgtaatcttctttattgccgtaacctttattagcatcctgacaactggcgagggcgagggcagggtcggaataatcctgactctcgccatgaatatcatgtcaacactgcagtgggctgtcaatagcagcattgacgtggatagcctgatgcggagcgtgagcagggtcttcaagtttattgatatgccgacggagggtaagccgactaaatccaccaaaccatataagaatggccagctgtctaaggttatgattattgagaacagtcatgtcaagaaggacgacatttggcctagcgggggacagatgaccgttaaggacctgacagctaagtacaccgaaggagggaacgcaatcctcgagaacattagtttcagcattagtccaggccagcgggtgggcctgctgggcaggaccgggagtggaaaatcaactctcctctcagcattcctgcgcctgctcaacaccgaaggagagatccagatcgatggagtttcttgggattctatcacacttcagcagtggcgcaaggccttcggagtcattccccagaaagtgtttatcttctccggtacattccgaaagaacctggatccctacgaacagtggtctgaccaggaaatctggaaagtggcagacgaggtgggcctccgaagtgtcatagagcagtttccaggtaagctcgattttgtacttgtagatggtgggtgtgtgctgtctcacggtcataagcagcttatgtgcttggctcgctcagtgttgtcaaaagccaaaatcctgctgctggatgaaccctctgcgcatttggatcctgtgacctaccagatcatcaggcggacattgaaacaggcgttcgccgattgtaccgtgatactttgcgagcatcggatcgaggctatgctggagtgccagcaattcctggtgatcgaagaaaataaagtgcggcagtatgactctatccagaagctgctgaatgaaagaagtcttttcaggcaagccatcagtccaagcgaccgggtgaaactctttcctcatcggaacagcagtaagtgtaaatcaaaacctcagattgctgctttgaaagaggagacagaagaagaggtgcaggatacacgcctc

SEQ ID NO: 10139 - DNA, 4440 bp, Artificial Sequence
  Description of Artificial Sequence: Synthetic coding sequence
atgcaaaggtcccccctggagaaggcaagcgtggtcagtaagctatttttctcttggactagacccatccttaggaagggatatcgccaacggttggagttgagcgacatataccagataccgagcgtggattccgctgataatctgtccgagaagctagaacgggagtgggacagggagcttgcttcaaagaagaaccctaagctgatcaacgctctacggcgttgcttcttctggagatttatgttctatggaatatttctctatctgggcgaagtgaccaaagccgtccagcctctacttctcggccggataatagcatcctatgacccggacaataaggaagagagaagcattgcaatttatttaggtatcggactgtgtctcctgttcatcgtgcggaccttactcctgcatcctgcaatctttggcctgcatcacattgggatgcagatgaggatagccatgttctctctgatctataagaagacactcaagctcagctccagagtgctcgacaagatctcaataggtcagctggtgtccctcctgtcgaacaacctgaacaaattcgatgaggggctggctctcgctcattttgtatggatagctccactgcaagtggctctactcatgggattgatctgggaactgctacaggcaagcgccttttgtgggcttgggttcttaatagtcttggccctgttccaggcaggcttgggacgaatgatgatgaaataccgggaccaaagggcgggaaagatctcagagcggctggtcatcacaagcgagatgatcgagaatattcagtctgtgaaggcatactgttgggaagaggctatggaaaaaatgattgaaaatctcaggcagacagagctgaagctcaccagaaaagcagcatacgtgagatacttcaatagcagcgctttcttctttagtggatttttcgttgtgtttttgtcagtgctaccatatgctctcataaaaggaatcatcctgcgaaagattttcacgacgatatctttttgcattgtgctccgcatggcagtgacccgtcagtttccctgggccgtccagacctggtacgacagcctcggggctattaacaaaatacaagattttctgcaaaaacaagagtacaaaacactggagtacaatttaacaaccactgaggtggtgatggaaaacgtgacagccttttgggaggagggctttggtgaattgttcgagaaggcaaagcagaacaataataatagaaagacatcaaacggagatgattctctgtttttctctaacttcagtctactcggcacaccagtcctgaaagatatcaactttaagattgagcgcgggcagctgctagccgtcgctggtagtacaggcgcagggaaaaccagtctgctgatggtgattatgggagagctagaacctagcgagggcaaaatcaagcatagcgggcggatctcattctgctcccagttctcttggattatgccaggtaccattaaagagaatatcatattcggggttagttacgacgaatacagataccgttcggtcattaaggcctgccaattggaggaagacatttccaagttcgcagagaaagacaacatagtcttaggagaaggggggattacactgtccggaggacaacgtgctcgtatatctctggctagagccgtctacaaagacgccgatctgtatcttcttgacagtccctttggctacctcgatgttttgaccgagaaggagattttcgagtcttgtgtgtgtaaattgatggcgaacaagaccaggattctcgttacttctaagatggaacacctgaagaaagccgataagattctgattttgcacgaaggctcatcttacttctacggaacctttagcgaactgcagaacctccagccggacttcagtagcaagctaatggggtgtgacagcttcgatcagttctcagctgagcgccgcaacagcatactgactgagacattacatagatttagcctggaaggcgatgctcccgtctcctggaccgagactaaaaagcagtcctttaaacagacaggtgagttcggcgagaagcggaagaactccatcctaaaccctattaacagtatacgcaaatttagcatcgtgcaaaagactccacttcaaatgaatggcattgaggaagattccgacgagcccctggaacgtagactgagtctggtgccagatagcgagcagggcgaggcaattctcccaagaatatctgtcataagcaccggacctacattgcaagccagacgtcgccagagcgtgctcaacctgatgacccactccgtcaatcagggccagaacatccaccggaagaccacagcatccacccgaaaagtttccctggcaccccaggccaatctcaccgagctcgacatatacagcagacggctctcccaggagaccggacttgagatatcagaagagataaacgaagaagacctcaaagagtgtttcttcgacgatatggaaagcatacccgcagttaccacgtggaacacgtacctacggtacatcacggtacacaagagccttatctttgtactgatctggtgtctggtgattttcctggctgaggtcgctgcttccctcgtggtcctgtggctacttggcaatactcctctacaagataaaggtaattccacccactctcgaaataactcctatgcagttatcataacctcaaccagcagttactatgtgttttacatatatgtgggtgttgccgatacgctgctggctatgggcttttttagaggactccctctggtgcatacactcatcacagtttccaagatactgcatcacaaaatgttgcattccgtcctgcaggcccctatgtccaccctgaatacacttaaggccgggggtatccttaatagattctcgaaagacatcgccatattggacgatctgttacctctgacgattttcgacttcatccagctgctgctaatcgtgattggtgcaatcgctgtggtggccgtcctccagccatacatctttgtggccactgtgccggtcatcgtagcgtttattatgctcagggcctatttcttgcaaacctcccagcagctgaagcagttggaatcagaagggaggtcccccatattcacgcatctggtaacaagtctcaaagggctttggacccttcgagcattcggccgacagccctacttcgagacgttattccacaaggcactgaacctgcatacagccaattggtttctgtatctgagtaccttgagatggtttcagatgcgaatcgagatgatattcgtcatcttctttatagccgtcaccttcatctccatactcaccaccggagagggtgaaggccgcgtaggaatcattctgacgctggccatgaacattatgagcactctgcagtgggctgtaaacagttcaatcgacgtggattccctgatgcggtctgtgtcgcgggtgtttaaattcattgacatgcccactgaggggaagcctacaaaaagcacaaagccctacaagaacggacagctgtccaaagtcatgataatcgagaatagtcacgtgaagaaggacgatatttggccatcaggaggacaaatgacagtgaaagatctcactgcgaagtatactgaaggaggtaatgcgatcttagagaacatatcattctcaatttcaccagggcaacgcgtgggactgctggggcggactggctctgggaaatcaacgcttctatccgcttttctgaggcttctgaacactgagggggaaatacaaatagatggagtgtcttgggactctattacactccagcagtggcgtaaggcatttggagttattcctcaaaaagtcttcatcttttccgggacattcagaaagaaccttgatccatacgaacagtggagcgaccaggaaatttggaaagtcgctgacgaagtcggactgcgctccgtgatcgaacaatttcccggcaagttagattttgtcctggtcgacggcggttgcgttctgtcccacgggcacaagcagctgatgtgcctggctcgctctgtgctatccaaagctaagatcttgttgcttgatgagccctccgcccaccttgatccagtgacttaccagattatcagacgcacgctgaaacaggcgttcgctgattgcacagtaattttgtgcgagcatcggatagaggccatgctggagtgccagcagttcttagtgatcgaggaaaataaggtgaggcagtatgactctatacagaagttactgaacgagcgctctctatttcgacaggctatcagtccttccgaccgcgttaagctttttccccatcgcaactcttctaaatgcaaatccaagccacaaattgcggccctcaaggaggagacagaggaggaggtgcaagacacacggctc

SEQ ID NO: 10140 - DNA, 4440 bp, Artificial Sequence
  Description of Artificial Sequence: Synthetic coding sequence
atgcagagatcaccactggaaaaagcatccgtggtatcaaaactcttcttcagttggacgaggcccatccttagaaaaggttacagacagcggttggagctctccgacatatatcagattcccagcgtagattccgcggacaacctctccgaaaagttggagagagaatgggaccgcgagctcgcatctaagaagaatccaaagctgattaacgccttgaggcgctgcttcttctggcgatttatgttttatggcattttcctgtacctgggagaggtgaccaaggccgtgcagccattactacttggtcggattattgcaagctatgacccggacaataaggaagagcgatcgatcgccatttacctgggcatcggactatgcctgctttttatcgtgcgaactctacttctgcacccagccattttcggactacatcatatcggaatgcagatgaggatagctatgttctcgttaatctacaaaaagacactcaagctcagctcccgggtcctggataagattagcataggccaattggtaagtctgttaagtaataacctcaacaaatttgatgagggtcttgctctcgcccacttcgtttggatcgctcctctccaggtggctctgttaatggggctgatctgggagcttttacaggcttctgccttttgcggattgggtttcctgatcgtgctggctttgttccaggccggcctgggtcggatgatgatgaagtatcgcgaccaaagagcaggcaagatctcggaacgtcttgtcataacgagtgagatgatcgaaaacatccagtcggtgaaagcctattgctgggaagaggctatggagaagatgatcgaaaacctacggcagaccgagctgaaactcactcggaaggctgcgtacgtgagatattttaactcatccgcattctttttcagcggattcttcgtggtatttctgagcgtcctgccctatgcattgattaagggaatcatcctgcggaaaatcttcaccaccatatcgttttgtattgtgttgcgtatggcagtgacccgtcaattcccctgggcagtccagacatggtatgattcacttggggcaatcaataagatccaagattttctgcaaaagcaagagtataagactctcgaatacaatttgactaccaccgaagtggtcatggaaaacgtgaccgctttctgggaagagggattcggtgaacttttcgagaaagccaaacagaacaataataatagaaagacatctaacggtgacgactctctcttcttttcaaatttctccctgttgggcacacccgtgctgaaagacataaactttaaaatcgaaaggggccagctgctggcggtagccgggtccacgggggctggtaaaacgagcctgctgatggtgatcatgggagaactggaacctagcgaaggaaaaattaaacattcagggcgcatatcattttgtagtcaattttcctggatcatgcccggaactattaaggagaatataatatttggggtctcttacgatgaatatcgctacaggagtgtcattaaggcctgtcaacttgaggaagacatttccaagttcgccgagaaggataacatcgtcctcggagaaggtggcataaccctgtctggcggtcaaagagccagaatctcactcgccagggccgtgtataaagacgccgacctttatcttttagatagccccttcgggtatctggacgtactaacagagaaggaaatttttgagtcctgcgtttgcaaactgatggcgaacaaaactcgaattctggtgaccagcaagatggagcacctgaaaaaggctgataagatcttgatcctccatgaaggttccagctacttctatggaacattctccgaactccagaacctccagcccgacttcagttcaaaactgatgggatgtgattcttttgatcagttttccgcagaacgcaggaattcaatcttaactgagacactgcacagattttcactggaaggcgatgcaccagttagctggaccgaaaccaagaaacagtctttcaaacagaccggggagtttggtgaaaagcgcaaaaattctatacttaatcccattaattctattcggaagtttagcatcgtgcagaagacgccactgcagatgaacgggatagaagaggatagcgatgagcctttggagcggaggctaagcctcgtccctgattctgagcagggagaagccatccttcctagaatctcagtgatatccacaggaccgaccctgcaggctcgtcgcaggcagagtgttctgaaccttatgactcattctgtgaatcaaggtcaaaatatacaccggaagaccactgcaagtactagaaaggtatccctagctcctcaggccaacctgacagaactagatatttattctcgtcgcctcagccaagaaaccggcctggaaattagtgaagaaataaacgaggaggatctcaaagagtgttttttcgatgatatggaatccatccccgcagttaccacctggaacacttacctgaggtacataaccgtccataagagtctgatcttcgtgttgatttggtgcctcgtgattttcctggctgaggtggccgcttccctagtcgttttgtggctcctgggcaacacgcccctgcaagataaaggcaactcgacgcactccaggaataactcctacgccgttattattacctcgacaagttcctattatgttttttatatttacgtgggggtcgccgacaccctgcttgccatgggattttttaggggtctgcccctcgtccatactctgataacggtgtcaaagatcctccaccacaaaatgctacactctgttcttcaggctccaatgtccacactcaacactctcaaagccggagggatactcaatcggttctcaaaggatattgcaattctggatgatctcctccctttgacaatctttgacttcatccagctcctactgatcgtgatcggagcgattgcagtagtcgccgtacttcagccatacatctttgtggctaccgtgcctgtgatagttgcatttatcatgctgagagcttactttctgcagactagccagcagttgaagcagctcgaatcagagggacgcagccccattttcacacacctcgtaacgtcactgaaaggcctgtggacccttcgggccttcggaaggcagccctacttcgagactctcttccataaagccctcaatctacataccgcaaattggttcctgtatttgagcactctccggtggtttcagatgaggatcgaaatgatcttcgtgatcttcttcatcgctgtgaccttcatttccatcctcaccaccggtgagggcgagggtagggtggggattatattgacgttggccatgaatataatgtctaccctccagtgggccgttaactcatccattgacgtggacagtctgatgcgttctgtgtcacgggttttcaagtttattgatatgcctacagaaggcaaacctaccaagtccacaaagccctataagaacgggcagctaagcaaagtgatgataattgagaacagtcacgtgaagaaggacgatatatggccctcaggcgggcagatgacagtaaaagatttgaccgccaaatacactgagggcggcaacgccatcctggaaaacatcagcttttctatatcgcctgggcagcgcgtggggttgctgggccgcactggctcaggcaaatctaccctgctatcagctttcctaaggcttctgaacaccgaaggggagattcagatcgacggagtgtcctgggactctattaccctgcaacagtggcggaaggctttcggcgtgatcccccagaaggtcttcatcttttccgggacattcagaaagaacttagacccttatgagcagtggtcggaccaggagatttggaaagtagctgatgaagttggactgagatcggtgatcgaacagtttccagggaagctggactttgttctggtagatggaggctgtgtgttgtcacacgggcacaaacagttaatgtgcttagccaggtccgtgctgtcaaaggccaagatactgttattggacgagccgagcgcacatctggatcctgttacataccagatcataaggagaacactgaaacaggcattcgccgattgcacagtgatcctgtgtgaacatcgaatcgaagccatgttggagtgtcagcagtttttggtgattgaagaaaacaaggtgcgtcagtatgacagtatccagaaactgctgaacgagcggtcacttttccggcaagccatatcgccttcagacagggtgaaattattcccacataggaacagctcgaagtgtaaatctaagccacagattgctgctctgaaagaagaaacagaggaagaagtgcaggacaccagactg

SEQ ID NO: 10141 - DNA, 4440 bp, Artificial Sequence
  Description of Artificial Sequence: Synthetic coding sequence
atgcagaggagccctctcgagaaggcgagtgtcgtgtctaaactcttcttcagctggacaagacctatattgcgaaagggctaccgtcaacggctggagctctccgatatataccagattcctagcgtggactctgccgacaacctcagcgaaaaactggagcgggagtgggatcgcgaactggccagtaagaaaaacccgaaactaattaacgctctgagaaggtgcttcttttggcgcttcatgttttatgggattttcttgtacttgggagaggttaccaaagctgttcaacccctgttactgggccggatcattgcatcctacgaccccgacaataaagaggagagatccattgccatctacctggggatcgggctctgtctgctgtttatcgtcaggacgttgcttctgcatcccgccattttcggcctgcaccatattgggatgcagatgcgaatcgcaatgttctctcttatctacaaaaaaacattaaagttgagctcccgcgtcttagacaagatctcgatagggcagctggtgtcattgctgagtaacaatttaaacaaattcgatgaaggcttggccctggcacattttgtgtggatcgctcctctgcaggtggcactgctcatgggcctgatctgggaactgctgcaggcgtctgcattttgtggtttgggtttcctgattgttctggctcttttccaggcaggattggggaggatgatgatgaaatacagggatcaacgcgctggcaagatttctgagcgtttggttattaccagtgagatgatcgagaacattcaaagtgtgaaggcctattgttgggaagaggctatggagaagatgatcgagaaccttaggcagactgagttaaaattgacgcggaaagctgcctacgttagatacttcaattcgtctgcattcttcttcagtggattttttgttgtcttcctctcagtgcttccatacgcactgattaaagggatcattctcaggaagattttcacaaccataagtttttgtatagtgctccgaatggccgtgactaggcaatttccatgggccgtgcaaacatggtacgattcccttggcgctatcaacaaaatccaggacttcctgcagaaacaggaatataagacattggaatacaacctgacgacgactgaggtggtcatggaaaacgtgaccgctttctgggaggaagggttcggcgagctgtttgagaaagccaagcagaataataacaatcggaaaacgtctaacggagacgattcacttttcttttccaattttagcttgttgggtacacccgtcctgaaggacattaacttcaaaatagagcggggacaactgctggccgtggcgggtagcacgggggccgggaagacaagtcttttgatggtgattatgggtgaactcgagccttccgaagggaagatcaagcattccgggcgaatttcattttgctctcagttcagctggatcatgcccgggacgatcaaggagaatatcatctttggcgtgtcatacgacgaatatagatacagatcggtaattaaggcctgtcagctggaggaagatatatctaagttcgccgagaaggataacattgttctgggcgagggcggaatcaccctgagcggggggcagagagcgcgaatttctttagccagagcagtttataaagatgcagacctgtacctcttagactctccatttggctatctggatgttcttacggagaaggagatcttcgaaagttgcgtttgtaagctgatggccaacaagacaaggatcctcgttactagtaaaatggaacatctgaaaaaggccgacaagatcctcatcctgcatgaaggatcctcgtacttttacggcaccttcagcgaacttcagaatctgcagcccgactttagcagcaagctgatgggctgcgattctttcgaccagttcagcgccgagcgtcggaactcaatcctcaccgagacacttcacagattttcactggagggcgacgcccctgtctcgtggaccgagacaaagaaacagtcctttaaacaaactggcgaattcggagagaagcgaaagaactcaatcttgaatccaattaacagtatccgaaagttcagcatagtccagaaaacccctctgcagatgaatggcatcgaagaggattccgatgaacctctggagcggaggctgtcactggtgcccgactccgaacagggcgaggccatcctgcccaggatcagtgtgatcagtacagggccaacccttcaggcgaggcggagacagtcagtgctcaatttgatgacccatagcgtgaatcaaggtcagaacatccacaggaaaaccaccgcaagtactaggaaggtgtccctcgcgccacaagctaatctgacagaattagatatttacagtaggcggttgtctcaggaaactgggcttgagatttctgaggagataaacgaggaagatcttaaagaatgcttttttgacgacatggagtccatcccggcagtgaccacttggaatacttatctgcgctacattaccgtccataagtccctgattttcgtacttatatggtgtttggtgatattcctggctgaggtagccgccagcctggtggttctttggctgctgggaaataccccactgcaggataaaggaaacagtacacactccaggaacaatagttacgcagttatcattacttccacgtcctcatactatgtgttttacatctatgtgggagtggcagacaccctgctggccatgggtttctttcgtggcctccccttggtacataccctgatcacggtgagtaaaatcctgcaccataagatgctccattccgtacttcaggcccccatgagtacacttaacaccctgaaggctgggggcatccttaaccgttttagcaaagacattgcgatcttggacgatttgttgcccttgacgattttcgacttcattcagttgctgctgatagtcataggggccatcgctgtggtcgcagtgctgcagccctacatctttgtggccactgtgcccgtgatcgtggcgttcattatgctgcgggcctacttcctgcaaaccagtcagcagctcaagcagctcgagtccgaaggcaggtcacccatctttactcatctggtgacttccctgaaaggactgtggacacttcgagcgtttggcaggcaaccctattttgagaccctgttccacaaagctcttaacctgcacaccgccaattggttcctgtacctgtcaacccttaggtggtttcaaatgcgcatcgaaatgatcttcgtcatattcttcatcgccgtgacattcataagcatcttgacaacgggagaaggggagggcagagttggcattatcctgactctggctatgaatattatgtctactttgcagtgggctgtgaacagttccattgatgtagattccttgatgaggtccgtctctcgggttttcaagtttattgatatgccaactgaagggaaaccgacaaaaagtacgaagccttataagaatggccaactgtccaaagtcatgatcatcgagaactcccatgtgaagaaagacgatatatggccatctgggggacagatgactgtgaaggatctgacagcaaagtatactgaaggcggaaatgcgatcctggagaatattagcttctctatatcccctggccagcgggtgggactgctcggccgcacaggcagtggcaagagcaccctcttatcagcgtttctgcgccttctgaacactgagggggagatccagattgacggcgtcagctgggatagtatcacactgcagcagtggcggaaggccttcggcgtgattccacagaaggtctttatcttctcgggtaccttccgcaaaaaccttgatccttatgagcagtggtctgaccaagagatatggaaagttgccgacgaggtgggcctcagaagcgtgatcgaacagttcccaggtaagctggattttgtgctggtcgatggtggatgtgtgctttcacatggccataaacaacttatgtgtttagctcgctccgtcctgtcaaaggctaagatcctgctgcttgatgagccttccgcccacttggatcccgtaacgtaccagattattcgccgcaccctaaagcaggcatttgccgactgcactgtgattctgtgtgagcataggattgaagccatgctcgaatgccagcagtttcttgttatcgaggagaataaggtccgccagtatgattccatccaaaaactccttaatgaaagatccctattcagacaagcgatttctccatctgatagagttaagttgtttccacatcggaactccagtaaatgcaaaagcaagccgcagattgccgctttgaaggaagagacagaggaggaagtacaagacaccagactt

SEQ ID NO: 10142 - DNA, 4440 bp, Artificial Sequence
  Description of Artificial Sequence: Synthetic coding sequence
atgcagcgttctccactggagaaggcctcggtagtgagtaagcttttcttttcttggaccagaccgatcctaagaaagggttatcgccagcgcctggagctgtcggatatctaccaaataccatcagtggatagcgctgataatttgagcgaaaaacttgagcgtgagtgggacagggagttggcgtctaagaagaacccgaaattgatcaacgccctccgtcggtgtttcttttggcgtttcatgttctatggcatttttctatacctgggagaagttacaaaggcagttcaaccgttgttgctcggccgaattatcgcttcgtacgatccggataataaggaggaacgatcgattgctatttacctggggataggcctttgtttgctgttcattgtgagaacccttctgctccacccagctatttttggcctgcatcatattggcatgcaaatgagaatcgccatgttctctctgatttacaagaaaacgcttaagttgagctctagagttttggataagatctccatcggccagctcgttagtcttttgtctaacaacttgaacaaattcgacgaaggcttggctctagcccactttgtctggattgctccgttgcaggttgctctgttgatgggccttatttgggaattgttgcaggcgagcgcgttctgtggactcggcttcctgattgttttagctctattccaggccggtttgggacgcatgatgatgaagtatcgggaccagagagcaggcaagattagcgagcgcctcgtgatcacgagtgaaatgatcgaaaatatccagtctgtaaaggcctattgttgggaggaggccatggaaaaaatgattgaaaatcttaggcagacggagttgaagctgactcgaaaggcggcgtacgtaagatacttcaatagttcagcgttctttttctcaggtttcttcgttgtgtttcttagcgtacttccctatgctcttataaagggaatcatcctacgcaaaattttcaccaccatatcgttctgtattgtgctacgtatggcagtgacgcgccagtttccttgggcggttcagacgtggtatgactctcttggtgcaattaataaaatccaggacttccttcagaaacaggaatataaaaccttggaatataatctgaccaccactgaggtagtgatggagaatgtaactgcattctgggaggagggattcggagagctcttcgagaaggcgaagcagaacaataataacagaaagacatcaaatggcgatgattctctgttcttcagcaatttttcgctcttgggtacgccggtactcaaagacatcaactttaagatcgaacgagggcaacttctcgcagtagccggatcaaccggtgccggcaaaacgtcgctgttaatggttatcatgggcgagctagagccctcggaggggaagatcaagcattctggtcggatcagcttctgctcccagttcagctggataatgcctgggacgataaaagaaaatattattttcggggtctcgtatgatgagtaccgataccgctcggttatcaaagcctgtcaactcgaagaagatatctcaaagttcgccgagaaagacaatattgtattgggggagggtggaattactctgagtggagggcaacgtgcacggatatctctcgctcgggcagtgtacaaagatgcggacctctatcttttggatagccccttcggctatctggatgttctaacggaaaaggagatattcgaatcttgcgtctgtaaactgatggctaacaagactcgtatcctggtcacaagcaagatggaacatctcaaaaaggcggataagattctcattttacatgagggctcttcatacttctatggtacgttctctgaactgcaaaatctgcagcccgacttctcaagcaaactgatgggctgcgactccttcgaccaattctccgcagagcggaggaattccatcctaaccgagacacttcatcggttttctctggaaggggatgccccggtctcctggacggagacaaaaaaacagagtttcaaacagacaggcgagttcggtgagaaaaggaagaatagcatcctcaatccaattaattcaatccgcaaattctcgatcgtccagaagacaccactccagatgaacggtatcgaagaggattccgacgaacccctcgaacgcaggctgtccctagtgccagacagcgaacaaggtgaagccatattgccccgaatttcggttatcagtacgggtccaaccttgcaagctcgacggagacagtcggtcctaaatttgatgacccactcagtcaatcagggacaaaacattcatcgcaagactacagctagtactcggaaggtttccctcgctccccaggccaatctaaccgagcttgatatctacagtaggcggttgtcccaagaaaccggcctggagatttctgaagagattaacgaagaggatctgaaagagtgcttctttgacgacatggagagtatccctgcagttaccacttggaacacataccttagatatatcacggtccataagagcttgatcttcgtcttgatttggtgcctagtgatcttcctggcggaagtggccgcctccctcgtggtcctgtggctcctcgggaatacacctctccaagacaaggggaattctacacactcacggaacaattcctacgccgtgatcatcacatccacgtcgtcctactatgtgttctacatctacgtaggagtcgcagatactctactggcaatgggtttctttcgcggtcttcctctggtccacacactgataacggtgtctaagattctccatcacaaaatgctgcactcagtcctccaagcgcccatgagcaccttgaacactcttaaggccggtggtatcctgaatcggttctcgaaagacattgccattttggatgacctactaccgcttactatcttcgattttattcagctcctgctgatcgtaatcggcgcaatcgccgtagttgctgtccttcaaccatatatcttcgtggcaacggtccctgttatcgtggcgttcatcatgctccgcgcctatttcctccagacaagtcaacagctgaaacagcttgaatccgaggggcgatctcccatcttcactcacctggtgacgtccttaaagggactgtggacattacgtgcgttcggccgacagccgtatttcgagaccctgttccataaggcacttaatctgcatacagcaaattggtttctctatctttccacgctgcgttggttccaaatgcggatcgaaatgatttttgtcatctttttcattgccgtgacattcatatctatacttaccacaggagagggggaggggcgtgtcggcattatcttgactttggcgatgaatataatgtcaacgctccagtgggctgtcaatagttcaatcgatgtcgactccctaatgcgctcagtgtctcgggtatttaagtttattgacatgcctactgaaggaaagcctactaaaagcacaaagccctacaaaaacggacaactgagcaaggtcatgatcattgagaactctcatgtgaagaaagatgatatttggcctagtggtggtcaaatgaccgttaaggacttaaccgctaagtatactgaaggcggaaacgccatcctagagaacatttcattctcaatcagcccaggtcagcgcgtcggcctcctagggcgcactggtagtggcaaatcgacacttttatccgcttttctcagactacttaacactgagggcgaaatccagatagacggcgtctcctgggatagcatcacgttgcaacagtggaggaaggccttcggtgtcatcccacaaaaggtcttcatattcagtggtacttttcgcaagaacctggatccatacgagcagtggtcggaccaggagatatggaaagttgccgatgaggtgggtctccgtagtgtaattgaacagtttcccggaaagcttgacttcgtgctcgtcgatggaggatgtgtgctgtcccacggccataaacaactcatgtgcctggctcgtagcgtcctgtcgaaagcaaaaatcctactgttggacgaacccagcgctcatttggatcccgtgacttaccaaattatcagacgaacccttaagcaagcttttgctgattgtaccgtcatactgtgcgaacaccgcatagaggccatgttagagtgccaacaatttctggtgatcgaggaaaataaggtgcgccagtacgattccattcagaaacttctgaacgaacggtccctcttccgacaagctatctctccatcagacagagtcaaactctttccgcaccgaaacagttctaagtgcaagtctaagccgcagatagcggccctgaaagaggagacagaggaggaagttcaagacacgagactc

SEQ ID NO: 10143 - DNA, 4440 bp, Artificial Sequence
  Description of Artificial Sequence: Synthetic coding sequence
atgcagcggtcaccgctggaaaaggctagcgtcgtgtccaaattgttcttttcgtggactcgtccgatactgcggaaggggtatcggcaacgcctcgagttgagtgacatctaccagatcccaagcgtcgattccgcagacaacctgtcagagaaactggaacgggaatgggatcgcgagctggcgtccaagaagaatcccaagctcatcaacgcattgcggcgctgctttttctggcggttcatgttctacggcatctttctctacctgggagaggtcaccaaagcagtccagccccttctgcttgggagaatcatcgcgtcgtacgacccggacaataaggaggaacggtcgattgcgatctacctggggatcggattgtgccttctcttcattgtgcgcaccctgttgctgcatccagccatctttggactgcatcatatcgggatgcagatgcggatcgcgatgttctccctgatctacaagaaaacgctcaaactgtcaagccgcgtcctggacaaaatctccatcggccaattggtgtcgttgctgtctaataacttgaataagtttgatgaaggactcgcactcgcccactttgtttggatcgccccacttcaggtggcgctgctgatgggattgatctgggagttgctccaagcctccgccttttgtggtctgggctttctgatcgtgctggcactgttccaagcgggacttggcagaatgatgatgaagtaccgggaccaaagggccgggaagatttcggagcggctcgtcatcacctcggagatgatcgaaaacatccagtcggtgaaggcctactgctgggaggaggccatggagaagatgatcgagaatctgaggcagaccgagctgaagctgaccaggaaggccgcatacgttagatacttcaactcatcagccttcttctttagcggttttttcgtggtgttcctgtcggtgctgccgtacgccctgattaagggtatcatactccgcaagatcttcaccaccatctcgttttgcatcgtgctgagaatggccgtgacccggcagttcccgtgggcggtccagacctggtacgacagcctcggagccattaacaaaatccaagatttcctgcagaagcaagaatacaagaccctggaatacaatctgaccaccactgaagtggtgatggagaatgttactgcgttttgggaagagggattcggcgagctgtttgagaaggcgaaacagaacaacaataatcgaaagacttctaacggcgacgattccctgttcttctccaactttagcctgctcggcaccccggtcctgaaggacatcaacttcaagattgaaaggggacaattgctcgctgtggctggcagcaccggcgccggaaagacttctctcctgatggtgattatgggagagctcgaaccgtccgaaggcaagatcaagcactcaggtcggatctccttctgttcccagttcagctggattatgccaggaactatcaaggaaaacatcatcttcggagtgtcctacgacgaatatagataccggtcagtgattaaggcctgccagcttgaggaggacatcagcaagttcgcggaaaaagacaacatagtgctgggggaagggggcatcaccctgtcgggaggacagcgcgcccgaattagcctggctcgcgcggtttacaaagatgccgatctgtacctgctggactcgcctttcggctaccttgacgtgctcaccgaaaaggagatatttgaatcctgcgtctgtaagctcatggccaacaaaactagaatccttgtcactagcaaaatggaacacctgaaaaaagcggacaagatcctgatcctgcatgagggtagctcctacttctacggaaccttctcggagttgcagaacctgcagccggacttctcgtcaaaacttatgggatgcgactcatttgaccagttctcggcagaacggagaaactcaattcttaccgaaactctgcaccggttcagcttggagggagacgcgccagtctcctggactgaaaccaagaagcaatccttcaaacagactggagaatttggggagaagagaaagaactccatcctgaatccgatcaactccattcggaagttcagcattgtgcaaaagactcccttgcagatgaatggaatagaagaggactcagacgaacccctggaaaggagactctcactcgtgcctgactcggaacaaggcgaggcgatcctgccacgcatttcagtcatctcaactggaccaaccctgcaggcacgccgccgtcagagcgtcctgaatctgatgacccactcagtgaatcaaggacaaaacatccatagaaagaccactgcctcgacgcgtaaagtctcgctggccccccaagccaatctgaccgagctggacatctactcgcgacggctttcccaggaaaccggattggagatcagcgaagaaatcaacgaagaggacctcaaggaatgttttttcgatgatatggagtccattcctgcagtgactacgtggaacacgtatctccgctacatcaccgtccacaagtctctcatcttcgtacttatctggtgccttgtgatcttcctggcagaagtggcggcgtccctcgttgtcctgtggctcctcggaaacactccgctccaagataagggcaactcgacccactcgcggaataacagctatgctgtgatcattacctcaacttcgtcatactacgtcttttacatatacgtcggcgtggctgataccctgctggcgatgggattcttccgcggcctgccattggtgcacacgctcattactgtgagtaagattttgcatcacaagatgttgcactcagtgctccaggcaccgatgtcaacgctgaatacgttgaaagccggcggaatcctgaacagattctcgaaggatatcgccattcttgacgatctcctgcctctcactatcttcgacttcatccagctgctcttgatcgtgatcggcgccatcgccgtggtggcggtgctccaaccatacatctttgtggcgactgtgcccgtgatcgtcgcgttcattatgctcagagcgtacttcctccaaacttcacagcagcttaagcaactggaatccgagggacggagcccgatcttcacccatctcgtaacgtccctcaaggggctgtggaccctgcgcgctttcggacggcaaccgtacttcgagactctcttccacaaagcactgaacttgcacaccgcaaattggttcctctatctctcgactctgcgctggttccagatgaggatcgaaatgatcttcgttatcttcttcatcgctgtgactttcatcagtatcctgactactggagaaggagagggacgggtgggaatcatcctcactctggcaatgaacattatgtcgactctccagtgggcagtaaacagcagcatagatgtggactcgcttatgcgctccgtgagccgtgtgttcaaattcattgacatgccgactgagggaaagccgaccaagtccaccaagccttacaagaatggacagttgagcaaagtgatgatcatcgagaactctcacgtgaagaaagatgatatctggccttccggcggtcagatgaccgtgaaagacctgaccgcgaagtacactgaagggggtaacgccatcctggagaacatttcattttccatctccccaggacaacgtgtcggcctgctcggtcggaccggctccggtaaatcgactctgctctcggcctttctgcgcctgctcaataccgaaggtgagatccagatcgacggtgtctcatgggattcgatcaccctgcaacagtggcggaaagccttcggggtgatcccgcagaaggtgttcatcttctcggggacgttcagaaagaacctggatccttacgaacaatggagcgaccaagaaatctggaaagtcgctgacgaagtggggctgcgctcggtcatcgagcaatttcctggaaagctggatttcgttctggtggacgggggatgcgtgctttctcatgggcataagcagctgatgtgccttgctcgctccgtgctttcgaaggctaaaatccttctcctcgacgaaccaagcgcccaccttgatccagtcacctaccagatcatccgcagaacgctgaaacaggctttcgcagattgcactgtgattctttgcgaacaccgaattgaggcgatgcttgaatgtcagcagttcctggtcatcgaagaaaacaaagttcgccaatacgattccatccagaagctcctgaatgaaaggtcgctgttccgccaggccataagtccgtccgatcgcgtgaaactctttccgcataggaactcgagtaagtgcaagtctaaacctcagatcgcagcccttaaggaggagactgaggaagaggtccaagacaccagactc

SEQ ID NO: 10144 - DNA, 4440 bp, Artificial Sequence
  Description of Artificial Sequence: Synthetic coding sequence
atgcagcgtagccccttggagaaggctagtgtggtcagcaagctctttttctcctggactaggccaattctacgtaagggttaccgccagcgcctcgaacttagtgatatttaccaaatccccagcgttgactccgccgacaacctctctgaaaaactagagagggagtgggatcgcgagttggcgtccaagaagaacccgaaactcataaacgcgctccgtcgttgcttcttttggcgtttcatgttctacggaatctttttgtacctgggggaagtgacgaaggcagttcagcctctgctgctcggccggatcatcgctagctacgatccagacaataaggaagaaaggtccatcgctatttacctaggtatcggtctgtgcttgctgttcattgttcgcaccctcttgctgcacccggcgattttcggcttgcaccatatcggaatgcagatgcggatcgctatgttctcccttatctacaaaaagaccttgaagctgtcctcccgtgtgttggacaagattagcatcggacagctcgtctctctgctcagtaataacttgaacaaatttgatgagggactagcactcgcccatttcgtctggatcgctccgctacaggttgccctgttaatgggtctaatctgggagttgttgcaggcttcggcattctgcggtctgggctttctgatcgtcctcgccctcttccaagctggcttgggacggatgatgatgaagtatcgcgaccagcgtgctggaaagatctctgaacgcctggtgattaccagcgagatgatcgagaacatccaatctgtaaaggcatactgctgggaagaggccatggagaagatgatcgagaacctccgtcagacggagctcaagctgaccaggaaggcggcttacgttcggtactttaactcgagcgcattcttcttcagcggcttcttcgtcgtcttcctgtcggtcctgccttatgcgttgatcaagggcattatcctcaggaagatctttactactatctccttctgcatcgtgctgcggatggctgtgactaggcaattcccctgggcggtccaaacctggtatgactcgctgggtgccatcaacaagatccaggatttcttgcagaagcaggagtacaagactttggagtacaacctgaccaccaccgaggtagtgatggagaacgttacagccttctgggaagagggcttcggggagctgttcgaaaaagctaagcaaaacaataacaaccgcaagacctccaacggcgacgatagcctgtttttttccaacttttcattattgggaacgccagtcctaaaggacatcaacttcaagatcgagcggggacaattgctggctgtagctggttctacgggtgccggcaagacatccctgctgatggtcatcatgggcgaacttgagccctctgaaggtaagatcaaacatagtggtcgcatctcgttttgctcccagttctcatggatcatgccgggtacaatcaaggaaaacatcatctttggagtctcctacgatgagtaccggtaccgtagtgttatcaaggcgtgtcagttggaggaagatatcagcaaatttgcggagaaggataacatcgttttgggagaaggtggcattaccctcagcggcggtcagcgtgctcgcatctcgctagcacgggcggtttataaagatgctgatctgtacctcctggactctcccttcggctacctcgacgtcctgaccgagaaggagatcttcgagagctgtgtttgtaaactcatggccaacaagacccggatcctagttacaagcaagatggagcatctcaaaaaagcagacaagatcctcatcttgcacgaaggttcctcttacttttacggcacattcagtgagctacaaaatctccagcctgacttcagttccaaactcatgggctgcgatagcttcgaccagttctcggctgagcgcaggaactcgatcctaactgagacgctccacagatttagccttgagggcgacgctccggtttcctggactgaaacaaaaaagcagagcttcaagcagaccggagagtttggcgagaagcgtaagaactccatactgaatcccatcaactccatccgcaagttctccatcgtgcagaagacccccttgcagatgaacggcatcgaggaggattcggacgaacctcttgaacgtcgcctttcgctcgttcctgacagcgagcaaggtgaggctattctcccccggatctccgtgatttccaccggccctaccctgcaggctcgtcgccgtcagtccgtcctgaacctgatgacccacagcgtcaaccagggacagaacatccatcggaagactactgcttccacccgtaaggtttccctggcaccccaggcaaacctcaccgaactcgacatctactcgcgccgcctttcccaagagaccggactcgaaatcagtgaggagataaacgaggaagacctgaaggaatgcttcttcgacgacatggaaagtatcccagcggtcactacctggaatacctatctccgctacatcaccgtccataagtctcttatctttgtcctgatttggtgccttgtaatcttcctggccgaggtcgctgcctcgttggtggttttgtggctgctgggaaatacaccattacaggacaagggcaactcgacccattctcgaaataactcttacgcagtcattatcaccagtaccagcagctactacgttttctacatatacgtcggtgtcgctgacactcttctggctatgggcttcttccggggtttgcccctcgttcacacgctcatcaccgtcagcaagatcctgcaccacaagatgttgcactccgtgcttcaagcccccatgtctaccctcaacactttgaaggctggcggaatacttaaccggttctccaaggatatagctatcctggatgacctccttcctttgaccatattcgacttcatccaactcttattgatcgtgatcggcgccattgctgtcgtcgccgtgctgcagccatacattttcgtagcaacggtgccagtgatcgtcgccttcatcatgcttcgcgcttatttcctccagaccagccagcaactcaagcagctggagtccgaagggcggtccccgatcttcacacacctcgttacgtcgctcaagggtctatggacgctaagggcctttggtcggcaaccttactttgaaactctgtttcacaaggctttgaacctgcatacggctaactggttcctatacctgtcgaccttgcgctggtttcagatgcgcatcgaaatgatcttcgttatctttttcatcgccgtcaccttcatctcgatcttgaccaccggagagggagagggcagggtcggtattatcctcaccctcgctatgaatattatgagcactctgcaatgggctgtcaactcgagcatcgacgtggactctctgatgcgttctgtcagtcgtgtatttaagttcattgatatgcccaccgagggcaagcccacgaagtctaccaagccctacaagaacggccagctcagcaaggtcatgatcatcgagaacagtcacgtgaagaaagatgacatctggccctcagggggtcagatgaccgtgaaagacctgaccgctaagtacaccgagggcggaaacgctattctggaaaacatttccttttccatctcccctggccaacgcgtgggtctgctaggccgcacgggtagcggcaagtctaccctgctgagtgctttcttgcgcctgctcaacactgaaggtgagattcagatcgatggtgttagctgggactcgatcacgctccagcagtggagaaaggcattcggtgttatcccccagaaggtgttcatcttttccggtaccttccgtaagaacctcgacccgtacgagcaatggtcggatcaagagatatggaaggtggctgacgaggtaggacttcgttccgtcatcgagcagttccctggcaagctcgactttgtcctggtcgacggaggttgcgtgctgtcccacggtcacaagcaacttatgtgccttgcccgtagcgttctcagcaaggctaagatcctcctcctggatgagccttcggcccatcttgaccctgttacctaccagatcattcgccgtaccctgaagcaagccttcgctgactgtaccgtgatcttgtgcgagcaccgcatcgaggccatgctcgagtgccagcagttcctggtgatcgaggaaaacaaagtgcgtcagtacgactccatacaaaagttgcttaatgagcggtctctcttccgtcaggccatctccccttccgatcgggttaagctattcccccaccggaactcgtcgaagtgcaagagcaaaccgcaaatcgctgccctgaaggaagagaccgaggaggaggtgcaggacactaggcta

SEQ ID NO: 10145 - DNA, 4440 bp, Artificial Sequence
  Description of Artificial Sequence: Synthetic coding sequence
atgcaacgaagccccctcgagaaggcttcggtggtgagcaagttgttcttctcctggactcggccgatcctgcgtaagggataccgccagcgccttgagctgtctgacatctaccaaatcccatccgtcgactcggcggacaatctgagcgaaaagctggagagagaatgggaccgcgagctcgccagcaagaagaacccgaaactcatcaatgcgctgcggcgctgctttttctggaggttcatgttttacggcatctttctctacctgggcgaagtgaccaaggcagtgcaaccactgctcctcggcagaattatcgcttcctacgacccggacaataaagaagaaaggagcatcgcaatctacttgggcatcggattgtgtctgcttttcatcgtccggactctgttgctccaccctgctatcttcgggcttcaccacattggaatgcagatgcggatcgcgatgttctcactgatctacaagaaaacgttgaaactgtcaagcagagtcctggataagatctcgatcggacagctggtcagcctcctctccaataacttgaataagttcgatgagggcttggccctggcccatttcgtgtggattgccccgcttcaggtcgctcttctgatgggcctgatctgggagcttctgcaggcctcggctttctgcggtttggggtttcttattgtgctcgcgctgttccaggccggactcggtcgcatgatgatgaaatacagagatcagagggcaggaaaaatctcagagcggcttgtcatcacttccgaaatgattgagaatatccagtcggtgaaggcctactgttgggaggaagcgatggagaagatgatcgaaaatctcaggcagaccgagctcaagctgactaggaaggcggcatacgtccgctacttcaactcatccgcgttcttcttctcggggttcttcgtcgtgttcctctcagtgcttccgtacgccctgatcaagggaatcattctcagaaagatattcacgactatttctttctgcatcgtcctcagaatggccgtcaccagacaatttccatgggctgtccaaacctggtacgattcattgggagcgatcaataagatccaggatttcctccagaaacaagaatacaaaactctcgaatacaatctgactactaccgaagtcgtgatggagaatgtcaccgctttttgggaggaaggcttcggcgagttgtttgagaaggcaaaacagaacaacaataaccgtaagacgagcaacggagacgactccctcttcttctcgaatttctcgctcctcggaactccagttttgaaagacattaacttcaagatcgaacgcggacaactcttggccgtggctggatcgactggggccggcaagaccagcctgctcatggtcattatgggtgaactcgaaccttcagagggaaaaatcaagcattcgggcaggatcagcttctgttcgcaattttcttggatcatgccgggaaccatcaaggaaaacatcatctttggcgtgagctacgacgaataccgttatcggtcggtgattaaggcgtgccagctggaggaagatattagcaagttcgccgagaaggacaacatcgtgctcggagaaggaggaatcacgctcagcgggggacagcgcgccagaatctcactggccagggctgtgtacaaggacgccgatctgtacctgttggactcgcctttcggatacctggatgtcctcactgaaaaagaaatcttcgagtcgtgcgtgtgtaagctgatggccaacaagacgagaatactcgttacctcaaaaatggagcatctcaagaaggctgacaaaatcctgatcctgcatgaaggatccagctacttttacgggaccttcagtgaactccagaacctgcaacccgacttttcgtccaagctgatggggtgcgactcgtttgatcagttttcggccgaacggagaaacagcatcttgactgaaaccctccacaggttttctctggaaggagacgcgcccgtgagttggaccgaaactaagaagcaatcgttcaagcagactggcgaattcggagaaaagcgcaagaattcaatcctcaaccccatcaattccatcagaaagttctcgatcgtgcaaaaaacccccttgcagatgaatggaatcgaggaggattcggatgaaccgctggaacggcgactttccctggtcccggactcggaacagggagaggccatcctgcctaggatctccgtgatctcaaccggaccaaccctccaggcacgccgaaggcaatccgtcctgaacctgatgacgcacagcgtgaaccagggccaaaacatccacagaaagaccaccgctagcactcgcaaggtcagccttgctccgcaggctaatcttactgaactcgacatttactcacgcagactgagccaggagacgggtctggaaatctctgaggagatcaatgaagaggatttgaaggagtgtttcttcgacgatatggagtcaatcccggccgtgaccacttggaacacctacctgagatatatcaccgtgcacaaatcgttgatttttgtgctcatttggtgcctggtcattttcctggctgaagtggccgctagcctggtggtgctgtggctcctgggaaacaccccgttgcaagataaagggaactccacccactcacggaacaatagctacgccgtcatcatcacctccactagctcgtactacgtgttctatatctacgtgggagtggccgataccctgctggcaatgggcttcttccggggactcccactggttcatactctcattaccgtgtccaagatccttcatcacaaaatgctccactctgtgctccaggcaccaatgagcacgctcaataccctgaaggccggcgggattctgaaccggttctcaaaggacatcgctatcctggacgatctcctcccgctcactatctttgactttattcaactgctccttatcgtcatcggagccatcgccgtcgtggcggtgcttcagccatacatctttgtggccactgttccggtgatagtggcattcatcatgttgcgagcctacttccttcagacttcacagcaactgaaacagctcgaatccgaaggacggtcgcctatcttcacccatctcgtgactagcctcaaaggactgtggactctgcgggctttcggcaggcagccatatttcgagactttgttccacaaggcccttaacctgcacactgcaaactggttcctctacctgtcgacccttcgctggttccagatgcgcatcgagatgatctttgtgattttcttcatcgctgtcaccttcatctcgatcttgaccaccggcgaaggtgagggtagagttggaatcatcttgactctcgcgatgaacattatgtccactcttcaatgggctgtgaactcctcgatcgatgtggattcactcatgcggtctgtgtcgagagtctttaagtttatcgacatgccaaccgaaggaaagccgactaagtcgaccaagccatacaagaacggacagctgtcaaaggtgatgatcatcgaaaactcacacgtcaaaaaggacgatatctggccaagtggaggccaaatgaccgtcaaagacctgactgcgaagtacaccgagggaggcaacgctattctggagaatatctccttctcaatctcacccgggcagagagtcggacttctgggacgcacgggatccggaaagtcgactctgctttcggcgttcctgcggctgctcaacactgagggggagatccagatcgatggtgtcagctgggactcaatcaccttgcaacagtggcggaaggcttttggagtaattccacagaaggtctttatcttctcgggcactttcagaaagaacctggacccgtacgaacagtggagcgatcaggaaatctggaaggtggccgatgaagtggggctccggtccgtcatcgaacagttccctggcaagctcgattttgtgctcgtggacggaggatgtgtgctgtcccacggccacaagcagctgatgtgcctggctcggagcgtgcttagcaaggcaaagatcctcctcctggatgagccgagcgcccatcttgacccggtgacttatcagatcatccggagaacgctcaagcaggcctttgcagactgcaccgtgatcttgtgcgagcatcgcatcgaagctatgctcgagtgtcaacagttcctggtcatagaagaaaacaaggtccggcagtacgacagcatccagaaactcctcaatgagcgcagcctgttcagacaggcaatttccccgtccgacagagtgaagctgttccctcacagaaacagcagcaagtgcaagtccaagccacagattgcggcattgaaggaagaaactgaagaagaggtgcaagacacccgcctc

SEQ ID NO: 10146 - DNA, 4440 bp, Artificial Sequence
  Description of Artificial Sequence: Synthetic coding sequence
atgcaaaggagtcctttggagaaagcatcagtggtttctaaattgtttttctcttggactcgtccaatcttgaggaagggctaccgtcagaggcttgaattaagtgatatttatcaaataccatccgtggattctgctgacaacctcagtgaaaaattagagcgagagtgggatcgggagttggcttccaagaagaatccaaagctcattaatgctttgcgaaggtgcttcttctggcggttcatgttctatgggatcttcttgtacttaggagaggtcactaaggctgttcaaccattattgctaggtagaattatagcttcctacgatccggacaataaggaagaaagatcaattgctatctacttgggtattggattgtgcttgcttttcattgtgcggactcttcttttgcatccggctatctttggtctccatcatatcgggatgcaaatgaggattgctatgttttctctcatttataaaaagacattaaaactgagttcgcgtgtgctagataagatttcaattggtcagcttgtatctcttttaagcaataacctcaacaagtttgatgaaggtctcgctcttgcgcatttcgtttggattgcccccctccaagtggcattgctgatgggacttatttgggaactccttcaagcatcagctttctgtgggcttgggttcctaatcgtgcttgcacttttccaagctggattggggagaatgatgatgaaataccgagatcagagggccggtaagattagcgagaggctagtgataaccagtgaaatgattgagaacattcaatctgtaaaagcatattgctgggaggaagcaatggagaagatgattgaaaaccttcggcagacggaattgaagcttactaggaaggcagcttacgtgagatatttcaatagctcagctttctttttttcgggtttttttgtcgtgtttcttagcgttctcccctatgccctcatcaaagggattatcctgcgtaagattttcacgacgatatcgttttgcatagtgcttagaatggcggtcacacggcaattcccttgggctgttcaaacttggtacgattccttgggagccattaataaaattcaagatttcctccaaaaacaagagtataaaactcttgagtataacttgacaaccacggaggttgtaatggaaaacgttacagctttctgggaggagggatttggtgaactttttgaaaaagctaagcagaataacaacaaccgaaaaacttcaaatggggatgatagtctcttcttcagcaatttttccctacttggtaccccggtacttaaagatattaacttcaagatcgaacgaggtcaattgctggcagtggccggttccacaggagctggcaaaacctccttgcttatggtgatcatgggcgaactcgaaccatcagagggaaagattaagcattctggaaggattagcttttgctcacagttcagctggatcatgcccggcactattaaggagaacattattttcggggtttcttatgacgagtatcgttacaggtctgtgataaaggcttgccaattagaagaagatatcagcaaatttgcggagaaggataatattgtgctcggtgaaggtggaattactcttagtggtggtcaaagagcgaggatcagtttggcgagggccgtctacaaggatgccgatctttatcttttggacagcccttttggttaccttgatgtgttaaccgaaaaagagatcttcgaaagctgtgtgtgtaaacttatggctaataagacacggatattggttacttccaaaatggaacatttgaagaaagctgataagatcctcattcttcatgaggggagctcatatttctatggcactttctctgaacttcaaaatctccaaccggatttctcttctaagctcatgggatgtgactctttcgaccaattctctgctgagcggcgaaattctattctgacagaaacccttcacaggttttcattggaaggtgatgcaccagtttcctggacggaaaccaagaagcaatcctttaagcaaactggagagtttggagaaaaaagaaagaattcaatcttgaatccaattaactccatacgtaagttttctattgttcagaagacacctcttcaaatgaacggcatagaagaggattctgatgagccactggaaagaagactgtctctagttcctgacagtgagcaaggggaagctatccttcctagaatttccgttattagcaccggaccaactttgcaagcaagacgtcgacaaagcgttcttaatttgatgacgcactcagtcaatcaaggacaaaatattcataggaagaccaccgcttctacaagaaaagtgagcctcgcgcctcaagcgaatctgaccgagctagatatttattctagacgtctttcccaggagactggacttgaaatttccgaagagattaacgaagaagatcttaaggagtgtttcttcgatgatatggagtcaatcccagctgtcactacttggaacacatatttgcgatacatcacagttcataagagtctcatattcgttttgatttggtgcttggttatctttcttgccgaggtcgccgctagccttgtggtcctttggctcctggggaacacaccactgcaagacaagggcaatagcacccattctaggaacaattcatatgctgttataataacttcaacctcttcttactacgtgttctatatatatgtaggtgttgcagatacacttttggccatgggtttttttcggggattaccacttgtgcatacactgattacggtctctaagattctccaccataagatgcttcatagcgtgctgcaggcacctatgagcactttaaacacgttgaaggctgggggtattctcaatcgtttttcgaaggatattgcgattttggacgatttgctccctctcacaatctttgacttcattcaattgctgctcatagtgataggagcaattgcggtggtggcggttttgcagccttatatatttgttgctacagttccggttattgttgcatttattatgttaagggcatatttcctacagacttcacaacaattaaaacaattagagtctgaaggtagaagcccaatttttacccatctggtaacctctcttaaaggattgtggactttaagggcattcggtagacagccctatttcgaaacacttttccacaaggcactcaatctacataccgctaattggtttttgtatcttagtactctccgctggtttcaaatgcggatagaaatgatcttcgttattttcttcattgcagttacttttatttcaatcctgaccactggcgagggcgagggaagggttggtattatactaactctggctatgaatataatgtctacgctccagtgggctgtcaacagcagtatcgatgttgattccttaatgcgttctgtcagtcgtgtgttcaaattcatcgatatgcctacagaggggaagcctaccaagtccacaaagccatacaagaacggacaactgtctaaggttatgattatcgaaaattcccacgttaagaaggatgatatttggccatcgggaggtcagatgaccgtgaaagatttaactgccaagtacaccgagggtggaaacgccattttagaaaatattagtttcagcattagtcccgggcagagagtaggacttctgggaagaaccggttcaggaaaatctacgttactgtctgcattcctccgacttcttaatacagagggtgaaatacaaatcgatggcgtctcgtgggattcaatcacattacaacagtggcgcaaagcgtttggcgtcattccacagaaggtctttattttttccgggacttttaggaagaatctggatccatatgagcaatggtccgaccaggaaatttggaaggtggctgacgaagtgggcctccgtagtgttatcgaacagttccctggaaagttagacttcgtcttggttgatggtggctgtgtgctttcgcacggacacaaacagctgatgtgcttggcaaggtcggttctaagcaaagctaagatcttgctattggacgaaccaagtgctcatttggatcccgtgacctatcaaattatccgccgaactcttaaacaggcatttgcagattgcactgtcatcctctgcgaacacagaatagaggcgatgttagagtgtcaacagtttctagttattgaagaaaataaggtgaggcagtacgactctattcagaaactcctaaacgaaaggagcttgtttagacaggccatttcaccatcagatagagtaaaattgtttccacatcgaaactcctcaaagtgcaaatctaagccgcaaattgcagccctaaaagaggaaacggaagaagaggtgcaggacaccaggctg

SEQ ID NO: 10147 - DNA, 4440 bp, Artificial Sequence
  Description of Artificial Sequence: Synthetic coding sequence
atgcagcgaagtcccctggagaaggcctcggtcgtgtcgaaactgttctttagctggacccgccctattctccggaaaggataccgacaaagacttgaactttcggacatttaccaaattccaagcgtggatagcgcggacaatctttccgaaaagctcgaacgtgagtgggatcgcgagcttgcatcaaagaagaacccaaagttgatcaatgcactccgccgctgtttcttttggcgctttatgttttacggaatctttctgtatctgggagaagtcactaaagcagttcaacctctccttctcggtcggattatcgcctcctacgatcctgacaataaagaagaaaggagcattgcaatctaccttggaattggcctgtgtctgctcttcatagtccgtactctcctgctgcacccggcaattttcggtctgcaccacattgggatgcagatgagaatcgcaatgttttcgttgatctacaaaaagacgctcaaacttagctcgagggtgctggataagatttcgatcggacaacttgtaagccttctgtccaacaacctgaacaagtttgatgagggccttgcccttgcgcattttgtgtggattgcgcctctccaagtggcccttctcatgggccttatctgggagttgctgcaggcatcggctttctgcggactgggattcctgatcgtgcttgccctgtttcaagcagggctgggacgcatgatgatgaagtaccgcgatcagagagcgggtaagatctcggaacgacttgtgattacttccgaaatgatcgaaaacatacaaagcgtcaaggcttactgctgggaagaagcgatggagaagatgattgaaaacctccggcagactgagcttaagttgactcggaaggccgcatacgtgcggtactttaactcgtccgcgtttttcttttcgggtttcttcgtggtgttcctgtcagtcttgccgtacgctttgataaagggaattatccttaggaagatattcaccaccatttcgttctgcatcgtgctgagaatggcagtgacccgacaatttccctgggcagtgcagacgtggtacgattcgctgggtgcaattaacaagatccaggacttcctccagaagcaagaatacaaaacgctggagtacaatctcactaccaccgaggtggtgatggaaaacgtgactgcattttgggaagaaggttttggagaactgtttgaaaaggcaaagcagaacaacaataaccgaaagacgagcaatggagatgattcgctgttcttttccaacttcagcctgctgggaaccccagtgcttaaggacattaacttcaaaattgaacgggggcagcttcttgcagtggcaggttcaactggagcggggaaaacctctctgcttatggtgatcatgggagagctggaaccctccgaaggtaagatcaagcattccggcaggatttccttctgttcccaattttcgtggatcatgcccggaaccataaaggaaaacatcatttttggagtgtcctacgacgaataccgatataggagcgtgatcaaagcatgtcagctcgaagaggatatctccaagttcgcagagaaggataacatcgtgctcggagaaggcgggattacgctgagcggaggacagcgggcaagaattagccttgcacgtgcggtgtacaaggatgccgacttgtaccttctggattccccatttggttaccttgatgtgctgaccgaaaaagagatattcgagtcgtgtgtgtgcaagctgatggccaataagacgagaatcctggtgacgtccaagatggagcaccttaagaaagcagataagatcctcatccttcacgaaggaagctcctacttctatgggaccttttctgagctgcaaaatctgcaacccgatttctcgtcgaagttgatgggatgtgatagctttgaccaattctcagcagaacgtaggaattcgattctgaccgagacgctgcatagatttagccttgagggtgacgcacctgtctcgtggactgaaaccaagaagcaatcctttaagcagacgggggaatttggggaaaagaggaaaaactctattcttaatcctatcaactccattaggaaattctcgattgtccaaaagacccctctgcagatgaacggcattgaagaagattcagacgaacctcttgaacggaggctgtcgctggtccctgattcggaacaaggagaggctatactcccaagaatttcggttatcagcactggtccaaccctccaggcaagacgcaggcagtccgttttgaatctcatgacccattcggtgaaccagggtcagaatatccatcgtaaaactaccgcctctactagaaaggtgtcgctggcaccacaagctaacttgaccgaacttgacatttacagccgcaggctgtcccaagagactggtcttgaaatttcggaggagataaacgaagaggacctgaaggagtgttttttcgatgatatggaatcgatcccagccgtgacgacgtggaacacttacctccgctacataaccgtccataaatcgcttatctttgttcttatttggtgtctggtgatcttccttgcagaggtcgccgcatccctggtggtgctgtggcttttgggaaacactcctctgcaggataagggaaactcgacgcactcgagaaacaacagctacgcagtgatcataacctcgactagcagctactacgtcttttacatttacgtgggagttgcagataccctgctcgctatgggcttcttccggggtctgcctctggtgcatacccttattaccgtctcgaagattcttcaccataagatgctccattccgtgcttcaggcccccatgtcgaccctcaacactcttaaggcaggagggatattgaaccgatttagcaaggatattgcaattctggatgatctgctgcctctcaccatcttcgacttcattcagctcctgctcattgtcattggagctatagcagtggtggctgtgctgcagccatacatttttgtggccactgtaccggtgattgtggcctttatcatgttgagagcatactttttgcagacctcgcagcaattgaaacaactggaatcggagggtagaagccccatctttacccaccttgttacctcgcttaaaggtctttggactctgcgggcattcggtagacaaccttactttgagactctttttcacaaagcactgaacctgcacactgcaaactggttcctttacctgtcaaccttgcgctggttccagatgcggatcgaaatgatattcgtcattttctttatagccgtcactttcatttccattcttacgactggtgaaggggagggaagagtgggaataatcctcaccctcgcaatgaatatcatgtcaacgctgcagtgggccgtgaatagcagcattgatgtggattcactgatgcggtcagtttcgcgagtgttcaaattcattgacatgcctactgaaggtaagccaaccaagagcaccaagccatacaagaacgggcaactgtcgaaggtgatgatcatcgaaaactcacatgtcaaaaaggacgacatctggccgtccggtggccaaatgactgtgaaggatctcactgcgaagtacactgagggtggaaacgccattcttgagaacatcagcttttccatttcgcctggtcaaagagtgggacttttgggcaggactggatctggaaaaagtacgcttctttccgcattcctccgcttgctcaataccgagggggagattcagattgatggagtgtcctgggactccattacccttcaacagtggcgcaaggctttcggggtgattccacaaaaggtgtttatcttctcaggcactttccgcaagaatctggatccttacgaacagtggtcggatcaggaaatctggaaggtcgcagatgaagtggggctgagatcggtgattgagcagtttcccggaaagctggacttcgtgcttgtcgacgggggatgcgtgctctcacatgggcataaacagcttatgtgtctggcaagatccgtgctctccaaggccaaaattcttcttctggatgaaccttcagcacatttggacccggttacctaccagatcattcgaagaacccttaagcaagcgtttgccgactgcaccgtcatcttgtgcgagcacaggattgaagccatgctggaatgtcagcagtttcttgtcatcgaagaaaacaaagtgagacaatacgactccatccagaaactgcttaatgaaagatccctctttcgccaggcaattagcccatcggacagagtgaaacttttcccccatcggaactcaagcaagtgtaagtcgaaaccgcaaatcgctgcccttaaggaggaaactgaggaagaggtgcaagataccagactt

SEQ ID NO: 10148 - DNA, 4440 bp, Artificial Sequence
  Description of Artificial Sequence: Synthetic coding sequence
atgcagcggagtcctttggaaaaagcctcagtggtatccaagctgtttttttcttggacacggcccatactccggaaaggatatagacagagactcgaactctccgatatttatcagattccctctgtggattctgcagataatctctctgaaaaattagagcgggaatgggatagggaactggcatcaaagaaaaatcctaaactaattaatgctctccgcagatgttttttttggcgctttatgttttacgggatctttctatatctaggggaagtgacaaaagcggtgcagcctctgctcttggggagaataatcgcctcatatgatccagataacaaagaagagcgatctattgccatctatctgggaatcggactgtgcctgctattcatagtgcgaacactgctattacatccagctatcttcggactgcatcatataggaatgcagatgcgaatagccatgttttctcttatctataagaaaactcttaaattaagttctagggtactcgataaaatctcaatcggacagctggtatctttgctatctaataacttgaataagtttgatgaagggctcgcactagcgcatttcgtctggattgcgcccctgcaggttgctttattgatgggactgatctgggaactgttacaagcctctgccttttgtgggctcgggtttcttattgtgcttgctttgtttcaggccggactcggacgcatgatgatgaaatacagagaccagcgagcaggaaaaatatctgaaaggctagtgatcacatcagaaatgatcgaaaatatccagtcagttaaagcttactgctgggaggaagcaatggaaaaaatgatcgaaaacctaaggcagactgaactaaaactcacaaggaaagcggcatatgttaggtacttcaatagttcagctttttttttctcaggattcttcgtcgtgtttctgtccgtcctgccttatgcactcatcaagggaatcatcttgagaaagatcttcacaactatttccttctgcattgttctacgaatggctgtaacacgacagtttccatgggctgtacagacttggtatgattctttgggggcaatcaacaaaatccaggatttcttgcagaaacaggaatataaaacacttgaatacaatcttactactacagaagtcgtgatggaaaacgttactgccttctgggaagaagggttcggagaactctttgaaaaagctaaacagaacaacaataatcgaaaaacttctaacggagatgattctctgtttttttccaatttctctctccttgggactccagttctgaaagatattaattttaagatcgaaagagggcagctgctcgccgtagctgggagtactggggcggggaaaacttctcttctaatggtgatcatgggagagctagagccctctgaagggaaaataaaacactccgggcgaatctctttctgttcacaattctcatggataatgcccgggacgataaaagaaaatatcatctttggggtgtcttatgatgaatatcgataccggtcagtaataaaggcttgccagttggaagaagacatatccaaattcgctgaaaaggataacattgtgttaggggaagggggaattactctctccggagggcagagagcaaggatctctttagctcgggccgtgtacaaagatgctgatctttatcttctggattcacccttcggatatctcgatgtattaactgaaaaggaaatcttcgaatcatgcgtgtgtaaactcatggcaaacaaaacgaggattttggtgacttctaaaatggaacatctcaaaaaagctgacaaaattctgatcctccacgaaggatcaagttatttctatgggacattttcggaactgcagaacctgcagccagatttcagtagtaaactgatggggtgtgatagtttcgatcagttctcagccgaacgacgaaatagtatacttacagaaacactccatcgctttagtcttgaaggagacgcacccgtgtcgtggactgaaacaaagaaacagtcattcaaacagactggggaatttggagagaaacggaaaaattctatcctgaatccaatcaattccattcggaaatttagtatagttcagaaaacgcccttacagatgaacggaatcgaggaagattctgacgaaccactagaaaggagactctcactcgtccctgactcagaacagggggaggcgatcttgccccggatctcggtgatatctacagggcctacgctgcaggcccggagaaggcagtcggttctcaacctcatgacacactcagttaaccagggacagaatatccatcggaaaacaacagcctctactcgcaaagtctctctcgccccacaggccaatctcactgaactggatatctactccagaaggttgtctcaggaaacaggactggaaatctctgaagaaatcaacgaagaagatctgaaagaatgcttctttgacgacatggaatctatacctgcggtaactacttggaacacatatcttcggtatatcactgtacacaaatcgctcatctttgtgcttatctggtgccttgtcatctttcttgccgaagtggctgcaagtttagtggtactatggctcctcggaaacactcctctccaggataaaggaaattccacacattcacggaataatagttatgctgttataattacttcgacttctagttactatgtcttttatatttatgtcggagtggccgatacattattggcaatggggtttttcagaggactccctctggtgcatactctcatcacagtgtccaaaatcctgcaccataaaatgttacattcagtgcttcaggcccctatgtcaactctcaacacacttaaagctggaggaatcctaaataggttctccaaggatatagccatcttagacgatttgctgcccctgactatattcgattttatccagctgctcctgatagtgataggggcaatcgccgtggtcgcagtgcttcagccttatatttttgtggctacagtgccagtaatcgttgcttttattatgctaagagcttattttttgcagacatctcagcaattaaaacaactggaatccgaaggaagatcacccatttttactcacctggttacttcacttaaaggattatggacactacgtgcttttggacgccaaccttactttgaaacactcttccacaaagccctaaatctgcacacggccaactggttcctgtacttatcgacacttcgatggttccagatgaggattgaaatgatatttgtaattttcttcattgccgttacattcatatcaatattaacaacaggggaaggagaaggaagggttggaatcatcctcactctggctatgaatattatgagtacactacagtgggctgtgaattcatctatcgatgtagattcccttatgcggtccgtgagtagagtgttcaaattcatcgatatgccaacagagggaaagcctacaaaatctacaaaaccctacaaaaatggacagctatctaaggtgatgatcatagagaactctcatgtcaagaaggacgacatttggccgagtggaggacagatgacagtaaaagatttaacagcgaagtacactgaagggggaaacgctatcctcgaaaacatctcgttttccataagtcctgggcagcgcgtagggctccttgggcgaacaggatcagggaaatcaactcttctaagtgcatttcttaggcttctcaatacagaaggagagatccagatagatggagtttcgtgggattctataactttacagcagtggcggaaggctttcggggtgattccgcagaaggtttttattttctctggaacatttcggaagaatctcgatccttacgaacagtggtctgatcaggagatttggaaagtggccgatgaagtgggacttaggtccgtgattgaacagttccctggaaagttagattttgtgctcgtggatggagggtgtgtgctttctcatggacataaacagctgatgtgtctagcccgctctgtcttatcaaaagctaaaatactgttgctcgatgaaccctcagcacacctggatcccgttacttatcagatcatcagacggacactgaaacaggctttcgctgattgcacagttatactatgcgagcaccgcatcgaggctatgctcgaatgccagcagtttctagttatagaagaaaacaaagtaaggcagtatgattctattcagaagttactgaatgaacggagtctcttcagacaggcgatatctcccagtgatcgcgtcaaactgttccctcacaggaatagttcaaaatgtaaatcaaagccacagattgctgccctgaaagaagaaacagaggaagaagtccaggatactcgactc

SEQ ID NO: 10149 - DNA, 4440 bp, Artificial Sequence
  Description of Artificial Sequence: Synthetic coding sequence
atgcaacggagcccacttgaaaaggcgtccgtagtgtccaaactcttcttttcgtggaccaggccgatcctccgcaagggatatagacagaggctggaactgtccgacatctaccaaatcccgtcagtcgactctgccgacaatctgtccgaaaagctggaaagagagtgggatcgcgagttggcctctaagaagaatccgaaactgatcaacgcactgcggcgctgcttcttctggagatttatgttttacggaatcttcctctacctcggagaagtgaccaaggcggtccaaccactgctgttgggtcgaatcatcgcatcatacgacccagacaataaggaagagcgtagcatcgctatctacctcgggatcggactgtgcctgctgttcatcgtgagaacgttgctgctgcatccggcaatctttggactgcaccacattggaatgcaaatgcggatcgccatgttcagccttatctacaaaaagactctgaaactgtcgtcgcgggtgctggacaagatcagcatcggacagctggtgtccctgctgagcaataatcttaacaagtttgacgaaggactggcgttggctcacttcgtgtggatcgccccactgcaggtcgccctcctgatgggcctcatttgggaactcctgcaggcctcggcattttgcggccttggttttcttatcgtcctggcgctgttccaggcgggactcggaagaatgatgatgaagtaccgcgatcagcgggcaggtaaaatctcagaacgcttggtcatcacttcagaaatgatcgaaaacattcaatcggtgaaagcctactgctgggaggaggccatggagaagatgatcgagaatctgagacagactgaattgaagctgactcgaaaagccgcctacgttcggtacttcaattcctcagctttcttctttagcggcttttttgtggttttcctctcggtgctgccttacgccttgataaaaggaattatcctgcggaagatcttcactactatcagtttctgtatcgtgctgcgcatggccgtgactcggcaattcccgtgggccgtgcaaacctggtacgattcgctgggagcaatcaacaagatccaggactttcttcaaaaacaggagtacaagactttggaatacaacctcactacgactgaggttgtcatggagaatgtcaccgcattctgggaggaaggcttcggagagctcttcgaaaaggctaaacagaataacaataacaggaaaacttcaaacggtgacgattcgctcttcttctccaatttcagcctgcttggaaccccggttttgaaggacatcaacttcaagatcgaacgcggccaactgctggcagtggccggatccaccggcgcaggaaagacctccctgctgatggtgatcatgggcgaactcgagccgtcagaaggaaaaatcaagcactcaggacgcatcagtttctgctcgcagttttcgtggattatgcccggaaccattaaggagaacatcatcttcggagtctcgtacgatgaatacaggtacaggtcggtgatcaaggcctgccagctcgaagaagatatcagcaagttcgccgaaaaggataacatcgtactgggagaggggggcattactctctcaggagggcagagagctcggattagcctggcccgtgccgtgtacaaggatgccgatctgtatctcctcgattctccatttggctaccttgatgtgctgaccgaaaaggaaatcttcgaatcgtgtgtgtgtaagctcatggcaaacaagactcgcatcctggtcacgtcaaagatggagcacctgaagaaggctgacaagatcctgatactgcacgaagggtcaagctatttctacgggaccttcagcgaactgcaaaaccttcagcccgacttctcatcgaaactcatgggatgtgattcgttcgaccagttctcagccgagcgccgtaacagtattctgaccgaaaccctgcaccggttctccctcgaaggtgacgcccctgtgagctggacggaaaccaagaagcagtccttcaagcaaaccggggaattcggggagaaacgcaagaacagcattctcaacccgattaactcgattcgcaagttttcgatcgtccaaaaaaccccgctccagatgaacggcatcgaagaggatagcgacgaaccactggaacgcagattgtcactggtgccggattccgaacagggagaggctatcctgcctcgcatctcggtgatctccacgggtccaactctgcaagcccgccgcagacagagcgtgctgaacctgatgacccactccgtgaatcaggggcagaatatccacaggaaaaccaccgcgagcacccgcaaggtgtcgttggctccacaagctaatctgactgaactcgacatatactcgcggagactctcccaagaaaccggactcgaaattagcgaggagataaatgaggaagatctgaaagaatgtttctttgacgacatggaatccatccccgccgtcactacctggaacacctaccttagatacatcactgttcacaagtcgctcatctttgtcctgatctggtgcctcgtgatcttcctcgcagaggtagccgcgtccctggtggtgctgtggttgctcggaaacactccgctgcaggacaagggaaactctacccattcccgcaataacagctacgcggtgatcatcacctccacctcatcctattacgtcttttacatctacgtgggcgttgcggataccctgcttgccatgggatttttccgcggcctcccgctcgtgcacactctcatcactgtgagcaaaatcctgcatcataagatgctccactctgtactgcaggctccaatgtccactcttaacaccttgaaagcaggcggcatccttaacagattctcaaaagatatcgcaatcctggacgacctgctccctctgacgatcttcgatttcattcagctccttctcatcgtcattggcgcgattgcggtggtggccgtactgcaaccgtacatctttgtggctactgtcccggtcatcgtggccttcatcatgctgcgggcgtacttcctgcaaacttcgcagcagttgaagcaactcgaatccgaaggcaggtcccctatcttcacgcatcttgtgacctccctgaagggactctggaccctgcgcgcgttcggaaggcagccttatttcgagacgctcttccataaggccctcaatctgcataccgcaaattggttcctgtacctgagcactctgcggtggtttcaaatgcgcatcgagatgatcttcgtgatcttcttcatagcggtgacctttatctcaatcctcacgaccggtgaaggagaggggcgggtcggtatcattctgaccctggccatgaatatcatgtcaaccttgcagtgggccgtcaactcgtccatcgacgtggactcgctcatgcggtcggtgtctcgggtgttcaagttcattgacatgccaactgagggaaagcccactaagtccaccaagccatacaagaacggtcagctttccaaggtcatgatcatcgagaacagccatgtgaagaaggacgacatctggcctagcggtggacagatgactgtgaaagatctcacggccaagtacacggagggagggaacgctatcctggagaacatttcgttttcgatctcgccgggacagcgcgtcggactcctcggccgcactggatcgggaaaaagcactctcttgtccgcgttcctgagactgctcaacactgagggggagattcagatcgacggtgtctcttgggattccattacccttcagcagtggcggaaggccttcggggtgatcccgcagaaggtgttcattttcagcggcactttccggaagaacctggacccgtacgaacaatggtccgaccaagaaatctggaaagtggcggacgaggtgggactgcgctccgtgatcgaacagtttcccgggaagctggacttcgtgctggtggacggaggctgcgtccttagccacggtcataagcaactgatgtgcctggcaagatcagtcctcagtaaagcgaagatcctgctcctggatgagccgagcgcgcacctcgatccggtgacttaccagatcatcaggcggactctgaaacaagcgttcgctgattgcaccgtcattctctgcgagcatcggatcgaggcaatgcttgagtgccaacagttcctggtgatcgaggagaataaagtacggcagtacgactcgatccagaagttgttgaatgaaaggtcgcttttccgtcaggctatctcccccagcgatcgcgtcaaattgtttccacaccgcaacagttctaaatgcaagagcaagcctcagatcgcagcactgaaagaggaaaccgaagaagaagtgcaagacacccggttg

SEQ ID NO: 10150 - DNA, 4440 bp, Artificial Sequence
  Description of Artificial Sequence: Synthetic coding sequence
atgcagaggagccctctggaaaaagcgtcggtcgtctcgaagctgtttttctcctggaccaggcccatcctccgcaaggggtacagacaacggctcgaacttagcgacatctaccagataccgtccgtcgactccgccgataacttgtcggagaagttggagagggaatgggaccgggaactggcatccaagaaaaacccgaagctcatcaatgccctgcgccgatgttttttctggagattcatgttttacgggatttttctctacctgggtgaagtaaccaaagcggtccaaccgctgctcctgggaaggatcatcgcgtcgtacgacccagacaacaaggaggaacgctccatcgcaatctacctcggaatcggtctgtgccttcttttcatcgtgcgcactctgctgctccatcctgctatcttcggactccatcatattggcatgcagatgcgcatcgccatgttttctctgatctacaagaaaaccttgaagctgtcaagccgcgtgctggataagatcagcattggtcaacttgtgtcacttctgtcgaataatctcaataagttcgacgaaggactggctcttgctcatttcgtgtggatcgcgccattgcaggtggccctcctgatgggactcatatgggaattgctccaggcctccgcgttctgcggactgggtttcctgattgtgctcgcactgtttcaggcgggattgggtagaatgatgatgaagtaccgggatcagagagccgggaaaatctccgagagactcgtcatcacttcagaaatgattgaaaacatccagtcggtcaaggcatattgctgggaggaagccatggagaaaatgatcgaaaacctgcgacagactgagctcaagctgaccagaaaagccgcgtacgtgcgctacttcaattcctcggcctttttcttctcgggattctttgtggtgttcctgagcgtcctgccttacgctctgatcaagggaattatcctgcgtaagatcttcactacgatatcattctgcatcgttcttaggatggccgtgacgcgccaattcccatgggcagtgcagacctggtacgactccctcggagccattaacaaaatccaggacttcttgcaaaaacaggaatacaaaaccttggaatacaatctgaccactacggaagtggtgatggagaatgtgaccgcgttctgggaggaaggattcggcgagttgttcgagaaggcgaagcagaacaacaacaatcggaaaacttctaatggagacgattcattgtttttctcgaacttcagcttgctcggaaccccggtcctgaaggacatcaacttcaaaatcgagcgcgggcaactcttggccgtggctggatcgaccggcgcgggaaagacctccctgcttatggtgattatgggggaactggagccgtcagagggaaaaatcaagcactcgggacgtatctcattctgctcgcagttttcgtggattatgccaggcaccattaaggagaacatcatctttggcgtgtcgtacgatgaataccgctaccgctcggtcatcaaggcatgccagctggaggaagatatcagcaagtttgcagagaaggataacatcgtcctgggtgagggcggaatcactttgtcgggaggacaacgggccaggatcagcctggccagagcagtttacaaggacgccgacctgtacttgctggactcgccgtttggctacctggatgtcctcaccgagaaggagatattcgaatcgtgtgtctgcaagctgatggctaataagacccgcatcctggtgacctctaagatggagcacctgaaaaaggctgacaagatcctcatcctgcacgaaggctcttcctacttctacgggaccttcagcgaactccagaacctgcagccggacttcagttcaaagctgatgggttgcgattcgttcgatcagttcagcgccgaaagacggaattcaatcctgactgaaactctccacagattcagtctcgagggtgacgcaccagtgagctggacggaaacgaaaaagcaatcgttcaagcaaactggggaattcggagagaaacgcaagaacagcatcctgaatcccatcaactcaattaggaagttttcgatcgtgcagaaaactccgctgcaaatgaacgggattgaagaggactcggacgagccgctcgagcgccgactctccttggtaccggattcggaacagggcgaagcaatcctgccgcgcatctcagtgatatcaaccggccctaccctgcaagcgcggcgcagacagtccgtgctcaacctgatgactcactcggtaaaccagggtcagaacatccaccgtaaaacgactgcatcgacgaggaaagtttcgctggctccgcaggctaacctcactgaactcgacatctacagccggcgcctcagccaggaaaccggactcgagatcagcgaggagattaacgaagaagatctgaaggagtgcttctttgatgatatggaatcgatccccgcagtgaccacttggaatacctatctcagatacatcacggttcacaagtcgctgatcttcgtcctgatctggtgtctggttatcttcttggccgaggtggccgcctcgctcgtggtgctttggctcttgggaaacaccccgctgcaggataagggaaactccactcactccaggaacaactcctacgcagtcatcattacctcgacttcctcctactacgtattctatatctacgtgggagtggcagatactcttcttgctatgggatttttcagaggcctgccgctggtgcatactctcatcaccgtgtctaagatcctgcaccacaagatgttgcattctgtgctgcaagctccaatgtcaactctgaacactctcaaggccggaggtattctgaaccggttttcaaaggatattgcaatcctcgacgacctcctcccgttgactatcttcgactttatccagctcctgctgatcgtcattggagccatagcagtcgtggccgtgttgcagccgtacatcttcgtggcaaccgtgccagtcatcgtggcgttcattatgctccgggcgtacttcctccaaacttcacaacagctgaaacaattggaatcagaaggacggtcgccgatctttactcatcttgtcaccagccttaagggcctgtggaccttgagggccttcggacgccagccatacttcgaaactcttttccacaaagccctcaatctgcacaccgccaactggttcctgtatctctccaccctccgctggtttcaaatgcggatcgaaatgatcttcgtgatcttcttcatcgctgtcacttttatcagcatcttgaccactggagaaggagaaggaagggtcgggattatcctgaccctggcaatgaatatcatgagcactctgcaatgggccgtgaactcgagcatcgatgtggactcactgatgcgctccgtctcgagagtgttcaaattcattgatatgccaaccgagggcaaaccaaccaagtcaactaagccgtacaagaatggccagctttccaaagtcatgatcatcgagaactcccatgtgaaaaaggacgacatctggccatccggaggacaaatgaccgtgaaggatctgactgctaagtacaccgaaggcggcaacgctattttggagaatatcagctttagcatatcaccaggtcagagggtcggactgctcggccgaacgggaagcggtaagtccacccttctcagcgccttcctgcggcttcttaataccgagggagagattcagattgacggggtgagctgggactccatcaccctccagcagtggcgcaaggctttcggcgtgatccctcaaaaggtgttcatcttctcaggcacgttccggaaaaacctggacccttacgaacaatggtcggaccaggaaatctggaaagttgcagacgaagtgggcctgaggagcgtgatcgagcagtttcctgggaagttggatttcgtgctcgttgacgggggttgcgttctttcacatgggcacaagcagctgatgtgcctggcgagaagcgttctgtcaaaggcgaagattctgctgctggacgaaccctccgcgcatctggatcccgtcacctaccaaatcatcagacggacgttgaagcaagcctttgcggactgtaccgtgatcttgtgcgaacaccggatcgaagctatgctggagtgtcagcagttcctggtcatcgaagagaataaagttcggcagtacgactcgatccagaagctcctgaatgaacgcagtctgttccgccaagccatcagtccgtccgatagagttaagctgtttccccaccggaactcgtcaaagtgcaaaagcaagcctcaaatcgcagctttgaaggaggagactgaagaagaggtgcaagatactagactg

SEQ ID NO: 10151 - DNA, 4440 bp, Artificial Sequence
  Description of Artificial Sequence: Synthetic coding sequence
atgcaaaggagccccctggagaaggcatcagtcgtgtctaagttgttcttttcctggactagaccaattctgagaaaaggctacagacaaagacttgagctttccgacatttaccaaatcccatcggtcgactcggctgacaacctgtctgaaaagttggaacgcgaatgggatcgtgagctcgcaagcaagaaaaatcccaagttgattaatgcactccgccggtgtttcttttggcgcttcatgttctacgggatatttctttacctgggagaggtgaccaaggccgtgcagcctctgcttcttggaagaatcattgcatcgtacgacccagacaataaagaggaaaggagcattgcgatttacctggggattggactgtgccttctctttattgtgagaactttgctgctgcatcctgcaatcttcggactgcatcatattggaatgcagatgagaattgcaatgttctccttgatttacaaaaagaccctgaagctgtcgtcccgcgtgctcgacaagattagcattggtcaactcgtgtcactcctgtccaacaatctgaacaagtttgatgaaggcttggcactcgcgcactttgtctggatagcacctctgcaggtcgcactgcttatgggccttatctgggaactgctgcaggctagcgccttctgtggactgggatttcttatcgtgctcgccctgtttcaagctgggctgggaagaatgatgatgaaataccgggatcagcgggcaggcaagataagcgagaggctggtcatcacctcggagatgatcgagaatattcaaagcgtgaaggcatactgttgggaggaagcaatggaaaagatgattgagaatttgcgccagaccgaacttaagctcactagaaaggcggcctacgtgcggtacttcaactcgtcagcatttttcttctcagggttttttgtggtgttcctgtcagtgttgccctatgcgctgatcaagggtatcattctgcggaagatctttactaccatctcgttttgcattgtcctgcgcatggcagtcactcgccagtttccttgggctgtgcagacctggtacgattcccttggtgcaatcaacaaaattcaagattttcttcagaaacaagaatacaagactttggaatacaatctgactacgaccgaggtcgtcatggaaaacgtcaccgcgttctgggaggaggggtttggcgaactgtttgaaaaagcaaagcaaaacaacaacaatagaaagacgtcaaacggagatgattcgcttttcttttcgaacttttcgcttttgggcactccagtgttgaaggacattaacttcaagatcgagaggggacaacttctggcagtggcaggatcgaccggagcaggaaagactagccttctgatggtgataatgggggaacttgagccttcggagggcaagatcaagcattcgggcaggataagtttttgttcgcaattctcatggataatgcctggcactatcaaggaaaacatcatctttggtgtgtcctacgatgagtaccggtacaggtcggtcatcaaggcctgccaactggaggaagatatatcgaagtttgcggaaaaggataacattgtgctgggagaaggtggaatcacgctgagtggtggccagcgcgcgcgtattagcttggcccgagcagtgtataaggatgcagacctgtacctgcttgattccccctttggctacctggatgtgcttaccgagaaggaaatcttcgagtcttgcgtgtgtaagttgatggcgaacaaaactagaattctcgttacttctaaaatggagcatctcaagaaagccgataagattcttatcctccatgaaggttccagctacttctacggtactttttcggagcttcagaatctgcaacccgacttttcgagcaagctcatgggatgtgatagttttgatcaattttctgccgaacgccgcaactcgattctgaccgaaactcttcatagatttagccttgaaggtgatgcccccgtcagctggacggagactaagaagcaatcatttaagcaaactggagaatttggagaaaagagaaaaaacagcattctgaatcctatcaattccattcgcaagttttccattgtgcaaaagaccccactgcagatgaacggaattgaagaagatagcgatgaaccgctggaaagacgcctttcacttgtgcctgattcagaacagggagaagctattttgccgagaatctcggtcatctcgactggacctactcttcaagcaaggcggcggcagtccgtgctgaaccttatgacgcactcagtgaaccaaggccagaatattcatcggaaaactactgcatcgactagaaaggtttcgctggcaccccaggcaaatctgaccgaattggacatttactcacggcggctgtcacaggaaaccggtctggagattagcgaagagattaacgaagaagatctgaaagaatgcttctttgatgatatggagagcatacctgcagtgaccacctggaatacttatctccggtacataaccgtgcacaagagcctgatctttgtgctgatttggtgtcttgtgatttttctggcggaagttgcagcgtcgctggtggtgctttggctgttgggtaatactcctctccaggataagggaaattcgactcattccagaaacaactcctacgcagtcatcatcacctccacgagctcctactacgtgttttacatttacgttggagtcgcagacaccctcctggcaatggggttctttcgcggattgcctctggtgcatactctgattaccgtatctaagattctccaccacaaaatgctgcactcagtgctgcaagctcccatgtccacccttaacacccttaaggcaggcggaattttgaaccgattctccaaagacatagcgattctggatgatctgcttcctttgaccatttttgatttcattcagctcctcctgattgtgattggagcaatcgcagtcgtggcggtgctccaaccatacattttcgttgcaactgtgcctgtcattgtggcattcatcatgttgagagcatactttcttcaaacttcacaacaactgaagcaactggagtcggaaggaagatcaccgattttcacccatcttgtcacttccctgaaaggactctggactttgcgtgcattcgggcgacagccgtactttgaaaccctgtttcataaggccctgaatctgcacactgctaattggttcctgtatctgtcaactcttcggtggttccaaatgcgtattgaaatgatttttgttatcttcttcattgcggtgaccttcatttccatactcaccacgggggaaggtgaaggacgcgtgggaatcatcctcaccctggcgatgaacattatgtccactctccagtgggccgtcaactcgtcgattgacgtcgatagccttatgcgtagcgtgtctagggtgttcaaattcattgacatgccgacggaaggcaagcctactaaatccacgaaaccatacaaaaacggtcaactttctaaagtcatgattatcgaaaactcgcacgtgaaaaaagatgacatctggccgtcaggtggacagatgactgtgaaagatctcactgcaaaatacaccgaaggcggtaatgcaatcctggaaaacatctccttttcaattagcccaggacaacgcgtgggtttgcttggcaggactgggtcagggaagtcgacgcttttgtccgccttcctgagactcctgaatacggagggcgaaattcagattgatggcgtgtcgtgggactcgataactcttcagcagtggcgcaaggcttttggggtcattcctcagaaggttttcatcttttcaggcacctttcggaagaatctcgatccttacgagcaatggtcggatcaagaaatatggaaagtggcagatgaggtcggactccggtccgtgattgagcaattcccaggcaagttggatttcgtgctcgtggacggaggatgtgtgctgtcacacggtcataagcaacttatgtgtcttgcccgttccgtgctctcaaaggcaaagatactgctcctcgacgaaccttcagctcacctggacccggttacttaccagattatcagacggaccctcaagcaggcatttgcggactgtacggtcatactgtgtgaacatcgcatcgaagcgatgcttgaatgtcagcaatttctggtgattgaggaaaacaaggtgcgtcaatacgattccatacaaaagctcctgaacgagagatcgctttttaggcaggcaatctcaccttcggatcgggtgaagctctttccccacagaaactcgtcgaagtgcaaatccaagccacagattgcggcactcaaggaggaaaccgaggaggaagtgcaagatactcgcctc

SEQ ID NO: 10152 - DNA, 4440 bp, Artificial Sequence
  Description of Artificial Sequence: Synthetic coding sequence
atgcagaggagtccactcgagaaggcttctgtggtgagcaagttgttcttttcatggacacgccctatcttgcgaaaggggtataggcagcgcctggagctgtcagacatttatcagatcccatcggtggattccgcagataacctgtccgagaagctggaacgggagtgggatcgcgaactggcgagcaagaaaaatccaaagctgattaatgcgctacgccggtgctttttttggcgatttatgttttacggaattttcttgtacctgggtgaagtaacgaaagcagtccaacctctcctgctggggcgcataattgcctcatatgacccagacaacaaggaagaacgtagcatcgcgatttatctgggcattggactgtgtcttctgttcatagttcgtacgttgctgcttcacccggccatcttcggtttacaccacatcggtatgcagatgcgcatagcaatgtttagcctaatctataaaaagacgctcaagctgagcagccgagtgctggacaagatcagcatcggtcaactggtgagcctgctctccaataaccttaataagtttgacgaaggtctggctctggctcatttcgtttggattgcgcctctccaggtggcgctactgatgggactgatttgggagctgctgcaggcgagcgcattttgcggactgggcttcctgatcgttttggcgctgtttcaggccggcctcggcagaatgatgatgaagtatcgcgaccagcgcgccggtaagatcagcgagagactggttatcaccagcgagatgattgagaacatccagagcgtcaaggcttactgctgggaagaggcaatggagaaaatgatagaaaatctgcgtcaaactgagctgaaactcacaaggaaggcggcctacgtcaggtatttcaactcaagcgcatttttctttagcggcttcttcgtcgtttttctgtcagttcttccttatgcgctgattaaaggtattattctgcgcaagatcttcaccacgatctcgttctgcattgtgttacgtatggccgtcactcgccagttcccctgggcggtccaaacttggtatgattccttgggcgccattaacaagattcaggatttcctccagaagcaggagtataagactttagagtataacctgacgactacggaggtcgtgatggagaatgtgactgcattttgggaggagggattcggcgaactctttgagaaggcaaagcagaacaacaacaatagaaaaacgagcaacggtgacgactccctgtttttctcgaactttagcctgctgggaacgccagttctgaaggatattaacttcaagatcgaacgcggccagcttctggcggtggcaggcagcacgggcgctgggaaaacttcgctgttaatggtgataatgggggaactggaaccgtcagaaggcaaaatcaagcacagcggtcgcattagcttctgtagccagttcagctggattatgcctggaaccatcaaagaaaatataattttcggagtgagttacgatgagtaccggtaccgctctgttattaaagcatgccagctggaggaagatatcagcaagttcgcagaaaaggacaacatagtcctgggcgagggaggcattacgcttagcgggggccagagagctcggatctcactggcgcgtgcagtctataaagatgcagatctttacctgttggattcaccgttcggttacctggatgtcctgacggaaaaggaaatttttgagagctgcgtttgcaagctgatggccaataagacgcgcatattggtgactagcaagatggaacatctgaaaaaggcggataagattctgattctgcacgaggggtcttcctatttctatggtacattttctgagctgcaaaacctgcaaccagatttttcaagcaaactgatgggctgcgatagcttcgatcagttctccgccgagagacgcaacagcatcctcacagagacgcttcaccgcttcagcttagaaggtgacgcgcccgtctcttggactgaaacaaaaaagcagtcctttaagcagactggcgaattcggcgagaagaggaagaattccattttgaacccaattaacagtattaggaagtttagcatcgtccaaaagaccccactgcaaatgaatggcattgaggaggattctgatgagccactggaacgtcgcctctcgctggtgccagacagcgagcaaggagaagcgatcctgccacgcatcagcgtgatcagcaccggcccgactctgcaggcgcgcaggcgtcagagcgtcctgaatctgatgactcattctgtgaaccagggtcagaacatccaccgtaaaacgactgcgagcacgagaaaagtatcgctggcgccacaggccaatctgaccgaactggatatttacagccgccggctgtctcaggagactggtctggaaatttcagaagagatcaacgaggaagacttgaaagagtgcttctttgacgacatggagtccattccagcggttaccacgtggaatacttatctccgctatattactgttcacaaaagcttaatcttcgttctgatctggtgtctggtgatcttcctcgcagaagttgcggcaagcctggttgtgctctggctgttgggcaacactccactccaggacaagggtaacagcacgcacagccgtaacaacagctacgctgtgattataacgagcacgagcagttactatgtcttctacatttacgtgggtgttgcggacaccctgcttgccatgggtttcttccggggcttaccactagtgcacacgctcatcacggtgtctaagatcttacaccacaagatgcttcatagcgtactgcaggcccctatgtcaaccttgaataccttgaaagccggtggaattctaaaccggttcagtaaagacatcgccatcctggatgatctgttgcctctcactatctttgattttatccagctgctgttaattgtaatcggggcaattgccgttgtggccgttctgcaaccgtatatattcgtcgctaccgtgccagttattgtggcgtttattatgctcagggcctattttctgcagacgtctcaacagctgaagcagctggaaagcgaaggtcgtagccctatcttcactcacctggttacgtccctcaagggtttgtggactctgcgcgccttcggccgccagccttactttgagaccctgttccacaaagctttaaatcttcacaccgcaaactggttcctgtatctgtctacactgcgatggtttcaaatgcgcattgagatgattttcgttatcttttttattgcagtgactttcatcagcatcctgactacgggagaaggtgagggtcgggtcggtataatcctgacgctggctatgaatattatgagtactctgcagtgggccgttaattccagcatcgacgttgatagcctgatgcgcagcgtttcccgcgtgtttaagtttattgacatgccgactgaaggtaaaccaacgaagagcaccaagccatataaaaacggccaactcagcaaagttatgatcattgagaattctcatgtcaaaaaggatgatatctggcctagcggtggccagatgactgtgaaagacttgacggccaagtacactgaggggggcaatgccatcctggaaaatattagcttcagcatctccccgggccaacgcgtcggcctgctggggcgcaccggtagcggtaagtccacactgctgagcgctttcttgcgcctgttgaatactgaaggggagattcaaatcgatggcgtgagctgggatagcatcacgctgcaacagtggcgaaaagccttcggggttattcctcaaaaggtgttcatcttcagcggaacattccgcaagaatctagacccgtacgagcagtggagcgaccaagaaatttggaaagttgctgacgaggttgggctacgcagcgtgattgagcagttcccaggcaagctggatttcgtcctcgtggacggcgggtgcgttcttagccatggtcataagcaacttatgtgcctggctcgcagcgtactaagcaaagcaaagattctcctgcttgacgagccttctgctcacctggacccagtcacgtatcaaataatccgtcgcaccctgaaacaggcatttgctgactgtacagttattctgtgcgaacatcgcatcgaggcaatgctagagtgccagcagttcctagtgatcgaggaaaataaagtacgtcagtacgattcaatccaaaaactgctgaacgaacgaagcctgtttcgccaagctatcagcccatcagacagggtgaaactgttcccacacaggaatagcagcaaatgtaagagcaagccgcaaattgccgccctgaaagaagagacggaagaagaagtgcaagatactcgcctt

SEQ ID NO: 10153 - DNA, 4440 bp, Artificial Sequence
  Description of Artificial Sequence: Synthetic coding sequence
atgcagagatccccgctcgaaaaagcatccgtggtgagcaaattgtttttcagctggactagacctattcttcgcaaggggtaccgccagcggctcgaactctcggatatctaccaaattccttcggttgatagcgctgacaatctctcagagaaactggagcgcgaatgggatcgcgaactggcatcgaaaaagaatcctaagctcataaacgcgctgcgtagatgcttcttttggcgctttatgttctatgggatatttctttacctgggtgaggtgactaaggccgtccaacctcttcttctcggaaggattatagcctcctacgatcctgataacaaggaggaacgatccatcgccatttacctggggatcggtctgtgtttgctctttatagtgcggacccttctccttcatccagcaattttcgggctccaccatatcggaatgcaaatgcggattgctatgttttcgctcatctacaagaaaacgctgaaactttcgtcaagagtgctcgacaagatctcgataggacaattggtgtcgcttctctcaaataaccttaacaaattcgatgaaggcctcgcactggcccattttgtctggatcgcaccactgcaagtggcacttcttatgggcttgatttgggaactcctgcaggcgtccgccttttgtggacttgggtttcttatcgtactcgcgctttttcaggctggccttggaagaatgatgatgaaataccgggaccaaagggcgggtaagatatccgaaagacttgtgattacctccgaaatgatcgagaatattcagtccgtcaaggcgtattgttgggaagaagccatggaaaagatgattgaaaacctgcggcagaccgaactcaaacttacccgaaaggcggcatacgtgcgctacttcaactcctcggcattctttttctccggcttcttcgtggtgtttctgtccgtgctgccttacgcactgataaagggaatcatactccgcaagattttcaccacgatatcgttttgcattgtgcttagaatggcagtcacccgacagttcccatgggccgtgcaaacctggtacgactcactcggagcaatcaacaagattcaagactttttgcaaaagcaagaatacaaaacccttgaatacaatctcaccaccaccgaagtggtcatggagaatgtgaccgcattttgggaagaaggattcggagagctcttcgaaaaggcaaaacagaacaacaataacagaaagacgtcaaatggggatgactccctctttttcagtaatttctcgctgcttggaacgcctgtgctgaaggacattaactttaagatcgaacgcggacaactcctggcagttgcaggtagcactggtgctggtaagacttcgctgctgatggtgattatgggtgaacttgaaccttctgagggtaagattaagcattcgggtcggatatcattctgtagccagttttcctggatcatgcccggtaccattaaagagaacattatctttggagtgtcatacgacgagtatcggtaccgttcggttatcaaggcatgtcaactggaagaggatatttctaagtttgcagaaaaggataacatcgtgcttggagaaggtggaattaccctgtcgggtggccaacgggcaagaatatctcttgctcgggcagtctacaaggacgcagatctgtacctgctcgactcaccctttggatacctggacgtccttactgagaaagagattttcgaatcatgcgtgtgtaagctcatggcgaacaagacgcgaatcctggtgacttctaagatggaacatcttaagaaggccgacaagatactgatcctgcatgaaggctccagctacttctacgggactttttctgaacttcagaatctgcaacctgatttttcatccaaacttatggggtgtgattcgtttgaccaatttagcgccgaaaggcggaactccattctcactgaaacgctgcatagattttcacttgagggggacgctccagtatcctggactgagactaaaaagcagagctttaagcaaacgggagaatttggagagaagcgaaagaacagcattctcaatcccatcaatagcattcgaaagttttcaatcgtccagaaaaccccactgcaaatgaacggaattgaggaagattcggatgagccccttgagagacgcctgtccctcgtgcctgattccgagcagggtgaagccattttgccaagaatatcagtgatctcgaccgggcccacccttcaagcacgtaggaggcagagcgtccttaacctgatgacccactcggtgaaccagggccaaaacattcatcgcaaaactactgctagcacccgcaaggtaagccttgcaccacaggcaaacttgactgaattggacatctactcccggagactgtcacaggaaacgggccttgagattagcgaagagattaacgaagaggaccttaaggagtgcttttttgatgacatggagagcataccagccgtgactacctggaacacctaccttcggtacatcactgtgcacaaatccctgatcttcgtgctcatttggtgtctggtgatattcctggcagaagtggctgcgtccctggtggtcctttggcttctgggcaacaccccgctccaagataaggggaattcgactcacagccgaaacaactcctacgccgtcatcatcacttccacctcctcttactacgtattctacatctacgtgggagttgcggacaccttgcttgcaatgggctttttccgaggcctgcctctcgtccacacgctcattaccgtgtcgaagattctccatcataagatgctgcattcagtgcttcaagcaccaatgtcgacgctcaacaccctcaaggcgggcggaattctgaataggttttccaaggatattgcaatcctggatgatctgttgcccctgaccatttttgacttcattcagctgcttttgatagtcatcggcgcgatcgcagtcgtggcggtcctgcaaccttacatcttcgtggcaaccgtgccagtgattgtggcatttatcatgctgcgggcatatttccttcagacctcgcagcaacttaagcaactggagtcagaagggagatcacccattttcacgcacctggtcacgtccctgaaaggactttggacccttagagcattcgggcgccagccatacttcgaaacccttttccacaaggcactgaaccttcacaccgccaattggtttctctacctgagcaccctgagatggtttcagatgaggatcgagatgatcttcgtgatctttttcatcgcagtgaccttcatttcaattctgactactggagaaggggaagggcgggtgggaatcattctcacgctggctatgaacataatgtcgacccttcaatgggcagtgaacagttcaatcgatgtggattccctgatgagatccgtgtcaagagtctttaagttcatcgacatgccgacggaagggaaacccactaagagcacgaagccatacaagaatgggcagctttcgaaggtcatgattattgagaattcccatgtgaagaaagatgacatctggccttcaggtggccagatgaccgtaaaggatctcactgccaagtataccgaaggcggaaacgctatcctggagaacatatcatttagcatatcgccgggtcaacgcgtcggtctgctgggtcgtacggggtcgggaaagtcaactctgctgtcagcgttcctccgccttttgaacactgaaggagagattcaaattgatggagtctcgtgggattccattaccctgcagcaatggcgtaaagcctttggtgttatcccacaaaaagtgttcatcttttcgggaacttttagaaagaaccttgatccatacgaacaatggtccgatcaggaaatttggaaggtggcagacgaagtgggacttcgctccgtgatcgaacaatttccaggtaaactggattttgtgctggtggacggtggatgcgtgcttagccacgggcataaacaattgatgtgcttggcaagatcggtcctgtccaaggcgaaaatacttttgcttgatgagccctcggcacatcttgatcccgttacgtatcagattatccgtagaaccctgaaacaggcctttgcagattgtactgtgattctttgtgagcataggattgaagcaatgctggagtgtcaacaatttctggtgattgaagagaacaaggtgcggcaatacgattcgatccaaaaacttcttaatgaacggtcactttttagacaggcaatttcccccagtgaccgtgtgaagttgtttcctcatcggaattcatccaaatgtaaatcaaaaccacagattgcagctcttaaggaagaaactgaggaggaggtgcaggatactcgtttg

SEQ ID NO: 10154 - DNA, 4440 bp, Artificial Sequence
  Description of Artificial Sequence: Synthetic coding sequence
atgcagaggagcccacttgagaaagctagcgtggtgagcaaactcttctttagctggacacggcccatcctgaggaaaggctatagacagcgcctggaacttagcgacatctatcagattccttctgtagactccgccgacaatttatctgagaagctggagcgggagtgggaccgtgagctggcctccaagaagaatcccaaactaataaatgccctcaggcgctgttttttctggcgctttatgttttacggaattttcctctatctgggggaagtaaccaaagccgtccaacccctgcttttagggcgtataatagcctcatatgatccagataataaagaggaacgcagtattgccatctatctgggcatcggcctgtgtcttctatttatcgttaggactctgctactacatccggctatttttggcctgcaccacatcggcatgcagatgcgtatcgccatgttttctttgatttataagaaaaccctcaagctgagttcaagagttctggataagatttcgatcggccagttagtctccttgctatcgaacaatctgaacaagtttgacgaaggccttgccctcgcccactttgtttggatcgctcccctccaggttgccctgcttatggggctgatctgggagctgcttcaggccagcgccttctgtggtttggggtttctcatcgtgctggctctcttccaagccggcctggggcggatgatgatgaagtatagagatcagcgggctggaaaaatcagcgaacgactcgtgattacctcagaaatgattgaaaatatccagtcagtgaaggcttattgctgggaagaggcaatggagaaaatgatcgagaatctcaggcaaactgagctcaaattgacgcgcaaagccgcatacgtgaggtactttaatagtagcgctttcttcttcagtggctttttcgtcgtgtttctgtccgtgttgccttatgctctgattaagggcatcatcctgcgaaagattttcactacgatctctttctgcatcgtgttgcggatggccgtgactcgacagtttccctgggctgttcagacttggtatgacagcctcggcgctatcaacaagatccaggatttcctgcagaagcaagagtacaagacattggagtacaacctgaccacaactgaggtagtgatggaaaacgtgaccgccttttgggaggaggggtttggtgagctgtttgagaaagcaaagcagaataacaacaataggaaaacatcgaatggagacgattcacttttctttagtaatttctctctattggggaccccagtccttaaggatataaatttcaagatcgagagaggacagctgctagccgtggccgggtccactggcgccgggaagaccagcctgttgatggttatcatgggcgaactagagccttccgaaggaaagatcaagcacagcggacgcatcagcttctgttcccagttttcgtggataatgcccggcacgatcaaggagaacattatcttcggcgtgagttacgatgagtacagatatcgaagcgtcatcaaggcctgtcagcttgaagaggatatcagcaagtttgcagaaaaagacaatatcgttctgggggagggtgggatcacgcttagcggtggacagcgtgccagaatctcactggcacgcgctgtgtataaggatgcggacctgtatctgctcgattccccttttggttatctcgatgtcctgacagaaaaggagatctttgaaagttgcgtatgtaagctgatggccaataagaccaggattctggtcactagcaagatggaacacctgaagaaggctgataagatcctaattcttcacgaaggcagctcatacttctacggaactttctctgagctccaaaacctacagcccgacttctcctctaagcttatgggttgtgacagctttgaccaattctcagcggagcgtagaaatagtattctgaccgagaccctccatcgattctctctcgagggtgacgccccggtgtcatggacagagactaagaagcagtcttttaaacaaacaggagagtttggcgagaaacggaagaatagcatcctgaaccccatcaatagcattcgtaaattttccatcgtacagaagaccccactgcagatgaacgggatcgaagaggattcagatgaacccttggagcggaggctgagcttagtccctgacagtgaacagggagaagcgattctgcctcgaatctctgttatatccaccggcccgaccctccaagcgagacggaggcaatcagtgcttaatctcatgactcactctgtcaatcagggacaaaacatccacagaaagacaactgcatccacacggaaagtgagtctggccccccaggcgaacctaaccgagctagatatctatagtcggcgtttgagccaagaaactgggcttgagatcagcgaagagatcaatgaagaggatcttaaggaatgtttcttcgacgatatggagtccatccccgctgtgaccacttggaacacttatctgcgatacatcacagtccataaatccttaatattcgttctgatttggtgtcttgtaatttttctcgcagaggtggccgcatccctcgttgtgttgtggctcctgggcaacacaccactccaagataagggcaacagtactcatagtaggaacaatagctatgctgttattattacctcaaccagttcttactacgttttctatatctacgtgggcgtggcagacaccttgctggcaatggggttcttcagagggctccccttggtgcacaccctgataacggtctccaagatcctacaccataagatgttgcatagtgtcttacaggcccctatgtctaccttgaatacactgaaagccggggggatactgaatagattctccaaagacatcgctatcctggatgacctgctgcccctgacaatctttgattttattcagctgcttctcattgtgatcggggcgatcgcagtcgtggcagtgttgcagccgtatatattcgtagctaccgtgcctgtgatcgtggcattcattatgctgcgagcttatttcctccagaccagccagcagttgaagcaactcgaaagcgaaggcaggtcacccatctttacacatctggtaactagtctcaaaggtttatggacattgagagccttcgggcgacagccatatttcgaaaccctgtttcacaaggccctgaacctccatacagccaactggttcctttacctatctactttaaggtggtttcagatgcgcatcgaaatgatcttcgtcattttcttcatagctgtgacatttataagcattctgaccaccggcgagggggaaggcagagtgggcattattctgacactggcaatgaacatcatgtcgaccttgcaatgggcagtcaattcgtccatcgacgtagactctttaatgaggtcagtgtctcgcgtgttcaaatttattgacatgcctacagagggtaaaccaacaaagtccaccaagccatacaagaacggccagctgagtaaggttatgattattgagaactcccacgtcaaaaaggacgacatatggccaagcggagggcagatgactgtgaaagatttaactgcaaaatatacagaaggtggcaacgcaatcctagagaacatcagcttctctatatcacctgggcagagggtgggactgttaggccggacagggtctgggaagagcacattgctgtcagcttttctccgtctcctgaacactgagggggagatacaaattgacggagtttcttgggatagcatcactctgcaacagtggaggaaggccttcggcgtcatcccccaaaaagtctttatcttctctggaacatttcgcaagaatttggatccttatgaacagtggtcggatcaggagatctggaaggtcgcagacgaggtagggttgcgcagtgttatcgagcagttccctgggaagctggacttcgtgctggtggatggtggctgcgtcctgtcacacgggcataagcagttgatgtgtctggcccgcagcgtcctgagcaaagccaaaattcttttgttggatgaaccttctgcccatcttgatcctgtgacctatcagatcatacgaaggaccttgaagcaagccttcgccgattgtaccgttatactgtgcgagcaccggatcgaggcaatgctggagtgtcagcagttcctggtgattgaggaaaacaaagtgcggcaatatgatagcattcagaagctgctgaacgaacggagtctgtttcggcaggcaatctccccatcagatcgggttaaactgttccctcatcgaaatagcagcaaatgtaagagcaagccccagattgctgccctgaaagaggaaacagaagaggaagttcaggacactcgactc

SEQ ID NO: 10155 - DNA, 4440 bp, Artificial Sequence
  Description of Artificial Sequence: Synthetic coding sequence
atgcagcggagtccactggaaaaggcctccgtggtgagcaaactgttcttttcgtggactcgaccgatcttgcggaaaggctaccgccaaagactggaactgtcggacatctaccaaatcccatcagtggactcggcagataacctgtccgagaagctcgagcgcgaatgggaccgcgagctcgcctccaagaagaacccaaaactgatcaatgctctgcgccgctgctttttctggcggttcatgttctacgggatcttcctgtacctgggcgaagtgactaaggctgtgcaaccgctgctgctgggacggatcatagcctcatacgacccagacaacaaggaagaacgctccatcgccatctacctgggaatcggactgtgcctcttgtttatcgtgagaactctgttgctgcacccagctatctttggtctgcaccacatcggaatgcagatgcgtatagcgatgttctccctcatctacaaaaagaccctgaaactgagctcaagagtgctggataagatctccatcggacagctggtgtcactcctctccaacaatctcaacaaatttgatgagggactggctctggcccatttcgtgtggatcgccccactccaggtggcactgttgatgggactgatctgggaactgctccaagctagcgctttctgcggcctcggcttcctgattgtgctggcgttgtttcaggccggtcttggacggatgatgatgaagtaccgggatcagagggccggcaagatttccgaaaggctcgtgatcacctctgagatgattgagaatatccagtcggtcaaggcatactgttgggaagaggcaatggaaaagatgatcgagaacttgagacagaccgagctgaagctgacgcggaaagctgcatacgtgagatacttcaattcatcagcgtttttctttagcggctttttcgtggtctttctgtcagtcctgccatacgctctgatcaagggaatcatcctccggaagatcttcactactatctccttttgcatcgtgctgaggatggcggtaacccgccagtttccatgggccgtgcaaacgtggtacgattcactgggagccatcaacaaaatccaagacttcctgcagaaacaagaatacaagaccctggagtacaacctgactaccactgaagtcgtgatggagaacgtcactgctttctgggaagagggattcggagaactgtttgaaaaggcgaagcagaataacaacaatagaaagaccagcaatggagatgactcgttgtttttctcaaacttctcactgcttggaacccccgtcctgaaggacatcaatttcaaaatcgaaagaggacagctgctcgccgtggcaggctcgactggagcgggcaaaacctcgctgctcatggtgatcatgggagagctggagccttccgagggaaagatcaaacactcaggtagaatctctttctgttcgcagttcagctggatcatgccagggaccatcaaggaaaacatcatcttcggagtgagctacgatgaataccgttaccggtcggtcataaaggcatgccagctggaggaagatatcagcaaattcgccgagaaggacaacatcgtgcttggagagggaggtatcacgctgagcgggggacaacgcgcccgaatctccctggcacgcgctgtctacaaagacgctgatctgtacctcctggactcaccgtttggctacctcgatgtgcttaccgagaaggaaatcttcgaatcgtgtgtgtgcaagctgatggctaacaaaactagaatcctggtgacctcgaagatggagcacctgaagaaggccgacaagatccttatcctgcatgagggcagcagctacttctatggaaccttctccgagctgcagaatttgcaaccggacttctcgtcgaaactgatgggctgtgactcctttgaccagttcagcgcagaacgccgcaattcaattctgactgaaacgctgcatagattctccttggagggagatgcgcctgtcagctggaccgagacgaaaaaacagtccttcaagcagaccggagaatttggcgaaaaacggaagaactcgatccttaatccgatcaactcgatccgcaagttcagcatcgtgcagaaaacgccactccaaatgaatggaattgaggaggacagcgacgagccgctggaacgtaggttgagcttggtgccggactcagaacagggcgaggccattctgccgcggatctcggtgatttcaactgggccgacgctccaggcgagacggcgccagagcgtcctgaacctgatgacgcattccgtcaatcaaggacaaaacattcatcgcaaaactactgcctcgacgcggaaggtgtcccttgccccgcaggctaatctgaccgaactggacatctattcccgccgcctcagccaagaaactggacttgaaatctcggaagaaatcaacgaagaggacctgaaggagtgctttttcgacgatatggagtcaattcccgcagtcaccacgtggaacacctacctgcggtacatcactgtgcataaatcgctcattttcgtgttgatctggtgtctcgttatcttcttggcggaagtcgcagcgagccttgtcgtgctgtggctccttggaaatacccctttgcaggacaagggaaactcgacgcactctcgcaacaatagctacgcagtcatcatcacgtcgacttcgagctactacgtgttttacatctacgttggggtggctgataccctgctcgcaatgggcttcttccggggtttgcccctggtccacaccctgattaccgtatccaagatcctgcatcacaagatgctgcactcggtgctgcaggcgcccatgtcaaccctgaacactctgaaggcgggcggcatcctgaatcggttttccaaggatatcgccattctggatgacctcctcccgttgactattttcgacttcatccaactgctgcttatcgtcataggtgcgattgcagtcgtagccgttctgcagccttacattttcgtggcaaccgtccctgtcattgtcgctttcatcatgcttagggcttacttccttcagacttcgcaacaactcaagcagctggaatcggaggggcggtcgccgatcttcacgcacctcgtcacctcgctcaaagggctgtggactctgagagccttcgggaggcagccgtacttcgagactttgttccataaggcactgaacctgcacaccgccaattggttcctctatttgagcactctgcggtggttccagatgcgcatcgaaatgattttcgtgattttctttattgcagtgaccttcatctccattctcacgaccggagaaggggagggacgagtgggtatcatcctcactctcgcaatgaatatcatgtccaccctccagtgggccgttaatagttccattgatgtggattcgctgatgcgatccgtgtcacgcgtgttcaaattcattgacatgcccactgagggcaagccgacgaagtcgaccaagccttacaaaaatggacagctctcgaaggtgatgattatcgaaaactcgcatgtgaaaaaggacgatatctggcccagcggcgggcagatgaccgtcaaagacctcacggctaagtacaccgaagggggaaacgcaatcctcgagaatatcagcttcagcatcagcccaggtcagagagtcggactcctcggaagaacgggatcgggcaaatccactcttttgtcggcgttcctgcgcttgctgaataccgagggggagatccagatcgacggtgtctcttgggattcaatcaccctgcagcagtggcggaaagccttcggggtgatcccgcaaaaggtgttcatcttttccggaactttcaggaagaacttggatccgtatgagcagtggagcgaccaggaaatttggaaagtcgcggacgaggtggggctgagaagcgtgatcgaacagttccccgggaagctggactttgtgctcgtggacggaggatgcgttctgagccacggccacaagcagctcatgtgtctggcccggagcgtcctttccaaggccaagatcctcctgctcgacgagccgtcggcacacctggaccctgttacttaccagatcatcaggagaactctgaagcaggcgtttgcggactgcaccgtgattctgtgtgaacatcgcattgaagctatgctggaatgccagcagtttctggtgatcgaggaaaacaaagtgaggcagtacgactccattcagaagctgctgaacgaacggtcactgtttagacaagcaatcagccccagcgaccgcgtcaagctgttcccccacaggaattcatcgaagtgcaagtcaaagccccaaatcgcagcactgaaagaagaaaccgaggaagaagtccaggacactaggctg

SEQ ID NO: 10156 - DNA, 4440 bp, Artificial Sequence
  Description of Artificial Sequence: Synthetic coding sequence
atgcagagatctccgttggaaaaagcttctgtggttagtaagctgttctttagctggacccggcctatactgcgtaaaggatatcgtcagcggcttgaattgtcggatatttatcagatacctagtgttgattcagccgacaacttgagcgaaaaacttgagcgtgagtgggacagagaactggcgagcaaaaagaatccgaaacttattaatgcacttcgcagatgctttttctggcgctttatgttttatggaatcttcttgtacttaggagaggtaactaaagctgttcaaccgcttctgctgggtagaatcattgcttcatacgatcctgataataaggaagagcgtagcattgccatctatttgggcattggcttatgtttattgtttatagtgcgtacgctattattacaccctgctatatttggcctacatcatataggaatgcaaatgcgaattgcgatgttttctctgatctataagaagacattgaaactgtcgtcacgtgtattagataaaatctccataggtcagctcgtatcattacttagtaataatttaaataaatttgatgagggattagcactggcccatttcgtatggatcgccccgttacaggtggccctgctaatgggcctgatctgggaattattacaggcttctgcattttgcggcttaggtttccttatcgtgcttgctctttttcaagctggcttaggccgaatgatgatgaagtatcgtgatcagcgcgcgggcaagatttccgagcgcctggtgattacgagcgaaatgatcgaaaacatccagagtgttaaagcgtattgctgggaggaggcaatggagaaaatgatagagaatctcaggcaaacggaattaaaacttacacgcaaagcagcgtatgttcgatattttaattcatccgcgttttttttttcaggattttttgtggtttttctgtcagtattaccgtatgcccttatcaaaggaatcattcttcgtaaaatttttacgacgatttcattttgtatcgttctgcgtatggcggtcacgcgacagtttccgtgggcagtgcagacatggtatgactcgctcggtgccatcaataaaatacaagacttcctgcaaaagcaggagtataagacattagaatacaatcttacaacaacagaagttgtcatggagaacgtgactgctttctgggaggaggggtttggcgagctttttgaaaaagcgaagcaaaataataataatcgtaaaacttctaacggggacgattctttgttcttttctaatttttcgttgctgggaacaccggttctaaaagatatcaattttaaaattgagcgtggccagttactggcagtcgcaggctctacaggcgccggtaaaaccagccttttaatggtcattatgggagaacttgaaccctctgagggaaagatcaagcatagcggccgaattagcttttgctcccagttttcatggataatgccaggaaccatcaaggaaaacatcatttttggagtgtcgtacgatgagtaccggtatcgttcagttatcaaagcttgccaacttgaggaagatatttcaaagtttgccgaaaaagacaatattgtcctgggtgaaggcggaattacactttcgggaggacagagggctcggatttcgttggcgcgcgcggtttataaagacgcagatctgtatttacttgattccccatttggttatttggatgttttaacggaaaaagaaattttcgaatcttgcgtgtgcaaactgatggctaacaagacgcgcattctggtcacttcgaaaatggaacacctgaaaaaagctgataaaatcctgatcctgcatgaaggaagttcctatttttatggcaccttttctgaattacagaacctgcaaccggactttagctctaaactcatgggatgtgatagcttcgaccagttctctgcagagaggcgcaattcgatcttgacagagacattgcatagatttagcctcgagggggatgcaccggtgtcttggacggaaacaaaaaaacaaagctttaaacagacaggggagttcggggagaaacggaagaattccatcctgaatcctattaacagcattcgcaagttttctattgttcaaaaaacacctttgcagatgaatggaatcgaggaagacagtgatgagcctttggaacggagattgtctcttgttccggattccgagcagggagaagccattcttcctcgtatctcagttatatcgactggtcctacactgcaagcaagacggagacagtcggttctaaacctgatgacacatagcgtgaaccaagggcagaacattcataggaaaacaaccgcatcaacccggaaggtttctttggcgccacaagcaaatttaacagagctggatatttatagtagacggctgtcacaagaaacaggtttggaaatttcagaagaaataaatgaggaagaccttaaagaatgcttttttgatgatatggagtctattccggctgtcacaacgtggaacacatatttacgttacattacagttcataaatcgcttatttttgtcttaatttggtgcctggtcatttttttggctgaagttgctgcgtcgcttgttgtcttatggttattaggtaatacacctttacaggacaagggcaacagtactcactcgcggaataattcttatgcagtgatcattacaagtacaagctcctattatgtattctatatctatgtgggagttgcagacacacttctggcgatggggtttttcagaggattaccgcttgtgcatacgctgattaccgttagcaaaatcctgcatcataaaatgctgcattcagtgttacaagccccgatgagtacgttaaataccttgaaagcgggcgggattcttaataggttttctaaagatattgcaatcctggatgatcttcttccgttgactatttttgattttatccaactactgctgatcgtgataggtgccatagccgtcgtcgcagtactgcagccttatatctttgttgccactgtgccagtgattgtagcattcattatgcttcgtgcttatttcctgcaaacatcacaacagttaaagcagctcgaatccgagggtagatctccgatttttacacatctggtcacatcgcttaaaggcctctggaccttacgagcctttggccgccaaccgtacttcgaaacgctctttcataaggcgttaaaccttcacacagccaattggtttttatacctgtccactcttcggtggtttcaaatgagaatcgagatgattttcgtgatcttttttattgccgttacatttatttctattttgacaacgggtgagggagaaggtagagttggcattatactaactctcgcaatgaatataatgtccacattacagtgggcagtgaacagttctattgacgtagactcacttatgcgcagcgtcagcagagtttttaagttcatcgacatgccgaccgaaggcaagccgacaaagtcgacaaaaccgtataaaaacggacagcttagcaaagttatgatcatagaaaattcccatgtaaaaaaagatgacatatggccatctggcggacaaatgacggttaaggatttaactgcaaaatacacagaaggaggcaatgcgatcttagagaatatctcgttctccatttcaccgggacagcgtgtaggcttattaggtcgcacaggctctggaaaatcaacacttctttcagcttttctgcgactgctcaacactgaaggagaaatccagatcgatggcgtctcttgggactctattacacttcagcagtggaggaaagcgtttggtgttattccacaaaaagtctttatttttagcggtacgtttagaaaaaatctggacccttacgaacaatggtcagatcaagaaatctggaaggtagcggatgaggtcggcctccggtcagtgatcgaacaatttccgggcaagttagattttgtgctggtagatggaggctgtgtacttagccatggccataaacaactgatgtgtcttgcgagaagcgtactttctaaggcgaaaatactgttacttgatgaaccgtcggcgcacctcgatccagttacctatcagattattcgacgcacacttaaacaggcatttgccgattgcacggtaatcctctgtgagcaccgtatcgaagctatgcttgaatgtcagcagtttcttgttattgaagagaacaaagtgagacaatatgactctatccagaaattattaaacgaaagatcgctttttagacaggcaatctctccaagtgacagagttaagctcttcccacatcggaactctagcaaatgtaagtctaagccgcagattgcagcccttaaagaagaaacagaggaagaggttcaggatacacgcctc

SEQ ID NO: 10157 - DNA, 4440 bp, Artificial Sequence
  Description of Artificial Sequence: Synthetic coding sequence
atgcagagatctcccctcgaaaaagcctctgtggtgtcaaaactgtttttttcctggacgcgtcccattctgcgtaagggttataggcagcggcttgagctcagtgatatataccagattcctagcgtggattcagccgataatctttctgaaaaactggagcgcgaatgggaccgagaattggcatccaaaaaaaatccaaaactgataaacgcactcaggagatgtttcttctggcgctttatgttctacgggatttttttataccttggcgaagtcacaaaagcagtgcaacccctcctactcgggcgcatcatagcctcttacgatccagataataaagaagaacgatccatagctatatatctcggaataggcctgtgcctgctgttcattgttcggaccctcttactgcatcccgctatcttcggattgcaccacataggcatgcagatgagaatcgcaatgtttagtttaatttataagaagactctgaagctttcatcacgcgtcctcgataagattagtatcgggcagctggtctccctcttgtcaaacaacctgaataagtttgatgaaggactggccttggctcatttcgtgtggattgcaccgcttcaggtcgcactgcttatgggtttgatttgggagctgctacaggctagtgccttctgcgggctcggtttccttatcgtgctagcacttttccaggccggtctggggagaatgatgatgaagtatcgggatcaaagagccgggaagatctcagagcgcctcgttataacttctgaaatgatagaaaacatccagtctgtgaaggcctactgttgggaagaggccatggaaaagatgatcgagaaccttcggcagacagagctgaaactgaccagaaaggccgcctatgtgagatactttaactcatcagcttttttcttcagcgggttcttcgtcgtcttcttgtctgtgctgccttatgcgctgattaaggggataatcctgagaaaaatctttactaccatctcattctgcatcgtcctccggatggctgtcaccaggcagttcccttgggccgtccagacgtggtacgacagccttggcgctatcaataagatccaggattttcttcagaagcaggaatacaagaccctggagtacaatctgaccaccactgaggttgttatggaaaacgttaccgccttttgggaggagggatttggagagctgttcgaaaaagctaagcagaacaataacaaccgaaaaacttccaacggagacgacagcttattcttttcaaatttctccctcctgggaacacccgtgctcaaggacattaacttcaagatagaacgagggcagctgctcgcagtggcagggtcaaccggcgccgggaaaacaagcttactgatggtcatcatgggggagttagagccctcagaaggaaagattaagcactccggccgaatttccttttgttctcagttctcatggatcatgcccgggaccataaaggagaatattattttcggtgtttcatacgatgagtaccgctatcggagtgtcatcaaggcatgtcagctggaagaggacatttctaagttcgccgagaaggacaatattgtcctcggagagggaggcatcacattgtccggaggtcaacgagcacggatcagtcttgctcgtgcagtgtataaagatgccgatctttacctgttggattctccattcgggtaccttgacgtcctcaccgagaaggagattttcgagtcctgcgtatgcaagttaatggctaacaagacccggatccttgttactagcaaaatggagcatctaaagaaggctgacaagattctgattctgcatgaagggtcctcctacttttatggtaccttttctgaactacaaaacctgcaacccgactttagctccaagcttatggggtgtgattcctttgaccagttctcagccgaaaggaggaactccatcctaactgaaacccttcatcgtttcagtctcgaaggcgacgccccagtctcatggacagagacaaagaagcagtcttttaaacagaccggcgagttcggggagaagagaaaaaacagtatcctgaacccaatcaattctattcgaaagttcagcatagtgcagaagacaccacttcagatgaacggaatagaggaagactccgacgagcctcttgaacgcagactctctctagtcccggactcggaacagggtgaagctattctgcctcgcatctcagtgattagtaccggacctaccctgcaagccagaaggagacagtcggtgctcaacctcatgacccattccgtgaatcagggccaaaacatccataggaaaacgacagcgtcgacacgcaaggtttccctcgccccccaggctaatctcactgaactcgacatatatagccggcgacttagtcaggaaactggtttagaaattagcgaagagattaacgaagaggatcttaaggagtgcttctttgacgacatggagtccattcctgccgttacaacatggaatacttacctgcgatacatcactgtgcacaagagtttgatcttcgtgctcatttggtgtctcgtgattttcctcgcagaggtggcggccagtctcgtggtgctctggctgcttggaaacaccccattacaggacaaggggaacagtacccactccaggaacaactcgtacgctgtgattatcacttcaaccagcagttactacgtattctatatttatgtcggcgtggcagatacactcctggcaatgggtttttttaggggcttgccgctggtgcacacactcataacagtttctaagatcctgcaccataagatgctgcactcagtgctccaggcacctatgtcgacactgaacactcttaaggcaggagggattctgaatagattctcaaaggacattgcaatcctggacgatttgctccccctgactatcttcgacttcattcagctcctgcttattgtgattggggccatagctgtggtggcggtgttgcagccatacattttcgtggctaccgtcccagtgattgtggcgtttatcatgctaagagcgtacttcctccagacttcccagcagcttaagcagctggaatccgaaggacggtcaccaatcttcacgcatctggttacctcactgaaggggctttggactctccgagccttcggccgtcagccctattttgagaccctgtttcataaagcactcaacctccacaccgccaattggttcctttatctgtctaccctcaggtggttccagatgcggatcgagatgatttttgtgattttctttattgccgtgacctttataagcatcctgaccacgggagagggggaaggacgggtgggcattattttgaccttggccatgaacattatgagtactcttcaatgggccgttaactcctcaatcgatgtcgactcactcatgcgctctgtgtcccgagtctttaaattcatcgatatgccaacggagggcaagccaacaaagtccacaaaaccttacaaaaacggccaactatcaaaagtaatgatcattgagaactctcacgtgaagaaagacgacatttggccctccggagggcagatgactgtgaaggacctgaccgctaaatacacagaagggggtaatgccattctggagaatatatctttctccatctctccgggacagcgcgtggggctcctgggcaggaccggctctggcaagagtacccttctgagcgcctttctgcggctgctgaataccgagggcgaaatacaaatagacggtgtgtcatgggactccattactcttcaacagtggcgcaaagctttcggagtgatccctcagaaggtgttcatcttttctgggacgttccgtaagaatttggacccctacgaacagtggagcgatcaggagatttggaaagttgcagacgaggtggggctgcgatccgtaatcgagcagttcccaggcaaacttgattttgtcctggtcgacggcgggtgcgtgttgagccatgggcacaaacagctgatgtgcctcgcccggtccgtcctaagtaaagccaagattctactattagacgagccttctgcgcatctcgaccctgtaacatatcagatcattcgcagaacgttgaagcaagcctttgccgactgtacagtgatattgtgcgagcaccggatcgaggcaatgcttgaatgtcaacagtttctcgttatcgaggaaaataaggtcagacaatatgattctattcaaaagctgctgaatgaacggtctctgtttcggcaggccatttctcctagtgatagagtgaagttgttcccccacaggaacagtagtaagtgcaagagcaaaccacagattgccgctctgaaggaggagactgaggaggaggtgcaagacacccgattg

SEQ ID NO: 10158 - DNA, 4440 bp, Artificial Sequence
  Description of Artificial Sequence: Synthetic coding sequence
atgcagagatccccgctggagaaagcatccgtggtgtccaaactcttcttttcctggaccagacctattttgcgaaagggatacaggcaaagacttgagctgtcggacatttaccaaatcccctctgtggatagcgccgataatctctccgaaaaacttgaaagggagtgggacagggaacttgccagcaaaaagaacccaaaactgatcaacgcgctgcggcggtgtttcttttggcgttttatgttttacggtatctttctttacctcggagaagtgactaaagcagtgcaacctttgctccttggccgcattatcgcctcatacgatcctgacaacaaggaagagaggtcgattgccatctacctcggtataggactttgcctcttgtttatcgttagaactctgcttctccaccctgcaatctttggactccaccatatcggcatgcaaatgaggatagcaatgttctcgttgatttacaagaaaaccctgaagctgtcgagccgcgttcttgataagatctccatcggacagctggtgtccctcctgagcaacaacctgaacaagtttgatgagggacttgcactggcccactttgtttggattgcgccactccaggtcgcactgttgatgggcttgatctgggaactcctccaagcgtctgccttttgcgggctgggttttctgattgtcctcgccctttttcaagccggacttgggcgcatgatgatgaagtacagggatcagagggcgggtaagattagcgagcgccttgtcataaccagcgaaatgattgagaacatccagagcgtcaaggcatactgctgggaagaggcaatggaaaagatgatcgaaaatctgcgtcaaactgaattgaagttgactagaaaagcagcgtacgtgagatacttcaattcgtcggcattcttcttttcgggcttttttgtcgtattcctttccgtgcttccctacgcactgatcaaggggattattctgcggaagattttcacgactatttctttttgtattgtattgagaatggcagtcacccgtcaattcccatgggctgtgcaaacctggtacgattcgctgggggcaataaacaagatccaggatttcttgcagaagcaagaatacaagacgcttgagtacaatctcaccactaccgaagtggtgatggagaacgtgacggcattttgggaagaaggcttcggagaactgttcgaaaaggcgaaacaaaacaataacaacaggaaaacgtcgaatggcgacgattccctgtttttcagcaacttctcactcctcggaacccctgtgcttaaggatatcaatttcaagatcgaacgcggacaacttctggcagtggcagggtccacgggtgcaggcaagacgtcactgctcatggtcataatgggagagcttgaaccttctgaaggaaagatcaagcacagcgggcgaattagcttttgttcccaattctcgtggattatgccaggtaccataaaggaaaacataatcttcggcgtgagctacgacgaatacagatataggagtgtgattaaggcatgtcagcttgaagaagatatctcgaagttcgcagagaaggataacatcgtccttggagaggggggaatcactctgtcaggaggtcagcgagcacggataagtttggcaagggccgtctacaaagatgcggatctctacctgcttgattccccttttggctacctggatgtgctgacggaaaaggaaatctttgagtcgtgcgtgtgtaaactgatggccaataagactagaattctggtaaccagcaagatggagcatctcaagaaggcggataagattcttattcttcacgagggatcgtcctacttttacgggacgtttagcgagttgcagaatctccagcctgatttctcctcaaagctcatggggtgtgactcatttgatcaattttcggcggaacggaggaacagcatacttactgaaactcttcataggttttcgctggagggtgacgcgcctgtctcttggactgaaactaagaagcagagctttaagcagacgggagaattcggtgaaaaaaggaaaaactcgattcttaacccgattaactcgatccggaaattctcaattgtgcaaaagacgcctcttcagatgaatggtatcgaagaagattcggatgaacctctggagcgcagactgagccttgtgcccgatagcgagcaaggagaagcgatactgcctcgcatcagcgtgatttccaccggaccaaccctccaggcacgccggagacagtcggtgcttaacctgatgactcactcggtcaatcaggggcagaacattcatcgaaaaacgactgcttcgacccggaaagtctcccttgcacctcaggccaatctgacggaactcgatatctactcgcggcgcctgtcgcaagaaaccggacttgagattagcgaagagattaacgaagaggaccttaaggagtgcttttttgacgacatggaatccatacccgcagtgaccacctggaatacctaccttcgatatatcaccgtacacaagtccctgatttttgtgcttatttggtgccttgtcatttttctggcagaagtcgcggcatccctggtggtcctgtggcttcttgggaatactccactccaagacaaaggcaactccactcattcacggaacaactcctatgcagtgatcattacctcgacctcgtcttactacgtgttttacatttacgtgggagttgcagataccctccttgcaatgggattcttcagaggactgccactggtgcataccctgatcaccgtctcgaaaatactgcatcacaagatgcttcattcagtgctccaagcaccaatgtccacccttaacactctgaaagctggtggaatcctcaatagatttagcaaggacattgccatactggacgaccttcttcccctgactatctttgactttattcagctccttcttatcgtcatcggagcaatagccgtggtggccgtgctgcagccctacatcttcgtggccaccgtcccagtgattgtggccttcattatgctcagggcttacttcctgcagacctcgcaacagcttaagcaactcgagagcgaagggcgtagccccattttcacccacctggtcacgtccctgaaaggtctgtggaccctgcgcgcctttggacggcaaccttactttgaaactctgtttcataaggcgttgaacctgcataccgcaaattggtttctttacctgtcgactctccggtggttccagatgcgtattgaaatgattttcgtgatattctttattgcagtgactttcatttccattcttactactggtgagggtgaaggacgcgtcggtattatcctgacccttgcgatgaacataatgagcaccctgcaatgggcggtcaattcgagtattgatgtcgactcgctgatgagatccgtgagccgggtgtttaagtttatagacatgccaacggaagggaaaccaaccaagtcaaccaaaccttataagaacggacagctcagcaaggttatgatcatcgaaaacagccacgtgaagaaagacgatatttggccttccggaggtcaaatgacggttaaggatctcaccgcaaagtacaccgagggaggcaatgcaatccttgaaaacatctccttctcaatatcacccggccagcgcgtgggtctgctgggtagaactggctcgggtaagtcgactcttctttcagcatttctccgccttctcaacaccgaaggggaaattcagattgatggggtttcctgggattcaattacgctccaacaatggcggaaggcttttggcgtgatccctcaaaaagtctttatcttttcggggacgttccgtaagaacctggatccatacgagcaatggtcagatcaagagatctggaaggtggccgatgaagtggggctgcgctcagtgatcgaacagtttccgggaaagctggatttcgtcctcgtggatggcggttgtgtgctgtcccacggacataagcagcttatgtgtcttgcaagaagcgtcctctctaaagcgaagatacttttgcttgatgaaccgtcggcacatcttgacccggtgacctatcaaatcatccgccggactcttaagcaagcgtttgcggactgtaccgtgatattgtgcgagcatcgcattgaggcaatgctggaatgtcaacaatttctggttatagaagagaataaggtgcgtcaatacgactcaatacagaaattgctcaacgagcgctccctctttaggcaagcaatttccccgagcgacagggtgaagctgttcccccatagaaattcatcaaaatgtaaatccaaaccacaaatcgctgccctcaaggaagaaaccgaagaggaagtccaggacactcgcctt

SEQ ID NO: 10159 - DNA, 4440 bp, Artificial Sequence
  Description of Artificial Sequence: Synthetic coding sequence
atgcagcgaagcccgctggaaaaagcgtcggtggtgtcgaaactgttcttctcgtggactcggccaatcttgaggaaaggttacagacagcgtctggaactcagcgacatctaccaaattccaagcgtggattccgcagacaatctctctgagaaactcgaacgcgagtgggatagagaactcgcttcaaagaagaaccctaaactcataaacgcgctgagacgatgctttttctggaggttcatgttctacggaatctttctgtacctgggtgaggttacgaaggccgtgcagccacttctcctcggacggatcatcgcgtcgtacgatccggacaacaaggaggaacgcagcatcgccatctatctggggattggactctgtctgctctttatcgtccgcacgctgctgctgcatccagccatcttcggcctccaccacatcggaatgcaaatgcgcatcgccatgttcagcttgatctacaaaaagactctgaagctcagctcccgcgtgctggacaagatttcgatcgggcagctggtgtcgctgctgtcaaataacctgaataagttcgacgagggactggcactggcccatttcgtctggatcgccccactgcaggtggcgctgctgatgggcctcatctgggagctgctccaggcgtcggctttctgcggtctgggtttcttgatagtcctggccctgttccaggcgggactcggccgcatgatgatgaagtaccgggaccagcgcgccggtaagatctcggaacggctcgtcatcacgagcgaaatgatcgagaacatccagtcagtgaaggcgtactgttgggaagaagctatggagaagatgattgagaacctgagacaaaccgagctgaaacttactcggaaggcagcttacgtgcgctatttcaactcctcagccttcttcttctccggattcttcgtggtgttcctctcggtcttgccgtacgccctcatcaagggaatcatcctgcgcaagatctttaccactatcagcttttgcatcgtgctgcggatggccgtgactagacagttcccgtgggccgtgcagacctggtacgactccttgggggccatcaacaaaatccaagacttccttcagaagcaggaatacaagaccctggagtacaacttgactactactgaagtcgtgatggaaaatgtcactgcgttttgggaagaaggattcggggagttgtttgagaaagctaaacaaaacaacaacaaccggaaaacctccaatggggatgactccctcttcttctccaatttctccctgctcggaactccagtgctgaaggatatcaactttaagatcgagcgcggacaactgctggccgtcgctggatcaactggagctggcaagacttccctgcttatggtgattatgggcgaactggaacctagcgagggaaaaatcaagcattcgggacgcatttccttctgcagccagttcagctggattatgcccgggaccatcaaagaaaacatcatctttggagtctcctacgacgaatacaggtaccgatcggtcatcaaggcctgccagctggaagaggacatctcaaagttcgcggaaaaagacaacatcgtccttggagaaggcggaatcactctgagcggaggtcagagagccagaatatccttggctcgggcagtgtataaggatgccgacctgtatcttcttgactcccctttcggttacctcgacgtgcttactgaaaaggagatcttcgaatcatgcgtctgcaagttgatggccaacaaaacccgcattctggttacttcgaagatggagcaccttaagaaagctgataagatccttatcctccacgaggggagctcctacttctacggcaccttctctgagctgcagaatttgcaaccagatttctcgtcgaagctgatggggtgcgactcgttcgaccagttctcggctgaacggaggaactcgatcctgacggaaaccctgcatagattctcgctggaaggggatgccccagtgagctggaccgagactaagaaacagtccttcaagcagactggggagtttggggagaaacgcaagaattccatcttgaacccgatcaactcaattaggaaattctccatcgtgcaaaaaactccgttgcagatgaatggaatagaagaggattccgacgagcctttggagcgcaggctctccctggttcccgactccgaacagggcgaagccatcctcccgcgcattagcgtgatctcgaccggcccaactctgcaagcccgccggcgccagtcagtcttgaacctgatgactcactcagtcaaccagggccaaaacattcaccggaaaaccaccgcatcgacgagaaaggtgagcctggcccctcaagccaacctgactgaactggatatctactcccggaggctttcacaagaaaccggactggaaatctccgaggaaatcaacgaagaagatctcaaagagtgcttcttcgacgatatggaatctatcccagccgtgaccacctggaatacgtatctgcgctacatcactgtccacaagtccctcatttttgtccttatttggtgcctcgtgatcttcctggcagaagtggccgcatcccttgtggtgctctggctcttgggaaataccccactccaagacaaggggaacagcacccactcgcggaataactcgtacgcggtcatcatcacctcgactagctcgtactacgtgttctacatctatgtgggagtggccgatacgctgttggctatgggtttctttaggggactgccgcttgtgcacactctcatcactgtctcgaagatcctccatcataagatgctgcactccgtccttcaagcccctatgagcactctgaataccctcaaagctggagggatcctgaacagattcagcaaagacattgcgatcctcgacgacctgctccccctcaccattttcgactttatccagttgttgcttatcgtgatcggagctattgcagtcgtcgccgtgctccagccatacatcttcgtggcaaccgttcccgtgatcgtggcgtttatcatgctccgcgcctacttcttgcaaacctcccaacaactcaaacagctggaatcggagggtcgctccccgatcttcactcatctcgtgacttccctcaagggactctggaccctgcgcgcctttggcagacaaccgtactttgaaacccttttccacaaggcgctcaatctgcataccgccaattggttcctgtacctctcaactttgcgatggttccagatgcgcatcgaaatgatcttcgtcatattctttatcgccgtgacctttatctcaatattgactactggtgaaggagaaggccgcgtcggaattatccttactctggctatgaacatcatgagcactctccagtgggcggtcaactccagcatcgatgtcgactcgctgatgcgcagcgtgtcgcgggtgttcaagttcatcgacatgccgaccgaaggaaagccgaccaagtctaccaagccctacaagaacggccagctttcgaaggtgatgatcatcgaaaacagccacgtgaagaaggatgacatttggcctagcggtggacagatgaccgttaaggacctgactgcgaaatacactgaaggagggaacgccatcctcgagaacatctcgttcagcatctctcctggacagcgggtggggctgcttggaaggaccggatcgggaaaatcgaccctgttgagcgcatttctccgactgcttaacaccgagggagagatccagatcgatggggtgtcgtgggactcgattaccctgcagcaatggcggaaagcattcggcgtgattccgcagaaggtgttcatcttttcgggaactttccgcaagaatctcgatccgtacgagcagtggtcagaccaagaaatctggaaggtggccgatgaagtgggcctgcgttcagtcatcgagcagttccctggcaagttggacttcgtgctggtcgacggaggctgcgttctgtctcacggccacaaacaactgatgtgcctcgcgcggtccgtgctgtccaaagcaaaaatcctgctccttgacgagccgtcggcgcacctggatccggtgacgtatcagatcatccggagaaccctgaagcaggccttcgcagattgtactgtgatcctttgcgaacatcgaatcgaggccatgctggagtgccaacagtttctggtcatcgaggagaacaaggtgagacagtacgactcaatccaaaagctgctgaacgaaaggtcactttttcgccaggccatctcaccatccgatcgagtcaaactcttcccacatcgcaactcctccaagtgcaagtcgaagccgcagatcgctgcactgaaggaagagactgaagaagaagtccaggacacccgcttg

SEQ ID NO: 10160 - DNA, 4440 bp, Artificial Sequence
  Description of Artificial Sequence: Synthetic coding sequence
atgcagaggtctcccctggagaaagcatctgttgttagtaagctgttctttagttggactcgccccatattacgtaaggggtaccggcaacggttggagctttcagacatttaccaaattccctcagttgactcagctgataatctgtccgaaaagctagagcgagaatgggacagggagctggctagcaaaaagaaccctaaactgattaacgcactacgtaggtgttttttttggcgattcatgttttacgggatttttctctatctgggggaggtgactaaggccgttcagcctctcctgctgggacggattatcgcaagttacgaccctgataacaaagaggaaagatccatcgctatatacttgggcattggtctatgcttactattcatcgtgaggaccctcctcctgcaccctgccatcttcggcttacatcacataggcatgcagatgaggatcgccatgttttctcttatatacaagaagaccctcaaactatccagcagggtgctcgataaaatctccatcggtcaattagtttccctgctgagtaacaatctaaacaaatttgacgagggtctagccctagcacactttgtttggattgcccctctgcaggtggcactgcttatgggacttatttgggagctgctgcaagcctctgcattttgtgggctgggcttccttattgtgctcgctttgtttcaagctggtcttggtcggatgatgatgaaatatagggaccagagagcaggtaaaatctccgaacgtctggtgataacctccgagatgatcgaaaatatccaaagcgtcaaagcctactgttgggaggaggcaatggagaagatgatagagaatctccgccagaccgaactaaagctaacaaggaaggccgcatacgtgagatatttcaattcttctgctttcttcttttcaggtttctttgtagtgttcctctctgtgctgccatatgcactgatcaaggggatcatactgcgcaagatctttactacaattagcttttgtatcgtgctgagaatggccgtcactaggcagtttccttgggctgtgcagacttggtacgactctctgggcgccataaacaagatccaggatttcttacagaagcaggagtataaaaccttagagtacaatctgaccaccactgaggttgttatggagaacgtcacagccttttgggaggaggggtttggagaactgttcgagaaggcaaagcaaaacaacaacaaccgtaagacctctaacggtgacgatagtctattcttcagtaattttagcctgctaggcacccccgtgctgaaggacatcaacttcaagatcgaacggggccagctattggctgtcgccggttcaaccggtgcaggaaagacttccctgctgatggtgataatgggggagctggagccatccgagggcaagataaaacattctgggaggatttccttctgcagccaatttagttggatcatgccaggcacaattaaggaaaacatcatctttggcgtttcttatgatgagtatcgctataggagcgttatcaaggcctgtcaattagaggaagatatctccaagtttgccgaaaaggacaatatcgtgctgggcgaggggggcattaccttaagcgggggccaacgagccagaatctctctcgcaagagctgtgtacaaggatgctgatctgtatctgctggactcccccttcgggtatctcgacgtgctgacagaaaaagagatcttcgagtcctgcgtgtgcaaactgatggctaacaagacacgtatcctagtcacaagtaaaatggagcaccttaagaaagctgacaagattctaatactgcacgagggctcatcctacttctatggcaccttttccgaattacagaacctgcaaccagacttcagcagcaagctcatgggttgcgatagtttcgatcagttctctgccgagcgacgaaactctatactaaccgagactctgcatcgcttctccctggagggagacgccccagtctcttggactgagacaaaaaaacagtcttttaaacagactggcgagtttggcgagaagagaaagaactctattctaaacccaataaacagtattcgcaagttttctattgttcagaaaactcctcttcagatgaacggcatcgaggaagatagcgatgaacctctggagcgtcggctctctctggtgccagattccgagcagggggaggctattcttcccaggatttccgtcatatccaccggccctacactgcaggcaagaagaaggcagtccgtgcttaacctaatgactcactccgtgaaccagggacagaacatccacagaaagactactgcttctacccgaaaagtgtcactggccccccaagctaatctgactgagctggacatttactctcgtagactttcccaggaaactggcttagagatcagtgaggaaattaatgaagaggacctgaaggagtgcttcttcgacgatatggagtcaattcccgccgtcaccacctggaatacatacctgcggtacatcactgtgcacaagtccctgatctttgtgctcatctggtgtctcgtgatattcttggccgaggtggctgcttctctcgttgtgctctggctgctcggtaatacacccctccaggacaaaggtaacagcacccactctcggaataatagctacgctgtgataataactagtaccagctcttattacgtgttttatatatatgttggggtcgctgacactctgttggctatggggttctttcggggtctaccactagttcacacattgattactgtctccaaaatcctgcaccacaagatgttacacagcgttctacaggcccccatgtccacactgaatacacttaaggccggcggaatcttgaataggttctccaaggatatcgccatcctggacgatctgctgccattgaccatctttgattttatacaattactattaatagtgattggggccatcgccgttgtggctgtgctgcaaccttacatttttgtggcaaccgttcccgttattgtcgcattcatcatgttgagggcttactttctgcagacctctcagcagttaaagcagttggagtcagagggcagatcccccatctttactcatcttgtgacctctctcaaggggttatggactctaagagcctttgggcgacagccatatttcgagaccctctttcacaaggcacttaacctccacacagctaattggttcctgtacctcagcactttgagatggttccaaatgcgcatagagatgatattcgtgatatttttcattgcagtgaccttcatctctatactgaccacaggcgagggcgagggcagagtcgggattatcctgactctggcaatgaatatcatgtctactctccagtgggctgtaaatagttccattgatgtcgatagcctgatgagatccgtgtctcgcgtttttaaatttatagacatgccaaccgagggcaagcctaccaagagcaccaagccttacaagaacggccagttgagtaaagtaatgattattgagaactcccatgtgaagaaagatgacatctggccctcaggtggccagatgaccgtgaaggatttgacagccaagtacactgaagggggcaacgcaattttggagaacatctcttttagcatcagcccaggccagcgcgttgggctcctgggcaggacaggctctgggaagtctacactgctgagtgctttcttgcggctcctgaataccgaaggagagatccagattgatggagtgagctgggattccatcacattacagcaatggcggaaggcctttggagtgatcccacaaaaggtcttcatcttcagtgggaccttcaggaagaatttagacccatacgagcagtggagtgaccaggagatctggaaggtggcagacgaagttggcctgcggtccgtgatagagcagttcccaggaaaactagatttcgtgcttgtggacggcggctgcgtgctgtcacacgggcacaagcagctgatgtgtctggctcgcagcgttctaagtaaagctaagattctgctattggatgagccctccgcacatctggaccctgttacctatcagataatccggcggaccctgaagcaagcatttgctgattgcacagtgattctgtgcgaacatcgcatcgaagcaatgctggagtgccaacagtttctggtcatcgaagaaaataaggtgcgacagtatgactctattcagaagctgttaaatgagaggtctttatttaggcaagccataagccccagcgatagagtcaaactgttccctcaccggaattcctccaaatgcaaaagcaagcctcaaatcgctgccctgaaagaggagaccgaggaggaggttcaggatactcgcctg

SEQ ID NO: 10161 - DNA, 4440 bp, Artificial Sequence
  Description of Artificial Sequence: Synthetic coding sequence
atgcagcgttcacctctggaaaaggcctccgttgtatcgaaactgttctttagctggacccgaccaattctcaggaaagggtaccggcagagactcgagctgagcgatatctaccagatcccctctgtggatagcgctgataacctgtcggagaaactagagcgcgaatgggaccgcgaactggcctcaaagaagaatcctaaattgatcaatgctcttcgccgctgcttcttttggcggtttatgttctacggtattttcctgtacctcggagaagtaacaaaggcggtgcaacctctcctgctgggcagaatcatcgcttcgtacgatcccgacaacaaggaggaacggtccatcgccatttacctgggaatcgggctgtgtctgttgttcatagtcaggaccctgcttttgcaccctgccatattcggcctgcaccatatcggcatgcagatgaggatcgctatgttctccttaatttataagaagaccctgaaactgtcatcaagggttctcgataagattagcattggccagctggtatctctgttaagcaacaaccttaacaaattcgacgagggcctggctctagcccactttgtgtggatcgcccctcttcaggtcgcgctcctcatgggtttgatctgggagctgctgcaggcaagcgccttctgcggcctcggttttcttatagtcctagctctgttccaagcaggcctgggccggatgatgatgaaatatagggaccagcgcgctggtaaaatctccgaacgcttggtcataacaagcgagatgatcgaaaatatccagagcgtcaaagcttactgttgggaagaagctatggagaagatgatcgaaaatctgaggcagactgaactgaaacttacacgtaaagccgcctacgtgcggtacttcaattcctcggcctttttcttcagtggtttctttgttgtgtttctatctgtgttgccttatgctttaatcaagggcataattctgagaaaaatcttcacgaccatctctttctgcatcgtgttacgcatggctgtgacaaggcagttcccatgggccgtccagacttggtatgacagtctgggggccatcaataagattcaggacttcctccaaaagcaagaatacaaaacactggaatacaatctgaccacaaccgaggtggtaatggagaatgtaacggccttctgggaggaaggattcggcgagctgtttgaaaaagcaaagcaaaataacaacaatagaaagacttctaatggcgatgactccttattcttttcaaactttagcctgctgggaactcccgttctgaaggacatcaactttaaaatcgagagagggcagttattggcggtggctgggagcaccggggccggaaaaacatcgctgctaatggtgattatgggagagctggaaccctctgaaggtaaaataaagcactccggccggatctccttttgctctcagttctcgtggataatgccggggacgatcaaggagaatatcatttttggagtctcgtatgacgagtaccgttatcggagcgtcatcaaggcgtgccagttagaggaggatatctccaagtttgccgaaaaagacaacattgtgttgggagaggggggcattacgttatccggagggcaaagggctaggatctcgctggctagggccgtgtataaggatgcagacctttacctgcttgactctccatttggttacctggacgtcttaactgagaaggagatatttgaatcatgcgtgtgcaagctcatggccaacaagacaaggatcctcgtgacgagtaagatggagcacttgaaaaaagctgataagatattgatactgcacgaaggcagctcctatttctatgggacgtttagcgagctgcaaaacctccaaccagatttcagctccaagctcatgggatgcgattcgtttgaccagttctcggccgaacggagaaatagcatcctgactgagacactacaccgcttttctcttgaaggtgatgcgccagtaagttggaccgagaccaagaaacaatcctttaaacagacgggtgaattcggggagaagaggaagaatagcatcctgaatccaataaactctattcggaagttttcaatcgtccagaagaccccactgcagatgaacggaattgaggaggattccgacgaaccactcgagagaaggctgtcgctggtccctgatagcgagcagggagaagcgatcctcccccggataagcgtaatcagcaccggacccacactgcaggcgaggcgtcggcaatcagtccttaatcttatgactcacagcgtcaaccaggggcagaacatccacaggaagaccaccgcctcaaccaggaaggtgtcgcttgcaccacaggccaatctgactgagctggacatctactccagacggctttcacaggagacgggccttgaaattagtgaggagattaatgaagaggacttgaaggagtgcttttttgacgatatggagtcaattcctgccgtgacaacctggaatacgtacctaaggtacattacagtccataaaagtctgattttcgtgctgatctggtgtcttgtgatttttttggccgaagtggcagcttctctcgtggttttgtggctgcttgggaacactccccttcaagacaaggggaatagtacccattccagaaacaatagctacgctgtgatcattactagcacttctagttactatgtcttttatatatacgtgggagtggcagatactttactcgcaatggggttcttccgtggcctgcccctcgtgcacaccctcatcacggtaagcaaaatcttgcatcacaaaatgctgcacagcgtgctgcaggcaccaatgagtactctgaatactttgaaagcaggagggatcttgaataggtttagtaaggatatagctattctcgatgacctgctgcctctgacaattttcgatttcatccagctcttattgattgtcataggagccattgcggttgtggcggtgctgcagccctacatcttcgttgccactgtgccagttatagtcgccttcatcatgctaagggcctattttctgcaaacatcgcaacagcttaagcagctagaaagtgagggccgctccccaatctttacccacctggtgacctccctgaaaggtctctggactctgcgcgcatttgggagacaaccgtactttgaaaccctcttccacaaagctttaaatcttcataccgctaactggtttctgtaccttagcaccttgcgctggtttcagatgaggatcgaaatgatctttgtgatcttcttcattgcggtgaccttcatctccatactgactaccggcgaaggagagggacgagtgggcatcattctcactctggccatgaatattatgagcacgctgcagtgggctgtcaatagttccattgacgtcgactccttgatgcgaagcgtgtcccgcgtcttcaagttcattgacatgcccaccgagggtaaaccaaccaagagcacgaaaccttacaaaaacggtcagttaagcaaggtcatgattatcgagaatagtcatgtgaaaaaggacgacatatggccatccggaggccagatgaccgtgaaagacctcactgccaaatacactgaaggagggaatgccatcctggagaacatcagcttctcgataagccctggacagagggtgggtctgctcggacgcacaggctctggcaagagcacgctgctaagcgcctttctccggctgttaaacaccgagggggagatacaaattgatggggtcagctgggactcaattacactgcagcagtggaggaaggccttcggagtcatccctcagaaggtttttattttctccggtacctttagaaaaaacctggacccttacgagcagtggagcgaccaggagatctggaaggtggccgacgaggttggtcttagatctgtgatcgaacaattcccagggaagttggacttcgttctggtcgatgggggttgtgttctgagccatggacataaacaactgatgtgcttagcaaggtctgtgctcagcaaggctaagatcctcttgctggacgaacccagcgctcacctggaccctgttacctaccagatcataagacgtaccctcaaacaggcttttgcagactgtaccgtaattttgtgcgaacacagaattgaggccatgttggaatgtcagcagttcctggtgatcgaagagaacaaagtgagacagtacgacagtatacagaaattattaaacgagcgcagcctctttcgtcaggccattagtcccagcgacagagtgaaactatttccacatcggaattcttcgaaatgtaagtctaaaccccagatagctgccctgaaagaagagacagaagaggaagtgcaggacactcgactg

SEQ ID NO: 10162 - DNA, 4440 bp, Artificial Sequence
  Description of Artificial Sequence: Synthetic coding sequence
atgcaaagatcaccattagaaaaagcatcagtagtatctaaattgtttttctcatggacaagaccaattttaagaaaaggttatagacaacgtttagaattaagtgatatttatcaaattccaagtgttgatagtgcagataacttaagtgaaaaacttgaaagagaatgggatagagaattagcttcaaaaaaaaatccaaagttaattaatgcacttagaagatgctttttttggagattcatgttctatggaatatttctttatctaggagaagttactaaagcagttcaaccacttttgttaggaagaattattgcttcatacgatccagataacaaggaggaaagaagtattgcaatttatttagggatcggattgtgccttttatttattgttagaacacttttattacatcctgctatatttggattacatcatattggaatgcaaatgcgtattgctatgttttctttaatttataaaaaaactttaaaattatctagtagagttttagataaaatatcaattgggcaattagttagtttattaagcaataatttaaataaatttgatgagggtcttgctcttgcacatttcgtttggattgctccattacaagttgctttgttaatgggacttatttgggaacttcttcaagcatcagccttttgcggattaggatttttaattgttttagcattgttccaagctggattaggaagaatgatgatgaagtatcgtgatcaaagagcaggaaaaatttctgagaggttagttattacttctgaaatgattgagaatattcaaagtgttaaggcttattgttgggaagaagctatggaaaaaatgattgaaaatcttagacagacagaacttaaacttacacgaaaagcagcatatgttagatattttaactctagtgctttttttttctcaggatttttcgtggtttttctttcagttttgccatatgcccttattaaaggtataattttgcgtaaaatttttacaacaatatcattttgtatagttttacgtatggctgttactagacagtttccttgggctgttcaaacatggtatgattcattgggagcaataaataaaattcaagattttttacaaaaacaagaatataaaactttagaatataaccttacaacaactgaagttgtaatggaaaatgtaacagcattttgggaagaaggatttggagaattgttcgaaaaggcaaaacaaaataataataatcgaaaaacttctaatggtgacgatagtctttttttctcaaatttctctttattaggaactccagttttaaaagatatcaattttaaaattgaaagaggtcaacttttagccgtagctggatcaactggagctggaaaaacttcgttgcttatggtgattatgggagaacttgaaccatctgaaggtaaaattaaacattcaggaagaattagtttctgttctcaattttcttggattatgccaggtacaattaaagaaaatattattttcggagtatcatatgatgaatatagatatagatcagttattaaagcttgtcaacttgaagaagatattagtaaatttgctgaaaaagacaatattgttttaggagaaggaggaattacactttcaggaggacaaagagcacgtatctcattggcaagagctgtttataaagatgctgatctttatttattagacagcccttttggatatttagatgttttgactgaaaaagaaatttttgaaagttgtgtttgtaaattaatggcaaataaaacaagaattttagttactagtaaaatggaacatttaaaaaaagctgataaaattttaatcttacatgaaggatcatcttatttttatggaactttctctgaacttcaaaatttacaaccagattttagttctaaattaatgggatgtgacagtttcgatcaattctcagcagaaagacgtaactctattttgactgaaacattacataggtttagtttagagggtgatgctccagtttcatggactgaaaccaaaaaacaatcattcaaacaaactggagaattcggagaaaaaagaaagaattctattttaaaccctattaactctattagaaaattttcaattgttcaaaaaactccattacaaatgaatggaattgaagaagattcagatgaaccacttgaaagaagactttctcttgtacctgattcagagcaaggtgaagcaattttaccacgaatttcagttatttctacaggaccaacacttcaagcaagaagacgacaatctgttcttaatttgatgactcattcagttaatcagggacaaaatattcatagaaagacaacagcttctacacgtaaagttagccttgcacctcaagctaatctaacagaacttgatatttattcaagacgtttatctcaagaaacaggtttagaaattagtgaagaaattaatgaagaagatcttaaagagtgtttttttgatgatatggaatctataccagctgtaacaacatggaatacttatttaagatatattactgtacataaatcattgatttttgttttaatttggtgtttagttatttttcttgcagaggttgcagcatcattagttgttctttggctccttggaaatactcctttacaagataaaggaaattctactcatagtagaaataattcatatgcagttattataacctcaacatctagttattatgttttttatatttacgttggagttgcagatactcttcttgcaatgggattcttcagaggattgcctttagttcatacattaattactgtttcaaaaattcttcatcataaaatgcttcatagtgttttacaagctccaatgagtactttaaatactcttaaggcaggaggaatattaaatagatttagcaaagatatagctattcttgacgacttattaccattaacaatattcgatttcattcaattattacttatcgtaattggagctattgcagttgtagcagttcttcaaccatatatttttgtcgctacagttccagttattgtagcttttattatgcttagagcatatttcttacaaacaagtcaacaattaaaacaattagaatcagagggaagatctccaatttttactcatcttgttacttctcttaaaggtttatggactcttcgtgcttttggaagacaaccatattttgaaactttgtttcataaagcattaaatcttcatactgctaattggtttctttaccttagtaccttaagatggtttcaaatgagaattgaaatgatatttgttatcttttttattgctgttacatttattagtattttaactactggagagggagaaggtagagttggtattattcttacacttgctatgaatattatgtcaactcttcaatgggcagttaattcatctattgatgtagatagtctaatgagatcagtttctcgtgtgttcaagtttattgatatgcctactgaaggaaaacctactaaatcaacaaaaccttacaaaaatggacaattatccaaagttatgataattgagaattcacatgttaaaaaagatgatatttggccatcaggaggacaaatgacggttaaagatttaactgcaaaatatacagaaggaggtaatgcaatattagaaaatatttcattttcaatatcacctggacaacgagtaggtttattaggaagaacaggatcaggaaagagtacattattatcggcattcttacgtttacttaatacagagggagaaattcaaattgatggagtaagctgggatagcatcactctacaacaatggagaaaagcatttggtgtaataccacagaaagttttcattttttctggaactttcagaaaaaatttagatccttatgaacaatggtcagaccaagaaatttggaaagttgcagacgaggttggattaaggtccgttattgaacaatttcctggaaaattagattttgtacttgttgatggaggatgtgtattatcacatggacataaacaattaatgtgtcttgcaaggagtgttctttcaaaggctaaaattttattattagatgaaccaagtgcacatcttgatcctgtaacttatcaaattattagaagaacattaaaacaagcatttgcagactgtacagttatattgtgtgaacacagaattgaagctatgttagaatgtcaacaatttcttgtaattgaagaaaataaggttagacaatatgattcaattcaaaaattacttaatgaacgtagtttatttcgacaagcaatttcaccatctgatcgtgttaaattatttccacatagaaattcaagtaagtgtaagtcaaaaccacaaatagctgctcttaaagaagaaactgaagaagaagtacaagatacaagactt

SEQ ID NO: 10163 - DNA, 4440 bp, Artificial Sequence
  Description of Artificial Sequence: Synthetic coding sequence
atgcagcgcagtcccctggagaaggcatcagtggtatccaagcttttcttttcttggacacgcccaattcttaggaagggctacaggcagaggctcgaactctctgacatttatcagatcccttcagtggactcagctgacaatctttctgagaagttggagagggagtgggacagggaacttgctagcaagaagaatcccaagttgatcaacgcgttgaggaggtgctttttctggagatttatgttctatggcatcttcctttacctgggcgaggtgacaaaggcagttcagcctttgcttttgggccgcatcatcgcctcctatgatcccgataacaaggaagaaaggagcatcgctatttacctgggcataggcctgtgtcttctgtttattgtgaggaccctgcttttgcaccctgcgattttcggcctgcatcatataggcatgcagatgagaatcgccatgttctcacttatttataagaaaaccctgaagctcagcagtagggttcttgacaagatttctattggtcaattggtatcactgttgtcaaacaacctgaacaagttcgacgaaggtctcgcacttgctcatttcgtgtggatcgcccctttgcaggtggccctgttgatgggtctcatatgggagctgcttcaagccagcgccttctgtggtcttggattcctcatcgtgctggcattgttccaggccggactgggcaggatgatgatgaagtaccgcgatcagagagccggtaagatctccgaacgcttggtgattactagcgagatgattgagaatatccagtctgtgaaggcttactgttgggaagaggccatggaaaagatgatagagaatctgaggcagaccgagttgaagcttactagaaaagcagcgtatgttcgctactttaactcctctgctttctttttcagcggattttttgtggtgttccttagcgtcctcccctacgctctcataaagggtatcatccttcgcaagatcttcactaccatttccttctgcattgttctgaggatggccgtgacaagacagtttccatgggcggtgcagacctggtacgactctcttggagccatcaacaagatccaggattttctccagaagcaggagtataaaaccttggaatacaaccttactactacagaagtcgtgatggagaacgtaaccgccttctgggaggaaggcttcggtgagttgtttgaaaaagccaagcagaacaacaacaaccgcaagacgtccaatggagacgacagcttgtttttctctaacttctcactgctcggcacaccagtcctgaaagacataaatttcaagatagagaggggccagctgctcgccgtggccggttccaccggagccggcaaaactagcctgctgatggttatcatgggcgagctcgaaccttccgaaggaaaaattaagcactccggtagaataagtttctgcagccagttcagctggattatgccgggcaccatcaaggagaacatcatatttggtgtcagttatgacgagtataggtaccgcagcgtgatcaaggcatgccagctggaagaggatataagtaagttcgccgagaaggataacatcgttctcggagagggcggtatcacgctcagcggtggccaaagagctaggatttctctggctagagctgtctacaaggatgccgacctttatctgctggactccccgtttggttatctcgacgtactgacagagaaggagatattcgagagctgtgtctgcaaactcatggcgaataagacacgcattctggtcacttccaagatggagcacctgaaaaaggcagacaaaattttgatccttcatgaaggttccagttacttctacggtacattttccgaattgcagaatttgcaaccagacttttcatcaaaattgatgggttgcgattcatttgaccagttttcagcagaaagaagaaatagcatcttgacagaaactttgcaccgcttttctctggaaggtgacgcgccggtgagttggacagaaactaagaaacagtcctttaaacagacaggtgaatttggagaaaagagaaagaattctattttgaatcccatcaactccattagaaaattctccattgtgcaaaaaacacctcttcagatgaacggaatagaagaagattccgatgaaccactggagaggagacttagcctggtgcctgatagcgagcaaggcgaggcaattctcccccgcatctccgtgatttccaccggccccacattgcaagccagacgccgccaatctgtcttgaatctcatgacgcactctgttaaccagggtcagaatatccacaggaagacgactgcctcaaccagaaaggttagcctggccccccaagcgaacctgacagaattggacatctactccagaaggctctcccaggagacgggtcttgagataagtgaagagatcaacgaggaagacttgaaagaatgcttcttcgatgatatggaaagtatcccagcggttacgacctggaatacatacttgcgctacattactgtccacaagtccctcatcttcgtgctgatttggtgcctcgtaatcttcctcgctgaggtcgcagcatcccttgtcgtgctgtggcttttgggcaacacacctctccaggataagggcaatagtacccactctaggaataactcttacgcagtcataattacaagcacatcctcctactatgtcttctacatttacgttggcgtggctgatacattgcttgcaatgggtttcttcagaggactccccctggttcacaccctcatcacagtgagtaagatcctgcaccacaaaatgttgcatagcgtgctccaagctccaatgtctacgttgaatactttgaaggcaggaggtattcttaacagattctcaaaagacatcgcgatccttgatgaccttcttcctctgacaatctttgacttcatccagcttctgctcatcgttatcggtgcgatcgccgtcgtggcagttctgcagccttatatcttcgtggctaccgtgccggtcattgtcgctttcataatgctgagagcctactttcttcagacatcccaacagcttaagcagctcgagtcagagggcaggtccccaatttttacacacctggtaaccagtctgaagggcctgtggacgctgcgcgcatttggaaggcagccctactttgaaactctgtttcataaagcccttaatctgcatactgctaactggttcctctacctgagtacactccgctggtttcaaatgaggatcgaaatgatttttgtcatcttcttcatcgccgtgactttcatcagcatactgactacaggcgaaggcgagggaagagtcggaatcattctgactcttgccatgaacattatgagcactctgcagtgggccgtcaattcctccatagatgtagactccttgatgcgctctgtttcccgcgtttttaagttcatcgatatgcccactgaaggtaaacccactaagagtaccaagccatacaaaaacggacagctctctaaggttatgattattgagaacagccatgttaaaaaagacgacatatggcctagcggaggtcaaatgacagtaaaggatctcaccgctaaatatactgagggcggaaatgctattctcgagaatatttcattcagtataagcccaggtcagagagtgggcttgctgggccgcacaggatccggaaaaagtactcttttgtctgccttcttgcgcctgctgaacactgagggtgagatacagatcgacggtgtctcatgggacagtatcacattgcagcagtggagaaaggctttcggtgttattcctcaaaaagtcttcattttcagcggaaccttcaggaagaacctggatccatatgaacagtggtcagatcaggagatctggaaggtggctgacgaggtgggtttgaggagcgttatcgagcaatttccaggcaaactggacttcgtgctcgtggacggcggctgtgtgctgtcccacggtcataagcagctcatgtgtttggccaggagtgtgctgagcaaggctaagatactgctgcttgacgagccgtccgctcacctggacccagtgacataccaaattattaggaggacccttaaacaggcgtttgctgactgcactgttattctctgcgaacacagaatcgaggccatgctggaatgtcagcagtttcttgtgattgaggaaaataaagtaaggcaatacgactcaattcagaaactcttgaacgaaagatccctgttccgccaagccatcagtcccagcgacagggtgaaactcttccctcacagaaattcctccaagtgcaaaagcaaaccacaaattgctgctctgaaggaggaaaccgaagaggaggtgcaggatacacgcctg

SEQ ID NO: 10164 - DNA, 4440 bp, Artificial Sequence
  Description of Artificial Sequence: Synthetic coding sequence
atgcagcgctcccctctggagaaggcgtcagtggtcagcaagctcttctttagttggacccgacccattttgcgcaaaggataccggcagcgacttgagctgtcggacatttaccagatcccttcagtcgattccgccgataatctttcggaaaagctggaaagggagtgggaccgagaacttgcatccaagaagaacccaaagctgatcaatgctctccgcagatgtttcttttggcgctttatgttttacggcatatttctttacttgggtgaagtgactaaggcagtgcaacctctgctgcttgggcgaattatcgctagctacgatccagacaataaggaggaacgttcgatcgccatttacttgggaatcggtctgtgccttttgtttattgtgagaactttgcttctgcacccagccatatttggattgcaccacataggtatgcaaatgagaattgcgatgttttcactgatatacaagaaaacgctcaagctctcatcgagagtgcttgacaagatctcgattggacaacttgtgtccttgctgtccaataacctgaacaagtttgacgagggccttgcacttgcccattttgtctggattgcacctcttcaagtcgcactcctgatgggacttatctgggaattgcttcaagcatccgcattctgtggcctgggttttctcattgtgttggccttgtttcaggcaggcctgggaagaatgatgatgaagtatcgcgatcagcgtgcgggcaagatttcagagagactggtgatcacctcagagatgatcgagaatatacagtcggtcaaggcatactgttgggaagaggccatggaaaagatgatagagaatttgaggcagaccgagctgaaacttacgcggaaggcagcatacgtgcgatactttaactcatctgccttctttttcagcggcttctttgtggtgtttctttccgtcctcccatacgcgctgattaagggcatcattctgcgtaagatctttactacgatttcgttttgcatcgtcctgcggatggcagtgactcgtcagtttccatgggccgtgcagacgtggtacgattcgctgggagcaattaacaaaatccaggattttcttcaaaagcaggaatacaagactttggaatacaacctgaccactactgaagtggtcatggaaaacgtgactgctttttgggaagaaggctttggagagctgtttgaaaaggcaaagcagaacaacaataaccgtaagacgtcaaacggcgatgattcgttgttcttttccaacttttccttgctcgggactccagtactgaaagatatcaacttcaaaatcgaacgaggccagctgctggccgtggcggggagcactggtgcaggaaaaacctccctgcttatggtaatcatgggcgagcttgaaccgtcagaagggaaaatcaaacattccggtagaatcagtttctgtagccaattctcatggatcatgcccggcactattaaggagaacattatcttcggggtgtcgtacgacgaataccgctacaggagcgtgatcaaggcctgccagctggaagaagatataagcaagttcgcagagaaggataacattgtgctgggtgaaggtggtataaccctgtcaggtggacaacgagcaaggatcagcctcgctagggcagtgtacaaagacgcagatttgtacctgctcgactccccctttggttacctggatgtgctcactgagaaggagattttcgaatcgtgtgtctgcaagctgatggctaataagactcgaatcctcgtgacctcgaagatggagcatctgaagaaggctgacaaaattcttatacttcacgaaggaagctcctacttctacggtaccttttccgagctgcaaaacctccaaccggatttctcatccaaactgatggggtgtgattcgttcgatcaattttcagcagaacgccgcaattctattctgaccgaaaccttgcacaggttcagcctcgaaggtgatgcacctgtctcgtggaccgaaactaagaagcaatcatttaagcagaccggtgaattcggagaaaaaagaaagaactccatccttaatccaataaactccattcgtaagttttccattgtgcaaaagacgcctctgcaaatgaacggaattgaagaagatagcgatgagccattggaacgtcgactgtctcttgtgcccgattctgaacaaggggaagcgattcttcctcgaatctccgtgattagcaccgggcctacccttcaggcccgccggagacagtccgtcctgaaccttatgactcactcggtcaaccaaggtcaaaacatccatagaaaaacgaccgcatcgacccggaaggtatcccttgcaccccaagcaaacctgactgagctcgacatttacagccggcgactctcccaggaaactggtctggaaatctcggaagagattaatgaggaagatctgaaggagtgttttttcgatgacatggaatcaattccggctgtcaccacctggaacacctacctgaggtatatcactgtccataagagcctgatctttgtgctcatttggtgcctcgtgatttttctcgccgaagtggcagcaagccttgtggtcctgtggttgttgggtaacactcctctgcaggacaagggaaatagcacccattcccgaaacaattcatatgcagtcattatcacttcaacttcatcctactacgtattctacatttacgtgggagtcgccgataccctgctggcaatgggatttttcaggggtctgcctctggtccataccctgattacggtttcgaaaattctgcaccataagatgcttcacagcgttctccaagcgccaatgagcaccctgaacactcttaaggcaggtggaattctgaataggttttcgaaggatatcgcgattctcgacgaccttcttcccctcaccatttttgacttcattcaactccttttgattgtgatcggagcaattgcagtggtcgcagtgctgcaaccatacatatttgtggccaccgtccccgtgattgtggcgtttatcatgctgcgcgcctatttccttcaaacctcgcaacagctgaaacagcttgaatccgaagggcgatcccctatcttcactcatctggtgacctcactgaaaggactctggactctgcgcgcatttggccggcagccatactttgaaaccctttttcataaggcactgaatttgcataccgcaaactggttcctttaccttagcactcttaggtggttccaaatgcgtatcgagatgatattcgttatcttctttattgcggtgactttcattagcatcctgacgactggtgaaggcgagggacgggtgggaataatccttacccttgcaatgaacattatgagcacccttcagtgggcagtgaattcatctattgatgtggactcacttatgcggtccgtttcgagagtctttaagttcatcgacatgcctaccgagggaaagcctacgaaaagcactaaaccttataagaatgggcaactgtccaaagtgatgatcatagaaaactcacatgtcaagaaggatgatatttggcctagcggaggccagatgactgtgaaggatcttactgcaaaatacactgagggtggcaatgcgattctggaaaacatatccttttccatttccccagggcagcgtgtcggtctgcttggtcggaccggatccggcaaatcgactcttctttcagcgttcctcagactgctcaatactgagggagaaattcaaatcgacggcgtgtcatgggacagcattacgcttcaacagtggcggaaggcctttggcgtgatccctcagaaagtgttcatcttttcgggaacctttcggaagaaccttgatccttatgagcaatggagcgatcaagaaatttggaaagtggccgatgaggtgggattgcgttcggttattgaacaattccccggaaagctggactttgtgctcgtcgacggagggtgtgtgcttagccacgggcataagcagcttatgtgtcttgcccgatctgtgctttccaaagcgaaaatactgttgctcgacgaaccttcggctcacctggacccagtcacgtaccaaatcatacggagaacccttaaacaagcatttgctgattgtaccgtgattttgtgtgaacatcgaattgaagccatgctggaatgccaacagttcctcgtgattgaggaaaacaaagtgagacaatacgatagcattcaaaaactgcttaatgaaaggagtctgttcagacaagctattagcccgtcagatagagtgaagctctttcctcataggaattcgtccaagtgtaagtcgaaaccgcagattgcagccctcaaggaagagactgaagaagaagtccaagacacccgactg

SEQ ID NO: 10165 - DNA, 4440 bp, Artificial Sequence
  Description of Artificial Sequence: Synthetic coding sequence
atgcaaagatccccgttggaaaaggcgtccgtggtgagcaagctcttcttttcgtggactcgcccgatcctgcggaagggatacagacaacgcttggagttgtccgatatctaccagattccgagtgtggacagcgctgataacctgtcagagaagctggagagggaatgggacagggaactggcatcaaagaagaaccctaaactcatcaatgccctccggaggtgttttttctggcgcttcatgttctacggaattttcctgtacctgggagaggtcactaaggccgtccagccactgctgctcgggcggattatcgcatcgtacgacccagacaacaaggaggaaagatccatcgccatctacctgggaattggcctttgccttcttttcatcgtgagaactctcctgctgcacccagccatctttggattgcaccatatcggcatgcaaatgcgcatcgctatgttctcactgatttacaagaaaaccctgaagctctcctcaagagtgctcgacaagatctccatcggccagctcgtgtccctgctgagcaacaacctgaacaagtttgacgagggacttgccctcgcgcacttcgtgtggatcgcgcctctgcaggtggctcttctcatgggactgatctgggagctgctccaggcttcggcgttttgcggactgggattcctgatcgtgctggccctcttccaggcaggactggggcggatgatgatgaagtaccgggatcaacgcgccggcaaaatctcagaaaggttggtgatcacgtcggaaatgatcgagaatattcaatccgtcaaagcatactgctgggaagaggcgatggaaaagatgatcgaaaacttgcgccagaccgaactgaagctcacccgcaaggctgcatacgtccggtacttcaattcgtccgcattcttcttctcaggattcttcgttgtgttcctgtcggtgctgccgtatgccctgatcaagggaatcatcctcaggaagatctttacgaccattagcttctgcatcgtgctgagaatggcagtgacccgccagttcccatgggctgtgcaaacttggtacgattcactgggcgcgatcaacaagatccaggacttccttcagaagcaagagtacaagaccctggaatacaatctgactaccaccgaagtggtgatggagaatgtgaccgcgttctgggaggaagggttcggggaactgtttgagaaggccaagcagaataacaataaccgaaagacttcgaacggcgacgattcgctgttcttctccaacttttccctcctcggtactccggtcctcaaggacatcaatttcaaaatcgaaagaggccagctcctggctgtcgccggaagcaccggcgccggcaagacctccctgctgatggtgatcatgggagaactggagccgtcagaagggaagatcaagcacagcgggagaatctccttctgtagccaattctcctggatcatgcccggaactatcaaagaaaacatcatttttggagtcagctacgacgaatacaggtaccgctccgtgatcaaggcgtgtcagttggaggaggatatcagcaagttcgccgaaaaggacaacatcgtgctgggagaggggggcattacgctgtcgggaggacagcgcgcgcggatttccctggctagagctgtgtacaaggacgcagacctgtacctgctggactctccgttcggctacctcgacgtgctgaccgagaaggagatattcgaatcgtgtgtctgcaaactgatggccaacaagacccgcatcctggtgacctcaaaaatggaacacctcaagaaggctgacaaaatcctgattctccatgaaggctcctcctacttctacggcacttttagcgaacttcagaacctccaacccgatttcagctcaaaactcatgggctgcgactccttcgaccagttcagcgccgagcggcgcaattcgatcctgaccgaaactctgcatcgctttagcctggagggagacgcccctgtcagctggaccgaaaccaagaagcagtctttcaagcagaccggggagtttggagaaaagaggaagaattccatcctcaacccaatcaacagcatccggaaattcagcatcgtgcaaaagaccccgcttcaaatgaatggcattgaagaggattcagatgaacctctcgagcggagactttcactggtccctgatagcgaacaaggcgaagcaattctgcctaggatcagcgtgattagcactggaccgactctgcaagccaggaggcgccaaagcgtcctgaacctgatgactcactcggtgaaccagggccagaacatccaccgcaaaacgaccgcgtcaacccgcaaggtgtcacttgccccacaagcaaacctgaccgaattggacatctactcccgccggctgtcccaggagactgggctggaaatctccgaagaaatcaatgaggaggatctgaaggaatgttttttcgacgatatggaaagcatcccggccgtgaccacctggaacacctacctcaggtacatcactgtgcataagagcctcattttcgtcttgatctggtgcctggtgatcttccttgccgaagtggcggcatcccttgtggttctgtggctcctgggcaatacccctctgcaggacaagggaaatagcactcattcacggaataactcctacgccgtgatcatcacctcaacgtcatcgtactacgtgttctacatctacgtcggggtggcggataccctgcttgcaatgggttttttccgcggacttccgttggtccatactctgatcactgtgtccaaaatcttgcatcataagatgctccacagcgtcctgcaagcaccgatgtcgactctcaacactctgaaggccggagggattctgaataggttctccaaggacattgccatcctggatgacctcctgccgctcacgatcttcgatttcatccagctgctcctgatcgtgattggcgctatcgccgtggtcgccgtcctccagccctacatctttgtcgccacggtgccggtgatagtggcgttcattatgttgcgggcatacttcctccagactagccagcagctgaagcaactggaatcagaggggcggagccccattttcactcatctggtgacctccctcaagggactctggaccctgagagccttcgggcggcaaccgtacttcgaaactttgtttcacaaggcccttaacttgcatacggctaactggttcctctacctttcaaccctcagatggtttcagatgcgcatagagatgatctttgtgatctttttcatcgccgtgactttcatctccatcctgaccaccggcgaaggagagggtcgcgtcggaatcattttgacccttgcgatgaatatcatgtcgacgctgcagtgggccgttaatagctcaatcgatgtggactcgctgatgcgctcggtgtcacgggtgttcaagttcatcgacatgccaactgaagggaaaccaactaagagcaccaaaccgtacaagaacggtcagctttcgaaggtgatgataattgaaaattcgcacgtgaaaaaagacgacatctggccatccggaggacaaatgaccgtgaaagacctcaccgcgaagtacaccgagggcggaaacgccatcctggaaaacatctccttcagcattagcccgggccagagagtcggactgctcggtcgcaccggatcagggaagtctactcttctctcagctttcctgcgtttgctcaatacggaaggggagatccagatcgacggagtgtcctgggattcaatcaccttgcagcagtggcgcaaggcctttggagtgatcccgcagaaggtgttcattttctcgggaactttcagaaagaacctggatccgtacgagcaatggtcagaccaggaaatctggaaagtggcggatgaagttggactgagatccgtgatcgaacagttcccaggcaagctggacttcgtgttggtcgatggcggatgtgtgctgtcccatggccacaaacagttgatgtgcctggccagaagcgtcctcagtaaggcaaagatcttgctgctggatgaaccgtccgcacatttggacccggtgacttaccagatcatacggaggactctgaagcaggccttcgctgactgtacggtgattttgtgcgagcacagaatcgaagctatgctggagtgtcagcagtttcttgtgatcgaagaaaacaaagtaagacaatacgactcgatccaaaagttgctcaacgaaagatcgctctttcggcaggccatctcaccgtccgatcgagtcaaactcttcccgcacaggaattcttccaagtgcaagtccaaaccgcaaattgctgcactgaaggaagaaaccgaggaagaagttcaagacacccggctg

SEQ ID NO: 10166 - DNA, 4440 bp, Artificial Sequence
  Description of Artificial Sequence: Synthetic coding sequence
atgcaacgctcccctctcgagaaggcctctgtggtaagtaaactgtttttcagctggacacgcccaattctgcgtaagggctatagacaaaggctcgaactgtcagacatttaccagatcccttctgtggactcagcagataatctgagcgagaagctggagagagaatgggatagagagctggcatcaaagaaaaacccaaagctgataaacgcactccggcgttgcttcttctggcgattcatgttctacggaattttcctctacttgggcgaggttaccaaggccgtgcagcctttgcttctcggtagaattatcgccagttatgacccagataataaggaagaaagatcaatcgccatctatctgggtataggactatgtctcctcttcattgtgaggactttgctgttacaccctgccatatttgggctacatcacattggcatgcagatgagaattgcgatgttcagcctcatctacaaaaaaacattgaagctcagctcacgagtgctcgacaaaatatccataggccagctggtcagcctgctgagcaataatctcaacaagtttgacgaggggcttgcactggctcacttcgtctggattgccccgttacaggttgcactgctgatgggactgatttgggagctgttacaggcgtctgccttttgcggcctggggttccttattgtcttagctctgtttcaggccgggctcggaaggatgatgatgaagtatcgagatcaacgggccggaaaaataagcgaaaggctagtcattacttcagaaatgattgaaaatattcagtcagtgaaagcctattgttgggaggaagctatggagaaaatgattgaaaatctgcggcaaaccgagctgaaactgacaaggaaggctgcctatgtgcgatacttcaatagtagcgcattttttttctcaggattctttgttgtcttcctgtccgttttgccatatgccctgatcaagggaataatcctacgtaagatctttacaacaatcagcttctgtatcgtgctgagaatggccgtgacccgacagtttccatgggcagtgcagacttggtacgatagcctcggtgccatcaataaaatacaggattttctacagaagcaggaatataagacacttgagtataatctgaccaccaccgaggtggtgatggaaaacgtcacagcgttctgggaagaagggtttggcgagttgtttgaaaaggccaagcaaaacaacaataatagaaaaacatctaacggcgacgattccttattcttttccaactttagcctgcttggcactcctgtgctgaaagatatcaacttcaagattgagcgaggccagctattggccgtggccggatcaactggagctggcaagacctcattgctgatggttattatgggagagctagaaccaagtgaaggaaaaatcaagcactccggccgcatctccttttgcagtcaattctcctggataatgcccggaaccattaaggaaaatatcatattcggcgtttcttacgacgaatatagataccgaagcgttatcaaggcttgtcagctcgaagaagacattagcaaattcgctgagaaggacaacattgtgctgggagaaggcggtatcacattaagcggaggccagcgggctaggatctccctggcccgggccgtgtacaaagatgcagacctgtacctgttagattccccctttggttacctggatgtgcttacagaaaaagaaatcttcgagagttgtgtttgtaaactaatggcaaacaagaccagaatactggtcacatctaagatggagcatctgaaaaaggccgacaagattctaattctccatgaagggtcctcatacttttacgggacatttagtgagcttcagaacctgcagccagatttctcctccaagctcatgggctgcgattcttttgatcagttctcagccgagaggagaaactctatcttgacagaaacactacatcgattctccctggaaggcgacgcccccgtgtcctggacagaaacaaagaaacagtccttcaagcagaccggagagttcggggagaaacgaaagaattcaatcttaaatcctatcaacagtatccggaagtttagtatcgtccagaagacgcccctccagatgaatgggatcgaggaggattctgacgaacctctcgagcggcggttgagcttggtgcccgatagcgaacagggagaggcgattctgcctcgcatcagcgtgatatctactggtcctactttgcaagctagaaggaggcagagcgtgttgaatctaatgacacactccgtgaaccaaggtcagaatattcaccgaaaaaccacggcatccactagaaaagtaagcctggcaccccaagccaacctgaccgaacttgatatttattccagacgtctctcccaggaaactgggctggagatttctgaagagataaatgaagaggacctgaaagaatgttttttcgatgatatggaatcgattcccgccgtcaccacttggaatacctacttgaggtatatcacagtgcataaatctttgatttttgtgcttatctggtgtctggtcatcttcttggcggaagttgccgcgtcgctcgtggtcctatggctgttaggaaacaccccactccaggacaagggcaactccacacacagtagaaataacagctacgccgtcataatcacctccacaagcagttactatgtattctatatttatgttggcgtcgccgacaccctgctagccatggggttctttagggggttgcctcttgtgcatacactgattacagtgtctaagatcctccatcataaaatgttgcacagtgttcttcaggcccctatgagcacccttaatacattgaaagcaggaggcatccttaaccgtttctcaaaggatatagccatcttagatgacctcctgccactgaccattttcgactttatccagctgctgcttattgtgattggggccatcgcagtggtagctgtgctacaaccttatattttcgtcgcaaccgtacccgtcatcgttgcttttattatgttgcgagcttattttctccaaacatcacaacagcttaagcagctcgaaagtgaaggtagaagtcctattttcactcaccttgtgacctccttaaaaggcctgtggaccctgagggcgtttgggaggcagccgtatttcgagaccctgttccacaaggccctcaatctacatacagcgaactggtttttgtatttgtcaaccctgaggtggttccaaatgagaatcgagatgattttcgtaattttcttcattgcagtgacattcatttcgatactcacaacgggcgaaggagagggacgcgtaggcataattctcacactggctatgaacattatgtctactctccagtgggcggtcaactcgagtatcgatgtggattcgctgatgagaagcgtcagcagggttttcaagttcatcgacatgcctactgaaggaaaacctaccaagagtaccaaaccgtataagaacggtcagctgtcgaaagtaatgatcattgaaaattcacatgtaaaaaaagatgatatttggccctccggcggtcaaatgacagtgaaggatctgacagctaaatataccgagggggggaatgccatcctagagaatatctccttcagcatctcacccgggcaacgagtgggcttattgggcagaaccggcagcggcaagagcaccctacttagtgcctttctgagattgctcaacacagagggggagattcaaatcgacggagtgagttgggactctatcaccctgcagcaatggcgcaaagctttcggggtcattccacagaaggtttttatctttagtgggacttttagaaagaatctggatccatacgaacaatggagcgatcaggagatctggaaagtggctgacgaagtgggcctacgtagcgtgattgaacagtttcccggaaagctggatttcgtcctggtggacggcggttgtgtgctatctcatgggcataagcagctcatgtgtctggccaggtccgtcctatcgaaggcaaaaattctgctcctggatgagccatccgcacacctggaccccgtgacttatcaaataatcagaaggacgctaaaacaggccttcgcggactgcacagtgatcctatgtgaacacagaatagaggctatgttagaatgtcagcagttcctggttattgaggaaaacaaagtgcgacagtacgattcaatacagaagcttctcaacgagcgttcactctttcggcaggcaatttcaccctccgacagggtcaaactcttccctcatagaaatagctcgaaatgcaagagcaaaccccagatcgctgcactgaaagaggagacggaggaagaagtccaagatacccgactt

SEQ ID NO: 10167 - DNA, 4440 bp, Artificial Sequence
  Description of Artificial Sequence: Synthetic coding sequence
atgcaacgctcgccgctggaaaaagcgtccgtagtctccaagctgttcttttcatggactcggccgatccttcggaagggctacagacaacggctggaattgtccgacatttaccagattccctccgtggactcagcggacaatctcagcgagaaactggaacgcgaatgggaccgggagctcgcgtcgaagaaaaacccgaaactgatcaacgccctccgcagatgcttcttttggcggtttatgttctatggaatcttcctgtacctgggtgaagtgaccaaagcggtgcagccactcctgctcggacggatcatcgcctcctacgatccggataacaaggaggagcggtcgatcgccatctacctggggattggtctgtgccttttgtttatcgtgcgcactctgcttctgcacccggcgatatttggattgcatcacatcggaatgcagatgcggattgcgatgttctccctcatctacaaaaagactctgaaactgtcctcacgcgtgctcgacaaaatctcgatcggacaactcgtctcactcctgtcgaataacctcaataagttcgacgagggactcgcactggcgcactttgtgtggatcgccccactccaggtggctctcctgatgggactcatctgggagctccttcaggcgtcggccttctgcggcctcggcttcctcatcgtcctggctctgtttcaggccggactgggcaggatgatgatgaagtaccgcgaccagcgggcaggcaagatttccgagaggttggtgatcacctcagaaatgatcgaaaacatccaatcggtcaaggcatactgttgggaagaagccatggagaaaatgattgagaacctccgacagacggagctgaagctcaccagaaaggccgcttacgtgcgctacttcaacagcagcgctttctttttctccgggttctttgttgtgtttctctccgtgctcccttacgctcttatcaaaggaatcatcttgcgaaagatcttcactacgatctcattttgtatcgtgctccggatggccgtgactaggcagttcccctgggccgtgcagacttggtacgacagcctcggagcgatcaacaagatccaagacttcctgcaaaagcaggaatacaagaccctggagtacaacctgactaccactgaagtcgtcatggagaacgtgaccgcgttctgggaggaggggttcggagaactgtttgagaaagcaaagcagaacaacaacaatcgcaagacctccaacggggatgactcacttttctttagcaacttctcactccttggaacgccggtgctgaaggatatcaatttcaaaatcgagcgcggtcaactgctggccgtggccggatcgactggggctgggaaaaccagcctcctcatggtgatcatgggtgaattggaaccgtccgagggaaagataaagcacagcgggcgcatttcgttctgctcgcaattcagctggatcatgccgggaacgatcaaagagaatatcattttcggagtgtcctacgacgagtaccggtacaggtcagtgatcaaggcgtgccagctggaggaagatatttccaagtttgccgaaaaggacaatatcgtgcttggagaaggtggcattaccctgagcgggggccaacgcgcaagaatctccctcgcccgtgcggtgtacaaagatgctgatctgtacctgctggactctcctttcggctacctggacgtcctgactgaaaaggagatcttcgaaagctgtgtgtgcaagttgatggcaaacaaaacgcggatccttgtgacctccaaaatggagcatcttaagaaagccgataagatcctgatcctgcatgagggaagctcctacttctacggaacgttctccgagcttcagaacttgcaaccagacttttcgtcgaaactcatgggatgcgactcgtttgatcaattcagtgccgaaagaagaaactcgatcctgacggagactctgcatagattctcgctggagggagacgccccagtgagctggaccgagactaagaagcagtccttcaagcaaaccggagagttcggagagaagaggaagaattctatcctgaaccctatcaactctatccgcaagttttcgatcgttcaaaagacccctttgcaaatgaatggcattgaggaggactcggatgagccacttgagagacgcctgtcccttgtgccggattcggagcaaggggaagctatcctccctaggatctccgtgatcagcaccggaccgaccctccaggctcggcgcaggcagtcagtgctgaacctgatgactcactccgtgaaccagggccagaacatccatcgaaagaccaccgcaagcacccggaaagtgtcccttgccccacaagccaatcttactgagctggacatctacagtagaaggctctcccaggagactggccttgaaatctccgaagagattaatgaggaggatctcaaagagtgtttctttgacgatatggagtcaatcccagcagtgaccacctggaatacctaccttcggtacatcacggtgcacaagtcgctgatcttcgtgctcatctggtgtctcgtcatttttcttgctgaggtcgcggcgagcctggtggtgctctggctcctgggcaacaccccactgcaagataaaggcaactccacccactcccggaataactcctacgcagtgatcataacctcgacctcctcatactacgtattctacatctacgtgggagtcgcagacactctcctggccatgggatttttcaggggcctgcccctggtgcacactctgatcaccgtgtccaagatcttgcatcacaagatgctgcactccgtgctgcaggctccgatgtcaactctcaacacgctgaaggctgggggcattctgaaccggttctcgaaagatatcgccatcctcgatgacttgttgcctctcactatcttcgactttatccagctgttgctcattgtcattggcgctatcgccgtggtggcggtgttgcagccttacattttcgtcgccactgtcccagtgatcgtcgccttcatcatgctgcgcgcttacttcctccagacttcacagcagctgaaacaactcgagtcggaaggtcgctcccctatcttcacccacctggttacttcactgaagggcctgtggactctgcgcgcgttcggacggcagccatactttgaaactctctttcataaagctctgaacctccacactgctaactggtttctttacctgtcgaccctcagatggtttcaaatgcggattgaaatgatcttcgtgatcttctttatagctgtgacttttatctcgattctcaccactggggaaggagaaggacgggtgggaatcatcctgaccctcgcgatgaacatcatgtcaaccctgcaatgggccgtgaacagctcaatcgacgtggattcgctcatgagaagcgtgtcccgggtgtttaagtttatcgacatgcccactgaaggtaaacccactaaatcaactaaaccatacaaaaatggacagctctcgaaggtgatgatcattgaaaacagccatgtgaagaaggacgacatttggccgtctggcggacagatgaccgttaaggatctgactgctaaatacactgagggaggcaatgccatcctggaaaacatttcgttctcaatctccccgggacagcgcgtgggactgttgggacgcaccggaagcggtaagagcactttgctgagcgcttttctgcggctcctgaacaccgaaggggagatccagatcgacggagtgagctgggactcgatcaccctccagcagtggagaaaggcctttggcgtgatcccgcagaaggtgttcatcttctcaggtaccttccggaagaatctcgacccatatgagcagtggtctgaccaggaaatctggaaggtcgccgatgaagtggggctgaggtccgtgatcgagcagtttccgggcaagctggactttgtgctggttgatggaggatgtgtgctgagccacggacacaaacaattgatgtgtctggcgcgcagcgtcctgtccaaagccaagatccttctgctggatgagccgtcggcccacctggacccggtgacctaccagatcattcggcgcactcttaagcaggcgttcgcggactgtactgtgattctgtgtgagcatcgtatcgaagcaatgctggaatgccaacaattcctggtcatcgaagagaataaggtccggcagtacgattcaatccagaagctgttgaacgagcggagcctgttccggcaggctatctcgccgtcggatcgcgtgaagctctttccgcatcggaattcgtcaaagtgcaaatcaaagccacagattgcggctctgaaggaagaaaccgaggaagaagtgcaggacacccgcctg

SEQ ID NO: 10168 - DNA, 4440 bp, Artificial Sequence
  Description of Artificial Sequence: Synthetic coding sequence
atgcagcgctcacctctagagaaggctagcgttgtgagcaaactgtttttctcttggactaggcctatcctgcgaaagggctacaggcagcgccttgagctgtcagatatataccagataccttctgttgactccgccgacaatcttagcgagaagctcgaacgggagtgggatagggaattggccagcaagaaaaacccaaagcttattaatgccttgcggagatgtttcttctggcgatttatgttttacgggatcttcctgtatctgggggaggtgacgaaagccgtgcagccgttgctattaggaagaatcatcgccagctacgatcccgacaataaggaggaacggtccattgcaatctatctgggcatcgggctttgcctgctcttcattgtccggacactgctgctccatcccgccatcttcggattgcatcatatcggaatgcagatgcgtatcgctatgttttccctgatttacaagaaaaccttgaaactctcctcccgagtgctcgataaaatctcaataggacagttggtgagtctcctctccaataacctgaataaatttgatgagggacttgcactggctcactttgtgtggatcgcgcccttgcaggtggcgcttctgatgggcctcatctgggagttgctgcaggcaagcgccttctgtggactcggtttcctaattgtgctcgctctgttccaggctggcctggggaggatgatgatgaaatatagggaccagcgcgccggcaagatatctgagaggcttgtcattacaagcgaaatgatagagaatatccagtccgtgaaggcttactgttgggaagaggccatggagaaaatgatcgaaaacctgcgacagacagagttgaagctgacacgtaaggcagcttacgtgagatattttaactctagcgccttttttttttcaggtttctttgtcgtctttctgtctgtgctgccttacgccttgatcaaaggaataatacttcggaagatcttcaccacgatcagtttttgcattgttctgcggatggctgttactcgccagttcccctgggccgtgcagacgtggtatgattcgcttggagccataaataagattcaggactttctgcaaaaacaggaatataaaaccttggaatataatcttacgaccacggaggtagtgatggaaaacgtaacggcgttctgggaagaggggtttggcgaactcttcgaaaaggcgaagcagaacaataataataggaaaacaagtaacggggatgattctctgtttttctctaacttttctctgcttggcactcctgtgttaaaggatattaactttaagatcgaaaggggtcagcttctcgccgtggcaggcagcacgggagccggcaagacgtccttgcttatggtaatcatgggagagctcgagccttcggagggaaaaatcaagcactccggacgaataagtttttgtagccagttcagctggattatgccggggaccatcaaggaaaacatcatttttggcgtgagttacgatgagtaccggtatagaagtgttattaaggcctgccagctggaggaagacatttcaaaattcgcggaaaaggacaacatcgtcttaggcgaaggaggcatcactttgagtggcggccaaagggcccgcatctccctggcacgggccgtgtacaaggatgcggacctttatctcctagacagccctttcggatacttggacgtcctgacggagaaggaaatatttgagtcatgtgtgtgtaagttaatggccaacaaaacccgcattctcgtcacctcaaaaatggaacatcttaaaaaggccgataaaattctgatattgcatgagggatcctcctatttctatggcactttttccgagctgcagaacttgcagcctgatttttccagtaagttaatgggatgcgattccttcgatcaattcagcgccgagcggcggaactccatcttgacagaaacactccatcgtttctcactcgagggcgatgctcccgtgagttggacagagacgaaaaagcaatcttttaagcagaccggtgagttcggcgaaaagcgaaagaattcaattttgaacccaataaactctattaggaaattcagcatcgtccaaaaaacacctctgcagatgaatggaatagaagaggatagcgatgagccgctcgagaggaggttatctctagtgcctgatagcgaacaaggtgaggcaattctcccgaggattagtgtgatatccactgggccaactctgcaggcccggcgacgtcagtccgtcctcaatctgatgacccactcagtgaaccagggccagaacattcacagaaaaaccactgcctctaccagaaaggtgtcacttgcccctcaggcgaatctcaccgaactggacatttactcccggaggctctcacaggagacgggacttgaaatatctgaagagataaatgaggaggatctgaaggaatgtttcttcgacgatatggaatccatacccgccgtaacaacatggaacacctacctgagatacataacagtgcacaagagtttgatttttgttctgatatggtgcctagtcatctttctggcggaggtggcagcctccttagtggtgctgtggctgctcggtaacaccccgctccaggataagggaaattcaacccacagtaggaacaattcctatgccgtgatcatcacatctacatcttcttattatgtgttttacatctacgtgggcgtggccgacaccctgctcgccatggggttctttcgaggtttgcctttggtgcacactctgattaccgtcagcaaaattctgcaccacaaaatgctgcacagtgtcctgcaagcacctatgtctacgctgaacactctgaaggcaggcggtatcctgaacagattttctaaggacatcgcaatactcgacgatctgctgcccctgacgatttttgatttcatacagttgctactcatcgtgataggagctatagcggtcgtggcggtgttgcaaccgtatatctttgtcgccactgttcccgtcatcgtagctttcattatgctcagagcctacttcctgcaaacatcccagcagctcaaacagctcgagtccgagggtaggtcccctatcttcacccacctggtgacttctctaaagggactctggactctcagggcgttcggtcgccagccctatttcgagactctcttccataaggccctgaatctgcacacagcgaactggtttctgtacctaagtacgcttaggtggttccaaatgaggatcgagatgatcttcgttattttcttcattgcagtcacttttattagcattcttactacgggggagggtgaaggacgagtcggaatcatcttaactctggctatgaacattatgtccaccctacaatgggccgtgaactctagtatcgacgtggactcacttatgagaagcgtgagccgagtgtttaagtttatcgacatgcctacagagggaaaacccacgaagtctaccaagccgtataaaaacggtcaacttagcaaggttatgattatagagaactcacacgtaaagaaggacgacatttggccatccggggggcagatgactgttaaggatctgacagctaagtacaccgagggcggcaacgcaatcctggagaatattagtttctctatttccccgggacagagagtggggcttttaggccggactgggtcaggaaaaagtaccttgctgagcgcatttctgcggctcctgaacactgaaggcgaaatccaaattgacggcgtgagctgggattcaatcaccttgcagcaatggcgtaaggctttcggggttattccacagaaggtgttcattttctctgggactttccggaaaaatctagacccctacgagcagtggtcagaccaagagatttggaaggtggctgacgaggtcggtctgcggagcgtcatcgagcaattccccgggaaactggatttcgtgctggtggacggtggctgtgtattgtcccatgggcacaaacagcttatgtgtctggcacggtctgtactgtccaaggctaaaattttactgctcgatgaaccttcagcgcatctagaccccgtgacctaccaaattatccggagaaccctaaagcaggcttttgctgactgtaccgtgatattgtgtgaacaccgcattgaggcaatgttggagtgccaacagttcttggtaatcgaagaaaacaaggtcaggcagtatgattcaattcaaaaactgctcaacgagcggtcactgttcaggcaggcgatcagccctagtgacagggtaaaactgttccctcaccggaatagctctaaatgtaaatccaaacctcaaattgccgcattgaaggaagagaccgaagaagaggtgcaggatactcggctg

SEQ ID NO: 10169 - DNA, 4440 bp, Artificial Sequence
  Description of Artificial Sequence: Synthetic coding sequence
atgcaacgatcccctcttgagaaggcatccgtggtgtcgaaacttttcttttcttggacgaggccaattttgagaaagggatacagacaaagactggaactgtctgatatctaccaaatccctagcgtggacagcgccgataacctttccgaaaagctggaacgagagtgggaccgggaattggcctcgaaaaagaatccaaagctgattaatgccctgaggagatgttttttctggaggtttatgttttacggcatttttctctaccttggcgaagtcaccaaggcggtgcagcctcttctgcttggtcgaatcatcgcatcgtatgaccctgataacaaggaagagcggtccattgcaatttacctgggaattggactctgtctcctctttattgtcagaaccctgcttcttcatcctgcgatatttgggctgcaccacataggaatgcaaatgcgcattgccatgttctccctgatttacaaaaagactttgaaattgtctagccgtgtcctggataagatctcaatcgggcagctcgtatccttgttgagcaacaatttgaacaagtttgatgaaggtcttgcattggcacactttgtgtggatcgcccctctgcaggtcgcactgctcatgggactgatctgggagctcctgcaggcctccgcattttgtggactgggctttctgatcgtgctggcactttttcaggccggactgggaagaatgatgatgaagtacagagatcaacgggcaggcaagattagcgaaagacttgtgattactagcgagatgattgagaatatccagtcggtcaaggcatactgctgggaagaagcgatggaaaagatgatagagaatctgagacaaactgaactgaaactcactcgaaaggctgcatacgtgagatacttcaatagctctgcattctttttctccggcttttttgtggtctttctcagcgtcctgccgtacgcacttatcaagggaatcattcttagaaagatattcaccaccatttccttttgtattgtgctcagaatggcggttacgcgccaatttccatgggcggtgcaaacttggtacgacagtcttggagccataaacaagattcaggattttctgcaaaagcaagagtacaagacgttggaatacaaccttacgactacggaagtggttatggagaacgtcaccgcattctgggaagagggatttggggaactttttgaaaaggccaaacagaacaacaataacagaaagacctcgaacggggacgattccctgtttttcagcaacttttccctgctgggaactccagtgctgaaggacattaacttcaagatcgaaagaggccaactcctcgcggtggcgggaagcactggagcagggaaaacttccctgctgatggtgattatgggtgaacttgaaccaagcgagggaaaaatcaagcactcaggtcggattagcttctgtagccaattttcatggattatgccaggcaccattaaagaaaacatcatttttggcgtgtcgtatgacgaatacagataccgctcagtgatcaaagcatgtcaacttgaagaagatatttccaaattcgcggaaaaggacaatattgtgctgggtgaagggggaataactctctccggaggccagagagccaggatctcgctcgcacgcgcggtgtacaaagacgcggatctgtatcttcttgatagcccctttgggtaccttgatgtgctcaccgagaaggagatattcgagtcgtgcgtctgcaagctgatggcaaataagaccaggattctggttacctccaagatggaacatcttaagaaagccgataagattcttatcctgcatgaggggtcaagctacttctacggaacgttttcggagctgcaaaacctgcaaccggatttctcgtccaaactcatgggatgcgattccttcgatcaattttcggctgagagacggaactcgatactgaccgaaacccttcatcgctttagcctggagggagatgcccctgtctcgtggaccgaaactaagaaacaatcgttcaagcagaccggagaattcggggagaaacggaaaaactccatattgaaccctatcaactccattcggaagtttagcatcgtgcaaaagacgcctctgcaaatgaatggcattgaggaggattcagatgaaccacttgagcgcagactgtcacttgtccctgactcggaacaaggagaggcaattcttcctcgcatcagtgtgatctcgactggaccaaccctgcaagcacggcgcagacaatcagtgttgaatctgatgacccattccgtgaaccagggtcagaacatccaccgcaagactactgcatccactaggaaggtcagtctggctccccaggcaaatcttacggaacttgacatttactcaagacgactgtcgcaggagactggtttggaaatttcagaggagattaacgaagaagatcttaaggagtgcttttttgatgatatggagtctattcctgcagtgaccacttggaatacctacttgaggtatatcactgtgcacaagtccctcatttttgtccttatttggtgtctggtgatattcctggcggaagtcgcagcttcccttgtggtcctgtggctgctgggcaatactcctctgcaggataagggtaattcaacccactcacgaaacaactcctacgccgtcattatcacttcgacctcatcatactacgtgttttacatctacgtgggtgtcgcggatactttgctggcaatgggatttttccgaggtctgccactggtgcacacccttataacggttagcaaaattcttcatcataagatgctccactccgtccttcaggctccaatgtccaccctcaacactctgaaggcgggaggaattctgaatcgattctcgaaggacatcgcaatcttggatgatctgctgccactcactattttcgatttcattcagctgctcctgatcgttataggagccatagcggtggtggccgtccttcagccatacatctttgtcgccaccgtgcctgtcatcgtcgctttcatcatgttgcgcgcgtactttctgcagaccagccagcaacttaaacagcttgagtcggaagggcgttcacccatattcactcatcttgtgacgtcgcttaagggcttgtggacgctgcgcgcatttggtcggcaaccatacttcgaaactctgtttcacaaagctctgaatcttcataccgcaaattggttcctctacctttcaaccctgaggtggttccagatgcgaattgaaatgattttcgtgattttctttattgccgtgacttttatctccatcctgaccaccggtgaaggagaaggacgggtgggtatcattctgactctggcaatgaacattatgagcacccttcagtgggctgtgaactcgagcatcgacgtagacagcctgatgaggagcgtatccagagtgtttaagtttattgacatgcctaccgaagggaaacctactaagtccaccaagccctacaaaaacggtcagctcagcaaagtgatgataatcgagaattcgcatgtgaaaaaagacgatatctggccctcaggcggtcaaatgactgtgaaggatctgacggccaagtacaccgaaggggggaacgcaattctggagaacatttccttctccatatccccaggccagcgagtgggactgctgggccgaaccggtagcggaaagtcaaccctcttgtcagcctttcttaggctcctgaataccgagggtgaaattcaaatcgacggtgtttcgtgggacagcattaccctccaacagtggagaaaggcatttggggtgattccacaaaaagtattcattttctctggtacttttcggaagaacctggacccttacgaacagtggagcgaccaagaaatttggaaggttgcagatgaggtcggcctgcgcagtgtgatagaacaatttcccggaaagctcgatttcgtcctggtggatggtggttgtgtgttgtctcacggccacaagcagcttatgtgtcttgcaagatcggtcttgtcaaaggcaaagatacttcttctcgatgaaccttcggcacatctcgaccccgtgacctaccagattatccgtcgcactctgaagcaggcattcgcggattgtacggtgattctctgcgagcacagaattgaagctatgcttgaatgccagcaatttctcgtgatagaagaaaacaaggtgcgacagtatgattccatccagaaactgctgaacgaaaggtcactcttcaggcaagcaatctcgccttcggatcgggtgaagctcttcccccataggaactcctcgaagtgtaaatcgaaacctcaaatcgcagcactcaaagaagaaaccgaagaagaagtgcaagacacgcggttg

SEQ ID NO: 10170 - DNA, 4440 bp, Artificial Sequence
  Description of Artificial Sequence: Synthetic coding sequence
atgcagcgcagcccactggagaaagcgtccgtcgttagcaagctgttttttagctggacacgccccattcttaggaaaggctatcggcagagactcgagctctccgacatctatcagattccatctgtagactccgctgataacctgtcggagaaacttgagcgagagtgggaccgcgagttggcaagtaaaaagaatccaaagctcattaatgcattgagacggtgtttcttttggcggttcatgttttacgggatcttcctctatctgggcgaagtgaccaaggctgtccagccgcttctgctgggccggatcattgcctcctatgacccagacaacaaagaagagcgctccatcgcaatatacctgggaattggcttatgcctcctgtttatagtgcgcacactgctgctccatcctgctatatttggacttcatcatattggaatgcagatgcggatcgccatgtttagcctgatttacaaaaaaacactgaagctgtcatcgcgggtcctagataagatttccattgggcagctcgtgtccctgctgtcaaacaacctgaacaaatttgatgaaggtctcgctctcgcccactttgtctggattgcacccttgcaagtggccctgcttatgggactgatttgggagctgctacaggccagcgccttctgtggcctgggcttcttgatcgttctggcgttatttcaagctggactgggaaggatgatgatgaagtacagagaccagcgcgccggcaagatctccgaacggttagttattacctcagagatgatcgagaacattcagtccgtcaaggcatactgctgggaggaggctatggaaaaaatgattgagaacctgcgccagaccgaattgaaactcaccagaaaggccgcgtacgtccgatatttcaactcctccgcctttttcttcagtggttttttcgtggtgttcctttccgtgctgccttacgcgctaataaaagggattattctccggaaaatttttaccaccatcagcttctgcatcgtcttgagaatggcggtgacccggcaattcccatgggctgtgcaaacctggtacgactctttgggcgcaatcaataagattcaggacttcctgcagaagcaggagtacaagactttggagtacaacctcaccaccactgaagtcgtaatggagaacgtcactgccttctgggaggagggttttggcgagctgttcgagaaagcgaagcagaacaacaataatcgcaaaacttcaaacggtgatgacagcttattcttctctaatttctctcttttgggtacccctgtgctgaaggacattaatttcaagatagagagaggccagctgctcgctgtcgctggatccaccggggcaggaaagacctcactgttgatggtaattatgggggagctcgaacctagcgagggcaaaattaagcactcaggacgaatctccttctgtagccagttttcttggatcatgcccggcacaataaaggagaacattattttcggcgtgtcatacgatgagtaccgctatcggtccgtgatcaaggcatgccagctcgaggaagacatctctaaatttgctgagaaagacaacattgttctcggcgaaggtgggattaccctgtcagggggccaacgggcccggatctctctggcccgggccgtatataaggacgccgacttgtacttacttgattcccctttcggttacctggacgtcctgactgagaaggagatatttgagagttgtgtgtgtaagctgatggccaataaaacccgcatcctcgtcaccagtaagatggaacatcttaagaaggcggacaagatcctgattttgcatgaaggatcatcctacttctacggaactttttcagaactccagaacctccaacccgatttctcttccaagctcatgggatgcgatagcttcgatcaattcagcgccgagagacgaaattcaattcttaccgagactttgcaccgcttcagcctggaaggcgacgcaccagtgtcttggactgaaacgaaaaaacagagcttcaagcaaacaggggagtttggggaaaagcgtaagaactcaatcctcaatccaatcaactccatccgcaagttttctatcgtccagaagacccccctgcagatgaatgggatcgaggaggatagtgatgagcctctggagcggagactgtcactagtgccagactccgaacagggggaggccattttacctcgcatcagcgttatctccacaggacctacacttcaggcgaggagaagacagtcggtgctcaacctgatgacccactccgtcaaccaggggcagaatattcatcggaagacgaccgcctccacgagaaaggttagcctagcccctcaggctaatttgacggaactggacatttattcgcgcaggctgtcccaggaaacaggtctcgagatttcggaggagattaatgaagaggacctgaaggaatgcttctttgacgacatggaatccattcccgccgtcactacctggaatacatacctgcgatacatcaccgtgcacaagagcttgatattcgtactaatatggtgccttgtgatattcctggcagaggtggccgcatctcttgtcgtcttgtggttgctgggtaacacacctctgcaagataaaggtaacagtactcactcacggaataactcttatgctgtcatcatcaccagcacatcgagttactacgtgttctatatctatgtcggcgtggcagatactctactagccatggggttctttcgtggactgcctctggttcatacgttgattaccgtttccaaaattctgcaccacaagatgttgcactctgtcctacaagctcctatgagcaccctgaatacccttaaagcaggaggcattctaaatagattctcgaaagacatcgcaattctggatgaccttcttccgcttacaatctttgactttatccaactcctgctcatagtgataggggcaatcgcagtagtggcagtcctacagccttatattttcgtggctaccgtgcccgtgatagtggccttcatcatgttgagggcttacttcttacaaaccagccagcagctcaaacaactggaatctgaggggaggtccccaattttcacacaccttgtcacctccctcaagggcctatggaccctgagggcctttggtagacagccctactttgagaccctcttccataaagcgctgaacctgcacacagcaaactggttcctgtatctttccacactgaggtggtttcagatgagaattgaaatgatttttgtcattttttttatcgcagtgacattcataagcatcctaacaacgggggagggcgaaggccgggtcggaattattcttacgctggcaatgaatataatgtcaactctccaatgggccgttaatagtagtatagacgtcgattcactgatgaggtccgtgtccagagtgttcaaatttatcgacatgccaaccgaagggaaaccaaccaaaagcactaagccatacaaaaacggacagctatctaaagttatgattatcgaaaactcccacgtaaagaaagatgatatctggccaagtgggggtcagatgacagtgaaggacctgaccgcaaaatatactgaggggggcaacgctatccttgaaaacattagctttagcatcagtcctggccaacgggtgggcctcctcggtaggaccggttctggtaaatccaccctgctgagcgccttccttcgcctgctcaatactgaaggcgagattcaaatcgatggcgtctcttgggatagtatcactctccagcagtggcggaaagccttcggagtcattccacagaaggtctttatattcagcggcacgtttcggaagaatttggacccctacgagcagtggtccgaccaagaaatctggaaagtggcagacgaagtagggctgaggagtgttatcgagcaattccccgggaaactcgattttgtcttagtcgatgggggatgcgtgctgtctcacggacataaacagctgatgtgcttggcccggagcgtcctcagcaaagctaagatcctcctgctcgacgagccaagtgcccatttggaccctgtgacatatcagattatccgcaggacactcaagcaggccttcgcagactgtacggttattctgtgcgagcatcgcattgaagccatgctagagtgccagcagttcctagtgatagaagagaataaggtgcgacagtatgactctatacagaagttattgaacgagagatctctgttccggcaggctatatcaccaagcgaccgcgttaagctcttcccacataggaactcttcgaagtgtaaatcgaaaccacaaattgcagcgctgaaggaggagacagaagaggaagtgcaggatacaaggctt

SEQ ID NO: 10171 - DNA, 4440 bp, Artificial Sequence
  Description of Artificial Sequence: Synthetic coding sequence
atgcaacggtcaccgctcgaaaaagcatcagtggtaagcaagctcttcttctcctggacgagaccgattcttcgaaagggatatcgacaaaggttggagctcagcgatatttaccaaatcccatcggtggattcggcagataacctgtcagaaaagctggagcgggagtgggaccgcgagcttgcaagtaagaagaaccctaagctgatcaatgccttacgcaggtgcttcttttggagattcatgttctatggtatattcctgtacctcggcgaggtaaccaaagctgtccagcctctgctcctggggcggatcatcgccagttatgatccggataacaaggaggagcgctccatcgccatctacctcggaatcggcctgtgtctgctttttatcgttcgtaccctcctgctccacccggctatctttggcctgcaccatattggcatgcaaatgcgaatcgccatgttttcactgatctacaagaaaactctcaaactgtcttctcgggtccttgacaaaattagcattggccagctggtttctttgcttagcaacaatctcaacaagttcgatgaaggactcgcactggctcatttcgtgtggatagcccccctacaggtagcccttttgatgggcctcatttgggaactcctgcaggccagcgccttctgcggcttaggtttcctcatcgtactggctctttttcaggcaggtctcggaaggatgatgatgaagtatcgcgaccaacgggccggaaagatcagcgagcgcttagtgattaccagcgagatgatagagaacatccagtccgtcaaagcatactgttgggaggaagcaatggagaagatgatagagaatctgagacagaccgagctgaagctcactagaaaggccgcctacgtccgttactttaacagctctgcattcttctttagcggattcttcgtggtctttctaagtgtattgccttacgctctcattaaaggaatcatattgcggaagattttcacaactataagcttttgtatcgtgttgagaatggccgtcactcggcaattcccatgggctgtgcaaacatggtacgacagcttaggagcaattaacaagattcaagattttctacagaagcaggagtacaagaccctcgaatacaacctgaccacgacagaagtggtcatggagaacgtgaccgcattctgggaagaaggatttggcgaattatttgaaaaggcaaaacagaacaataacaatcggaagacaagcaacggggacgactccctgtttttttccaacttctccctcctaggcacacctgtgcttaaggatatcaatttcaaaattgaacgtgggcaactgcttgcagtagctggctctactggagcgggtaagacaagtctgctgatggttattatgggcgagctggagccctccgaggggaagataaaacacagcgggaggatcagtttttgctcgcagttctcatggattatgccgggaacgataaaggaaaatattatctttggagtgtcttacgatgagtatcgctaccggagcgtgatcaaagcttgccaattagaggaagacatatctaaatttgccgaaaaggataacattgtactgggagagggaggaattaccttaagtggtggccaacgggctcgaatatcactagcacgagcagtgtataaagacgccgatctctacctactggattctccatttgggtatttggacgtcctcacagaaaaagagatattcgaatcttgtgtgtgcaaactcatggcaaataaaacccgcatcttggtgacaagcaagatggagcacctgaagaaagccgacaaaattctgattttgcacgaaggatcaagctacttctatgggactttctccgagctgcaaaatctgcagccagactttagctcgaagttgatgggatgcgatagcttcgaccagttctccgctgaacgacggaactcaatcctgacagagacgttacaccgcttctcattggaaggcgatgccccagtctcctggacagagaccaagaagcagagctttaagcagaccggcgagttcggagaaaagaggaaaaattcaatcttaaatcctataaactcaatccgcaagttctccatcgtccagaagacccctctgcagatgaatggaattgaagaggatagcgacgagcctctggagaggcgcctctctctggtgccagacagcgagcaaggcgaagcaatcctccctcgcatatctgttatcagcactgggcccacgcttcaggcaaggcgccgtcagtccgtgctgaacctcatgactcattccgtgaatcagggacagaatatccacagaaaaacaactgccagcacccgtaaggtgagcctcgctccccaggccaacttaaccgaattggatatttattctaggagactgtcccaggagactggccttgagataagcgaggagattaacgaggaggacttaaaagaatgttttttcgatgatatggagtcaatcccagccgtcaccacatggaacacttacctgcgatatataacagtgcataagtcattaattttcgtgctgatctggtgcttggtcatattcctcgctgaggttgccgccagcctggttgtactgtggttattaggtaacactcccctacaagacaaggggaactccacccacagccgcaataatagttacgctgtgataattacaagcacttcatcatactacgtgttctatatttatgtcggtgtcgctgacacccttctggccatgggattttttagaggcctgcccttagtccatacgctcatcactgtttctaaaattctgcatcacaaaatgctccatagcgttttgcaggccccaatgagcacactcaataccctgaaagccggggggatccttaatcgattctcgaaagatattgcgatcctcgacgatcttttaccattgacaatcttcgatttcatacaactgctcctgatcgtgatcggcgctatcgcggtggttgccgtattacagccctatatctttgtggctaccgtgcctgtgatcgtggcttttatcatgttacgcgcttacttcttacagacctcccaacagctaaaacaactggagtcagaaggacggtctcccatatttactcacctggtgactagcctgaaagggctgtggacgttgcgcgcatttggcaggcagccttacttcgagaccctatttcataaagccctcaacctgcatactgctaactggtttctgtatctcagtaccctgcggtggtttcagatgagaattgaaatgattttcgtcattttctttatcgctgttacattcatttctattcttactaccggggaaggcgaagggcgggtgggcatcatacttacactggccatgaatatcatgtcgacattgcagtgggctgttaactcatccatcgacgtggactccctgatgcgatcagtgtccagggtgtttaagtttatcgatatgcctaccgagggtaaaccaaccaagtcaacaaaaccctataagaatgggcaactttccaaggttatgatcatagaaaactctcatgtcaagaaggacgacatatggccttccgggggccaaatgaccgtgaaggacctcaccgccaaatacaccgagggtggaaatgccattctggagaacatcagcttctccatcagcccagggcagcgagtgggccttctgggacgcaccggctctgggaagagcaccctgctgtctgcctttctccggctcttgaacactgagggcgaaattcagatcgatggcgtctcatgggactctatcaccctccagcagtggcggaaagctttcggtgtaataccccagaaggtatttatttttagtggcacgttcagaaagaacctcgatccgtatgaacagtggtcagaccaggagatctggaaggtggcggatgaggtgggactgcgatcagtgatcgaacagttccccggcaagttagatttcgttttagtagatgggggttgcgtgttatcccatggtcataagcagcttatgtgcttagcacggtccgttctctctaaggcgaagatactcttgctcgatgaaccttctgcccacctagaccccgtgacataccagattatcagaaggacacttaaacaggcattcgcggattgcaccgtgattctgtgtgaacatcggatcgaggcaatgttggagtgccagcaattcctggtgattgaagagaataaggtcagacagtatgactctatacaaaagttactgaacgaaagatccttgttcaggcaagcaatctcccccagcgaccgggtaaaactgttccctcaccgtaatagttccaaatgtaagtctaagccgcagatcgccgctctgaaggaagagacagaggaggaggtccaggacacgagactc

SEQ ID NO: 10172 - DNA, 4440 bp, Artificial Sequence
  Description of Artificial Sequence: Synthetic coding sequence
atgcagcgttcaccactggagaaggcaagcgtggtgagcaaactcttcttctcttggacgcgacccattctacggaagggatacagacagcgcctcgagcttagtgatatataccagattcctagtgttgactctgccgacaatttatccgaaaaactggagagagagtgggatagggagctggccagcaagaagaatccgaaactgataaatgccctgcgtcggtgtttcttctggaggttcatgttttatggtatttttctgtacctgggcgaggttacaaaagccgtccagccattgctgctcggtagaattatagcctcctatgacccagataataaagaggaacgcagtattgccatttacctgggcattggcctgtgcctgctctttattgttcggacactgctgctgcacccagcaatattcggactacaccatatcggcatgcagatgcgaatcgccatgttcagtctgatttacaagaaaaccctgaaactttcctcgcgggttcttgataagatttctattgggcagctggtctctcttttgagtaataacctgaataagtttgatgaaggactggcacttgctcacttcgtgtggattgcacccctccaggtagccttattaatgggtctgatttgggagcttctccaggcctctgctttctgtgggcttgggtttctgattgtgttggccctgtttcaggctggcctggggcggatgatgatgaagtaccgggaccaacgcgccggaaagatatcggagagactagttataacaagcgaaatgatcgaaaacatccagagcgttaaggcgtattgctgggaggaggccatggaaaaaatgatcgaaaacttgcgccagaccgaactaaaattgacgcgaaaagccgcatatgtgaggtatttcaattcatctgccttctttttcagtggtttcttcgtcgtgtttttatccgtcctcccctatgccctgatcaaaggtatcattctgcgcaagatattcacaactatctccttctgtattgtcctccgcatggctgtcacaaggcagtttccatgggcagtgcaaacgtggtacgactcacttggagccattaacaagattcaagattttctgcaaaagcaagaatacaaaaccttagagtataatctcactactacggaagtggtgatggagaacgtgacggctttttgggaggaaggattcggggaattgtttgaaaaagctaaacagaacaataacaacagaaaaacgtcaaatggagacgatagcttatttttcagcaacttttccctgttgggaacaccagttctgaaagatattaattttaagattgagcgagggcagctgctggccgtcgcagggagtaccggagcagggaagacctcacttttaatggtgattatgggagagttggagcctagcgaggggaagatcaagcactcgggtcggatcagcttctgctcccagttctcatggattatgcccggcacgattaaggagaatatcatttttggagtgtcttacgacgaataccgatatagatccgtgatcaaggcctgccagctggaagaagacatctccaagtttgctgagaaagacaatatagtccttggtgagggcggcataacactctcaggcggacagagggcacgaatctcattggctcgggcagtatataaagacgcagacctctatttgctggactcacccttcgggtaccttgacgtccttacagaaaaggagatcttcgagtcgtgtgtgtgcaagctgatggcaaacaagacgaggatcctggttacctccaagatggagcacttgaaaaaggcagacaagattcttatactgcacgaaggaagctcctatttttacggaacattttctgaactccagaacttgcagccggatttcagttctaaactcatgggctgtgactcttttgatcagttcagtgctgagcgtaggaatagcatactaacagagaccttgcatagattcagtttggagggggacgctcccgtcagctggaccgagacaaaaaagcaatcattcaaacagaccggtgagttcggcgagaagcgaaaaaacagcatcctgaaccccattaactccattcgtaagttctccattgtgcagaagacgccactacagatgaatggaattgaggaagattctgacgaacccctggaacggcggttgtcattagttcctgacagcgagcaaggggaggccatcctcccccggatctccgtgatttctaccggtcccaccttgcaggctcggaggcggcagtctgttttgaacctgatgacccacagtgtaaaccaagggcagaatatccaccggaagacgacagcttcaaccagaaaggtcagcctcgcaccccaggccaacctgacggaattagatatctactcacgccgcctgtcacaagagactggcctggaaattagcgaagaaatcaacgaggaagatctgaaggagtgcttctttgacgatatggagagcattcccgcagtgaccacctggaatacttaccttcgttatattacagtccacaaaagtctgatattcgtactaatctggtgtctggtgatttttctggcagaagtcgccgcttccctggttgtcctctggttacttggcaacaccccccttcaagacaagggcaattctacacatagtagaaacaactcatatgcagtgatcatcacatccaccagtagctactacgtgttctatatctacgtgggagtcgccgacacactgctggccatgggcttttttagaggattacccttagttcacactctgattaccgtctccaagatccttcatcacaaaatgctgcactctgtcctgcaggcccctatgagcacattaaataccctaaaggccggcggcatcctgaaccgcttctccaaggacattgccatcctggatgatttgcttccattgacaatattcgattttatacagctcctactgattgtgataggcgcgattgctgtggtggctgtgcttcaaccgtatatttttgttgccacagtccctgtgatagtggcatttatcatgctgcgggcctactttcttcaaacaagtcagcaactgaagcagcttgagagtgagggaaggagccccattttcacccacttggtgacttcgctgaaaggcttgtggacgctcagagcttttgggagacaaccatacttcgaaaccctgttccacaaggctctcaacctgcatactgctaattggttcctgtatctttcgactctgcggtggtttcaaatgcgaatagaaatgatctttgtgatatttttcattgcggtgacctttatttcaatcctaaccaccggggaaggagagggaagagtcggaataattctgacgttggcaatgaacatcatgtccacgctccagtgggctgtgaattcctctatagacgtcgacagcctcatgcgaagtgtgagccgtgtgttcaaattcatcgacatgcctacggaaggtaaacccactaagagtactaaaccttacaagaacggccagctttctaaagtcatgatcattgagaactcccatgtgaaaaaagatgacatttggccgtccgggggccagatgacagtgaaggatctcaccgctaagtacaccgaaggcgggaacgcaatccttgagaatattagcttctctatttcccctggccaacgggtgggcctgctgggccgtacaggcagtgggaaaagcacgctgttgagcgcgttcctgaggttgttaaacaccgagggtgagatacagatcgatggtgtcagctgggactctatcactttacagcagtggagaaaggccttcggagtgattccgcaaaaggttttcatcttcagcggcacttttcgcaagaatctagacccgtacgaacagtggtctgatcaggagatctggaaggttgccgacgaagtggggctccggtcagtgatcgagcagtttcccgggaaactggatttcgtactcgttgacggcggctgcgtgctctcccacgggcataagcagcttatgtgcctggcaaggtcagtcctcagcaaggcaaagattctcctcctggatgagccatcagctcaccttgatccagttacctatcagatcatccggcgaactctcaaacaggctttcgcagattgcaccgtgattctgtgtgagcaccgcattgaagctatgctggaatgccagcagttccttgttatcgaagagaataaagtccggcagtacgacagcatccaaaagctgctcaacgagcggagcctttttaggcaagccatcagtccatctgacagggtcaagcttttcccccacaggaacagttcaaaatgtaagagtaagccacagatcgcggccctgaaggaggagaccgaggaggaggtgcaggatacacgactc

SEQ ID NO: 10173 - DNA, 4440 bp, Artificial Sequence
  Description of Artificial Sequence: Synthetic coding sequence
atgcagcggtcaccacttgaaaaggcctcagtggtgtcgaaacttttcttctcgtggactcgaccaattctccgaaaaggatacagacaaagacttgaactctcagacatttatcagatcccctccgtcgacagcgctgataacctgtccgagaaattggaacgtgagtgggatcgggaattggcctccaagaagaatcctaagctgattaatgcacttagaagatgcttcttttggaggtttatgttttacggaattttcctgtacctgggggaggtgaccaaagcagtgcagcccttgctgctgggaagaattatcgcttcctacgatcctgataacaaggaagaacgcagcatcgcaatttaccttggaattgggctgtgtctccttttcatcgtccgaaccctgcttcttcaccccgcaatctttggtctgcatcacatcggaatgcagatgagaattgcaatgttctcgcttatctacaagaaaaccctcaagctgtcatccagggtgctggacaagattagtattggacagctggtatcccttctttcgaacaaccttaacaagtttgacgaaggcctggcgttggcacactttgtctggatcgcaccgctccaagtcgctcttctgatgggactgatttgggaacttctgcaggcaagcgcattttgtggtctgggttttctcatcgtgcttgcacttttccaggcaggtctggggagaatgatgatgaagtaccgggatcagcgagctgggaagattagcgagcgactggtgatcactagtgaaatgattgagaatattcaatcagtgaaggcatactgttgggaagaagccatggagaagatgatcgaaaacttgcgccaaaccgaactcaaacttacccgcaaggccgcatacgtgcgctactttaactcgtcggctttctttttcagtggctttttcgtggtgttcctgagcgtccttccatacgcattgattaaaggtatcattctgagaaagatctttaccactatttcattttgtattgtgctgcggatggcagtgaccaggcagtttccctgggccgtccaaacctggtacgacagcctgggtgcaattaacaagattcaagatttcctgcaaaagcaagagtacaagactctggagtacaacctcactactactgaggtggtaatggaaaatgtgaccgcattttgggaggagggatttggtgagctttttgaaaaggctaaacaaaacaacaacaaccgaaagacgtcaaacggagacgattcgcttttcttcagcaacttctcattgcttggtactcctgtgcttaaggacataaacttcaagatagagcgcggacagcttctggctgtggccggctcgacgggtgccgggaaaacgtcgcttctgatggtcatcatgggtgaacttgagccgtcagaaggaaagattaagcattcgggacgcatttcattttgctcacaattctcgtggataatgccgggcaccattaaggaaaacatcatctttggtgtgtcctacgacgaatatcgatacagaagcgttatcaaggcatgccaacttgaagaagatatttcaaagtttgcagagaaagacaatattgtgttgggagaaggtggaatcaccctctccggcggccaaagagcaagaattagcctggcccgtgcagtgtacaaggacgcggatctttaccttcttgattcgccatttggatacctcgatgtgctgactgaaaaagagatattcgaaagctgtgtctgtaaactgatggcgaataagactagaatccttgtgacttccaagatggagcacctcaaaaaagcagacaaaatacttatactccacgagggatcttcgtacttttacggaaccttttcagagctgcaaaaccttcaacctgatttcagctcgaagctgatgggttgcgacagctttgatcaattcagcgcagaacgcagaaattcgattctgaccgaaacccttcataggttctccctcgaaggcgatgcaccagtctcatggaccgagactaaaaagcaatcctttaagcagaccggtgaatttggcgaaaagcgcaagaactccatactgaatccgatcaatagcattagaaagttttcaattgtccaaaagactccgctgcagatgaacggaattgaagaggattcagacgagccacttgaacgacgtctctccctggtgccagattcggagcagggagaagcaatacttccaagaatttccgtcatttcgaccggacctaccctgcaggctaggcgacgtcagtcggtcctgaatctcatgactcattcagtcaaccaaggtcaaaacattcatagaaagactaccgcaagcaccagaaaggtgtcgctggcaccacaagcaaatttgactgaacttgacatctactctcgccgactgagccaggaaactggtctggaaatctccgaagagattaacgaagaggacctgaaggaatgtttctttgatgacatggagtccattccggcagtcactacctggaacacttatctgagatacatcactgtccacaagtccttgatttttgtgctgatatggtgtctggtgattttcctggccgaggtcgccgctagcctcgtcgtgctgtggctccttgggaatactcctcttcaagataagggaaatagcactcattcgcggaacaattcgtacgcggtgatcattacgagcacttcgtcgtactacgtgttttacatctacgtgggggtggccgacaccctgctggcaatgggattctttcggggtttgccccttgtgcataccctgataactgtgtcgaagatcctgcaccacaagatgctgcattccgtgctgcaagcccctatgagcactctgaatacgcttaaggcaggaggtattcttaacagattttcgaaggatatcgcgattctggatgacctcctcccacttactattttcgactttattcaacttcttcttattgtgataggcgcaatcgcggtggtggctgtgctccagccatacatttttgtggcaactgttccagtgattgtggcgttcatcatgcttagggcgtactttcttcagacctcgcaacagctgaagcaacttgaatcggaagggcggtcgcccattttcacgcatctggtgaccagcctcaaaggcctctggaccctgagagcatttggtagacaaccttacttcgagactctttttcataaagccctgaacctccacaccgcaaactggttcctttacctttccaccctcagatggtttcagatgaggatagagatgatctttgtgatcttctttatcgcagttaccttcatttcaattcttacgaccggagaaggggaaggcagggtggggatcatcctgaccctggcaatgaacatcatgtccactttgcaatgggcagtgaattccagcatcgatgtggactcacttatgagatccgtatcaagagtgtttaagtttatcgacatgcccactgaaggcaagcctactaagtcaaccaagccttacaagaatggccaactttcgaaggtgatgattattgaaaactcccatgtgaagaaggacgatatttggccttcaggaggtcagatgactgtgaaggatcttaccgcaaagtatacggagggtggaaatgccattctggaaaacattagcttttccatttcacctggtcagagagtggggctccttggtcgcaccggctcgggaaagtcgactctgctgtcggcatttcttagactgttgaacactgaaggtgagatacaaattgacggtgtctcctgggattccataaccctccagcaatggcgtaaggcattcggagtcatccctcaaaaagtgtttatcttctcaggtacctttagaaagaatctggacccatacgagcagtggtcagatcaggaaatctggaaagtggccgatgaggtgggattgcgcagcgtgatcgaacaattcccaggaaagctggactttgtgctggttgatggtggatgtgtgctgtcgcatggacacaagcaactgatgtgtcttgcccgttcggtgctttccaaagcaaagatactgctcctcgatgaaccgtccgcccacctggatcccgttacttaccaaatcatcagacgaaccttgaagcaagcatttgcggattgtactgtcatcctgtgtgaacatagaatcgaagcaatgctggaatgccaacaatttcttgtcattgaagaaaacaaggttagacagtacgattccattcaaaagctgctgaacgagaggtccctttttcggcaagctatctccccatcggatagagtgaaactgttcccacatagaaattcctcgaagtgtaagtcgaagccccagattgccgcccttaaggaagaaactgaggaggaggtccaggataccagactt

SEQ ID NO: 10174 - DNA, 4440 bp, Artificial Sequence
  Description of Artificial Sequence: Synthetic coding sequence
atgcaaaggtcgcccctggagaaggcctcagtggtgtctaagctgttcttttcgtggacccgtccaattctccgaaagggataccgtcagagactggaactttcagacatttatcaaatcccatcggtcgattcggcggataacttgtcagaaaagctggaaagggaatgggatagggaactggcaagcaagaaaaatccaaaactcattaatgcactgaggagatgttttttctggagatttatgttttatggtatcttcctgtaccttggagaggtcacgaaggcagtgcaacccctgctgcttggtagaatcatcgcatcatacgatcctgacaataaggaggaacgatccatcgcaatctacctggggattggtctttgtctccttttcattgtgcgtacgcttcttctgcatcctgcaatcttcggactgcatcatattggtatgcaaatgcggatcgcaatgttctcattgatttacaagaaaactctgaagctgtcctccagggtccttgacaagattagcattggacagctggtgagcctgctttcgaacaacctcaacaaatttgacgagggacttgcacttgcacacttcgtgtggatagcccctcttcaggttgcactgctgatgggacttatctgggaacttctgcaagcatccgcattctgtggtcttggatttcttatagtgctggctctgtttcaggccggtctgggacggatgatgatgaagtaccgagatcagcgagcaggaaagatatcggaaaggcttgtcataacctccgagatgatcgagaacattcaaagcgttaaggcctactgctgggaagaagccatggagaagatgatcgaaaatctgcgccagaccgagttgaagctgacccggaaagcagcatacgtgaggtacttcaactcatcagcattcttcttttctggttttttcgtcgtttttctttccgtgctcccctacgcactcatcaagggtatcattctccggaagattttcactaccattagcttttgtatcgtgctccggatggcagtcacccgacagtttccctgggccgtgcaaacgtggtacgacagccttggcgcaattaacaagattcaggattttcttcaaaagcaggaatacaaaacgcttgagtacaatcttactactaccgaagtcgtgatggaaaacgtgactgccttttgggaagagggatttggtgagctgttcgaaaaggctaaacaaaacaacaataatcggaaaacgtccaatggagacgactcccttttcttctctaacttttccctgcttgggactcctgtcctcaaggacatcaatttcaagatcgagcgtgggcagctgctggctgtggcaggatcgacgggagccggtaagacctcacttctgatggtgatcatgggagaactcgaacctagcgaaggaaagattaagcattcaggccgcatctccttttgttcgcaattttcctggattatgcctggaactatcaaggagaacattatcttcggtgtgtcgtacgatgagtacagatacaggtcagtcattaaagcgtgccaactggaggaggatatctccaaatttgcagaaaaggacaatattgtgctcggagaaggtggcattactctgagcggaggacagagagcgaggattagcctggcaagagcggtctacaaggatgcagatctttacctgctcgacagcccatttggatatcttgatgtgctcactgaaaaggagatctttgagtcgtgtgtgtgcaagctcatggcgaataagactagaattcttgtcacttcgaagatggagcacctcaaaaaggccgataagatcctgattttgcatgaaggatcatcatacttctacggaaccttttcggagctgcagaacctgcaacctgacttcagctccaagctcatgggttgtgattcatttgatcagtttagcgctgaacgtcggaattcaatcctgacggaaaccctccatagattttcgttggaaggagacgcaccggtttcgtggacggaaactaaaaagcagtcatttaagcaaaccggtgaatttggggagaaacgcaagaattcaattctcaaccccatcaatagcatccgcaagttctcgatcgtgcagaaaactccactccagatgaatggtattgaagaggattcggatgaaccacttgaaagacgactgtcactggtgcccgattcagagcaaggggaggcaatccttcctcggatcagcgtcatctcaaccgggcctactctgcaggcaagacggagacaatccgtgctgaatcttatgactcatagcgtcaatcaaggacaaaacattcacagaaagactaccgcatccaccagaaaagtctcccttgcgccgcaagcgaacttgaccgaactggatatctactcgcgtcgcctctcgcaggaaactggtttggaaattagcgaagaaatcaatgaagaagatcttaaggagtgttttttcgacgatatggaatcaatccctgcagtgactacttggaacacctacctgagatacatcactgtccataagtcccttatcttcgtcctcatttggtgtcttgtgatttttctcgcagaagtggcggcttcgctggtggtgctttggctgctcggtaatactcccctgcaggacaagggaaattcgactcattcgagaaacaattcgtacgcggtgataatcacttcgacttcctcgtactacgtgttctacatttacgtgggagtcgctgatactcttcttgcgatgggcttttttcgaggactccccctggtccatactctcataaccgtctcgaagattctgcatcataagatgcttcattccgtgttgcaagcacctatgtccactcttaataccctgaaggccggcgggattctgaacagattttcgaaggatatcgctatcctcgacgatctcctcccactgaccattttcgactttattcaactgctgctgatcgtgatcggagcaattgcagtggtcgccgtgcttcaaccatatatcttcgtggccactgtgccagtgatcgtcgccttcatcatgctccgcgcatactttctccaaaccagccaacaacttaagcaacttgaaagcgaaggacgctcgccaatctttacccatcttgtgacctccctgaagggcctgtggaccctgcgggccttcggtcgccagccgtattttgaaaccctttttcacaaagctctcaacctccacactgcaaattggtttctgtacctgtcgacgctgagatggtttcagatgcgcatcgaaatgatcttcgtgattttctttatagcagtgactttcattagcatcctgactaccggggaaggggaaggtcgtgtcgggataattcttactcttgcgatgaacattatgtcgactctgcagtgggccgtcaactcgtcgattgacgttgactcccttatgagaagtgtctcacgcgtgtttaagtttatagatatgcccaccgagggaaagccaactaaatcgaccaagccctacaaaaatggccaactcagcaaggtcatgattatcgagaattcccatgtcaagaaagacgacatttggccttcaggcggtcagatgaccgtgaaggatctgaccgcaaagtacaccgagggtggcaacgcaatactcgaaaacatatcctttagcatcagcccgggccaacgcgtgggactcctgggtagaaccggatcgggcaagtcgacccttctgagcgcctttctgcgcctcctgaacaccgaaggcgagatccagatcgatggagtgtcgtgggactcgatcacccttcagcaatggcggaaggcctttggagtgattccccaaaaggtgtttatcttttcgggtacctttcgaaagaatctcgatccttacgagcaatggtccgatcaagaaatatggaaggtcgcagacgaagtcggacttcgatccgtgatagaacagtttcctggaaagctcgattttgtgttggtggatgggggctgtgtcctttcccatggtcataaacaactgatgtgtctcgcaagaagtgtgctttcgaaggccaaaattctgctgcttgatgagccttcggcgcacctggatcccgtcacttaccagatcattagacgcactctgaagcaagcctttgccgattgcaccgtgattctttgtgaacaccgtattgaagcgatgcttgaatgtcaacagtttctggtgatagaggaaaacaaggtcagacagtacgattccatccaaaaacttttgaatgagcgatcgctgttccgacaagccattagcccatcagatcgggtcaagctgtttccccatagaaattcgtccaagtgcaagagcaagccacagattgcagccctcaaggaggaaaccgaagaagaagttcaagacactaggctt

SEQ ID NO: 10175 - DNA, 4440 bp, Artificial Sequence
  Description of Artificial Sequence: Synthetic coding sequence
atgcaacggtcgcctcttgaaaaagcgtcggtggtgagcaagctgtttttctcgtggactagaccaattctgaggaagggctaccgccagaggcttgagctgtccgacatctaccagataccctcggtagattcagcagacaacctctcggaaaaacttgaacgggaatgggacagagaactggcatccaaaaagaatccgaaacttatcaacgcacttagacggtgttttttctggcggttcatgttctacgggatatttctctaccttggggaagtgactaaggccgtgcaaccactgcttctcggacggattattgcatcctacgatccagacaataaggaagaaagatccattgcaatctacctgggcatcggactgtgcctgttgtttattgtgcgaactttgctcctgcatccagccatttttggactccaccatattggcatgcaaatgaggatagcaatgttctcgctgatctacaaaaagactcttaaacttagcagcagagtcctcgacaaaatctcgataggacagctggtaagccttctgtcgaataacttgaacaagtttgatgaaggacttgcccttgcccatttcgtgtggattgcgcctctgcaagtggcgctgctgatggggcttatttgggagctcctgcaagcgtccgctttttgtggacttgggtttctgatcgtgcttgctctgttccaggccggactgggcaggatgatgatgaagtacagagatcagcgggccggtaagatctcggaacgtctcgtgattacctctgaaatgattgaaaacatccagtcggtgaaggcatactgctgggaagaagcaatggaaaagatgattgagaatctgcggcaaaccgaacttaagttgacccgcaaagctgcatacgtgagatactttaacagtagcgccttctttttctcgggtttcttcgtggtgtttctttcggtgctgccatacgccctgattaaaggaatcattctccgaaagattttcaccaccatctcattttgcattgtccttagaatggctgtgactagacagtttccatgggccgtccaaacctggtatgactcccttggcgcaatcaacaagattcaagattttcttcaaaagcaggaatacaaaactcttgagtacaatcttaccactactgaagtcgtcatggaaaacgtgactgctttctgggaagaagggtttggtgagctttttgagaaggccaaacaaaacaacaataatcgcaagacgtctaacggagatgattcattgtttttctcgaactttagtttgctcggaaccccagtgctcaaagacatcaatttcaaaattgaaaggggccaacttctcgcggtcgctggaagcaccggtgcaggtaaaacttccctccttatggtgatcatgggggaactggaaccgtcggaaggaaagattaagcattcgggtaggatttccttttgttcgcagttttcatggatcatgccgggcactatcaaggagaacatcatttttggtgtgagctacgatgaatacagatacaggagcgtcattaaggcatgccaactggaagaggacattagcaaatttgccgaaaaggacaacattgtgctcggggaaggtggaatcactctcagcggtggacaaagggcaagaatctcacttgcacgggcagtgtataaagatgcagatctttacctgctcgactcgcctttcggctacctggatgtcttgactgagaaggaaatcttcgaatcctgcgtgtgcaagctgatggcaaacaagactaggatccttgtcacgtcgaagatggaacacctcaagaaagcggacaaaatactcatcctgcacgaaggatcaagctacttttacggaaccttttccgaactgcaaaatctgcaaccagatttttcgtcaaagctcatgggatgcgattcatttgatcaattctcagcggagcgccgtaattcgattctcaccgaaactctgcatcggttctccctggaaggagacgccccggtcagttggactgaaaccaagaaacagtcatttaagcagacgggtgaatttggagagaagcgcaagaatagcattctgaacccaatcaattccatccgaaagttctccatcgtgcaaaagacccccctccagatgaatggcattgaggaggattcggatgagcctctggaaaggagactgtccctggtgcctgactccgaacagggggaagcaattctgcctcgaatatcggtgatttccaccgggccaaccctgcaagcacgcaggcgtcagtccgtcctcaatctcatgactcatagcgtcaaccaaggtcaaaacattcatcgtaagaccactgcgtcgactaggaaggtcagcctggctccacaggccaatcttactgaactggacatttactcccgccggcttagccaggaaaccggactggaaataagcgaggagatcaacgaagaggatctgaaggagtgcttttttgacgatatggagtccattccagcagtgaccacttggaacacttatctgcggtacataacggtgcacaagtcccttatcttcgtgttgatctggtgcctggtgatttttctcgcagaagtggcagcgtcactcgtggtgctttggctgctgggaaacaccccactgcaggataaaggtaacagcactcatagcagaaataactcatacgcggtgattatcacgtccacctcctcctactacgtgttttacatctatgttggtgtggcggacacccttctcgcaatgggcttttttcgtggtttgcctctcgtccacacgcttataacggtttctaagattctccatcataagatgctgcatagcgtcttgcaggcacctatgtcaaccctgaacaccctgaaagcaggtgggatcctgaatcgattttccaaggatatcgcaattcttgatgacctgcttcctcttaccatttttgacttcatccaactgcttctgatcgttattggagcaattgcggtggtggcagtcctgcaaccgtacatttttgtggcaaccgtgccagtcatagtggcctttatcatgctcagggcatacttcctgcaaacctcccagcaactgaagcaactggaatcagaggggaggagccctatctttactcatctggttaccagcctcaagggactttggacccttcgtgcatttggacgccagccatactttgagactctctttcataaggcactcaaccttcacactgcaaactggttcctgtatctttccaccctgcgatggttccaaatgaggattgaaatgatcttcgtcatattcttcattgcagtgaccttcatcagcattctgactaccggagaaggcgagggaagagtcgggatcatattgacccttgctatgaacattatgtccactcttcaatgggccgtgaacagctcgatagatgtggattcgctgatgagatctgtctctagggttttcaagtttatagatatgccgaccgaaggaaaacccacgaagtcgactaagccctacaagaacggccagctttcgaaggtcatgattattgaaaactcgcatgtgaaaaaggatgatatttggccttcaggtggtcagatgaccgtgaaggatcttactgcaaagtacaccgaaggaggtaacgcgatacttgagaatatctcattctccatttcgcctggtcaaagggtgggactccttgggcgcaccggttcagggaagtcaacccttctttcagcgtttcttagactccttaataccgaaggggaaattcagattgacggagtgagctgggactcaataacgctgcaacagtggcgcaaagccttcggagtcattccacaaaaagtgttcatcttttccggaactttccgaaagaatctcgatccctatgaacaatggtctgatcaagaaatctggaaggtcgcagacgaagtcggactgcggtccgtgatcgagcaattccctggtaagctggacttcgtgctcgtggacggtggttgtgtgctttcacacggtcacaagcagctgatgtgccttgcacgatccgtgctgtccaaggcaaagattctgctccttgatgaaccttcggcgcatttggatccagtcacgtaccaaatcatcagaagaactctcaaacaggcttttgcagattgcaccgtcatcctctgcgaacacaggattgaagcaatgcttgagtgccagcaatttcttgtcatcgaggaaaacaaagtgaggcaatatgactcgatccagaagctcctgaatgaacgttcactgtttcggcaggcaatttccccctccgatagagtcaaacttttcccgcatagaaattcgtcaaaatgtaaatccaagccacaaatagcggcactgaaggaagaaaccgaagaagaagtgcaggacacccggctt

SEQ ID NO: 10176 - DNA, 4440 bp, Artificial Sequence
  Description of Artificial Sequence: Synthetic coding sequence
atgcaacggagcccgctcgaaaaggcgtcggtggtgagcaaactgtttttctcctggactcgcccgatcctgcgcaagggataccgccaaaggctggaactgtcggacatctaccagatcccgtccgtggactcggcagacaacctgtcagaaaaactggagagggaatgggaccgtgagttggcatcaaagaaaaatcccaagctgattaacgccctccgacgctgctttttctggcggttcatgttttacggtatctttctctacttgggcgaagtgactaaggctgtgcagcctctcttgctcggaagaatcatcgcctcatatgaccctgacaataaggaagaacggtccattgcgatttacctgggtatcggactctgcctgctgttcattgtgcgcactctgctgcttcatccagcgatctttggactccaccacatcggcatgcaaatgagaatcgccatgttcagcctgatctacaagaaaactctgaaactttcgagcagggtgctggataagatctcaatcgggcagttggtttccctccttagcaacaacctcaacaagttcgacgagggactcgctctggcccactttgtctggattgcccctctgcaagttgctctgttgatgggcttgatttgggaattgctccaggcctcagcgttctgtggactgggattccttatcgtgcttgcactgttccaagcgggactgggacgcatgatgatgaagtacagagatcagcgcgctggtaagatctccgagagactggtcatcaccagcgaaatgattgagaacatccaatccgtcaaggcctactgttgggaagaagcaatggagaagatgatcgaaaatctccgccagacggagctcaagctgacccggaaggcagcgtacgttcggtactttaactcctcggccttctttttctccggtttcttcgtcgtgtttctgtctgtgcttccttacgcactgatcaaggggatcatcctccgcaaaatctttaccaccatctccttctgtatcgtgctgagaatggccgtgactcgccaattcccatgggccgtgcaaacctggtatgactcgctcggcgccattaacaagatccaagactttttgcagaagcaggagtacaagacgctggaatacaacctgactaccaccgaggtagtcatggaaaacgtgactgcattttgggaagagggcttcggagaactttttgagaaggccaagcagaacaacaacaaccgcaagacttcaaacggggacgactcgctctttttcagcaatttcagtcttttgggcacccccgtgctgaaggatatcaacttcaaaatagagcggggacaacttctggccgtggcgggatcgactggtgcgggaaagacctcgctgctcatggtgatcatgggagaactggagccatccgaggggaagattaaacattcaggtcgcatctcgttctgctcacagttctcatggatcatgccgggcactatcaaggaaaacatcatcttcggagtgtcatacgacgaataccggtatcgctcggtgataaaggcgtgccaactcgaagaagatatttcaaaattcgcggaaaaggataacatagtgttgggagagggagggatcactttgtcgggtggccaacgcgcccggatctccctcgcgcgcgccgtgtacaaagatgcagacctctaccttttggattctccgttcggatacctggacgtgctgaccgaaaaagaaatcttcgaaagctgcgtgtgcaaactcatggcgaataagacccgcattcttgtgacgtcgaaaatggaacatctcaagaaggcagacaagatcctgatcttgcacgagggctcctcctacttctacggaactttctcagaactgcagaatctgcaacccgactttagctcgaagttgatgggttgtgactcctttgaccagttctcggccgaacgccggaactccatcctcactgagactctgcatcggttctccctggaaggagacgcaccggtgtcatggaccgaaaccaagaagcagtcatttaagcagaccggagagtttggagaaaaacgcaagaactctattctcaatccgatcaactcgatccggaagttttcaatcgtgcaaaagaccccgcttcagatgaatggcatcgaggaggactcggacgaacctctggagcggcgcttgtcgttggtcccggactctgagcagggggaggctattctgccgcggatcagcgtgatttccactggcccgaccctgcaggcaagaagaaggcagtccgtgctcaacctcatgactcactcggtgaaccaaggccagaatatccacagaaaaaccaccgcatcgacccggaaagtgtctctggcacctcaagcaaacctcaccgaactcgacatctacagccggcgcctgtcgcaggagactggattggagatctctgaggaaatcaatgaggaagatctcaaggagtgttttttcgatgatatggaaagcatccctgcagtgaccacctggaacacgtacctccgctacattacggtgcacaagtcgttgatcttcgtcctgatttggtgcctcgtgatctttctggccgaagtggcggcctcgttggtggtgctgtggctgctcggcaacactccactgcaagataagggcaattcgacccactcaagaaataactcatacgctgtgatcatcaccagcacttcatcatactatgtgttctacatctacgtcggcgtggccgacactctgctggcaatgggcttcttccgcggattgccgctggtccatactttgatcactgtgtcgaaaatcctccatcataagatgctgcattcagtgctccaagcacctatgtcgactctgaacaccctgaaggccggaggcatcctcaacagattttcgaaggacatcgcgattctcgatgacctcctgccgctcaccattttcgacttcatccagctgctgctgatcgtcatcggagccatcgcggtcgtcgcagtgctccaaccatacatcttcgtggccactgttccggtcatcgtcgcgtttatcatgctgcgggcatacttcctgcagacctcccagcagctgaagcagctggaatccgaaggccgctccccgattttcactcatctggtgacctcgctgaagggactgtggactctgcgggcgtttggtagacaaccgtactttgaaaccctgttccataaggcactgaatttgcacacggcgaattggttcctgtacttgagcaccctccgctggttccaaatgagaattgaaatgatctttgtgatctttttcattgcggttaccttcatcagcatcttgaccactggagaaggagaaggcagggtcggaatcatcctgactctggccatgaacattatgagcaccctgcagtgggcagtgaactcatccattgacgtcgattcgctgatgaggtccgtgtcccgggtgttcaaattcatcgatatgccaacggaaggaaagccgaccaagtcgaccaagccgtacaaaaacggtcagctctcgaaggtgatgatcattgagaactcccatgtgaaaaaggatgacatctggccttccggtggtcagatgaccgtgaaagatctgaccgcaaagtacactgaaggaggcaatgccatcctcgaaaacattagcttctccatctccccgggacagcgggtgggcttgctgggtcggactggatcaggcaagtccacgctgctttcggccttcctcagactgctgaacactgagggagaaatccagatcgacggagtgagctgggattccatcaccctgcaacagtggagaaaggccttcggagtcatcccgcagaaagtgttcatcttctcgggcactttccggaagaatctggacccctacgagcagtggtctgatcaggagatctggaaagtcgctgacgaagtgggactgcggagcgtcatcgagcagtttccaggtaagctggacttcgtcctggtcgatggaggatgcgtcctctcgcatggccataagcagcttatgtgcctcgctcgctcagtcctgtccaaggcgaagattcttctgctggacgagccatccgctcacctcgaccctgtgacttaccagattatccgccgcaccttgaaacaagccttcgccgactgcactgtcatcctttgcgagcatcgcattgaagcgatgctggagtgccagcagttcctggtgatcgaagagaacaaggtgcgacagtacgactctatccagaagctgctgaacgaacgatcgctgttccgccaggcgatttcaccgtcagacagggtcaagctctttccgcatagaaacagctccaaatgtaagtcgaagcctcaaattgccgccctgaaagaagaaacggaggaggaggtgcaggacaccagactg

SEQ ID NO: 10177 - DNA, 4440 bp, Artificial Sequence
  Description of Artificial Sequence: Synthetic coding sequence
atgcagcgcagtccactggaaaaggccagcgtcgtatccaagttgtttttctcttggaccaggcccatcctgcggaagggataccggcagaggctcgagttgtccgatatctatcagatccctagtgtggacagcgctgataatctgtcagagaagctggagagagaatgggatagggagttggcatccaagaagaacccaaaactgatcaatgcactcaggcggtgctttttttggaggttcatgttttacggtatcttcttatatctgggcgaggtgaccaaagcggttcagccgctcctgcttggacggattattgcatcttacgatcccgataataaagaggagcggagtattgcgatttacttggggattggcttgtgcctgctcttcatcgtgcgaactctactgctacatcctgcgatctttggcttgcaccatatcggtatgcagatgcgaatcgctatgttttctctaatctataagaaaacattgaaactcagttcgagagtgcttgacaaaatctccataggacagttagtgagtttgttgtccaataacctgaacaaattcgatgaggggttggcgcttgcccatttcgtgtggatcgcccctctccaggtcgctctcctcatgggactgatttgggaattgttgcaggcctccgcattctgcggcctcggatttctgattgtgctcgcacttttccaggcgggcctcgggagaatgatgatgaagtaccgggaccagcgcgcgggaaaaatttctgaacgccttgtaattacgtccgagatgatcgagaacattcagtccgtgaaggcctactgttgggaagaggcgatggagaagatgatcgagaatcttcgacagacagagctgaaactcacccggaaggcggcttacgtaaggtattttaactcaagtgccttcttcttttccgggttcttcgtagtgtttctctctgtgctcccttatgccctcattaaggggataatattaaggaaaatcttcaccaccataagtttctgtatcgtgttgcgcatggcagtgacccggcagttcccctgggctgtgcagacctggtatgactccctcggggccatcaacaagatccaggatttcctacagaagcaggagtataagacactggagtacaatttgactactacagaagtggtaatggagaacgtcaccgccttttgggaggaaggtttcggtgagctctttgagaaagcgaagcaaaacaacaataaccggaagacatccaatggagacgactccctgttcttcagcaatttctctctgctcggcacccctgtgttgaaggacatcaacttcaagatcgaacgcgggcagctcctcgcagtggcaggaagtaccggcgctgggaagacatccttgttaatggttattatgggcgagctggaaccatcggaaggcaagattaaacatagcgggcggatttctttttgcagccaattctcttggattatgcccggtaccattaaggagaacataatcttcggcgtttcctatgacgaatacaggtataggtctgtcataaaagcctgtcagctagaagaagatatttctaagttcgcagagaaggataacattgtcttaggcgagggcgggatcaccctaagcggtggccaacgcgctcgtatttctcttgcccgggcagtatataaggatgccgacctgtacctcttggactcacccttcggctacttggacgtcctcacagagaaggagatattcgagtcctgcgtgtgtaaactgatggccaacaagacacgcatcctagtgaccagcaaaatggaacacctgaaaaaagctgataaaatattgatactacatgaagggtcaagctacttctatgggactttttccgagttacagaacctgcagcctgatttttcttctaagctaatgggctgcgattcttttgaccagtttagcgctgagcggaggaactcaattctcaccgaaaccttgcaccggttttctctggaaggcgatgctcctgtatcatggacagagaccaaaaagcagtctttcaagcagactggcgaattcggagaaaaacgaaaaaactcaatccttaacccaattaactccatccggaagttcagcatcgtccagaaaactcccctgcaaatgaatggcattgaagaggattccgatgaaccattagaaaggaggctgtcacttgtaccagatagcgaacagggcgaggctatccttcccagaatcagcgtaatcagcactgggccgacactccaggcacgcaggaggcagtccgtgctgaacttaatgacgcactccgtgaaccagggccaaaacatccatagaaagacaactgcatccactaggaaagtttctctggctccacaggcaaacctaaccgagcttgatatctattcgcgacggctgtcccaagaaacgggattggagatcagcgaagagattaacgaggaggacctgaaggagtgtttcttcgatgacatggagagtattcctgctgtcaccacctggaatacctatctcaggtacattaccgtacataagagccttattttcgttctcatctggtgcctggtgatatttctggctgaagtagcggctagtttggtggtcctctggctactgggcaatacccctttgcaggacaagggtaactctactcacagtaggaataattcatatgcggtcattattaccagcacctcttcctattatgtcttctatatttacgttggagtcgctgacaccttgctggcaatgggtttctttcgggggctcccactggtgcataccctgatcacagtcagcaagatcctgcatcacaagatgcttcactccgtgctccaagccccgatgtcgactctaaacacactgaaggcagggggcattctgaatcgcttctcaaaagacattgccattctggatgacctcttaccgcttactatttttgatttcattcagctgctgctgatagtgattggggccatagccgtggtcgcagttctccaaccttacatctttgtcgccaccgtgcctgtgatagtagcctttatcatgcttcgcgcctatttcctccagaccagccagcagctcaagcagttggaatcagaaggcaggtcacccatttttacacatctggtgactagtttgaagggactttggactctgcgcgcgtttggccgacaaccatactttgagacactgttccacaaagctctaaacctgcataccgccaattggtttttgtatttgtccaccctccgctggttccagatgcgcatcgagatgatcttcgttattttctttattgcggtgacgttcatcagtatcctcacgaccggagagggagaaggaagagtggggattatactgacgctcgcaatgaatataatgtcgacgctgcagtgggctgtcaattctagtatcgacgtggactccctgatgcggtcagtgtcacgagtgtttaaatttatcgatatgccaaccgagggcaagccaacaaagtcaaccaaaccttacaagaatgggcagttgtctaaggtgatgatcatagaaaactcccacgtgaagaaagacgacatctggccttctggcggccagatgacagtgaaggaccttaccgcgaaatacacagaaggagggaatgctattttggaaaatatctcgttttcaatttccccaggacagagagtcggcttactcgggaggacaggctccgggaagtctaccctgctgtccgcctttctgcggttattaaataccgagggggagatacaaatcgatggcgtttcttgggacagcattaccctgcaacagtggcggaaagccttcggggtgataccacagaaggtctttattttctctggcacatttagaaagaacctggacccatatgaacagtggagcgaccaggagatctggaaggtggctgatgaggtgggactccgctcagtcatcgaacaattcccggggaaattagacttcgtgctggtcgacgggggatgcgtgctgagtcacgggcataagcaactcatgtgtctggcacggtccgtcctctcaaaagcgaaaatactgctcctggacgagccgtcagcgcacctggatcccgtgacataccagattatacgccggacactgaaacaggcttttgcagattgcactgtcattttgtgtgagcaccggattgaggcaatgttagaatgccagcagtttcttgtgatcgaggaaaacaaggtaaggcagtacgacagtatccagaaactcctcaatgagaggtccctgtttcgacaagccattagcccgtccgatcgagtcaagcttttcccccatcgcaatagctcgaagtgtaaatccaaaccacaaattgcagctctaaaagaggagacggaagaagaggtgcaggacactaggttg

SEQ ID NO: 10178 - DNA, 4440 bp, Artificial Sequence
  Description of Artificial Sequence: Synthetic coding sequence
atgcagcgatcaccactcgaaaaagctagcgtagtcagtaaattgtttttttcttggacacgcccgattctgcggaagggttatcgccagagactcgaactctcagatatttatcagataccaagcgttgactctgcagacaatctcagtgagaagctggagcgggaatgggatagggaactggccagcaaaaagaacccgaagcttatcaacgcccttcgcagatgctttttctggcgcttcatgttttacggcatcttcctttacctgggggaggtcacaaaagccgttcagcccctacttctggggagaattatcgctagctacgaccccgataataaggaggagcgttccatagctatttatctcggtatcggtctctgcctcctcttcatcgttcgcaccctgctgctgcaccctgccattttcggtttacaccatatcgggatgcagatgcggatcgcaatgttctctctgatttacaaaaagacactaaaattgtcctctcgagtgttagacaagatcagcattgggcaactggtttccttgctgtcaaacaatcttaacaaatttgacgaggggctcgctttggcccattttgtctggatcgcccccctgcaggtcgccctgctgatgggcctgatttgggaattgcttcaggccagtgccttttgcggactcggattcttgattgttctagctctgtttcaggccggtctgggaagaatgatgatgaaatacagagatcagcgtgccggcaaaattagcgagcgcctggtgattacttccgaaatgatagagaatattcaatcagtgaaggcctattgctgggaagaagcaatggaaaagatgatagagaacctgagacaaacagagctgaagttgacccgaaaggctgcctacgtcagatacttcaattcgtctgcttttttctttagcggattttttgtagtttttctgagtgttttgccttacgccttgatcaaggggatcattttgcgcaagatcttcacgacaatatcattctgtattgtcctgagaatggccgtgactagacaattcccttgggctgtccagacctggtatgactcactgggagccatcaacaagatccaggattttctgcagaaacaggagtacaagactctggaatataatctgacaacaactgaagtggttatggaaaacgtgacagctttttgggaagaagggttcggagagctgtttgaaaaggctaagcagaacaacaacaaccgtaaaacctccaacggtgacgacagtcttttcttctccaatttttccctgctgggcaccccagttttaaaagacatcaacttcaaaatagagagaggtcaactcctggccgtggccggatccaccggcgcgggaaaaacaagcttgctcatggttattatgggcgaattagaacccagcgaaggaaaaattaagcactcaggcagaatatctttctgtagtcaatttagctggattatgccaggtacgatcaaggagaatattatcttcggcgtgagctacgacgagtaccgatatagatccgtgatcaaagcatgccagctggaggaggacatttcaaaatttgctgagaaggataacattgttctgggggaaggtggaattaccctttccggagggcaaagagcccggataagcctggcacgagcggtatataaagacgcggacctgtacctgctggatagcccattcgggtatctcgacgtcttgaccgaaaaggaaatatttgaaagttgtgtgtgtaagttgatggccaataagacacgaatcctcgtgacttctaaaatggagcatcttaaaaaggcagacaaaattctgatcctccacgaaggcagttcctatttctacgggacgttctcagaactgcagaatttgcagcctgacttttcctccaagttgatggggtgcgatagcttcgaccagtttagtgccgagcgccggaatagtattctgactgagaccctgcaccggttttcactcgaaggagatgccccagtgagttggaccgaaacaaagaaacagtcattcaagcagaccggagagttcggcgagaaacggaagaactccatcttgaatccgattaacagtatcaggaagttttcaatcgtgcagaaaactcctctccaaatgaatggaattgaagaggatagtgacgaacctcttgagcggcgcctcagtcttgtgcccgacagcgaacagggcgaggcaattctgcccagaataagcgtgatctccactggtcctactcttcaggctcgccgcagacagagtgttctgaatttaatgacacactccgtgaatcagggccagaatatccaccggaagaccactgcaagcacacgtaaggtgagcctcgcccctcaagcaaacctgacagagcttgacatttactccaggagactgagtcaagaaactggtctcgagatatctgaagaaattaacgaagaggacctcaaggaatgcttcttcgatgacatggaaagtatcccagctgttactacctggaatacctacctgcgctatattaccgtgcacaagtcgcttatctttgttcttatttggtgcctagtgatctttttggccgaggtagcggccagcctagtagtcctgtggttgctgggcaatacccctctgcaggacaagggcaacagcactcattcacgcaataattcttatgccgtgataatcaccagcaccagctcctattatgtgttttatatctacgtgggtgtggcagatacactgctcgcaatgggttttttccggggcctgccactagttcacaccctcattaccgtttctaaaatacttcatcacaaaatgctgcactcagtcttgcaggccccaatgagtactttgaatacgttgaaagccggaggtatcttaaaccgattcagtaaagatattgccattctggatgaccttctgcccctcaccatcttcgattttatacaacttttactaattgtgattggagcaattgctgtcgtggccgtgttgcaaccctacatctttgttgctactgtgccagttatcgtcgcttttataatgctgagagcctattttcttcaaacatcccagcagctgaagcaactggaatcggaggggcgcagccccatattcacacatctggtcacctctttgaaagggctgtggaccctccgagcctttggcaggcaaccctacttcgagacgttgttccacaaggctctgaacttacataccgccaactggttcctctacctgtcaacattgcggtggtttcagatgagaatcgaaatgatcttcgtcatcttctttatagctgttaccttcattagtattctgacgactggggagggtgaaggcagagtgggtataatactgacgctcgccatgaacattatgtcaacgctgcagtgggccgtgaacagcagcatagatgttgacagcctcatgcgatcggtctctcgtgtcttcaagttcatcgatatgccaaccgaggggaaacctacaaaaagcacgaagccatacaagaatggccaactgagcaaggtgatgattatcgagaactctcacgtgaagaaagatgatatctggccaagtgggggccagatgactgtgaaggatttgactgcaaaatataccgaaggcgggaatgcgattcttgagaatatctctttttcgatttcacccgggcaaagggttggcctcctgggacgcactgggtccggaaagagcaccttactatcagcttttctgcggttgctgaatacagagggggaaattcagatcgatggcgtttcatgggattcaattacgttacaacagtggcggaaagcctttggcgttattccccaaaaggtgttcattttttcaggaacctttagaaagaacttggacccatatgagcagtggtcggatcaggagatctggaaggtcgcagacgaagtgggcctcaggtccgtgatcgagcaattccccggaaagctggactttgtgttggtggatggcggatgtgttctttcacatggacataagcagctgatgtgtctggcaagaagtgtattatccaaggctaaaattttgcttctcgatgaaccgtctgcgcacttggaccccgtcacataccaaatcatacgccggacattgaagcaggctttcgctgattgtactgttattctgtgcgagcacaggatagaggccatgctcgaatgtcagcaatttcttgtcatagaagagaacaaggttagacagtacgacagtattcagaagcttttgaatgagagatcgctgttcagacaggctatttcaccatcagaccgggttaagctatttccccaccgcaattcttctaagtgcaagtctaagccacaaattgctgctctaaaggaggagacagaggaagaggtgcaagatacccgactt

SEQ ID NO: 10179 - DNA, 4440 bp, Artificial Sequence
  Description of Artificial Sequence: Synthetic coding sequence
atgcagagatcccctttagaaaaggcaagcgtggtgagtaagctatttttcagttggactagacctatcctgagaaaggggtacaggcagcgtctcgagctgagtgatatctaccagatcccaagcgttgatagcgctgacaacctttccgaaaagctcgagcgcgagtgggatagggaactggcctctaagaaaaaccccaagcttatcaatgcgctccgtcgttgcttcttctggcggtttatgttttacgggatctttttgtatttgggtgaagttactaaggctgtgcaaccactattgctgggtcggatcattgcgtcctatgatccagataataaagaggagcgcagtattgcgatttacctcggcataggtctctgcttgctatttattgtgcgcaccctgctgctgcacccagctatctttggcctgcaccacataggaatgcagatgcggattgccatgttcagcctaatctacaaaaaaacactgaagctgagttcccgggtgttggacaagattagcatcgggcaactggtgagtctcctcagcaacaacctgaacaagtttgatgaagggctggctctggctcacttcgtctggatcgccccactgcaggttgcgttgctgatgggtctcatatgggaattgctgcaggccagcgccttttgcgggctgggctttctgatcgttctggctctgtttcaggccgggctcggccgtatgatgatgaagtaccgcgatcaacgcgcagggaaaatttcagagcggctagtcatcaccagtgaaatgatagaaaatatccaaagcgtgaaagcgtactgctgggaggaagctatggagaaaatgattgaaaaccttcgccagacagagctgaagctgactcgcaaggctgcctacgtgcgctacttcaactcatccgcttttttcttttccggtttctttgtggttttccttagtgtgctgccctacgctctgataaagggaattatcctacgcaagatctttacaaccattagcttttgtatagtgctgagaatggcagtgacccgacagtttccctgggctgtgcagacctggtatgatagtttgggagcaatcaacaagatacaggacttcctgcaaaagcaggagtataagactctggagtataaccttacaacaaccgaggtggtgatggaaaatgtcacagccttttgggaggaagggtttggggaactgtttgaaaaagccaaacagaacaacaacaacaggaagacatctaatggcgacgattcgctcttcttttccaatttctctctgcttgggactccagttctcaaagatatcaatttcaaaatagagcgcgggcagctgttggcagtcgctgggtctacaggggccggcaaaactagcctgctgatggtgattatgggggagttggagccttccgagggcaagatcaaacacagcgggcgcatcagtttttgtagccagttctcttggatcatgcccgggacgataaaagaaaacatcatatttggcgtgtcttatgacgaatatcgatatcggagtgttatcaaggcatgccagctggaagaggacatatcgaaatttgccgagaaagataatatcgttttaggagaggggggaattacattgtcgggtggccaacgggcacgaatatctttggcacgggctgtctataaagacgccgacttgtacctgctggactcccctttcgggtatttggatgttctgaccgagaaagagatctttgaatcctgcgtctgcaagcttatggccaacaagaccaggatactggtgacatcgaaaatggaacaccttaagaaggcggacaagatcctgatcctgcacgagggaagcagctatttctatgggacattcagtgaactccagaatctgcaacccgatttcagctccaagttaatggggtgtgacagtttcgaccagtttagtgctgagcgccggaatagcatcctaactgaaaccctgcacagatttagtcttgaaggtgacgcacccgtgtcctggaccgagaccaaaaagcagagcttcaaacagactggcgaattcggcgagaaaaggaaaaacagcatcctaaacccaattaatagtatccggaaattttctattgtgcagaagacacccctccagatgaatgggatcgaagaagattccgacgagccgctagaacgtagattgagccttgtccccgatagtgaacagggggaagccatactccctcgcattagcgttatatccacaggcccgacactccaggccaggcggcgccagtccgttcttaatcttatgacgcattccgtgaatcagggccagaacatccatcgcaagactacagccagtaccagaaaagtcagcttagcaccacaggcaaacttgacagaattggacatctacagccgtaggctaagccaggagacgggtctagaaatcagtgaggagatcaacgaagaggacctcaaagagtgcttctttgatgacatggagtcaatccctgctgtgacaacctggaatacctacttacgttatattaccgtgcacaagagcctgatttttgtcctaatatggtgtctcgtcatctttctagcagaagttgctgcttcactggtggtgctctggctgttaggaaacactcctcttcaggataagggcaactctacgcatagccgaaacaattcatacgccgtaattatcacttcaacgtcctcatactacgttttctatatctatgttggtgtagccgatacgcttctggccatgggcttttttcgggggcttcctctcgtacacactttaattactgtgtccaagattttacaccacaaaatgttgcactccgtgttacaggcaccaatgtctactcttaacacgctcaaggctggaggaattctcaatcgcttcagcaaggacatagctatccttgatgacctattgccactgacaatctttgatttcatccagctgctcttgattgtgattggcgcaatcgccgtagtggctgtactccagccctatatattcgttgctaccgtgcccgtgattgtagccttcatcatgctgcgagcctatttcctccagacaagtcagcagttaaagcaattagagtctgagggccggtctccgatctttacacacttagtaactagccttaagggactatggacactaagggctttcggtcgtcaaccttactttgagactttattccataaggcacttaacctgcataccgccaactggttcctctacctttccactttgcgatggtttcagatgcgcatcgagatgatttttgttatttttttcatcgccgtgactttcatctctattcttacaactggcgaaggtgaaggacgggtcggcattattttgactctggccatgaatatcatgtctaccctacagtgggcagtaaactcttcaattgatgtggattcgctgatgaggagcgtttcaagggtgttcaaatttattgacatgccaacagaaggcaagcctactaagagcaccaaaccgtataagaacggacagctgagtaaagtgatgatcatcgaaaatagccacgttaagaaagatgatatctggcctagcggcggccagatgactgtgaaggacctgaccgcaaagtatacagaaggcggaaacgccatcctggagaacattagttttagtataagcccgggacaaagggtcggactgctgggacgcacaggtagtggtaagagcacactgctgagcgcttttctccgcctgctcaacacggaaggggagatacaaattgacggtgtctcctgggattcgatcaccctgcaacagtggcgtaaagcattcggcgtcataccacaaaaggtgttcattttttcaggaacgttcaggaaaaacctggatccttatgagcagtggtctgaccaggaaatctggaaagtggcagacgaagtaggcttacgctcagtaattgagcaatttcccgggaagttggatttcgtcctggtggatggcggctgcgtcctctctcacggccacaagcaactaatgtgcttggcacgcagcgtgctttctaaagcaaagattctcttattggacgaaccctctgcgcatttagaccctgtgacctaccaaatcataaggcggacactgaagcaggcgtttgccgattgtaccgtcattctgtgcgagcaccgcattgaggccatgctggagtgccagcagttcctggtaatcgaggagaacaaagtgaggcaatacgactctatccagaagctgcttaacgagcgctccctgtttcggcaagccatttcaccttcagatagagtcaagcttttcccccaccgcaattcctccaaatgtaaatctaaaccccaaattgcagccttgaaggaggaaactgaggaggaagttcaggacacccgactg

SEQ ID NO: 10180 - DNA, 4440 bp, Artificial Sequence
  Description of Artificial Sequence: Synthetic coding sequence
atgcagagatcccccttagaaaaagcctctgtggttagcaaattgttctttagttggacaaggccaatcctgaggaagggataccggcagaggttagagttgagtgatatctaccagattccaagcgtagactctgccgacaacctctccgaaaagctggagcgggaatgggacagggagctagcctccaagaagaacccaaagctgattaatgctttgcgccggtgcttcttctggagatttatgttctatggcatttttctttacctcggcgaggttaccaaggccgtacagccgctgcttctaggcagaattattgcctcctacgatcctgacaataaagaggagaggagcatagccatatatcttggcattgggttgtgcctgctgtttattgtgcgtacccttctccttcaccccgctatctttgggctgcatcacataggcatgcagatgagaattgcaatgttctctctgatctataaaaaaaccctgaaactgagttccagggtcctcgataaaatttccatcgggcaactggtgagcttgctatcgaataacctcaacaagtttgatgagggcctcgcgttagctcatttcgtgtggatcgcacccctgcaagtggccttactcatgggactgatctgggaattgctgcaggcatcagcattctgcggtctgggatttttgattgtacttgctctgttccaagccggccttggcagaatgatgatgaagtaccgggatcagagggcggggaagatttccgagaggctggttatcacatcggagatgattgaaaacatacagtcggttaaagcctattgttgggaagaagcgatggagaaaatgatcgaaaacctcaggcagacagagttaaaacttacaagaaaggcggcttacgtacgttatttcaatagctcggcttttttcttttccgggttctttgtggttttcttgtctgtactgccttacgcactgattaaaggaattattctgcggaaaattttcacgaccatatctttttgcatcgtgctccggatggctgtgaccaggcaatttccctgggccgtgcagacctggtatgattcgctcggagcaatcaacaaaatccaggacttcctgcagaagcaagagtataagactctagaatataacctgactactacggaggtggtgatggagaacgtaacagccttctgggaggagggcttcggagagctgttcgagaaggccaaacagaataataataatcgaaagacctcaaacggagatgattcacttttttttagcaatttttcccttctgggcacccccgtgctcaaggacatcaatttcaagatcgagaggggccagctccttgccgtggcaggttccacaggggcgggcaaaacaagcctactcatggtgatcatgggtgaactggagccatctgaaggtaaaatcaagcattctggtcgcatcagtttctgcagccagttctcctggatcatgcccggaacaatcaaagaaaacatcatcttcggggtgagctacgacgaatatagatatagaagcgtcatcaaggcatgccagctggaggaggacatttccaaattcgccgaaaaggacaacatagttctgggcgaggggggaattacgctctcaggcgggcaacgggcaaggatatccctggcacgtgcggtctataaagacgctgatctttacctgctggacagccctttcggatatctcgacgtgttgaccgagaaggagatcttcgagagctgcgtttgtaagctgatggctaataaaacacgaattctagtgacctctaaaatggaacacctcaaaaaggctgacaagatcctgatcctgcacgaggggagcagctacttctacgggacattcagtgaattgcaaaacttgcaacctgatttctcgtcaaagctgatgggctgcgacagctttgatcagtttagtgccgagagacgcaatagtattctaacggagactctacaccggttttctctggagggtgatgcacctgtttcttggacggagaccaaaaaacaaagctttaagcagacgggagagttcggcgagaaacggaagaacagcatattgaacccgatcaatagtatcaggaagtttagcatcgtgcagaaaacccccctgcagatgaatggcattgaagaagactccgacgagccgctggaaagacgtcttagtctggtgccggatagcgagcagggagaggccatactgccaaggattagtgtcatttccactggtcctacactccaagcccggaggcggcaatcagtgctgaatttaatgacacactccgtcaaccagggccaaaacattcataggaagaccacagcgtcaactcgcaaggtgtcacttgctcctcaagccaatttaactgagctggacatctattcccggcgacttagtcaggaaaccgggttggagatttccgaggagatcaatgaagaggacttgaaggagtgcttctttgatgacatggagtcaatcccggccgttaccacatggaacacttatctgaggtatatcaccgtgcataaatccctgatttttgtgcttatttggtgcctagtgatctttctggccgaggtggcagcctctctcgtcgtcttgtggcttctcggaaacacacccctccaggacaaaggcaattctacccacagtaggaataactcctacgctgttattattacctcaaccagttcttattatgttttctatatctatgtgggagtagccgatacattactggcaatgggatttttccgggggctccccctagtccacacgctgataaccgtctccaagatacttcaccataaaatgctacactccgtgctgcaagccccgatgtccacactgaatactctgaaagctggcggtatcctgaaccggttctctaaggacatagctatcttggacgatctactacctctgactatcttcgactttattcagcttctgctcatcgtcataggcgctatcgctgtggtcgcagtgcttcagccctatatctttgtggccactgttcccgtgatcgtcgcatttatcatgcttagagcctattttctgcagacttcccagcagcttaaacagttggaaagtgaaggacgcagccccattttcacacacctagttacaagtctgaagggcttgtggacacttcgagcgttcgggcggcagccgtacttcgagaccctgttccataaggcgttaaatttgcacacggcaaactggttcctttacctgtcaactctgagatggttccagatgaggattgaaatgatcttcgttatattcttcatagccgtgacctttatctcgatactgacaacaggggagggcgaagggcgggtgggaattattctgactctagcaatgaacattatgagcacgctgcaatgggccgtgaacagttccattgatgtagactccctgatgcgatccgtgtcgcgcgtgttcaaatttatagatatgcctactgagggtaaaccaaccaagagcactaagccttacaagaatggccagttatccaaagtaatgatcatcgagaatagtcacgtgaagaaggacgatatctggcccagcgggggtcagatgaccgttaaagacctgacagccaagtacaccgagggtgggaatgcaatcttggagaacatctcctttagtatttcacctggacaaagagtgggtctgttgggacgcactggatcagggaaatccacactgttatccgcatttctacgactcctgaatactgagggagaaatccagatcgatggcgtttcctgggactccattacactccaacagtggcgaaaggcgtttggcgtcattccccagaaggtatttattttctcaggaacctttcgaaagaatctcgacccctatgagcagtggagcgaccaggaaatctggaaagtggctgatgaagtcgggctgagatccgtaattgaacagtttccaggtaagttggatttcgtgttggtggacggcggatgcgtactttctcatggacataagcagctgatgtgtctggcgcgttccgttctgtccaaggccaaaatactgttactggacgaaccatccgcacacctggaccctgtgacgtatcagattattcggcgcaccctgaagcaggcattcgccgactgtaccgtcattttatgcgaacaccggatagaggcaatgctggaatgtcagcaatttcttgtcatagaggagaataaggtccggcagtacgattccatccaaaagttgctgaatgagcggagtctctttcggcaggccatctccccatctgatagagttaaactctttccacatagaaactcttctaagtgcaagagcaagccacaaatcgccgctcttaaggaggagacagaagaagaagtgcaggatactcgtcta

SEQ ID NO: 10181 - DNA, 4440 bp, Artificial Sequence
  Description of Artificial Sequence: Synthetic coding sequence
atgcagaggtctccacttgagaaagcgtctgtcgtttctaagctttttttctcgtggacgagacccatcctcagaaagggatacaggcagaggctcgaactgtctgatatctaccagatcccgtccgtggattctgccgataacttatcagaaaagcttgagagggagtgggatcgagagctcgcatcaaagaagaatccaaaactgattaatgctctgcgccggtgttttttttggcgctttatgttctatggtattttcctttatcttggcgaggtcaccaaggccgtgcagcccctgctgctgggtaggatcattgcatcctatgatcctgataataaggaggagagatccatcgcgatatacttgggcattggcctttgccttctttttatcgttcgaaccctactgctccatcctgccatttttggtctccaccatatcggaatgcagatgcggattgctatgttcagtttaatatataagaagactctgaagttgtcatcccgcgtcttggacaagatatccattggacagctggtgtctctgttgtctaacaatctgaacaaatttgacgagggcctggcactggcccacttcgtatggattgcgcctctgcaagtagccttgctgatgggtttgatttgggagcttctgcaggcttccgcattttgcggcctcggctttctaatcgtgctggcgctctttcaggctggtttgggacgcatgatgatgaagtatagagatcaacgggccggaaagataagcgaaagattagtgattacatcagagatgatcgagaacattcagagtgtaaaggcctactgttgggaggaagccatggaaaagatgattgaaaatctccgacaaaccgaattgaagctgaccaggaaggcagcgtatgtgagatacttcaacagctccgcttttttcttctctggtttctttgtagtctttctctcagtgctgccatacgcgctgatcaaaggaatcatccttaggaaaattttcaccacaatctccttctgcattgttctgcgtatggcagtgactagacagtttccatgggccgttcagacgtggtatgactctttgggagccattaataaaattcaggacttcctgcaaaaacaggaatataagaccttggaatacaatctaacaacgacagaggtcgtgatggagaacgtgaccgcattctgggaggagggttttggggagctgtttgaaaaggccaagcagaacaataataatcgtaaaacatccaatggtgacgacagtttgttcttttccaatttctcgctgctgggcacccccgtgctgaaagatataaatttcaaaatcgagcgcggccagcttctagccgtggctggctctaccggagctgggaagacatccttgctgatggtcattatgggtgagctcgagccgtctgaggggaagatcaagcattccggcaggattagtttttgttcccagttctcatggattatgcccggcacaattaaggagaacatcatatttggagtgagctacgacgagtataggtatagatctgttatcaaagcatgccaactggaggaggatatatccaagttcgctgagaaggacaatatcgtgctcggtgagggaggcatcacgctttccggcgggcagcgggctcggatcagcttggcacgggctgtttataaggacgcggatctctaccttctcgactcaccctttggttacctcgatgtgctaaccgagaaggagatttttgagtcgtgcgtctgcaaactgatggctaacaagactcgtattctggtgacttcaaaaatggagcacctgaaaaaggccgacaagattcttatactgcacgagggaagcagttacttttacgggactttcagcgaattacaaaatttgcaaccggacttttcctcaaagctcatgggctgcgattcttttgaccagttcagtgcggagagacgcaattctattctaactgagaccctacaccgtttcagcttagagggtgacgcgcccgtgagttggactgaaacaaagaagcagtccttcaaacagactggtgaatttggagagaagcgcaagaacagcatccttaaccccatcaactcaattcgcaagttttcaatcgtgcagaagacgccgttgcagatgaatggtatagaggaggacagcgacgaacctctagaacggcggcttagtctggtgcctgattcggagcagggtgaggccattctaccccgtatttcagtcatctctacagggccaacccttcaggcccgtcggcgccagtccgtactgaatctaatgacccatagcgtgaaccagggtcagaatattcacagaaagactactgcctccaccagaaaggtaagtctggctccccaggcgaacctcactgaactggatatttatagtcgccgactgagtcaagagactggactggagattagtgaagagattaacgaggaggatctcaaagagtgtttcttcgacgatatggagagtatccccgctgtgacaacatggaatacttacctgcggtatataaccgtacataagtctttgatcttcgtcctgatctggtgccttgtcatcttcctggctgaggtggctgcctcattagtagtactttggcttctcggcaatactccactgcaggataaggggaattccacccactctcgcaacaatagttatgccgtgataattaccagtacttcatcctattatgtgttctacatctacgtgggggtggctgacaccctgttggcaatgggattttttcgcggcctccccctggtgcataccctgattaccgtgtccaaaattcttcaccacaagatgctgcatagtgtgcttcaggcgccaatgtcaactctgaacacactaaaggcaggcggcattttgaaccgcttcagcaaagacatcgcaattttggatgatttgctgccgctgactatcttcgacttcattcaactcctgctcattgtgattggagcaatcgctgtggtggctgtcttacaaccctatatctttgtagccacggtccctgtgattgtagccttcatcatgctgcgggcttatttcctccaaaccagccaacaactgaagcagttagagtccgaaggccgtagtcccatttttacccatctcgtgaccagcctcaaggggctgtggaccctgagagcctttggaaggcagccatactttgagacattgttccataaggccttgaacctgcacaccgctaactggttcctgtacctgagtaccctgaggtggttccagatgagaatagagatgattttcgttattttcttcattgctgtgaccttcatttcaatcctaaccacgggggagggggaagggcgcgtggggatcattctcaccctggccatgaatatcatgtcgaccttgcagtgggctgtgaacagctcaattgacgtggacagcctgatgaggagtgtaagcagggtgtttaagtttatagacatgcctactgaaggcaaacctactaagtctactaagccttacaagaatggccagctgtccaaggtgatgattattgagaacagccatgttaaaaaagatgacatctggcccagcggcggccagatgaccgtcaaggatctgacggcaaagtatacagaagggggtaatgccattctggagaatatcagctttagcatcagccccgggcagagggtggggctcttgggcagaaccggtagtgggaagtctaccctcctgtcagccttcctgaggctgcttaacaccgaaggagagatacagattgacggagtcagctgggattccattacacttcagcagtggaggaaggcttttggggtaatcccccaaaaagtgtttatttttagcggtacattcaggaagaacctggacccgtacgaacagtggtctgatcaggagatctggaaggtggccgatgaagttggtctgcgctccgtcatagaacaattccctggcaagctcgattttgtgttggtggacggggggtgtgtgctcagccacggacacaaacagttaatgtgtctggcccgcagtgtgctgtcaaaagccaaaatcctactgctagatgagccctcagcccacctagatcccgtgacatatcagatcatcagacggacactcaaacaggcctttgccgactgtaccgtgatcttatgtgaacaccgcattgaggccatgctcgaatgccaacagtttctggttatcgaggagaacaaggttcggcagtatgacagcatacagaaattacttaatgaaagatctctgttcagacaggccattagtcctagcgaccgagtcaaattgttccctcaccgcaatagttcaaaatgtaagtcaaaacctcagatcgctgcactgaaggaggagaccgaggaagaagtccaagatacacgcctg

SEQ ID NO: 10182 - DNA, 4440 bp, Artificial Sequence
  Description of Artificial Sequence: Synthetic coding sequence
atgcagaggtcgcctcttgagaaggcctcggttgtctctaagttgttcttttcatggacgaggccaatcctccggaaggggtaccgccaaaggctggaactttcagacatttaccaaatcccttcagtggattcggcggacaacttgtcggagaagctggaaagagaatgggaccgcgaattggcttcgaagaaaaaccccaagctgatcaacgccctgcgtcgctgctttttctggcgcttcatgttctacgggatcttcctctacttgggtgaggtgaccaaggccgtccagccattgctgcttggccggattatcgcctcttacgacccggacaataaggaggagagatcgattgcgatctacctgggaatcggcctgtgtctgctcttcatcgtgcgcactctgctcctgcaccctgctatcttcgggctgcaccatattggtatgcaaatgcggatcgcgatgtttagcctgatctacaaaaagactctgaaactgtcctcaagagtgcttgacaaaatcagcatcggacaactcgtgtctctgctgtcgaacaatcttaacaagttcgatgaaggactcgcgttggctcatttcgtgtggatcgcgccgctgcaagtggctctcctgatgggactcatctgggagctcctgcaagcgtccgctttctgcggactcggtttcctgattgtcttggcgttgttccaggcgggcttggggcgaatgatgatgaagtaccgggaccagcgcgcgggcaaaatcagcgaaagactggtcatcactagtgagatgattgaaaacatccagtcggtcaaggcctactgttgggaggaggcgatggaaaagatgatcgagaatttgagacagaccgagctcaagctgactagaaaagccgcgtacgtgcgctacttcaattcctcagcgtttttcttttccggcttcttcgtcgtgtttctgtccgtgctgccttacgccttgataaagggaattatcttgcggaagatcttcaccaccatctccttctgcatcgtgctccgcatggcagtgactcgccaatttccatgggcagtgcagacttggtatgatagcttgggggctataaacaagattcaggacttcctccagaaacaggaatacaaaaccttggagtacaacctcactacgaccgaggtggtcatggagaatgtgactgctttctgggaggaaggattcggcgagctgttcgagaaggccaagcaaaacaacaataaccggaaaacctccaacggcgacgattcgctcttcttttccaatttctcactgcttggaacccctgtgctcaaagacattaacttcaaaatcgaacggggacagctgttggccgtggcagggtcaaccggggcgggaaagacctccctgcttatggtgatcatgggggaattggaaccaagcgaaggtaagatcaagcattccggccgcatctcgttctgctcgcagttcagctggatcatgccgggtaccatcaaggagaatatcattttcggggtgtcatacgacgaatatagataccggtccgtgatcaaagcctgccagcttgaggaagatatctctaagttcgccgaaaaagacaacatcgtgctgggcgaaggagggatcaccctctccggtgggcagcgggcgagaatctcactggctagagccgtgtacaaagacgcagatctgtacctcctggactcgccattcggttacctcgatgtgctcactgaaaaggaaatcttcgagagctgtgtctgcaaacttatggctaacaaaactcggatcctggtgacttcgaagatggaacatctgaagaaagcagacaagatcctgattctgcacgaagggtcctcctacttctacggaacgttttcggaactgcagaacctgcagcccgacttttcgtcaaagctcatgggctgcgacagctttgaccagttctccgctgagcgcagaaacagcatcctgactgaaaccctccatagattcagcctcgagggggatgcaccggtttcatggactgaaaccaaaaagcagagcttcaagcaaactggcgaattcggcgaaaagcggaagaattccatccttaacccaattaactccatcaggaagttctccatcgtgcaaaagacgcccctgcagatgaatgggatcgaagaggacagcgacgagccactggagcggcgcctgtccctggtgccggactccgagcagggagaagccattctgccgagaatctcagtcatttccactggccccactctccaggcccgccgccggcaatccgtgctgaacctgatgacccatagcgtgaaccagggacaaaacatccataggaaaacgactgcgtccacccggaaggtgagcctggcgccacaggccaatctcaccgaactcgatatctactcgagacgactttctcaggaaaccggcctggaaatctccgaagagatcaacgaagaggatctgaaagagtgctttttcgacgatatggaatccatcccagccgtgacgacctggaatacgtatttgaggtacattacggttcataagtccttgatcttcgtgctgatctggtgcttggtaatcttcctcgcggaagtggcagcctcattggtggtcctgtggctcctgggaaatactccgctgcaggataagggaaacagcactcactcacggaacaacagctacgcggttatcatcacttccacttcctcctactacgtcttttacatttacgtgggcgtggcggacaccttgctcgcgatgggatttttccggggtctgccattggtgcacaccctcataaccgtgtcaaaaatcctccatcataagatgctgcattcagtccttcaagcgccgatgtcgaccttgaacactctgaaggcgggcggaatcttgaacagattctcgaaggacatcgccatcctcgatgacctcctgcccctcactatcttcgactttatccaactgctcctgattgtgattggagcaattgccgtggtcgcggtgctgcaaccatacatcttcgtcgccaccgtcccagtcattgtcgcttttatcatgttgagagcatacttcctgcaaaccagccagcagctcaagcaactcgagtcagagggtcgctccccgattttcacccacctggtgacgagcctgaagggactgtggaccctcagagcctttgggcgtcagccatactttgaaactctgtttcataaggcccttaatctgcataccgcaaactggttcctttacctgagcactctgcggtggttccaaatgcggattgagatgatcttcgtgatctttttcatcgctgtcactttcattagcatcctgacgaccggtgaaggagaggggcgcgtgggaatcattctgaccctggctatgaatatcatgtcgactctgcagtgggcggtgaactcgtcgattgacgtggactcgctgatgagatcggtgtccagggtgttcaaattcattgatatgccgacggagggaaagccgactaagtcgaccaagccgtacaagaacggccaactgtcaaaggtgatgatcattgagaactcgcacgtcaaaaaggacgatatttggccgagcggaggtcagatgaccgtgaaggacctcacggctaaatacaccgaaggaggaaacgcgatcttggaaaacatctcgttctcgatctccccgggccagcgagtgggactgctcggtcggactggatccggaaagtcaacgctgctgtccgcgttcctgagactgctcaacactgaaggcgaaatacagatcgacggagtctcgtgggattcgatcaccctccaacaatggagaaaggcttttggagtcattccgcagaaagtgttcatcttctccggtactttcagaaaaaacctggacccttacgaacaatggtcggatcaagaaatctggaaggtcgccgatgaagtgggcctgcgctcagtgattgaacagttccctggcaagctggatttcgtgctcgtcgacggaggatgcgtgctcagccacggccataaacaactgatgtgtcttgcccgctcggtgctttctaaggccaagatccttctgcttgacgagccgtcagcgcacctggatccggtgacctaccaaatcatcaggcgtactctcaagcaagcgttcgccgactgcactgtcatcttgtgcgaacaccgcatcgaggcgatgcttgagtgccagcaattcctggttatcgaagagaataaggtccgtcagtacgactcgattcagaaacttctgaacgaaaggtccctctttcggcaggctatttcaccgtcagatcgggtcaaactgtttccgcaccgcaacagcagcaagtgtaaatcgaaaccgcaaatcgctgcactcaaagaggagactgaagaggaagtgcaggatactcgcctc

SEQ ID NO: 10183 - DNA, 4440 bp, Artificial Sequence
  Description of Artificial Sequence: Synthetic coding sequence
atgcagaggtctcccctggaaaaggcttccgttgtcagcaaattgtttttcagctggaccaggcctatactgcgcaagggataccggcaacgcttggaactctcggacatttatcagataccatcggtggactccgccgataacctgtcggagaagctggagcgagagtgggacagggaactggcgagcaagaagaacccaaagcttattaatgcgcttaggcgttgcttcttttggcgcttcatgttttacggcatctttctgtacctcggcgaggtcacgaaagccgtccaaccactgttgttgggccgcatcatagcgagttatgatccggacaataaagaagagcgctcaatcgcgatttacctcggcatcggactttgcttactgttcatagtcaggaccctcctattgcacccggcaattttcggcctccaccatatagggatgcaaatgcgtatcgcgatgttttccctgatctataagaagaccttgaagttgtcctcccgcgttctcgacaagatctcaatcggccagctagtgagtttgctcagtaacaatctgaataaatttgatgagggtcttgccctggctcacttcgtttggatcgcgcctctccaggtggctttactgatgggactcatctgggagctattacaggcatcggccttttgtggtctgggtttcctcatcgtgctggccttatttcaggctggcctgggcagaatgatgatgaaataccgtgatcagcgagcaggtaagatctcggagcgcctggttattacgagcgagatgattgagaacatccagtccgtgaaagcctattgttgggaggaggccatggaaaagatgattgagaatctgcggcagacagagctgaaactcacaaggaaggctgcttacgtccgctattttaacagcagtgccttctttttctccggtttcttcgtggtgttcctgtccgtccttccctatgccctgatcaagggtatcatactgcgcaagatttttacgacgatttcgttctgtattgttttgcggatggccgttacgcgacagttcccatgggcagtccagacgtggtacgatagtctgggcgccatcaataagattcaggacttcctgcagaagcaggagtacaagaccctggagtataacttgacaaccacggaagtggttatggagaacgtgaccgcgttttgggaagagggatttggtgagctttttgagaaggccaaacaaaacaacaataatcggaagacaagcaacggcgacgattccttattcttctctaactttagccttttaggcacccccgtactaaaggacattaatttcaagattgagcgcggacaactgctggcggtagctggcagtaccggtgctggcaaaactagcttgctgatggtgattatgggcgaactggagccctccgagggaaagattaagcatagcggtcgcatctccttttgctctcagttcagctggataatgcccggcaccatcaaggaaaatataatttttggcgttagttacgatgaataccgctaccgctccgtgataaaagcatgccagctagaggaggacatcagtaagttcgctgagaaggataacatcgtcttaggcgagggcggaatcactctcagtggaggccagagggcccgcatctccctggcgagagcggtctacaaggacgccgacttgtacctgctagatagcccatttggttacctggacgtcctcacagaaaaggagattttcgagtcgtgcgtgtgcaaacttatggccaataaaactcgcatcctggtcacctcgaagatggagcaccttaagaaagccgacaaaatcctgatcctgcacgaaggatcctcctacttctatggcacattttccgagctgcagaaccttcagccggatttttcgtccaaactaatgggttgcgacagtttcgaccagttcagcgcagagcgccggaactcgatcttgacagagaccttgcacaggtttagtctggaaggagacgcgccggtgagctggaccgagacaaagaagcaatccttcaagcaaaccggcgagtttggagaaaagagaaaaaatagcattctcaacccgatcaattccattcgcaaattcagcatcgtccagaaaacacccctacagatgaacggaatagaagaggattctgacgagcccctggagcggcggctttcccttgtgccggatagcgaacagggagaagcaatactgccgcgcatatcagtgatcagcacgggtccaacactgcaggctcgccgacgtcagtccgtgctgaacctcatgacccattcggtgaatcagggccagaacatacatcggaaaacgaccgcttccacccgcaaggttagcctcgcgccacaggctaacctaacggaattggatatctattccaggcgcttgtcccaggaaaccggacttgaaatctccgaagaaatcaacgaagaggatcttaaagagtgcttttttgacgacatggaaagcattccagccgtaacaacttggaatacgtatcttcgatacataaccgtacacaagtcgctgattttcgtcctgatttggtgcctagtgattttcctggccgaggtggccgcatcattagtcgttctgtggcttctgggaaacactccacttcaggacaagggcaattccacgcacagtcgcaataactcctatgcggttattataacctccacgtcttcctactacgtgttctatatttatgtgggtgtggcggacaccctcctggcgatgggttttttcaggggccttccactcgttcatacgttaataaccgtatctaagatcctacatcataagatgctgcactcagttctgcaagcccccatgagcacgctcaataccctgaaggcaggcggaattctaaatcgttttagcaaggacatcgcgatcctggatgatctgttgccactgacgattttcgatttcatccaattgctgctaatcgtgatcggcgccatcgctgttgtggccgttttgcagccctatatctttgtggccacggtgccagtcatcgtggcctttattatgctgagagcctactttttgcagacctcgcaacaattgaagcagctcgagagtgaaggacgttcccccatttttacgcatctggtcacatccctgaagggactgtggacactgagggcgttcggacgacagccgtacttcgagaccttgttccacaaggccctaaacctgcacaccgccaactggtttctgtacttgtccactttgcggtggttccagatgcgaattgagatgatcttcgtcatcttcttcatcgctgtgaccttcatcagtatactgaccaccggcgagggagaaggccgcgtgggcatcatcctaacgctggccatgaatattatgtctaccctgcagtgggcggtcaattcatcgatcgatgtcgacagcctgatgcgctccgttagtcgagtgtttaagtttattgatatgcccactgagggtaagcccactaagtccacgaagccgtataagaatggccaactgtctaaagttatgattattgagaactcgcatgtgaagaaagatgacatttggccttcaggaggacaaatgactgtgaaggatctaaccgctaagtacaccgaaggcggcaatgccatcctagaaaacatttcgttctccatatcgccgggccagagggtgggactgcttggacgcaccggcagtgggaagtcaactttgttgtcagcgtttctgcggttgctgaacacagaaggtgagatccagattgacggtgtgagctgggactcgatcacgctgcagcagtggcgtaaggccttcggagtcataccgcaaaaggtattcatattctctggcacattccgcaaaaatctggacccatacgaacagtggagtgatcaggagatatggaaggtcgctgatgaagtcgggcttcgcagtgtgatcgagcaattcccagggaaactggatttcgtgctagtagacggaggttgcgttttgagtcacggacacaaacagctgatgtgtttggctcggtcggtcctctcgaaagcaaagattctactgcttgacgaaccatcagcacacctggacccagtaacatatcaaattatacgccgtacgctgaaacaagcctttgcagattgtaccgttattctctgcgaacaccgcatagaagccatgttggaatgtcagcagttcttggtgatagaggagaataaggtgcgccagtatgatagcatccagaagctgttgaacgagcgctccttgttccgtcaggctattagtccctctgatagggtgaagctcttcccacaccgaaatagctcaaagtgtaagtccaaaccgcaaatagccgctctgaaggaggaaaccgaagaagaggtgcaagacacccggctg

SEQ ID NO: 10184 - DNA, 4440 bp, Artificial Sequence
  Description of Artificial Sequence: Synthetic coding sequence
atgcagcgtagcccacttgagaaggcttccgtggtgtccaagctgtttttctcctggacaaggcctattttgcgtaaagggtataggcagcgcctggaacttagcgacatatatcagattccctctgtcgatagcgccgacaacctgagtgaaaagctagagagagagtgggaccgtgagctagctagcaagaagaatcctaaactgatcaatgccctgagaagatgcttcttctggcggttcatgttctacggaatcttcctgtatctcggcgaggtcactaaggctgtccaaccactgctgttgggccggatcatcgcgtcttatgatcctgacaacaaggaagagcgtagcatcgcaatatacctaggtatcggcttatgtctgctgtttatcgtgaggactctcctgctccaccctgcaatctttgggctacatcacataggaatgcagatgagaattgccatgttctccctgatatacaaaaaaaccttgaagctgtcaagccgggtgctggataagatttctattgggcagctggtgagcctgctttccaataatcttaacaagtttgatgagggtctcgctcttgcccatttcgtgtggattgcccctttgcaggtcgccctgctcatgggcctgatatgggagctgttacaggcctccgccttttgcgggctaggatttctcatcgtgctagcactttttcaggccggtctgggccggatgatgatgaaatatcgcgaccagcgggccggaaagattagcgaacggttggtcatcaccagtgagatgatcgaaaatatacagtccgttaaggcttactgctgggaggaggccatggagaagatgatcgagaacctgcgtcagactgaacttaaactgacccggaaagccgcgtatgtgcgatactttaatagttcagccttttttttcagcggcttcttcgtcgtatttctgtccgtgttgccttacgccctaatcaagggaattatcctcaggaagatatttaccactataagcttctgtattgttttgaggatggcagtcactcgccagtttccctgggccgtgcagacttggtacgattctctcggggcaataaacaaaatccaggactttttgcaaaagcaggagtataaaaccctagaatacaatctgacaaccacagaggtagtgatggaaaatgtcactgccttctgggaagagggctttggagaactattcgagaaagccaagcagaataacaacaaccggaaaacgtccaacggggacgattccttgttcttttcaaatttttctttactggggacgcccgtcctaaaagatattaatttcaaaattgagagaggacaactccttgcagttgcaggctcaactggtgctggtaagacgagcctattgatggtgatcatgggggagttggaacccagcgagggaaaaatcaagcattctggcagaatttccttttgttcgcagttttcctggataatgcccggaacaattaaggaaaacatcatcttcggcgtgagctacgatgaatacaggtatcgaagtgtaatcaaggcatgtcagctagaggaagatatttctaaatttgcagagaaagacaacatagtgctaggggagggaggcattaccctgtcaggcggtcaacgggccaggatcagcctggcgcgagccgtttataaggacgctgatctgtacctgctcgatagcccgtttggttatctcgatgtgcttaccgagaaagaaatcttcgagtcctgtgtgtgcaaacttatggcgaataaaacccgtatcctcgtgacctcaaaaatggaacacctcaagaaagccgacaagattctcattttacacgaaggctcatcctacttctacggcaccttctccgagctgcagaatctgcagccagacttttcatctaagctgatgggttgcgacagcttcgaccagtttagtgctgaacgacgaaacagtatccttaccgaaaccctccacagattcagcttagaaggagacgccccggtatcctggaccgaaacaaagaaacagtctttcaagcagactggggagttcggcgagaagcgaaagaatagtatcctcaaccccatcaactcaatcaggaagtttagcattgtgcaaaaaaccccactgcaaatgaacggcatcgaggaggatagtgacgaacctctcgagcgaaggcttagcttggtgcctgattctgagcagggcgaggctatactcccccgaattagcgttatatctactggacctacactgcaggccagaaggcgccagagtgtgctgaacttaatgacacactccgtgaaccagggtcagaacattcacagaaaaactaccgcctccaccagaaaggtctcattggctccacaggcaaatttaaccgagctagacatttacagccgccgtctgagccaagagaccggtttagaaatcagtgaggaaatcaacgaggaagacctgaaagagtgtttctttgacgatatggagagcatccctgccgtgacaacctggaacacctatctgcgctatataaccgtccacaagagtttgatttttgtactgatctggtgtttagttatcttcctagctgaagtggccgcaagtctcgtggtgttatggcttctcggaaacacgccattgcaggataaaggtaactctacgcacagtcgcaataattcatacgcggtgattattacatcaacaagtagctactacgtcttttacatttacgtcggggtggcagacacccttctcgccatgggctttttccggggcctgcccttggttcatacgttgattaccgtgtccaagatcctccatcataagatgctccactcagtacttcaagcccctatgtctacgctgaacaccctcaaagccggaggcatacttaacagatttagcaaggatatcgctatccttgacgatctgctccctttgactattttcgatttcatccagctcctactaatcgtcattggagctatcgcagtggtcgccgtgcttcaaccctacatattcgtggccaccgtgccagttattgttgcctttatcatgctgcgagcctacttcctccagactagccagcagttgaagcagctagagtccgaggggcggagccccatttttacccacctggtgacatccctgaaagggttgtggactctccgtgcgtttggcaggcagccgtacttcgaaaccttgttccataaagccttgaatctccacacagctaactggttcctgtatctatcaacactccgatggttccagatgaggattgagatgatcttcgtcatctttttcatcgcagttacatttatatccatcctaactaccggcgaaggcgaaggacgtgtcggaatcatccttactctggcaatgaatatcatgtctacgctacaatgggcagtgaattcttctatagacgtggactccttaatgcgctcagtctctagagtttttaagttcatcgatatgcctacagaaggcaagcctacgaagtctaccaaaccatacaagaatgggcaattaagcaaagtgatgataattgagaacagtcatgttaagaaagacgacatttggccttcaggaggccagatgacagtcaaagatctaacggcaaaatatactgagggagggaatgccatactcgaaaacataagcttttccatttcccctgggcagcgggtgggtctactgggacggacaggctctggaaagagtactctgttgagcgccttcttacggctgcttaatactgagggtgagattcagattgacggggtgagctgggactcaatcactctgcagcagtggaggaaggcattcggagtaattccacagaaagtgtttatatttagcgggacatttcgcaagaatctggatccctacgaacaatggtctgaccaagagatctggaaagtcgctgacgaggtgggcctgaggagcgtgatcgaacaatttcctgggaaacttgacttcgttttggtagacggtgggtgtgttctctctcacggacataaacagctgatgtgtctcgccaggtctgtgcttagcaaggccaagatattgctgcttgatgagcctagtgcacacctggatccagtgacttaccagataattaggcggacactgaagcaggcattcgccgactgcaccgtgattctgtgcgaacaccggatcgaagccatgttggaatgccagcagtttctggtgatcgaagagaacaaagtgcgccagtacgactcaattcagaagctcttaaacgaacggtccctcttccgccaggcaatctctccaagtgaccgtgttaagctattcccccatagaaactctagtaagtgtaagtctaaacctcagattgctgccttgaaggaggagacagaggaggaagtccaggacacccggtta

SEQ ID NO: 10185 - DNA, 4440 bp, Artificial Sequence
  Description of Artificial Sequence: Synthetic coding sequence
atgcaaagatcacccttggagaaagcttccgtggtgtctaaactgtttttcagttggacaaggccgattctccggaaggggtaccggcagcggctggagctgagtgacatataccagatcccatcagtcgattccgcagacaacctgagtgaaaagctcgaacgggagtgggacagggagctggcatcgaagaagaatcccaaactaatcaatgccctgagaaggtgcttcttttggcgctttatgttctacggcatctttctgtatctgggcgaggttacgaaggctgtgcaacctctgctgcttggcaggatcatcgcatcctatgacccagataacaaagaagaacgcagcattgcgatttacctggggattgggctctgcctgctgttcatcgtgaggaccctcctactccaccctgcaattttcgggctccaccacatcggaatgcagatgagaattgccatgttcagcctcatctacaagaagaccttgaagctgtcatctcgagtgctggacaagatttcaattgggcaactggtctcattactgtcgaacaatcttaataagtttgacgaggggctggcgctggcacattttgtctggatcgcgcctctgcaggtagccctcctgatgggactgatctgggaactcctacaggcctccgccttctgtgggttgggattcctgattgtgcttgcactgtttcaagcaggcctcggtcgcatgatgatgaaataccgtgatcagcgcgctggcaagatttccgaaaggttggtgataactagtgaaatgatcgaaaatattcagagcgttaaggcgtactgttgggaggaggccatggagaaaatgattgaaaacctaagacagacagaactcaagttgaccagaaaagcagcctacgttaggtactttaacagttccgctttcttcttctccggcttctttgtggtgtttctcagcgtgctgccttacgctctcatcaaaggaatcattttgcggaaaatcttcaccactatttcattttgcatcgtattaaggatggccgtcacacgacagtttccttgggccgtccagacatggtatgactccttgggggcgattaacaaaatccaggacttccttcagaagcaagagtataagacactggaatataatctaaccaccactgaagtagtgatggagaatgtaaccgctttctgggaggaggggttcggggagctcttcgagaaggcaaaacaaaacaataacaacagaaagacttccaacggcgatgactctttatttttcagcaactttagcctgctcggcactcccgtactgaaagatattaacttcaaaatagagagaggccagctgctcgctgtggctggttctaccggcgctggaaagacaagccttttgatggtgatcatgggcgagttggagccttcggagggcaagattaaacacagtgggcgcatatcattttgctcccagttttcctggatcatgcccggaacaattaaggaaaacattattttcggtgttagttacgatgagtatcgctaccgatccgtgatcaaggcatgccagctggaggaagacatctcgaagttcgccgagaaggacaacatcgtgcttggcgagggaggcatcaccctgtctggcgggcagcgagctaggatctcactggccagggcagtatacaaagacgccgatctgtacttattggattcaccttttggctatctcgatgtgctgaccgaaaaagaaatctttgaatcttgcgtatgtaaacttatggctaataaaacacggatcttagtgaccagcaaaatggagcatctcaaaaaggccgacaagatcctcatactgcatgaggggtcgtcttacttctatggcacattctccgagctccagaatttacagcctgacttcagtagtaagttgatggggtgcgactcatttgaccaattcagtgccgagaggcgaaactctattctaacggagacacttcatagattttcgctggagggggacgcgcctgtctcctggaccgagacaaaaaagcagagcttcaaacagactggggagttcggggagaagagaaaaaattctattctgaatcccataaattccatccgaaaattctccatcgtgcagaagaccccactccagatgaacggtattgaggaagacagcgacgagccactggaacggcgattatccctcgtgcctgacagtgaacagggggaggcaattttgccacgcattagtgtcataagcaccggaccaaccctgcaggctaggaggcgccaatccgtactgaatctgatgacacactccgtcaaccagggacagaatatccacaggaaaactactgcctcgactcgtaaggtctccctggcaccacaggccaacttgaccgaactcgacatttactcccgtaggctcagccaagagactggtcttgaaatctcagaggagatcaacgaggaggacctgaaagaatgcttctttgatgacatggagtctattcccgcagtaaccacatggaatacatacttgagatatatcacggtacacaaatccctgatatttgttttgatatggtgtctggtcatcttcttagccgaagtggcagccagcctggtagtgctgtggctcctcggcaacacaccactgcaagataaagggaattcgactcactcgcggaataatagctatgcggtgatcattacctctacttcatcctactatgtattttacatttatgtcggcgttgcggacacccttctggccatgggattcttccgagggcttcctctcgtgcacactctaatcacagtgtcgaaaatccttcaccacaaaatgttacactcagtactgcaagccccaatgagcaccctcaacacacttaaagctggtggcatcttgaatcgattctcaaaagatattgcaatactggacgacctgctgcccctgaccatcttcgactttattcagctgctgctgatagtgatcggcgctatcgctgttgtcgccgtgctgcaaccttacatcttcgtggccactgtgccagttatcgttgcttttataatgctccgcgcttattttttgcagacctcgcagcagcttaaacaactggagagtgaggggcgaagcccgatttttacacacttggtgacctccctaaaaggtctctggactctccgggccttcggcaggcaaccttactttgagaccctgtttcacaaggccctcaacttgcacacggctaactggttcctttatctttcaacccttaggtggtttcagatgaggatcgagatgatcttcgtgatcttttttatcgctgtaactttcatcagcattctcactacaggcgaaggagaggggagagttggaatcattctaacactggccatgaatattatgtccaccctgcaatgggccgtcaacagcagcatagatgttgatagccttatgcggtccgtgagtcgggtattcaaattcatagacatgccgaccgaaggaaagccaactaagtccacaaagccctataagaatgggcaactgagcaaagtgatgattattgaaaactcacacgttaaaaaagatgatatctggccctcagggggacagatgacggttaaagatttgaccgcaaaatacactgagggaggcaacgctattctcgagaacatcagtttttcaatcagtccaggtcaacgcgtcggactgttaggaagaactggctctgggaagagtactctgttatcggcgtttctaaggctgctaaacaccgaaggcgagatccagattgacggcgtttcgtgggacagtatcacactccaacagtggaggaaggcatttggagtgatcccccagaaggtgttcatcttctcaggcacctttcgtaagaatctagacccatacgaacagtggtccgaccaggaaatttggaaggtagcagacgaggtcgggctgcgttcagtgatcgagcagtttcccgggaagctcgacttcgttctggttgacggaggatgtgtgctctcgcatgggcataaacagctaatgtgtctagcccgctcggtactgtcaaaggctaaaatcctgctgttagatgaaccttcggctcatctagaccccgttacataccaaatcatccgacgaacactaaagcaagcattcgccgattgcaccgtcattctgtgcgagcaccggatcgaagctatgctggagtgtcagcagttccttgtcatcgaggagaataaggtgcgccagtatgacagcatccaaaagcttctcaacgagcgttccttgtttcgacaggctatctcaccgtccgaccgcgtcaagctgtttccccataggaatagcagcaaatgcaagtcaaagccccagattgccgcattgaaggaggagactgaggaagaggtgcaggatactcgactg

SEQ ID NO: 10186 - DNA, 4440 bp, Artificial Sequence
  Description of Artificial Sequence: Synthetic coding sequence
atgcaaaggtcacctcttgaaaaggctagcgtggtttcgaaactgttcttcagttggaccagacctattttgcgcaagggatataggcagcgtctcgaattatccgatatttatcagattccatccgttgactccgcagataacctctcagagaagcttgagcgggaatgggatcgggaacttgcaagcaaaaagaatccaaagttaataaacgctctcagacgatgctttttttggcgatttatgttttatggaatctttttatacctcggagaagtaacaaaggccgttcaaccgctccttctcggacggattatcgcatcttatgacccagacaataaggaggagagatctatcgcaatttacctgggaattgggctatgtctgctgttcattgtgagaacgttacttcttcatccagcaatttttggattgcatcatatcggaatgcaaatgagaattgctatgttttcattgatttataaaaaaacactcaagctttcttcaagagtcctagataagatatctattggtcaactagtatctctactcagcaacaaccttaataaatttgatgagggacttgctctagctcactttgtgtggattgcaccactccaagtggccctcttgatgggactgatttgggaactgcttcaggcgtctgctttttgcggacttggattccttattgtgctagcactctttcaagccggtttgggaagaatgatgatgaaataccgagaccagagagcgggaaaaatcagtgagagattggtgatcacatcggagatgattgagaatattcagtctgttaaagcatactgttgggaagaagctatggagaagatgattgagaatctccgtcaaacagagcttaaactcacacgtaaagctgcatatgtcagatacttcaattcttctgcgttctttttcagtggcttcttcgtggtttttttgtctgtcttgccttacgctcttatcaagggaataatcctcagaaagatattcactactattagtttttgtattgtgctaaggatggcagtaactagacaatttccatgggccgtacaaacgtggtatgactcacttggtgctatcaataaaattcaagatttcctgcagaaacaagagtataagacactggaatacaatttgacaactacagaggttgttatggagaatgttacagccttctgggaagaaggtttcggagaacttttcgaaaaagctaaacagaataataataatagaaaaacttctaatggagatgattcgttatttttctcaaacttcagcctgcttggaactcccgtccttaaggatattaacttcaagatcgaacgaggacagttgctcgctgttgcaggatcaaccggtgctggtaaaacatcattacttatggttattatgggagaacttgagccgtctgaaggaaaaataaagcattcgggacgtatttcattttgctcgcaattctcctggataatgccaggaacgatcaaggaaaacatcatattcggagtgtcgtatgacgaatatcgctacagatcagtcataaaggcttgccagcttgaagaagatatttcaaagtttgcagaaaaggataatatagtattaggggaaggagggattacgcttagcggaggacaacgtgcacgaatttcgctggctcgagctgtttacaaagatgctgacctataccttctggattccccatttggctacctcgacgttctcacggaaaaggagattttcgaatcatgtgtttgtaagctcatggctaacaagacacgaatcttggtcacatcgaaaatggagcatttgaaaaaagctgataaaatactgatccttcacgagggtagttcctatttctacggaacattctcggagttgcaaaatctgcagccagatttttccagtaagcttatggggtgtgattccttcgatcaattttcagctgaacgtcgtaattctattctaacggagactcttcaccgtttctctttggaaggtgatgccccggtgtcatggacggagactaaaaaacaatcgtttaaacagactggagaatttggggagaaaagaaagaattctattctgaatcccattaattctatcagaaagttcagcattgtccaaaagactccactgcagatgaatggaatcgaggaagatagtgatgaaccattagaacgaagactatcgttggttccggatagcgaacaaggcgaggctatcttgcctcgtatatcagtaatcagtacgggacccacactccaagcccgacggcgtcaatccgttctgaatctcatgactcattcagtaaaccaaggacaaaatattcatagaaagacaaccgcaagtactagaaaagtttcactcgcaccacaggcaaatctgacagaacttgatatatatagtagaagattgtcccaggaaacgggtttggaaatctctgaagagattaacgaagaggacctgaaggaatgttttttcgatgatatggagtcaattccggcagttactacatggaatacctacttgcgttatattactgttcacaaatctctcatctttgttttaatttggtgcttggtaatattcttagctgaagtcgcagcgtcactcgttgtgctttggcttttgggaaatactccattgcaagacaaaggtaattccactcattctcggaacaatagttatgcggtcattatcacttcaacgtcgtcatactatgtcttttacatttatgtcggagttgctgatactctactggctatgggattcttccgcggattacccttggtccacaccctaattactgtttcgaagattctacaccataaaatgctccatagtgtcctccaggctccaatgagtactttaaatacactcaaagctgggggaattttaaatagattctccaaggatatcgcgattcttgacgaccttttgcctttaactatctttgattttattcaactcctccttatagtgatcggggctatagctgtcgtagctgttttgcaaccttatatctttgtggcgaccgttccagtgatcgttgcatttattatgctccgggcatatttcttgcaaacttctcagcagctcaaacaattggagtcggagggaagaagcccaatttttacccacttggtgacttctttgaagggattgtggactcttcgggcattcggcagacagccatatttcgagactttatttcataaggcactgaatcttcatactgctaactggtttctgtatttatcgacacttaggtggttccagatgagaattgaaatgatttttgttatatttttcatcgcagtcacattcatatccatacttaccacaggcgagggagaaggtcgtgttggaattatccttaccctcgctatgaacattatgtctaccttgcaatgggctgtcaattcctctatagacgtcgactctctgatgcgttctgttagcagagtcttcaaatttattgacatgcctacagaaggaaagcctaccaagtcgactaaaccatacaaaaatggacaactttcaaaagtgatgatcattgagaattcccatgttaaaaaagacgatatttggccaagtggaggacagatgacagtcaaggatttgactgcgaaatacacagaaggaggaaatgcaattctagaaaatatcagcttctcaatttcgccagggcagcgagttggtttgctcggacgcactggttcaggaaagtccactcttctctcagcgttcttaaggcttctaaacacggagggagagatccagatcgatggagtttcttgggactctattactctgcaacaatggcgtaaggcttttggtgttattcctcaaaaggtgtttatcttttcgggaaccttccgcaaaaatttagatccatatgaacaatggtccgatcaggaaatatggaaagtcgcggacgaggtgggacttagatcagttattgagcaatttccgggaaaacttgacttcgtcctggtcgacggtggatgtgttctgagtcacggacataagcaacttatgtgtctagcaagatctgttctttcaaaagcaaaaattttgctacttgatgaaccaagcgctcacctagaccctgttacctaccaaattattcgcagaactttgaagcaagcgttcgctgattgcacagtaatcctctgcgagcacagaattgaagcaatgctagagtgccagcaatttttagtcattgaggaaaataaagtgcgacaatacgatagcatacaaaagcttctgaacgaacgaagtttgtttcgacaagcaatttcgccatcggatcgggtcaaattgttcccgcacaggaacagtagtaagtgtaaatcaaaaccgcaaattgcggctcttaaagaagaaactgaagaggaagtgcaggatacacgattg

SEQ ID NO: 10187 - DNA, 4440 bp, Artificial Sequence
  Description of Artificial Sequence: Synthetic coding sequence
atgcaacggtcgcccctggagaaagccagcgtggtgtccaagctgtttttctcatggactaggccaatcctgcggaagggctaccgccaaaggcttgaactgagcgacatttaccagatcccttcggtggatagtgctgataatctttcggaaaagctggaacgtgagtgggatcgcgagcttgcatccaagaagaacccgaagctgatcaacgcgctcagacgatgcttcttctggcggtttatgttctacggaattttcctctacctcggagaagtgaccaaagcagtgcagccgctccttctgggacgcatcatcgcgtcgtacgaccctgacaataaagaagagcggtcgatcgctatctacctcggaatcggactttgcctgctgttcatcgtgcgcaccttgctcctccaccccgctatctttggcttgcaccatatcgggatgcaaatgagaatagctatgttctccctcatctacaaaaagactctgaaattgtcctcccgagtcttggacaaaatctcgatcggacaactggtgagcctgctctccaataacctgaataagttcgacgaaggcctcgccctggctcacttcgtctggatcgccccgttgcaggtggccctgctcatggggcttatctgggaactgctgcaagcctcggcgttctgcgggctcgggttcctgattgtgcttgcgctctttcaggccggactgggacgcatgatgatgaaatacagggatcaaagagctggaaagatatcggaacggctggtgattactagcgaaatgatcgagaatattcagagcgtgaaggcatactgctgggaagaggccatggagaagatgatagagaacttgagacaaactgaactgaagctgacccggaaggcagcgtatgtgcgctactttaactctagtgcattcttcttctccgggttcttcgtggtttttctcagcgtgttgccatacgccctcatcaaaggaatcattctcagaaagatcttcactactatttcattttgcatcgtcctgcgcatggccgtcacccggcagtttccttgggcagtgcagacctggtacgactcgctgggtgcaattaacaaaatccaggatttcctccaaaagcaggagtacaagacgctcgaatacaatctgaccactaccgaagtcgtgatggagaacgtgaccgccttctgggaagaggggttcggggagctgtttgagaaggcgaaacagaacaacaacaatagaaagacttccaatggagatgattcgcttttcttttccaacttctccctgctgggtacgccggtcctcaaggacatcaacttcaagatcgaacgcgggcaactgctggcggtggcgggatcgacgggagccggaaagacctcactcctgatggttatcatgggcgaactcgagccgagcgaaggaaagattaaacactcgggaagaatctctttctgtagccagttcagctggataatgccgggcactatcaaggaaaacatcatttttggagtgtcgtacgatgaataccgctacaggtcagtcatcaaggcctgccaactggaggaagatatttcgaagtttgcagaaaaagacaacatcgtgctgggcgagggaggaatcactctgtctggaggacagcgagcccggatttctttggctagggcggtctacaaagacgccgacctgtacctcttggactcgcctttcggatatcttgatgtgcttaccgagaaagaaatcttcgagtcgtgtgtttgcaagctcatggccaacaagaccagaatcctggttacctccaagatggagcatctcaaaaaagcggataagatcctgatcctgcatgaaggatcgagctacttctacgggaccttctccgaactccaaaacctgcagccggatttctcatcgaaattgatgggctgcgacagctttgaccaattttctgccgagcggcgcaattcgatcttgactgaaactcttcaccgcttctcgctggagggcgatgcgccggtgtcgtggactgagactaagaagcagtcctttaagcagactggtgaattcggcgaaaagcgcaaaaactcgattcttaatcccattaactcaatccggaagttcagcatcgtgcagaaaaccccactgcaaatgaatggtatcgaagaagattccgatgagccgctggaacgtcggctgtccctcgtgcctgacagcgaacagggagaggcgatcttgccgcgcatcagcgtgatctcgactggaccaaccctgcaggcccgccgtcggcagtcagtgctcaacttgatgacccatagtgtgaatcaaggacagaatatccaccgcaagacgactgctagcacccggaaagtgtcgttggcgccgcaagccaacctgaccgaacttgatatctactcacggaggctgtcccaggagactggcctggaaatctctgaagagatcaatgaggaggacctcaaggagtgcttcttcgacgacatggagagcatcccagccgtcactacctggaatacctacctgcgctacatcacggttcacaaaagcctgatcttcgtgctgatctggtgtttggtcatcttcctggccgaggtcgccgcctcactcgtggtgctgtggctgctgggcaacactccactgcaggataagggcaactccactcattcccgaaataactcttacgccgtgatcataacctcgacctcgtcatactacgtgttctacatctacgtcggggtggcagacaccttgctcgccatgggattcttccgcggattgccgctggtccacactctgatcactgtgagcaagatcctccaccacaaaatgctgcacagcgtcctgcaagccccaatgagcactctgaacactctgaaagccggaggaatcctcaatcggttttcgaaagatattgcaatcctcgacgacctgctgcctctgaccatcttcgacttcatacagttgcttttgatcgtcatcggcgcaatcgccgtggttgctgtgctgcaaccctacatcttcgtggcgaccgtacccgtcatcgttgcgttcatcatgctgcgcgcgtacttcctgcagaccagccaacagcttaagcaactggagtcggaggggagatcaccaatcttcacccatctcgtgacctccctcaagggcctgtggactctgcgcgcattcggccggcaaccgtactttgaaaccctctttcacaaggcgctcaatctgcataccgctaactggttcctgtatctctccacgctgcgctggttccagatgcggatagaaatgatcttcgtcatctttttcatcgcagtcacgtttatcagcatcttgactaccggtgagggagagggcagagtcggaatcatcctcaccctcgcgatgaacatcatgagcaccctgcagtgggcagtcaactcatccatagacgttgacagccttatgagatcggtttccagggttttcaaattcatcgacatgccgactgaaggaaagccgacgaagtcaactaagccgtataagaacggacaactgagcaaggtcatgattattgagaattcccacgtgaagaaggacgatatatggccttcgggaggccagatgaccgtgaaggatctgacggctaagtacactgaagggggtaacgcgatccttgaaaacatctccttctccatctcaccaggccagcgggtggggttgctgggtcgcactggatcgggcaaatcaactctgctgagcgcattcttgcgcttgctgaacactgaaggagaaatccagatcgacggtgtgtcctgggactccatcaccctgcagcaatggagaaaggcctttggcgtcattccgcagaaggtgtttatcttctcgggaaccttccgcaaaaacctggatccttacgaacaatggtccgaccaagagatttggaaggtggctgacgaagtgggactgcggtcggtcattgagcagttcccgggcaagctcgacttcgtgctcgtggacggtggttgtgtcctgagccatggtcacaagcagttgatgtgtctggctagatccgtgctgtccaaagctaagatcctccttcttgacgaaccaagcgctcacttggacccagtgacctaccagataattcgccggactctcaagcaagcctttgcggattgcaccgtgatcctctgcgaacatcgtatcgaagcgatgctggaatgccagcagttcctggtaatcgaagagaacaaggtgaggcagtatgactccatccaaaagctcctcaacgaacgctccctcttcaggcaggcaatctcaccttcggaccgcgtcaagttgtttccgcatcggaatagctcaaaatgcaagtccaagccacaaattgccgccttgaaggaggaaaccgaagaggaagtgcaggatacgcggctc

SEQ ID NO: 10188 - DNA, 4440 bp, Artificial Sequence
  Description of Artificial Sequence: Synthetic coding sequence
atgcaaagaagcccactggagaaggcatcggtggtgtccaaactgtttttctcctggactagacccatcctgcgtaaaggctaccgccagaggctcgaactgtcagatatctaccagatcccgagcgtggattcagcagataacctgtccgaaaagctggaaagagagtgggatcgggaactggcatcgaagaagaatcccaagctgattaatgcacttcgcagatgctttttctggaggtttatgttctacgggatttttctgtacctcggggaggtgactaaagctgttcaacctctcctccttggtcgcattattgcgtcgtacgacccggacaataaggaagaaagatcaatcgcgatttaccttggcattggactgtgtctgctgtttatcgtgcgcacccttctcctgcaccctgctatctttgggctccatcacattgggatgcaaatgagaattgcaatgttctcgcttatctacaagaaaaccctcaagctctcatcccgtgtgcttgataagatatcaatcgggcaattggtgtcgctgctgtccaacaacctgaataagtttgatgaagggctcgcactggctcactttgtgtggattgcaccgcttcaggtcgcactgctgatgggactgatctgggaactgctgcaagcctcagcattttgcgggcttggatttctcatagtcctggccttgtttcaggcaggtcttggtcgaatgatgatgaaatacagggatcagagggccggtaagattagcgaacgactggtgatcacttcggaaatgatcgaaaacatccagtcggtcaaggcctactgctgggaagaagcaatggaaaagatgatagagaatttgcgccaaaccgaattgaaactcactagaaaagcagcatacgtgaggtacttcaacagctcagcattctttttctctggctttttcgtggttttcttgtccgtccttccatatgcccttatcaagggcattatccttcggaagatctttaccacgattagcttctgcattgtccttagaatggcggtcacccgccagtttccttgggccgtgcagacctggtacgactcccttggggcaatcaataagatccaggactttctccagaagcaggaatacaaaactcttgaatacaacctcaccaccactgaggtggtcatggaaaacgtgactgcgttttgggaagagggattcggggagctcttcgagaaagcaaagcaaaacaacaataacagaaaaacctcgaatggagacgattcccttttctttagcaacttttccctcctcggtaccccagtgcttaaggacataaactttaagattgaaagaggtcaactgctcgccgtggcaggatcgactggagccggtaaaacgagccttttgatggtcattatgggagaactggaaccgtcagaaggcaagattaagcatagcggtcggatcagcttttgttcgcaatttagctggattatgccggggaccataaaagagaacatcatctttggtgtgtcatacgacgaatacagataccgcagcgtcatcaaggcctgccagcttgaggaggatatttcaaaattcgcagaaaaagataacatcgtgctcggcgaaggaggcattactctctccggtggacaaagagcccgtatctcactcgccagagctgtgtacaaggatgccgatctgtacctgctggattccccctttggatacctggatgtcctcactgagaaggagatttttgaatcgtgtgtttgcaagttgatggccaacaaaactcggattcttgtcacttcaaagatggaacacttgaaaaaagcggacaagattcttatactccacgaaggatcatcgtatttctacggaaccttctcggaacttcaaaacttgcaacctgatttctcatcgaaactgatggggtgtgattcgtttgatcagttttccgccgaacgacgcaattccatccttacggaaaccctgcatcgcttcagcctcgaaggggatgccccagtgtcctggaccgaaactaaaaagcaatcattcaaacagaccggcgaatttggagaaaaaagaaagaattcgattctgaatcccattaactccattcggaagttctcaattgtgcaaaaaacgcctcttcagatgaatgggatcgaggaagattccgacgaacctcttgagcggcgcttgtccctggtccccgattccgagcaaggtgaagccatccttccacggatttcagtcatctcaactggacccactttgcaagctcgccggcgccaaagcgtccttaatcttatgactcacagcgtgaaccagggacagaacatacatagaaaaaccaccgcctcgacccggaaagtgtcccttgcacctcaggcaaatctgactgagcttgacatctactccagacggttgtcccaagagactggtcttgaaatttcggaagagattaacgaagaagatctcaaggagtgtttctttgacgacatggagtcgattcctgcagttaccacctggaacacttatctgagatacattaccgtgcataaatccctgatcttcgtcctcatctggtgtctggtgattttcctggccgaagtggctgcttcgcttgtggtgctttggctgctcgggaacacgccgttgcaagacaagggaaactcgacccatagccgcaataactcatacgcagtgataatcacttcgacctccagctactatgtgttttacatatacgtcggagtggccgataccttgctggcaatgggtttctttagaggccttcctctcgtgcatactctgattacggtgagcaagattctgcatcataagatgctgcattctgtgctgcaggcaccgatgtcgactttgaacacccttaaggcaggtgggattctgaatcgctttagcaaggacatcgcgatccttgatgatcttctgcccttgacgatatttgactttatccagcttctgctcattgtgattggagcgatagccgttgtggcagtgcttcaaccatacatctttgtcgccactgtgccagtgattgttgcgtttatcatgcttcgagcctactttcttcaaaccagccagcagcttaagcaactcgagagcgaaggtcggtcccctattttcactcatctggtgacttccctcaagggtttgtggactctccgtgcttttggacggcagccttactttgaaactctgtttcacaaggctctgaatttgcataccgctaactggttcctttacctctcgaccctgcgttggttccaaatgaggatagagatgatcttcgtgatctttttcatcgccgtcacctttatcagcatactcactaccggagaaggagaggggagagtgggtatcattcttacgctcgccatgaacatcatgtccactttgcagtgggcagtgaatagctcaatcgatgtggatagccttatgcggtcagtctcacgtgtgtttaagtttatagacatgcctactgaaggaaagcccactaaatccacgaagccttacaagaacgggcagctgtcgaaggtcatgattattgagaactcgcatgtgaagaaagatgatatttggccgtccggagggcagatgacggtgaaggaccttaccgcaaagtacaccgagggaggaaacgccatccttgagaacatctcgtttagcatatcgccaggccagcgtgtgggactcctgggtagaaccggctcaggaaagtcaaccctcctttctgcctttcttcgccttctgaacaccgaaggagagatacagatcgacggtgtgtcgtgggactcgatcactcttcaacagtggagaaaagcattcggagtgattccacaaaaagtgtttatcttttcgggtaccttccgtaagaacctggatccatacgaacagtggtcagatcaggaaatatggaaggtggccgatgaggtgggacttcgatcggtcatcgagcagtttccgggcaaacttgactttgtgttggtggacggcggatgtgtgctgtctcatggtcacaagcaacttatgtgccttgcacgctctgtcctgtcgaaggcaaagattctgctgcttgatgaaccaagcgcgcatctggaccctgtgacctaccagataatcagaaggaccctgaagcaggcattcgccgactgtactgtcattctctgcgaacatcggattgaagcaatgcttgaatgtcaacaatttctggtcatagaagaaaacaaggtgaggcagtacgattcgattcaaaaactgctcaatgagcggtccttgttccggcaagcaataagcccatccgacagagtcaaattgttcccacaccgaaactcgagcaagtgtaagtccaaacctcaaatagcggcactgaaggaagaaaccgaggaggaggtgcaagatactaggctt

SEQ ID NO: 10189 - DNA, 4440 bp, Artificial Sequence
  Description of Artificial Sequence: Synthetic coding sequence
atgcaacgttcgccgttagaaaaagcgtcggttgtatcgaaactatttttttcgtggacgcgtccgatactacgtaaaggttatcgtcaacgtttagaactatcggatatatatcaaataccgtcggtagattcggcggataatctatcggaaaaactagaacgtgaatgggatcgagaattagcgtcgaaaaaaaatccgaaattaataaatgcgttacgacgttgttttttttggcgatttatgttttatggtatatttctatatttaggtgaagtaacgaaagcggtacaaccgttactactaggtcgaataatagcgtcgtatgatccggataataaagaagaacgatcgatagcgatatatctaggtataggtttatgtttactatttatagtacgtacgttactattacatccggcgatatttggtctacatcatataggtatgcaaatgcgtatagcgatgttttcgctaatatataaaaaaacgctaaaattatcgtcgcgagttttagataaaatatcgataggtcaattagtatcgctattatcgaataatctaaataaatttgatgaaggtttagcgttagcgcattttgtttggatagcgccgctacaagttgcgctactaatgggtttaatatgggaattattacaagcgtcggcgttttgtggtttaggttttttaatagtactagcgttatttcaagcgggtctaggtcgtatgatgatgaaatatcgagatcaacgagcgggtaaaatatcggaacgattagtaataacgtcggaaatgatagaaaatatacaatcggttaaagcgtattgttgggaagaagcgatggaaaaaatgatagaaaatttacgtcaaacggaactaaaactaacgcgtaaagcggcgtatgtacgttattttaattcgtcggcgttttttttttcgggtttttttgtagtttttttatcggtattaccgtatgcgttaataaaaggtataatactacgaaaaatatttacgacgatatcgttttgtatagtattacgtatggcggttacgcgtcaatttccgtgggcggttcaaacgtggtatgattcgctaggtgcgataaataaaatacaagattttctacaaaaacaagaatataaaacgttagaatataatctaacgacgacggaagttgtaatggaaaatgttacggcgttttgggaagaaggttttggtgaattatttgaaaaagcgaaacaaaataataataatcgtaaaacgtcgaatggtgatgattcgctatttttttcgaatttttcgttattaggtacgccggttctaaaagatataaattttaaaatagaacgaggtcaattactagcggtagcgggttcgacgggtgcgggtaaaacgtcgttattaatggttataatgggtgaattagaaccgtcggaaggtaaaataaaacattcgggtcgtatatcgttttgttcgcaattttcgtggataatgccgggtacgataaaagaaaatataatatttggtgtatcgtatgatgaatatcgttatcgttcggtaataaaagcgtgtcaactagaagaagatatatcgaaatttgcggaaaaagataatatagttctaggtgaaggtggtataacgttatcgggtggtcaacgagcgcgaatatcgttagcgcgagcggtatataaagatgcggatttatatttactagattcgccgtttggttatttagatgtactaacggaaaaagaaatatttgaatcgtgtgtatgtaaattaatggcgaataaaacgcgtatactagtaacgtcgaaaatggaacatctaaaaaaagcggataaaatactaatactacatgaaggttcgtcgtatttttatggtacgttttcggaactacaaaatctacaaccggatttttcgtcgaaattaatgggttgtgattcgtttgatcaattttcggcggaacgtcgtaattcgatattaacggaaacgttacatcgattttcgctagaaggtgatgcgccggtatcgtggacggaaacgaaaaaacaatcgtttaaacaaacgggtgaatttggtgaaaaacgaaaaaattcgatattaaatccgataaattcgatacgtaaattttcgatagtacaaaaaacgccgctacaaatgaatggtatagaagaagattcggatgaaccgttagaacgtcgtttatcgctagtaccggattcggaacaaggtgaagcgatactaccgcgtatatcggtaatatcgacgggtccgacgctacaagcgcgacgtcgtcaatcggtactaaatttaatgacgcattcggttaatcaaggtcaaaatatacatcgtaaaacgacggcgtcgacgcgtaaagtttcgctagcgccgcaagcgaatttaacggaactagatatatattcgcgtcgtctatcgcaagaaacgggtttagaaatatcggaagaaataaatgaagaagatctaaaagaatgtttttttgatgatatggaatcgataccggcggtaacgacgtggaatacgtatctacgttatataacggtacataaatcgttaatatttgtattaatatggtgtctagtaatatttctagcggaagttgcggcgtcgctagttgtactatggttattaggtaatacgccgttacaagataaaggtaattcgacgcattcgcgtaataattcgtatgcggtaataataacgtcgacgtcgtcgtattatgtattttatatatatgttggtgtagcggatacgctactagcgatgggtttttttcgtggtctaccgttagtacatacgctaataacggtatcgaaaatattacatcataaaatgttacattcggtattacaagcgccgatgtcgacgttaaatacgctaaaagcgggtggtatactaaatcgtttttcgaaagatatagcgatattagatgatttattaccgctaacgatatttgattttatacaattattattaatagtaataggtgcgatagcggttgtagcggttctacaaccgtatatatttgttgcgacggttccggtaatagtagcgtttataatgctacgagcgtattttttacaaacgtcgcaacaattaaaacaattagaatcggaaggtcgttcgccgatatttacgcatctagtaacgtcgctaaaaggtttatggacgctacgtgcgtttggtcgtcaaccgtattttgaaacgctatttcataaagcgctaaatctacatacggcgaattggtttttatatttatcgacgttacgttggtttcaaatgcgtatagaaatgatatttgtaatattttttatagcggtaacgtttatatcgatattaacgacgggtgaaggtgaaggtcgtgtaggtataatattaacgttagcgatgaatataatgtcgacgctacaatgggcggttaattcgtcgatagatgttgattcgctaatgcgttcggtttcgcgtgtatttaaatttatagatatgccgacggaaggtaaaccgacgaaatcgacgaaaccgtataaaaatggtcaactatcgaaagttatgataatagaaaattcgcatgttaaaaaagatgatatatggccgtcgggtggtcaaatgacggttaaagatttaacggcgaaatatacggaaggtggtaatgcgatattagaaaatatatcgttttcgatatcgccgggtcaacgtgtaggtctactaggtcgaacgggttcgggtaaatcgacgttactatcggcgtttctacgattattaaatacggaaggtgaaatacaaatagatggtgtatcgtgggattcgataacgctacaacaatggcgaaaagcgtttggtgttataccgcaaaaagtatttatattttcgggtacgtttcgtaaaaatttagatccgtatgaacaatggtcggatcaagaaatatggaaagttgcggatgaagtaggtctacgatcggttatagaacaatttccgggtaaattagattttgttctagttgatggtggttgtgtactatcgcatggtcataaacaattaatgtgtctagcgcgatcggtattatcgaaagcgaaaatactactactagatgaaccgtcggcgcatctagatccggtaacgtatcaaataatacgacgtacgttaaaacaagcgtttgcggattgtacggtaatactatgtgaacatcgtatagaagcgatgctagaatgtcaacaatttttagtaatagaagaaaataaagttcgtcaatatgattcgatacaaaaactattaaatgaacgttcgctatttcgtcaagcgatatcgccgtcggatcgtgtaaaactatttccgcatcgaaattcgtcgaaatgtaaatcgaaaccgcaaatagcggcgttaaaagaagaaacggaagaagaagttcaagatacgcgtcta

SEQ ID NO: 10190 - DNA, 4440 bp, Artificial Sequence
  Description of Artificial Sequence: Synthetic coding sequence
atgcaacgcagccctttggagaaggctagtgtggtgtcaaagctctttttctcttggacccgcccaatcctgcggaaaggctacaggcagcgcctggaactgtccgacatttaccagattccttctgttgatagtgcagacaacctaagcgagaagcttgagcgagagtgggatcgggagctggcctcaaaaaaaaatccaaaacttatcaatgcacttcgcagatgcttcttctggcgctttatgttctatggcatatttttgtaccttggggaggtgactaaggcagtgcaaccgctgctgctaggccggattatcgcttcatacgaccccgacaacaaggaagagcggagcatagctatttacctggggattggtctgtgtctcctgtttatcgtgagaacactcctgctacatccagccatttttggcctccatcatattggaatgcaaatgagaattgccatgttttccctcatctacaaaaaaacactgaaactctcatcgagagtgctagataagatttctatagggcagctggtgtccttgctttccaacaaccttaacaaattcgatgagggcttggcccttgcccacttcgtgtggatcgcgccactgcaagtcgctctgctgatgggattgatttgggagctgctgcaggcaagcgcattctgtggcctggggttcttaatagtgcttgcactgtttcaggctggactcggacgaatgatgatgaaataccgcgaccagagggctggcaagataagtgaacggctcgtgatcactagcgaaatgatcgaaaatatccagagcgtaaaagcttattgctgggaggaagctatggagaaaatgatagaaaacttgcgtcagacggagttgaagctgacccgtaaggctgcttatgttcgctacttcaattccagcgcgtttttcttctcaggcttttttgtggtatttctgtcagtcctaccttatgcccttatcaagggcattatcctgcggaagatttttacaaccatttccttctgcatagtgctgcggatggcagtaacaagacaatttccgtgggctgtgcaaacgtggtacgactccctcggcgccatcaacaagatccaggactttcttcagaagcaggaatataagacactcgagtataacctaaccactacagaagtggttatggagaatgttacagctttttgggaggagggcttcggtgagctcttcgagaaagctaagcagaacaataataaccgcaagacaagtaatggcgacgatagtctgtttttcagcaatttcagcctgctggggacacccgtgctaaaggatattaattttaagatcgagcgcggccagctgctggcggtcgctggcagtacgggggctggcaaaactagtttgctaatggtcattatgggagagctagaaccttctgagggcaaaataaaacacagcggaagaatatcattctgcagtcagttctcctggataatgcccggcacaataaaagagaacataatctttggagtctcgtacgatgaatacagatatagatcggtcattaaagcctgtcaactagaagaggatatcagtaagttcgcagaaaaagacaatatcgtgctgggcgaaggtgggattacgcttagcggcgggcagcgggcccgtatatcactggccagggctgtatataaggacgcggatctgtatctcctggactccccgttcgggtatttagatgttctaacagagaaggaaatctttgaatcctgtgtgtgcaaattaatggcaaacaagacccgcattctggtgacttccaaaatggaacatttgaagaaggccgataagatattaatcttgcacgaaggttcatcttatttttatggcactttttccgagctgcagaatctacaaccagatttttcctccaagctcatggggtgcgactcttttgatcagttcagtgccgagcggcggaatagtatcctgacggagactctgcatcgattcagcctggaaggggatgcgccagtatcgtggacagagaccaaaaagcaatcctttaagcagacaggggagttcggcgaaaaacgtaagaattctattttgaaccccataaactccatccgaaagttttcaatcgttcagaagacccccctgcagatgaacggaattgaagaggactccgacgaaccactggagcgcagactgtctctggtccctgactccgaacagggagaggcaattcttccgagaatatccgtgatctcaacgggccccacgctgcaggcccggcggagacagagtgtactcaatctgatgacccattcagtaaatcaaggacagaacatccaccgcaagaccacagcctcaaccaggaaggtctctctggccccccaggctaacctgaccgaactggatatttatagcaggagactgtcacaggaaacagggttggaaatttcagaggaaattaatgaagaggaccttaaagagtgctttttcgacgacatggagtccatacccgcagtgaccacgtggaacacatatctcagatatattactgtgcataaaagtttgatcttcgtcttaatctggtgccttgttattttcctcgccgaggtggcagcctccctggttgtgctgtggcttttggggaacacacctttacaggataaaggaaatagcacccactccagaaacaacagctacgcggtgataatcacaagtacttcatcctattacgtcttctatatttacgtcggagtcgcagatactctgctcgctatgggcttctttagggggcttccactggtgcacaccctgataaccgtttccaagatattgcatcataaaatgttacattctgtgctgcaggctcctatgagtactttgaatactctcaaagcgggtggcatactgaaccgattctcaaaggatatagcaattctcgacgacttactcccactcacaatatttgattttatacaattgcttctcatagtgatcggcgcgatagccgttgtggccgtattgcagccctacatttttgttgcaactgttcccgtgatcgtcgcttttataatgctgcgtgcctatttcctgcagacaagccagcaactcaaacagttggagagcgaggggcggagccccatctttacacatctggtcacatctttgaagggtctctggacactgagggcatttgggcgtcagccctacttcgagacactgtttcacaaagcattaaatctccatacggccaactggtttttgtacctttctacccttagatggttccagatgcgcatagagatgatctttgtcattttcttcatcgccgtaacctttatttcgatcctgactaccggagagggtgagggacgagtcggcatcattctgacacttgctatgaatatcatgtctacactgcagtgggccgtcaatagctccattgacgtggacagcctgatgcggagcgtcagccgcgtcttcaaattcattgacatgccgaccgagggcaagcccacaaaatccaccaaaccgtataagaacgggcagctgagcaaagtgatgatcatagaaaacagtcacgtaaaaaaggatgacatttggccatccggggggcagatgacagttaaagatctgacagcaaaatacacagaagggggcaatgcaattttggagaatatatcctttagcattagccccgggcagcgcgtggggctgctcggcaggacaggctccggaaaatccaccctgctgtcggccttcctgaggctgctcaatacagaaggagaaatccaaattgacggtgtgagctgggatagcatcacattacaacagtggcggaaagcctttggcgttatccctcagaaagtcttcatcttttccggaacatttaggaaaaacctggacccttacgagcagtggtctgatcaggagatctggaaggttgcggatgaagtggggttaaggtcagttatcgagcagtttcccggtaagttggactttgtcctggtggatggaggatgcgtccttagtcacggtcataagcagttgatgtgccttgctcggtcagtgctctccaaggccaaaattctgctgttggacgaaccctctgcacacctggaccccgtgacttatcaaattattcgaagaacactgaagcaggccttcgctgactgtacggttattctgtgtgagcataggatcgaagcgatgctggaatgtcagcaattcctggttattgaggagaataaagtcagacagtatgattcaatccagaagctgcttaacgagaggagtctcttccgccaggcgatcagtccttcagatcgtgtgaagctcttccctcaccgaaattctagtaaatgcaagtcaaagccccaaattgcagccctcaaagaagagacagaggaggaagtgcaagacacacgcctc

SEQ ID NO: 10191 - DNA, 4440 bp, Artificial Sequence
  Description of Artificial Sequence: Synthetic coding sequence
atgcagaggtcacctcttgaaaaggcatcggtggtttcgaaattgtttttctcgtggacccgccccattcttagaaagggatacagacagcggctcgagctcagcgatatctatcagattccatccgtggatagcgcagacaatctttcggaaaagctggaacgagaatgggaccgcgagttggcgagcaagaaaaaccctaaactgattaacgctcttcggagatgcttcttttggagatttatgttctacggaattttcctctaccttggtgaggtgaccaaagcagtgcaaccattgctcctgggacgcatcattgcatcatatgacccagacaacaaggaagaacgcagcatagcaatctacctcggaattggactttgtctcctgtttatcgttcggaccctgctgctgcatcccgcaatctttggccttcatcatattggaatgcaaatgcggatagcaatgttctcgcttatctacaagaaaactttgaagctgtcgtccagagtgttggacaaaatctccatcggtcaattggtgtcgctcctgtccaataatctcaacaaatttgatgaaggtcttgccctggcacatttcgtctggatcgcacctctgcaagtggcgctgcttatgggcctcatttgggagctgctgcaagcctcggccttttgtggtctggggtttcttattgtgctggcattgttccaggccggccttgggcgcatgatgatgaagtacagagatcaaagagcaggcaagatatccgaaagacttgtgattaccagcgaaatgattgagaacattcaatccgtcaaggcatactgttgggaggaagcaatggaaaagatgatagaaaacctgcgacagaccgaactgaagctcaccagaaaggcagcatacgtcagatactttaacagctcagccttcttcttttccggattctttgtggtgttcctgtcggtgctgccttacgcactcattaaagggattattctccgcaagattttcactactatctccttttgcattgtgctccgcatggcagtgactaggcagttcccttgggcagtgcaaacgtggtacgacagcttgggagccattaacaaaattcaagatttcttgcagaagcaagagtacaagacgcttgaatacaacctcacgaccactgaggtggtgatggaaaacgtgactgcattttgggaggaaggcttcggtgagctgtttgagaaagcaaagcaaaacaacaataaccggaaaacctcaaatggggacgacagccttttcttctcaaacttttcgctcctgggcaccccagttctgaaggacataaacttcaagattgaacggggacagctgctggcagtggcgggtagcactggggccggcaagacctcgctccttatggtgataatgggcgaactggagccctcggagggaaagatcaaacattcgggcaggatctcattctgctcccagttttcgtggattatgcctgggactattaaggaaaacattatcttcggagtgagctacgatgaatacagatacaggagcgtgattaaggcgtgccaacttgaggaggacatttctaagtttgccgagaaggacaatatagtgctgggagagggaggaattaccctttctggagggcagcgtgcccgtatctccctggcaagagcggtctacaaggatgccgatctgtaccttctcgattcaccttttgggtacctcgatgtgctgacggagaaggagattttcgagtcctgtgtctgcaagctgatggcaaataagacccgaattcttgtgacctccaaaatggaacatttgaaaaaagctgataagatactgattctgcacgaagggtcctcatacttttacggaaccttttcagaactccagaatcttcagcccgatttttcctccaaactcatgggatgcgattcgttcgaccaattctcggcggaacggcgtaattccattcttaccgaaaccctccacagattttctcttgaaggcgatgcacctgtctcgtggaccgaaacgaaaaagcagtcctttaagcaaactggagaattcggtgaaaagcgcaagaattcgatccttaaccccatcaattctatcaggaagtttagcatcgtgcaaaagaccccactccagatgaacggaattgaagaggactcggatgagccacttgagcggcggctctccttggtgcctgacagcgaacagggcgaagcaattctgcctcgaatttcggtgatctcgaccggaccgacgctgcaggcaagaagaaggcaatccgtcctcaacctcatgactcattcagtgaatcaaggacaaaacattcatagaaagaccactgcatccaccaggaaggtcagcctggccccccaagcaaatcttactgagctggacatctactctcggaggctgtcccaagaaactggtcttgagatttcagaagaaatcaatgaggaggatctcaaggaatgtttctttgatgatatggaatcgatcccagccgttaccacttggaacacttatctcaggtacattaccgtgcacaaatccctcatcttcgtccttatttggtgccttgtgatttttctggccgaagtggccgcatcactggtggtcctgtggcttctgggtaacactccgctgcaagacaaaggaaactccactcacagcagaaacaatagctacgcagtgatcatcacgtccacttcctcatattacgtgttttacatctacgtcggagtggcagatacccttctggcgatgggcttttttcggggacttcctctggtgcacaccctcattactgtcagcaagattctccaccataagatgctgcattccgtgctgcaggcacctatgagcacccttaacaccctcaaggctggaggcattctgaaccggttctccaaagatatcgcgattctggatgatcttctgccactgaccatatttgacttcatccaactgctcctgatagtgataggcgccattgcagtggtcgcagtgctgcaaccttacatctttgttgcaaccgtgccagtgattgtcgccttcatcatgctcagagcctacttccttcaaacttcacagcagcttaagcaacttgaatcagagggccgatcgccaatcttcacccatctcgtgacctcgcttaagggactgtggaccttgagggcctttggcagacagccgtacttcgagactctgttccacaaggcactcaacctgcacactgctaactggtttctttacctgtcgaccctgaggtggtttcaaatgcggatcgaaatgatatttgtgatctttttcatcgctgtcactttcatcagcattttgactacgggcgaaggtgaagggagggtcggcataattcttacccttgccatgaacattatgtccacccttcaatgggcagtcaactcgtcaatcgatgtcgattcgctcatgcgtagcgtcagccgtgtgtttaagtttatcgacatgcctactgaagggaaaccaactaaatccactaagccttacaagaatgggcagctttcaaaggtcatgattatcgaaaactcccatgtgaagaaggacgacatctggccgtccgggggtcagatgaccgtcaaagatctcacggcgaagtacaccgagggtggtaacgcgatccttgaaaacatttccttttcaatctcgcctggtcagagagtgggattgctcgggcgaacgggaagcgggaagtcaacccttctttccgcatttctccggttgctcaacactgaaggagaaattcaaatcgacggcgtgagctgggattcaatcaccctccaacagtggcggaaagcatttggggtgatcccacagaaggtgttcatcttctccggtacttttcggaaaaaccttgatccctacgaacaatggtccgaccaggagatatggaaggtcgccgacgaagtgggacttaggtcggttattgaacaattcccgggcaagctggatttcgtcttggtggatggtggttgtgtgctctcgcatggacataaacagctgatgtgtctcgcgaggagcgtccttagcaaagctaagattttgcttcttgatgagcctagcgcacacttggatccagtgacctaccagattatccggcggactctcaagcaagcgttcgcagactgcacggtgatcctttgcgaacataggattgaagcaatgctggaatgccagcaatttcttgtgattgaagagaacaaagtgagacaatatgattcgattcagaaacttctgaacgaaaggtcgttgtttagacaagcaatatccccatcagacagagtcaaactttttcctcataggaattcatcgaagtgtaagtccaagccacagatcgccgcattgaaggaggaaactgaagaggaagtccaggatacccggctt

SEQ ID NO: 10192 - DNA, 4440 bp, Artificial Sequence
  Description of Artificial Sequence: Synthetic coding sequence
atgcaacggagccccctggaaaaagcctcagtggtatctaagctgttcttctcctggacccggcccattctgaggaaaggttaccgacagagactggaactgtcagatatctaccagatcccgagtgttgactcggccgacaacctgtccgaaaagttggagcgggaatgggatagagagctcgcctcaaagaagaatccgaagctgattaacgcactgcgccggtgtttcttctggagattcatgttctacgggatcttcctgtacctgggagaggtcaccaaggcggtgcagccactcctcctgggcagaatcatcgcgtcctacgacccggataacaaggaggaacggtcgatcgccatctacctggggatcggactgtgccttctgttcatcgtccgcactctgctgctccacccggcgatctttggcctgcaccacatcgggatgcagatgcgcatcgctatgttttcgctgatctacaagaaaaccctcaagctcagctcaagagtgcttgacaaaatcagcatcggtcaactggtgtcgctgctctcgaataatctgaacaagttcgatgaagggttggcgctggcgcattttgtgtggatcgcgccgctgcaggttgccctgcttatgggactgatctgggagcttctgcaagcatcagccttctgcggattgggatttctcatcgtcctggccctgtttcaggccggccttggcagaatgatgatgaagtaccgcgatcagagagctggtaagatatcggagcgcttggtgattacctcggaaatgatagaaaacatccaatcggtgaaagcctactgctgggaggaggcgatggagaagatgatcgagaatctccggcagaccgaattgaaactcacccgcaaagcggcctacgtgcgctacttcaactcgtccgctttcttctttagcggattctttgtggtgttcttgagcgtgctcccctacgccttgattaagggcatcatcctccgaaaaatcttcaccactatcagcttttgcatcgtgctgcgcatggcagtgactcgacagttcccgtgggcagtgcagacctggtatgactcgctgggagcgatcaacaaaatccaagactttctgcagaagcaagagtacaaaactctggagtacaatctcactaccacggaagtggtcatggaaaatgtgaccgccttctgggaagaaggatttggagaattgttcgagaaggctaagcagaacaacaataaccgcaagaccagcaatggcgatgactcacttttctttagcaacttctccctgctggggaccccagtcttgaaggatatcaatttcaagattgaacgcggacagctgctggcagtggccgggtcaactggggccgggaaaacctccctgctgatggtgattatgggagaactcgaaccttcggaaggcaagatcaagcattccggccgcatcagcttttgttcccaattcagctggatcatgccaggaacgatcaaggaaaacatcatcttcggagtctcctacgatgaatacaggtacaggtcggtcatcaaggcatgtcagctggaagaggatatctcgaaattcgctgagaaagataacatcgtgctgggggagggtggaatcaccctctcgggaggacagcgggcccggatttcgctggctagagccgtctacaaagacgcagatctgtaccttctcgattcaccgttcggatacctcgatgtgctcaccgaaaaggagatatttgagtcttgcgtgtgcaagctgatggcgaataagacgagaatcctcgttacttccaagatggaacatctgaagaaggcagataagattttgatcctccatgagggatcatcttacttttacggaactttctcggaactccaaaacctgcagccggacttctcctccaaactgatggggtgcgacagcttcgaccagttcagcgcagaacggcgcaattcgatcctgaccgagactctgcacagattctcactcgagggagacgcgcctgtatcctggaccgagactaagaagcagtcgttcaagcagactggcgaattcggggaaaagcggaaaaactccatcctgaacccgatcaattcgattcggaagttttccatcgtccaaaagacccccctccaaatgaatggcattgaagaggactccgacgagcctctggagcggcgcctgagcctggtgccggactcggagcaaggtgaagccattttgcctcggattagcgtcatctcgaccggaccaactttgcaagcgcggaggagacaatcggtgctgaatctgatgacccactcagtgaaccaaggccagaatattcacagaaaaactaccgcctcgactcgaaaggtcagcctcgctccgcaggccaacttgaccgaactggacatttactcgcggcgactgagccaagaaaccggcctggaaatctccgaggaaatcaacgaagaagatctgaaagagtgcttcttcgatgatatggaatcgatccccgcagtgaccacttggaacacctacctgcgctacatcaccgttcacaaatccctgattttcgtgcttatctggtgcctcgtgatcttcctggccgaggtcgccgcatccctcgtcgtgctgtggctgctggggaacacccctctgcaggataagggaaactcgacccactcgcgtaacaactcgtatgcagtgatcattacctctacctcgtcctactatgtgttttacatctacgtgggagttgcggataccctcctggcgatgggatttttccgggggctcccactcgtgcacactctgatcacggtatcgaaaatcctgcaccacaaaatgctccacagcgtgctgcaagcgccgatgtccactttgaatactctgaaggcaggggggatcctgaatcgcttttcgaaggacatcgctattctggacgacctgctgccgttgaccatctttgatttcatccagctgcttctgatcgtgatcggcgcgatcgcggtggtggctgtgctgcagccgtacattttcgttgcaactgtgcctgtcattgtggcattcattatgcttagggcctacttccttcagacctcgcaacaactgaaacagctggagtcggaaggccgctccccgatcttcactcacctcgtgacttcgttgaaaggtctgtggaccctgcgggcttttggacgccaaccgtattttgagactctctttcacaaggccctgaatctgcacactgcgaactggtttctctatctgtccaccctgcggtggttccagatgagaatcgaaatgatcttcgtgatcttcttcatcgcggtgacgttcatctcaattctgacgactggagagggtgaaggccgcgtgggaataatcctgaccctggccatgaacatcatgagtactctgcagtgggccgtcaactcgagcatcgacgttgacagcctgatgcgctccgtctcgcgcgtgttcaagtttatcgacatgccaaccgagggaaagccgactaagtccaccaagccatacaagaacggacagctttccaaggtcatgattattgaaaactcccacgtcaaaaaggacgatatctggccttcgggagggcagatgaccgtgaaggatctcactgcaaagtacactgaaggaggaaacgctattttggagaatatctccttctcaatctccccaggccagcgggtgggactgctgggccgcaccgggtccggaaagtcgaccctgctttcagcctttctgcggcttctgaacaccgagggagagatccaaatcgatggagtctcctgggattccatcactctgcagcagtggcggaaggccttcggagtgatcccccagaaggtctttatcttttccggtactttccggaaaaatcttgacccatacgaacaatggtccgaccaagaaatctggaaggtggctgacgaagtcggcctccgctctgtcattgagcagttcccgggcaaactggactttgtgctggtggacggaggctgcgtgctgtcccatggacacaaacagctgatgtgtctggcccgctctgtgctctcaaaggcgaagatcctgcttctggatgaaccgtccgcgcatctggatccagtgacctatcagatcatccggcggactctgaagcaggcctttgctgactgcaccgtcatcctgtgtgaacatcggatcgaagcaatgctggaatgccaacagttcctggtgatcgaagagaacaaagtcaggcagtacgattcgatccaaaagctcctgaacgagagatcgctcttcaggcaagccattagcccaagcgaccgagtcaagctcttccctcatagaaactcgtcgaagtgcaaatcgaaaccgcagatcgccgccctgaaggaagaaactgaggaggaggtacaggacactagactc

SEQ ID NO: 10193 - DNA, 4440 bp, Artificial Sequence
  Description of Artificial Sequence: Synthetic coding sequence
atgcaacggtcaccactggagaaagctagcgtcgtttccaaattgttctttagctggactagaccaattctccggaaggggtatcggcagcggctggagctttctgatatataccagattccaagtgtggattccgcagataatctcagtgaaaagctcgagcgagaatgggaccgcgaactggcctctaaaaagaatccgaagctcatcaacgcacttcggcgctgttttttctggcggttcatgttctacggaatctttctgtatctgggcgaggtcactaaggccgttcagcccctgctgcttggccggatcatcgcctcctacgaccccgataataaggaggaacgcagcatcgctatctatctgggcattgggctgtgtttattattcatcgtccggaccttgctcctgcatccagccatatttggcttacatcatatcggcatgcaaatgcggatagccatgttctccctgatctataaaaaaacccttaagctaagcagccgagtacttgacaagataagtatcggacaactcgtttctcttctgagcaataacctgaacaagtttgatgagggccttgccctggcacacttcgtgtggatcgcgccacttcaggtagccctgctaatgggcctgatctgggagctcttgcaggcttctgcgttttgcggtctcgggtttctgattgtccttgcactgttccaagctggactgggtagaatgatgatgaagtaccgtgaccaaagggctggcaagatttccgaacgactggtgattacatcggagatgatagagaatatccaaagcgtgaaagcttactgttgggaggaggccatggagaagatgatcgaaaatctcaggcagaccgaactgaagctaactagaaaggccgcttatgtgcgctactttaacagctccgctttctttttctctggttttttcgtcgtgtttcttagcgtgctgccttacgccttgatcaagggcataatcttacggaaaatctttacaaccatttctttctgcattgtgctgcggatggcagtaacacgacaattcccctgggccgtccagacatggtatgactctctgggcgctataaataagatccaggactttctgcaaaaacaggagtataagaccctggagtataatctgactactaccgaggtggttatggaaaatgtaacagcgttctgggaggagggatttggtgaactttttgagaaggctaagcagaacaacaataaccgaaagacttcaaatggcgacgactctctgttcttcagcaacttcagcctcctgggcacaccagtacttaaggatatcaacttcaaaatcgagagggggcaattactggctgtggcaggctcgactggcgcggggaagaccagtttgttaatggtgattatgggcgaacttgaaccttctgagggcaagatcaaacactccggcaggatctccttctgttcacagttctcatggatcatgccaggaacaatcaaggaaaatattatctttggtgtgtcatacgacgagtataggtatcggagcgtgatcaaggcttgccagctggaggaagacatcagcaaattcgcggaaaaggataacattgttctaggggagggtgggataaccttatctggaggccagagggcgcgcatttctcttgccagggcagtgtacaaagatgccgacctctacctcctcgacagcccattcggctacctggacgtcttaaccgaaaaagagatattcgagtcatgcgtgtgcaagctcatggcgaacaaaacccgaatactggtgacatccaaaatggaacacctgaaaaaggcggataaaatcctgattttgcacgaagggtcatcctatttttacggcacattttctgaacttcagaatctgcagcccgactttagttcgaaactgatgggttgtgatagtttcgatcaattctctgcggagcggcgaaatagcatcctcacggaaacgcttcaccggttctctttggagggagacgccccggtcagctggactgagacgaaaaaacagagcttcaagcagacgggggaattcggcgaaaagcggaagaacagtattctgaatcctattaactccattcgcaaattttcaatagtacaaaagacgcccctgcagatgaacgggatcgaagaggactcagacgagcctctcgagcggcggctgtctctggtgcctgactccgaacagggtgaggcaatccttccccgcatctctgtgatctctaccggacctacactccaggcacggagacgccaatccgtcctaaatctcatgacacactccgtcaatcagggccagaatatccacaggaaaaccactgcgtcgacgaggaaggtgtctttggcaccacaggcaaacctgaccgaattggatatctatagcaggcgtctgagccaggagacaggactcgagatctccgaagaaatcaacgaggaagatctgaaagagtgcttctttgacgacatggagtccattcctgcggtaacaacttggaacacatatcttcgctacatcacagtgcataagtctcttatctttgtcctgatttggtgtttggttatctttcttgctgaggtggccgcgtcactggtggttctatggctgctgggtaacactccactgcaggataagggcaatagtactcatagtcgtaacaatagttatgccgtcatcataacctctacaagttcatactacgtgttttatatctacgtgggagtcgccgacacactgctggctatgggcttcttccggggcctacccctggtgcatactctgatcactgtaagcaaaatcctgcaccacaaaatgctgcatagcgtcctgcaggccccaatgagtacactcaacacccttaaggccggggggatattgaaccggtttagtaaggacatcgctatcctggacgacctgctgcccttaactatcttcgattttattcaactactgttgatcgtcatcggcgccatagccgtggtggcagtgctgcaaccatatatcttcgtcgccactgttcccgttatcgtcgccttcattatgctgagagcctatttcctccagacaagccagcagcttaaacaactggaatccgaggggagatctccaatattcactcacttggtgactagcctgaaaggtctgtggactttgcgggcgttcggaagacagccttattttgagactttgtttcacaaagcactgaacctgcacacagcgaattggtttctgtacctgtccacactgcgctggttccagatgagaattgagatgatattcgtgattttcttcatcgccgtcaccttcatttctattttaacaacaggggaaggggaaggccgagtcgggattatcctgacattagccatgaacatcatgagcacattgcagtgggccgttaacagcagcatagacgtcgacagcctcatgcgctccgtcagtagggttttcaaattcatagatatgccaactgagggaaagccaacgaagagcacaaaaccttataaaaacggacaactgagtaaggtgatgatcatcgagaattctcacgtcaagaaggacgacatatggccttccggcggccaaatgactgtcaaagatctgactgcgaaatatactgagggaggcaacgccatccttgaaaacatctccttttccataagtcctgggcagcgcgtagggctgctgggccgtaccgggtccggcaagtctacgctgctgtcagcatttctgcgcctactaaatacagaaggcgagattcagatcgacggagtctcctgggactcgatcacactccagcagtggcgtaaagctttcggcgtgatcccacagaaggtttttatcttttctggaaccttcagaaagaatctggacccttacgaacagtggtctgaccaagagatttggaaggttgccgatgaggttggtctgcggtccgtcattgagcagttccccggcaagctggacttcgtgctggtagatggaggttgcgtgctgagccacggacacaagcaattgatgtgcttggccaggagcgttttgtctaaagcaaagatacttttgttagacgagccgtccgcccatctcgaccctgtcacatatcagatcatcagacggaccctcaaacaggcattcgcggactgcaccgtgatactgtgtgagcatcggatcgaggcgatgctcgaatgtcagcaattcttggttatcgaggagaacaaggttcggcaatatgattccattcagaaacttctaaatgaacgcagtctattcaggcaagccatatctccaagcgatagggttaaactgttccctcatagaaattcgtcaaagtgtaagtccaagcctcagatcgccgctttaaaggaggaaacagaggaagaagttcaagatacacggtta

SEQ ID NO: 10194 - DNA, 4440 bp, Artificial Sequence
  Description of Artificial Sequence: Synthetic coding sequence
atgcaacggagccctctcgagaaggcctccgtcgtgtcaaaacttttcttcagttggactaggcccatccttagaaagggatatcgacagcggcttgaactttcggatatctatcaaatcccctcggtggactcggcagataatctgtctgaaaagctggagcgagaatgggatagagaactggccagcaagaagaacccaaagctgataaacgctcttagaagatgtttcttttggcgcttcatgttctacgggattttcctttaccttggtgaggtgaccaaggccgtgcaacctctgcttctcgggcgcatcatagcatcctacgatccagataacaaagaagaaaggtcgattgcaatctaccttggaatcggactttgtcttttgtttattgtccggaccttgcttctgcacccggccattttcggattgcatcacattggaatgcaaatgagaatcgccatgttctcgcttatctacaaaaagactctgaagttgtcgtcgcgtgtgttggataagatttccattggacaattggtatcactgctctcgaacaacctgaacaagttcgatgaaggtcttgcactggcccacttcgtctggatagcccctttgcaagtggcactgctcatggggctgatttgggaactcctccaagcatccgcgttttgcggcctcggatttcttatagttctggcattgttccaggccggtctgggtcgcatgatgatgaagtatcgcgatcagcgggcgggcaagatttcggaaaggctggtgattacgtcagagatgatcgagaatatacaatccgtgaaggcctactgttgggaagaagcgatggagaaaatgattgaaaatcttcgccagaccgaacttaagctgactaggaaggccgcatacgtgaggtactttaactcttcggcattctttttcagcgggttcttcgtcgtgtttctgtcagtgctcccttacgcacttatcaagggcatcattctcaggaagattttcaccaccattagcttttgtatcgtccttaggatggcggtgaccagacaatttccatgggcagttcaaacttggtacgattcacttggtgccattaacaaaattcaagacttcctgcaaaaacaggagtacaagaccctggaatacaaccttactaccactgaagtggtcatggaaaatgtgactgcattttgggaagagggatttggagagctgttcgagaaggcaaagcaaaacaataacaatagaaaaactagcaacggcgatgatagcctgttcttctcaaacttctcgctgctcggaactccagtgctgaaggacattaactttaagatcgaaagaggccagctcctcgcagtcgcagggagcactggtgctggtaagacttcgcttctgatggtgataatgggagaattggaaccctccgagggcaaaatcaagcattcgggcagaatctccttttgttcccagttttcatggattatgcccggtactataaaggaaaacatcatttttggagtctcctacgatgagtacaggtaccgctccgtgatcaaggcttgtcaactggaagaagatatatccaaatttgcggaaaaggataacatcgtgcttggagaaggtggcatcactctgtcgggaggtcagcgtgcacggatttccctggcacgagcagtgtacaaggacgctgacctttacttgctggattcgccttttggttacctcgatgtcctgacggaaaaggagatatttgaaagctgtgtctgtaaactcatggcaaacaagactcggatcctcgtcacttcaaaaatggagcatctgaagaaggcagacaaaatcctcatcctgcatgagggtagctcttacttttacggcaccttcagcgaacttcaaaacctgcaacctgacttcagctcgaagctcatgggttgtgactcttttgatcaattttcggcagaaagacgcaactccattctgaccgaaaccctccaccgcttttcgcttgaaggtgacgcccccgtgtcctggacggaaaccaagaagcaatcgtttaaacaaacgggtgaatttggcgagaagcgtaagaacagcatcctcaacccgattaactcaatccgtaagtttagcattgtgcaaaagactcctctgcagatgaacgggattgaagaggattccgacgaacctctcgagcggagactctcgctggtgccggattcagagcaaggtgaagcgatccttccccggatttctgtgatctcgactggaccaacgcttcaagcacggagacggcagtcggtccttaaccttatgacgcatagcgtgaatcagggacagaatattcacagaaagaccaccgcgtccacgcgcaaggtgtccctggcaccccaagccaatcttaccgagctcgatatctactcaaggcggctctcgcaagagactggacttgagatttccgaagaaatcaacgaggaggacctgaaagaatgtttctttgatgacatggagagcatccccgccgtcacgacttggaatacctatctcagatacataaccgtccataagtcgcttatctttgtgctgatttggtgcctggtgatttttctggcagaagtggcggcatcgctggtggtgctgtggctgcttggaaatactcctctgcaagataaaggaaatagcactcatagcagaaacaactcctacgcggtgatcattacttcgacctcatcctactacgtgttctatatctatgtcggagtggctgacacccttctcgctatgggattctttagaggcctccctctcgtgcatacccttattaccgtgtccaaaattctgcaccacaagatgctgcattccgtcctgcaagcacctatgtccactctgaatacgctcaaggcaggcgggattcttaaccgattttcaaaggatatcgcaattctggatgatctgctgccactcaccatctttgatttcatacaattgttgctcatcgtgatcggcgcgattgccgtggtggcagtgcttcagccatacatttttgtggcaactgtgccggtcattgtggcatttatcatgctccgggcatactttctgcagactagccaacagcttaaacaattggagagcgagggaagatcgccgattttcactcatttggtaacctcactgaagggactgtggaccctgcgcgcgtttgggagacagccctacttcgagactctttttcacaaggccctgaatcttcataccgcaaattggttcctgtacctctcgactcttcgctggtttcaaatgaggattgaaatgatctttgtcattttctttattgcagtgaccttcatttcgatcctgaccaccggagagggagaaggcagagtcggaatcatactgaccctcgcaatgaacatcatgtccaccctccaatgggctgtcaattcttctatcgacgtggactcacttatgagatcagtgtccagagtgttcaagtttattgatatgccaactgaaggcaagccaaccaagtcgaccaagccatacaagaacggtcagctctcaaaggtcatgattatcgaaaactcgcatgtgaagaaagatgatatctggccttccggcggccaaatgaccgttaaagatcttaccgcaaaatacactgaagggggtaacgcgatccttgagaacatatcgttctcaatttccccgggacagcgggtgggtctgctgggtcggacgggaagtgggaagtcgactctgttgtccgcctttcttagactgctgaatactgaaggcgaaattcagatcgatggcgtgagctgggactcaatcactcttcaacagtggagaaaggcctttggcgtgattccccagaaagtgtttatcttttcgggaaccttccggaagaatctcgatccgtacgaacagtggtcagatcaggagatctggaaagtggcggacgaagtgggattgcgctcagtgatagaacaattcccgggtaagctggattttgtgcttgtggatggtggctgcgtgctttcacatggtcataagcagctgatgtgtctggccagatcagttctctcaaaagcaaagattctcctgttggacgaaccatcggcccacctcgacccagtgacttaccaaatcatacgccggacccttaaacaagcattcgccgattgcactgtaattctttgtgaacatagaattgaggcaatgctcgaatgccaacagttcctggtgatcgaagaaaacaaagtgcgacagtatgattcaatacaaaaactgctgaatgaacgaagcctttttagacaagcgatatcaccttcggacagagtgaaactgtttccccacaggaattcgtcaaagtgtaaaagcaagccgcagattgcagcattgaaggaagaaaccgaagaagaggtgcaggatacccgtttg

SEQ ID NO: 10195 - DNA, 4440 bp, Artificial Sequence
  Description of Artificial Sequence: Synthetic coding sequence
atgcaaagatcgcctcttgaaaaggcctcggtggtttctaaactgttcttttcctggactagaccgattctgcggaaggggtaccgtcaacggcttgaactgtcagacatataccaaattccttcagttgatagtgcggacaacctgtccgagaagttggaacgcgaatgggatcgggaactcgcatctaaaaagaacccgaagctgattaatgcactgagaagatgtttcttttggcgatttatgttttacgggatctttctctacctcggagaagtgactaaagccgtgcagccgctgctcttgggacgcattatagcttcgtacgatcctgataacaaagaagagaggtcaattgccatttacctgggtatcggactgtgcctcttgttcatcgtgaggaccctgttgcttcaccctgcgatttttggacttcaccatataggaatgcaaatgcggattgcaatgttcagcctgatttacaaaaagacgttgaaactgtcctcacgtgtgctcgataagatttcgatcggacaactggtgtcattgttgagcaataacttgaataagttcgatgagggattggcacttgctcattttgtgtggattgccccacttcaagtggcgttgcttatgggactgatctgggagctgcttcaggcgtcggcattttgcggactcggatttctgattgtgctggcgctgtttcaggcaggacttggcagaatgatgatgaaatacagggatcagcgagcaggcaaaatctctgagcgtctcgtcatcacgtcggaaatgattgaaaacattcaatccgtcaaggcctactgctgggaggaagcaatggagaagatgattgagaaccttcgtcagaccgaactgaaactgaccagaaaggccgcctacgtgcggtactttaactcctccgccttcttcttctccgggttttttgtggtgtttctctcggtcctcccatacgcactcattaaagggatcattcttagaaaaatcttcacgactatttccttttgtatcgtccttagaatggcagtgacgcgtcaatttccttgggcagtccaaacgtggtacgatagcctgggagctatcaacaagatacaagatttcctgcagaagcaggaatacaagactcttgaatacaatctgactactaccgaagtcgtgatggaaaacgtgaccgcgttttgggaagagggctttggtgaattgtttgaaaaggccaagcaaaacaataacaaccgaaagacctcaaacggtgacgactccctcttcttttctaatttctcgcttcttggcactcccgtgctgaaggacattaactttaagattgagcgcggtcagctcctggccgtcgcaggatcaaccggagcaggaaagacttcgctcctcatggtgataatgggtgagctggagccatcagaaggaaagattaagcattccggtaggatttcgttctgttcgcagttttcgtggattatgcctggtactattaaggaaaacatcatttttggtgtctcctatgatgaataccgctacaggtcggtcattaaggcgtgtcagctggaagaggacatctccaagtttgctgagaaggacaatatcgtgcttggagaaggagggatcaccctgtccggtggacaaagagcccgtatttctctcgcacgtgctgtgtacaaggatgcggacctgtacctccttgatagcccctttgggtatttggacgtgctcactgaaaaggagatttttgagtcgtgcgtctgtaagctgatggcaaataagaccagaattcttgtcacttcgaagatggaacatctcaaaaaggccgacaaaattctcatactgcatgaggggtcgtcctacttttacgggactttttcggaacttcaaaaccttcaaccagattttagttcgaagttgatgggttgtgacagcttcgaccaattctcggccgaacgccgcaactcaatactgacggagactctgcacaggttctcccttgaaggagatgccccggtttcatggaccgaaactaagaagcaatcgtttaagcaaactggcgaattcggagagaagagaaagaacagcatcctgaacccaatcaactccatcaggaaattctccattgtccagaaaacccctcttcaaatgaacgggattgaagaggactccgatgagcctctggagagacgactttcgttggtgccagattcagaacagggagaagcaatattgcccagaatctcggtgattagcacgggtccaaccctgcaagcacgcaggagacaaagcgtcctgaacctgatgacccactccgtgaaccaaggacagaacatccatcgtaagaccactgcctccacgcgcaaagtgagcctggcacctcaggcaaatcttaccgaactggacatctattctaggaggctctcgcaagaaactgggctcgaaatttccgaagaaatcaatgaggaagatcttaaggaatgcttctttgacgatatggagtccataccagctgtgactacctggaacacgtatctccgatacatcaccgttcataagtcattgatattcgtgctcatttggtgtctcgtcatttttctggctgaagtagcagcaagcctcgtcgttctgtggctccttggtaacacgccgcttcaggataagggcaatagtacccactcgcggaacaatagttacgcggtgatcataacctcgacctcgtcctactacgtgttctacatttacgtcggtgttgcagataccctcctggcaatggggttctttcgggggctccccctggttcataccctgataactgtctcgaagatacttcatcataagatgctgcatagcgtgctgcaagcccctatgtccactcttaatacccttaaagcgggtgggatccttaaccggttctccaaggatattgcaattctggatgatctccttcctctgactatctttgactttatacaacttctgctcatcgttattggggcaatagcagtggtggccgtattgcagccttacatatttgtggccactgtccctgtgattgttgccttcatcatgcttcgggcatactttcttcaaacctcgcagcagcttaagcagctggaatcggagggaagatcaccaattttcactcatcttgtgacctccctcaaaggtctttggacccttcgcgcattcgggcgccaaccatactttgaaaccctcttccataaggcactcaatcttcacactgcaaattggtttttgtacctgagcaccctccggtggtttcaaatgaggattgaaatgatctttgtgatcttctttatcgcagtgacctttatctcaattctcactactggcgaaggcgagggccgtgtgggaatcattcttactctggcgatgaatatcatgtcgacgctgcagtgggcagtgaactctagcatagatgtcgattcgctcatgaggagtgtgtcacgggtctttaagtttatcgacatgcccactgaaggtaaacccaccaagtcaactaagccatacaaaaacggccaactgtcaaaagtcatgattatcgaaaactcccacgtgaaaaaggatgacatttggccttcaggcggacagatgactgttaaggacctcactgcaaagtacactgagggtggtaacgcgattctggagaatatcagcttctccatctcgccaggccagagagtgggtctgctgggaagaaccggatcgggcaagagcaccttgctttcagcctttctccgacttctgaacactgaaggcgaaatacagatcgatggcgtttcctgggattcaatcaccctccagcagtggagaaaggcctttggggtgattcctcagaaagtgtttatcttttcaggaactttccgaaaaaacctcgatccttacgagcagtggtcggaccaagaaatttggaaggtggcggacgaggtgggcctgcgctcagtgatcgagcagtttcccggcaagctggatttcgtgcttgtcgatggtggatgtgtgctttcccatggacacaaacaacttatgtgcctcgcaaggtccgtgttgtccaaagcaaagatacttctcttggacgagccttcggcacacctggacccggtgacgtatcagattattcggcgtactctgaaacaggcgtttgcagactgcactgtgatcctttgcgaacaccgtattgaagccatgcttgaatgtcagcagtttctggttattgaagagaataaggtgagacaatacgattccattcaaaaacttctgaatgaaagaagccttttccggcaagcaatttccccctccgaccgggtgaaactgttcccccatcggaattcatcgaaatgcaagtcgaagccacaaattgcagcactcaaggaagaaaccgaagaggaagtccaagatacccggttg

SEQ ID NO: 10196 - DNA, 4440 bp, Artificial Sequence
  Description of Artificial Sequence: Synthetic coding sequence
atgcagagaagtcctcttgaaaaagcgagcgtggtatccaaactatttttctcgtggacaaggcccatcctccgcaaaggatatagacaaaggctggagcttagcgacatctaccagatacctagcgtcgatagcgccgataacctgtcagaaaaactggaaagagagtgggacagggaactcgcatccaaaaagaacccgaagctcatcaacgcgttgaggcggtgctttttttggcgcttcatgttctacggaatcttcctgtatctcggcgaagtgacaaaggccgtccagccacttcttttgggaaggataattgccagctatgatcccgacaacaaagaggagcggagcattgccatttacctgggcatcggcctgtgcctgttgttcatagtcagaacccttcttcttcatccagcaatatttggattgcaccatatcggaatgcagatgaggatcgcaatgttttccctgatctacaagaaaaccctgaaactgtccagcagggtactcgataagatctcaatcggacagctggtgtctctgctgtcaaataaccttaataaattcgatgagggactggctctcgcccactttgtgtggatcgccccattgcaagtcgcactcctgatgggcctgatctgggaactgctgcaggcaagcgcattttgtggactgggcttcttgatcgtgttggccctatttcaggctggtcttggcagaatgatgatgaaatatcgggatcagagagcaggaaaaataagcgaaagactggtgatcacatcagaaatgattgaaaatatccagtctgtgaaggcttactgttgggaagaagcgatggaaaaaatgatcgagaatttgaggcaaaccgaactgaaattgacaaggaaggcagcctacgtcaggtactttaatagtagcgcttttttcttttctggtttcttcgtggtgttcttgagcgttctcccttacgctttaattaaggggatcatccttcgtaagatcttcacaactatctctttttgcatcgtgcttcgcatggctgtgacccgacagttcccttgggctgtgcagacatggtacgactccttgggggctattaacaaaattcaagattttctgcagaaacaagagtacaaaacactggaatacaaccttacaacaacggaagtggtgatggagaatgttacagctttctgggaggaggggttcggcgagctgttcgagaaagccaagcagaacaacaacaaccgcaaaacaagtaatggcgatgactccctgttcttctcaaactttagcctgctgggcactcctgtgctgaaggatatcaacttcaagatcgagagaggtcaactgctggcagtggctgggagcaccggcgccggcaagactagcctgctgatggtcattatgggcgaactggagccttccgagggcaagattaaacacagcggtaggatcagcttctgctctcagttcagctggattatgcctgggacaatcaaggagaatatcatttttggagtcagctatgacgaatatagatacagaagcgttataaaagcttgtcagctggaggaggatatcagtaagtttgcagaaaaagataacatcgtcctcggcgagggtggaatcactctcagcggaggacaacgcgcaagaatctcactggctagggccgtatacaaggatgccgacctttatttattggacagtccttttggataccttgatgttctgaccgagaaagagatcttcgaaagctgcgtttgcaaactgatggctaacaagaccaggattctggtaaccagtaaaatggagcacttgaagaaggccgataagatcctgatcctgcatgagggaagctcttacttctacggcacattttccgagttgcagaacctgcaacctgacttttcttcaaaactgatgggctgcgattcattcgaccagttctctgcagagcgcaggaattctattcttacagaaaccttgcacagattcagcctagagggagatgcccctgtgtcgtggaccgaaacaaaaaagcagtcgtttaagcagaccggtgaattcggtgagaaacgcaagaactccattctgaacccaataaactcaataaggaagttcagcatagttcagaagactccactccaaatgaacggtatcgaggaagactccgatgaacccctggagcgtaggctgagtttagtgcccgattcagaacaaggtgaggcaatactgcctcgaatctccgtgatatccactgggccgactctacaagcaaggaggcgtcagtcagtcctcaatcttatgactcatagcgtgaaccagggacaaaacatccaccgcaagacgacagcgagcactagaaaagtcagcctggccccacaggctaacctaaccgaactggacatatatagcaggcgcctcagccaggaaacaggcctagagatttcggaggagataaacgaggaagacctcaaggaatgtttctttgatgatatggagagtatcccagcagtgactacatggaatacctatctgcgctacattaccgtacacaaaagcctaatctttgtcctgatttggtgcttagtgatctttttagctgaggttgctgcatcacttgtcgtcctctggctgctgggaaacacccctttacaggataagggcaacagtacccactctagaaataacagctacgcagtcattataaccagcacaagctcctactacgttttctacatctacgttggcgtagccgacaccctgttggctatgggtttttttagaggccttccgctggtgcatacactgatcaccgtgtctaagatactccaccataaaatgttgcatagcgtgctccaagctccaatgtctacactaaatacattaaaagcggggggaattctgaatcgattcagcaaggacattgcaattctggacgatcttctgcctctgacaatctttgactttattcagctcctgctgattgtgataggcgccatcgctgtggtggcggttctacagccctacatattcgtcgccacggtccctgttatcgtggcattcatcatgctgagagcttactttctgcagaccagccagcaactcaagcagctggaaagcgagggcagatcccccatcttcacacatcttgtgacctctctgaaaggcctttggactcttcgcgcttttggaaggcaaccatacttcgaaaccctgtttcacaaggcgctgaacctgcatacagccaactggttcctgtatttgtcaactcttcgatggtttcagatgaggatcgagatgatcttcgttatcttttttatagccgtgaccttcatttccatcctcaccacaggtgaaggagagggacgggtgggaatcatcctgacgctggctatgaacattatgagcacactgcagtgggcagtgaatagctctatcgatgtcgatagtctgatgaggtccgttagtcgagtcttcaaattcatcgacatgcctacagaaggaaagccgaccaaatccaccaagccgtacaagaacggtcagctttccaaggtcatgataatagagaatagccatgttaagaaggatgacatttggccttccggcggccagatgacagtgaaagatctgactgcgaagtatactgagggagggaacgccatcctcgagaacatttctttctccatctccccgggccagcgagtgggccttctgggacgtacaggcagtggcaagagtacactcctgtcagcttttctcagattgcttaacactgagggcgagattcagatcgacggcgttagctgggattcaataacactgcaacagtggagaaaggcttttggggtcatcccccaaaaggtgttcatcttctccgggacatttcgcaagaacctggacccctacgagcagtggagcgatcaagaaatctggaaggttgctgacgaagtaggattgaggtccgtgatcgagcagttcccagggaaactcgacttcgtgcttgtggacggtgggtgtgtcctgagtcacgggcacaaacaactgatgtgccttgctaggtctgtgctatcaaaagctaaaatacttttactggatgagcctagcgcacacctggaccctgtcacctatcagattatcaggagaactctgaagcaggccttcgcagactgcaccgtcatcctgtgtgaacacagaatagaggcaatgctagaatgtcagcagtttctggtgatagaggaaaacaaagttaggcagtatgacagtattcagaaactcctcaatgagaggtctcttttccgtcaggccatcagtccaagcgacagggtgaagttgttccctcacagaaactcttccaagtgcaagagcaaacctcagattgctgcattgaaggaagaaacagaggaggaggtccaagatacaagactg

SEQ ID NO: 10197 - DNA, 4440 bp, Artificial Sequence
  Description of Artificial Sequence: Synthetic coding sequence
atgcagcggtctccactcgagaaggcatcggttgtgtctaaactgtttttctcctggacccggccaatccttagaaagggatataggcagcgactggaactcagcgatatctatcagattccctctgtggatagtgcggataacctcagcgagaaacttgaaagggagtgggatagggagctggcttcaaaaaagaatcctaagctgatcaacgccctccgcagatgcttcttttggaggtttatgttctatggcatctttttgtacctcggagaggtgaccaaagcggtgcaacctctcctgctgggtaggatcatagctagttacgatcccgataacaaagaggaaaggtccatcgccatttatctcggaattggactgtgtcttttgttcatcgtcagaactctgctcctgcatcctgccatcttcgggttgcaccacattggtatgcagatgcggattgccatgtttagcctcatttacaagaagactcttaagctgagttctcgtgttctggacaagatctcaatcggacagctggtcagcttgcttagcaacaatcttaacaaattcgacgaggggctggcgttggcgcacttcgtctggatcgctccactccaggtcgctttgttaatgggtttgatatgggagcttctgcaagctagcgccttctgtggcctcggattcctgatcgtgctggctctcttccaggcaggattgggcaggatgatgatgaagtacagggatcaaagggctgggaaaattagcgaaagacttgtgatcactagcgagatgatcgaaaatatccagagtgttaaggcctattgctgggaggaagccatggagaagatgatagagaatcttagacaaaccgagcttaagttgaccaggaaagcagcctatgtccgctatttcaactcttctgcctttttttttagcggattcttcgtggtctttcttagcgtcctgccatacgcactgatcaaagggattatcctcagaaagatttttaccactatcagtttttgcatcgtccttaggatggccgtgacccgtcagttcccctgggctgtgcagacatggtacgactctctcggagctatcaacaagatacaggactttcttcaaaaacaagagtataagactctcgaatataacttaaccaccacagaggttgtgatggaaaatgtcaccgccttttgggaggagggcttcggagaactttttgaaaaagcaaagcagaataacaacaacaggaaaacctctaacggtgacgacagccttttcttcagcaacttttcgcttctgggcacaccagttctcaaagatatcaattttaaaatcgaacgcggtcagctcctcgccgtcgcgggaagcactggggctggaaagacaagcctgcttatggtgatcatgggcgagcttgagccttccgaaggaaaaatcaagcacagcggacgcatttcattttgctcacagttttcttggattatgcctggaacaattaaggaaaatattattttcggcgttagctatgacgagtacaggtatagaagcgtgattaaagcgtgccagcttgaggaggacattagcaaatttgctgagaaggacaatattgtcttgggtgaaggtggaattaccctgtctgggggacagcgggctcgaatctccctggccagagccgtatacaaagacgccgatctgtacctgctcgactccccattcggttacctggatgtgctcacagaaaaagaaatctttgaaagctgtgtatgcaagctgatggcgaacaaaaccaggattctcgtgacgtccaagatggaacatctgaagaaagctgataagatacttatcctgcatgagggcagttcttatttctatggtacattttctgagctgcagaatctgcaacccgactttagtagcaaactgatgggatgcgattcattcgatcaatttagcgctgaacgccggaacagcatcctgacagagactttacataggtttagcttagagggcgatgcacctgtgtcctggacggagaccaagaaacaatcatttaagcaaactggagagtttggagagaagaggaagaacagcattctcaaccctatcaactctatacgcaaatttagcattgttcagaaaaccccccttcaaatgaacggaatagaagaggattccgatgaaccactggaacgcagactgtccttggtgcccgacagcgaacaaggagaggccattcttcctcgcatcagcgtaatatctaccggtccaaccttacaggccagaaggagacagagcgtcctgaacctgatgacacatagtgtcaaccaaggtcagaatattcatcgtaagactaccgcatcaacgaggaaggtgagcctggccccacaagctaacctgaccgaattggatatctatagtaggaggctctcacaggagacaggtctcgaaattagcgaggaaataaacgaggaagatctgaaggaatgcttcttcgacgacatggagtcaatcccagccgtgactacgtggaacacataccttcgctacattacagtccataaaagtctgatatttgtccttatctggtgcctcgttatcttcctggcggaggtcgctgcatctcttgtggtcctgtggctgttgggtaatacaccacttcaggacaagggcaatagcacacactcacgcaataatagttacgctgtaatcattacgtccacttcttcatactacgttttctacatctacgtgggcgtcgcagacacactgctcgcgatggggtttttcagaggactgccactcgttcacaccctcattaccgtcagcaagattcttcatcacaagatgcttcacagcgtgctgcaggctcctatgtccaccctgaacaccctcaaagcgggaggaatcctcaacaggtttagcaaggatattgctattctggacgatcttctgccgctgactatttttgactttatacaacttcttctcattgttatcggagcaatcgctgtggtggcagtgttgcaaccgtatatctttgtagccacagtgccagtcattgtagcattcatcatgctgagagcgtattttctccagactagccagcaactgaaacaacttgagtccgaaggaagatccccgattttcacccacctggtgaccagcctcaagggactgtggaccctgcgggcttttggaaggcagccatactttgaaaccctgttccacaaggcgttgaatcttcacacagctaactggttcctgtatctgagcaccctgcgatggttccaaatgcgcatcgaaatgatattcgtgattttcttcatagccgtaacattcatctccatcctcactacaggcgaaggggagggccgtgtaggaatcatactgaccctggcaatgaacatcatgtccacactgcagtgggcagttaacagcagcatcgacgtggacagcctgatgaggtcagtatccagggtgttcaaatttatagatatgccaaccgaaggtaaaccaacaaaaagtacaaaaccgtacaagaacggtcaactctcgaaggtgatgatcatcgaaaacagtcacgtcaaaaaagacgacatttggcctagcggagggcaaatgaccgtgaaggacctcaccgcaaaatacaccgagggtggaaacgccattctggagaacatcagcttctccattagtccaggacagcgagttggcttgcttggcaggaccggctctggaaaatctacacttctcagcgcatttctcaggctgctcaacactgaaggtgagatccagatcgatggcgtaagctgggatagtattactttacagcaatggcggaaggcatttggggtgatcccccagaaagtatttatttttagcgggaccttccgaaaaaacctcgatccatacgaacagtggtctgatcaagagatctggaaagtggctgatgaggtgggcctgagaagtgttattgaacagttccctggcaagctggactttgtgttggttgatgggggctgtgtcctgagtcacgggcataaacagctcatgtgcctggctcggtctgtcttgtctaaggctaagattctgctgctcgatgaaccatcagcacacctcgatcccgtcacataccagattataagaagaacactcaaacaggccttcgcagactgcacagttatcctctgtgagcatcggatcgaagctatgctcgaatgccaacagtttcttgtgattgaagaaaataaggtgcgacaatacgactcaatccaaaaactgctcaacgaacggtcgcttttcagacaggctataagtcctagtgatagggtcaaactgttcccccatcgcaactcttcaaaatgtaagagcaagcctcagatcgccgcattaaaggaggaaaccgaagaagaagtccaggacaccagactg

SEQ ID NO: 10198 - DNA, 4440 bp, Artificial Sequence
  Description of Artificial Sequence: Synthetic coding sequence
atgcagagatcccccctagaaaaagcttccgtcgtatcaaaactgtttttctcttggacacggccaatccttcgaaaagggtataggcagcgccttgaactttcagatatctatcagatcccctcagtcgattcagccgataacctctctgaaaaactcgagagagaatgggatcgggagctggcctctaagaagaaccccaagctaatcaatgctctcaggagatgttttttttggcgatttatgttttacgggatattcttgtacctgggggaagtcactaaagccgtgcagcctcttctcctcgggcgtattatagcctcgtatgatccagataacaaagaagaacgatccattgccatctacctcgggattgggctttgccttttatttatagttagaactctcctgctacatcccgctatttttgggcttcatcacataggaatgcagatgaggatagccatgttttctctgatatataaaaaaacactaaaactgtcttcacgtgtactcgataaaatatccatagggcagcttgtctctctgctctctaacaatcttaacaagtttgacgaaggattggcacttgctcatttcgtttggatcgcccctcttcaggtagcgctgcttatgggactcatttgggagttgctgcaggcctccgctttttgcgggctcgggtttctcatagtgctcgctctgttccaggctggattagggaggatgatgatgaagtaccgcgatcagagggccgggaaaatctctgaaagactggtaatcacaagtgaaatgatcgaaaacatacagtctgtcaaagcctattgctgggaagaagctatggaaaaaatgatcgagaatctaaggcagactgagttaaagctgactaggaaagccgcttatgttagatactttaattcctcagcctttttctttagtgggttttttgttgtgtttctgtccgtcttgccttacgcattaattaaaggaattatactgcgaaaaatctttactactatttctttctgcatcgtgctccggatggccgtaacacggcagttcccatgggctgttcagacgtggtatgattcactgggggctataaacaaaatacaggattttctgcagaaacaggaatataaaactcttgaatataacctcacaacgactgaagtggtaatggaaaatgtcacggcgttctgggaagagggattcggggaacttttcgaaaaagctaaacagaacaataataacagaaaaacatctaacggagatgattctctttttttttctaacttctctctccttgggactccagtactcaaagatatcaacttcaaaatagagcgggggcagttacttgctgtggcaggatctacaggagcagggaagactagtcttctgatggtgatcatgggagaactcgagccctctgaaggaaaaatcaaacattctgggcgcatctctttctgttcacagttttcatggatcatgccaggaacaatcaaagaaaatataatcttcggggtgtcttatgacgaatatcgatataggtccgtgatcaaagcatgccagctcgaagaagatatttccaaattcgctgaaaaagataacatagtcctgggagagggagggattactctatccggagggcagcgagcccgaatctcattggctcgggccgtttataaagatgcggacttatatctgctcgattctccattcgggtatcttgatgtcctcactgaaaaagaaatattcgaatcctgcgtatgcaaacttatggctaataaaactcgaattcttgtaacttcgaaaatggaacacctaaaaaaagccgataagattctcatcctgcatgaggggagtagttatttctatggaactttcagtgaattacagaacctccagcccgactttagttccaagcttatgggatgtgactccttcgatcagttcagtgccgaaaggcgcaattccatattaacagaaactcttcataggttctctttggaaggggatgctcccgtgtcctggacagagactaaaaaacagtccttcaaacagacaggagaattcggagagaaacggaaaaattctattctaaatccaatcaactcgatccggaaattctctatcgtgcagaagactccacttcagatgaacggaatcgaggaagattctgatgaaccactggagcgacgactttctctggtgccagatagtgaacagggagaggccatacttcctaggataagtgtgatttcaactggacctacactccaggcccggcgaagacagtctgtcctaaacttgatgacacattccgtcaatcaggggcagaatatccacaggaaaacaacggcttcaacacgcaaagttagtcttgcaccacaggctaatctgacagagctcgatatttatagtcgcaggctctctcaggaaactggattggagatctccgaagaaataaacgaagaagatctcaaagaatgtttttttgatgatatggaatctataccagctgtaacaacatggaacacatatctccggtatatcactgtgcataaaagtctgatcttcgtactgatatggtgtttggttatctttctggctgaagtcgccgcctcgttggtggtactatggctgctgggaaacacaccactgcaggataaggggaactcgacacacagtcgaaataactcttatgcggtcataatcacatcgacaagttcatattatgtattttatatctacgtgggagttgccgatacactgctcgccatgggattctttaggggattaccactggtgcatactctcataactgtttctaaaatcttgcaccacaaaatgctgcactcagtactacaagctccaatgtctactctcaacacactgaaagcaggaggaatcctaaaccggttttcaaaagatatcgcgatccttgatgatctcctccctctaacaatcttcgatttcatccagctcctactcatagtgataggagccatcgccgtcgtggctgtactgcagccctatatttttgtcgccactgtgcctgtcatagtggcatttattatgctccgggcatattttttacaaacatcccagcagctcaaacagcttgaatctgaaggacggtcccctatattcacgcatttggtaactagtctgaagggactctggacactgcgtgcattcggacgccagccctattttgaaacactgttccacaaagccctaaacctgcacacagccaactggttcttatatctttctactcttcgctggtttcagatgagaattgaaatgattttcgtgatttttttcatagccgttacatttatatctatccttacaacaggagaaggggaaggaagggttggaataattctgactcttgccatgaatataatgagtacactccagtgggccgtgaactcatcaatagatgttgatagtctcatgagatccgtgtccagggtctttaagtttatcgatatgcccactgaaggaaaacctacaaaatccactaaaccctataaaaatggacaactttccaaagtcatgatcatagaaaactcccatgtcaaaaaagacgatatctggccttcaggagggcagatgacagtcaaagatctgactgctaaatacacggaaggggggaacgccatcctggagaacatcagtttttcgatctccccaggacagagggtggggctgctcgggcggactgggtcaggaaaatccacacttctatccgccttcttgcgacttctcaatacagagggggaaattcaaatcgatggagtatcttgggattcaataactctccagcagtggcgcaaagcattcggagtgatccctcagaaagtcttcatcttctctgggacattccggaaaaatctcgacccatacgaacagtggtctgatcaagaaatttggaaggttgccgatgaagttgggcttcggtcagtcatagaacagttccctgggaaactagactttgttctcgtggatggagggtgtgtcctctcgcacggacataaacagttgatgtgcctggcccggtctgtgctctcgaaagctaaaatcctccttctagatgaaccatctgcccacctcgatcctgtcacatatcagatcatccggagaacactcaagcaggcctttgccgattgcacagtaatattgtgtgaacatcgcatcgaagccatgttagaatgccagcagttcctggtgatagaagaaaacaaagtgagacagtacgactccatacagaaactcctcaatgaacgttctctctttagacaagccatcagtccttcagatcgggttaaacttttccctcatcggaactcctcaaaatgcaaatccaaacctcagatagccgcccttaaagaagaaactgaagaagaagtacaggatacaagactg

SEQ ID NO: 10199 - DNA, 4440 bp, Artificial Sequence
  Description of Artificial Sequence: Synthetic coding sequence
atgcagcggagcccattggagaaggctagcgtcgttagtaaactctttttttcctggacccgcccaatacttcgcaagggctaccgccagaggctggaactaagcgacatttaccagatccccagcgtcgatagtgccgacaacttgtccgaaaagctggaacgagagtgggaccgggagctggcctccaaaaagaacccaaaactgataaatgccctgcgtaggtgctttttctggagattcatgttttatggcatctttctgtatctgggcgaggtaaccaaggcagtacaaccattgcttctagggcggattattgcctcctacgaccccgacaataaagaggaaaggagcatcgctatatatctgggaattggtttgtgtctgctctttatcgttagaacactcctcttgcatcctgccatcttcgggttgcaccacatcggaatgcagatgcgcattgcgatgttcagtctgatctacaaaaagaccctgaaactctcatctagggtgctcgacaaaatctcaattgggcagctggtgagcttactctctaacaacctgaacaagtttgacgagggactcgcactggcgcacttcgtctggatcgctccgctgcaggtggctcttctgatgggtctgatatgggaattgttacaggcgagcgctttttgtggcctgggatttctaatagtgcttgcactcttccaggccggattaggccgcatgatgatgaaataccgggaccagcgggcgggaaagattagcgagagattggtcatcacatctgagatgatagaaaatatccagtctgtgaaggcctattgctgggaggaggcaatggaaaaaatgattgaaaacctgcggcagacagaactcaaactgactcgaaaggccgcttatgttaggtattttaactccagcgctttctttttttctggattcttcgtcgtctttttgtccgtactgccatacgccctgattaagggtattatcttgaggaagatcttcactacaatctccttttgtatcgtattgcggatggcagtcacccggcaattcccttgggccgtgcagacctggtatgatagtttgggagctattaataaaattcaagattttcttcagaagcaggaatacaagacccttgagtacaaccttaccaccaccgaagtcgtaatggagaatgtcaccgctttttgggaagaaggttttggagagttatttgaaaaagctaagcagaataataataaccgcaaaaccagtaacggagacgatagcctcttcttctccaattttagcctgctgggtacacccgtgctgaaagatattaactttaagatcgagaggggacaactgctcgctgtggcaggctccacaggagcaggaaaaaccagcctgcttatggtgatcatgggcgagcttgagccatcggaggggaagatcaaacattcgggaagaatctcattctgcagccaattcagctggatcatgcccggcaccatcaaggagaatatcatctttggcgtctcatatgatgagtacaggtataggtccgtcatcaaggcatgtcagttggaggaagatatctcaaaattcgccgaaaaagataatatcgtcctcggcgagggaggtattacactgagcggcgggcaacgcgcacgcatcagtctggctcgggcggtttacaaagatgccgatttgtacttgctagactccccttttgggtacctcgatgttctgactgaaaaggagatattcgaatcttgtgtgtgcaaactgatggctaataaaacgcgcattctggtgactagtaaaatggaacacctgaaaaaagccgacaaaattctgatcctgcatgagggatctagctacttctatgggactttttccgaactgcaaaaccttcagccggacttttcttccaagctgatgggatgcgatagctttgaccagttctctgccgaaagacggaactccatcttaactgagacattgcacaggttctctctggagggcgatgccccagtttcctggaccgagaccaaaaaacagagctttaagcagacaggggagttcggggagaaacgaaaaaactcaatactcaaccctatcaacagcatccggaaattttcgattgtgcaaaaaaccccactccaaatgaacggtattgaggaagactctgacgagccactcgaacgtcgtttgtctctggtgccagactcagagcagggcgaggcaattctgcccagaattagtgtcattagcacaggcccgacactccaagctcggaggcgtcagagtgtactgaatctcatgacccactcggtaaaccaaggtcagaacatccacagaaaaactacagcatccaccaggaaggtcagcttggccccacaagccaaccttaccgagctcgacatctactcccggcgcttatcacaggagaccgggcttgaaatttctgaggagatcaatgaagaagaccttaaagagtgtttcttcgatgatatggaatccatccccgccgttacaacgtggaatacttatctgagatacattacagtccataagtcgctaatattcgtgttgatatggtgcttagtgatcttcctggccgaggtggcggcttccttggtggtgctgtggctgctcgggaatacccccctgcaggacaaggggaattctactcacagccgtaataactcctacgctgtgattatcacctccaccagctcatactacgttttctacatttatgtgggggttgccgatactctgttggctatggggttttttcgcggtctcccattggtacacactctgattacagtctctaaaattctgcatcataaaatgctgcacagcgttcttcaggctcctatgtctactttgaacacactgaaagctggtggcatcctgaataggtttagcaaggacatcgcgatcctggatgatcttctgcctctcacaattttcgattttatacagctgttgctgatcgtgattggcgcgatagccgtcgtagcagtgctccagccctacattttcgtcgctaccgtgcctgtgattgtcgctttcattatgctgagggcttacttcctgcagacttctcagcagttaaagcaattagagtctgaagggcgtagccctatctttacccatctggtgacatcactgaagggcctgtggactttgcgagccttcggccgtcagccgtattttgagacactgttccacaaggctttgaatctgcacacagccaattggtttttgtacctttcaaccctccggtggtttcagatgcgtatcgagatgatcttcgtgattttttttatcgcagttacctttatctcgatcttgaccacgggcgaaggagaaggccgcgtgggaatcatattgacgctggctatgaatatcatgtctacacttcagtgggcggttaactcctccattgacgttgatagcctcatgaggagcgtaagtcgggtctttaaattcattgatatgcctaccgagggaaagcccaccaaatccacaaaaccctacaagaatggacaattgtcaaaagtgatgataattgagaatagtcacgtgaagaaagatgatatctggccaagtgggggacagatgacagtgaaggacctgaccgctaaatacacagaggggggtaacgcaatcctggagaatattagtttttctatctcacctggacagagagtgggactcctgggtaggactggttcgggcaagagtacccttctttccgccttcctgcggctattgaataccgagggtgagatccagatcgacggtgtctcatgggacagcattacgttgcagcagtggaggaaggccttcggggttattccacagaaggtatttatattctctggtaccttcaggaaaaacctggacccatatgagcagtggagcgatcaagaaatttggaaggttgcagatgaggtaggcctcaggagtgtgatcgaacagtttcctggcaaactggactttgtcctggtcgatgggggatgtgtgttatcgcacgggcacaaacagcttatgtgcctggcgagaagcgtactttcgaaagcgaaaatcctcctgctggatgagccatcagcccatttggatccggtcacttaccaaattattaggagaactctcaaacaggcatttgctgattgcacggtgatcctttgcgagcatcggatcgaggctatgctggaatgtcagcagttcttggtgatcgaagagaacaaggtcaggcaatatgattccattcagaaactgctgaacgaacggtctctgtttcgccaagcaatcagtccttctgatcgggtaaaactctttccgcacaggaatagttcaaaatgcaaaagtaagcctcagattgcagccctgaaggaagaaacagaggaagaggtccaagacactcggctg

SEQ ID NO: 10200 - DNA, 4440 bp, Artificial Sequence
  Description of Artificial Sequence: Synthetic coding sequence
atgcagcgcagcccactggagaaggcctccgtggtttctaagctgttcttctcgtggacacgaccgatattaaggaagggttataggcaaagactcgaactgtccgacatatatcagattccatctgtcgattctgccgacaatttatccgagaagttggagcgagaatgggatagggagttggctagcaagaagaatcctaaactgattaatgcgcttagacggtgcttcttttggaggttcatgttctacggcatattcctctatctgggcgaagtgacaaaagccgtgcaacccctgctgcttggccgaatcattgcgagctatgatcctgacaacaaagaggagagatccattgcgatctacctaggaattggcctgtgtctccttttcattgtgcgcacattactgctgcaccccgctatatttggcctgcaccacatcgggatgcaaatgcgcatcgccatgtttagtctgatctacaaaaagaccctaaagctcagttctcgcgtattggacaagatctctataggccagctggtgtctctcctgtctaataatttgaataagttcgatgagggactggctttggcccacttcgtgtggattgcccctttgcaggttgcattgcttatgggactgatttgggagctcttacaagcctcagccttctgtggtctagggttcctcattgtgctggctctgttccaggcaggcctaggcaggatgatgatgaaatacagagatcagagagcaggcaaaatctctgagaggcttgtcataacctcagaaatgattgagaacatacagtccgtcaaggcttactgttgggaggaagccatggagaaaatgatcgaaaatttgcgccagactgagcttaagttgactagaaaagctgcgtatgtgaggtacttcaattcatcagcgttcttctttagcggcttttttgttgtattcctgagtgtgctgccttatgcattgatcaaaggcataatattgcgtaagatctttacaaccatcagcttctgtattgtgctgcgcatggccgtcactcgccaattcccttgggctgttcagacctggtacgacagtctgggtgccattaacaaaattcaggactttcttcaaaagcaggaatataagactctagagtacaatctcacaacaacagaagttgtgatggagaacgtcaccgcgttctgggaagaaggcttcggcgagctattcgaaaaagctaaacagaacaataataaccggaaaacatcaaacggcgatgattctctgttttttagtaacttcagcctgttgggcaccccagttctgaaggacatcaactttaagatcgaaaggggacagctcctagctgtggctggatcaaccggggcagggaaaacctcgttgctaatggttattatgggagaactcgagcccagtgaggggaaaattaagcattcagggcggatctctttttgctcgcagttttcctggatcatgcctgggaccatcaaagagaatatcatctttggggtgtcatacgacgaatatagataccgctcggtcattaaagcatgccaattggaggaggatatttctaagttcgccgagaaagacaacattgttctgggcgaaggcggtatcaccctgagcggtggccagcgcgcaaggatctccctagctagagccgtttacaaagacgctgatctatatctgctggattccccattcggttacctagatgtgcttaccgaaaaagaaatatttgagagctgtgtgtgcaaactgatggccaataagacacgaattcttgtgacctcaaagatggaacacttgaagaaggccgataagatcctcatcctgcacgaggggagttcttacttttatgggaccttcagcgaactgcagaatttgcaacccgactttagctccaaactcatgggatgtgactccttcgaccagttctcagccgaacgccgtaattcaattctcactgaaactttgcataggttttctctcgagggagacgcccccgtctcatggaccgaaaccaagaaacaatccttcaaacagaccggggagttcggagagaaacggaaaaattccatattgaaccctatcaacagcattcggaaattctcgattgttcaaaaaaccccacttcagatgaatggaattgaagaggacagtgatgagcccctcgaacgacggctgtctctggtacctgatagtgagcaaggcgaggctattctgccacggatcagcgtgatctccaccggccccactcttcaggccaggcggagacaatcagtattgaatttgatgacccactccgtgaaccaggggcagaatatacacagaaaaaccactgcctctacccgcaaggtgtccctagccccccaggccaaccttactgaactggatatttactctcgcagactgtcccaggaaaccgggctggaaattagtgaggaaatcaatgaggaggatttaaaagagtgctttttcgacgatatggaatcgatacctgccgtaactacatggaacacctacctgaggtacatcacagtgcacaagtccctgatcttcgtgctcatttggtgtttagtgatcttcctggcagaggtggcagcaagcctcgtagtgttgtggctcctgggaaacacaccactgcaggacaagggaaactccacccattcccgaaataattcttatgcagtgatcatcacctcgacgtcttcatactacgtgttttacatttatgtcggagtcgccgacactctgctggccatgggttttttccgcgggctcccactggtgcatacactaatcacagtgtctaaaatcctgcatcacaagatgcttcactctgtgttgcaggctcccatgtccacactaaacactctcaaggctgggggcatccttaatagatttagcaaggatatcgctatacttgacgaccttctgccgcttacgatctttgatttcattcagctcctgctgatcgtgataggtgccatcgctgtggtggctgttctgcagccctatatattcgtagccacagtacccgttatagtcgccttcattatgctgcgcgcctatttcctgcaaacttcccaacagttaaagcaactcgaaagcgaggggagatctcctatatttacacacctggtgacatcgctgaaaggtctctggacgcttagggcatttggccggcaaccatatttcgagaccttgtttcataaggcgctgaacctccatactgcaaactggtttttgtacctgagtaccctgagatggttccagatgcggatcgaaatgattttcgtgatctttttcatagcagtgacatttatctcaatcttaacgacgggtgagggcgagggcagagtgggcatcatcctgactctggcaatgaatataatgtctaccctccagtgggcagtcaattcgtctatcgatgtggactcgcttatgcgttcagtatctagagtctttaaatttatagacatgcctacagagggaaagcccaccaagagtacaaagccctataaaaatggtcagctgagtaaagtcatgattatagagaatagccacgtgaagaaagacgacatctggccgtcaggtggacagatgacagtgaaggaccttaccgccaagtatactgagggagggaacgcaatcttggagaatataagtttctcaatatcgccgggtcaacgggtgggattgctgggccggaccggctccggaaaatcaacactgctgtccgcctttctccgtctactgaatacagagggagagatacaaatagacggcgtgtcgtgggattccattacacttcagcagtggcgaaaggcgttcggggtcatcccccagaaggtttttatcttcagcgggacgttccgcaagaatcttgatccttacgagcagtggtcagatcaggagatttggaaggttgctgatgaggtgggcctaaggtcagtcatagaacaattccccgggaaactggacttcgttctggtggacggcggctgcgtgctgtcgcatggacacaaacagctgatgtgccttgctcgatcggtgctgtcgaaagcgaagatcctgctgttagatgaaccgtccgctcatttggaccccgtcacgtatcagataataagaaggactttgaagcaggcgttcgctgactgtacggtgatcctctgtgagcaccgaatcgaagctatgttagaatgtcagcagttcctggttatcgaagagaacaaggtgaggcagtacgactccattcagaagctgctgaatgaacgaagtctcttcagacaggcaatttcacctagtgatcgggtcaagttgtttcctcatcggaactcttcaaagtgcaagtccaagcctcaaatcgctgccctaaaagaggaaacagaagaggaggtgcaagacactagatta

SEQ ID NO: 10201 - DNA, 4440 bp, Artificial Sequence; identical to SEQ ID NO: 10140
  Description of Artificial Sequence: Synthetic coding sequence

SEQ ID NO: 10202 - DNA, 4440 bp, Artificial Sequence
  Description of Artificial Sequence: Synthetic coding sequence
atgcagcgcagccctctggagaaggcctcagtggtgagcaaattgtttttcagctggactaggccaatactgcgcaaggggtacagacaaagacttgaactctccgatatctaccagatcccgtctgtggattccgctgataacctgtcagaaaagctggagcgagaatgggatagagagttggcaagcaagaaaaacccgaaactgatcaatgcactcagaagatgcttcttttggcgcttcatgttttacggaatctttctctacctgggtgaagtcaccaaggcggttcaacctctgctgctggggcgcattattgctagttacgatccagacaacaaagaagaacggtccatagccatttacctgggcattggactttgccttctgtttatagtgagaaccctgctgctgcaccccgcaattttcggacttcatcatatcgggatgcaaatgcgtatcgcaatgttttcgctgatttacaagaaaaccctcaaactgtcctcgcgggtcctcgataagatttctattggacagctggtgagccttctgtccaacaacctgaacaagttcgacgaagggctggcacttgcacacttcgtctggattgcccccctccaagttgcacttctgatgggtctgatttgggagcttcttcaggcctcagcattctgtggtttgggatttctgatagtgctggcactgtttcaggcaggacttggtaggatgatgatgaagtaccgggaccagcgtgccggaaagatctcggaaagactggtgatcacctcagaaatgatcgaaaacatacagtcggtgaaggcctactgttgggaagaagcaatggagaagatgattgaaaatctccgtcaaaccgaattgaaactcacccgcaaggcagcatacgtgaggtactttaactcgtcagcattcttcttttccgggtttttcgtcgtgtttttgtccgtgttgccatatgctctgatcaagggaatcatccttcgtaagattttcacgaccatatcgttttgtatagttctgcgcatggcggttacgcgacagttcccgtgggctgtccagacctggtacgactccctcggggctataaacaaaattcaagattttctgcagaagcaagaatacaagactttggaatacaaccttaccactactgaggtcgtgatggaaaatgtgaccgctttctgggaagagggctttggagaacttttcgagaaggcaaagcagaacaacaacaatcggaaaacctcaaatggagatgactccctgttcttttcgaatttctcgttgctggggacccctgtgcttaaggatatcaatttcaagattgaacgggggcagctgcttgcggtggcaggttcaactggagccggcaagacctcattgttgatggtgataatgggggagcttgagccaagcgaaggcaaaatcaaacactcaggacggatatcgttttgctcgcaattctcctggattatgccagggaccatcaaggagaacatcatttttggcgtgagctacgacgaatatcgctacagaagcgttatcaaggcatgccagctggaagaggatatatcaaagttcgcagaaaaggacaatatagtgctgggtgagggtggaatcaccctttccggtgggcagcgcgcacggatctcgcttgcgagggcggtttacaaagatgcagatctttacctgctcgactcaccatttggttatcttgatgtgttgactgagaaagagattttcgaaagctgtgtgtgcaagctgatggccaacaagacgcgcatcttggtgacctccaaaatggaacacctgaagaaggcagacaaaattctcatccttcacgaaggaagctcatacttctacggtactttttcagaactccaaaacttgcagcccgatttctcatccaagctgatgggatgtgacagcttcgaccaattctccgcagagaggaggaattccattcttaccgaaacgcttcatagattttcgctggaaggcgacgcccccgtgagctggaccgaaaccaagaaacagtcatttaagcaaactggagagtttggggaaaagcgaaagaatagcattcttaacccaattaactcaattcggaagttttccatcgtgcagaaaactcctctgcagatgaatggcattgaagaagatagcgacgaacccctggaacgccgtctctcactggtgcccgactcggagcaaggtgaagcaatcctgcctagaatttctgtaatctccaccggaccaactctgcaggcgagacggagacagtcggtgctgaatctgatgacccattccgtgaaccaaggtcaaaacattcatcgaaagaccactgcctccacccgcaaggtgtcccttgcccctcaggctaatctcactgagcttgacatttactcaagacggctgtcgcaagaaacggggcttgaaatctccgaagagataaacgaggaagatctgaaagagtgtttctttgatgatatggagtccatccctgcggtcactacgtggaacacttacctccgttacatcaccgtgcacaagtcacttatcttcgtgctgatttggtgtcttgtcatttttctcgcagaagtcgcagcgtcgcttgtcgtgttgtggttgctcgggaacactccacttcaggacaaaggcaatagcacccattcgcgcaataactcctacgcggtcatcattaccagcacctcaagctactacgtgttctatatctacgtgggggtagcggatacgctgctcgctatgggcttctttagaggactgccgctcgtgcatactctcataaccgtctcgaagattctccatcacaagatgctgcattccgtgctgcaagcccctatgtctactctgaacactttgaaagcaggcggtatactgaaccgtttttccaaggatatcgcaatcctggatgatcttctgcctttgaccattttcgactttatccagctcctgcttattgttattggagccatcgcagtcgtggcggtgctgcaaccatacatctttgtagcaaccgttccagtgattgtcgcatttatcatgctgagggcttacttcctccaaacctcccaacagttgaaacaactggagtcggaaggacgctccccaatctttactcatctcgtgactagccttaaaggtctttggactctcagggcctttggacgtcaaccttactttgagactctctttcataaggcattgaatctccacaccgcgaattggtttctgtacctgtcgactctcaggtggttccagatgagaatcgaaatgatttttgtgatctttttcatcgcagtgacttttatctcaatcctgactactggcgagggagagggtcgggtgggaatcattctgactcttgcaatgaacattatgagcactctgcaatgggcagtcaactcgtcaatagatgtcgattcactgatgaggtcagttagccgggtgtttaagtttatagatatgccgaccgaaggaaagcctactaagtcaactaagccttacaagaatggacaactttcaaaggtgatgattatagagaattctcatgtgaagaaagatgatatctggcctagcggtggccagatgactgtcaaggatcttaccgctaaatacacggaaggaggaaacgcaattctcgagaacatctcgttttccatatcaccgggacagagggtgggattgctcggtagaactggtagcggcaagagcactcttctttcggcatttctgagactccttaacaccgaaggagagattcaaattgatggtgtctcgtgggactccataacgctccaacaatggagaaaggcatttggcgtgatcccacaaaaggtattcatattctcgggtacgtttagaaagaacttggatccctacgagcaatggtccgatcaggagatctggaaggtggcggatgaagtgggactccggtccgtcattgagcaattccccggcaagctcgacttcgtccttgtcgacggtggctgcgtgctgtcgcatggtcacaagcagctgatgtgtctggcaagatccgtcctctcgaaggcaaagatacttctcttggatgagccttcagcacatctggaccctgtcacttaccaaatcattcggcgtaccctgaagcaagcctttgctgattgtacggtgattctttgtgagcaccgaatcgaggcaatgcttgagtgccagcaatttctggtgattgaagaaaacaaagtgcgacaatatgattcaattcagaagctgctcaacgaacggtcgcttttccggcaggcaatttccccatcagatcgggtgaaactttttccacatcggaattccagcaagtgtaagtcaaagcctcaaatcgccgcattgaaagaagaaaccgaggaagaagtccaagacacccgcctt

SEQ ID NO: 10203 - DNA, 4440 bp, Artificial Sequence
  Description of Artificial Sequence: Synthetic coding sequence
atgcaacggtctcccttagagaaagcatcagtggtgtccaaactgtttttctcctggactagaccaatactgcggaaaggatacagacagcgtctggaactcagcgatatatatcagattccctcagtggactccgctgataatctcagtgaaaagctggaacgggaatgggatcgagagctcgcctccaaaaagaaccccaaactgatcaatgcactgcggcgatgctttttctggcggttcatgttttatggtatttttctttatcttggcgaggtgaccaaagccgttcagccccttctcctcggccgaattattgcatcctatgatccagacaataaggaagaacgatctattgcaatctatctaggaataggtttgtgtttattgttcatcgtgcgaaccttgctcctgcaccccgctattttcggactacatcacattggtatgcagatgcgaattgcgatgttcagtctaatttacaaaaagaccctgaagctgtcctcacgggtgctggataagatctccattggccagctcgttagcctgttatcaaataatctgaataagttcgatgagggactggctctcgcacacttcgtgtggatagccccgctccaagtggcgctgctgatggggttgatctgggagcttttgcaggcatccgctttttgcggactgggattcctcatcgtcctagccttgttccaggccggcttgggccgcatgatgatgaagtatcgggaccagcgggctggcaagatcagcgagagactcgttattactagcgagatgatcgagaacatccagtcggtcaaagcatattgttgggaggaagctatggagaagatgattgagaatcttcgccagaccgagcttaagttaacgaggaaagctgcctacgtgagatacttcaacagttccgcttttttctttagtgggttttttgttgtgttcctgagcgttctgccgtatgcgcttataaaagggattattctgcggaagatcttcacaacgatcagcttttgcattgtgctcagaatggccgtgacgaggcagtttccttgggccgtgcagacatggtacgattctttgggcgcaatcaacaagattcaagacttcctgcagaaacaagaatataagaccctagaatacaacctgaccacaacagaggtcgtgatggaaaatgtcaccgccttctgggaggagggattcggtgaactcttcgagaaagccaaacagaacaataataaccgcaagacctcgaacggtgacgattcactgtttttcagtaacttttcactgttgggcactccagtgctaaaggatatcaattttaaaattgagcgcgggcagttgctggctgtggcaggatctacaggcgcaggcaaaacatcactccttatggttatcatgggcgaactggagccctccgagggcaaaattaagcactctggacgtatatccttctgctcacagttttcctggatcatgccaggaactattaaggagaacatcattttcggcgtcagttatgacgaataccgctaccggagcgtaattaaggcctgtcagcttgaggaagatatctcaaagtttgcggagaaagataatatcgtattgggcgagggggggataacacttagcggcggtcagagggccagaatctccctggccagagccgtgtacaaagacgcagatctgtacctgctggacagccctttcggctatctggatgtcttgaccgaaaaggaaatctttgagagttgcgtctgcaagctcatggcaaacaagactcgtattcttgtgacgtccaaaatggaacacctgaagaaggctgacaaaatactaatccttcacgaaggctcatcctacttttacgggaccttctctgaactgcagaatttgcagcctgacttttctagcaaattgatgggctgtgactcctttgatcagtttagcgctgagagaaggaactcgatcctgacagaaacgctgcatcgcttttccctcgaaggtgacgctccagtgagctggactgagacaaaaaagcagtcattcaagcagaccggtgagtttggggaaaagcgcaagaattctatcctgaatcctatcaatagcatccgaaagttctccatcgtccagaagacgcccctgcaaatgaacggaatcgaggaagatagcgacgagccgttagaacggagactcagcctcgtccccgacagcgaacaaggagaagcaattctgccccggatttcagtaatctcaaccggaccaacgctccaggcacggcgacgtcaaagcgtgctcaacctgatgacccactcagtaaaccagggccaaaacatccataggaaaactactgcgtctacacggaaagtgtccttggccccacaggccaaccttacagaactggacatctactcaagaaggctatctcaggaaacaggactggagatatccgaagagattaatgaagaggatttgaaagagtgtttctttgacgatatggagtctattcccgctgttacaacctggaacacttatctgaggtatatcactgtccacaaatcacttatctttgtgctgatctggtgcttggtgatcttcctggcagaggtggccgcctccttggtagtcctgtggctgctgggaaatacgccgcttcaagacaaaggcaatagcacccacagccggaacaacagttacgctgttatcattacatctacatcttcatactacgtgttctatatttatgtcggcgtggccgacaccctgctggcaatgggattcttccggggcctccccctggtccacactctgatcaccgtgagcaagatcctgcatcataaaatgctccatagcgtcctgcaggcgccgatgtctaccctgaacaccctaaaagccggcggtattctgaatcggtttagtaaggacatagcaattctggacgaccttttacctcttactatctttgacttcattcaactgctcttgattgttattggagctatcgctgtggtcgccgtgctgcaaccctacattttcgtggccaccgttcccgtgattgtggcctttatcatgcttagagcctactttcttcaaacaagccagcaactcaagcagcttgaatcagaagggaggtcgcctatttttacccatctcgtaactagcctcaaagggctctggacattgagggcattcgggcgacagccttacttcgagaccctgttccacaaagcccttaatctacacactgccaattggtttctctatctatctacacttagatggttccagatgcggatagagatgattttcgtcatcttttttattgctgttactttcatctccatcttgacgactggtgagggtgaaggacgcgtaggcataatactgactttagcaatgaatatcatgtctaccctgcagtgggctgtaaacagcagtatagacgtggacagccttatgcggagcgtgtcccgggtttttaaatttattgacatgccaacagagggaaagccgactaagtctaccaagccttataagaatggacagctcagcaaggtgatgataattgaaaactcccacgttaagaaggacgacatatggccttccggtggccagatgacggtgaaagacctgaccgccaaatacactgaaggtggtaacgcaatcctcgagaatatttcattcagtatatccccaggtcagcgggtaggtctgctcggccggactggctccgggaagagcaccctgctgagcgcttttctgaggctgttaaatacagagggcgagattcagatagacggagtgtcttgggacagcatcactctgcagcagtggcgaaaggccttcggagtcatccctcagaaggtgttcattttttctgggacttttaggaaaaatctcgatccatacgaacagtggtccgatcaggaaatttggaaagtagcagacgaggtcggcctgcggtcagtgatcgagcagtttccagggaagctggacttcgtactggtggacgggggctgcgtgttaagtcacggccacaaacaacttatgtgtttagctcgctccgtcctctcgaaggcgaaaattttattgctggatgaaccctctgcacatcttgatccggttacctaccagataattcggagaaccctgaagcaagcttttgccgactgtacggtgatcttgtgcgaacataggatcgaggccatgctcgaatgtcaacagttcctggttatcgaggagaacaaggtgcggcagtacgactcaatccaaaagttgctgaatgagcgttccttgttcaggcaggccatttctcctagtgacagagtgaaactgttccctcatcggaactcttcaaagtgcaagtcaaaaccccagatcgcagcccttaaggaggaaaccgaggaggaggtgcaggacacgaggctg

SEQ ID NO: 10204 - DNA, 4440 bp, Artificial Sequence
  Description of Artificial Sequence: Synthetic coding sequence
atgcagaggagccctctcgagaaggcatccgttgtgagtaaattgttttttagttggacacgccctatcctgcggaaagggtacaggcagcgactggaactgtccgatatctaccaaattccttccgttgattccgctgataacctgagcgagaaactggaacgcgagtgggatagagagttggcttctaagaagaatcccaaattaataaatgctctcaggcgatgttttttttggcgattcatgttttatggaatcttcctgtaccttggtgaggtcactaaggccgtgcaacccctgctgttaggccggatcatcgctagttatgatcctgataacaaggaagaaaggagcattgccatctaccttggtatcgggctatgcctcctgttcatagtacgcacattactactgcaccccgcaatttttgggttgcatcatataggcatgcaaatgagaatcgctatgttttcgctcatctataagaaaacactaaaactcagcagtcgggtgcttgacaaaattagcatcggccagctggtgtctctcctgtcaaacaatctgaataagtttgatgaggggctcgcactcgcacacttcgtgtggattgcccctctccaggtggcattgctcatgggcctgatttgggaactgctacaagcgtctgctttttgcggactgggttttctcatagtcctcgcattattccaggccggactaggccggatgatgatgaaatatcgggaccagagggccgggaagattagtgagcgccttgtgatcacgagcgaaatgattgagaatattcagtcagtgaaggcttattgctgggaagaggcaatggaaaagatgatagaaaacctccgccagacggagctgaaattgacaaggaaggccgcctatgtgcggtatttcaattcatctgccttctttttttcggggttttttgtcgtgttcctgagcgtgttgccctatgccctcattaaagggatcattttgcgcaagatttttactacgatttccttctgtattgtgctgaggatggcggtcacccgtcagttcccctgggctgttcagacatggtacgattcacttggcgcaatcaataagatccaggactttctccagaagcaggagtataaaacacttgaatacaatttaactacaacagaggttgttatggagaacgtcaccgccttttgggaagaaggattcggggagctgtttgagaaggccaagcaaaataataataatcgaaagacatctaacggggatgattcccttttcttttcaaacttttctcttctgggtactccggtgctgaaagatatcaacttcaagatcgaaagagggcagctgctggcggttgccgggagcacgggcgccggcaaaacctcgctattgatggtgatcatgggagaactggaaccctcagaaggcaaaattaaacacagcggcaggattagtttttgttcacagttctcttggatcatgcccggcaccataaaggaaaacataatttttggggtgtcctacgatgagtaccgctacaggagtgtgatcaaggcctgtcaactcgaggaagatatctccaaattcgccgaaaaagacaacatagtgctcggcgaaggaggaatcacactgtccggaggccagagagcgaggatatctctggctagggcagtatacaaagacgccgacctgtatctcttagatagccctttcggctacttagatgtcctcaccgagaaggaaatttttgaatcctgcgtgtgtaaactcatggcgaacaagacaagaatcctcgtgaccagcaagatggaacacctgaaaaaagcggacaaaatcctgatactgcatgagggatcatcttacttttacggaactttctcagagctccaaaacctgcagcccgacttctccagtaagctgatggggtgcgatagctttgatcaattcagcgccgagcgacggaattccattctcacagagacattgcatcgcttctctttggaaggcgacgcgccagtctcctggacagagactaaaaaacagtcatttaagcagacgggagagttcggggagaagcggaagaacagtatcttgaatcctatcaattcgatccggaaattcagcatagtgcagaaaactccccttcagatgaacggaattgaggaagacagtgacgagcccctggaacgacggttatccttggtgcctgatagtgagcagggcgaggccatcctgcccagaatctctgtgatctcaacgggccctacgctacaggctcggcgaaggcagagtgtgctgaatctgatgacgcactcagtgaaccaggggcagaatatccaccggaagacgacggcgagcaccagaaaggtttctttagctccacaggcgaacttaacggagttggatatttattcgcgccgcctcagtcaagagacgggcctcgaaattagtgaagagattaatgaagaagacctgaaagaatgcttcttcgacgatatggagagtattcccgcggtgacgacgtggaatacctatttgaggtacatcaccgtgcacaaatcactcatcttcgtgctgatatggtgcctggttatctttttggccgaggtggctgcttctctggttgtgctgtggctactgggcaatacaccactacaggacaagggcaatagtactcattcccggaacaactcttacgcagtaattatcacatctacatcctcttactacgtcttttacatttatgtgggcgtggctgacacactcctcgccatgggtttcttccgggggctgcccttggtccacactctgattaccgtgtcgaagattttgcaccacaagatgcttcattcagtgctgcaggcccctatgagtaccttaaatactttgaaggctggaggcatcttgaaccgtttttcaaaggacatagcaatcctcgatgacctcctccctctgactatcttcgacttcatccagctattgctgatagtaattggggccatcgctgtagtcgccgtgctgcagccctacatcttcgttgctacagtgcctgtgatcgttgcctttattatgctcagagcgtatttcctccagacttctcagcagctgaagcagctcgaaagtgagggcaggtcccccatcttcacacacctggtcacctctcttaaaggcctctggacccttagggcttttggaaggcagccgtatttcgagacactattccataaggcattaaatctgcacaccgcgaattggtttctttatctgtcgactctgcgctggtttcagatgagaatcgagatgatctttgttattttctttatcgcagtgactttcatctctatactgaccaccggtgagggagagggccgagtgggcatcattctcaccctggctatgaacatcatgagcaccctgcagtgggcagttaacagttcgattgatgtggattctctgatgaggtcagtgagtcgagtgttcaagttcattgatatgcctaccgaaggcaaacctaccaagagcaccaaaccatataagaacggccagctgtctaaagtaatgataatcgagaattcccacgtgaagaaagatgacatttggccgtccgggggccagatgactgtgaaggacctgaccgctaagtacaccgaagggggcaacgccattctggaaaatataagtttcagtatctctcctggccaacgagtgggactgcttggaaggaccggtagcgggaagagtacactgttgagcgcgtttcttaggctgctgaatacggagggggagattcagatagacggggtgagctgggattcaattacattgcaacaatggagaaaggcatttggagttatacctcagaaagtattcatattctcgggcacgttccgcaaaaatctagatccctacgaacaatggtccgaccaagagatttggaaagtcgccgatgaggtgggccttaggtccgtaatcgagcagtttccagggaagttggattttgtcctggtggacggagggtgcgtcctgtcccacggccataagcagttgatgtgtctagcaagatctgtgctatcgaaggcaaaaatcctgttgttggacgagccaagcgcacacttagatcctgtcacttatcagataatcaggcgtactttgaaacaggcgtttgccgattgcaccgtcattttatgcgagcaccgcatcgaagctatgctagaatgccagcagttcctggtgatagaggaaaacaaagtgaggcagtatgacagcatccaaaagttgcttaacgaacgttctctgttccgccaggccatatctccgagcgatcgggttaaactgttccctcatagaaatagttctaaatgcaagtccaaaccacagatagccgccctgaaggaagagacagaagaagaggtgcaagataccaggctc

SEQ ID NO: 10205 - DNA, 4440 bp, Artificial Sequence
  Description of Artificial Sequence: Synthetic coding sequence
atgcaaaggtcccccctggagaaggcgagtgttgtgtccaaacttttcttctcatggactagacctattctcaggaaaggatacaggcaaaggcttgaactttcagacatttatcaaataccctcagtggattcagccgataacctctcagaaaagctggaaagggagtgggatagggaattggcctcgaagaagaatcctaaacttatcaacgctcttcgccgttgtttcttttggaggttcatgttttacggaatcttcttgtaccttggcgaagtgaccaaggcagtccaaccacttttgctgggccgcatcatcgcatcatatgaccctgataacaaggaagagcgctcgattgctatttaccttggtattggactgtgtctcctgtttatcgtgcgcaccctgcttcttcatccagcaattttcggtctgcaccacattggtatgcaaatgcgtatcgccatgttttccctgatatacaagaaaacccttaagctgtcatcgagagtgctggacaagatttcgattggtcagcttgtgtcgctgctttcgaacaatctcaataagtttgatgaaggcctcgccctcgcccactttgtctggattgcaccccttcaggtggcacttcttatgggtcttatatgggagctccttcaggcatcagcattttgcggactggggtttctcattgtgctcgcactctttcaggcaggactgggtaggatgatgatgaagtacagagatcaaagagccgggaaaatcagcgaacggctcgtgattacctcggaaatgatagagaacatacaatccgtgaaggcatactgttgggaagaggcaatggagaagatgattgaaaacctccgccagaccgagctcaagctcactagaaaggcggcttacgtgcggtactttaacagcagcgcgtttttctttagcggatttttcgtggtgtttctgagtgtgctcccctacgccctgattaagggaatcattctgagaaagatctttacgaccatctccttttgcatcgtccttaggatggcagtgactcggcagtttccttgggcagtgcagacctggtacgattccctcggcgccatcaacaaaattcaggatttcctccaaaagcaggagtacaaaactctggaatacaatcttactaccactgaagtggtcatggaaaacgtcactgcattttgggaagaaggattcggggagctgttcgagaaggctaagcaaaacaataacaatcgtaaaacttcgaacggtgatgattcgctgtttttctcaaacttcagcctgctgggcaccccggtgctcaaagacatcaactttaagatagagcgaggacaacttctggcggtggcaggttcaaccggtgcaggcaagacgtcactgcttatggtgattatgggcgagctcgagccctcagaaggtaagattaagcattcagggaggattagcttttgtagccagttttcatggatcatgcctggcactatcaaggaaaacataatcttcggcgtgtcctacgatgagtacagatacagatccgtcatcaaggcatgtcaacttgaagaggacatctccaaattcgcagaaaaggacaatatcgtcctgggagaaggggggattaccctgtcaggcggtcagcgggcacgtatcagcctggcaagagcagtttacaaggacgccgacctgtacctcctggattcgccatttggatacctcgacgtgctcaccgaaaaggagatttttgagagctgcgtgtgcaagctcatggccaacaagactagaatcctcgtgacctcgaaaatggaacacctgaaaaaggcagataagatcctgatacttcatgagggaagctcatacttttacggaaccttctcagaacttcaaaatctgcaacctgatttctccagcaagctgatgggatgtgattcgttcgatcagttttcggcggagagaaggaactccattctgacggagactttgcataggttctcgctcgaaggcgacgcccctgtgtcttggaccgagacgaagaagcaatcttttaagcagactggcgaatttggggagaaacgcaaaaactccattctcaaccctatcaattcgattcgtaagttttcgatcgttcaaaaaactcctctccagatgaacggcattgaagaggactcggacgaaccattggaacggcggctttccctcgtccctgactccgaacaaggtgaagcaatcctgcctaggatctccgtgatttccacgggaccaactctgcaagctcgccgcagacaatccgtcctcaaccttatgactcatagcgtgaaccaggggcaaaacatccatagaaagaccactgcatcgaccagaaaagtgtcactggcacctcaagcaaatcttacggagctggacatatactccagacgactttcccaagaaacgggccttgaaatctcagaagaaatcaatgaagaagatcttaaagagtgcttttttgatgacatggaatccattcctgctgtgactacttggaacacctaccttcggtacataaccgtgcataagtccctcatctttgtgctgatatggtgcctggtgatttttctggccgaagtcgcagcctcacttgtggtgctttggcttctcggaaatactcctcttcaggataagggaaactccacccatagcagaaataactcatacgcagtgatcattacttcgacttcatcctattacgtcttttacatctacgtgggtgtggcagatactcttctggctatgggtttcttccgcggcctcccattggtgcacaccttgataaccgtgagcaagattctgcatcacaaaatgctgcattcagtgctccaagccccaatgtcaacgcttaatactcttaaagcaggaggaattctgaatcggttttcgaaggatatcgccatacttgatgacctccttccactgaccatctttgatttcattcaactgcttctgattgtcattggagccattgcagtggtggcagtgctccaaccgtatatctttgttgccaccgtgcctgttattgtcgcgtttatcatgctgcgcgcgtactttcttcaaactagccagcaactgaagcaacttgaaagcgagggccgaagcccgatctttacccatcttgttacctcactgaaaggtctttggactctgcgtgcctttggacgccaaccatacttcgaaaccctgtttcataaggcactcaacctgcacactgcaaactggttcctgtacctgtcgactcttcgctggttccagatgagaatcgaaatgatatttgtgatcttctttatcgccgtcacgttcatctcaatactgacgaccggcgagggagaaggaagagtgggaattatccttactctggcgatgaacattatgagcaccctccagtgggcagtgaactcaagcatcgacgtggactcactcatgaggtcagtgtccagggtgtttaagtttatagatatgccgactgaaggaaagccgactaagagcactaagccttacaagaacggacaactctcgaaggttatgattatcgagaactcacatgtgaagaaagatgatatctggccttcggggggccagatgacggtgaaggaccttaccgcaaagtacactgaaggaggcaacgctatccttgagaatatctcgttttcgatttcgcctggccagcgcgtgggtctgctcggacggaccggctcaggcaagtcgacccttctgtccgctttccttaggctgctcaacaccgaaggggaaatccagattgatggggtgtcctgggatagcataactctgcagcaatggagaaaggctttcggagtcattccacaaaaggtgtttatcttctcgggtacttttcgcaagaaccttgatccttatgaacaatggtcagatcaggaaatttggaaagtcgcagatgaagtgggtcttaggtccgtgattgaacagtttcctggtaaacttgactttgtccttgtggatggaggctgtgtgctttcccacggtcataagcaactgatgtgtcttgcacggagcgtgttgagcaaagcgaaaattcttctgcttgacgaaccttcggcacatctggacccggttacctaccagattatccgcagaaccctgaagcaagcattcgcagattgtactgttatcctgtgtgaacaccgcatagaagccatgctggaatgccaacagttccttgtgattgaagagaataaggtccggcagtatgactcaattcagaaattgctgaacgagagatccctgtttagacaggcaatctccccaagcgatcgagtgaagctgtttccacatcggaattcgtccaagtgtaagtcaaaaccccaaatcgcagcactcaaagaggaaactgaagaagaggtgcaggataccagactg

SEQ ID NO: 10206 - DNA, 4440 bp, Artificial Sequence
  Description of Artificial Sequence: Synthetic coding sequence
atgcaaagatcgcccctggaaaaggccagcgtggtgagcaagctgttcttttcgtggacgcgccccatcctgcgcaaaggctaccgccaaagactggaattgtccgatatctaccaaattccgtcagtcgattcggctgataatctctccgaaaaacttgaacgcgaatgggaccgggagctcgcttcaaagaagaacccgaaacttatcaacgcactgcggaggtgtttcttctggcgcttcatgttttacgggattttcctctatttgggagaagtgacgaaggcggtgcagccgctgctcctgggacgcatcatcgcctcgtacgacccagacaacaaggaggagaggagcattgccatttacctggggatcggactgtgccttctgttcatcgttcgcaccctgctgctgcacccggcaatcttcggactccaccatatcgggatgcagatgcggattgcgatgttctctcttatttacaagaagaccctgaagctgtcgagccgcgtgcttgataagatctccatcgggcaactcgtgtccctgctgagcaacaacctcaacaaatttgatgaaggactggcactggcccatttcgtgtggatcgctccactccaggttgcacttctcatggggctgatctgggaacttctccaagcctccgccttctgcggactgggcttcttgatcgtgcttgccctgttccaagctgggctgggacggatgatgatgaagtatagggaccagcgggcaggaaagatttccgagaggctcgtgatcacttcggaaatgatcgaaaatatccagtcggtgaaggcgtactgctgggaggaggcaatggagaagatgatcgagaatctgcgacaaaccgagctcaaactcacccgcaaggcggcgtacgtgcggtactttaactcgagcgctttcttctttagcggatttttcgtggtgtttctctcggtgctgccgtacgcccttatcaagggcatcattctccgaaagatcttcactaccatctcgttctgtatcgtcctccgaatggctgtgactagacaattcccgtgggccgtgcagacctggtacgattcgctgggcgcaatcaacaagatccaggatttcctgcagaaacaggagtacaaaaccttggaatacaatctcactaccactgaagtcgtcatggagaacgtcaccgcgttttgggaagaaggcttcggggaactcttcgagaaggctaagcaaaacaataacaaccggaagactagcaatggggacgatagcctgttttttagcaacttctctcttctgggaaccccggtcctgaaggacatcaacttcaaaatcgagcgcggtcagctgctcgccgtggcggggtcgactggcgcgggcaagacttccctgctcatggtgatcatgggagaactggaaccatcggaaggaaagattaaacactccggacggatctcgttttgctcccagttctcgtggatcatgccgggaaccatcaaggaaaacattatcttcggagtttcctacgacgagtacagatatcggagcgtcatcaaagcatgccaactcgaggaagacatatcgaagttcgccgaaaaagataatatcgtgctgggcgagggtggaatcactctgagcggaggacagagagcaagaataagcctcgccagggcagtgtacaaggatgccgacctgtacctgctggactccccgtttggataccttgatgtgttgactgagaaggaaatcttcgaatcctgcgtgtgcaaattgatggccaataagacgagaatccttgtgacctccaagatggagcatttgaagaaggcagataagattctgatcctgcacgaggggtcctcatacttctacggaactttctcagagctccagaacctccaaccagacttctcttcaaagctgatgggctgtgactcctttgaccagttctcagcggaacgacgcaattcgatccttaccgagacgctgcaccgcttctcacttgagggagacgctccggtgtcgtggaccgaaactaagaaacagtccttcaagcaaaccggagagttcggtgaaaaacggaaaaacagcatcctgaatccgatcaactctatccggaagttttccattgtccagaaaactccccttcaaatgaacggaatcgaggaggattcagatgaaccgctcgaacggcggctgtcacttgtgccagactccgaacagggagaagcaattctgccgcgcatctcggtgatctccaccggaccgacccttcaggcccgcagacgccagtcggtgcttaacctcatgactcacagcgtcaaccaaggccaaaatatccaccgcaaaactaccgcatccacgaggaaagtctcgctggcgccgcaggccaacctgactgaactggatatctactcacggaggctttcccaggaaactggtcttgagatctccgaagaaatcaacgaggaggacctcaaggagtgcttcttcgacgatatggaatccatccccgccgtgaccacctggaacacttacctcagatacatcactgtgcacaagagcctgatcttcgtcttgatctggtgtctcgtgatttttctcgccgaggtcgcagcttctctggtcgtgctgtggctgcttggaaacacccctcttcaggacaagggcaattcaacccactcgagaaataactcgtacgccgtgattatcacttcgacttcgtcctactacgtcttctacatctacgtgggtgtcgccgacactctgctcgccatgggatttttccggggcttgccgcttgtccacactctcatcacggtgtcaaagatcctgcaccacaagatgcttcattcagtgctgcaagctcccatgtcgaccctgaatactttgaaggcaggagggatcctgaaccgcttttccaaagacatcgccatccttgatgatctgctgccactgaccatcttcgattttatccagctgctcctgatcgtgattggagccatcgccgtggtggctgtcttgcaaccctacatcttcgtggcaactgtcccggttatcgtggccttcatcatgctgcgggcctactttctgcagacctcgcagcagcttaagcagctggagagcgagggaagatccccgatctttacgcatctggtgaccagccttaagggtctgtggactttgcgcgctttcggccgccaaccctacttcgaaaccctctttcataaagcactgaatttgcacaccgctaactggttcctttacctctcgaccttgcggtggttccagatgagaatcgaaatgattttcgtcatcttcttcatcgctgtgacttttatctcgattctgaccactggagagggcgaaggaagagtcggaatcatccttactttggccatgaatatcatgtcaaccctgcaatgggccgtgaatagttcaatcgacgtcgactcgctcatgcgttccgtgtccagagttttcaagttcattgacatgccgaccgaaggaaagccaactaagtccactaagccgtacaagaatggccaactgtcaaaagtgatgatcatcgagaatagccatgtgaagaaggacgacatctggccgtcaggcggccagatgactgtgaaggacctgaccgccaaatatactgaaggaggaaacgcgatcctggagaacatctctttcagcatttccccgggacaaagagtcggactgcttggtagaactggatcaggcaagtcaaccctgctctcggccttcctccgcctgctgaacactgaaggggaaatccagatcgacggggtttcatgggactcgattacgcttcagcagtggcggaaagcattcggagtgatcccacagaaagtgttcatcttctccggaacgttcagaaagaacttggacccgtacgagcagtggtccgatcaagaaatctggaaggtggcggacgaagtgggcctcagatcggttatcgagcaattccccgggaagctcgacttcgttttggtggacggaggatgcgtgctctcccatggacataagcagctcatgtgcctcgcgcgctcggttctgtcgaaggcgaagattctcctcctggacgaaccgtcggcccacctggatccggtgacttatcagatcatccgacggaccctgaaacaagccttcgcggactgcaccgtgatcctgtgtgagcaccgcatcgaagcgatgctggaatgtcagcagttcctggtgattgaggaaaacaaggttcggcagtacgattccatccagaaactgctcaatgaacggtcactcttcagacaagcgatctccccatcggaccgcgttaagctgttcccacaccggaattcctcgaagtgcaagtcgaagccgcaaatcgcagccctcaaggaggaaaccgaggaagaagtccaagatactcggctc

SEQ ID NO: 10207 - DNA, 4440 bp, Artificial Sequence
  Description of Artificial Sequence: Synthetic coding sequence
atgcaacgttcccctctggaaaaggcctcggtggtatccaagctcttcttctcgtggactcgcccaatccttcgtaaggggtaccgtcaaagattggagctgtcagatatctaccaaattccttcggttgattcggccgataacctttccgaaaagctggaacgagaatgggacagagagctcgcatcaaaaaagaaccctaaattgattaatgcactgagaagatgtttcttttggcgttttatgttctacggcattttcctgtatctgggagaagtcactaaggcagtccaaccgctgcttcttggcaggatcatcgcatcctacgatcccgataacaaagaagagaggtcaattgctatctacttgggtattggtttgtgtcttttgtttatcgtcaggacccttttgctgcaccctgccatttttggtctgcatcacatagggatgcaaatgagaattgcaatgttttcattgatttacaagaaaactcttaagctgagctccagggtccttgataagatttcaatcggacaactggtgtcgctgttgtcaaataaccttaacaaattcgacgaaggtctggctctggcgcactttgtctggattgcacctctccaagtggcgctgctgatgggtctgatttgggaactccttcaagcctcggccttctgtggactggggtttctgatcgtgcttgcattgttccaggcaggactggggcggatgatgatgaagtaccgcgatcaacgcgccggaaagatttcggaacggctcgtgatcacctctgaaatgattgaaaacatccagtcggtgaaagcatactgttgggaggaagccatggagaagatgatagaaaatctgcgtcaaactgaacttaagttgactagaaaggcagcgtacgtgcggtactttaactcgagcgctttctttttctcaggcttttttgtggtattcctctcggtccttccgtacgcacttatcaagggaattatccttcggaagattttcaccactatatccttttgtatcgtgctgagaatggcagtcactaggcaatttccttgggcagtgcagacctggtacgattcactgggagcaattaacaagattcaggactttctgcaaaagcaagaatacaagacccttgagtataacctcaccactaccgaagtcgtcatggaaaacgtgaccgcattttgggaagaaggattcggcgaactgttcgaaaaagcaaaacagaacaacaacaataggaaaactagcaatggagacgactccctgtttttcagcaactttagcctgctcgggacccctgtcctgaaagatatcaacttcaaaatagaaagaggacaacttctggcagtggcaggaagcactggcgcgggaaagacctcgcttcttatggtcatcatgggcgagctggaaccttcagaaggcaagattaaacacagcggacggatcagcttttgttcacaattttcctggattatgcctggtaccattaaggaaaacattatctttggtgtgtcctacgatgagtaccgctacaggagcgtgattaaggcatgccagttggaagaggacataagcaagtttgcagaaaaggataacattgtgcttggagaaggaggtattaccctgagcggaggtcagcgtgctcgcatttccttggcacgggctgtctataaagatgcagatctgtacctccttgatagcccatttgggtacctggatgtcctgactgagaaggaaatctttgagtcgtgcgtgtgtaagctgatggcaaataagaccagaatccttgtcacgtccaagatggagcacctcaaaaaggccgacaagatcctgattctgcatgagggatcatcgtacttctacggaacctttagtgaactgcagaacctgcaaccggattttagctcgaagctcatgggatgtgactcgtttgatcaattttccgctgagaggcgcaactcaatccttactgaaaccctgcatcgcttttccctcgagggcgatgcacccgtctcctggactgaaactaagaagcaatcctttaagcaaaccggggagttcggtgagaagcggaagaactcaattctgaatccgatcaactccataaggaagttttcgattgtccaaaaaactccacttcaaatgaatgggatagaagaggatagcgatgagccacttgaaagaaggctgagcctggttccagattcagaacagggagaagcaattctgccacgaataagcgtgatctcaaccgggcccaccctgcaggcgcggcgcaggcagtcggtgctcaatctgatgacccattcggtcaaccaagggcagaatatccatcgaaaaactactgcctccactcgcaaagtgagtctcgccccacaagcaaatcttaccgagttggacatttactcgagaaggctttcccaagaaaccggacttgaaatctcagaagaaatcaacgaagaagatctgaaagagtgttttttcgatgatatggaatccatccccgctgtgaccacctggaacacttatctgaggtacattaccgtccacaagtcgctcatttttgtgcttatttggtgtctggtgatttttctggccgaggtggccgcctccctggtggtcttgtggcttcttggtaatactcctttgcaggacaagggaaactccacccatagccgtaataactcctacgcagtcatcattacctccacttcgtcctactacgtgttttacatttacgtgggggtggcagatactctgctggccatgggttttttccgtggtctgccgcttgtgcatacgcttattaccgtgtcgaagattctgcatcacaaaatgctgcatagcgtgctgcaagcgccgatgtcaactctgaacacgttgaaggccggcggcattctcaaccggttttccaaggacatcgcaattttggatgatctgctcccactgaccattttcgatttcattcagctgcttctcattgtcatcggtgccatcgcagtggtggcggtcctgcagccttacattttcgtggcaaccgtgcccgtgattgtggcatttatcatgcttcgtgcgtacttcctccaaacttctcagcaacttaaacagctggaatcagaaggaagaagcccaatcttcacccatctcgtgacttcgcttaagggcctctggaccctcagagcctttggacgccaaccttactttgaaactctctttcacaaggcattgaaccttcacacggcaaattggtttctttacctgagcaccctccggtggtttcaaatgaggatagaaatgatctttgtgatcttcttcatcgcggtgacgttcatcagcattcttacgactggtgaaggagaaggcagagtcggaatcattctgactctcgccatgaatatcatgtccactcttcagtgggcagtgaattcctcgatagatgttgatagccttatgcggtcggtgtctcgtgtctttaagttcattgatatgccaactgaaggcaagccaactaagtcgaccaaaccctacaaaaacggacaattgagcaaggtcatgatcattgagaattcgcacgttaagaaagatgacatctggccatcgggcggacagatgaccgtgaaagatctgaccgcgaagtacactgaaggtggtaacgccattcttgaaaacatctcgtttagcatttcacctggccagcgggtcggactgctgggacggactggcagcggtaaaagcacccttctttcggcgtttcttagacttctcaatactgaaggcgaaattcaaatagacggcgtttcgtgggattcaataacgctgcaacagtggcgcaaggccttcggagtcatcccgcagaaggtgttcatcttttcgggtactttcaggaagaaccttgatccttacgaacagtggtccgatcaggaaatttggaaggttgcagatgaggtcggattgcggtccgtgattgagcaatttccagggaaactggacttcgttctggtggatggtggttgtgtgctgtcgcatggacacaagcaactgatgtgcctggcacggtcagtgcttagtaaggccaagattcttcttcttgatgaaccatccgcgcatctggaccccgtgacttaccagatcataagaaggactcttaaacaagccttcgcagattgtaccgtcattctctgcgaacatcgcattgaagccatgctcgaatgccaacaatttctggtgattgaggagaataaggtgagacagtatgacagcatccaaaagttgctcaatgagagatcactgtttaggcaagcaatctctccctccgatagagtgaaactttttccgcatcggaactcctccaaatgcaaatccaaacctcagattgccgcacttaaagaagaaactgaagaggaagtccaagataccaggctc

SEQ ID NO: 10208 - DNA, 4440 bp, Artificial Sequence
  Description of Artificial Sequence: Synthetic coding sequence
atgcagaggtccccccttgagaaagcttctgttgtatccaagcttttcttttcttggactagaccaatcctccgtaaaggttatcgccaaaggctggagctgtctgacatttaccagatcccatcagtagactctgctgataatctctccgaaaaacttgaacgcgaatgggaccgcgaacttgcatccaagaagaaccctaagctgattaacgcactgcgccgctgcttcttctggagattcatgttctatggtattttcctttatctcggagaggtaaccaaggccgtccagccactgctcctgggaagaatcatcgcctcctatgatcccgacaacaaggaggaacgttctatcgccatctatctgggaatcggtctgtgcctgctcttcattgtgcgcactttgcttctgcaccctgctattttcggattgcatcacataggcatgcagatgcgcatcgctatgttttccttgatctacaagaagaccctgaagctctcatcaagggtcctggacaagatttccattggccagcttgtttccttgttgagcaataacctcaataaatttgacgagggccttgccctcgctcatttcgtctggattgctccccttcaggtggcccttttgatgggtctgatatgggagttgctccaggcttccgctttctgtggtctcggctttctcattgtactggccttgttccaagccggcctcggaaggatgatgatgaagtacagagaccaacgcgccggaaagatctctgaacgtctggtcattacctccgagatgattgaaaacatccagtcagtgaaggcctattgctgggaagaggccatggagaaaatgattgagaacctgagacaaaccgaactcaagctgactaggaaggccgcttacgtccgttacttcaattcaagtgctttcttcttctcaggatttttcgtagtgttcctctccgtcctcccttacgctcttattaagggtataatcctccgtaagatattcaccacaatctctttttgcatcgttctgagaatggctgtcacccgtcagttcccttgggcagtacagacttggtacgactctttgggcgcaattaacaagatacaagactttctgcagaagcaggaatacaagacccttgagtacaatctgaccactacagaagtagtgatggagaatgttaccgccttttgggaagagggctttggtgagttgttcgagaaggctaagcaaaataataacaatcgtaagacttccaacggcgatgattctttgtttttctccaactttagtctgctgggtacacctgtactgaaggacattaacttcaaaatagaaaggggccaactgctggccgtcgccggtagcactggtgctggcaagactagccttttgatggtaattatgggtgagcttgagccttcagagggaaagattaaacacagtggaagaatctctttttgttcccagttctcttggatcatgccaggtaccatcaaagagaacatcattttcggcgtttcctacgatgagtataggtacaggtctgtcattaaggcctgccagctcgaggaggatatttctaagtttgctgagaaagacaacatcgtactcggagaaggcggaataactttgtccggaggccaaagggcccgcatctctcttgcacgcgccgtctataaagacgcagacctgtacctgctggacagtccattcggatacctcgatgtgctgaccgagaaagaaatattcgaatcttgtgtgtgcaagctgatggctaacaagacaagaatcctcgtgacttccaagatggagcacctgaagaaagcagataaaatactgatcttgcatgaaggatccagctacttctacggcacttttagtgagctccagaacctgcaaccagatttctcaagcaagctcatgggatgcgatagcttcgaccagttttccgcagagaggagaaactcaattttgacagaaaccctgcatcgtttctctctcgagggtgacgcacctgtctcctggactgaaacaaagaagcagagcttcaagcagacaggcgagttcggcgaaaagcgtaaaaactccatcctgaacccaatcaacagcatcagaaaattctctatcgtccagaagaccccccttcaaatgaacggaatcgaagaggattccgacgagcccctggaaaggagactcagtcttgtgccagacagtgagcaaggtgaagctattctgccccgcatcagcgtgattagcaccggtcctactttgcaggctaggaggcgccagtctgtgcttaatctgatgactcacagcgtgaaccagggccagaatatccaccgcaagaccaccgccagtactagaaaggtgtctctcgcaccacaggctaacctgaccgaattggatatctactctagacgtctttcccaagagactggactggaaatcagtgaggagatcaacgaagaagacctcaaggagtgtttttttgacgatatggaaagtattcctgctgtgactacctggaacacctacctgcgttacatcactgttcataagtctctgatcttcgtcctgatctggtgccttgtcatctttcttgcagaagttgcagcatcccttgttgtcctgtggttgctgggaaataccccactgcaggacaaaggcaacagcactcattcccgtaacaactcctacgctgtcatcatcacctctacatccagctattatgtgttctacatctacgtgggagtggctgacactctccttgcaatgggtttcttccgcggtctgcctctcgttcacacattgatcactgtatctaagatcctgcaccataagatgctccactccgtcctgcaggctcctatgagtactctgaatactctgaaggcaggcggtattctgaaccgcttctcaaaggatattgctattctggatgatttgttgcccctcacaatatttgatttcattcagcttctcctgatcgtgataggcgctatcgcagtggtcgctgtgttgcagccctacatctttgtcgctactgtcccagtaatagtggcattcatcatgcttagggcctactttctccagacctcccagcagctgaagcagctcgagtccgaaggtaggagccctatcttcacccacctcgttacctcacttaaaggcctctggaccttgagagcttttggtagacagccctactttgaaactttgttccataaggccctgaacctccacaccgccaactggttcctttatctttcaacactcagatggttccaaatgcgcatcgagatgatctttgttattttctttatcgcagtcaccttcataagcattcttaccactggagaaggagagggtagagtaggcatcatcttgaccttggccatgaatatcatgtccacccttcagtgggctgtgaactcctctatcgatgtggatagtttgatgcgttctgtgagtcgtgtctttaagttcatcgacatgcccactgagggaaagccaactaagtcaactaagccctacaaaaatggccagctttctaaggttatgatcatcgagaattcacatgtcaagaaggatgatatctggcctagcggcggtcaaatgaccgtgaaagacctgacagctaaatatactgagggaggaaacgcaattctggaaaatatctccttctccattagtcctggacaaagggtcggtctgctgggtagaaccggatctggcaagagcaccctgctgtctgccttcctccgcctcctcaacactgaaggtgaaattcagattgacggagtcagctgggactctataaccttgcagcagtggagaaaggccttcggagtaatccctcaaaaggtgtttatcttcagcggcaccttcagaaagaatctcgacccttatgaacagtggtctgatcaagaaatatggaaggttgccgatgaagttggacttcgttcagttattgaacaatttcccggcaaattggatttcgtcctcgttgacggtggctgcgtgttgtctcatggccataaacaattgatgtgcctcgccaggtctgttctgagcaaggctaagatactgctcctggatgagccttcagcacacttggatccagtcacctaccagatcattcgtaggactcttaagcaggccttcgctgactgcaccgttattctctgcgagcacagaatagaggccatgcttgaatgccaacagttcctcgttattgaggagaacaaggtgaggcagtatgatagcatccagaaactgctgaacgaaaggtccctgtttaggcaagccatcagcccctctgaccgcgtcaaactcttcccccataggaattcctcaaagtgcaaaagcaagccccagattgccgctcttaaggaagagacagaagaggaggtccaggatactcgtctg

SEQ ID NO: 10209 - DNA, 4440 bp, Artificial Sequence
  Description of Artificial Sequence: Synthetic coding sequence
atgcaacgcagccctctggagaaggcgtccgtggtgagcaagctgttcttctcctggaccagaccgatactgcgtaagggctacagacagcggttggagctgtcggatatctaccagatcccgtcggtggactccgctgataacctgtccgaaaagctggaacgggaatgggaccgcgagttggccagcaagaagaatccgaagctcatcaacgcactccgcaggtgcttcttttggcggttcatgttttacggaatcttcctgtacctcggggaagtgaccaaagcggtgcaaccgctgctgcttggtagaatcatcgcctcgtacgacccggataacaaagaggagagatcgatcgctatctacttggggatcggactgtgcctgttgttcattgtccggacgctgttgctccatccggcgatctttggactccatcacattggaatgcagatgaggatcgcgatgttttccctgatttacaagaaaaccctgaaactctcgagcagggtcctggataagatctcgatcggccagttggtgtcgcttctgagcaacaaccttaacaagttcgatgaaggcctcgccctggcgcacttcgtgtggatcgcgcctctgcaagtggcactgctgatgggacttatctgggaactcctgcaggcctccgccttctgtggactgggtttcttgatcgtgctcgcccttttccaggctggcctgggacggatgatgatgaagtaccgggatcagcgcgctggaaagatctccgaacggctggtgatcacgtcggagatgattgagaacatccagtccgtcaaggcctactgctgggaggaagctatggagaagatgatagagaacttgcgtcaaactgagctcaagctcaccagaaaggctgcctacgtgagatatttcaacagcagcgctttcttctttagcggattctttgtcgttttcctgtccgtcctcccgtacgcgttgatcaaggggatcatcctccgcaagatcttcaccaccatctcattttgcattgtgcttcgcatggccgtcactcggcaattcccatgggcagtgcagacttggtacgactcgctgggcgcaattaacaaaatccaggattttcttcagaagcaggaatacaagactctcgaatacaacctcaccactactgaagttgtgatggagaatgtgacggccttctgggaagaaggattcggagagcttttcgagaaggccaagcagaataacaataacagaaaaacctcgaacggggacgactcgctcttcttttccaacttttcgctcctgggaaccccggtgcttaaagatatcaacttcaagatcgagcgcggacagctgctggccgtcgcgggctccactggcgcaggcaagaccagcctgctcatggtgatcatgggagaactggaaccgagcgagggtaagatcaagcacagcggacggatctcattctgttcccaattctcgtggattatgccaggtaccatcaaggagaacatcatctttggcgtgtcctatgatgagtaccggtaccgatcggtgatcaaggcgtgccagctggaagaagatattagcaaattcgccgaaaaggataacatcgtcctcggtgagggcggaataactctttccgggggacagagggcacggatctcgctcgccagagctgtgtacaaagacgcggacctctacttgttggactcgcccttcggatacctggacgtgctgaccgaaaaggaaatcttcgaatcatgcgtgtgcaagctgatggcaaacaagacccgcattctggtgacctcgaagatggagcacctgaaaaaggcggacaaaatcctcattttgcacgagggtagctcgtacttttacggaactttctcagaactccagaacctccagccggacttcagctcaaagctcatggggtgcgactccttcgaccagttctccgctgagagaagaaactcaatcctgaccgaaaccctccaccgcttctcactcgaaggagacgctcctgtgtcgtggaccgagacgaaaaaacagagcttcaaacagaccggcgagttcggagaaaagagaaagaactcgatcctgaatccaatcaacagcatcagaaagttttcaatcgtgcagaaaactccgctccagatgaacggtatcgaagaggactcggacgagcctctggaaaggcgcctctcgctggtcccggactccgaacagggagaagccatcctgccgcgcatcagcgtcatctccactggccctaccctgcaggcacgcagacggcaatcggtgctgaacctgatgacccattccgtcaaccaaggacagaatatccaccgcaaaaccaccgcatcgaccagaaaagtgagcctcgcgccgcaagcgaacttgaccgagctcgacatctactcacgtcgtctctcgcaagaaactggactcgagatctccgaggaaatcaatgaagaggaccttaaggaatgctttttcgatgacatggagtcgattccagccgtgaccacgtggaacacctatctgcgctacatcaccgtgcacaagtcgctcatatttgtcctgatctggtgcttggtcatctttctggccgaagtggcggcctcgctggtggtgctgtggctgttgggcaacacgccactgcaggacaaggggaactcaacccatagccggaataactcgtacgcggtcatcatcaccagcacttcctcctactacgtgttctacatttatgtcggtgtggccgatacgctgctggccatggggttttttcgcggcctgccgctggtgcataccctgatcacggtgtccaagatcctgcaccacaaaatgctccactcggtgctgcaggcaccgatgtcgactcttaatactctcaaggccggaggaatcctcaaccgcttctcgaaggacatcgccatcctggacgacctcctgcctctgacgatctttgacttcatccagctgcttctcattgtgatcggagcaatcgccgtggtggccgtcctgcagccttacattttcgtggctactgtgccggtgatagtggcctttatcatgctgcgggcgtatttcctccaaacctcccagcaactgaagcagttggaaagcgaaggccggtcaccaatctttactcacctcgtcacctcgcttaagggcctgtggacgctccgcgcgttcggacggcaaccatacttcgaaaccctctttcacaaggctctgaatctgcacactgccaactggttcttgtacctgtcgaccctgaggtggtttcaaatgcggatcgaaatgatcttcgttatcttcttcattgccgtcacttttatcagcattctgactactggcgagggagaaggacgcgtgggaatcattctcaccttggcgatgaacatcatgtccaccctgcagtgggccgtgaattcctccatcgatgtggactcgctcatgcgctcagtcagcagagtgttcaaattcatcgacatgccgaccgagggaaagccgaccaaatccactaagccctacaaaaatgggcaactctccaaggtcatgatcatcgagaatagtcacgtcaagaaagatgacatctggccgagcggtggccaaatgaccgtgaaggaccttaccgccaaatacaccgaaggaggaaacgcgattctggagaacatctcatttagcatctcccctgggcaaagggtcggattgctcggtcgcactggatccggaaaatcaactctgctgagcgccttcctgaggttgcttaacaccgaaggcgagattcagatcgacggagtgtcatgggactcaattaccctgcagcaatggaggaaggcattcggggtgatacctcagaaggtgttcatcttttcagggaccttcagaaaaaacctggacccgtacgaacaatggagcgatcaggaaatctggaaggtggcggacgaagtgggtctgcggagcgtgatcgaacaattccctgggaaacttgattttgtcttggtggatggcggctgcgtgctgtcacacggccacaaacaactgatgtgcttggcccgctcggtcctgtccaaggctaagatcctgctgctggatgaaccgtcggcgcacctggaccctgtgacctaccagatcatccggcggaccctgaagcaagcattcgccgattgtactgtgatcctgtgtgaacatagaatcgaagcgatgctggaatgtcaacagttcctggtgatcgaagagaacaaggtgagacagtacgacagcatccaaaagctgctgaatgagcgaagcctttttagacaggccatctcgccgtctgaccgggtgaagctcttcccgcatcgcaatagctccaagtgcaaatcgaagcctcaaatcgccgccctcaaggaggagactgaggaagaagtgcaagacactcggctg

SEQ ID NO: 10210 - DNA, 4440 bp, Artificial Sequence
  Description of Artificial Sequence: Synthetic coding sequence
atgcagcgctccccacttgagaaggcgagcgtggtgagcaagctcttcttttcctggaccagaccgattctgagaaaaggttacagacagagacttgaactctcggatatctaccaaattccgagcgtggactccgccgataacctgtccgagaaacttgaaagggagtgggaccgggaattggcctcaaagaagaatccaaagctgatcaatgcactccgtaggtgcttcttctggcgatttatgttttacggaattttcctctatctgggagaggtcaccaaagctgtccagccgctgctcctggggcgcatcatcgcgtcctacgaccccgacaataaggaggagcggagcatcgcgatctacctggggatcggactgtgtctgctgttcatcgtgcggactctcctgctgcaccccgcgatcttcggtctgcatcacatcggaatgcaaatgcggatcgcaatgttctcgcttatctacaaaaagacccttaaacttagctcaagagtgctggacaagattagcatcggtcagctggtgagccttctctcaaataacctgaacaagttcgacgagggactggccctggcccatttcgtgtggatcgccccactccaggtggcactcctcatgggactgatctgggagttgttgcaagcgagcgccttctgtggattgggcttcctgatagttctcgcactgttccaggcgggcttggggcggatgatgatgaagtaccgggaccagcgcgcgggaaagatttcagagcgcctcgtcatcacttcggaaatgatagagaatattcagtccgtcaaagcctactgctgggaggaagccatggagaaaatgatagaaaacctgcgccaaactgagctcaagttgactaggaaggccgcatacgtgagatacttcaacagctcggcattcttcttcagcggatttttcgtggtattcctctctgtactgccgtacgccctgatcaaaggaatcatcctgaggaagatcttcaccaccatctcattctgtattgtcttgcgcatggcggtgacgagacagttcccatgggcggttcaaacttggtacgactcattgggagcaatcaacaaaatccaggactttctccagaaacaagagtacaagactctggaatacaacttgaccactactgaagtggtgatggagaatgtcactgcattttgggaagagggcttcggagagcttttcgagaaggcaaagcagaataacaataatcggaaaacctcaaacggagacgacagcctctttttctcgaacttctcgctcctgggaactccggtcctcaaagatatcaacttcaagatcgagcggggccagcttcttgcagtagccggaagcaccggagcaggcaagacctccctgctgatggtcatcatgggagagttggaaccgtcggaaggaaagatcaaacattcgggacggatcagcttttgctctcaattctcatggattatgcccggcaccatcaaagagaacatcatcttcggagtgtcgtacgatgagtaccgctacagatccgtgatcaaggcctgccagttggaagaggacatctcgaagttcgcggaaaaggacaatatagtactgggtgaagggggaatcaccttgtccggcggccagagagcccgtatctcgctggcacgcgctgtctacaaggatgcggatctgtacctcctcgattcaccgttcggctatctcgacgttcttacggagaaggagatctttgaatcgtgcgtctgcaaactgatggctaacaaaacccggattctggtcacgagcaaaatggagcacctgaagaaagccgataagatcctgatcctgcatgaaggatcatcatatttctacggaactttctccgaactgcaaaacctgcagcccgacttctcgtcgaagctgatgggatgcgattcgttcgatcaattctcggctgaacgacgcaactcaatcctcaccgaaacgcttcataggttctcgctggaaggtgacgccccagtcagttggaccgaaaccaagaagcaatcatttaagcaaactggtgaattcggagaaaagcgaaagaactcgatccttaacccgatcaactcaatcagaaagttctcgatcgtccagaaaactccactgcaaatgaacggaatcgaagaggacagcgatgagccgctggagaggagactgtcattggtcccggactccgagcagggcgaagccattctgcccagaatttccgtgatctccacgggaccgaccctccaggcgaggcggcggcaatcggtgctgaacctgatgacccattccgtgaaccagggccagaatatccatcgcaaaactaccgcttctaccagaaaggtcagcctggctcctcaggcaaatctgactgagctcgacatttactcccgcagattgtcccaggaaaccggactggaaatttcagaggagatcaatgaagaggacctgaaggagtgcttctttgacgacatggaatccatccctgcggtgaccacttggaacacctacctgcgctacatcactgtgcacaaatcactgatctttgtcctgatctggtgcctggtgatcttcctcgcagaagtagccgcctccctggtcgtgctctggctcctgggaaatactccacttcaagacaaggggaacagtactcactcgcgcaacaattcgtacgcagtgatcatcacgtctaccagcagttactacgtattctacatctatgtcggtgtggcggacaccctgttggctatggggtttttccgggggcttccgctggtgcacaccctcattaccgtgtccaagatcctgcatcacaagatgcttcacagcgtgctgcaggccccaatgagcaccctcaacaccctgaaggccggcggaatcctcaatcggttctccaaggacatcgctatcctcgatgatttgctgcctctcactatcttcgacttcatccaactcctgctgatcgtcattggggccatagccgtggtggctgtgctgcagccgtacattttcgtggctacggtgcctgtgatcgtggcctttatcatgctgcgggcctacttcctccagacttcccagcagttgaaacaactggagagcgagggtcgctcgccaatctttacccacctggtgacttcgctgaaggggctctggaccctgagggccttcggcaggcaaccctacttcgaaaccctgtttcataaagccctgaacttgcacaccgccaactggtttctttacttgtccactctgcggtggttccagatgcgcatcgaaatgattttcgttatctttttcatcgcggtgacctttatctctatcctcactaccggagagggcgaaggccgcgtcggtatcattctgactctcgcgatgaatatcatgtccaccctccagtgggcagtgaattctagcatcgacgtggactcactcatgcgcagcgtctcccgggtgttcaagttcatcgacatgccgacggaaggcaagccgaccaagagcactaagccttacaagaacggccaactctccaaggtcatgatcatcgaaaactcccatgtgaaaaaggatgatatttggccttccgggggccaaatgactgtgaaagacctcaccgctaaatacaccgaaggagggaacgccatcctcgaaaacatctcttttagtatctcgccgggccaacgggttggacttctcggacgcactggttccggaaaatccacgctgctttcagcctttctccgactcctcaacactgaaggagaaatccaaatcgacggcgtgtcctgggattccataaccctgcaacaatggcgaaaggcgttcggcgtgataccacaaaaggtgtttatcttctccggaactttccgcaagaatttggatccttacgaacagtggagcgatcaggaaatctggaaggtggccgatgaagtggggctccgctcagtcattgagcaatttccaggtaagctggatttcgtccttgtcgacggagggtgcgtgctgtcgcacgggcacaagcagcttatgtgtctggcgcgctcggtgctgagcaaagctaagatcctgctgctggatgaaccgtcggctcacctggaccctgtgacctatcagatcattcgccggactttgaagcaggcttttgctgactgtaccgtcatcctttgcgaacaccgcattgaagcaatgctggaatgccagcagttccttgtgatcgaggaaaacaaggtcagacagtacgattcaattcagaagttgctcaatgagcgctcgctctttcggcaggccatctcgccgtccgacagagtgaagttgttcccacaccggaactcgtcaaaatgcaagtcaaagccgcagatcgccgccctgaaggaagaaacggaagaggaggtgcaggatactcggctc

SEQ ID NO: 10211 - DNA, 4440 bp, Artificial Sequence
  Description of Artificial Sequence: Synthetic coding sequence
atgcaaaggtccccgctggagaaggccagtgtcgtgagtaagctcttcttcagttggacccgccctatactgcgaaaggggtacagacagagattggagctgtccgatatctaccaaattccatcagtggactccgccgataacttgtctgagaaacttgaaagagaatgggacagggagctggcctctaaaaagaaccccaaactgataaacgccctccgacgatgctttttctggagattcatgttctatggcatctttctgtatctcggagaagtcaccaaagccgtgcagccactgctgctgggcaggatcatcgccagctacgacccagacaataaagaggagcgttcgatcgctatctatctgggcatcggcttatgtctgctgttcatcgtgagaactttgctactgcatcctgctattttcggccttcaccacattgggatgcaaatgaggattgcaatgttctcgttgatttacaagaagaccttaaaactgagctcccgagtactggataagattagcatcggtcagctggtgtcactgttgtccaacaatctaaacaagttcgacgaaggtctggccctggcacacttcgtgtggatcgcccccctccaggtcgctttactaatgggcctaatttgggaattactgcaggcttctgccttctgcggtctggggttcctcatcgtgctcgccctgtttcaagctggcctcggaagaatgatgatgaagtatcgggaccaaagagctggaaaaattagcgaaagacttgtaattactagcgagatgattgagaatattcagtccgtcaaagcctactgttgggaagaggctatggaaaagatgatcgaaaatcttcgacaaaccgaactgaagcttactcgaaaggcagcttatgtgcgatatttcaacagtagcgctttcttcttctccggtttttttgttgtgttcttgtccgtcctaccttacgcgttgatcaagggcattatcctgcgaaagatattcaccaccataagtttttgtatcgttctcaggatggctgtcacacgacaatttccttgggccgtccaaacatggtatgattctctaggagcaattaataagatccaggatttcctgcagaagcaggaatacaagacactcgaatacaatctgactaccactgaagtagtgatggaaaacgtgaccgccttttgggaagagggatttggagaactgttcgagaaagccaagcagaacaacaataataggaaaacttcaaacggggatgattccctattctttagtaacttttcgctgcttgggacacctgtactgaaggatataaacttcaagattgagagaggacagctgctggcagtagcaggctctaccggagccggtaaaacaagcctgttgatggtgatcatgggagaactggaacctagcgaggggaagataaagcactccgggagaatttctttttgctcacagttttcctggattatgcccggcaccattaaggaaaatataatctttggggttagctacgacgagtatcgttacaggagtgtgatcaaagcctgtcagctggaagaggatattagcaagttcgctgaaaaagataacattgtcctgggtgaaggcggaataactttgtccggagggcagcgggcgagaatttccctggcacgtgccgtctacaaggacgcagatctctacctcctggattcccctttcggctatctcgatgtgttgaccgagaaggaaatatttgagtcttgcgtgtgtaagctcatggcaaacaaaacaagaattttggtaaccagcaaaatggagcatttgaaaaaagccgataagatacttatactacacgaaggctcttcctacttctacgggacctttagcgagctgcagaacctacaacccgatttttctagcaaactgatgggctgtgacagttttgatcagtttagtgcggaaaggaggaatagcatacttacagaaaccttacaccggttcagcctagagggagacgctcctgtgtcttggactgagactaaaaagcagtccttcaaacagaccggcgaattcggggaaaagaggaagaattccatcctcaatcctataaacagcattcggaaattctctattgtgcagaaaacgccgctgcaaatgaatggcatcgaagaagatagcgacgaacctcttgagagaaggttgtcccttgttcccgacagtgagcagggcgaggccatattgccgcgaatttcagtgatcagcaccggtcctacgttgcaagcgcgaagaagacagtccgtgctgaatctcatgacgcattctgtcaaccaaggtcagaacattcatcgaaaaaccacagcttctacaagaaaagtctctctggcgccacaagccaatcttaccgagctggacatatatagtcgtcgcctgagccaggagaccggtctcgagatatccgaagagataaatgaagaagacctcaaggagtgcttttttgatgacatggagtccattcctgcggtaaccacatggaacacttacttgagatacataacagtgcataagagcctcatattcgtccttatctggtgtctggtcatcttcctcgccgaagtggcagcctccttggtggtcctctggctcctgggaaatacaccactgcaggacaagggtaacagtacccatagccgaaataactcatacgccgtgattataacctctacttcttcatattatgtgttctatatttacgttggggtcgcagataccctgctggctatgggcttttttcgagggttgccactggtccacaccctcatcacagtttccaagatcctgcaccacaaaatgctccattctgtactacaggcccccatgagcactcttaacacgttgaaagctggaggtatcttgaaccgattcagcaaggacatcgctattctggacgacttgcttccgcttacaatttttgatttcatacagctgttactgattgtgatcggcgccattgcggttgttgccgtcttgcagccatatatctttgtggcaaccgtgccggtgatcgtggctttcatcatgctgagagcgtatttcctgcagacgtcccagcagttgaagcagctggaaagtgagggtcgttccccgatttttacgcacttggtgacaagcctgaaaggcctgtggaccctgagggcgtttggacgacagccctacttcgagacacttttccacaaggctcttaatctgcacacagcgaattggttcttgtatctgagtacacttaggtggtttcagatgagaatcgagatgatatttgtcatctttttcatcgcggtcaccttcatttctatcttgacgacaggagagggtgaaggaagagtagggatcattctgaccttggctatgaatatcatgagtaccctccagtgggcagtgaattcaagtattgatgtggactcactcatgcgtagtgtgagtagagttttcaaatttattgacatgcccaccgaggggaagcctactaaaagcacaaaaccatataaaaacggccagttatccaaggtaatgatcatagaaaacagccatgtgaagaaagatgatatctggccaagcggaggacagatgactgtgaaagacctgaccgccaagtatactgagggtggaaacgccatcctggaaaacatctccttctctatatccccgggtcagagagtgggccttttaggtcgtacaggatctggaaaatctaccctcttgagcgcattcttaagactgctcaataccgaaggcgagatccagatcgatggcgtttcctgggacagtattactctgcagcagtggaggaaagcttttggagtgatcccacaaaaggtgttcattttctccggcacttttaggaaaaatctggacccttatgagcagtggagtgaccaggaaatctggaaggttgcagacgaagtcgggctgcgatcggtgattgagcagttccccggcaaactggattttgtgctggttgatggcggctgcgtcctcagccacggccacaagcagctgatgtgcctcgctcggtctgtccttagtaaagctaagatcctactgttagatgaaccctctgcccatctggacccagtcacctaccaaatcatccgaagaacccttaagcaggccttcgccgattgtactgtgatcttgtgcgagcacaggatagaagccatgttagagtgtcagcaattcctggtgattgaagaaaataaggttcgacagtacgacagtatacagaagcttctgaatgagagaagtctgttcagacaggccattagcccttccgaccgagtgaaacttttccctcaccgcaatagctcgaagtgcaaatccaagccacagatcgccgcattgaaggaggaaaccgaagaggaggtgcaggacaccagactg

SEQ ID NO: 10212 - DNA, 4440 bp, Artificial Sequence
  Description of Artificial Sequence: Synthetic coding sequence
atgcagagaagcccgctcgagaaggctagcgtcgtgtccaaactgttttttagctggaccagaccgatcctgagaaagggttaccggcagcgcctcgagctgtcggacatctaccagataccgagcgtcgattccgctgacaacctgtcagaaaagctggaacgggaatgggatcgagagcttgcaagtaagaaaaacccaaagctcatcaacgcacttagacggtgcttcttctggcgcttcatgttctacggaattttcctgtacctgggtgaggtcactaaagccgtgcaaccgctgctcctgggacgcatcatcgcatcatacgatccggataataaggaagaacggagcatcgcgatttacttggggattggactttgccttctgttcatcgtcagaactcttctgctccatcccgccatcttcggtttgcaccacatcgggatgcagatgcggatcgcgatgttctcgctcatctataagaaaactctcaaactgtccagccgggtcttggataaaatctcaatcggtcaactggtcagcctgctgtccaacaatctgaacaagtttgacgaaggccttgcactggcgcatttcgtgtggatcgcccccctgcaagtggccttgctgatgggactgatctgggaactgttgcaggcatcggcgttctgcggattggggttcctcatcgtactggctctgttccaggctggactcggaagaatgatgatgaagtaccgcgaccaacgcgcaggaaagatctcagagcgcctcgtcatcacgtccgaaatgattgagaatatccagtccgtcaaggcgtactgttgggaggaagcgatggagaagatgatcgaaaatctccgccaaaccgagctcaaactcactcgcaaggccgcctacgtgcggtactttaactcgtccgcctttttctttagcggattctttgtggtgttcttgtccgtgctcccatacgcgctgatcaagggaatcatcctgcggaagatttttactaccatcagtttttgcattgtcctgcgcatggccgtgactaggcagtttccgtgggctgtgcaaacgtggtacgactcactgggcgccatcaataagatccaggatttccttcaaaagcaggaatacaagaccctggagtacaacctcaccaccactgaagtagtgatggaaaacgtgaccgccttctgggaagaggggttcggagagttgtttgaaaaggcgaaacagaacaacaacaaccggaaaacttccaacggggatgacagcttgttcttctccaacttctccctcctcggcactccggtgctgaaggacatcaatttcaagatcgaaagaggtcagctgctcgccgtggccggatcgactggagccggtaaaacctccctgctgatggtgatcatgggggagctggagccatcagagggaaaaatcaaacactccggtcggatctccttttgcagccagttctcctggatcatgccaggcactatcaaggagaacattatcttcggcgtgagctacgacgaatacagatatcgcagcgttatcaaggcgtgtcagctggaggaggatatttccaagttcgccgagaaggacaacattgtgctcggagaaggaggcatcaccctgtcgggaggccagcgggcgcgcatctcgctggcacgggcagtgtataaggacgcagacctctatctgctcgactccccgtttggatacctggacgtgctcactgagaaggagatcttcgagtcgtgcgtgtgcaagctcatggccaacaagaccagaatcttggtcacctcgaagatggaacacctcaagaaggctgacaagatcctgatcctgcacgagggatcgtcgtacttctacggtaccttctcagaactgcagaatctgcagccagatttctcgagtaagttgatggggtgcgactccttcgaccaattctccgccgaaagacgcaactcaatcctcactgaaactctccacaggttttcactggaaggcgatgcacctgtgagctggactgagactaagaagcaatcgttcaagcaaacgggggaattcggggagaagagaaagaactcgatcctgaatccgatcaacagcatccgtaaattcagcatcgtccaaaagactcccttgcagatgaacggaatcgaagaggattccgatgaaccgcttgaacggcggctgtcgctcgtgcccgattccgaacagggagaggctattctgcctaggatctcagtcatctccacgggacctactctccaggcccgccgccgccagagcgtgctgaacctgatgacccattcagtgaaccagggccagaatatacaccgcaaaactaccgcctctactagaaaggtgtcactcgctccacaggcgaatttgaccgagctcgacatttactcgcggaggctgtcacaagaaactggactcgagatttctgaggaaatcaacgaggaggacctgaaagaatgcttcttcgacgacatggagtcgatcccagccgtgaccacctggaatacctacctgcgctatatcacggtgcacaaatcgcttatcttcgtgctgatctggtgcctggtcatcttcctcgcggaagtcgccgcgtccctggtggtgctgtggctccttggaaacaccccattgcaggacaagggaaattcaacccactcgaggaacaactcgtacgcggtcattatcaccagcaccagctcctactacgtgttctacatctacgtcggcgttgcagacaccctccttgctatgggcttttttagaggactgccgctcgtgcatactctgatcactgtctccaaaatactgcatcataaaatgctccatagtgttttgcaagcccctatgtccaccttgaacaccctcaaggccgggggcattctgaaccgtttcagcaaagacatcgccatcctggatgacctgctcccgcttactatctttgacttcattcagctgctgctgatcgtcatcggagccatcgctgtggtggccgtgctgcagccgtacatcttcgtggcaacggtgccggtcatcgtggcattcatcatgctgcgggcgtacttcctgcagacctcccagcagctcaagcagctggaatcggagggtcgctcaccgatcttcacccatctcgtgacctccctcaagggcctgtggactctgcgggcctttggacgccaaccgtactttgaaacgctgttccataaggccctcaatcttcacaccgctaactggttcctgtacttgtcgaccctcagatggttccagatgagaatagaaatgatcttcgtcatcttcttcatcgcggtgaccttcattagcatccttactacgggcgaaggggaaggacgcgtgggcatcatcctgactcttgcgatgaatatcatgtccacgctccaatgggccgtgaattcgtcgattgacgtggattctctgatgcggtcggtgagccgcgtgttcaaattcatcgacatgccgactgaaggcaagcccaccaaatctactaagccgtacaaaaatggacagctctcaaaggtcatgatcatcgaaaactcacacgtcaaaaaagatgacatttggccatcaggcggacagatgacggttaaggatctgaccgcaaagtacaccgaaggcggcaatgcaatcctggagaatatcagcttctctattagccctggccaaagggtgggactgctgggtaggaccggttccggaaagtcgaccttgctgagcgcctttctccggctgctgaataccgaaggagaaatccagatcgacggagtgtcgtgggattcgattaccctgcagcagtggcgcaaggcgttcggagtcatccctcaaaaggtgtttatcttttcaggcactttccgaaagaatctggatccatacgagcaatggtcagaccaagagatctggaaggtggctgatgaggtcggacttcgatcagtgatcgaacaattccctggaaagttggacttcgtcctggttgacggaggatgtgtgctgagccacgggcacaaacaactgatgtgcctcgctagatcggtcctgtcaaaagcaaaaatcctgctccttgatgagccatcggcgcacttggatcctgtgacttaccagatcattcggcggaccctcaagcaggccttcgcagactgtactgtcatcctgtgtgaacatcgcatcgaagccatgctcgaatgccaacagtttctggtgatcgaagagaacaaggtgaggcaatacgacagcattcagaaactgctgaacgaacgcagcctctttcgccaagccatctccccgtcggaccgggttaagctgttccctcaccgcaactcgtccaaatgcaagtcgaagccccaaattgccgctctgaaggaagaaactgaggaagaggtgcaggataccaggctt

SEQ ID NO: 10213 - DNA, 4440 bp, Artificial Sequence
  Description of Artificial Sequence: Synthetic coding sequence
atgcagagatcgccactagaaaaggcctctgtggtgtccaaattattctttagctggacacgccccatcctacggaaagggtacagacagcgtctggagttgtctgacatctaccagatcccctccgtcgatagcgccgataatctctcggaaaaactcgagcgtgaatgggaccgcgagttggcctccaaaaagaaccccaagctgatcaatgccttgcgcagatgttttttttggagattcatgttttacggcatttttttgtacctaggcgaggtcaccaaggctgttcagcctttgctcctcggacggatcatcgcctcttatgacccagacaacaaggaagagaggtctatagctatctatctgggcatcggcctgtgcctactgtttatcgtgcggactctgctcctgcatccagctatcttcggcctgcaccatattgggatgcagatgcgcattgcaatgttcagccttatttataaaaaaacgctcaaattgagtagccgcgtacttgacaaaatctcaattggccagctcgttagcctgctttccaataacctgaataagtttgacgagggtctggctctcgctcattttgtgtggattgctccccttcaggtcgccctcctgatgggcctgatatgggaactgctgcaggctagcgctttttgcggcctcgggttcctgattgttctggctcttttccaggccggactggggaggatgatgatgaaatatcgtgaccaaagggcggggaaaatctctgagcgcctggtgataacgagcgagatgatcgaaaacattcaaagcgtgaaggcctactgctgggaggaagccatggaaaaaatgattgagaaccttcggcagacagaactgaaacttactcgcaaggctgcctatgttagatactttaattcatcggccttttttttcagcggatttttcgtggtgtttctgtctgtccttccatatgcccttattaagggcattattttacgcaagatctttacgacaatcagtttctgcattgtcctgagaatggccgttacccgacagttcccctgggcagtgcagacctggtacgactcactgggggctattaataagattcaggactttctacagaagcaggagtacaaaacactggagtacaacctgactaccactgaggtggtcatggagaacgtgaccgcattctgggaagagggcttcggcgaactattcgaaaaggcgaagcagaacaacaataatcgtaagacatcgaacggtgatgatagtttattcttctccaacttttcactgcttgggaccccagtgctcaaggacatcaacttcaagattgagcgaggccagttgctggcagtagccgggtccacaggggctgggaagacctcactactgatggtgatcatgggcgagctcgagccatccgagggtaagattaagcacagcggccggattagcttttgcagccaattctcctggattatgccgggaaccataaaggaaaatatcatcttcggggtgtcctatgacgagtaccggtataggagcgtaattaaggcatgccaactggaagaagatatatctaaattcgccgagaaagacaatatagtgctaggcgaggggggtataactttatccggtggtcaaagagctcggatctccctggctagagccgtttataaagatgccgacctttacctgctcgattctccctttggttatctcgatgtactgacagagaaagagatcttcgagtcttgcgtgtgtaagctgatggccaataagacccgtatcctggtgacatcaaagatggagcacctgaagaaagcagacaaaatccttatcctgcacgaaggctcatcgtacttttacggaacattctcggaacttcagaacctgcagcccgatttttccagcaagctgatgggctgcgactccttcgaccaattttcagctgaaaggcgcaactccatcctgactgaaacattgcatagatttagcctggagggagacgcaccagttagctggaccgaaacaaagaaacaatcgtttaagcaaactggcgagtttggcgagaaacgaaagaattccatcctcaatccaatcaacagtatcagaaagttctcgattgttcagaagacacccttacagatgaacgggatagaggaagattcagatgagccactagaacgaaggctttccttggtcccagacagtgaacaaggagaagctatcctgcctaggatcagcgtcatctctacgggaccaaccctacaggctaggcgcagacagtccgtgctcaacctaatgacccatagtgtgaatcagggccaaaacatccataggaaaaccaccgcttccactcgtaaggttagcttggctccccaggcgaatctgaccgaactggatatctacagtaggagattgtcgcaagaaactggattggagatcagtgaggagattaatgaggaggatctgaaagaatgtttttttgatgatatggaaagcattcctgctgtgacaacctggaacacctatctccggtacataacagttcataaaagtctaattttcgtgctgatatggtgcctggtaattttcctggccgaagtggctgcttctctggtcgtcctgtggctcctgggcaacaccccactacaggataaggggaattccacccatagtagaaataattcttatgctgtcatcattacatctacatctagctattatgtcttttacatttacgtgggcgtggctgacacattgctggcaatggggtttttcagggggctccctctagtccacacactgattaccgtctcgaaaattttacaccacaaaatgctgcactccgtgctccaggcccctatgagtacactgaatacactgaaagccggtgggattctgaaccgattctctaaagacatagcaatactggacgatttgttgccgctaaccattttcgattttatacagttattactaatcgtcattggtgcaatcgccgtcgtggcggttttgcagccctacatctttgtcgctactgtaccggtcattgtggcttttataatgctgcgagcttatttcttgcagacctctcaacagcttaagcagcttgagtctgagggcaggtctccgattttcacacacttggtgacctcgctcaaggggctttggaccttacgggccttcggcaggcagccttatttcgaaaccctgttccacaaggcccttaatcttcacacggcgaactggttcctctatttaagtaccctccggtggttccaaatgagaattgagatgatattcgttatcttttttatagccgtgacgttcattagcatccttaccacgggcgaaggtgaaggacgagtcggcataattctgactttagccatgaacataatgtccaccttgcaatgggctgtgaatagcagcatcgacgtggattccttgatgcggtcggtgagtagagtctttaaattcattgatatgccgacagaggggaaacccacaaagtctaccaaaccctataaaaacgggcagctgtcaaaggtgatgatcatcgagaatagtcacgtaaaaaaggatgacatctggccctcaggaggacaaatgaccgtgaaagatctgaccgccaagtataccgagggggggaatgccattctggagaatatctcctttagcattagccctggccagcgggttggtctcctgggccgaaccggatccggcaaatctaccctcctgtctgcctttctgcggctgcttaacacagaaggagaaatccaaatcgatggagtctcgtgggacagcataactcttcaacagtggaggaaggcctttggcgtgatcccccagaaagtcttcatattctcgggaacgttcagaaagaatcttgacccgtacgaacagtggtcagatcaagagatttggaaggtggccgatgaggtggggttgcgcagcgtgatcgagcaattcccaggcaagctggacttcgtcctggtggacggaggctgcgtgctgtcacacgggcataagcagctcatgtgcctggcccgcagtgtgcttagtaaagccaaaatccttctcctcgacgagcctagcgcccacctggaccctgtgacataccagattatccgacgcacccttaaacaggcctttgcagattgcactgtgatactgtgtgaacaccggatcgaggccatgttagaatgtcagcaatttcttgtcattgaagaaaacaaggtgcgacagtatgacagcattcagaaacttctcaatgagaggagcttgtttcgccaggccatcagtccttcggaccgtgtgaaactttttccacatagaaactccagtaaatgcaagtctaagcctcagatcgctgcattgaaagaagagaccgaagaagaggtccaagacacacgttta

SEQ ID NO: 10214 - DNA, 4440 bp, Artificial Sequence
  Description of Artificial Sequence: Synthetic coding sequence
atgcaacgcagccctctggaaaaggcttcggtggtgtccaaactgtttttctcatggactcgcccaatactgcggaaaggctatcgccagagactcgaactgtccgatatctaccaaatcccaagcgtggattcagcggacaacctcagcgaaaagctcgagcgggagtgggatagggagttggcttcgaagaaaaatccgaagctgatcaatgccttgcggcggtgcttcttctggcgtttcatgttttacggaatcttcctgtatctgggggaggtgaccaaggccgttcaacccttgttgttgggccggatcatcgcgtcgtacgacccagataacaaggaagagaggtccatcgccatctatctggggattggactttgtctgctgttcatcgtccgcaccctgttgctccaccccgccatttttgggctgcatcacatcggtatgcaaatgcggatcgcgatgttctccctgatctacaaaaagactctgaagctgtcctcgcgggtgctcgacaaaatctcgattggacaattggtgtccctgctttcgaacaatctcaataagttcgatgagggcctcgctctggcccactttgtctggattgcgccgcttcaggtggcactcttgatgggactgatctgggagctgttgcaggcatctgccttctgcgggctcgggttcctgatcgtcttggcattgttccaggctggcctgggacggatgatgatgaagtaccgcgaccagagagctggtaaaatctccgaaagactcgtcatcactagcgaaatgattgagaacatccagagcgtgaaggcatactgctgggaagaagcaatggaaaagatgatagagaacctcagacaaacggaactgaagctcacccgcaaagccgcttatgtcaggtactttaactcaagcgccttcttcttctcgggttttttcgtggtgttcctgtcggtgctcccgtacgccctgatcaaggggattatccttcgaaagatcttcacgaccatcagcttctgcatcgtgctgcggatggccgtcaccagacagtttccttgggccgtgcagacttggtacgactctctgggagccattaacaaaatccaggacttcctccaaaagcaagaatacaagaccctcgagtacaacctcaccacgactgaggtggtcatggaaaacgtcacggcattctgggaagagggattcggagaactttttgaaaaagccaaacagaacaataacaacaggaaaacctcgaatggagacgattcactgttcttttcgaactttagcctgctcggtactccggtgttgaaagatatcaacttcaaaatcgaacgcggtcaactgcttgcagtcgctggaagcaccggagcaggcaaaacctcgctgcttatggtgatcatgggtgaactcgaaccgtccgaaggaaagattaagcattccggccggatctccttttgctctcaattctcgtggattatgccgggaactatcaaggaaaacattatcttcggggttagctacgacgagtacaggtacagaagcgtcattaaggcctgccagctggaggaggacatctccaagttcgcagaaaaggacaacattgttcttggtgaggggggcatcaccttgagcggaggacagagagcccggatctcactggcgcgggctgtgtacaaggatgcagacctctacctcttggactcgccattcgggtaccttgatgtgttgactgagaaagagatttttgagtcatgtgtctgcaagctcatggctaataagacgcgcatcctggtgacttcgaaaatggagcatcttaagaaggccgacaaaatcctgattctgcatgaaggctcctcctacttctacggtactttttcggaactgcagaatctgcagccggatttctcatcaaaactgatggggtgcgatagcttcgaccagttttcggcggaaagacgcaactcaattcttaccgagactctccaccgcttcagccttgagggagatgcacccgtgtcgtggactgaaaccaaaaagcagtcattcaagcagaccggagagtttggggagaagcgcaagaactcgattctgaatccgatcaattccattcggaagttctccatcgtgcaaaaaacgccgctccagatgaacggcatcgaagaagatagcgatgaaccgctggaacggcggttgtccctcgttccagactccgagcaaggtgaggcaattctgcctcgcatctcggtgatctccactggacctacgctgcaggctcgccgccggcagtccgtcctgaacctgatgactcactcggtcaatcagggacagaacatccaccgaaaaaccactgctagcacccgcaaggtcagcctggcgcctcaagccaatctcactgaactggatatctatagccgccgccttagccaagaaaccgggctcgagatttccgaggaaatcaatgaggaagatctcaaggaatgctttttcgatgacatggagtcaatcccagccgtgactacctggaatacttatctcagatacatcaccgtgcataagtcactcatcttcgtgttgatctggtgcctggtgatcttcctcgctgaggtcgccgccagcctcgtggtcctgtggctcctgggcaacactccgctccaggacaagggtaacagcactcactcgagaaacaattcctacgccgtgattatcacttcgaccagctcatactatgtgttttacatctacgtcggcgtggcggacactttgttggcgatgggattcttccgcggactgccactggtgcacactctcatcactgtgtcgaagatcctgcatcacaaaatgctccactccgttcttcaagcaccgatgtcaactctgaatactctgaaggcgggaggcatcctgaacaggttctcaaaggacatcgcaattctggacgacttgctgccgctcactatattcgacttcatccagcttcttttgattgtgatcggagcgatcgcggtggttgccgtgcttcaaccctacatcttcgtggcaacggtgccggtcatcgtcgcgtttatcatgctccgggcgtacttcctccagacttcgcaacagctgaagcagctggaatcggagggacggtccccaatctttacgcatctggtcacttctctgaagggactgtggacgctgcgggctttcgggcggcagccgtacttcgaaaccctgttccataaggctctgaatctgcacactgccaactggttcctctacctctcgaccctccgctggttccagatgagaattgaaatgatttttgtgatcttcttcatcgctgtcaccttcatctcgatcttgactaccggagaaggagagggtcgcgtgggaatcatacttactctcgccatgaacattatgagcaccctgcagtgggctgtgaactcatccatcgacgtggattcgctgatgaggtccgtctctcgcgtctttaagtttatcgacatgccgactgaaggtaagccaactaagtcaaccaaaccgtacaaaaatggccaactgtccaaagtgatgatcatagagaactcccacgtgaagaaagacgatatctggccgagcggcgggcagatgactgtgaaagatctgactgccaaatacaccgaaggaggcaatgccatcttggaaaacatctcgttcagcatctcaccgggacaaagagtgggactcctggggcggactggctcgggaaagtccacgctgctctcggcattcctgcgactgttgaataccgaaggtgagatccaaatcgatggcgtgtcttgggactcaatcaccttgcaacagtggcggaaggcgtttggcgtgattccacagaaggtgttcatcttctcgggaacttttaggaagaacctggacccctacgaacagtggtctgatcaggagatctggaaggtggcggacgaagtgggcctccgatctgtgatcgaacagtttcctggtaagctcgacttcgtgcttgttgacggtggatgtgtgctgtcgcacggtcacaagcaactgatgtgcctcgccaggtctgttctgagcaaggcaaagatcctcctgctcgacgaaccgtcggctcacctggaccctgtcacgtatcagatcatccgccggaccctgaaacaggcgttcgccgattgcaccgtgatcctgtgcgagcataggatcgaagcgatgctggagtgtcagcagttccttgtcatcgaggagaacaaggtgagacaatacgactcgatccaaaagctgctcaacgagaggtcactgtttagacaggcgatctccccttcggatcgcgtgaaactctttccgcacaggaactcgtcgaagtgtaagagcaaaccacagatcgcagcgctcaaggaagaaactgaggaagaagtgcaggatacccgcttg

SEQ ID NO: 10215 - DNA, 4440 bp, Artificial Sequence
  Description of Artificial Sequence: Synthetic coding sequence
atgcagcgctcgcctttggagaaggcatccgttgtgagcaaactgtttttctcatggacccggccgatcctgcgtaagggatacaggcaacgactggaactcagcgacatttaccaaatcccttcggtcgatagcgcagataacctctccgaaaagctcgaaagagaatgggacagagaactggcatcaaagaagaaccctaaacttatcaacgcacttcgaagatgttttttctggagatttatgttttacggtattttcctgtacctgggagaagtgaccaaggctgtccaacctctgcttctcggaaggataattgcctcctacgatcctgataacaaggaagaacgcagcattgcaatttacctgggaatcggactgtgtctgttgtttatcgtgcgcactcttcttctccacccagccatattcggactgcaccatatcgggatgcaaatgcgaattgctatgttttccctgatatacaagaaaactcttaagctcagctccagagtcctcgataagatatcaataggtcaactggtgtcactgctctcgaataatctgaacaagttcgatgagggtcttgccctggctcattttgtctggattgcaccactccaagtcgcacttctgatgggacttatttgggaactgcttcaggcctctgccttctgtgggcttgggtttctcatcgtgctggcactttttcaagccggactcgggaggatgatgatgaagtaccgggatcaacgcgcagggaagatctcggaacgactggtgattacttcggagatgatcgagaatattcagagcgtgaaggcctattgctgggaagaagctatggagaagatgatcgaaaatcttcgtcagaccgagctgaagctcaccagaaaagcagcatacgtccgctactttaacagctccgcgttcttctttagtggattctttgtggtgtttctttcagtgctcccgtatgctctgattaagggcattattctgcggaagatcttcactaccatcagcttctgcattgtcctcagaatggcagtgaccagacagtttccctgggctgtgcagacctggtacgactcgctgggcgcaatcaataagatccaggacttccttcagaagcaagagtacaagaccctggaatacaacctgaccaccactgaagtggtcatggaaaacgtgacggcattttgggaagaaggattcggggaactttttgagaaagcaaaacagaacaataacaacagaaagacctccaatggtgatgattcactgttcttctcgaacttttcccttcttggtactccagtgctcaaggacatcaatttcaagattgaacggggacaactcctcgcggtggcagggtcaaccggagccggtaaaacttccctgctgatggtcatcatgggtgaacttgaaccctccgagggcaagatcaaacattccggccgcatttcgttttgttcacagttctcgtggatcatgcccggcaccattaaagagaatatcatattcggagtctcgtatgacgaatatcggtacagatcggtcatcaaggcctgtcagcttgaagaagatatttcgaagttcgccgaaaaggacaatatagtgctgggtgagggagggattactctttctggaggacagagggcccgcatatcgctggcaagagcagtgtacaaagacgcggacctgtatctgctggattccccatttgggtaccttgatgtgcttaccgaaaaggagatttttgaatcctgcgtgtgtaagctgatggcgaataagactcgtattttggtgacctccaaaatggaacatcttaagaaggccgataagatacttatcttgcacgaaggttcgagctacttctacggaaccttttcagaacttcaaaatctgcagcctgatttctcatctaagctgatgggatgcgattcctttgatcagttctcggcagagaggagaaactcgatacttaccgaaaccttgcaccgcttctcgcttgaaggtgacgcacccgtgtcttggactgaaactaagaaacagtcttttaagcagaccggagagttcggagaaaaacggaagaattccatcctgaacccaattaactcgattcgcaagtttagcatagtccaaaagaccccactgcagatgaatggaatcgaagaggatagcgatgaacctcttgaaaggcgactttcactggtgccggactccgaacagggagaagcaattcttcctcgcattagcgtgatttcgactggtcctactctgcaggcacgccgcaggcagtcggtccttaaccttatgacgcatagcgtgaaccaaggacagaatattcatagaaagaccaccgcatcaacccggaaagtgtcgcttgcacctcaggcaaacttgaccgaactggatatctactcacggagactttcccaagagactggtctggagatttccgaagagatcaacgaagaagatctgaaagagtgcttctttgacgacatggaatccatccctgcggtcactacctggaacacctacctgcggtacatcaccgtgcacaaaagccttatctttgtgctcatttggtgtctggtgatttttcttgcagaggtggcggcctctcttgtcgtgctgtggctcctgggcaacactcccctccaggataagggtaactccactcattctcgtaacaattcgtacgcagtgatcataacctcgacctccagttactacgtgttctatatctacgtcggagtggcagataccctgctggcgatgggtttctttcgtggacttcccctcgtgcatacccttatcaccgtgtcgaagatcctccaccataagatgctgcatagcgtgttgcaggcccccatgagcaccttgaacaccctcaaggcaggtggcatcttgaaccggttttcgaaggatatagcaattcttgatgatctgcttccactgactattttcgatttcatccagcttctccttattgtgattggagccatcgcagtggtggcagtgcttcagccttacatctttgtggcaacggtgcctgtgattgtggcgtttatcatgctcagagcgtacttcctccaaacctcgcagcagctgaaacaactggagtctgagggccgaagccctatctttacgcatctggtgacctccttgaaggggctgtggactcttcgcgcctttggtagacagccttactttgaaaccctttttcataaggcactcaaccttcatactgcaaactggtttctgtacctttccacgctgcgctggtttcaaatgcgcattgaaatgattttcgtgattttcttcattgcagtgacgttcattagcatccttactaccggtgagggtgaaggcagagtcggcataatcttgactctggcaatgaatatcatgtcaacgcttcaatgggcagtgaacagctctatcgatgtcgactcactgatgaggtccgtgagccgggtgttcaaattcatcgacatgcccaccgaggggaaacctaccaagagcactaagccttacaaaaacggacagttgagcaaagtgatgataatcgagaattcccacgtgaagaaggatgacatttggccatcaggaggacaaatgactgtgaaggatcttaccgcaaagtacactgaaggcgggaacgcgatactggaaaacatctcattttcgattagccccggacaacgcgtgggactgctcggtagaaccggcagcggcaagtcaactcttctctcagcattcttgagactgcttaatactgaaggggagatccagattgatggagtctcctgggactcgatcacgctgcaacagtggagaaaggcatttggagtgataccccagaaagtgtttatcttctcgggcacttttagaaagaacttggacccttacgaacagtggtcggaccaggaaatttggaaggtggcagatgaagtgggactcagatcagtgatcgaacaatttccaggtaaactggactttgtgcttgtggatggaggatgcgtcctgtcacatggccacaagcaactcatgtgtttggctcgatcggtgctctccaaggctaagatcctgcttcttgatgaaccttcagcacacctggatcctgttacctatcagattatcagacgcactttgaagcaagcattcgccgactgcaccgtgatcctctgtgaacaccgcatcgaggctatgctggaatgccaacagtttctggtgattgaggagaataaggtgagacaatacgactcgatccaaaagctcctcaacgagagaagtttgtttaggcaggccatctccccgagcgatcgcgtcaagctctttccacatagaaatagcagcaagtgcaagtcgaagcctcaaattgcagccctcaaagaagagacggaagaagaggtccaagacactagactg

SEQ ID NO: 10216 - DNA, 4440 bp, Artificial Sequence
  Description of Artificial Sequence: Synthetic coding sequence
atgcagcgctcccctcttgagaaagcttcagtagtttccaagctgttcttcagctggactagaccaatcctcagaaaaggatataggcagagactggagctctcagacatctaccagatccctagcgtggatagcgcagacaacctgtcagaaaaactggaacgcgagtgggatcgcgagctggccagcaaaaagaacccgaagctgattaacgcactgagacggtgctttttctggaggtttatgttctacggaatcttcctatacttgggggaagtaacgaaagctgtacagccactcctgcttgggcggattatcgcctcgtacgatcctgacaataaagaggagcgatcaattgcaatctacctagggatcggactgtgcctgctgtttatcgttcgtaccctcctgctgcaccccgcaatttttggcctgcatcatattgggatgcaaatgagaatcgccatgttctcattgatttacaagaagacattaaaactcagctcacgggtgctcgataaaattagcatcgggcagctggtaagcttgcttagcaataatctcaacaagttcgatgaagggctggctctcgcacattttgtgtggatcgccccactgcaagtagctctcctgatggggctcatctgggaactccttcaggcatcagctttctgtggccttggattcctcattgtgttggccctgtttcaagctgggttgggtaggatgatgatgaagtatcgcgaccagcgtgctggaaagatcagtgagcgcctggtcattaccagcgagatgatagaaaacatccagtccgtaaaagcttattgctgggaggaggcgatggaaaaaatgatcgagaacttacggcagacagaactcaaactgaccaggaaagccgcgtacgtgagatatttcaatagtagcgcattcttcttttccggcttcttcgtcgttttcttgagtgtgctcccctacgcactcataaaaggtatcattctccgaaaaatttttacaaccatatccttctgtatagtgctgagaatggcagtgacgcgccagtttccctgggccgtgcagacttggtacgacagcctgggcgccatcaacaaaatccaggactttcttcaaaaacaagagtataaaacactggaatacaatttaacaaccaccgaagtcgttatggagaacgtgacggccttctgggaggagggtttcggggaattgtttgagaaagctaagcagaataataataacagaaaaacctctaatggcgacgattccttgttcttttcgaatttttctctgctggggacgcctgtgctcaaggatatcaacttcaagatcgaaaggggtcagctcctagcagtggcagggagcacaggcgctggtaagacctcactgctgatggtgatcatgggggaactagagccttccgagggcaagataaaacattcgggacgcatcagcttctgtagtcaattcagctggatcatgcccggaaccatcaaagaaaacatcatcttcggagtgtcttacgacgaataccgctaccggtctgtgattaaggcgtgccagctagaagaggatatttcaaagttcgctgagaaggataatattgtgttgggcgaaggcgggatcaccttgtctggcgggcaacgcgctagaatttccctcgccagggcagtctataaggatgctgacctctacctcctggactccccttttggctacttggacgttcttaccgaaaaggaaatattcgagagctgcgtgtgtaagctcatggccaacaagacacggatattggtgacatccaaaatggagcacctcaagaaggcggacaagattctgattctgcacgaaggatcctcatatttttacgggacattcagcgagctacagaacctccagcccgacttcagtagcaagctcatggggtgtgactcattcgatcagttctccgccgaaaggagaaactccattttgacagaaacattgcatcgcttttccctggagggggacgctccagtttcctggacagagactaaaaaacagtcatttaaacagactggagagttcggcgaaaaacgcaaaaactctatactcaacccaatcaattctatcaggaagtttagtatcgtgcagaagacccctctccagatgaatggaatagaggaagactcggatgagccacttgaacgccgtctgtccttggttcctgattccgagcagggcgaggccatcctcccccgcattagcgtaatatctaccgggcccactttgcaagcccggcgccgccaaagtgtcttgaatctgatgacacattctgtgaatcaaggccagaatattcacagaaaaacaaccgcctccacccgcaaagtcagcctggctccccaagcaaacctcacggagttagacatctattcacggcgattgtctcaggagactggtctcgagatatcagaggaaatcaatgaggaggatctgaaagagtgctttttcgacgacatggagtcaattcccgcagtgacgacgtggaatacatatttacgatacatcaccgtccataagtccctcattttcgtgctgatctggtgtctggtgatatttttggccgaagtagcagcttctcttgtagtgctctggttattagggaacacgcctttgcaggacaagggaaatagcacccactcccgtaacaactcctatgccgtcataattacctccacctctagctattatgtcttctacatatatgtcggcgtagctgatactctcctggcaatgggctttttcagaggacttcctttggtacataccttgattacagttagcaaaattttacatcataaaatgctgcatagcgttctgcaggcccccatgtccaccttgaatacactgaaggcgggcgggatcctcaacagatttagcaaggacatcgctattctggatgatctgctcccgctcactatcttcgacttcattcagttgctgctgatcgttattggcgcaatcgctgtggtggcagtcttgcagccatacatttttgtcgctaccgtgcccgtaattgtggccttcatcatgctgcgggcatatttccttcaaacttcccagcagctgaagcaactcgaaagtgaggggcggtcgccgatatttactcacttagtcacttcattgaagggcctttggacccttcgcgcattcggccgacagccctattttgagaccctgtttcataaggccctcaacttgcatacagcgaattggtttctgtacctcagcacgttacggtggtttcaaatgcgaattgagatgattttcgtaattttcttcatcgccgtgaccttcataagtatactgacaacaggcgagggggagggtagagtggggataattttaactctggccatgaacataatgtccacactgcagtgggcagtcaattcttcaatcgatgttgattccctgatgcgttccgttagcagagtgttcaaattcatcgacatgcccacagaggggaagccgacaaagagcactaaaccctacaagaacggccagctgtccaaggtgatgatcatcgaaaactcccatgtgaagaaagacgacatttggcccagcggcggacagatgacagtcaaggatctcaccgctaagtacacggaaggaggtaatgccattctggagaacatatcattttccataagcccaggtcagagggtcgggctgctcgggaggaccggtagtggtaagagcaccctcctaagcgcttttctgaggctccttaacactgaaggcgaaatccaaatcgacggcgtttcctgggactctatcacccttcaacaatggcgaaaggcgttcggggtgattcctcagaaggtgtttatcttcagcggcacctttcgtaagaacctcgatccatatgagcaatggagcgatcaggaaatttggaaggtagctgatgaagtggggctcaggagcgtaatagagcagttccccggcaagctggacttcgttctggtcgatggcgggtgcgtattgtcacacggacataagcagctgatgtgtctggcccgatccgtgttaagcaaggctaaaatcttgcttctcgatgaacccagtgcccatctggacccagttacttatcagatcatccgtagaaccctaaagcaggcttttgccgattgtaccgttattttatgcgaacatcgaattgaggctatgctcgaatgccaacagttcctcgtcatcgaggaaaataaagtgcggcagtatgacagcatccaaaaactccttaacgagaggtctctgttcagacaggccatatccccctctgaccgggttaagctgttcccccaccgcaacagctctaagtgcaagtcaaaaccccagattgctgccctcaaggaggagaccgaggaagaggttcaggacacccgcttg

SEQ ID NO: 10217 - DNA, 1101 bp, Artificial Sequence
  Description of Artificial Sequence: Synthetic coding sequence
atgataaggaattggctcacaatctttattctttttcctttaaagctagtcgaaaaatgcgagtcaagcgtctcactgacagtgccacccgtcgtcaaactagagaatggatcaagcaccaacgtatccctcacgttacgtccaccattgaatgccaccctcgtcatcacattcgagattaccttcagatctaagaacattactatactcgaactacctgatgaagtcgtggtccctcccggcgtcaccaatagtagtttccaggttactagtcagaatgtgggccagctcactgtgtatctccacgggaatcattcaaatcagaccggaccccgcattagattcctcgtgattcgctcgtccgccatatcaattatcaaccaggtgataggatggatatattttgtcgcctggtcaattagcttctacccgcaggtgatcatgaattggcggagaaagtcggtcatcgggctgagtttcgactttgtcgctctgaacctgactggttttgttgcttattctgttttcaatataggacttctgtgggtgccctacattaaggagcagttcctgctgaaatatccaaatggggtaaatcctgtcaattccaatgatgtgtttttctccctccatgcagtggtgctgacgctgattataattgtccagtgctgtctgtacgagagaggggggcaaagggtctcgtggcccgcaattgggtttctggtgttagcatggctttttgcctttgtgacaatgattgtggccgctgtaggcgtaaccacatggttgcagtttttgttctgcttctcttatattaagcttgctgtgactttagtgaagtacttccctcaggcctatatgaatttctactacaagagcaccgagggatggagcataggaaacgtcctcctggacttcaccggtggaagcttctcacttttacagatgttcttacagtcgtataacaacgatcagtggactctgattttcggtgacccgacaaaatttgggctgggagtcttctcaatcgtgttcgatgtcgtgttcttcatccagcacttctgcctgtaccggaagaggccaggctatgaccagctaaat

SEQ ID NO: 10218 - DNA, 1101 bp, Artificial Sequence
  Description of Artificial Sequence: Synthetic coding sequence
atgatccgcaattggctcaccatattcattctcttcccgcttaagctcgtcgaaaagtgcgaatcctcggtgagcctgaccgtccctccggtggtgaagctggagaatggttccagcaccaacgtgtcgctgacgctgcggccaccacttaatgcaacgctcgtgatcactttcgagataacctttcgctccaagaatatcactattcttgaacttcccgatgaagtcgtggttccacctggtgtcactaattcctcgtttcaggtgacctcccaaaacgtgggccaactcactgtctaccttcacgggaaccattcgaaccaaacgggtccacgcattcgttttctggtcattaggagctcggcaatctcaatcatcaaccaagtgattggctggatctacttcgtggcatggtccatatcgttttaccctcaagtaatcatgaactggcgcaggaagtccgtcataggactgtcttttgattttgtggccctgaacctcactggatttgtcgcctacagcgtgttcaatattgggcttctttgggtgccatacatcaaagagcagtttctgctgaagtaccccaacggagtcaacccggtcaattcaaacgatgtctttttctccctgcatgcagtggtgcttactcttatcattattgtgcagtgttgtctgtacgaacgcggtggacagagagtttcctggccggcaattggattcctcgtcctggcatggctgtttgccttcgtcaccatgattgtcgcggctgtgggagtgactacctggctccagtttcttttttgtttttcctacataaagctcgccgtgactctggtgaagtacttccctcaggcttacatgaacttctactacaaatcgactgaaggttggtcgatagggaacgtgctcctcgatttcaccggcggatcgttttcgctgcttcaaatgtttctgcaaagctacaacaacgatcagtggaccctcattttcggagatcccaccaagtttggactgggagtgttttccatcgtgtttgatgtggtgttcttcattcaacatttttgtctttaccgtaaaaggccaggttacgatcaactgaac

SEQ ID NO: 10219 - DNA, 1101 bp, Artificial Sequence
  Description of Artificial Sequence: Synthetic coding sequence
atgattagaaattggcttactatctttatactgttccccttgaaactcgtagagaaatgtgagtcttctgtgtcactcacagttccacctgtggtcaagctggaaaatggttcttccaccaatgtgagcttgacccttagaccacctttgaacgctactctggtcattacttttgaaatcactttccgtagcaagaacatcacaattctcgagttgccagatgaggtcgtggtgcccccaggagtaaccaattctagcttccaggtgacatcacagaacgtcggccagcttactgtgtacctgcatggcaaccactccaaccaaacaggcccacgtattagattcctcgttatccgcagctccgctatcagtatcatcaaccaagtcatcggatggatttacttcgtcgcctggtctattagtttttaccctcaagttatcatgaattggaggcgtaaatctgtgatcggactgtctttcgatttcgtggccttgaacctgacaggtttcgtcgcttacagtgtcttcaacatcggacttctgtgggtgccatatatcaaggagcagttcctgcttaaataccccaacggtgtcaatcccgtgaattccaacgatgtctttttctctctgcacgctgtcgtacttactctcatcattatcgtccagtgctgtctgtatgagcgcggcggacaaagagtctcctggcctgctataggctttctggtactcgcttggctgtttgccttcgtgactatgatcgtggccgctgtgggcgtaactacttggttgcagttcctcttctgtttctcatacatcaagctcgctgtgaccctcgtgaagtacttcccccaggcatatatgaacttctattacaaatctaccgagggctggtccatcggcaatgtcctcctggacttcaccggtggttctttttcattgctgcaaatgttcctccagagctacaacaatgaccagtggacattgatattcggagaccccaccaagttcggactgggtgtgttcagcatcgtgttcgatgttgtatttttcatccagcatttctgcctctacagaaagagacccggctacgatcaattgaac

SEQ ID NO: 10220 - DNA, 1101 bp, Artificial Sequence
  Description of Artificial Sequence: Synthetic coding sequence
atgatcaggaactggctcaccatcttcattctgttcccgctgaagctggtggagaaatgtgagagctccgtgtcgctcactgtgcccccagtcgtgaagttggaaaatggatcgagcaccaatgtctcattgactttgcgcccacctctcaacgcaaccctcgttatcacttttgaaattaccttcagatcgaaaaacatcactatcctggaacttccggacgaggttgtggtgccaccgggagtcactaattcctcgttccaggtgacttcacaaaatgtggggcaactcactgtctacttgcacggaaaccactcaaaccaaactggacccagaatcagattcctggtcatcagatcgtcggccatcagcatcattaatcaagtgatcgggtggatttacttcgtggcttggtcaatcagcttctacccgcaggtgatcatgaactggcgccgcaagtccgtgattggcttgtcattcgacttcgtggcactcaacttgactggattcgtggcctactccgtgttcaatatcggactgttgtgggtgccgtacatcaaggaacagttcctgctgaaataccccaacggggtaaatcctgtcaattcgaatgatgtgtttttcagcctgcacgcggtggtgctgaccctgattatcatcgtgcaatgctgcctgtacgagcgcggcggacagcgggtgtcatggccagcgatcggctttctggtcctggcgtggctgttcgcgttcgtgaccatgatcgtcgccgcggtgggagtgaccacctggctgcagttcctgttctgcttttcgtacattaaactggctgtcacgctggtgaaatacttcccacaggcgtacatgaatttctactacaagagcactgaagggtggtccatcggtaacgtcctgctcgattttactgggggttcatttagcctgcttcaaatgttcctgcagagctacaacaatgaccaatggacgctcatttttggggacccgaccaaattcggactgggcgtgttctcgatcgtgttcgacgtggtgttcttcatccagcacttctgcctctaccgcaaacggcctggatacgaccagctcaac

SEQ ID NO: 10221 - DNA, 1101 bp, Artificial Sequence
  Description of Artificial Sequence: Synthetic coding sequence
atgattcgcaattggttgaccatctttatactcttccctctgaaactggtcgagaagtgtgagtcgagcgtttcgcttactgtccctccggtcgttaagctcgagaatggctcctccactaacgtgtcgcttactctgaggccaccactgaacgcaactcttgtgattacttttgaaatcacgtttaggtcaaagaacatcactattctcgaactgcctgacgaagtggtcgtcccacccggggtcactaactcttctttccaagtcacttcacaaaacgttgggcagcttacggtctatcttcacggtaatcatagcaatcagactggaccgagaattcggtttctggtgattaggtcctcagcgatttcgattatcaatcaagttattggatggatctactttgtcgcatggtccattagcttttacccacaagtgatcatgaactggcggaggaagtcagtcattggccttagctttgattttgtggcacttaacctgaccggattcgtggcatactcagtgttcaacattggattgctgtgggtgccatacattaaggaacagttcctcctgaagtaccccaacggggtgaaccccgtgaactccaacgatgttttcttttctctgcacgccgtcgtgctcacccttatcataattgtccagtgctgtctttacgaaagagggggacaaagagtgtcctggcctgcgattggcttcctcgtgcttgcctggctgttcgcattcgtgaccatgatcgtggccgcggtgggtgtcacgacgtggttgcagtttctcttttgtttctcgtacataaagttggcagtgactctggtgaaatactttcctcaagcctacatgaacttttactacaaaagcaccgaaggttggtccatcggaaatgtgcttctcgactttaccggaggttccttttcactgctccagatgtttctgcaatcatacaacaacgaccagtggactcttatcttcggtgatcccaccaagtttggtcttggagtcttttccatcgttttcgacgtggtgtttttcatccaacatttctgtctttacagaaagcgcccaggatacgatcaactgaat

SEQ ID NO: 10222 - DNA, 1101 bp, Artificial Sequence
  Description of Artificial Sequence: Synthetic coding sequence
atgatccgaaattggctgaccatctttatcctgttccctctgaaactggtggaaaaatgcgaatcttctgtttcactgaccgttccccctgtggtaaaactcgaaaacgggagttccactaacgtgtcccttacattgcggccccccttgaatgccaccctcgtgatcacgtttgagattaccttcaggagcaagaacataaccatcctggagctgccggacgaggtggtggttcctcccggtgtcacaaacagttctttccaggtcaccagccagaatgtcggccagctgaccgtgtatctccatggcaatcattccaaccagacagggccacggatccggtttctggtgatacgctcatccgccatcagcatcataaaccaggtcatcggatggatttactttgtcgcttggtcaatctcattttacccccaggtgatcatgaactggagacgcaagtccgtaataggtctgagttttgatttcgttgctctgaatctcaccgggttcgtggcctatagcgtgtttaatattggtctcctttgggttccttacattaaagagcaattcttgcttaaataccctaacggtgtgaatcctgtcaattctaacgacgtttttttcagtctgcacgctgtcgtcttgaccctgattatcatcgtgcagtgttgcctctatgaacgggggggccagagagtgagctggccggccatagggtttctcgtgctcgcctggcttttcgccttcgtcacaatgatcgtggcggctgtgggcgtcactacatggcttcagtttctgttttgcttctcctatatcaaattggctgtcaccttggttaaatacttcccccaagcctacatgaatttctactataagtctacggagggctggagtattgggaatgtgctgttggacttcactgggggcagcttctctttgctgcagatgtttcttcaatcttacaacaacgaccaatggacgctcatctttggggaccctactaaattcggtctgggcgtgttcagtatcgtcttcgacgtggtttttttcatccagcatttctgcttgtatcggaaacgccctggctacgatcagcttaat

SEQ ID NO: 10223 - DNA, 1101 bp, Artificial Sequence
  Description of Artificial Sequence: Synthetic coding sequence
atgatacggaattggctcacgatttttattttgtttccactcaagctggttgagaagtgtgagtctagtgtttcattgacagttccacctgtggtaaagctggaaaatgggtcatctaccaatgtgagtctgaccctgcgtcctccgctgaacgccactttggtgattactttcgagattacgttccgctccaagaatattactattctggagctccctgatgaggtggttgtgccccccggagtgacaaactcaagttttcaggtgacaagccagaacgtgggccagttaaccgtatatctgcacggcaaccacagtaatcagacaggtccacgcatccggttccttgtgataaggtcttccgcaatttcaatcatcaaccaagtcatcggctggatttacttcgtggcttggagtatatctttttatccacaggtaattatgaattggcggcgcaaaagcgttataggcctctcatttgacttcgtagctctgaacctgaccgggttcgtcgcctacagcgtgttcaacatcggtctgctgtgggtgccgtatatcaaggagcaatttctccttaagtatccgaacggggttaatccggtaaattcgaacgatgtcttctttagcctccacgccgttgtcttaactctgatcatcatcgtccagtgttgtctgtacgagaggggggggcagagagtgtcctggccagcaattggttttttggtgctcgcgtggctcttcgctttcgtgacaatgatagtggccgcagtaggcgtcactacatggctccagtttctcttctgcttctcctacatcaagctggccgtcaccctcgtaaaatacttcccccaggcttatatgaatttttattataaaagtaccgaagggtggtcaatcgggaatgttttgcttgatttcacaggaggctctttctcactcctgcagatgttcctccaaagctacaacaacgaccaatggactttgattttcggagacccgactaaattcggattgggggtgttctccatagtgtttgacgtcgtcttttttattcagcacttctgtctgtatcgaaagagacccggctacgatcagctgaat

SEQ ID NO: 10224 - DNA, 1101 bp, Artificial Sequence
  Description of Artificial Sequence: Synthetic coding sequence
atgatccgcaattggctgactatcttcatcctgtttcctctcaaactcgtcgaaaagtgtgaatcgagcgtgtccctgacggtgccaccagtggtgaagctggagaatggatcgagcaccaatgtcagcctcaccctccggccgccgctgaacgcaactctggtgatcacgtttgagattacctttcgatccaagaacattaccatcctggaactccccgatgaagtggttgtcccgcccggagtcactaatagctcgtttcaggtcacttcccagaatgtgggtcagctgactgtctacttgcatggcaaccactcaaaccaaaccggtccgcgcattaggtttctcgtgatcagatcgtccgcgatttccatcatcaaccaggtcataggctggatatactttgtggcttggtccatcagcttctacccacaagtcattatgaattggagacggaagtcggttatcggactgtcgtttgacttcgtggccctgaacctgaccggattcgtggcgtacagcgtgttcaatatcggacttctgtgggtgccgtacattaaggagcagttcctgctgaagtacccaaacggtgtgaacccggtgaactcgaacgacgttttcttctccctgcatgccgtggtgctgacgttgatcattatcgtgcaatgttgcctgtacgagcgcgggggacagagagtctcatggcccgctatcggctttctggtcctcgcttggctgtttgcattcgtcacgatgatcgtggcagccgtgggcgtgacgacttggctgcagttcctcttctgcttctcatacatcaagttggccgtgacccttgtcaagtacttcccgcaagcatatatgaacttttactacaagtcaactgagggatggtcgatcggaaacgttctcctggacttcaccggtggatctttctccctgctgcagatgttcctgcaatcatacaacaacgaccaatggaccctgatctttggcgatcctactaagttcggactcggagtgttcagcatcgtgtttgacgtggtgtttttcatccagcacttttgcctgtaccgcaaacgccccggatacgatcagctcaac

SEQ ID NO: 10225 - DNA, 1101 bp, Artificial Sequence
  Description of Artificial Sequence: Synthetic coding sequence
atgatcagaaattggttgaccatctttatccttttccctctcaaactggtggagaagtgcgaatccagcgtgtcccttactgtgccaccagttgtcaagctcgagaacggatcgtcgaccaatgtgtcgctcacgctgcggccgccgctgaacgccactctcgtgatcactttcgaaatcactttccgcagcaagaacatcactatcctggaactgccggatgaggtcgtggtgccgccaggagtgacgaactcgtccttccaagtgaccagccagaatgtgggccagttgactgtgtacctccacggtaatcactcgaaccagaccggaccgagaatcagattcttggtcattcgctcctccgctatctcaatcatcaaccaagtgatcggctggatctacttcgtggcctggtcgatctccttttacccccaagtcatcatgaattggagacggaaatcggtgatcggactgtcctttgacttcgtggcgcttaacctgaccggatttgtcgcctacagcgtgttcaatatcggactgctctgggtcccttacatcaaggaacagttcctgctgaaatacccaaacggagtgaaccccgtgaattccaacgacgtgtttttctccctgcacgcggtggtgctcactctgatcataattgtgcagtgttgcctgtacgagcgcggcggacagcgtgtgtcatggcccgctattggatttctcgtgctggcctggcttttcgccttcgttacgatgatcgtggcagctgtgggggtgaccacctggctccaattcctgttctgcttctcatacatcaagctggcggtgaccctggtcaaatacttcccacaagcctacatgaacttttactataagtccactgaaggatggtccatcggcaacgtcttgctggacttcaccggaggatcattctcgcttctgcagatgttcttgcaatcctacaacaatgatcagtggaccttgattttcggcgatcccactaagttcgggctgggcgtcttttcgattgtgtttgatgtcgtgtttttcatccagcacttctgcctgtaccggaaaagaccggggtacgaccaactcaac

SEQ ID NO: 10226 - DNA, 1101 bp, Artificial Sequence
  Description of Artificial Sequence: Synthetic coding sequence
atgattcgcaactggctgaccatcttcatcctctttccgctgaagctcgtggaaaagtgcgagtcatcggtgtccctcactgtgccgccggtggttaagctcgaaaacggatcatccactaacgtttccctgaccctgcggccgcccctgaacgccaccctggtgatcacttttgagatcactttcagaagtaagaacatcacgatcctcgagctccccgatgaggtggtggtccccccaggagtgactaatagctcgtttcaggtcacctcacaaaacgtcggccaattgactgtctatctgcatggaaaccacagcaatcagactggaccgcgcatccgcttcctggtgatccgctcatcggcaattagcatcattaaccaagtgattggttggatctattttgttgcctggagcatttcgttctacccacaggtgatcatgaactggcggcgcaagagcgtgatcggcctgtcgttcgattttgtggcactgaatctcaccggttttgtcgcgtattcggtgttcaatattggactgctgtgggtgccttacataaaagagcagttccttctcaagtacccgaatggcgtgaatccggtgaactcaaacgacgtgttcttttccctgcacgccgtcgtgcttactctgatcatcatcgtgcaatgttgtttgtacgaacggggtggccagcgggtgtcttggccggcaatcggattcctggtgctcgcgtggctgtttgcctttgtcactatgattgtggccgcagtcggagtgactacgtggctgcagttcctgttctgcttcagctacatcaaactggccgtcactcttgtcaagtacttcccgcaggcgtacatgaatttctactacaaatcgacggagggctggtcgattggcaacgtgctgctggatttcactgggggctcgttctccctgctgcagatgttcttgcagtcctacaataatgatcaatggaccctcatcttcggagatcctaccaagttcgggttgggagtgttcagcatcgtgtttgacgtcgtgttctttatccagcacttctgcttgtatagaaagcgccctgggtacgatcagttgaac

SEQ ID NO: 10227 - DNA, 1101 bp, Artificial Sequence
  Description of Artificial Sequence: Synthetic coding sequence
atgattcgcaactggttgacgatcttcattctgtttcccttgaagctggtcgaaaagtgtgaaagttctgtgtctcttaccgtaccgcccgtggtgaagttagagaacggctcatctacaaacgtgtcgctcactctgcgccctcctcttaatgctacacttgtcattaccttcgagatcacattccgaagtaaaaatataacaatcctggagctgccagacgaggtcgtggtgcccccgggcgtaactaactcatcatttcaggtgaccagccagaatgtcggccagctgacagtgtatctgcatggaaatcatagtaaccagaccggccctcggatcagatttctcgtgattcgatcctctgcaatcagtatcattaatcaggtgataggctggatctatttcgttgcctggtccatatctttttaccctcaggtgatcatgaactggcggagaaagtccgtaatcggactcagctttgacttcgttgctctgaacctaacaggattcgtcgcatacagtgtgtttaatataggcttgctgtgggtaccctatatcaaagagcagttccttctgaaatatcccaacggcgtgaatccagtgaattccaatgacgtttttttctctttgcatgcggtggtgctcaccttgataataatagttcagtgttgtctgtacgagagaggcggccagcgagtgagttggcctgccatagggtttctcgtactagcatggctttttgcctttgtgaccatgatcgtcgctgcagtcggggtgacaacatggctgcagttcttgttttgcttcagctatataaaattggctgtcacgctcgtaaagtattttccccaagcttatatgaacttttactacaagagtactgagggatggtctatcggcaatgtactgttggatttcactggaggaagtttcagccttctgcaaatgttcctacagtcatacaataacgaccagtggactctgatatttggagatccgactaaatttggtctgggtgtgttttctattgtctttgacgttgtgttcttcatccagcatttttgcctctatagaaagcggccaggatacgaccagctgaac

SEQ ID NO: 10228 - DNA, 1101 bp, Artificial Sequence
  Description of Artificial Sequence: Synthetic coding sequence
atgatccgcaactggctgacaatctttatactgttccccctaaagctcgtcgaaaagtgtgaatcctcagtcagcctaaccgttccccccgtggtgaaacttgaaaatggcagctccaccaacgttagcttaactctcaggcctccactaaatgctaccctggtgattacctttgaaatcacctttcggagcaagaacatcactatattggaactgccagacgaggtggtagtaccacccggcgttactaatagcagtttccaagtgacctcacaaaacgtcggccagctaactgtgtacttacacggcaatcacagtaatcagacaggccctaggatcaggttcctggtgataaggtcctccgccatatctattataaatcaagtaattggctggatatattttgtagcatggagtatatccttttatcctcaggttatcatgaactggcggcgcaaatctgtcatcggcttatccttcgatttcgttgcccttaacttaacaggatttgtagcttactctgtgtttaacattgggctattatgggtgccttatattaaagagcaatttctgttgaaatatccaaatggggtgaacccagtgaactctaacgacgtgttcttttctctgcacgccgtggtgctcactctcataattatagtgcagtgctgtctgtacgagaggggaggccagcgggtgtcctggcctgctatcggctttctggtgctggcctggctattcgcatttgtgacaatgatagttgctgcagtcggcgtgacaacatggttacagtttttattttgcttcagttacatcaagctagctgtgacacttgtaaaatacttcccacaagcttatatgaacttctactacaagagcaccgaaggatggagcataggcaatgtcctcctggactttaccggtggctcttttagcctacttcagatgttcttgcagtcttacaataacgaccagtggaccctcatatttggcgatccaacaaaatttggcctgggcgtgttctctattgtctttgatgtggtcttttttatacagcacttctgcctataccgcaagaggcccgggtatgatcagttaaac

SEQ ID NO: 10229 - DNA, 1101 bp, Artificial Sequence
  Description of Artificial Sequence: Synthetic coding sequence
atgataagaaattggcttacaatttttatattatttcctttaaagttagttgaaaaatgtgaatcaagtgtatcacttacggttcctccagtagttaaattagaaaacggatctagtacaaacgtttcattaactttgagacctccattaaatgcaactcttgtaataacatttgaaattacttttagatcgaaaaatataacaattttagaattaccagatgaagtagttgttccacctggagttactaattcatcttttcaagttacttctcaaaacgttggtcaattaacagtttatttacatggaaatcatagtaatcaaactggaccaagaattagatttttagttattaggagctcagcaatttcaattattaatcaggtgattggatggatttattttgttgcatggtctatttcattttatccacaagttattatgaattggagaagaaaatctgttattggactttcattcgatttcgttgcattaaatttaacaggattcgtagcatattcagtttttaatattggtttattatgggttccatatattaaggaacaatttcttttgaaatatccaaatggagttaatccagttaattctaacgatgtttttttttcacttcatgcagttgttcttacattaataattattgtacaatgttgtttatacgaacgtggtgggcaaagagtcagttggccagctattggatttttagttttagcttggctttttgcttttgttactatgatagttgcagcagttggtgtaactacttggttacaatttttattctgtttttcctatataaagttggcagttacacttgtaaagtattttccacaagcatatatgaatttttattacaaatcaacagaaggatggagtattggtaatgttttattagattttacaggtggaagtttttcattattacaaatgttccttcaatcttataataatgatcaatggactttgatttttggtgatcctactaaattcgggcttggagtttttagtattgttttcgatgtagttttttttattcaacatttctgtttatacagaaagaggccaggatatgatcaacttaac

SEQ ID NO: 10230 - DNA, 1101 bp, Artificial Sequence
  Description of Artificial Sequence: Synthetic coding sequence
atgatcagaaattggctcaccatctttattctgttccctcttaaactcgttgagaagtgcgaatcctcggtgtcgcttactgtccctccggtggtgaaacttgagaatggttccagcactaacgtcagccttacgctccgtcctcctctgaatgccactctcgtcattaccttcgagatcacttttcggtcaaagaacatcacgattctggagctgcccgacgaagtcgtggtgcctcccggagtaaccaactcatcgttccaggtcacctcgcaaaatgtgggacagttgactgtgtacctgcacgggaatcattccaaccagaccggtcctcgcattaggtttctggtgattagaagcagcgcgatcagtatcattaaccaagtgattggatggatttacttcgtcgcatggtcgatatcattctacccgcaagtgattatgaactggaggcgaaaatccgtgattggacttagctttgattttgtggcacttaacttgacgggatttgtggcttactcagttttcaatataggtctgctctgggtcccttacattaaggagcaattcctgctgaaataccctaacggagtcaaccctgtcaacagcaatgatgtgttctttagccttcatgccgtcgttctcacccttatcataatcgtccagtgttgtttgtacgaacggggcggacagcgagtgtcttggccagctattggatttcttgtgctcgcgtggctgtttgcatttgtgaccatgatagtcgcggcggttggagtgactacctggcttcaatttctcttttgcttttcttacattaagctggcagttaccctcgtgaagtacttccctcaggcctacatgaatttctactacaaaagcaccgaggggtggtcgattggtaatgttttgctcgattttaccgggggctcgttttcgctcctgcaaatgttccttcaaagctacaataacgatcagtggacccttatctttggtgacccaactaagtttggactcggtgtgtttagcattgtgtttgacgtggtgttctttattcagcatttttgcctgtacagaaagcgccctggctacgaccagttgaat

SEQ ID NO: 10231 - DNA, 1101 bp, Artificial Sequence
  Description of Artificial Sequence: Synthetic coding sequence
atgatcaggaactggctgaccattttcattctgttccccctgaagctggtggaaaaatgcgagtcgtctgtgtccctcacggttccgccggtggtgaaactcgaaaacggaagctcgaccaatgtgagcctgaccctgcggccgcctctgaacgctacgttggtcatcactttcgaaataaccttccggtctaagaacatcactatcctcgagctgccagacgaagtggtggttccaccgggtgtgaccaactcgtcctttcaagtgaccagccagaacgtcggccagctgactgtctacctgcacggaaatcattcaaaccaaactggcccgaggatcaggttcctcgtcatccggtcgtcagcgatttccatcatcaaccaggtgatcgggtggatctatttcgtggcctggtcgatcagcttctatcctcaggtcataatgaattggaggcggaaaagcgtcatcggactgtccttcgatttcgtggcgctgaaccttaccggatttgtggcttacagcgtctttaacatcggactgctttgggtgccatacatcaaggaacagttcctgctcaagtacccaaatggcgtcaatcccgtcaacagcaatgacgtgttcttctcgctgcacgccgtcgtgctcacgctgatcatcatcgtgcaatgctgcctgtacgaacgcggaggtcaacgcgttagctggccggccatcggattcctggtgcttgcatggctcttcgcgtttgtgaccatgattgtggccgcagtcggagtgaccacttggctgcaattcctgttttgcttctcatacattaagctcgctgtcactctcgtcaagtacttcccgcaggcgtacatgaatttctactacaagtctaccgagggatggtcgatcggtaacgttttgctcgactttaccggaggatctttcagcttgctccagatgttcctccaatcctacaacaatgatcagtggactcttatcttcggtgatcctactaagttcgggcttggggtgtttagcattgtgtttgacgtggtgttcttcatccagcatttctgcctttaccggaaacggccggggtacgatcagctgaat

SEQ ID NO: 10232 - DNA, 1101 bp, Artificial Sequence
  Description of Artificial Sequence: Synthetic coding sequence
atgatccgaaattggcttaccattttcattctttttccattgaaactggtggaaaagtgcgaatcatccgtgtcccttactgtccctcctgtggtgaagctcgagaatggctcttccactaatgtgtccctgaccctcagaccacctttgaatgcaaccttggtcatcacttttgaaattactttccggtcgaaaaacataactattcttgaactgccagatgaggtcgttgtgccaccgggcgtgaccaactcgtcatttcaagttaccagccagaacgtgggacaacttacggtgtacctgcatggaaatcactcaaatcaaactggaccccggataagattcctggtcattcggtcgtcggcaattagcatcattaaccaagtcatcggttggatttacttcgtggcatggagcatttcattctaccctcaagtcattatgaattggcgacggaaaagcgtgattggactgtcctttgatttcgtggcactcaaccttactggttttgtcgcgtactcggtgttcaatatcggacttctgtgggtcccatacatcaaggagcagttccttctgaagtacccgaatggtgtgaacccagtcaatagcaacgatgtctttttctcactccatgcggtggtcctgaccctcataatcattgtgcaatgctgtctttacgaacgaggcggacagcgagtctcctggcccgcaattggttttcttgtgctcgcatggctgtttgcatttgtgaccatgatagtggctgccgtgggagtgaccacctggctccaatttctcttctgttttagctacataaagctggcagtgacgcttgtgaagtattttccccaagcctacatgaacttttactacaagtccacggaaggttggagcattggaaacgtcttgctggactttactgggggatcgttttcgcttcttcaaatgtttctccaatcctacaacaacgatcagtggactctgatttttggtgatcccaccaagttcggtcttggcgtgttctcgatcgtgtttgacgtggtgttctttattcagcacttctgtctgtatcggaagcggcccggatatgatcaactgaac

SEQ ID NO: 10233 - DNA, 1101 bp, Artificial Sequence
  Description of Artificial Sequence: Synthetic coding sequence
atgattcgaaactggctcactatctttattctcttcccgctgaaactggtggagaagtgcgaatcgtcagtgagcctgacggtgcccccagtggtcaagctggaaaatggatcgtccactaacgtgagcctgacccttcgtcccccgcttaacgcaaccttggtcataactttcgaaataaccttcagatccaagaatatcactattctggaactgcctgatgaagtggtggtgcctcctggagtgacgaactcgtcattccaagtgacttcacagaacgtgggtcagttgactgtgtaccttcacggtaaccactcaaatcaaacggggcctcggatacgatttctcgtgatccgatcgtcagcaatttccatcattaaccaggttatcggttggatttactttgtcgcttggtccatttctttttaccctcaagtgattatgaattggaggaggaaaagcgtgatcgggctgtcctttgattttgtcgcgcttaacctgacgggatttgtggcttacagcgtgtttaacattggacttctttgggtcccatatatcaaggagcagttccttctcaagtacccaaacggcgttaatccagtgaactcgaatgacgttttctttagcctccatgccgtcgtcttgacgctgatcattattgtgcagtgttgtctgtatgaacggggcggacaaagagtgtcgtggccggcaattggtttcctcgtgcttgcatggctctttgcctttgtcaccatgattgttgcagcagtgggtgtaactacctggttgcaatttctgttttgctttagctacataaagctggcggtaaccctggtgaagtactttcctcaagcctacatgaacttttactacaaatcgaccgagggctggtccatcggaaacgtactcctcgatttcaccggaggatcgttctctcttctgcagatgtttcttcagtcgtacaataacgatcaatggaccttgatcttcggcgacccaactaagtttgggcttggggttttctccatcgtgtttgatgtagtgtttttcatacagcatttctgtctgtaccgcaaaagacccggatacgaccaacttaat

SEQ ID NO: 10234 - DNA, 1101 bp, Artificial Sequence
  Description of Artificial Sequence: Synthetic coding sequence
atgatccggaattggctcacaatctttatactgtttcccttaaaactggtggaaaaatgcgaatcctccgtttccctgacagtgccccctgtggttaagcttgaaaatgggtcttctactaatgtatccttaactctgcgacccccactaaatgccacactcgtcattactttcgaaattacttttcgatccaaaaacatcacaattctcgaacttcccgatgaagtggtcgtacctcctggggtgactaactcttcatttcaggtgacatctcagaatgtagggcagctaactgtgtatctacatggaaatcactcgaatcagacagggccacggatccggttcttggtgattcgatcctctgcaatcagtataataaaccaggttattggatggatctactttgttgcctggtcaatatcattctatcctcaggttatcatgaactggagaagaaaatccgtaatagggctctcctttgatttcgttgccctgaatctcactgggttcgtggcctattctgtctttaacatcggattgctctgggttccatacatcaaagagcagttcctccttaagtatcccaacggagtcaaccccgtgaattctaacgatgttttcttctctctccatgctgtcgtactcactttaatcatcatcgtgcagtgctgtttatatgaaagaggggggcagcgggtttcttggccagcgattggatttcttgtactcgcttggctttttgctttcgtgactatgattgttgctgcagttggagtgacaacatggcttcagtttcttttctgcttcagttacattaaactcgccgtgactcttgtgaaatatttccctcaggcatatatgaacttctattataaatctacagaaggatggtctatcggaaatgtcctgcttgatttcacggggggatctttctccctgctacagatgttcctccagagttataacaacgatcagtggacactcatattcggagaccctacaaagttcggactcggagtgttttccatcgtgttcgatgttgtgttctttatccaacacttttgtctctacagaaagcggcctgggtacgaccagcttaac

SEQ ID NO: 10235 - DNA, 1101 bp, Artificial Sequence
  Description of Artificial Sequence: Synthetic coding sequence
atgattagaaattggctgaccatttttattctattccctttgaagcttgtggaaaagtgcgagtcttccgtttcactcacggtgcctcctgtcgttaagctggagaacgggtctagcaccaatgtttccttgaccctgcggcctcccctaaatgccacactggtgatcacctttgagataacattccgctcgaaaaacatcacaatcctggagttaccagatgaggtggtggtaccccctggtgtgacgaacagctcttttcaggtgacctcccagaatgtcggacagctcaccgtctacctacatgggaatcatagtaatcagactggtcccaggatccggttcctggtgatcagaagcagcgctattagtatcatcaatcaagtgatcgggtggatctactttgtggcatggtccatctcattctacccccaggttatcatgaactggcggcggaagagcgtgattggactgagcttcgatttcgttgcattgaacctcactggattcgtcgcatacagtgttttcaacataggtctgctctgggttccttacattaaggaacagttccttctcaagtatcccaatggagtgaatcccgtgaatagtaatgacgtgttcttttccttgcatgcagtggtcttaaccctaataatcatcgtgcagtgctgtctttacgagagggggggacagagagtctcttggccagctataggcttcctggtgctggcgtggttattcgcgttcgtcaccatgatagtagcagctgtaggggtaactacctggctgcaattcctattctgcttctcatacattaagctcgcagtgacattggtgaagtacttcccccaggcttatatgaacttttattataaatccaccgaagggtggagcatcggcaatgtgctgctcgatttcacaggcggaagtttctccctgttgcagatgttcttacagagctacaataatgatcaatggacactgatttttggggacccaactaaatttggcctcggggtcttttctatcgtttttgacgtcgtgtttttcatccagcacttttgcctgtatcggaagcgaccagggtacgaccagcttaat

SEQ ID NO: 10236 - DNA, 1101 bp, Artificial Sequence
  Description of Artificial Sequence: Synthetic coding sequence
atgatacggaactggctgaccatcttcatcttgtttcccctgaagctcgtggaaaagtgcgagagctcagtgtccttgaccgtcccgccggtggtgaaactggaaaacggatcgtcaactaatgtctccctgactctccgcccgccgttgaacgccacgctggtgatcacgttcgaaatcacctttcgttcaaagaatatcaccattctggaattgcctgatgaggtggtggtcccaccgggcgtgaccaattcctcattccaggtgacctcgcagaacgtcggtcaattgactgtttatctgcacggcaaccattcgaatcagacgggcccgcgaatcagattcctcgtcatcaggagctcagccatctcaataatcaatcaagtgatcggctggatctactttgtggcatggtctatcagcttctacccgcaagtgattatgaactggcggcggaagtcggtgattgggctgtccttcgacttcgtggcgctgaacctcaccggcttcgtagcctactcggtgtttaacattggactgctctgggtcccctacatcaaagagcagttcctgttgaagtacccaaatggagtgaaccctgtgaattccaatgatgtgttcttcagcttgcatgcggttgtactgaccctcattatcatcgtgcaatgctgtctctacgagaggggaggacagagagtctcttggcctgccatcggattcctggtcctggcatggctgtttgccttcgtcactatgatagtcgccgctgtcggagtgactacttggctccaatttctgttctgcttctcatacatcaagctggcggttactcttgtgaagtacttcccgcaagcatacatgaacttttactataagtccaccgagggatggtcaattggaaacgtcctcctcgacttcacggggggatcattcagcctcttgcagatgttcctgcagtcctacaacaacgaccagtggactctcatctttggcgaccctacgaaattcgggctgggggtgtttagtatcgtgtttgatgtggtgttcttcatccagcacttctgcctgtaccgcaaaagaccaggatacgaccagctcaac

SEQ ID NO: 10237 - DNA, 1101 bp, Artificial Sequence
  Description of Artificial Sequence: Synthetic coding sequence
atgatccgcaactggctgactatcttcatcctttttccgctcaagctcgtcgagaagtgcgagtcaagcgtgtccttgacggtccctcctgtcgtcaagctcgagaacggtagctccaccaacgtgtcgctgactcttagaccaccgctcaatgccacgctggtcattactttcgaaatcactttcaggagtaagaacatcaccatcctggaattgccggacgaagtggtggtgccgccaggggtgactaattcttcgttccaggtgacctcacaaaatgtcggtcagcttaccgtgtacctgcatggtaatcactcgaaccagaccggcccaagaatacggttccttgtgatccggtcctcggcaatctcgatcatcaaccaagtgattggatggatctacttcgtggcctggtcaatttcgttttacccgcaagtcattatgaactggcggcggaagtccgtgatcgggttgtccttcgacttcgtcgcgctgaatctgaccgggtttgtggcttactcggtgttcaatatcggactgctctgggtgccctacattaaggagcagtttctcctgaaatatccgaacggagtcaaccctgtgaactccaatgacgtgttcttcagcctccacgcagtcgtgctgactcttatcatcatcgtgcaatgctgtctttacgagcggggcggacaacgggtgtcgtggcctgctatcgggttcctggtgctggcctggttgttcgcctttgtcacgatgatcgtcgctgccgtcggggtgaccacgtggctccagttcctgttctgcttttcatacatcaaactcgcggtgaccctggtgaaatacttcccccaggcctacatgaacttctactacaagtccacggaaggatggtcaatcggaaacgtgctgctggacttcaccggaggatctttttcactgctgcagatgttcctccagtcgtacaataacgaccagtggactctgatatttggggacccaaccaagttcggactgggcgtcttctcgatcgtgtttgatgtggtgttcttcatccagcacttctgtctgtatcggaagcggccaggatacgatcagctgaac

SEQ ID NO: 10238 - DNA, 1101 bp, Artificial Sequence
  Description of Artificial Sequence: Synthetic coding sequence
atgatccgcaactggctcactatattcatcttgtttccactcaagctggtggaaaagtgcgaatcctccgtgtcactcaccgtcccgcctgtggtgaaactcgaaaatggatcttccaccaatgtctcactcaccctcagaccgccgcttaacgcgactctggttataactttcgagatcactttccgctcaaagaacatcaccatcctcgagctgccggacgaggtggtggtaccccctggcgtaaccaattccagtttccaggtgacctcgcaaaacgtcggtcaacttactgtctacctccatgggaaccacagcaaccagacgggaccacgcatccggttcctggtgatcaggtcgtccgccatatcgattatcaaccaggttattggctggatctacttcgtggcgtggtccatctcattctatccacaggtgattatgaactggcgtcgcaagagtgtgatcggtctgtccttcgatttcgtggcattgaacctgactggcttcgtggcctactcggtattcaatatcgggctcttgtgggttccttacatcaaggagcaatttctcctgaaatatcccaatggagtgaatccagtcaactcgaacgacgtctttttctcgctgcacgcggtcgtcctgactctcatcattatcgtgcagtgctgcttgtacgaacgaggaggacagcgggtgtcgtggccggcaatcggatttctggtcctggcgtggcttttcgcctttgtgaccatgattgtggctgccgtcggtgtcactacgtggctgcaattcctgttctgtttcagctatatcaagctggctgtgaccttggtcaaatactttccgcaggcttacatgaacttttactacaagagcaccgaaggatggtctatcggcaatgtgctgctggactttaccggaggcagcttttcgctgttgcaaatgttcctccagtcatacaacaatgaccaatggacgctcatcttcggggatccgaccaaattcggactgggtgttttctcaattgtgttcgacgtggtgtttttcattcagcatttttgcctgtacagaaagcggccggggtacgatcagctgaac

SEQ ID NO: 10239 - DNA, 1101 bp, Artificial Sequence
  Description of Artificial Sequence: Synthetic coding sequence
atgatccggaattggctgaccattttcatcctgtttcccttaaagttggttgagaagtgtgaatccagcgtgagtctaaccgtcccacctgtggtgaagctggaaaacggaagctccaccaatgtcagtctcactctcagaccgcctctgaatgccaccctcgtgattaccttcgagatcaccttcaggtccaagaacataaccatcctggaactgccggacgaggttgttgttccaccaggggtgacaaactcgagctttcaggtcacctcccagaacgtgggacagcttaccgtgtatctgcatggaaaccatagcaatcagacggggccgcggattcggtttttggtgattcgtagcagtgctatcagcataattaaccaggtaatcggctggatttactttgtcgcatggagcatcagcttctacccgcaggttatcatgaactggaggcgcaaatctgtgatagggctgagttttgactttgttgccctgaaccttacaggattcgtcgcatacagcgtgttcaatatcggcctgctctgggtgccctacatcaaagagcagttcttgctaaagtacccaaacggggtgaatcctgttaacagtaacgacgtgtttttttcattgcacgccgtggttttgactctaataatcatcgtccagtgttgcctctacgagcggggtggccagcgggtgtcttggcctgcgattggctttcttgtgctggcgtggctgttcgcattcgtgactatgatcgtcgccgcggttggggtgacaacctggctgcagtttctcttttgtttcagttatattaagctggccgtgaccctggtcaagtactttccacaagcatacatgaacttttactacaaatctacagaaggttggagtattgggaatgtgctactggacttcacaggggggtccttttcactgctgcagatgtttctacagtcctacaacaacgaccaatggaccctgatcttcggcgatccaaccaagtttggactcggggtgttcagcatagtttttgatgtggtgttcttcattcagcacttctgcctgtaccgaaaacgacctggatacgatcaactcaac

SEQ ID NO: 10240 - DNA, 1101 bp, Artificial Sequence
  Description of Artificial Sequence: Synthetic coding sequence
atgattagaaattggctcacaatctttatcctgtttcctctgaaactcgtggaaaagtgtgagagcagtgtaagccttacagtaccccctgtggtgaaactcgagaatggatcctcaactaacgtgagcttaacccttcgcccaccactgaacgcgacccttgtaatcacatttgaaatcacgttccgcagtaagaatataactattctggagcttcccgatgaggtggtggtgccccccggcgtgaccaatagcagtttccaggttacgagccagaacgtgggccaattgactgtttacctgcacggaaatcactccaaccagacagggcccaggattcgattcctggtgattagatcctcagcaatctcgatcataaaccaggtcatcggatggatctatttcgtagcttggagtatttcgttttatccgcaggtaatcatgaactggaggcgcaagagtgtgatcggactgtcgtttgactttgtagcattaaatctaactgggtttgtggcatacagcgtttttaatatcggtttgctgtgggtgccttatatcaaagagcagttcctattgaaatatcctaatggtgttaatcctgtcaattcaaatgatgtgttctttagcctgcacgcagtcgtcctgactctgatcataatcgtccagtgctgtctgtacgagcgtggcggtcagagagtgtcctggcccgcaatcggattccttgtgctagcctggctgtttgccttcgtgactatgatcgttgcagctgttggagtgaccacttggctgcagttccttttctgcttttcatacataaaactggctgtaacactggtcaaatattttccacaagcctacatgaacttttactacaagtcaactgaaggttggtcaatcggaaatgttctgttggactttactggaggatcgttttccctactgcagatgtttcttcagtcatacaacaacgaccagtggaccctcatttttggggatccaacaaagtttgggttgggggtttttagcattgtgttcgatgtcgtcttcttcattcagcatttttgtctctacaggaagcgcccaggttatgaccaattgaat

SEQ ID NO: 10241 - DNA, 1101 bp, Artificial Sequence
  Description of Artificial Sequence: Synthetic coding sequence
atgattagaaactggctcaccatcttcatcctcttccctctcaaattggtggagaagtgtgagtcatcggtgtcacttactgtcccgccggtcgtcaaactggagaatggaagctctaccaacgtctccctcaccctccgacccccgctgaatgcaaccttggtgatcacctttgagattacctttaggagcaaaaacatcaccatcctggaactgccggacgaagtggtggtgccacccggcgtcaccaactcatccttccaagtcacctcccagaacgtgggtcaactcaccgtgtacctgcacggcaatcatagtaaccagactggccctaggataaggttcctcgtgatccgctcatcggcaatctcgatcatcaaccaggtgatcggatggatctacttcgtggcgtggtcgatctcattctaccctcaggttatcatgaattggcgccgtaaaagcgtcataggacttagcttcgatttcgtggcccttaacctgaccggatttgtcgcttattccgtattcaacatcggactgctgtgggtgccgtacatcaaagaacagtttctgctgaagtacccaaacggtgtgaatccggtgaattccaatgacgtattcttctccctgcacgccgtagtgctgactttgattatcatcgtgcaatgctgcctttatgaaagaggagggcagcgcgtgtcatggcctgccatcgggttcctcgtcctcgcgtggcttttcgcctttgtgaccatgattgtcgccgcggtgggcgtgactacctggctgcagttcctgttctgcttctcttacatcaaactcgcagtgactcttgtgaaatacttcccacaagcctacatgaacttctactacaagagcacggagggctggtccatcgggaatgtgcttctggacttcactggaggtagcttcagcctgctgcaaatgttcctccagtcctataacaatgaccagtggaccctgatcttcggagatccgactaagtttggccttggcgtgttctcgatcgtgttcgatgtggtgtttttcattcagcacttctgcctgtatcggaagcggccaggatacgaccagctgaac

SEQ ID NO: 10242 - DNA, 1101 bp, Artificial Sequence
  Description of Artificial Sequence: Synthetic coding sequence
atgattcgcaattggttaactatatttatcctctttcctctgaaacttgtagaaaagtgtgaatcgtccgtttccctgactgttcccccagtggtgaagttggagaacggatcatctactaacgtgtctctgacacttcgaccccccttgaacgctaccctcgttatcacatttgagattactttccgcagcaagaacattacaattttggagttaccagacgaagtagttgtcccccccggagtgaccaacagctctttccaggtgacaagccagaacgtcgggcaactgaccgtgtatctacacggcaatcactctaaccagacaggcccccgcatccggttcctcgttattcgatcctccgcgatcagcatcattaaccaggttataggatggatatactttgtggcgtggagtatcagtttctatccacaggtcatcatgaattggcgtcgcaaatctgtgataggcctgagcttcgatttcgtcgccttgaatttaactggcttcgtggcctattcagttttcaacatcggcctactgtgggtcccttatatcaaggagcagttcttgttaaagtatccaaatggcgtcaatccggtgaactccaacgacgtgtttttcagccttcacgccgtggtgctcacactaatcataatagtgcagtgttgtctttacgaacgaggggggcagagagtatcttggccagctatcggctttcttgtcttggcatggttgttcgcatttgtcactatgattgtagccgctgttggggttacgacatggctacagttcttgttctgtttctcatacattaagttggccgtcacactcgtgaaatacttcccccaagcctacatgaacttttactacaagtcgacagagggttggtccatcggcaacgtgctgttagactttaccggtggtagcttcagtctactccaaatgttcttgcagtcctacaacaacgaccagtggactctgattttcggggacccaacgaaatttggcctcggcgtgttctctatcgtgttcgatgtggtttttttcatccagcatttttgtctatatcgaaaacggcccggctacgatcaactgaac

SEQ ID NO: 10243 - DNA, 1101 bp, Artificial Sequence
  Description of Artificial Sequence: Synthetic coding sequence
atgattagaaattggctcactattttcatactgttcccactgaagctcgttgaaaagtgtgagtctagcgtttcactcactgtcccaccagtggttaaactagagaatggatcctcaaccaacgtgagccttaccctgaggcctccgctcaatgcgacactggttatcacgttcgagataacgtttcgctccaagaatatcacaatactcgagttaccagacgaagtcgtggtgccgcccggagttactaattcctctttccaggtgacatcacaaaatgtcgggcagctaactgtatatctgcacggcaaccatagcaaccagactggtcctcggattagattcttggttatcaggagctcagctattagcataattaaccaggttattggttggatttactttgtggcttggtccatttctttctatcctcaagtgattatgaactggcgaaggaaaagcgtcatagggctcagctttgatttcgtggcgctgaatctgaccgggttcgttgcctatagtgtgttcaacatcggattattgtgggttccctatatcaaggaacagttcttacttaaatatcctaatggcgttaatcctgtcaacagtaatgatgtcttcttctccctccacgctgtggtgcttaccctgattataatcgtgcaatgttgcctgtacgagagggggggccaaagagtgtcctggcctgccatcgggttcttggtgttggcatggcttttcgccttcgtcaccatgattgtggccgctgtgggcgtgactacatggcttcagttcttgttttgctttagttacataaagctagctgtaactctggtgaagtatttcccacaggcctatatgaacttctactacaaatcaactgaggggtggagcatcgggaatgtgctactggactttacggggggcagtttctccctgctccagatgttcctgcagtcttacaataatgaccagtggaccctgatattcggggatcctacaaagtttgggcttggggttttcagcattgtcttcgacgttgtgtttttcatccaacacttttgtctgtacaggaaacgtccaggctacgaccagctgaac

SEQ ID NO: 10244 - DNA, 1101 bp, Artificial Sequence
  Description of Artificial Sequence: Synthetic coding sequence
atgatccgcaattggctgaccatctttatcctgtttccactgaagctggttgagaaatgtgaaagttctgtctcactgaccgtcccgcccgttgttaaacttgagaatgggagcagcaccaacgtaagcctcaccctgaggcctccgctaaatgctactcttgtcattacattcgagatcacttttcgctccaagaatattaccatcctggaactgcctgacgaggtggtcgtcccgcccggggtcaccaattccagcttccaggtcactagccagaatgttggccagctgaccgtgtatctccatggaaaccacagcaaccagactggccctcgcatccgtttcctggtaatacgtagcagcgcgatatcaattataaatcaagttatcggctggatctacttcgtggcttggagcattagcttttatccgcaggtgattatgaactggcgacgcaagtctgttattggtctgagcttcgactttgtggcccttaaccttaccggttttgtcgcatattccgtgttcaacatcggcctgctgtgggttccgtatattaaggagcagttcctattaaaatatccgaatggtgtcaaccctgtgaatagcaatgatgtcttcttctctctgcacgcagtcgttctgacgcttattattatcgttcaatgttgcctgtatgagcgaggtggtcagcgggttagctggccggcgatcggctttttggtcctggcctggctgttcgcgtttgtgacgatgattgtggcggcggttggtgtgactacgtggctccagtttctgttctgtttcagctacatcaaactcgcggtaaccttagtcaaatattttcctcaggcatacatgaatttttactataaaagcaccgagggctggagcattggtaacgtgctgctggattttactgggggttcgttcagccttttgcagatgtttctgcagagctataataatgatcagtggaccctgatttttggagatccaactaagtttggtctgggcgtgttcagcattgtgtttgacgtcgttttttttatccagcatttttgcctctaccgcaagcgaccgggatacgatcagctgaat

SEQ ID NO: 10245 - DNA, 1101 bp, Artificial Sequence
  Description of Artificial Sequence: Synthetic coding sequence
atgatccggaattggctgaccatcttcatcctttttcctcttaaactggttgagaagtgtgaaagctcagtgtccttgactgttccccccgtcgtgaagctcgagaacggatcgtcaaccaacgtgtctcttaccctccgacccccactgaacgcaactctggtgattaccttcgagattacgttcagaagcaaaaacatcactatactcgaactgccagatgaagtggtggtcccgccaggagtgactaacagctcgtttcaggtgacctcgcagaatgtcggtcaactgactgtctatctgcatggtaatcactctaaccaaactggtccgcgaattcgatttcttgtcattagatcgagcgctattagcattatcaaccaagtgatagggtggatttacttcgtggcatggtccatctcgttttacccgcaagttatcatgaattggcggagaaaaagcgtgatcgggctgtcatttgactttgtggcactgaatttgacgggcttcgtcgcgtactcagtgtttaacatcggccttctgtgggtgccttacattaaagagcagtttctcctcaagtaccctaatggagtcaacccagtgaattcaaacgatgtgtttttctcgcttcacgccgtcgtcctgaccctcatcatcatcgtgcaatgctgtctttatgaaaggggaggacaaagggtgtcgtggccagccattggcttcctggtcctcgcatggctgtttgcgtttgtcaccatgattgtcgccgcagtgggtgtgactacctggcttcaattcctgttttgtttttcgtacattaagttggcagtcactctcgtgaagtacttccctcaagcgtacatgaacttttactacaagtccactgagggatggagcattggaaatgtgctgcttgattttaccgggggctcgttctcccttctgcaaatgttcctccaatcctacaacaatgatcagtggaccctcattttcggtgatcctactaagtttggtttgggggtgttttcaatcgtgtttgacgtggtgttctttatacaacacttctgcttgtacaggaagaggccaggctacgatcaactgaac

SEQ ID NO: 10246 - DNA, 1101 bp, Artificial Sequence
  Description of Artificial Sequence: Synthetic coding sequence
atgattagaaattggctgacaattttcatcctcttcccactaaagctggttgaaaaatgcgagagcagcgtcagcctgacagttcctcctgtggtgaagctcgaaaatgggtcttctacgaatgtgtcgctgacgctccggcctcccctcaacgctaccctcgtcataaccttcgagattacgttccggtctaagaacatcaccattctggaactacccgacgaagtggtagtccccccaggagtgactaacagtagctttcaagtcactagtcagaacgtcggtcagctgaccgtgtacctccacggcaaccacagcaaccagactggcccgaggatacggtttctcgtaatccgaagcagcgctatttctatcataaaccaggtcatcggctggatttatttcgtcgcctggagcatctccttttacccacaggtcataatgaactggcgccggaaatcagttataggtttatcattcgactttgtggcccttaacctgaccggcttcgtagcatactcggtattcaacatagggttgctgtgggtgccatatattaaagaacagtttctgttaaaataccctaacggggtgaatcctgtcaacagcaacgacgtgttctttagtcttcatgctgttgtactgacccttatcattatcgtacagtgttgcttatatgagcgtggagggcaacgtgtcagctggcccgctataggatttttagtcctcgcctggttgtttgccttcgtcaccatgatagtcgcagctgtcggtgtgacaacgtggctgcaattcttgttctgttttagctacatcaagttggccgtcaccctagtgaagtacttcccccaggcttatatgaatttttactacaaatcaactgaaggctggtctatcgggaatgtactgctggatttcaccggcggatccttttctctcttgcagatgttcttacagagttacaacaacgaccaatggacccttattttcggcgatccgactaagtttggactgggcgtgttttctatcgtgttcgacgtcgtctttttcattcagcatttttgcctatatagaaagcggccggggtatgatcagttaaac

SEQ ID NO: 10247 - DNA, 1101 bp, Artificial Sequence
  Description of Artificial Sequence: Synthetic coding sequence
atgatccggaattggctcactattttcattcttttcccgctgaaactggtggagaaatgcgagtcatcggttagccttacggttccccccgtcgtaaagctggaaaacggatcctcgaccaacgtgtccctgacgttgcgtccgccgttgaacgccacattggtgatcacgttcgaaataacattccgctcgaagaatatcaccattctggagctgcccgatgaggtggttgtccctccgggcgttacaaactcatcctttcaggtgacctcccagaatgtcggacagctgaccgtctaccttcacggtaatcatagcaaccaaaccggtccgcgcattcgattcctggtgatccgtagctccgcaatatcgatcatcaaccaggtgattggctggatatacttcgtagcgtggtctattagcttctatccacaggtgatcatgaactggagacgtaagtcggtaattggcctctccttcgattttgtagctctaaatctgactggcttcgtggcctattcggtgttcaacattggcttgctgtgggtgccatacataaaggagcagttcttactgaaatacccgaatggcgtcaacccagtgaactcgaacgatgtgtttttttcgcttcatgccgtggttctgaccttgattattattgttcagtgctgcctatatgagcgcggcgggcaacgggtgagctggccagccatcggctttctggtcctggcctggttgttcgccttcgttaccatgattgtggccgccgtgggcgttaccacctggttgcagttcctgttctgcttctcgtacatcaagctcgccgtcaccctggtaaaatacttcccacaggcttacatgaacttttattataagagtacagaaggatggagcatcggcaacgttctgttggactttactggtggctcattctcgctgttgcagatgttccttcaaagttacaacaatgaccagtggaccttgatcttcggtgatccaaccaaatttggcctaggagtgttttccattgtcttcgacgttgtgtttttcatccagcacttctgcctgtaccgcaagcgaccgggatacgatcagctgaat

SEQ ID NO: 10248 - DNA, 1101 bp, Artificial Sequence
  Description of Artificial Sequence: Synthetic coding sequence
atgatcaggaattggctcacgatattcatcctgttcccactaaagctcgtggagaaatgtgagtcgtctgtgtcactgactgtgcctcctgtcgtcaaactggagaatggctccagcacgaacgtcagcctgacacttagacctccattgaacgccactcttgtcatcactttcgagatcacattccgctccaaaaatataaccattctggaactgccggatgaggtggttgttcccccaggtgtgactaactctagttttcaggtaacatctcaaaacgtagggcagttgactgtgtacctgcatggtaatcatagcaaccagactgggcccagaattaggttcctcgtgatacgtagctcagccatctctatcatcaaccaggtgattggatggatctacttcgtggcgtggtctatctcattttatccacaagttatcatgaactggaggcgaaagagcgtcataggactgtcgttcgactttgtggccctgaatctgactgggtttgtggcttactctgtgtttaacatcgggctgttgtgggtaccttacatcaaggagcagtttcttcttaagtaccccaacggggtcaatcccgtgaacagtaatgatgtgttttttagtctccatgccgtcgttttaacattgatcatcatcgtccagtgctgtctatacgaacgaggcggccagagggtctcctggccagcaatcggcttcttagtgcttgcctggctctttgcgtttgtcaccatgatcgtggcggccgttggggttacaacatggcttcagtttctgttctgtttctcttacatcaagcttgcagtgacgctagtgaaatatttccctcaggcctatatgaatttttattacaaatcgactgaggggtggtccatcggaaacgttttgttagacttcaccggggggtctttctcccttctgcagatgtttctgcagtcatacaacaacgaccaatggaccctaatctttggcgatcccactaaatttggactgggggttttctccattgtcttcgatgtggttttctttattcagcacttctgtctgtatcgaaagcggcccgggtatgaccagcttaac

SEQ ID NO: 10249 - DNA, 1101 bp, Artificial Sequence
  Description of Artificial Sequence: Synthetic coding sequence
atgatcaggaactggttgacaatctttatccttttccccctgaaactcgttgaaaaatgtgaaagcagtgtgtctctgactgttccacccgtggtgaagctggagaacggcagctctaccaacgtttcactcacgctgagacctccactgaacgctactctcgttatcacctttgagatcacctttcgctcaaagaatatcacgatcctcgagctgcccgacgaggttgtggtgcctcccggggtcacaaattcctcatttcaggtgacatcccagaacgttggtcagctcacggtctatctgcacggaaatcacagcaaccagacgggtcctcgaatcagatttctcgttataagatcaagcgctatatccatcatcaaccaggtgatcgggtggatttactttgtggcctggtccatcagtttctacccccaggtgataatgaactggagaagaaagagtgtcattggtctgtcttttgacttcgtcgcactgaatttgaccggcttcgtggcctactcagtgtttaacattggcctcctctgggttccatacattaaggaacagtttctgttgaagtaccctaatggagtgaaccctgtgaacagcaacgatgtcttttttagtctgcatgctgtcgttctgaccctgattatcatcgtgcagtgttgcctctacgaacggggaggacagagggttagttggccagcaatcggctttctcgtgctggcgtggctgtttgccttcgtcaccatgattgtagcagccgtgggtgtcaccacatggctccagtttctgttctgcttctcttatattaagttggcagtcactctcgtgaagtactttccccaggcgtacatgaatttctattacaaatccaccgagggctggagtataggtaatgtcctgctcgacttcacaggagggtccttctccctcctccaaatgtttcttcagagctataacaacgaccagtggacgctcatttttggcgatcccactaagttcggcttgggtgtattctcaattgtctttgacgtcgtgttctttatccagcatttttgtctctatcgcaagaggcctgggtatgaccaactcaat

SEQ ID NO: 10250 - DNA, 1101 bp, Artificial Sequence
  Description of Artificial Sequence: Synthetic coding sequence
atgataaggaactggcttactatcttcattcttttcccccttaaacttgtggaaaagtgtgagtcctccgtgtctctcaccgtgccaccagtggtcaagctggaaaacggatcctcaactaacgtgtcgcttaccctcagaccccctctgaatgcaactctggtgattacctttgaaattacttttcgctccaagaatatcactattctcgaactgcccgacgaagtggtggtgccccctggtgtcactaattcgtcgttccaggtcacctcccagaatgtggggcaattgaccgtctaccttcatggaaaccattcgaaccaaactggaccccgcattcgctttcttgttattagatcatcggcgatctcgattatcaaccaggtgatcggttggatctattttgtggcatggagcattagcttttacccacaggtgatcatgaactggaggcggaagtcggtcattggactctcctttgatttcgtggcactgaatctcaccggctttgtcgcctactcggtgtttaacatagggcttctttgggtgccatacataaaggaacagtttctgctgaaataccctaatggcgtaaacccagttaactccaacgacgtgtttttctcgctgcatgcggtggtgttgaccttgattatcatagtgcagtgctgcctttacgaaagaggaggtcagcgggtttcctggccagctatcggatttcttgtgctcgcgtggctgtttgcatttgtcaccatgatcgtcgcagcagtgggagtgacgacctggttgcaattccttttttgtttttcctacatcaagctcgcagtgaccttggtgaagtacttccctcaggcatacatgaatttctactacaaatcaactgagggttggtcgattggaaacgtcctccttgattttaccggtggatccttttcgctcctccagatgtttctccaatcgtacaataacgatcaatggactctgatatttggagatccgaccaagtttggtctgggagttttttccatcgtgttcgatgtcgtctttttcattcagcatttctgtctgtaccggaaacgcccgggttacgatcaacttaac

SEQ ID NO: 10251 - DNA, 1101 bp, Artificial Sequence
  Description of Artificial Sequence: Synthetic coding sequence
atgattaggaactggctgacgatctttatcctcttcccgcttaagctcgtggagaaatgcgagtcgtccgtctcacttacggtgccgccagtggtgaagctcgaaaacggttcgtcgactaatgtgtccctcacgctccgaccaccgctgaacgccactctggtgatcacctttgaaatcaccttcagatcgaagaatatcaccatcctggagctgcctgatgaagtggtggttccgccaggcgtgaccaactcgtcctttcaagtgacttcccagaacgtcggccagctgaccgtgtacctgcatggaaatcacagcaatcaaaccggccctcgcatcaggttccttgtgatccgctcgagcgcgatcagcatcatcaaccaagtgatcggatggatttacttcgttgcatggtccatcagtttctaccctcaggtgatcatgaactggcgcagaaagagcgtgatcgggttgagtttcgatttcgtggcactgaatctcactggattcgtcgcctactccgtctttaacattggactgctctgggtgccgtatatcaaggaacagttcctgctcaagtaccccaatggggtcaatccggtaaattcgaacgacgtgtttttctccctgcacgcggtagttctcacccttatcattatcgtccagtgctgcttgtatgagcggggaggacagagagtgagctggccagccatagggttcctggtgctcgcttggcttttcgcctttgtgaccatgatcgtggcagctgttggagtcacgacttggcttcaatttctgttctgtttctcgtacatcaaactggccgttactctcgtcaaatacttcccccaggcgtacatgaacttctactacaagtcaactgaaggatggtcgataggtaatgttctcctggatttcaccggtggttcatttagcctgctccagatgttcctccaatcctacaacaacgaccaatggaccctgattttcggtgatcccacgaagtttggcctgggcgtgttctccatcgtgtttgatgtggtgttctttatccagcacttttgcctctaccggaaacgcccgggctacgaccagctgaac

SEQ ID NO: 10252 - DNA, 1101 bp, Artificial Sequence
  Description of Artificial Sequence: Synthetic coding sequence
atgatcaggaactggctcaccatcttcatcctgttcccgctgaaacttgtcgaaaagtgtgaatcgagcgtttcactgacggtcccacctgtggtcaaactggagaatggctcaagtaccaatgtttccttgactctccgccctcccttgaatgcgacgttggtaataaccttcgaaatcacatttcgttcgaagaacataactatcctagaattacctgatgaagtggtggtcccccccggtgtcacaaacagtagctttcaagtcacaagccagaacgtcggacagcttactgtatacctccacggcaaccacagtaaccaaacaggaccccgaatccggttcttggtcatccgatcatccgcgattagcatcattaaccaagtcatcggctggatctactttgtggcctggtcaatttcgttttatcctcaggtcatcatgaattggcgccgtaaatcagtgatcggactgtccttcgactttgttgctcttaacctaacgggcttcgtcgcctatagcgtcttcaatatcggactcttgtgggtaccttacataaaagaacagtttttgttgaagtatccaaatggggtgaatcctgtgaatagtaacgacgttttcttttctttacacgcggttgtccttactctcatcatcatcgtgcaatgctgtttgtacgagcgaggaggtcagcgcgtatcttggccagccatcggattcctcgtgctggcctggttgttcgcattcgttactatgatcgtcgcagcagtcggtgttacgacctggcttcagttcttgttctgcttttcctatatcaaactcgcagttacgctggttaaatatttcccacaagcttacatgaacttctattacaagtccacagaaggttggagcatcggcaatgtgcttctggactttaccggtggctctttcagtctactgcagatgttcttgcaatcctataacaacgatcagtggactctgatcttcggcgatcctaccaagtttggtttgggagtgttttcgatagttttcgacgttgtgtttttcatacaacacttctgcctttataggaagagacccggatacgatcagttgaat

SEQ ID NO: 10253 - DNA, 1101 bp, Artificial Sequence
  Description of Artificial Sequence: Synthetic coding sequence
atgattaggaactggttgacgatcttcatcctctttcccctgaagttggttgagaagtgtgaaagctccgtgtccctgaccgttccgccggttgtgaaactagagaacggttctagcaccaacgtctccctcacactgcgccccccccttaacgccacgctcgtgatcactttcgagatcactttcagatctaagaacatcacaatcttagagcttcccgacgaggtggtggtccctcctggcgtcaccaactcctcattccaggtgacctcccagaacgtaggacaactgaccgtatatctgcatggaaatcacagtaatcagacgggtcctagaattcgttttttggtcatccgctcgtctgccatctctatcattaatcaggtcattggttggatctacttcgttgcctggtcgattagtttctatccccaggtcataatgaattggcgtagaaagtccgttatcggcttgtcgtttgatttcgtggcattaaaccttaccggtttcgttgcctactccgtctttaacatcggtctgctttgggtgccttacattaaggaacaatttcttctcaagtatccgaatggcgttaatccagtaaactcaaacgacgtcttcttctccctccatgccgtcgtccttaccctcatcatcatcgtgcagtgttgcctctatgagaggggcggtcagcgtgtgtcttggccggctatcggttttttggtcctggcctggctcttcgccttcgtgaccatgatcgtggccgcagtgggcgttaccacatggttgcagttcctattctgtttctcgtacattaaactggccgtgacgcttgtcaagtacttccctcaggcatatatgaacttttactataaatccaccgaaggctggtcgatcggcaacgtgctgctggatttcactggtggttctttttctctgttgcagatgtttctccagtcctataacaacgatcagtggacactcatctttggggatcccaccaagttcggtctcggcgtcttttcaatcgtgtttgatgtggtgttctttattcagcacttctgtctttaccgcaagcgtccgggctatgaccagctcaac

SEQ ID NO: 10254 - DNA, 1101 bp, Artificial Sequence
  Description of Artificial Sequence: Synthetic coding sequence
atgattaggaactggcttaccatctttattctttttccccttaaacttgtggagaaatgcgagagctccgtgtcactgaccgttccccccgtcgtgaagctggaaaacggttcttccaccaatgtgtcactcacccttcgtccacctctcaacgcgactctcgtgataactttcgaaatcacttttcgatccaaaaacattacgattctcgaattgcctgatgaggtcgtggtcccacccggcgtcactaactcgtcttttcaagtcacctcgcagaatgtcggtcaactcacggtgtatcttcatggaaatcattccaaccaaactgggccaagaatccggtttttggtgattagatcgtcagccatttctattatcaaccaggtgatagggtggatatactttgtcgcatggtcgatatcattttacccgcaggtgattatgaattggcgtcgaaagagcgtgatagggctcagcttcgacttcgtggccctcaacctgactggttttgtggcctacagcgtgttcaacattgggcttctgtgggtcccgtacatcaaggagcaatttctgcttaagtatcccaacggagttaacccggtgaattccaacgacgtgttctttagcctgcacgcagtcgtgcttactctgatcattattgtacagtgttgcctgtacgaaagagggggacaacgtgtgtcctggcctgcaatcggatttctcgtcctggcgtggcttttcgcatttgtgaccatgatagtcgcagcagtgggagtcaccacctggcttcagttccttttttgttttagctacatcaagctggccgtgaccctggttaagtacttcccgcaggcatacatgaatttctactacaagagcactgaagggtggagcattggtaatgtgctgctcgattttaccggtggatccttttccctgttgcaaatgttccttcagtcgtataacaatgaccaatggaccctcatttttggagatccgactaaattcggattgggcgtctttagtatcgtgtttgacgtggtgtttttcattcagcacttctgtctttacaggaagcgacccggatacgatcaactgaac

SEQ ID NO: 10255 - DNA, 1101 bp, Artificial Sequence
  Description of Artificial Sequence: Synthetic coding sequence
atgatccgcaactggctgaccattttcatactttttcctctgaagctggtggaaaagtgcgaatccagcgtgtcgctcactgtccctccagtcgtcaaactggaaaacgggtcgtcgactaacgtgtcactcactctcagaccacctctgaatgcgacgctcgtgattacttttgagatcacctttcgctcaaaaaacatcaccatcctggagctgcctgatgaagtcgtcgtcccgccgggagtgaccaactcgtcgttccaagtcacctcgcagaacgtgggacaactgacggtgtacctccacggaaatcactcgaaccaaacgggaccaagaatccggtttttggtgatccgcagtagtgccattagcatcattaatcaagttatcggctggatctacttcgtggcgtggtccatctcgttctacccacaggtgattatgaactggcgccgcaagtcagttattggactctccttcgacttcgtcgcactgaacctgactggatttgtggcttacagcgtgttcaatatcggactcctgtgggttccctacattaaggaacagttcttgctgaaatacccaaacggcgtcaatccggtcaatagcaatgatgtgttcttctccttgcatgcagtggtgctcaccctgatcatcatagtccagtgctgcctgtacgaacgaggcggtcagcgggtgagctggcctgcgatcggtttcctcgtgctggcctggctcttcgcgtttgtcaccatgattgtggctgccgtcggagtaaccacgtggctccaattcctgttctgttttagctacatcaagctggctgtcacgctggtgaagtacttcccacaggcatatatgaacttctactacaaaagcactgagggctggagcattggtaacgttcttcttgacttcactggaggatcattctccttgctgcagatgttcctgcaatcttacaacaatgatcagtggactctcatcttcggcgaccccacgaagttcggcctcggggtgttttcaatcgtgttcgacgtggtgttctttatccaacatttttgtctctatcgcaagcggccgggctacgaccaactgaat

SEQ ID NO: 10256 - DNA, 1101 bp, Artificial Sequence
  Description of Artificial Sequence: Synthetic coding sequence
atgatacgtaactggttgactatcttcattctgtttcctctcaagctagtggagaaatgtgagtcgtcggtctctttgacggtcccgcccgtggtgaaactcgaaaacggctccagcactaacgtctcactcacgttgcgaccccccctgaatgccaccttggtcataacttttgaaataacgttccgatcaaagaacatcacaattcttgagttaccagacgaggtggtggtcccccccggggtcacgaactctagttttcaggtgacgagtcagaacgtcgggcagctgaccgtgtacctgcacggaaaccactccaaccaaaccggccctaggatcagatttcttgttatccgttcatccgccatatccattatcaatcaggtgatcgggtggatctactttgtcgcgtggagtatctcattctacccacaggtcatcatgaattggcggcgcaaatccgtgatcgggctgtcgtttgattttgtggccctcaatctgaccggtttcgttgcctattcggtgttcaacatcggcctcctctgggtgccatacatcaaagagcagtttctgttgaagtaccccaatggtgtgaatccggtgaatagcaacgacgtgttcttttcccttcatgccgtcgtgctaacgttgatcataattgttcagtgctgcctgtacgagcggggtgggcagcgcgtgagctggcctgcaattggcttcctggtactcgcctggctgttcgcttttgtgacaatgattgtggccgccgtgggtgttaccacctggctgcagttcctgttctgtttctcatacattaagctggctgtgaccctggtgaagtactttcctcaggcgtatatgaatttctactacaaaagcactgagggttggagtataggaaatgtgctgctcgatttcactggaggttcttttagtctgctccaaatgtttttgcagagctacaacaacgaccagtggacacttatcttcggggaccccacgaaattcggcctcggggtcttcagtatcgttttcgacgtcgttttttttatccagcacttttgcctgtaccggaagcgccccggatatgaccagttgaac

SEQ ID NO: 10257 - DNA, 1101 bp, Artificial Sequence
  Description of Artificial Sequence: Synthetic coding sequence
atgattcggaactggcttacgattttcattctatttccgctaaaattagtagaaaaatgtgaatctagcgtatcattgacggttcctccggtggtcaaattggaaaacggctcttctactaatgtttcattaacactaagacctccacttaacgcaacgctggtcataacttttgaaatcacgtttcgcagcaaaaacattacaattctggagcttcctgacgaagttgttgtgcctcctggagtaacaaatagttcatttcaggtcacttctcagaacgtaggtcaattaacggtgtaccttcatggtaatcattccaatcaaactggcccgagaattcggtttctggtgatacgatcttcagcaatcagcattattaatcaggtgattggttggatctattttgtagcctggtctatatctttctaccctcaggtaattatgaactggcgtcggaaaagtgtaatcggcttgtcatttgattttgtcgcccttaacctaacgggctttgtagcgtattctgtgtttaatataggattgctctgggttccttatatcaaggagcagtttcttcttaagtacccgaatggtgtaaacccggtcaattcgaatgatgtatttttttctttgcacgctgttgtgctgaccctcataattattgttcagtgctgtttgtatgagcgcggaggccaaagagtgtcgtggcctgccatcggttttttagttcttgcttggctgtttgcattcgtaacgatgatcgtggcggcggtaggcgttactacgtggctccaatttttgttctgcttttcttacatcaaacttgctgtaactcttgtcaagtattttccgcaggcgtatatgaatttttattataaatcaactgaaggatggtctattggtaacgtccttttggattttaccggcgggagcttctctcttctgcagatgttcctacagagctacaataatgatcagtggacactaattttcggagatcctacaaaatttggcttaggagtgttttctatcgtctttgatgtagtcttctttattcagcatttttgcctttatcgcaaacggccgggctatgatcagttgaac

SEQ ID NO: 10258 - DNA, 1101 bp, Artificial Sequence
  Description of Artificial Sequence: Synthetic coding sequence
atgattcgcaattggctgactattttcatactttttcccctgaagctggtggagaagtgtgaatcgtcggtttcactcaccgtgccacccgtcgtgaagctggaaaacggatcgtcaacgaacgtcagcctcacccttagaccgcctctgaatgcaactcttgtcatcacctttgaaataacttttcgctcgaaaaacatcactatcctcgaactgccggatgaagtggtcgtgcctcctggggtgaccaactcgtcgtttcaggtcaccagccaaaatgtgggacagctgactgtgtacctgcatggtaaccactccaaccaaactggaccccgtattcggttcttggtcattagatcgtcagctatcagcatcattaatcaagtcattggctggatatacttcgtggcatggtcgatatcgttctaccctcaggtgattatgaactggcggaggaagtccgtgattggtctttcctttgattttgtggcacttaatctgactggctttgtggcgtattccgtgttcaatattggcctcttgtgggtcccatacatcaaggaacagtttttgcttaagtaccctaacggtgtgaacccggtcaacagcaacgatgtgttcttctcactccatgcagtggtcctgacgctgatcataatagtccagtgttgtctttacgaacgcggagggcagcgggtcagttggccggctattgggttcctggtgcttgcctggctgttcgcttttgtgactatgatagtggccgcagtgggagtgactacctggctgcagtttcttttttgttttagctacattaagctcgccgtcaccctggtcaagtactttcctcaggcctacatgaacttctactataagtccactgaaggctggtcgattggcaatgtgcttcttgattttaccggaggctcgttctcactgctgcaaatgttcttgcaatcctacaacaacgatcaatggactttgatttttggtgaccctaccaaattcggactcggagtgttttcgattgtgtttgacgtggtgttctttattcagcacttttgcctgtaccgaaagaggcccggatacgaccaactgaat

SEQ ID NO: 10259 - DNA, 1101 bp, Artificial Sequence
  Description of Artificial Sequence: Synthetic coding sequence
atgatcaggaattggctcactatattcattctgtttccattgaagctggtcgagaagtgtgagtcaagcgtgtcactaactgtgcctcctgtcgtgaagctggagaatgggagttctactaacgtcagtctgacattgcggccccctcttaatgccaccctcgtcattacattcgaaatcacttttcgcagcaaaaacataactattctcgaactgccagatgaagtcgttgtgcctccaggggttaccaactccagttttcaagtgacctcacagaatgtgggacagctcaccgtctatctccacggcaatcactcaaatcaaacaggaccccggatcaggttcctggtcattaggtcttccgctataagcatcatcaatcaggtcattggctggatctacttcgtagcgtggagtatctctttttatcctcaggttatcatgaattggaggagaaaatccgtgatcggactgtcatttgactttgtggcacttaatctcacaggtttcgttgcctattcagtattcaacatcggcctcctgtgggtcccctacataaaagaacagtttctgttgaagtatccgaatggggtaaatcctgtcaacagtaacgacgtgttctttagtttgcacgccgtagtgctcactttgataattattgtccagtgctgcctatatgaacgcggcggccagcgagtgtcttggccggccattggttttttagtgctcgcttggctgttcgcgttcgtaacaatgatcgtcgctgccgtcggcgtcacaacctggcttcagttcctgttttgtttttcatatatcaaattggctgtaaccctggtgaagtactttccccaggcttatatgaacttctactataaatccacggagggttggtctatcggcaatgtgttgctagatttcacaggtgggagctttagcctgcttcagatgtttcttcaaagctacaacaatgaccagtggacacttatctttggtgatccgaccaagttcggcctgggagtattctctattgtcttcgacgtggtattttttatccagcacttttgcctctaccgcaaacgtcccggatatgaccagctcaac

SEQ ID NO: 10260 - DNA, 1101 bp, Artificial Sequence
  Description of Artificial Sequence: Synthetic coding sequence
atgataagaaactggctgaccattttcatcctgttcccgctcaagctggtcgagaaatgcgaatcgtcagtgtcgctgaccgtgcctccggtcgtcaagctggaaaacgggagctccaccaacgtgagcctgactcttcggccaccgctgaacgcaactttggtgatcaccttcgaaatcacttttcggtcaaagaacatcactatccttgagctgccagacgaagttgttgtgccgccgggtgtgaccaattcatccttccaggtcacgtcacaaaacgtgggacagcttactgtctacctgcacggaaaccacagcaaccaaaccggaccccggatccggttcctcgtgatccgttccagcgctatctcgatcatcaaccaggtgatcggatggatctacttcgtggcctggtctatctcattctaccctcaggtgatcatgaactggagaagaaaatcagtgatcgggctgtccttcgacttcgtggccctgaacctgaccggcttcgtggcctactccgtctttaacatcggccttctgtgggtcccctacatcaaggaacagtttttgctgaagtaccctaatggcgttaatcctgtgaactctaacgatgtgttcttctcgctccatgcagtggtgctcaccctgatcattatcgttcagtgttgcctgtacgaaaggggtggccagcgagtgtcctggcctgcgatcggatttctggtgctggcatggctgttcgccttcgtgactatgattgtggccgccgtgggcgtcacgacctggctgcaattcctgttctgcttctcctatatcaaattggcggtcaccctcgtgaagtactttccccaagcctatatgaacttctactacaagtccaccgaaggatggtcgatcggaaacgtacttttggacttcactgggggcagcttttccctcctgcaaatgttcctgcagtcgtacaacaatgatcagtggacccttatcttcggcgatcctaccaagttcggactgggtgtgttctcaatcgtgttcgatgtggtctttttcatccagcacttctgcctgtatcgcaagaggcccggatacgatcagctcaac

SEQ ID NO: 10261 - DNA, 1101 bp, Artificial Sequence
  Description of Artificial Sequence: Synthetic coding sequence
atgattagaaattggctaaccattttcattttgttccctctgaaactcgtcgagaaatgcgaatctagcgtatcgcttaccgtgccaccggttgtcaaactggaaaacgggagcagcactaatgtgtccttgacactgcgtccccctctgaatgccaccctggtcattacttttgagattactttccgctctaagaatattacaatcctggagctcccagacgaagtggttgtgccacccggtgtcacaaattcaagtttccaggtgacgagtcagaatgtggggcagcttaccgtttacttgcatggaaaccatagcaatcagactggaccaagaattaggttcctagtgatacgctcctccgccatttcaattatcaaccaggtaatcgggtggatctattttgtggcctggtctatcagcttttaccctcaggtgattatgaattggcgtaggaaatcggtcatcggcctgtcgttcgatttcgtggcccttaatctgacaggatttgttgcgtattcagtgttcaacattgggcttctgtgggtgccatacatcaaggaacagttcctgttgaaataccctaatggcgttaaccccgttaattctaacgatgtgttcttctcacttcacgccgtggtgctgactcttattatcattgtccagtgttgcctgtatgagcggggcgggcaaagagtgtcttggccagctattgggttcctagttctggcctggttatttgcatttgtaaccatgattgtggcagccgtaggcgtgacaacatggctgcagtttttgttctgtttttcctacattaagttagctgtgactctggttaaatattttccccaggcgtatatgaacttttactacaagtcaaccgagggctggtccatcggtaatgttttacttgacttcaccggtggctcgttcagcctactgcagatgtttttgcaatcttacaacaacgaccagtggaccctgatctttggggacccaaccaagtttgggttaggggtgtttagtatagttttcgacgtagtgttttttatacagcatttttgtctctataggaaacgcccaggctatgaccagcttaac

SEQ ID NO: 10262 - DNA, 1101 bp, Artificial Sequence
  Description of Artificial Sequence: Synthetic coding sequence
atgatacgcaattggctaactatcttcatattgtttccgctaaagctggtcgaaaagtgcgagagctcggtctccttaactgtccccccggtggtgaaattggagaacggatccagtaccaatgtgagtctgaccctacgcccgccactgaacgcaacacttgtaataacatttgagataacatttagatcgaaaaacataacaatactggaactgcctgacgaggtagtcgtccctcctggagtcaccaattcttccttccaggtgacctctcagaacgtagggcaactcactgtctaccttcacggcaaccacagtaatcagacagggcctcgaattaggttcttggttatcagatcctcagccataagtattatcaaccaggtcattggctggatctactttgttgcctggagcatctccttctatcctcaggtcatcatgaactggaggcgaaaatccgtcatcgggttgtctttcgactttgtcgccttgaacctgaccggattcgtggcctattcagtgttcaacataggcttgctatgggtgccttacatcaaggaacagttcttactgaagtacccaaacggggtgaaccccgtcaattccaatgatgtgtttttcagcctccacgccgttgtgctaacactgataatcatcgtgcagtgttgtctctacgaacgggggggacagcgagtgtcttggcctgccattgggttcttagtgctggcctggctcttcgcattcgtcaccatgattgtggctgccgtaggggtgaccacctggcttcagttccttttctgttttagctacattaaattagccgtgacgctggtgaaatattttcctcaagcatacatgaatttttactacaagtcaacagaggggtggagcatcggaaatgtcctgcttgacttcaccggaggttcattttcacttttgcaaatgttcctccagagctacaacaacgatcagtggaccctgatctttggtgatcccacgaaatttggactcggtgtttttagcatcgtgtttgacgtggtcttctttattcagcacttctgcctctatagaaaacgccccggctacgatcagttgaac

SEQ ID NO: 10263 - DNA, 1101 bp, Artificial Sequence
  Description of Artificial Sequence: Synthetic coding sequence
atgataagaaactggctgactatttttatactgttcccattgaagctggtggagaagtgcgaatctagcgtgagtctaacagtcccccccgtcgttaaattggagaacggctcgtccacaaacgtgtccttgactctgcgcccccctttaaatgccacgcttgtgatcacctttgagatcacattccgatcgaaaaatatcactatccttgagcttcctgacgaagtcgtagtcccgccaggagttactaatagctcatttcaagttacctcacagaacgtggggcaacttacagtgtatcttcacggcaatcattctaatcagaccggacctcgtataagattcctcgtgataagaagcagcgctatctctatcattaatcaggtgatcggatggatttactttgtggcatggagcattagtttctacccgcaagttataatgaattggcgacggaagagcgtaatcggactctccttcgatttcgtagctttgaacctgaccggttttgtggcttattctgtgttcaatattggtctgctgtgggtgccctacattaaggagcaatttctgctgaaataccccaacggtgtgaacccagtgaattccaatgacgtgtttttcagcctgcatgctgttgttctgacacttattatcatcgtccagtgctgcttgtacgaaaggggaggacagcgggtgtcttggcctgcgattggttttttggtactggcctggctttttgcttttgtgacaatgatcgttgccgcagtgggggtcacgacgtggctccagttcttgttctgcttctcctatattaaactggccgtcacgctggtgaagtacttccctcaagcctacatgaacttctactataaatctaccgaagggtggtcaatcggtaatgtactgctggacttcaccggtggatccttcagccttctccagatgtttctgcagagttacaacaacgaccaatggacgctgatctttggcgatccaacaaagtttggcctgggggtatttagtatcgtgttcgatgtagtattcttcattcagcatttctgcttgtataggaagcggccaggttatgatcaattgaat

SEQ ID NO: 10264 - DNA, 1101 bp, Artificial Sequence
  Description of Artificial Sequence: Synthetic coding sequence
atgatccgaaattggcttaccatctttatcctattcccactgaagcttgtggagaaatgtgagtctagcgtgagcctgaccgtcccaccagtggtgaagctcgagaatgggtcatccaccaatgtcagcctgaccctgagaccaccactgaacgccacccttgtgattacatttgagattacctttagaagcaaaaacattaccattcttgaactgccagatgaggtcgtcgtgccaccaggcgtgacaaattctagcttccaggtgacctcgcagaatgtaggacaactgaccgtttacctacacgggaatcattcaaaccagaccggtccccggattcggttcctggtgatccgcagcagcgctatttcaataataaaccaggtcattggctggatttactttgtcgcatggagtatcagcttttatccacaggtcatcatgaactggaggcgtaaatctgtaataggactctctttcgattttgtggctttgaacctcactggatttgtggcctacagcgtcttcaatatcggcctgctatgggttccttacatcaaggagcagttcctgctcaaataccccaatggggtcaaccctgttaatagcaacgacgttttcttctcactccatgccgtagtgttgaccctgatcatcattgtgcaatgctgcctgtacgaacggggcggccagagggtcagctggccagccattggctttctggtattggcttggctcttcgcctttgtcaccatgattgtcgccgcagtgggagtgacgacatggttacagtttctgttttgtttttcatacatcaagttggccgtaaccctggtcaaatacttcccacaggcatacatgaacttctattataaatccacagagggatggtcaatcggcaatgttttgctcgattttaccggcggatcgttctcacttctgcagatgtttctccaaagctataacaatgaccagtggaccttgatattcggggatcctaccaaattcggcctcggagtgtttagcattgtattcgacgtggtgttctttatccagcacttctgcctctatcgaaagcgaccaggttatgatcagctaaat

SEQ ID NO: 10265 - DNA, 1101 bp, Artificial Sequence
  Description of Artificial Sequence: Synthetic coding sequence
atgattcgcaattggctgaccattttcatcctgttcccgctgaagctggtcgagaagtgtgaatcctcagtgtcgctcaccgtcccgccagtcgtgaaacttgagaatggcagctcgactaacgtgtcactgactctccgccctcccctgaacgccaccctggtcatcaccttcgaaattacttttcgttccaagaacattaccatcctggagctgccagacgaggtggtagtgccccccggcgttactaactcatcttttcaggtgacgtcgcaaaacgtgggacaattgacggtctacctccacgggaatcatagcaatcagactgggcctcgcatccggttcctggtgatccggtcgtccgcgatcagtatcatcaatcaggtcatcggatggatctacttcgtcgcgtggtccatctctttctacccacaagtgattatgaactggcggcgcaagtcagttatcggcctcagtttcgatttcgtagcgctgaacctgaccgggtttgtggcctacagcgtgttcaacatcggcctgctttgggtaccttacatcaaagaacagttccttctgaagtatccgaatggagtgaacccggttaacagcaatgacgtgtttttctcactccatgcagtggtgctgaccctgatcattatcgtccagtgctgcctgtatgaaaggggcggacaaagagtcagctggccggctataggattcttggtcctcgcctggctgtttgcttttgtgactatgatcgtcgcggccgtgggagttactacttggctgcaattcctgttctgcttttcatatatcaaactcgccgttaccttggtgaagtacttcccgcaggcatacatgaacttctactacaagtcgaccgaaggatggtcgatcggaaacgtcttgcttgacttcactgggggatctttttccctgctgcagatgttcctccagtcgtacaacaacgaccagtggaccctcatttttggtgacccaacgaaatttggtctgggggtgttcagcatcgtgttcgatgtggtgttctttatccaacacttctgcctgtaccgaaagaggcctggttacgatcagttgaac

SEQ ID NO: 10266 - DNA, 1101 bp, Artificial Sequence
  Description of Artificial Sequence: Synthetic coding sequence
atgatccgaaattggcttaccatttttattctttttccgctgaagttggtcgagaagtgcgaaagtagcgtgtcgctgaccgtgccacccgtggtcaagttggagaatggctctagtaccaacgtttctctcaccttgcgacctccccttaacgctacacttgtgatcacctttgagatcaccttcaggagcaagaacataaccatcctggagcttccggacgaagtggtggtcccaccgggcgtcactaactcaagttttcaggtcacctcacaaaacgtaggtcagctgaccgtttatttacacggcaatcactcaaatcaaactggccccaggattaggtttttggtcatcagaagctccgcgatcagcattatcaatcaagtgattggttggatctacttcgtagcttggtcgatcagcttctatccgcaggtcatcatgaattggcgacgtaaatccgtgatcggattgtcttttgatttcgtggcccttaatcttaccgggttcgtggcgtattcagtcttcaatatcgggctcctgtgggtcccatacatcaaggagcagttcttgcttaaataccccaacggagtgaatccagttaattctaacgatgttttcttctcacttcacgccgttgtactgactcttatcataattgttcagtgctgtctgtacgaaagagggggacagagagtgagctggcccgctatcggattcttggtgctggcctggctttttgcctttgtgaccatgatcgttgccgcagtgggtgtgactacatggctgcagttcttgttctgtttttcctatataaagttggccgttacattggtgaagtacttcccacaagcttatatgaacttctactataagagtaccgaagggtggtctattgggaacgttctactggactttacaggcgggagcttttctctgctacaaatgttcctacagagttacaacaatgatcagtggacactaatcttcggagacccaacgaaattcggactgggtgtcttttctattgtgttcgacgtggtgtttttcatccagcatttctgcctctatcgaaagcgacctggatacgatcaattaaat

SEQ ID NO: 10267 - DNA, 1101 bp, Artificial Sequence
  Description of Artificial Sequence: Synthetic coding sequence
atgatccgaaactggttgacaatatttatattgttccctctgaaactggtagagaaatgcgagtcatccgtgagccttacggtgccgcccgtcgttaagctggagaacggatccagtacaaacgttagtttgaccctgaggcctccgctgaacgctactttagtgatcacctttgaaatcacctttagaagcaagaatatcacgatcctggagctccctgacgaagtggtggtcccccccggcgtgacgaattctagcttccaagtcacatcacagaacgttggccagctcactgtgtacttgcacgggaaccattccaaccaaacaggaccaaggatccgcttccttgtgatccgcagctctgccatttccatcattaaccaagtgattggatggatatatttcgtggcctggtccatttctttctacccccaggtgatcatgaattggcgacgcaagagcgttattggtttgtcctttgacttcgtagctctaaaccttaccggcttcgtagcttactccgtgtttaacattgggctgttatgggtgccttacatcaaggagcaattcctcctgaagtatccaaacggagtgaatccagttaactctaacgatgtttttttcagtctgcacgcagttgtgttaactctgataattatcgtacagtgttgcttgtacgagcgtggagggcaaagagtgtcttggcctgccatcgggttcctggtgcttgcttggctgtttgctttcgttacaatgatcgtggccgctgtaggggtgactacttggctgcagttccttttttgtttttcttatattaaacttgcagttactctggtcaaatattttcctcaggcctacatgaatttttactacaaaagtaccgagggctggtcgataggcaacgtcctgctggacttcacaggtggaagtttttctctgcttcagatgttcctgcagtcatataataatgatcagtggacactgattttcggcgatcccacaaagttcgggttgggtgtgttttccattgtctttgacgttgtttttttcattcagcatttttgtctctatagaaaacggccgggttatgatcaactgaat

SEQ ID NO: 10268 - DNA, 1101 bp, Artificial Sequence
  Description of Artificial Sequence: Synthetic coding sequence
atgatacgaaattggctgacaatctttatcttgtttccgctgaagctggtggagaaatgcgagtcttctgtgtcactgaccgtccctcctgtggtcaaactggagaacggatcatctactaacgtttccctcactctgcggccaccactaaacgctaccttagtgattacatttgaaattaccttccgatctaagaacatcactatcctagaattgccagacgaggtggtggtgccgcccggcgtaacaaactcgtccttccaagtaacatcccaaaatgtgggccaattgaccgtgtatctacatgggaaccacagtaatcagaccgggccgcgtatccgtttccttgtcatccgcagttcggcgattagcatcattaaccaggtcatcggttggatttactttgttgcatggtctatttctttttaccctcaggtcatcatgaactggcggagaaagagcgtgattggattatcatttgactttgtggctcttaatctgactggttttgtggcctacagtgtgtttaacattggcctactctgggtaccttacatcaaggagcaattcttactgaagtatcccaacggcgtcaacccagtcaatagcaatgatgtatttttcagcctgcacgcagtggtcctcacattgatcattatagtccagtgttgcctttatgagcgaggaggccagcgagtgagttggcctgcgataggatttctagtcttggcctggctcttcgcatttgtgaccatgatcgtcgccgccgttggcgtgaccacttggctacaattcctgttttgctttagctacatcaagctggcagtgaccctcgtcaagtacttccctcaagcctacatgaatttctattacaagtcaactgagggctggtcgatcggtaacgtcctcctcgacttcacgggagggagcttttccttacttcagatgtttttgcaatcatacaataacgatcagtggacactgatctttggagaccctactaaattcggccttggggtcttttccatcgtattcgacgttgtgttttttattcagcacttctgtctatacagaaagaggccagggtacgaccagctcaac

SEQ ID NO: 10269 - DNA, 1101 bp, Artificial Sequence
  Description of Artificial Sequence: Synthetic coding sequence
atgattcgtaattggttaacaatcttcattttgttccctctgaaattggtggagaaatgtgagtcaagtgtcagtctgacagttcctccggtagttaagcttgagaatggatcctcaacgaatgtaagtcttacgcttcgaccaccacttaatgcgacactggtgattactttcgagatcacttttaggtccaaaaatataacaatccttgaactgcctgacgaagttgttgtcccgccaggtgtgaccaactcatcatttcaagtaacatcacagaatgtgggacaactcactgtttatctgcatgggaaccatagtaatcaaactggaccacgtattcggttcctcgtgatcagaagctcagctatttctattattaaccaagttatcgggtggatctacttcgttgcttggtccatttctttttatccgcaggttataatgaattggagacgaaagtctgttattggtttgtcatttgattttgttgcgttgaatctcacgggatttgttgcctactccgttttcaacattggacttttgtgggtaccgtatattaaagagcaattcctattgaagtatccgaatggagtgaacccagttaatagtaatgatgtattcttcagtctccatgcagttgttcttactctcataataatagtacaatgctgcttgtatgaacgaggtgggcagcgagtgtcctggcccgctataggttttttggtgttggcatggttgtttgcttttgtcacgatgattgtagcagccgtaggcgtaactacatggttacaattcttgttctgcttctcatatattaagttggcggtcactctcgtgaaatatttcccacaggcttatatgaatttttactataagagtacagaaggatggtctataggtaacgtcttgctggattttacaggaggatctttttctctgttgcaaatgtttctgcaatcatataataacgaccagtggaccctgatattcggagacccaacgaaattcggattgggagtcttctctattgtgttcgatgttgtcttcttcatccaacatttctgcctttatcgcaaacgaccgggatacgatcaacttaat

SEQ ID NO: 10270 - DNA, 1101 bp, Artificial Sequence
  Description of Artificial Sequence: Synthetic coding sequence
atgatacggaactggcttactatattcattctatttcctctcaagctggtggaaaaatgtgaaagtagtgtctcccttacagtccctcccgttgtgaaactcgaaaacgggtcctccacaaacgtctccctgacgctaagaccaccactgaacgccactctagtgataactttcgaaatcactttccggtcgaaaaacatcactatcctcgagctgcccgacgaagtggtggtcccacctggggttactaatagttctttccaggtgacaagtcagaatgttggacaacttacagtgtatctccatggaaatcatagtaatcagacagggccaagaattcgcttccttgtgatacggtcatcagcaatatctataataaaccaggtgatagggtggatatattttgtggcttggagtatctctttttatccacaggttatcatgaactggcgcaggaaatcagtgatcgggctgtcctttgatttcgtggcccttaacctgacaggattcgtcgcttatagtgtttttaatattggacttctatgggtgccttatataaaagaacagttcctccttaaatatccaaacggggtaaaccctgttaactcaaatgatgtctttttctcgctccacgccgtagtgttaacactcatcataatcgtgcagtgctgtttgtacgaacggggaggacagcgggtaagttggcccgcaatagggtttcttgtgctggcgtggctgttcgccttcgtaactatgatagtcgccgccgtaggggtcactacttggctccagttcttattctgtttctcttacatcaaacttgccgttacacttgtgaaatatttcccccaagcctatatgaacttctactacaaatccactgaagggtggagtataggaaacgtgctcctggactttacaggggggtctttttccttactccagatgtttctccagtcctataacaatgatcagtggacactgatatttggagatcccacaaaatttggactgggggttttcagtattgtgttcgatgtggtttttttcatccagcatttttgcttataccgcaaaagacctggatatgatcagttaaat

SEQ ID NO: 10271 - DNA, 1101 bp, Artificial Sequence
  Description of Artificial Sequence: Synthetic coding sequence
atgatccgcaactggcttactattttcatcctttttccgcttaagctggtggaaaagtgtgaatcctctgtaagcctcacagtacctcccgttgtgaagctggaaaatggctcttctaccaatgtatctctcactctcagacctcccctgaacgcaaccctggtgataacctttgagatcacttttaggagcaagaatataaccattctcgaactgcccgacgaggtggtcgtaccacccggcgtgactaactcttctttccaggtgacttctcaaaacgtgggtcagctcacagtttacctccacggaaaccacagcaatcagaccggcccgcgcatccgcttcctggtcattagatctagtgccatctctatcattaatcaggtgatcggctggatctattttgtggcttggagtatcagtttttacccacaagtgataatgaactggaggagaaagtcagtcatcggactctctttcgatttcgtagcactgaacctcacaggattcgtcgcctacagcgtgttcaacattggcctgctgtgggtgccatatatcaaggaacagttcctcctgaaataccccaacggtgtcaacccagtgaactccaacgatgtgttcttttcacttcatgccgtcgtcctcacattgattatcattgtgcagtgctgtctgtatgaacgcggcggccagagagtcagctggccagcgataggcttcctcgtcttggcttggctctttgctttcgtgaccatgatcgtagcggccgttggagtcactacctggctgcagttcctgttctgtttcagctatatcaagcttgctgtcactctcgtaaaatacttcccccaagcctacatgaacttttattacaagagcacagagggctggagcataggaaatgtgctcctggattttactggaggatctttcagtcttctccagatgttcctgcagtcttacaacaacgaccagtggaccttgatcttcggtgatcccacaaagtttggtctcggagtattctctattgtgtttgatgtggttttttttatccagcacttctgcctttacagaaagaggcctggatacgaccaattgaac

SEQ ID NO: 10272 - DNA, 1101 bp, Artificial Sequence
  Description of Artificial Sequence: Synthetic coding sequence
atgattcgaaactggctgacgattttcattctgtttccacttaagctcgtggagaaatgtgagtcctcagtgagcctcaccgtcccgcctgtggtcaagttggagaacgggtcctcaaccaacgtgtccctgactctcagaccgcctttgaatgcaacgctcgtcatcacttttgaaataaccttccgctccaaaaacataaccatattggaacttccagacgaagtcgtggtgcccccaggggtgaccaatagttcattccaagtgaccagccagaatgtgggtcaactgacggtctacttgcacggaaatcatagcaaccaaaccggaccccggattagatttctggtcatacgctcgtccgcaattagcatcatcaatcaagtgattggttggatctattttgtggcctggagcatatcattctatccacaagtcattatgaactggagacgcaagtccgtgataggtcttagcttcgatttcgtcgcccttaacctgactggttttgtggcctactcggtgtttaacattggactcctttgggtgccatacattaaggaacagttcctgctgaaataccctaacggagtcaacccggtcaactcaaatgatgtgttcttctctcttcatgcggtggtgctcaccctgattatcattgttcagtgctgtctttatgaacgtggaggacaaagagtgtcctggccagcaatcggatttctcgtcctggcatggctctttgcatttgtgaccatgattgtggcagccgtcggagtgactacgtggctccaatttctgttttgtttttcgtacataaagctggcggtgactctggtgaagtattttcctcaagcatacatgaacttttactacaaatccactgaaggctggtcgataggtaatgtccttctggatttcactggaggtagcttttcgctcttgcagatgtttttgcagtcctacaataacgaccagtggacccttatcttcggcgaccccactaagttcgggctgggggtcttttccatagtctttgatgttgtgttctttattcagcacttttgcctgtaccgcaagcgcccgggctatgatcaactgaac

SEQ ID NO: 10273 - DNA, 1101 bp, Artificial Sequence
  Description of Artificial Sequence: Synthetic coding sequence
atgatccgcaactggctgaccatcttcatccttttcccactcaagctggtggaaaagtgtgaatcgtcagtgtccctgaccgtgccgccggtggttaagctggaaaacgggtccagcaccaacgtgtcactgacgctcagaccgccgctgaacgcaaccctggtgatcaccttcgagatcacctttcggtccaagaacatcacgattcttgaactgccagacgaagtggtcgtgccgccgggtgtcacgaacagctcgtttcaggtcacttcgcagaatgtgggacagctcactgtgtacctgcacgggaaccactcgaatcagactgggccgagaattcggttcctcgtgattcgatcgtccgctatctccatcatcaatcaagtgatcgggtggatctacttcgtggcttggagcatctcattctaccctcaggtgatcatgaactggcggcggaagagcgttatcggcttgtcattcgatttcgtggcccttaatctcactggcttcgtcgcatactccgtgtttaacatcggactcctgtgggtgccatacatcaaggagcaattcctcctcaaatatccaaacggtgtgaatccagtgaactcaaatgacgtgttcttctccctgcatgccgtggtcctcacgctcatcattatagtccaatgttgtctgtacgagagaggcggacaacgggtgtcctggccggccatcggattcctcgtgctcgcctggttgttcgcgtttgtcaccatgatcgtggcggctgtcggcgtcaccacttggcttcagttcctgttctgctttagctacatcaagttggcggtgactctggtcaaatacttcccgcaggcttacatgaacttttactacaaatctacggaaggatggagcattggaaacgtgcttctggacttcaccggggggagcttctcactgctccaaatgttccttcagagttacaacaatgaccaatggactctgattttcggagatccaaccaagttcggtctgggagtgttctccatcgtgtttgatgtggtgtttttcattcaacatttctgcttgtacaggaagcgcccagggtacgaccaactgaac

SEQ ID NO: 10274 - DNA, 1101 bp, Artificial Sequence
  Description of Artificial Sequence: Synthetic coding sequence
atgattcgaaattggctgaccattttcatactgtttcctctcaaacttgtggaaaagtgtgaatcaagcgtgagcctgactgtgccccctgtggtcaaacttgaaaacggctcgagcactaacgtgtcattgactcttaggccgcctctgaacgcaaccctcgtgattacttttgagattactttccggtccaaaaacattaccatccttgagttgcctgacgaagtggtcgtgccacccggagtcaccaactcctcgtttcaagtgaccagccagaatgttggtcaactgaccgtgtaccttcacggtaaccattccaaccaaactgggcctaggataagatttctggtcatcaggtcatcggcgatatccattatcaaccaagtgatcggatggatttacttcgtggcatggagtatcagcttttacccccaggtgatcatgaattggaggcggaaatcggtgataggcctttcatttgattttgtggcactgaacctcacgggcttcgtcgcctatagcgtgttcaatattgggctgctttgggtgccatacattaaggaacagtttcttttgaagtaccctaacggagtcaacccagtcaacagcaatgatgtgttcttttcattgcacgctgtcgtgctcaccctcatcataattgtccaatgttgcctgtacgaacgtggtgggcaacgcgtgtcatggcctgccatcggctttctcgtgctggcatggctttttgcatttgtgaccatgattgtggccgccgtcggtgtcactacttggctgcaattcctgttctgctttagctacattaaacttgcagtcaccctggtgaaatacttcccacaggcctacatgaacttttactacaagtcaactgagggctggagcataggaaacgtgcttctggatttcaccggaggctccttttcccttttgcagatgttcctccaatcatacaataatgatcagtggaccctgatctttggggaccctactaaattcggtctgggtgtgtttagcattgtctttgatgtggtgtttttcatacagcacttctgtctgtacagaaagcgcccgggctacgatcagctgaac

SEQ ID NO: 10275 - DNA, 1101 bp, Artificial Sequence
  Description of Artificial Sequence: Synthetic coding sequence
atgattcggaattggctgaccatcttcatactttttcctctgaagctcgtggagaagtgcgagtcgtctgtttccctgactgttcccccggtggttaaacttgagaacggaagtagtacaaacgtctccttaacactcagaccaccactcaacgcaactctggtgatcaccttcgagatcactttcaggtctaagaatatcaccatcctggaactgcctgatgaggtggtggtgccccctggcgtgactaatagctcatttcaggtgacctcgcagaatgtgggccagctgacagtttacctccacggcaaccactcaaatcagacaggcccccgaatcaggttccttgtgatccggtcttccgcaatttcaattataaatcaagtaattggctggatctactttgtggcctggtccattagtttttacccgcaggtcattatgaattggcggagaaaaagcgtaatcggcctgtccttcgactttgttgcgttaaacttgactggattcgtggcctacagtgtgtttaatataggccttctgtgggttccttacatcaaggaacagtttctcctgaaatacccgaatggagtgaaccccgtcaatagtaatgacgtgttcttctcattgcacgccgtggtgttaacactaatcattatcgtgcagtgctgcttgtacgagaggggcggacagagggtgtcttggcccgccataggattcctagtgctcgcttggttgtttgccttcgtcactatgatcgtggcggccgtgggcgtgaccacatggcttcagttcctgttctgttttagctacattaaactggcagtcaccctcgttaagtattttccgcaggcttatatgaacttctactataagagcacagaaggctggagtataggtaatgttctcttagattttactggtggatcatttagtctgctgcagatgtttttgcagtcatataataacgaccagtggactctgatatttggggatcctacgaaattcggactaggggtgtttagcatcgtgttcgatgtggtcttttttatccagcacttttgtttgtaccgcaagcgcccgggatatgatcagcttaac

SEQ ID NO: 10276 - DNA, 1101 bp, Artificial Sequence
  Description of Artificial Sequence: Synthetic coding sequence
atgatacgcaactggctgactatcttcatcctcttcccgctgaagctggtggaaaagtgcgagagcagcgtgtcgttgactgtgccgccggtcgtgaagttggaaaatggatcgtccaccaacgtgtctctgaccttgcgccccccactcaatgcaacccttgtcattacctttgagatcactttccggtccaagaacatcactatcctggaactgccggacgaggtggtggtgccaccgggcgtgaccaatagttcattccaggtcacttcacagaacgttggacaactcactgtgtaccttcacggaaaccattcaaaccaaaccggaccacgaatcagattcctcgttatccggtcgtccgccatcagcatcatcaaccaagtgatcgggtggatctacttcgtggcctggtcgatctccttctatcctcaggtcatcatgaactggagaagaaaatccgtgattggactctcgttcgatttcgtcgccctgaatctgactggattcgtcgcgtactcagtattcaacatcggcctgctctgggtgccgtacattaaggaacaattcttgcttaaataccctaacggcgtgaatcccgtgaattcaaatgacgtgttctttagcctgcatgctgttgtcctgacgctgatcatcattgtgcagtgctgcctgtacgaacgcggtggacaacgggtgtcctggcccgcgattggcttcctggtgctcgcatggctcttcgcatttgtgaccatgatcgtggccgccgtcggggtcacgacctggctgcagttcctgttttgcttctcctatatcaagctcgcggtcaccctcgtcaagtactttccgcaggcttacatgaacttctactacaagagcactgagggatggtcgatcggtaacgtgctgctcgactttaccgggggatccttctcgctgttgcagatgtttcttcagtcgtacaacaatgaccagtggactctgatcttcggagatcctaccaaattcggactgggcgtgtttagcatcgtgtttgatgtcgtgttcttcattcagcacttctgtctgtacaggaaacgcccaggttacgaccaactcaac

SEQ ID NO: 10277 - DNA, 1101 bp, Artificial Sequence
  Description of Artificial Sequence: Synthetic coding sequence
atgatccggaattggctcaccatatttatactgttccctttgaagttggtcgagaagtgcgaatctagtgtcagcctgacagtaccgccagtggttaaattggagaatggcagttccacaaacgtgtctctgactctaaggccaccactgaatgccaccctggtaatcactttcgagatcacattccgaagcaaaaacatcactatccttgagcttcctgacgaggttgtagtgccacctggagtgaccaactcgtcttttcaggtaaccagtcagaacgtcggtcagctcacggtctatctgcacgggaaccactccaatcaaacgggaccccgtattcgctttctagtcattcggtcctccgcgatttccattataaaccaggtgattgggtggatttatttcgtagcatggagcatcagcttctacccacaagtgatcatgaattggcgcagaaaaagcgtaatcgggcttagcttcgatttcgtcgctctgaacctgacaggcttcgtcgcctactctgtcttcaatatcgggttgctctgggttccatatatcaaggaacagttcctgctgaagtaccccaacggcgtcaatcctgtgaattcgaatgatgtgttcttcagcctccacgcagtagttcttaccctgattatcatcgttcagtgctgcctctatgagaggggggggcagcgagtgtcatggccagcaatcggattcttagttttggcctggctattcgcgtttgtcacaatgattgtcgcagccgtgggtgttacaacatggctgcagtttctgttctgttttagctatattaaactggctgtcacattggtgaagtatttcccacaggcctacatgaacttctactacaagagcactgagggctggtcaatcggcaacgtattgctagatttcactggcggatctttctctctgctgcagatgttcctgcagtcatacaataatgaccagtggacactgatcttcggagatcccacaaagttcgggttaggtgtgttcagtatcgtgttcgatgtcgtgttctttatccaacacttctgtctttacagaaagcggcctggctatgaccaactaaat

SEQ ID NO: 10278 - DNA, 1101 bp, Artificial Sequence
  Description of Artificial Sequence: Synthetic coding sequence
atgatacgtaattggctaacgatatttatactatttccgctaaaactagtagaaaaatgtgaatcgtcggtttcgctaacggtaccgccggttgtaaaattagaaaatggttcgtcgacgaatgtatcgttaacgttacgaccgccgttaaatgcgacgctagttataacgtttgaaataacgtttcgttcgaaaaatataacgatattagaactaccggatgaagtagttgtaccgccgggtgtaacgaattcgtcgtttcaagttacgtcgcaaaatgttggtcaattaacggtatatttacatggtaatcattcgaatcaaacgggtccgcgaatacgttttctagtaatacgatcgtcggcgatatcgataataaatcaagttataggttggatatattttgttgcgtggtcgatatcgttttatccgcaagtaataatgaattggcgtcgaaaatcggttataggtctatcgtttgattttgttgcgctaaatctaacgggttttgttgcgtattcggtatttaatataggtttactatgggttccgtatataaaagaacaatttttattaaaatatccgaatggtgtaaatccggtaaattcgaatgatgtttttttttcgctacatgcggttgtattaacgctaataataatagtacaatgttgtttatatgaacgaggtggtcaacgtgtatcgtggccggcgataggttttctagtattagcgtggctatttgcgtttgtaacgatgatagttgcggcggtaggtgtaacgacgtggctacaatttctattttgtttttcgtatataaaactagcggttacgctagttaaatattttccgcaagcgtatatgaatttttattataaatcgacggaaggttggtcgataggtaatgtattactagattttacgggtggttcgttttcgttactacaaatgtttctacaatcgtataataatgatcaatggacgttaatatttggtgatccgacgaaatttggtttaggtgtattttcgatagtatttgatgtagtattttttatacaacatttttgtttatatcgtaaacgtccgggttatgatcaattaaat

SEQ ID NO: 10279 - DNA, 1101 bp, Artificial Sequence
  Description of Artificial Sequence: Synthetic coding sequence
atgatccgaaactggctaacaattttcattctttttccactgaagctagtcgagaaatgcgagagctccgtatctctgacggtaccaccagtggttaaacttgagaacgggagtagcactaatgtgagccttaccctgcgccctcctctgaatgccacccttgtgatcacattcgaaataacatttagatccaagaatatcaccatcttggagctgcccgatgaagtggttgtcccacctggagtcaccaacagcagttttcaagtcacctctcagaacgtcgggcaattgacagtctacttgcacgggaaccattcaaaccagactggcccacgcatccggttcctcgtcatccggtcgagcgcaatttctattatcaaccaagttatagggtggatctatttcgttgcctggtctattagtttttaccctcaggtgataatgaattggcgccgtaagtcggtgattggcctgagctttgatttcgtggctcttaatctgacaggattcgtcgcttactccgtttttaatatcggactcttgtgggtcccttacattaaggagcagttcttactcaaatatcccaatggagtaaatcccgtgaacagcaacgatgtgttcttcagcctgcacgccgtggtgctcaccctgatcattattgttcaatgctgtctgtatgaaaggggaggacagagagtctcttggcccgcgatcggcttcctggtgctggcctggctgtttgcctttgttaccatgattgtggctgcggtgggcgtaaccacctggctccaatttctgttttgcttttcctatatcaaactcgccgtaaccctggtgaaatacttccctcaggcgtatatgaacttttactataaatccactgagggctggagcatcggcaacgtgctgctggatttcaccggcggatccttctcgctgctccaaatgtttttacagtcatataacaatgaccagtggacactgatattcggcgaccccacaaagtttggattgggtgtcttcagcattgtgttcgatgtggtgtttttcatccagcatttttgtctttatagaaagagaccaggctatgatcagttgaac

SEQ ID NO: 10280 - DNA, 1101 bp, Artificial Sequence
  Description of Artificial Sequence: Synthetic coding sequence
atgatccggaattggctcacaatctttatcctttttccccttaagctggtcgagaagtgtgagtcctcggtttcgctaaccgtgccacctgtggtgaagctcgagaatggcagctccacaaatgtgtccctcactttgcggccccctttgaacgccactctggtgatcacctttgaaatcacctttcgctctaagaatattacaatcttggaactccccgacgaagtcgtagtgcctccaggtgtaaccaactccagctttcaggtgacatcccaaaatgtgggtcagctgactgtgtaccttcacggcaaccactcaaaccagactggcccacgaattcgcttcttagtgatccgatcctcggctatttcgattattaatcaggtgatcggctggatctacttcgtggcttggagtatcagcttctacccccaggttattatgaattggagacggaaatccgttatcggcctgagcttcgacttcgtggctttgaacttaaccgggttcgtggcctattccgtgttcaatattgggctgttgtgggttccctatatcaaagagcagttcctgctaaaataccccaacggcgttaaccctgttaatagcaacgatgtttttttcagtctgcatgcggttgtgctcaccctgatcataattgtccagtgctgcttgtatgagagaggcggacagagggtatcttggcccgcaataggatttctggttctagcttggcttttcgcattcgtgacgatgatagtcgcagccgttggggtgacaacatggttacagttcctattttgtttttcgtatattaagctcgccgtcacactggtcaagtatttcccccaggcctacatgaacttctactataaatctacagagggctggtccatcggaaacgtcttgcttgatttcacaggaggctctttctccctattacagatgttcctccagtcgtataataacgaccagtggacgttgatctttggcgatccaacaaagtttgggttaggcgtgtttagcatcgtctttgacgtggtcttttttatccagcatttttgcctttacaggaagagaccgggctacgatcagctgaat

SEQ ID NO: 10281 - DNA, 1101 bp, Artificial Sequence
  Description of Artificial Sequence: Synthetic coding sequence
atgatccggaattggctgactattttcatcctgttcccactaaaactcgtcgagaagtgcgagtcttccgtatcgctgaccgttccgccagtcgtgaagctcgagaatggctcttctactaatgtctcgctgactcttaggccccctcttaatgctacccttgtcataacatttgagatcacctttaggtcaaaaaacattaccatccttgagctgccggatgaggtcgtggtaccacctggagtgacgaatagcagctttcaggtgacatctcagaatgtgggccagctgacggtgtatctgcacggtaatcacagtaatcagacaggcccacggatcagatttctagtgatccggagttcagccatatccatcattaatcaggttatcggctggatctattttgtcgcatggagcatctctttctacccccaggtcatcatgaactggaggcgaaagtccgtcatcggactatcctttgattttgtggccctaaacctaactggctttgtagcttattccgtctttaatattggtctcctttgggtgccctacatcaaagagcaatttttgctgaaataccccaacggcgtgaatccggtgaactctaatgacgtttttttttctctccacgccgtggtgctgaccctaatcattatcgtgcaatgttgcttatatgagaggggcgggcagagagtatcatggcctgcaataggattccttgtgcttgcgtggctattcgcgttcgtaaccatgattgtcgctgccgtgggggtgactacctggctgcagttcctgttctgcttcagctatataaaactcgcagtgacactagtgaaatatttcccgcaggcgtatatgaatttttactataaaagcaccgaggggtggagcatcggcaacgttctgcttgacttcacaggtggatccttctccctgctgcagatgtttctccagtcttacaataatgatcagtggacgttgatttttggagatccgaccaaatttggtctgggcgtatttagcattgtctttgatgttgttttctttatccagcacttctgtctctacaggaagcggcccgggtacgaccagctgaat

SEQ ID NO: 10282 - DNA, 1101 bp, Artificial Sequence
  Description of Artificial Sequence: Synthetic coding sequence
atgatcagaaactggctaaccatctttatcctgttccccctgaaactcgtggagaagtgcgagtcttccgtctctctcacggtgcctcctgtggtcaaactggagaacgggagtagcactaatgtctcattaactctccggccccctctgaatgccactctggtgatcaccttcgagataacgttccgcagtaagaacatcactatcctggagcttccagacgaagtggttgtgccaccgggcgtaaccaactcctctttccaggtgaccagccagaatgttggacagctgaccgtctatctgcacggcaaccatagcaaccagaccggtcccaggatcagattcctggtaatccggagctcagcaatttccatcatcaatcaggtgatagggtggatttattttgtcgcctggtccatctccttctacccacaggtaatcatgaattggcgccggaaatccgttatcggtttgtcattcgatttcgttgctttgaacctcaccgggtttgtggcctatagcgtgttcaacattgggttgctgtgggtcccttacataaaggaacagtttctgctcaaatatccgaacggagtgaaccctgtcaactcaaatgatgtgttcttttctctccacgcagtggtcctgactcttatcatcatcgtccagtgttgtctttacgaacgaggtgggcaacgcgtttcttggccagctatagggttcctcgtgcttgcctggcttttcgccttcgtgacaatgattgtggctgctgtcggtgtgacaacatggctgcagttcttattctgcttcagttacattaaactggctgtgacgctggtgaagtacttcccccaggcttacatgaacttttattataaaagtactgaggggtggtccataggcaacgttctcctggattttaccggtggcagtttctctctgctgcagatgttcctgcagagttacaataatgaccagtggacactgatctttggggaccccacaaagtttgggttgggggtgttctcgatcgtgttcgatgtcgtgtttttcattcaacatttttgtctgtacaggaaacgtccagggtatgatcaattgaac

SEQ ID NO: 10283 - DNA, 1101 bp, Artificial Sequence; identical to SEQ ID NO: 10267
  Description of Artificial Sequence: Synthetic coding sequence

SEQ ID NO: 10284 - DNA, 1101 bp, Artificial Sequence
  Description of Artificial Sequence: Synthetic coding sequence
atgattcggaactggctgaccatcttcattctgtttcctcttaaacttgttgagaagtgtgaatcatcggtgtccctgacggtccccccagtcgtgaagctggaaaacggttcaagcactaacgtgagcctcacccttcgacctccactgaatgccaccctggtgatcacttttgaaatcacctttcgcagcaagaacattactattcttgagctccccgatgaagtggtggtcccccctggagtgactaattcgtccttccaggtgacgagccaaaatgtgggtcagctgactgtgtacctccacggaaaccattcgaatcaaacgggacctcggattcgattcctggtcattagatcgtccgcaatttcgattatcaaccaagtgattggctggatatactttgtggcatggtctattagcttttacccccaggtgataatgaactggcgccgcaagagcgtgattgggctgtcctttgattttgtggcactcaacctcactggcttcgtcgcctattccgtgtttaacatcggactgctgtgggttccgtacattaaagagcagtttctcttgaaatatcctaacggtgtgaacccagtcaatagcaatgatgtgtttttctcgcttcacgccgtggtgctcaccctgataatcatcgtgcaatgttgtctgtacgagcgaggcggacaaagagtatcctggcctgccataggatttttggtcctggcatggcttttcgccttcgtcactatgattgtggcagcagtgggggtgaccacttggctccaatttctcttttgttttagctacattaagttggcagtgaccctggtgaaatactttcctcaagcatacatgaacttttactacaaatcgaccgaaggatggtcgatcgggaacgtgcttcttgattttaccggtggatcgttttccctgctccaaatgttcctgcaatcctacaataacgaccagtggactctcatttttggcgaccctacgaagttcggacttggagtcttttccattgtgtttgacgtggtctttttcattcaacatttctgcctgtataggaaacgtccagggtatgatcaactgaac

SEQ ID NO: 10285 - DNA, 1101 bp, Artificial Sequence
  Description of Artificial Sequence: Synthetic coding sequence
atgatacgcaactggttgacgatttttattctgttccctcttaagctggtagagaagtgtgaatcaagcgtgtctcttacagtcccgcccgtggtgaagttggaaaacggaagtagcacaaatgtgtcactgactctgaggcctccgctcaacgccacactcgtgattacattcgaaatcacatttaggtccaagaatatcacgatcctcgaactgccagatgaagtggtcgtgccccccggcgtgaccaacagttctttccaggtgaccagccaaaacgttgggcagttgaccgtgtatctgcacggcaaccacagcaatcagacaggcccgaggatcaggttccttgtaatcaggagttcagcaatctcaataataaatcaagtcatcggctggatctacttcgtggcttggagcataagtttctatccccaagtcattatgaattggcgccgcaagtccgtgatcggattgtctttcgacttcgtcgccctcaacctaaccgggttcgtcgcatattctgtttttaacatcggcctgctgtgggtcccctatatcaaggaacaatttctactgaagtaccccaacggtgtgaaccctgtgaattcaaacgacgttttcttttctcttcacgccgtggtgctgacccttatcatcatcgtccagtgctgtctgtacgaaagaggcgggcagcgagttagctggccagcaatcggtttcttggtgcttgcttggctttttgcatttgtgaccatgattgtggcagccgtgggagtgactacctggttacaatttctgttctgctttagttacatcaaacttgctgtcacacttgtgaagtacttcccgcaggcatatatgaacttctactataagagtacagaagggtggagcattggcaatgtgctgttggattttaccggcggcagctttagcctgttgcaaatgtttctccagagctataacaacgaccaatggaccttgatctttggagatccaaccaagtttggtctgggagtcttctcaattgtgtttgacgtggtttttttcatccaacacttttgtctgtacaggaagaggccagggtacgaccaactgaat

SEQ ID NO: 10286 - DNA, 1101 bp, Artificial Sequence
  Description of Artificial Sequence: Synthetic coding sequence
atgatcaggaattggctgaccattttcatacttttccctctgaaactcgtggaaaagtgtgagagctctgtgtcactgacggtgccaccagtggttaagctggagaacgggagctctacgaacgtgagccttaccctgaggcctccgctgaatgccacacttgtgataacattcgaaatcacttttcgaagcaagaacattacaatcctggagcttcctgatgaagtggtggtcccccccggggtaacaaactcatcctttcaagttaccagccagaacgttggacagctgactgtatacctgcacggaaaccattcaaatcaaactgggccgcgaatcagattcttggtgattagaagtagtgcaatcagtatcatcaatcaggtgatcgggtggatatacttcgtggcttggagcatttccttctatcctcaggtcatcatgaactggaggcgaaaaagcgtgattggactgtctttcgactttgtggcacttaatctgaccgggtttgtcgcatattccgtcttcaacattggactgctgtgggtcccgtatatcaaagagcagtttctgctcaagtacccaaacggtgtcaatccagtaaacagcaatgacgtctttttctctttgcacgctgtggtgcttacgcttataatcattgtgcagtgctgcctctatgaacggggcggtcagagggtttcctggcccgcaatcggctttctcgtactcgcctggttgttcgcgttcgttacaatgatcgtcgccgcagtgggcgtgactacctggctgcaatttctgttttgcttctcctacattaaactggcggtgaccctggtgaaatactttccccaggcctacatgaacttttactataagtccacggaggggtggagtattggcaatgtcttgctggatttcacagggggcagtttttccctgctccaaatgtttctgcagagctacaacaatgaccaatggaccttgatcttcggcgatccgaccaaattcgggcttggcgttttctctattgtttttgacgtggttttttttatccagcatttctgtttgtacagaaaaagacccggctacgatcagctgaac

SEQ ID NO: 10287 - DNA, 1101 bp, Artificial Sequence
  Description of Artificial Sequence: Synthetic coding sequence
atgatccgaaattggctgaccatctttatcctgttcccgttgaagctggtggaaaaatgcgagagctcggtatcgctgactgtgccgccggtggtcaagctcgagaacgggtccagcaccaacgtctccttgaccctgcgcccaccgttgaatgccactctggtcattactttcgagatcactttccggtccaagaacatcaccattctggagctcccggatgaagttgtggtccctcctggggtgaccaattcctccttccaagttaccagccagaacgtgggacaactcaccgtgtacctgcacgggaaccacagcaatcaaaccggaccccgcatcaggttcctcgtgatccgcagctcggcgatcagcatcattaatcaggtgattggatggatctactttgtggcttggtcgatttcgttctacccacaggtgatcatgaactggagaagaaagtccgtgatcggattgagtttcgacttcgtcgccctgaatctgaccggattcgtggcgtactcggtgttcaacatcggcctcctgtgggtgccgtacatcaaggagcagttcctgctgaaatacccaaacggagtgaatccggtgaactccaatgatgtgtttttctcgctgcacgcagtggtcctgactttgatcatcatcgttcagtgctgcctgtacgaacgcggcggacagcgggtgtcttggccggccatcggattcctggtcctggcctggctcttcgcattcgtcaccatgatcgtcgccgcagtcggagtcaccacctggctccagtttctgttctgcttttcctacatcaagttggccgtgaccctggtcaagtacttcccgcaggcgtacatgaatttctactacaagtccactgaaggatggtcgataggtaacgtgctgctggacttcaccggcggctcgttctcacttctgcagatgttcttgcaatcgtacaacaatgaccagtggactctgatctttggcgaccctactaagttcggactgggcgtgttttccattgtgtttgatgtggtgtttttcatccaacacttctgcctctacaggaaaagaccagggtacgaccagctcaac

SEQ ID NO: 10288 - DNA, 1101 bp, Artificial Sequence
  Description of Artificial Sequence: Synthetic coding sequence
atgatccggaactggctcaccatattcatcctctttccgttgaaacttgtcgaaaaatgcgaatcatcggtgtcgctcacggttccacctgtggtcaagctggagaatggttcgtcaaccaatgtgtcattgacccttcgtccacctctgaatgcaaccctggtgatcacttttgaaattacctttcggtccaagaacattaccatcctggaacttcccgacgaggtggtcgtccctccaggtgtcaccaattcgtcttttcaggtcacctcccagaacgttggccaacttaccgtgtacctgcatgggaaccattcgaaccaaactggacctcgaattagattccttgtgattcgctcgtcagccatctcgatcattaaccaggtcattgggtggatatactttgtggcatggtcgatttcattttaccctcaagtgattatgaactggcggagaaagagcgtgatcggtctgtccttcgatttcgtggcccttaaccttaccggatttgtcgcctattccgtgtttaacattggccttttgtgggtgccttacataaaggaacaattcctgctgaaatacccgaatggagtcaatccggtgaattccaatgatgtgttcttttcgctccacgccgttgtgctgaccctgataatcattgtgcaatgctgtttgtacgagcgaggaggacaaagagtgagctggcctgctataggattccttgtactggcctggttgtttgcatttgtcaccatgattgtcgctgcagtgggcgtgactacttggcttcaatttctgttttgcttttcgtacatcaagctcgcagtgaccttggtcaagtactttccacaggcctacatgaacttctactacaaatcgactgaaggatggtcaattgggaacgtgctgctggactttaccggagggtcattctcattgttgcaaatgtttctgcagtcctacaacaacgatcaatggaccctcatttttggcgatcctactaagtttggactgggagtgtttagcatagtgtttgacgtggtgttctttattcagcacttctgcctttacagaaagaggcccgggtacgaccagctgaat

SEQ ID NO: 10289 - DNA, 1101 bp, Artificial Sequence
  Description of Artificial Sequence: Synthetic coding sequence
atgattagaaactggctcaccatcttcatcctgttccctctgaagctcgtagaaaaatgcgagtcaagcgtcagtctgactgtgccgccggtcgtcaagctcgaaaatgggtcaagcactaatgtctcgctgactctccggcccccacttaacgccacccttgtcatcacgttcgaaatcaccttccgcagcaagaacattaccatcctggaacttcctgatgaggttgtggtcccaccgggagtgactaatagcagctttcaggtcacgtcgcagaatgtcggccagcttaccgtgtatctccacggtaatcactcgaaccagactggaccgcgcatccgattcctggtgattaggtcgtcagccatctccatcatcaatcaagtcatcggatggatctactttgtggcatggtccatctcgttttacccacaagtcatcatgaactggcgccgcaagtcggtgataggcttgagttttgacttcgtggccctgaacctcactggcttcgtggcgtactcagttttcaacatcggattgctgtgggtgccttacattaaagaacaattcctcctgaagtacccaaacggagtgaacccggtgaacagcaacgacgtattcttttctctgcatgctgtagtcctcaccctgattatcatcgtgcagtgctgtctgtacgagaggggagggcaaagagtttcttggcctgctatcggattccttgtgctcgcctggctgttcgcgtttgtgaccatgatcgtggcggctgttggcgtgacgacttggctgcagtttttgttttgcttctcgtacatcaagctcgccgtgaccctcgtgaagtacttcccgcaggcatacatgaatttctactacaagtcaaccgagggttggtccatcggcaatgtactgctcgatttcactgggggatccttttcactgctgcagatgttcctgcaatcgtacaacaatgaccagtggaccctgattttcggcgatccgactaaattcggacttggtgtgttttccattgtgtttgacgtggtgttcttcatccaacatttctgcctgtaccggaaacggcccggatatgaccagctgaac

SEQ ID NO: 10290 - DNA, 1101 bp, Artificial Sequence
  Description of Artificial Sequence: Synthetic coding sequence
atgatccgaaattggttaacgatctttattctcttcccattgaagttagtggaaaaatgtgagtcaagcgtatctctgactgtgcctccagttgtcaaattggaaaatggtagctctactaatgtttctttgacattgcgtccgccattgaacgcaactctggtgatcacctttgaaataacctttcgtagtaagaatataaccatactcgagcttccagatgaggttgtggttccccccggggttacaaattcgtcatttcaggtcacaagccagaacgtcggtcaacttacagtctacctgcacgggaatcattccaaccagaccggccccaggattcgttttttggttattcggtcatccgctataagtataataaaccaggttattgggtggatttattttgtagcctggtcgatttcattttaccctcaagtcattatgaattggcgtcgaaagtccgtaatcgggcttagcttcgattttgttgcgctcaacttgactggttttgttgcttatagcgtttttaatatcggattgttatgggtaccttacattaaagagcagttcctccttaaataccctaatggggttaaccctgtgaactctaacgatgttttttttagcctccacgcagtggtgttgacccttattattattgtccagtgttgtctttatgagaggggtggccagcgggtgagctggcctgctattgggttccttgttttggcttggttgttcgccttcgttacaatgatagtcgccgcagttggagttactacttggttgcaatttctgttttgtttttcctatatcaagttagctgtgactttggttaagtacttcccacaggcatacatgaatttctattacaaatctacagagggttggtcaatcggaaatgttcttttagatttcacggggggctcgttttcattgttgcagatgttcctccaatcatataacaatgaccagtggacacttatctttggtgatcctacgaagtttggattaggggtgtttagtatcgtgtttgacgttgtgttcttcattcagcacttctgcttgtataggaaacgtcctgggtacgaccagcttaat

SEQ ID NO: 10291 - DNA, 1101 bp, Artificial Sequence
  Description of Artificial Sequence: Synthetic coding sequence
atgatacgaaattggctgactatctttatcttgtttccactgaagttggtcgagaagtgcgaaagcagcgtctcactcacggtcccccccgtggtaaaattggagaatgggagtagtactaatgtctcattaaccctccggccgcctctgaacgcaactctcgtaataacattcgagattacctttcgctccaagaatattacgatcttagagctgcccgatgaggtggttgtccctcctggcgttaccaattcctcctttcaggtcacttcccagaacgttggtcagctgactgtgtacctgcacgggaatcactctaatcagaccgggcccaggatcaggttcctagtcatacgtagctctgccatttctatcattaaccaggtgatcggctggatctatttcgttgcatggtccatctccttttacccccaggtaatcatgaattggcgacggaaaagcgtaattggtttgtccttcgatttcgtggccctcaacttgacaggctttgtggcttactccgtctttaacattgggctgctttgggtcccctacataaaagagcagttcctgttgaagtacccgaatggggtaaaccctgtgaattccaatgatgttttttttagcttgcatgcagtggtgttaactttaatcattatcgttcaatgttgtctctacgagaggggcggccagcgagtatcatggccagcgatcggatttcttgtcctagcctggcttttcgcttttgtgactatgattgtggcagctgtgggcgtgactacctggcttcagttcctgttctgcttttcatatatcaaactcgcagtcacgttggtgaaatactttccacaagcctacatgaacttctactacaaaagtacagaggggtggagcattggaaatgtgctgctggacttcacaggtggaagctttagtttactgcagatgttcctgcagtcttataataacgatcagtggactctgatcttcggagaccccaccaagtttgggttgggagtgttttcaatagtgttcgacgtcgtgtttttcatccagcacttctgcctgtatcgaaagcgccccggctatgaccagcttaat

SEQ ID NO: 10292 - DNA, 1101 bp, Artificial Sequence
  Description of Artificial Sequence: Synthetic coding sequence
atgatacgcaattggctgaccatcttcatcctctttccactcaagttagtggagaaatgtgagagcagtgtaagcctgacagtgccccccgtggtgaagttagagaatggctccagcaccaatgtctctttaaccctccgcccaccactcaatgcaacgcttgtgattacatttgagattacattcagatccaaaaacatcaccatcttggaactgccagacgaggtagtggtccctccaggcgtcaccaattcgtcattccaggtcacgagccagaacgtcggacagctcactgtatacctgcatggaaaccatagtaatcagacaggacctaggatccggtttcttgtgatcagatcgagcgctatttcaattattaaccaggttatcggttggatatattttgtcgcctggtctattagcttctatccacaggttattatgaactggaggcgtaagagcgtgatcggcctcagcttcgactttgtcgccctgaaccttacggggttcgtggcatacagcgtgtttaacatcggcctactgtgggtcccatatattaaggagcagttcctccttaaatacccgaacggcgtgaaccctgtcaactcgaacgacgtattcttcagtcttcacgccgtggtgttgaccctaattatcattgttcagtgttgcctttacgagaggggaggccagcgtgttagttggcctgcgatcggttttttggtcttggcatggctctttgcctttgtgaccatgatcgtcgcggcggtaggagtgacaacttggctgcaattcctgttttgcttctcttacattaaactggccgtcacccttgtgaagtacttcccccaggcctatatgaatttctattataagtccaccgagggatggagcatcggaaatgtcctactggacttcaccggcggctctttcagcctcctgcagatgttcctgcagtcctataataacgaccagtggaccctgatcttcggggaccccacgaaatttggattgggcgtcttctctattgtgttcgacgtggtgttcttcattcagcacttctgcctctaccgaaagcggcctggctacgaccagctgaac

SEQ ID NO: 10293 - DNA, 1101 bp, Artificial Sequence
  Description of Artificial Sequence: Synthetic coding sequence
atgatcagaaactggctgacgatctttatcctgttccctcttaagctcgtggaaaaatgcgaatcgtcagtgagccttactgtccccccagtggtgaagctggagaatggatcgtccaccaacgtgtcactcaccctgcgccctccattgaatgccaccctggttattacgttcgaaatcacctttcggagcaagaatatcacgattctggaacttcctgatgaggtggtcgtgccccctggtgttactaactcgtcgtttcaggtgacttcacaaaatgtcgggcaactgaccgtgtacctgcatggcaaccattcgaaccagactgggccacgcataaggttcctggtcatcagatcaagcgctatttcgatcataaaccaggtgattggatggatctatttcgtagcctggtcgatttccttttaccctcaggtcatcatgaattggagaagaaaaagcgtgattggactttcattcgattttgtggccctgaacctgacgggatttgtggcatactccgtgttcaatattgggctcctgtgggtgccgtacataaaggaacaatttctcctgaagtaccctaatggcgtcaaccccgtcaactcgaacgacgtctttttctccctgcatgcagtcgttctgactctgatcataattgtccagtgttgtctttatgagcgtggcggacaacgagtgtcatggcccgcaatcggatttcttgtcctcgcttggcttttcgcattcgtcaccatgatcgttgcagcggtgggtgtgactacgtggctgcagtttctcttttgtttctcctatatcaaactggcagtgactctggtgaagtactttccccaagcgtacatgaacttttactacaagtcgactgaaggatggtcgattgggaacgtgcttctggattttaccggcggtagcttttcgttgcttcaaatgttccttcagtcatacaataacgatcaatggactctgatattcggagatcctacgaagtttggcctgggcgtgttctctatcgttttcgatgttgtctttttcatccagcacttttgtctttaccgtaagcgccccggttacgatcaactgaac

SEQ ID NO: 10294 - DNA, 1101 bp, Artificial Sequence
  Description of Artificial Sequence: Synthetic coding sequence
atgattcgaaattggctgactattttcatcttgttccctctcaaactggtggaaaaatgcgaatcctccgtgtcccttacagtacctcctgttgtgaagcttgagaatggtagctcaactaatgtaagcttaacacttcggccacccctgaacgccacactggtcatcactttcgagatcacgtttagatccaagaatataacgatcctcgaactcccagacgaagtcgtggtgccacccggtgtgaccaacagtagttttcaggtgacctcccagaatgtgggacagctcaccgtctatctccacggcaaccacagtaaccagactggcccgaggataaggttcctggtcatccgctcttccgctatctctatcattaaccaggtgattggatggatctatttcgtcgcttggagcatcagtttctatccacaggtcattatgaattggcgacgcaaaagcgtcatcgggcttagcttcgattttgtagccctgaacctgaccgggtttgtggcttactcagtgttcaatattggcctgctctgggtgccctacattaaggaacaatttctgctgaaataccctaacggggttaatcccgtcaactctaacgacgtgttcttcagcttgcacgctgtggtcttgactctgataatcattgtgcaatgttgcctctatgagaggggcggtcaacgggtgagttggccagcaatcggcttccttgtgctggcctggttattcgccttcgtcactatgatagtggccgccgtgggggtcacgacctggctgcagttcctgttctgcttttcctatattaaactggctgtgactcttgttaaatatttcccccaagcctacatgaacttttattataagtcgaccgaaggctggtctatcggaaacgtgctgcttgacttcacgggtggctccttttctctgctgcagatgttcctccagtcttataacaatgaccagtggactttgatttttggcgacccaactaagtttggcctgggcgtgttctccattgtgtttgacgtggttttttttattcagcacttttgtttatatcgcaaacgtccaggttacgatcagctcaac

SEQ ID NO: 10295 - DNA, 1101 bp, Artificial Sequence
  Description of Artificial Sequence: Synthetic coding sequence
atgatccgcaattggctgacgatcttcatattatttccacttaagctagtcgagaagtgcgagtctagcgtgtcattaactgttccccctgtagttaagctcgagaatgggtcaagtacaaacgtcagtctgacccttcgcccaccgctcaatgcaaccctggtcatcaccttcgagatcacttttcgcagcaagaatattacgattctggagctgcccgacgaggtggtggtgccaccgggagtcactaacagttcctttcaggtgacaagccaaaatgtgggacagcttaccgtgtacctacatggaaatcattcaaatcaaaccggacctaggatccgcttcctcgtgatccgatcatctgctatttccattattaaccaagtgataggctggatttattttgtggcctggtctataagcttttaccctcaggttatcatgaattggcgccgaaagtccgtgatcggccttagcttcgacttcgtcgccttgaacctcacaggtttcgttgcttacagcgtgtttaacattggattgttatgggtgccctatatcaaggaacagttcctattaaaatatcccaatggggttaacccagtgaatagcaatgacgtgttcttttcgctccacgccgttgtcctcacgctcatcattatagtccagtgctgcttatacgaacgaggaggccagcgggtttcttggcccgccataggcttcctggtgttagcctggctttttgcatttgtcaccatgatcgtcgcagccgtgggagtgaccacctggctgcaattcctgttctgcttctcttatattaaattagctgtgaccctcgtgaagtactttccacaggcctacatgaacttttattataagtctacagaaggctggtcaattggaaatgtgctgttggattttacgggcggcagttttagtcttcttcaaatgttcttacagtcttataataatgaccagtggacactcatcttcggagatcccactaaatttggactgggtgtcttttcgatagtgtttgacgtggtgtttttcatccagcatttctgtctgtaccgcaagcggcctggctacgatcagctgaac

SEQ ID NO: 10296 - DNA, 1101 bp, Artificial Sequence
  Description of Artificial Sequence: Synthetic coding sequence
atgatccggaactggctgaccatctttatactcttcccacttaagctggtggagaaatgcgaaagcagcgtctcccttaccgtgccacctgtcgtgaagctcgagaacggctcatccactaacgtctcgctgacgctgaggcctccactgaatgcaaccttggtgatcacctttgaaatcaccttcaggtccaagaatatcaccattcttgaacttcctgatgaggtggtcgtgcctcctggcgtgacgaattccagcttccaagttactagccagaatgtgggccagcttactgtctatctgcacggaaatcactccaatcaaacggggccacgtatcaggtttcttgtgattaggtcgtcggcaatatctatcataaaccaagtgatcggttggatctactttgtggcatggtcaatttcgttttacccacaggtgattatgaactggcgtagaaagagcgtcataggcctgagctttgatttcgtggcactcaaccttaccggatttgtcgcgtacagcgtgttcaacattggactgctgtgggtgccttacatcaaagagcaatttctgctgaagtaccctaacggggtgaaccctgtcaactcaaatgatgtctttttctcgcttcatgcggtggtgctcacgctcattatcatagtgcaatgttgtttgtatgaacgtggaggacaacgagtgtcgtggcctgccattggttttttggtcttggcatggctgttcgcatttgtgactatgatcgtcgcggccgtgggcgtgaccacttggctccagtttcttttttgttttagttacattaagttggctgtgaccttggtcaagtactttccgcaggcatacatgaacttttactacaagtccaccgaggggtggtcgataggaaatgtgcttctcgacttcaccgggggctcgttttcattgctgcaaatgttcctgcaatcatacaacaatgaccagtggactctgatttttggggacccgactaagttcggactgggtgtgtttagcattgtgtttgatgtagtgtttttcatacagcatttttgtctgtaccgcaagcgccctggttacgatcagcttaac

SEQ ID NO: 10297 - DNA, 1101 bp, Artificial Sequence
  Description of Artificial Sequence: Synthetic coding sequence
atgatacgcaactggctaacaatcttcattctgttcccgctcaaactcgttgagaaatgcgaatcctccgtcagcctaaccgtcccacctgttgtgaaactggagaatgggtccagcacaaatgtctccctcaccctgaggccacccctgaatgccactctggtgattacattcgagatcaccttcagatccaagaatatcacaattctagagctgcctgacgaggtagtggttccgcccggcgtgacaaatagctcattccaggtcacgtctcagaatgtgggacagctcactgtgtacctgcacggaaatcacagcaatcagactggaccgcgaattcgctttctcgtcattagaagttcagctattagcatcattaatcaggtcattgggtggatttacttcgtagcatggtcgatttccttctacccacaggtgataatgaattggcgcaggaaaagcgttatcggtctgtctttcgatttcgtagccctgaacctaacaggcttcgtcgcctactcagtttttaatataggtttactttgggtcccttatattaaggagcagtttctgcttaaataccccaatggtgtgaatcctgtgaactcaaatgatgtcttcttttctctgcacgcggtcgtgctaacattgatcattatcgttcagtgctgcttatacgaacggggaggacaacgtgtgtcctggccagcaatcggcttcttagttcttgcctggctgtttgctttcgtgacaatgattgtggcagccgttggcgtcacaacttggctgcagttcctgttctgcttttcctatatcaagctcgctgtgacattggtcaaatatttcccgcaagcttatatgaacttctattataagagcaccgaagggtggagtatcggaaatgtcctgttggacttcacaggaggctctttttcgctgcttcaaatgtttttacagagttacaacaatgatcagtggacactcatttttggcgatcctacaaagtttggtttgggggtgttttctatcgtgttcgacgtcgttttttttattcaacatttttgtctctacagaaagaggccaggatacgaccagctgaac

SEQ ID NO: 10298 - DNA, 1101 bp, Artificial Sequence
  Description of Artificial Sequence: Synthetic coding sequence
atgatccgcaattggcttaccatctttattctgttccccctcaagctggtcgaaaagtgcgaatccagcgtctcgctgactgtcccgcctgtggtgaagttggaaaacggaagctcgactaacgtgtctcttactcttagaccgcctctgaacgccactcttgtgatcaccttcgagatcacctttcgaagcaagaacattactatactggagctgcctgacgaagtggtggtgccaccaggagtcaccaactcgtcgttccaggtgacttcccaaaacgtgggacaacttacggtctacctgcatggcaaccattccaaccaaaccggacctagaattcgctttcttgtcatcagatcctcggccatatcaatcattaaccaggtgatagggtggatttacttcgtggcatggtcaatttcgttctacccacaggtgatcatgaattggaggcgaaagtcggtaattggcctgtcatttgattttgtcgcgcttaatctcactggatttgtggcatactcagtgttcaatatcggactcctttgggtgccatacatcaaagagcagtttctgctcaagtacccaaacggagtgaatccagttaacagcaatgacgtgtttttctcgctgcatgcagtggtgctgacgctcatcatcatcgtccaatgctgtctctacgaaagaggaggacagcgagtgtcctggccagccatcggattccttgtcctcgcatggctttttgcattcgtgaccatgatcgtcgcagcagtcggagtcactacctggctgcaatttcttttctgtttttcctacattaaactcgcagtcactcttgtgaaatacttcccacaggcttacatgaacttctattacaagagcaccgaagggtggtccatcgggaacgtgttgcttgattttacgggtggaagtttctcgctccttcagatgtttcttcaaagctacaataacgaccaatggaccctgatttttggagatccaaccaagtttggactgggtgtgttctcgatagtttttgacgtggtgttcttcatacaacatttctgtctgtaccgcaaaaggccggggtacgatcaacttaac

SEQ ID NO: 10299 - DNA, 1101 bp, Artificial Sequence
  Description of Artificial Sequence: Synthetic coding sequence
atgatccgcaattggctgactatcttcatcttgttcccgctgaaattggtcgagaagtgcgaaagctctgtgtccctcaccgtccctccagtggtcaagctggaaaacggctcatccactaatgtgagcctcacgctccggccgccgctgaatgctaccctggtcatcacgttcgagatcaccttcagaagcaaaaacatcaccatcctggaactgccggatgaggtggtggtgccacccggagttaccaattcctcgttccaggtgacttcacagaacgttggacaactgactgtgtacctgcatggaaaccactcgaaccagactggccctcgcatccggtttctggtgatccgcagctcagccatctcaataatcaatcaggttattggatggatatactttgtcgcctggtcgatctcgttctatcctcaagtgatcatgaattggcggcgcaaatccgtcattgggctctcattcgacttcgtagcactgaaccttactggcttcgtggcatactccgtgttcaacatcggactgctttgggtgccgtacatcaaagaacagtttctgctcaagtacccaaacggagtgaacccggttaactctaacgatgtgttcttcagcctccatgctgtagtcctgacgctgatcattatcgtgcagtgctgcctctacgaacggggaggacaacgagtctcctggccggcgatcggattcctggtgcttgcgtggttgttcgcgttcgtgaccatgattgtggcggccgtgggagtgaccacttggctgcagtttttgttctgcttctcgtacatcaagttggcagttactttggtgaagtattttcctcaggcttacatgaacttctactacaagtcgactgagggatggtccatcggcaacgtcctgctggacttcaccgggggtagcttttcccttctgcaaatgttcctgcagtcttataacaatgaccagtggaccctgattttcggggatccaactaagtttggcctgggcgtgttctcaattgtgttcgacgttgtgttctttatccagcatttctgtctctaccgaaagcggcccggctacgatcagctgaac

SEQ ID NO: 10300 - DNA, 1101 bp, Artificial Sequence
  Description of Artificial Sequence: Synthetic coding sequence
atgatccgaaattggcttaccatattcatcctgttccccctcaagctggtcgaaaagtgcgaatcatccgtaagcctgaccgtgccgccagttgtgaagttggagaatgggagctccaccaatgtgtccctgaccctgcgcccgccgctgaatgccacgttggtgatcactttcgagattactttccgctccaagaacatcactatcctggaactgcctgacgaagtggtggtccccccaggcgttactaactcttcatttcaggtgactagccagaacgtcggtcaacttactgtgtacctccatgggaatcacagcaatcagactggtcctcgcatcaggtttcttgtcatcaggtcctccgcgatttctatcatcaaccaggtgatcgggtggatctactttgtggcctggtccatctcgttctacccgcaggtgattatgaactggagacgcaagtcagtgattggcctgtcgttcgatttcgtcgctttgaacctcaccggctttgtggcatatagtgtattcaacatcggtttgctctgggtgccatacatcaaggagcagttcctgctgaaataccctaacggagtgaatccggtgaacagcaacgacgttttcttctcgctgcacgcggtcgtgttgacccttatcattatcgtgcaatgttgcctttacgaacggggaggacaacgggtatcatggcccgccattggcttcctggtgctggcatggctgttcgccttcgtgactatgatcgtcgcagcggtgggcgtgacgacctggctccaatttctcttctgcttttcgtacataaagctggctgtcaccctggtgaaatacttcccacaagcctacatgaatttctattacaaaagtacggagggctggtcgatcggaaacgtcctccttgatttcaccggaggatcgttttccttgctgcagatgttcctccagtcatacaacaacgaccagtggaccttgatcttcggggacccgactaagtttggactcggagtcttttcaatcgtgttcgacgtcgtattctttatccaacatttctgcctgtaccggaaaagaccgggatacgatcagctgaat

SEQ ID NO: 10301 - DNA, 1101 bp, Artificial Sequence
  Description of Artificial Sequence: Synthetic coding sequence
atgattaggaattggttgacaatttttattctgtttccattgaagctcgtggagaagtgcgaatctagcgttagcctaactgtgccccctgtcgtcaagttggagaatggaagctccacaaatgtgtccctcacactaaggcctccgctgaatgctacgttagtgattacattcgaaatcaccttccgcagcaagaatattaccatcctcgagttgccagatgaggtcgtggtgcctcccggggttaccaattcatcttttcaggtgacgagccagaacgtggggcagctaactgtctacctgcatgggaaccattccaaccagaccggacctcggatccgttttcttgtcatcaggagttccgccataagcatcatcaaccaggttattggttggatctattttgtcgcatggagtattagtttctatccacaagtcatcatgaactggaggagaaaatcagtcattgggctttcctttgactttgtagccttgaacctgaccggctttgtggcatactcagtcttcaatattgggctgctgtgggtgccatacatcaaggagcagtttttattgaagtaccctaacggggtgaaccctgttaattcaaacgacgttttttttagcttgcacgccgtcgtgcttacattgatcattattgtacagtgttgtttgtatgaacggggtggacagcgcgtgagttggccggcaatcggctttcttgtgctggcatggctctttgcattcgtgactatgattgtcgcagcggtgggggttaccacttggctgcagttcttattctgctttagttacatcaaattggcggtgacacttgtcaaatatttccctcaggcttacatgaatttttactacaagtccacagaaggttggtcgatcggtaatgttctcctagatttcactggggggagcttttctctgttacagatgttcttgcagagctacaataatgaccaatggaccctgatctttggagatcctactaagtttgggctgggcgtcttttctatcgtattcgatgtggtgttttttatccagcatttctgtctttatcgtaagcggccaggatatgaccagttgaac

SEQ ID NO: 10302 - DNA, 1101 bp, Artificial Sequence
  Description of Artificial Sequence: Synthetic coding sequence
atgattagaaattggttgaccatctttatcctgtttccacttaagcttgttgaaaagtgcgaatccagcgtcagcctgaccgttccacccgtcgttaaattggaaaacggctcttctaccaacgtctcactcactctgcggccacctctcaacgcaacattagtcatcaccttcgagatcaccttcaggagtaagaacatcacaatcttagaactgcctgacgaggtggtcgtccctcccggcgtgacaaactcaagcttccaggtgacaagccagaatgtgggccagttgacagtgtatcttcatggcaaccactctaatcagaccggacctagaatccggttcctcgtcatacggtcgagtgctatttccataattaatcaagttattggctggatctattttgttgcatggagcatctctttttatcctcaagtgatcatgaactggcggaggaaatccgtcattggactgtcatttgactttgtggctttaaaccttacaggcttcgtcgcttactccgtttttaacatcggcctgctatgggtgccatacattaaggaacagttcctgctcaagtaccccaatggtgtgaaccccgtcaactccaatgatgtcttcttttctcttcacgccgtggttctaaccctcatcatcatcgtccagtgttgcctgtacgaaaggggtgggcagcgcgtaagttggcctgctatcgggtttctggttcttgcttggcttttcgctttcgttaccatgatcgtggctgctgttggagtgactacatggctccagttcctgttctgcttttcttacatcaagctcgctgtaaccctggtgaaatactttccccaggcatacatgaatttctattacaagagcacagaaggctggagcattggcaacgtgcttctcgattttactggtggctcttttagtctgctgcaaatgttcctgcagagctacaacaacgaccagtggaccctgatctttggagatcctaccaaatttggactaggagttttcagcattgtgtttgatgtcgttttctttatccagcacttttgtctctacagaaaaagacccggatatgaccagttaaac

SEQ ID NO: 10303 - DNA, 1101 bp, Artificial Sequence
  Description of Artificial Sequence: Synthetic coding sequence
atgattcggaactggctgaccatattcatcctcttcccgctcaagctcgtggaaaaatgcgagtcctcggtcagccttaccgtacccccggtggtcaaacttgaaaacggaagctcaactaacgtgtcgttgactttgcgccctccccttaatgcgaccctggtcattaccttcgagatcaccttcagatcaaagaacatcactattctggaactcccagatgaagtggtggtgcctcctggagtgactaactcctcattccaagtgaccagccagaacgtcggacaactcacggtgtacctgcatggcaatcactccaaccagaccggaccacgtattcgctttctcgtcatcaggagcagcgcgatcagcatcattaatcaagtgatcggttggatatactttgtagcttggtccatctctttctaccctcaggtcattatgaattggagaaggaagtccgtcattggtctttccttcgattttgtggcacttaacctcactggtttcgtcgcatattccgtgtttaacatcggcctcctgtgggtgccttacataaaggagcagtttttgcttaagtaccctaatggtgtcaatcctgtgaactcaaacgatgtgttctttagcctccacgcggtggtcctgactctgattatcattgtgcaatgttgcctctacgaacggggtggccagcgcgtctcgtggccggcaattggatttctggtcctggcatggctttttgcatttgtgaccatgatagtggcagcagtgggcgtgactacctggctgcaatttctgttctgtttttcatacataaagttggcagtcactcttgtgaagtacttccctcaagcgtacatgaacttttactacaagtcgaccgaaggatggtcgatcggcaatgtgcttctggattttaccggcggatcgttttcgctcctccagatgttcctgcaaagctacaacaatgatcagtggactctcatctttggggacccaacgaagtttggactcggcgtgttttctattgtgtttgacgtggtgtttttcattcaacatttttgtctctaccggaagcggcccggttacgatcagctgaat

SEQ ID NO: 10304 - DNA, 1101 bp, Artificial Sequence
  Description of Artificial Sequence: Synthetic coding sequence
atgatcagaaattggctgaccatcttcatcttgtttccattgaagctagtggagaaatgtgagtcttcagttagcctgacggtgccgccggtagtgaagttggaaaatggcagcagcacaaacgtgtccctgacattaagacctcctctcaatgctactttggtgataacctttgagattaccttcagaagcaagaacattacgatcttggaacttccagacgaagtggtcgtgccacccggagtgactaattcttcttttcaggtcacctcgcagaatgtcggacaattgaccgtgtatcttcatggaaatcattctaatcagacagggccaagaattcgattcctcgtgatccgaagtagtgcaattagcatcattaaccaggtgattgggtggatctactttgttgcttggtctataagcttttacccgcaggttattatgaattggaggaggaaatctgtcatcggcttaagtttcgattttgtggctctgaaccttacaggcttcgtcgcttattcggtattcaacattggactgttgtgggtgccatacatcaaagaacagttccttctgaaataccccaacggggtgaatccggtcaactccaacgatgtattcttctcactccacgcagtggtgctgacacttattatcattgtccagtgctgtctttacgaacgaggcggtcagcgagtgagctggccagccatcggatttcttgtgctcgcctggctatttgccttcgtgacaatgatcgtcgccgccgtcggagttacgacctggctgcaattcttgttctgtttctcttacatcaagctggccgtaaccttggtgaagtacttccctcaggcctatatgaacttttattataagtcaaccgaaggatggtccatcggcaacgtcctgttggattttaccggcggaagcttttctctcctgcagatgtttttgcaatcctataacaacgaccaatggacccttattttcggcgaccccacgaagttcgggctgggtgtgttcagtattgtttttgatgtggtgttcttcatccagcatttttgcctttatcgtaagaggccagggtatgatcagctgaat

SEQ ID NO: 10305 - DNA, 1101 bp, Artificial Sequence
  Description of Artificial Sequence: Synthetic coding sequence
atgatcaggaactggttaacaatcttcatactgttccctctgaaactggtggagaagtgcgagagcagcgtgagcttaaccgtcccgccggtagtgaagctggagaacggttcctcaactaacgtgagcctgaccctgcgccccccgctgaatgctaccctggtgatcacatttgaaattacctttaggagtaagaatattactattctggagttgcctgacgaggtggtcgttcctcctggggttacaaactcttcctttcaagtcacgtcccaaaacgttggccaactaaccgtgtacctgcacggtaaccactctaaccaaactggtcctagaattaggttccttgtcattcgctcctctgctatctcgattatcaatcaagtgattggttggatttatttcgtcgcatggtctatttctttctatcctcaggtgattatgaattggcgccgcaaaagcgttatcggcctttcgtttgactttgttgccctgaatctgaccggtttcgtggcgtacagcgttttcaatataggcctgctgtgggtgccatacatcaaggagcaattcctactgaagtatccaaatggtgttaatcctgtcaactccaatgatgtcttcttctcactgcacgctgtggtgctgaccctgattatcattgttcagtgctgtttgtatgagcgtggcggacagcgcgtgagctggccggcgatcggttttttagtgttagcgtggctgtttgcctttgttaccatgatagtcgcagccgtcggtgttactacttggttgcaattcttgttctgcttctcttatattaagctggcggtcacgcttgtcaagtactttccacaggcttacatgaatttctattacaagagcacggaaggctggagcatcggcaatgtcttactggattttacgggtggtagcttctctctgctccaaatgttcctgcaaagttataataacgatcagtggacactgattttcggtgacccgaccaagtttggactgggcgtcttcagcatcgtgtttgacgtggtattcttcatccagcacttttgtctgtaccgtaaaagaccgggctacgatcagctgaat

SEQ ID NO: 10306 - DNA, 1101 bp, Artificial Sequence
  Description of Artificial Sequence: Synthetic coding sequence
atgatacgtaattggctaacgatatttatactatttccgctaaaactagttgaaaaatgtgaatcgtcggtatcgctaacggtaccgccggttgtaaaactagaaaatggttcgtcgacgaatgtttcgctaacgctacgtccgccgctaaatgcgacgttagtaataacgtttgaaataacgtttcgttcgaaaaatataacgatattagaattaccggatgaagtagttgttccgccgggtgtaacgaattcgtcgtttcaagttacgtcgcaaaatgtaggtcaactaacggtatatctacatggtaatcattcgaatcaaacgggtccgcgtatacgatttctagtaatacgatcgtcggcgatatcgataataaatcaagttataggttggatatattttgttgcgtggtcgatatcgttttatccgcaagtaataatgaattggcgacgtaaatcggtaataggtctatcgtttgattttgtagcgttaaatttaacgggttttgttgcgtattcggtatttaatataggtttactatgggttccgtatataaaagaacaatttctattaaaatatccgaatggtgtaaatccggttaattcgaatgatgtatttttttcgttacatgcggttgttctaacgctaataataatagtacaatgttgtttatatgaacgtggtggtcaacgtgtttcgtggccggcgataggttttttagttctagcgtggttatttgcgtttgttacgatgatagtagcggcggtaggtgtaacgacgtggttacaatttctattttgtttttcgtatataaaactagcggtaacgctagtaaaatattttccgcaagcgtatatgaatttttattataaatcgacggaaggttggtcgataggtaatgtattattagattttacgggtggttcgttttcgctattacaaatgtttctacaatcgtataataatgatcaatggacgttaatatttggtgatccgacgaaatttggtctaggtgtattttcgatagtttttgatgtagttttttttatacaacatttttgtctatatcgaaaacgtccgggttatgatcaattaaat

SEQ ID NO: 10307 - DNA, 1101 bp, Artificial Sequence
  Description of Artificial Sequence: Synthetic coding sequence
atgattcgcaactggctgaccatctttattctattcccattgaaattggttgagaaatgcgagtctagtgtatctctaacagtcccgcccgtggtgaagctggaaaacgggtccagcacaaatgtgtccttaacactccgcccccccctaaatgcaaccctagtcatcacctttgagataaccttcaggagcaaaaatatcaccatcttagaattgccagatgaagttgtggtaccgcctggggtaacaaatagttcctttcaggtgacctcacagaacgtgggccaactgaccgtgtacctacatggcaaccactcaaaccagacagggccccggattcgctttctagtgatccgcagttctgccatcagcatcatcaatcaggtcatcggatggatctacttcgtggcctggtcgatttctttttacccacaggtgattatgaactggagacgaaaatcagtgatcggtctgtccttcgatttcgttgctctgaatctgacgggatttgtggcttacagtgtgttcaacatcggcctcctgtgggtgccttacattaaagagcagttcttattgaaatatcccaacggcgtcaatcccgtgaattctaatgatgtctttttctccttacacgccgtggtactgacattgatcattatcgtgcagtgttgtctttatgagcgggggggccagagggtaagttggcctgcaataggatttcttgtccttgcatggctcttcgcatttgtgactatgatagtggctgccgtgggagtaaccacatggctccagtttttgttctgttttagttatattaagctcgcagtgaccttggtcaagtactttccacaggcgtacatgaacttctactacaagtccactgaggggtggagtatcggcaatgttctgttggatttcacaggcgggtcgttctcgttacttcagatgttcctccagtcatacaacaatgatcagtggaccctgatttttggcgacccaaccaaattcggccttggagtattttctattgttttcgacgtggtgttctttattcaacatttctgtctttatcgtaagagaccaggttatgatcaattgaat

SEQ ID NO: 10308 - DNA, 1101 bp, Artificial Sequence
  Description of Artificial Sequence: Synthetic coding sequence
atgatcagaaattggctgaccatatttatattgttcccacttaaattggtggagaagtgcgaaagttccgtctctctcactgtcccaccggtagtcaagcttgagaacggttctagtacaaatgtgtccctgactttgaggccgcccctgaacgccactcttgtaataacattcgaaataaccttccggagtaaaaatataacaatactcgagctccccgatgaagtcgtcgttccaccaggggtgacgaactcatcttttcaggtgacctcacagaatgtcgggcagcttactgtgtacttacatgggaatcacagcaatcaaaccggcccaagaatccgcttcctagtaattagaagctcagctattagcatcatcaaccaggtgatcggctggatctatttcgttgcttggagtatctctttctacccgcaagttatcatgaattggagaaggaaaagcgttatcgggctcagtttcgattttgtggcgctgaatctaacaggattcgttgcctactctgttttcaacatcggacttctctgggtgccttacatcaaagagcagtttctgctgaaatatccgaatggagtgaatcccgtgaactccaacgacgtttttttctccttgcacgccgtagtcttgactctgatcatcatcgtgcagtgttgcttgtatgagagaggcggtcagcgagtgagctggcccgccatcggattcttagttctggcttggttatttgctttcgtgacaatgattgtggccgccgttggggtaaccacttggctccagtttcttttctgtttctcctatattaagctcgccgtgacactcgtgaagtactttccacaagcatatatgaatttctactataaaagtaccgaaggatggtctattggaaatgtgctgcttgactttaccggcggatctttttctctactacaaatgttcctgcagtcttataacaacgatcaatggactctgatctttggtgacccaacaaagtttgggctgggtgtgttctcaatagtctttgacgtggtttttttcattcagcacttctgtctgtataggaagcggccgggttacgaccagctgaac

SEQ ID NO: 10309 - DNA, 1101 bp, Artificial Sequence
  Description of Artificial Sequence: Synthetic coding sequence
atgattcgaaattggctcaccatatttattttgttcccattaaagttggtcgaaaagtgcgaatcatctgtctctctgactgttccccctgttgttaaactggaaaacggatctagcacgaatgtttcgttgacactaagaccacctttgaacgctactttggtgattacattcgaaattacctttagaagtaagaatatcaccatccttgagctgccggatgaagttgtggtaccaccaggtgtcactaacagctcgttccaagtgacttcccaaaatgtcggacaacttacggtttatcttcacggcaaccattcaaaccaaactggaccgcgtattagatttcttgtgattagatcttcagccatttccatcatcaaccaagtaattggttggatttattttgtggcttggtctatcagcttctaccctcaggtcattatgaactggcgcagaaaatcggtgataggactatctttcgatttcgtcgcgttgaatctaaccggattcgttgcgtatagcgtttttaacatcgggcttctatgggttccatatatcaaagaacagttccttttgaaatatccgaatggtgttaaccctgttaattccaatgacgtgtttttctcgcttcacgctgttgttctcacacttattatcatcgtacaatgctgtctttatgaaaggggaggacaacgtgtatcatggccagcgattggattccttgttttggcttggcttttcgcgttcgttaccatgatcgttgctgccgtgggagtaactacgtggctgcaattccttttttgtttttcgtatatcaagctcgcggtaacattggttaagtattttcctcaggcttacatgaatttttactataagtcgacagagggatggtctattggaaacgttctacttgatttcacagggggttcgtttagtctgttgcaaatgtttctgcaatcatataataatgaccaatggactctcatcttcggcgatccaacgaagtttggactcggcgtattttccatcgtctttgatgttgtctttttcatccaacacttttgcctctacagaaaaagaccagggtatgaccaacttaat

SEQ ID NO: 10310 - DNA, 1101 bp, Artificial Sequence
  Description of Artificial Sequence: Synthetic coding sequence
atgattagaaactggctgaccatattcatcttgttcccactgaaactcgtcgaaaagtgcgagtcttcggttagtctaacagtgcccccagtcgttaaactggagaacggctcctcgacaaacgtctcattaacactacggccccctttgaatgccactctggtgatcacttttgaaataacctttcgttcaaagaatattactattctcgaactgcccgacgaggtcgtcgtgccacctggagtcactaatagttcgttccaggtgacatcacagaacgtgggccagcttactgtttatctccacgggaatcattccaaccagacaggaccccggatcagatttctggtgatccggagtagcgcaatatcgattatcaatcaggtgatcggctggatttacttcgtggcttggagcattagcttttatccccaagtgatcatgaactggcgaaggaaatctgtgattggactgtccttcgattttgtcgctctgaatttgaccgggttcgttgcttatagcgtttttaatatcggtttgttgtgggtaccatacatcaaggagcagttcttactcaagtacccaaatggtgtaaaccctgttaacagcaatgacgtattcttcagtcttcatgcggtcgtacttacgcttatcatcatcgtacaatgttgtttgtacgagcgaggaggtcaacgtgtttcttggccagctatcggcttccttgtgttggcctggctttttgctttcgtgaccatgattgtggctgccgtcggcgttactacttggctacagtttctcttctgtttctcctatatcaagctggctgtaaccctcgttaagtacttccctcaggcatatatgaatttctattacaagtctactgagggttggagcatagggaatgtgctcctggatttcacaggaggaagcttcagcctgctgcagatgttcctgcagtcatacaataatgatcagtggacgctgatcttcggggaccctaccaaattcgggcttggagtcttctcaatcgtgttcgacgttgtgttctttattcagcacttttgcttgtaccgaaagagacctggttacgatcagctgaat

SEQ ID NO: 10311 - DNA, 1101 bp, Artificial Sequence
  Description of Artificial Sequence: Synthetic coding sequence
atgatacgtaactggttgactatttttatactgtttccgcttaagttggtcgaaaagtgtgagtcatccgttagtctcacagtgccccctgtggtgaaactcgagaatggtagttccactaacgtatccctaaccctcaggcccccgttgaacgcgacgctcgtgatcactttcgagatcacctttaggtcaaagaatatcaccatcttggagctgccagacgaggttgtggtgcctcccggcgtgacaaactccagcttccaggttacctctcaaaacgttggtcaactcaccgtgtaccttcacgggaatcacagcaaccaaacggggccccggattcgctttctggttattcgctccagcgcgattagtataattaaccaagtgatcggctggatctattttgttgcctggtcaatcagtttttacccgcaggtaattatgaactggcgtcggaagtcagtcatcgggctgtctttcgatttcgttgccctgaaccttaccgggtttgttgcttattccgtgttcaacataggcctgttgtgggttccgtatattaaagagcagttcttactgaaatatccgaacggggttaaccccgtgaacagcaacgacgtattcttctcccttcacgccgtagtcttgaccttgatcatcatcgtacagtgctgtctgtatgagcgcggtggtcaacgggtgtcctggcccgcgataggattcttagtgctagcctggctgtttgctttcgtgaccatgatcgtggctgccgttggggtgacaacctggctgcagtttctgttctgcttctcttatatcaaactcgccgtgacattggtgaagtacttccctcaagcctacatgaacttttattacaaaagcaccgaggggtggagtattggtaacgttttacttgacttcaccggcgggtcattctcactcctacagatgttcttgcagtcgtacaataatgatcagtggacactcatatttggggacccgacaaagttcggtctgggagtgttctccattgtgttcgacgtcgttttctttattcagcacttctgtctttacaggaagagaccaggatacgaccagctcaac

SEQ ID NO: 10312 - DNA, 1101 bp, Artificial Sequence
  Description of Artificial Sequence: Synthetic coding sequence
atgattcgtaactggcttaccatcttcattctgttcccgctgaagttggttgaaaagtgtgagtcttcggtctcgctcaccgtcccccccgtcgtcaaattggagaacggttcctccaccaacgtcagccttacgttgcgtcctcctctgaacgctacccttgttatcaccttcgaaatcaccttccggtccaagaacattacgatcctggagctccctgatgaggtcgtcgtgccccctggcgtcacgaactcatctttccaggtcacctcgcagaatgtcggtcaactgacggtctacttgcacggcaaccactccaatcaaaccggcccgcgcatccggttcctggtcatacggtcctctgctatctcgatcatcaaccaagtgatcggatggatctacttcgttgcgtggtcaattagcttttacccacaggtgatcatgaactggcggagaaagagtgtaatcggcctgtcgttcgacttcgtggcgctgaacctgaccggttttgtggcttacagcgtcttcaatatcggcctgctttgggtcccctacattaaggagcagttcttgctcaagtaccctaacggagtgaaccctgtcaactcgaatgatgtctttttcagcctccacgcagtcgtattgaccttgattatcattgtacaatgctgcttatacgagcgcggcggtcaacgtgtgtcctggcctgctattggctttctagtgctggcgtggctgttcgcattcgtgaccatgatcgtcgccgccgttggtgtgaccacttggctgcagtttctcttctgcttctcctatatcaagctcgcagtcacccttgtgaagtatttcccccaagcttacatgaacttctactacaaatccacggagggatggtcaataggaaacgtgttgcttgacttcacagggggatcattctctctccttcaaatgttcctgcagtcgtacaataacgatcagtggacgctcatcttcggcgatccaaccaagtttggccttggtgtgttctctatcgtattcgacgtcgtcttctttattcagcacttttgcttgtacaggaagcgtcccggctatgatcaactcaac

SEQ ID NO: 10313 - DNA, 1101 bp, Artificial Sequence
  Description of Artificial Sequence: Synthetic coding sequence
atgatccgcaattggctgacaatcttcattctattcccccttaagttggtggaaaaatgtgagtcgtcggtttctctgacggtgccacctgttgttaaattggaaaacggttcatcaacgaacgtgtctctgacgcttcgcccgccgttgaacgctactctagtgataacattcgaaatcaccttccgtagcaaaaatataaccattctagagctccccgatgaggtggtcgtcccacccggtgttacgaattcatccttccaggtcaccagtcaaaacgtgggtcagcttactgtttatttacacggcaatcatagcaatcagactgggccccgaattagatttctggtcatccgatcaagcgccatctctattataaatcaggtcattggctggatctacttcgttgcatggtccatttccttttacccccaggtgatcatgaactggcgcaggaagagtgtgatcggcctctccttcgacttcgtcgccttaaatctcaccgggtttgtggcttattccgtttttaacatcggcctcttgtgggtcccatacatcaaagaacagtttctcctgaaatacccaaacggagtcaaccctgtaaatagcaacgacgtgtttttttccttgcacgccgtagtgctgacccttatcattatagtgcagtgttgtttgtacgagcgcggtggacagcgcgtgtcttggcccgcgatcgggtttctagttttagcctggttgttcgcgtttgtcacaatgatcgtggctgcagtgggcgtgaccacttggctgcagtttctcttctgcttttcctacatcaagcttgcagtaactctcgtgaaatacttccctcaggcttacatgaacttctactacaagagtaccgagggttggtctattggaaacgtcttgctcgatttcactggaggatctttctcactacttcaaatgtttctgcagtcctacaacaacgaccagtggaccctcatctttggcgaccccaccaaatttggcttgggcgtgtttagcattgtgtttgacgttgtattctttatccagcacttctgtctgtatcgcaaaagacccggttacgatcaactgaac

SEQ ID NO: 10314 - DNA, 1101 bp, Artificial Sequence
  Description of Artificial Sequence: Synthetic coding sequence
atgataaggaactggctgacaatctttattcttttccccttgaagctggtggaaaaatgtgagtccagcgtctcacttactgtcccacctgttgttaaactcgagaatggctcctccacaaacgtgagcctgacgttgcgcccccccctgaacgcaacattggtcatcacattcgagataacgttcaggtccaaaaacatcaccatactggagcttcccgatgaagtggtagttcccccgggtgtaacaaacagtagcttccaggtaacttcccagaacgtcggacagctcacggtgtacctgcacggtaaccattctaaccagactggccccaggatccgatttcttgtgataaggagttctgcaatcagtattataaatcaggtgattggctggatttactttgtggcgtggagcatctccttctaccctcaggtgattatgaattggaggcggaagtctgtcatcggactgtcattcgacttcgtggccctgaacctgacgggtttcgtggcctacagtgtctttaatattgggttgctgtgggtcccgtatataaaagagcagtttctcctcaagtaccccaacggagttaaccccgttaatagcaatgatgtgtttttctctctgcacgctgttgtcctcaccctcatcatcattgtgcagtgctgcctctatgagagagggggacagagagtctcttggcccgccattggattcttggtcctcgcatggttgttcgcctttgttaccatgatcgtggcggcggtcggggttactacctggcttcagtttctcttttgtttcagctacattaagttggcggtcactctcgtgaaatatttcccacaggcgtacatgaatttctactacaaatccaccgagggctggagcattggaaacgttctgttggattttactggaggctctttcagcctgctgcagatgtttctccagagttacaacaatgaccagtggacccttattttcggcgaccctacaaaatttggtttgggcgtgttttcaattgtcttcgacgttgttttctttatccagcatttttgtctgtacaggaagcggcccggatacgaccaactgaat

SEQ ID NO: 10315 - DNA, 1101 bp, Artificial Sequence
  Description of Artificial Sequence: Synthetic coding sequence
atgataaggaactggcttacaatcttcatccttttccccctcaaattagtggaaaaatgcgaatcctcggtctcgttaactgtccctcccgtggtgaagttggaaaacggatcaagtaccaatgtgtcactgaccctgaggcctcctctgaatgctacactggtaatcacatttgagataacattccgatccaagaacatcacaatactggaacttcctgacgaagtggttgtccctcctggggttacgaatagtagcttccaggtaacaagccagaacgttggacagttaacagtataccttcacgggaatcactccaaccagactgggccccgaatccggtttcttgttatccgttcttcggccatttctattattaatcaggtgatcggatggatatacttcgtggcgtggagtatctccttctacccccaggtgatcatgaactggcgccggaaatccgttattggactgagtttcgatttcgttgcactcaatctcacaggctttgtagcctacagcgtgtttaacatcgggctcctttgggtcccatatatcaaagagcaatttctcctaaagtatcccaacggcgtgaatccagtaaattccaatgatgtgttcttctctcttcatgccgtggtcctcacactgataatcatcgtgcagtgttgcctgtacgaaagagggggacagagggtgtcttggcccgccatcgggttcttggtcctcgcatggctttttgccttcgtgacaatgattgttgccgctgtcggcgtgaccacctggctgcagttcctgttttgtttttcctacattaaactggctgtgactctagtgaaatatttccctcaggcctacatgaatttctattacaaatctacggaaggttggtcaatcgggaacgtgctgttagatttcactgggggctcattcagccttctccagatgtttctgcagtcttataacaacgatcagtggacactcatcttcggggaccccaccaagtttggactgggcgtctttagcatcgtgttcgacgtggtgttctttatccagcacttttgcctgtataggaagcgccctgggtacgatcagctgaat

SEQ ID NO: 10316 - DNA, 1101 bp, Artificial Sequence
  Description of Artificial Sequence: Synthetic coding sequence
atgataagaaattggctgaccatattcattttgttcccactaaaactggtggagaagtgtgaatctagcgtgagtctaaccgtgcctcccgtagtaaagctggaaaacggttcctccacgaacgtcagtctgactcttcgccctcctttaaacgcgacattggtgattaccttcgaaattacctttcggtcgaaaaatattaccatcctggaattgccggatgaggtcgttgtccctccaggagttacaaactcgtccttccaagttacgtcgcagaatgttggccagctgaccgtctatttgcacggaaaccatagtaaccagacggggccacgtattaggttcctggtgatccgcagctcagccatttcgattatcaatcaggttattgggtggatttattttgtcgcctggtccatttccttctacccgcaagtcattatgaactggcgccgcaagtcggtgataggactctcgtttgatttcgtggccttgaatttgactggatttgttgcatactccgttttcaacattggtcttctttgggttccttatataaaggagcagttcctgctcaaatatcccaatggcgtgaaccccgtaaattctaatgacgtttttttctctctccacgccgtcgtcctcacgttgatcattatcgttcagtgctgtctatacgagaggggcgggcaacgcgtctcttggcccgcaatagggtttcttgtccttgcttggctctttgcttttgtgactatgattgtcgcagcagttggcgtgacgacttggctccagttcctattctgtttctcatatattaaactcgcagttactttagtcaagtatttccctcaagcctatatgaacttctactataagtcgacggagggctggagcatcggtaatgtattgttagattttacggggggaagcttcagcctgctccaaatgttcctgcaatcgtataataacgatcagtggacccttatctttggagatccgacaaaattcggtctgggcgtattctcaatcgtatttgatgtcgttttcttcatacagcatttctgtctttatcgtaagcgtccaggttacgaccagctgaac

SEQ ID NO: 10317 - DNA, 1101 bp, Artificial Sequence
  Description of Artificial Sequence: Synthetic coding sequence
atgatcaggaattggctcactatttttatactgtttccactaaagctggtggaaaaatgtgagagcagtgtgagccttacggtgcctcccgtggttaagttagagaacggatcatctaccaacgtaagcctgaccttgcggcctccactgaacgctacactggtaattacattcgagataactttccggagcaagaacatcactatcctggagctgccagatgaagtggtggtacccccaggggtgaccaacagttcctttcaggtgaccagccagaacgtggggcagctgactgtgtacctccacggcaaccatagtaatcagacggggccacgtattcggtttctggtcattagaagctcagcaatttctattattaatcaggttatcggctggatctatttcgtcgcttggtccatatctttctacccccaagtcattatgaattggaggagaaagagtgtgatcggtttgagctttgatttcgtcgcattgaatctgactggtttcgttgcgtactcagtgttcaacatcggccttctgtgggtgccttacataaaggaacagttcttattgaagtacccaaacggcgtgaatccagtcaattccaatgacgtgttcttctcactgcacgcggtcgtgcttacactaatcatcattgtccagtgttgtttgtacgaacgggggggtcagagggtttcatggccagctatcgggtttcttgtgcttgcctggctattcgcttttgtaacaatgatcgtagccgcggtaggcgttactacttggctgcaattcctcttttgttttagctacatcaaactagccgttacactcgttaagtattttcctcaggcctacatgaatttctattataagtccacagagggatggtcgatcgggaacgtgctgctggacttcacaggcggctctttcagtctgctccaaatgtttctccaaagttataataatgaccagtggacactcatcttcggagacccaacgaaatttggccttggggtattttccattgtgttcgacgtagtgttctttattcagcatttttgtctgtatcgaaaaaggcccgggtatgaccagctaaat

SEQ ID NO: 10318 - DNA, 1101 bp, Artificial Sequence
  Description of Artificial Sequence: Synthetic coding sequence
atgatcagaaactggctgaccatctttatcctgtttccattgaagctcgtggagaagtgtgagtctagtgtcagcctgactgtgcccccagtggtgaagctggagaatggctcttctaccaacgtttctctcaccttgcggccacctctgaatgcgactctagtgatcactttcgagatcacatttcggtccaaaaacatcacaatcctggaactaccggatgaagtggtagtgcctccaggagttactaactcttcatttcaggtgaccagccagaatgtcgggcaactgactgtgtatctacacggtaatcattccaatcagactggccctcgcatacggttcctggtgatccggagctccgctatctcaattatcaaccaagtgatcggttggatctactttgtcgcatggtctatctccttctatcctcaggtgatcatgaactggaggaggaaatccgtgatagggctatccttcgacttcgtcgctctgaaccttacggggttcgtcgcgtatagtgtgtttaatatcggcctgctgtgggtgccctacattaaggagcagtttctgctgaagtacccaaatggcgttaaccccgtgaacagcaacgacgtcttcttttctctccacgccgtggtcttgacgctgatcatcatcgtgcagtgctgtctgtacgaacgcggagggcagcgggtaagttggccagcaattgggttcctggttctggcctggcttttcgcattcgtgactatgatagtggccgcagtgggcgtgactacgtggctccagttcctgttttgcttctcctacattaagttggcagttaccctcgtgaagtacttcccgcaggcctacatgaacttctattataagtcaacggagggctggtcgatcggaaatgtcttgctcgacttcacagggggttctttttccttgctgcagatgttcctgcaatcatataataacgaccagtggaccttaatattcggagaccctaccaaattcggactgggcgtatttagcatcgtctttgacgtagttttctttattcagcacttctgcttgtacaggaagagacctggttatgatcagctgaac

SEQ ID NO: 10319 - DNA, 1101 bp, Artificial Sequence
  Description of Artificial Sequence: Synthetic coding sequence
atgattcggaactggctgaccattttcatcctgtttcccttaaaacttgtggagaagtgtgaaagcagcgtctcccttactgtgccacccgtggtaaaactggagaacggcagtagcactaacgtgagtttgaccttacgtccgcctctgaatgcaacattagtcattacatttgagataaccttccgcagtaaaaacatcacgatcctggaattaccggacgaggttgttgtcccacccggcgttaccaactcatccttccaggtgacctcccagaacgtgggccaactgactgtctatctgcatggcaatcacagtaatcagactggccccaggatcaggtttctcgtgattcgcagcagtgcgatatccatcattaatcaggtcattggctggatatacttcgtggcgtggtctatcagtttttatcctcaggtcattatgaattggagacgcaaaagcgtaattgggctcagttttgacttcgtggccttaaacctgaccggctttgtggcctattctgttttcaacatcggcctactgtgggttccatatataaaggagcagttcctgctgaagtacccaaatggcgtaaacccagttaattccaacgacgtgttttttagcttgcacgctgtagtcctcactctgattattatagtccagtgctgcctttacgagaggggcggtcagagggtgtcgtggcccgctatcggtttcctggtgcttgcctggctgttcgccttcgttactatgatcgtcgctgccgtaggagtgaccacttggctgcagttcctgttttgttttagttatatcaagttggccgtgacactggttaaatactttccacaggcttatatgaatttttactataagagtaccgagggctggtctataggaaatgtgctcctggacttcaccggcggctcctttagtctgctccagatgttcctgcaaagctacaataacgaccagtggaccttaatttttggcgatccaaccaagtttggcttgggagtattcagcatcgtgtttgatgttgtgttctttatccagcacttctgcctgtataggaagagaccgggatatgaccagctgaat

SEQ ID NO: 10320 - DNA, 1101 bp, Artificial Sequence
  Description of Artificial Sequence: Synthetic coding sequence
atgatccggaattggttgacaatcttcatcctattcccactgaagttagttgaaaaatgcgaatcttccgtctccctcacagtgccacccgtagtcaaactcgagaatggctcctcaactaatgtatcactgacgttacggccccccctgaacgcgactttggtgatcaccttcgagattacctttaggtctaaaaacatcactattctcgagcttcccgatgaagtggtggttcctccgggggttacgaactcctccttccaggtaacctctcagaatgtgggtcagctcactgtgtatttacacggcaaccactccaaccagacgggaccccggattcgatttcttgtgatcaggtcctccgctatttcaataattaaccaggtgataggctggatttattttgttgcttggagcattagcttttatccgcaggtgattatgaattggagaagaaagtccgtgatcggtctgagcttcgattttgtcgcccttaaccttaccggtttcgttgcttattctgtatttaacataggcctgctgtgggtgccctatatcaaggagcagtttctccttaagtatccgaatggtgttaatcctgtgaattcaaatgacgttttttttagcctacatgccgtggtcctgacgctgattatcatcgtacagtgttgcctgtatgaacgaggcgggcagagggttagctggcccgccatcggatttctggttctcgcctggcttttcgcatttgtcaccatgatagtggccgccgtcggggtgacgacctggttacagttccttttctgcttttcctacatcaaactcgcagttacactggtcaaatactttccacaggcctatatgaacttctattataaaagcactgaaggttggagcatcgggaatgtccttctggattttacaggagggtccttttccttactccagatgtttcttcagtcatacaataatgaccaatggacattaatttttggcgaccctacaaagtttggcctgggcgtgttctccatagttttcgatgtcgtattttttatccagcacttttgcctttacaggaagagacccggctatgatcagctgaat

SEQ ID NO: 10321 - DNA, 1101 bp, Artificial Sequence
  Description of Artificial Sequence: Synthetic coding sequence
atgattagaaactggctcactatcttcattctctttcctctgaagctcgttgaaaaatgtgagtcttcagtctctctgaccgtgccaccagttgtcaagttggaaaacggttcttctacaaacgtttcacttacactcaggccaccactcaatgctaccttggtaatcacctttgaaatcacattccgctcaaaaaacattactattctggaattgccagacgaggttgttgtgccaccgggcgtgaccaactcatccttccaggtaacgtctcagaacgtaggccagctcactgtctatttgcatggcaatcactcaaaccagactggacccagaatcagattcttggtgatccgcagttcagctattagcattataaaccaggtgattggttggatctactttgtggcctggtcaatcagtttctaccctcaggtcatcatgaactggagacgcaagtcagttatcggactctcttttgacttcgtggcactgaacctcaccggtttcgtggcttattctgtcttcaacatcggcctgttgtgggtcccatacatcaaggagcagttcctgctcaagtacccaaatggtgtaaaccccgttaactctaacgacgttttcttctccctgcacgccgtggtactgacgctcattataattgtacagtgttgcctgtacgagcgcggcggccaacgcgttagctggccagccattggttttttggttctggcctggcttttcgcatttgttacaatgatagtggcggccgtgggtgtgactacttggcttcagttcctcttctgcttcagttatataaagttggctgtgactctcgtgaagtacttcccacaagcctacatgaacttctactacaagtccactgagggctggagcattggtaatgttctgttggactttacaggtggttccttctctctgttgcagatgtttcttcaatcatacaacaacgatcagtggaccctgatctttggcgaccctaccaagttcggattgggagtcttctcaattgtgttcgacgtggtcttttttattcagcacttttgtttgtaccgcaagaggccaggatacgaccagcttaac

SEQ ID NO: 10322 - DNA, 1101 bp, Artificial Sequence
  Description of Artificial Sequence: Synthetic coding sequence
atgataaggaattggctgacaatcttcatactatttccgctcaaattggtcgaaaagtgcgaatcatcggtgagccttaccgtaccccctgttgttaaattggagaacggaagtagcaccaatgtgtcattgaccctcaggccccccttaaacgctaccctggtgattaccttcgaaattacatttcgctcaaagaacatcacaattcttgagctccccgacgaggtggtcgttcctcctggagttacaaacagctcctttcaagtgactagtcagaatgtgggtcaactgaccgtttacctccatggaaaccatagcaatcagaccgggccaaggatcagattcctggttatcagatcctcagccatttccattatcaaccaagttatcggctggatctatttcgtggcctggtcaatctccttttatcctcaggtgatcatgaactggcgaaggaagagtgtgatcggactgagtttcgattttgtggccctgaaccttacaggatttgttgcatatagtgtctttaacatcggcctcctttgggttccctacatcaaggaacagtttctcttgaagtatcctaatggcgtgaaccctgtaaacagtaatgacgtcttcttcagtcttcacgcagtggtgctcaccctgatcataatagtccaatgctgcctgtatgagagaggaggacagcgagtctcatggcctgcgattggcttcctcgtcctggcatggctgttcgccttcgtcacaatgatcgtggctgctgtgggagtcaccacctggctgcagtttcttttctgtttctcgtacatcaaactcgccgtgacccttgtgaagtattttccccaggcctacatgaatttttactacaaatctactgaaggatggtccataggcaatgtgctgctggacttcaccggaggttcgtttagtctgttacagatgttcctgcaaagctataacaacgaccaatggactttgatatttggggaccctaccaaattcggattaggggtcttcagcatagtgttcgatgtggtgtttttcatccagcacttctgtctgtatcgcaaaagaccaggttacgatcagctgaac

SEQ ID NO: 10323 - DNA, 1101 bp, Artificial Sequence
  Description of Artificial Sequence: Synthetic coding sequence
atgatcaggaactggcttacaatcttcatcttgttccccctcaagctcgtggagaagtgcgaatcatcagtgtcacttacagtcccaccagtcgtgaagctggaaaacggatcatccaccaatgtctctctgacacttagaccacctctgaacgccaccctggtgatcacattcgagataacctttcgcagtaagaatattacaattctggagctgccagatgaagtcgtcgttcctcctggtgtcacaaactcttccttccaagttacgtcccagaacgtgggacaactgaccgtctatctccatggcaatcactccaatcagacgggacccaggattcggtttctggtgatcaggtccagtgctatcagtattatcaaccaggtaatagggtggatttacttcgtggcttggtccatcagcttttatccacaggtgattatgaactggaggcgaaagtctgttataggacttagcttcgactttgtcgccctgaatctgacgggcttcgtggcgtacagcgtgttcaacatcgggttgctttgggtaccgtatataaaagagcagttcctcctgaagtatcctaacggagtgaatccagtgaattcaaacgacgtcttcttctctctccacgccgtggtgttgactctgattattatagtgcaatgttgcctgtacgagcgcggtggccagcgcgtcagctggcctgctattggtttcctggtgctggcttggctgttcgctttcgtcaccatgatcgtcgccgccgtaggggtgacaacttggctccagttcttgttttgctttagctacattaaattggcggtcacactcgttaaatactttccacaggcttacatgaacttctattacaagtccaccgaaggctggtccattggcaatgttctgttggattttacagggggaagcttttctctgctgcagatgttcctccagagctacaataacgaccagtggaccctgattttcggagatccaacgaaattcggactcggtgtgttttctatcgtgttcgacgtggtattcttcatacagcacttctgcctgtacagaaaaagacccggatatgatcagcttaat

SEQ ID NO: 10324 - DNA, 1101 bp, Artificial Sequence
  Description of Artificial Sequence: Synthetic coding sequence
atgatccggaattggctaactatttttatcctgttccctctgaagctcgttgaaaagtgtgagagttcagtgtcgctcaccgtgccccctgtggtgaagttggagaatggatccagtacgaatgtgtccttgaccctccgtcctcctctcaacgcgaccctggttataactttcgaaatcacttttagaagtaaaaatataaccatcctggagctgccagatgaagtggtagttccgccgggggtaactaactccagcttccaggtaacgtctcagaacgtcgggcaactcaccgtgtatctgcacggcaatcacagcaatcagacgggaccccggatacgcttcctggtcatacgatccagcgcgattagtattatcaaccaagtgataggttggatatattttgtggcatggtcgatctcattctacccacaggtgatcatgaattggaggcgcaaaagtgtcatcgggctttcgttcgacttcgtagccctgaatttaacgggcttcgtggcctattctgtttttaatattggtctactctgggtgccctatattaaggaacaattcctgcttaagtaccccaatggcgtgaaccctgttaacagcaacgacgtgttcttctccctgcacgccgttgtgttgacattaatcataattgtacagtgctgcttgtacgagagggggggccaaagggtgagttggccggctataggctttctagtcctggcatggctgtttgcttttgtcaccatgattgtggctgccgtgggagtcactacttggctacagtttttgttttgcttctcttacatcaaactggcagtgaccttggttaaatatttcccacaggcctatatgaatttctattacaagtctaccgaagggtggtcaatcggcaacgtgctgctcgatttcaccgggggctcattcagccttctacagatgttcctgcagtcatataacaacgatcagtggacgttgatctttggtgatcccaccaagtttggacttggcgtgttctccatagtgttcgacgtcgtcttttttattcagcatttttgcttatatcggaagagaccaggatacgatcagttgaac

SEQ ID NO: 10325 - DNA, 1101 bp, Artificial Sequence
  Description of Artificial Sequence: Synthetic coding sequence
atgattagaaattggttgaccattttcatactctttccccttaagctggtggaaaaatgtgaatcttctgtaagcttgaccgtgcccccggtcgtgaaactggaaaacggcagcagtaccaatgtgagcctgaccctcaggccgcccttaaatgctaccctggtgataactttcgagatcacgtttcggtctaagaatatcacaattctggagctaccagatgaggttgtggtcccaccgggggtcaccaacagctcctttcaagtcacgagccagaatgtgggacagctgacggtctacctccatggaaatcattcaaatcaaactggtccacgcatcaggtttttggtcatcagatcttcagctattagcattatcaaccaggtgatcgggtggatctattttgtcgcgtggagcatctccttctatccccaggttatcatgaattggcgacgtaaatcagtgatagggttgtcgttcgacttcgtcgcgttaaatcttaccggcttcgttgcatacagcgtgtttaacattggcctgctgtgggttccgtatattaaggaacagttcttgctaaaataccccaacggagtgaacccagtcaactctaatgacgtcttcttttcccttcacgccgtggtccttactttgataatcatagtgcagtgctgtctgtacgaaagaggcgggcagagagtttcatggcctgctatcggatttttggtcctcgcgtggctctttgcgttcgtcacgatgattgtagcggctgtgggggtgaccacctggcttcagtttctgttctgtttttcctatatcaagcttgcggtcaccctggtgaagtacttccctcaggcttacatgaatttttactataaatccactgagggctggtccatcggcaacgtgttgctcgattttactgggggttcctttagcttactgcagatgttcttacagtcctacaataatgaccagtggaccttgattttcggcgatcccactaaatttggtcttggagttttctcgatagtgtttgatgtggttttttttatccagcacttttgtctttatcgtaaacgtcctggctatgaccagctcaac

SEQ ID NO: 10326 - DNA, 1101 bp, Artificial Sequence
  Description of Artificial Sequence: Synthetic coding sequence
atgattaggaactggctgaccatctttatactgttccctcttaaactcgtagagaaatgcgaatcctcagtctctcttaccgtgcccccggtggtgaaactggagaatggatccagcaccaacgtctcattaaccttaagacctcctttgaacgccaccctggtcataacctttgaaattacctttagatcaaagaatattacaattctcgagctccccgacgaggtggtcgtgcctccaggtgtcacaaatagttcgtttcaggttacaagccagaacgtgggacagttgacagtctacctccacgggaatcactccaaccagaccggcccgaggatccggttcctggtcattcgcagcagcgctattagcataattaaccaggtgatcggttggatctatttcgtggcatggagtataagtttttatccccaggtaatcatgaactggagaaggaaaagcgtaatcggcctgtcatttgattttgtggcactgaacctgactggattcgttgcctattcggtgttcaacataggcctgctgtgggtgccgtacattaaagagcagttcttattgaaatatccaaatggagtgaatcccgtgaactcaaatgatgtgtttttttcccttcatgcagtggttctgacattgattattatcgttcagtgttgtctgtatgaaaggggagggcagcgtgtgagctggccagctatcgggttccttgtcttagcatggttattcgcattcgtgacaatgattgtagccgctgttggagtgaccacttggttgcagttcctgttttgtttctcatacattaagcttgcagtgaccctagttaagtattttcctcaggcctacatgaatttctactataagagcactgaaggctggtctatcggcaacgtcttgctcgattttacagggggtagcttcagcctcctgcagatgttcctccagtcatacaacaatgatcagtggacgttgatcttcggagatccaaccaagtttggacttggcgtgttcagtatagtttttgacgtggtatttttcatccaacacttttgcttgtatagaaaacggccaggctatgaccaactgaat

SEQ ID NO: 10327 - DNA, 1101 bp, Artificial Sequence
  Description of Artificial Sequence: Synthetic coding sequence
atgatccgaaattggcttactatatttattctgtttccactcaagttagttgaaaaatgcgagagtagtgtgtccctcacagtacctccagtggtgaagctggaaaatggttctagcacaaatgtgtcgctgacgctgaggccccctctgaatgcgacgctggtcataacgtttgagatcacttttcggtccaaaaatatcaccattctcgagctgcctgatgaagtcgtggtccctcccggcgtgacaaattcaagtttccaggtgacatcacaaaatgtcggacagctaacggtgtacctgcacggaaaccactctaatcagacgggaccccgtataagatttctggtgatccgaagctccgctattagcattattaaccaggttatcggatggatctactttgtcgcttggtctatatctttctatcctcaggtgattatgaattggcggcggaagagcgtgatcggcctgtcattcgacttcgtcgccctcaatctaactggctttgttgcctatagcgtcttcaacattgggctgttgtgggtgccctacatcaaagagcagtttctgctgaagtaccccaatggggtgaaccctgtgaactccaacgacgtgttcttctccctgcacgcggtcgtattgacgctgattattatcgtgcagtgttgtctatatgaaaggggtggccaacgcgtaagttggccagccataggcttcttggtcttagcttggttgtttgccttcgtcacaatgattgtggcagctgttggcgtaacaacatggctgcagttcctgttttgtttctcctatatcaaactcgcagtgactctcgtgaaatacttcccacaagcctacatgaacttctactacaaatcaactgagggctggagcataggaaacgtactgctcgactttaccggggggtccttcagtcttttgcagatgtttctccagtcatacaataatgaccagtggactcttatcttcggggatcctacaaagttcggactgggagttttttcgatcgtgttcgacgtcgtgttttttatccagcacttctgtctctacaggaagcgcccggggtatgatcaattgaac

SEQ ID NO: 10328 - DNA, 1101 bp, Artificial Sequence
  Description of Artificial Sequence: Synthetic coding sequence
atgattagaaactggttaactattttcattttattcccacttaaattagttgaaaagtgtgaaagttcagtttcattaacagtaccaccagtagtcaaacttgaaaatggatctagtacaaatgtttctttaacacttcgaccaccacttaatgctactttagtaattacatttgagattacttttagaagtaaaaatattacaattttagaattaccagatgaagttgttgttccaccaggtgttacaaattcatcatttcaagtaacgtcacaaaatgttggacaattgacagtttacttacatggtaatcatagtaatcaaacagggccaagaatacgttttttagttattagatcttcagccatttcaattattaatcaagttattggatggatttattttgttgcatggtctattagtttttatcctcaagttattatgaattggcgtagaaaatcagttatcggtttatcatttgattttgttgcattaaatttaacgggatttgttgcttatagtgtttttaacattggacttttatgggttccatatattaaagaacaatttttgttaaagtaccctaacggagtaaatccagtgaatagtaatgatgtttttttttcacttcatgctgtagttttaactcttattattattgtacaatgttgtttatacgaaagaggtggacaaagagtttcatggccagctataggtttccttgttcttgcttggttatttgcatttgtaactatgattgtagctgcagttggagtaactacatggcttcaattcttattttgtttctcatatataaaacttgcagttacactcgttaaatattttcctcaagcttacatgaatttttactataaatcaaccgaaggatggtcaataggaaatgttttattagattttactggaggatcatttagtcttttacaaatgtttttacaatcatataataatgatcaatggacattaatattcggagatccaacaaaatttggtcttggagttttctctattgttttcgatgtagtttttttcattcaacatttttgtctttatcgaaaaagaccagggtatgatcaattaaat

SEQ ID NO: 10329 - DNA, 1101 bp, Artificial Sequence
  Description of Artificial Sequence: Synthetic coding sequence
atgatccgcaactggttgacaatctttatcctgtttcccctcaagctggtcgagaagtgcgagtcttccgtcagtctgacagttcctcccgtggtcaagctggaaaacggttcctccaccaacgtttctctgacactgcgccccccacttaacgccacactggtgattacctttgaaatcaccttcagaagtaagaatattaccatcctcgagttgcctgatgaggtggtcgtaccccctggcgtgaccaactcttcctttcaggtcactagccaaaacgtcggccagttgaccgtgtacctgcatggaaatcactctaatcagaccggccctagaatacgctttttggtgattcgctccagtgccatcagcataattaaccaagtgatcggctggatctacttcgtcgcatggagcatttcattttaccctcaagtgatcatgaattggcgtcgtaagtccgtcatcggtctgtccttcgacttcgtcgccttgaaccttactggctttgtcgcttacagcgtgttcaacattggtctcctttgggtgccatatattaaggaacagtttctgttgaagtaccctaatggagtgaatcccgtcaatagcaacgatgtcttcttcagccttcacgctgtcgtcttgacacttataatcatcgtacagtgttgtctttatgaaaggggcggacagagggtctcatggcccgccattggattcttggtgctggcctggctgttcgcttttgttaccatgatcgtggcagctgtgggtgtcacaacttggctccagtttcttttttgcttctcttacatcaagctggcagtgactttggtgaaatacttccctcaagcatacatgaacttctactataagagcactgaaggttggtccatcggcaatgtgctgttggattttacaggcggaagtttctctctgctgcaaatgtttttgcaatcttataacaacgaccagtggactctgatatttggtgaccctaccaaattcggacttggtgtatttagcatcgtattcgacgttgtgtttttcattcagcatttctgcctctacagaaaacgccccggatacgaccaactcaat

SEQ ID NO: 10330 - DNA, 1101 bp, Artificial Sequence
  Description of Artificial Sequence: Synthetic coding sequence
atgatccggaattggttaacaatttttatcctgtttccactcaagcttgtggaaaagtgcgagtcaagcgtttcgctcactgtccctccggttgtaaagcttgagaacggttcgtcaaccaacgtgtcattgactttgaggcctccactcaatgctacactggttataacgtttgaaattacttttcgttcgaaaaatattaccatccttgaattgcccgatgaagtcgtcgttcctcctggcgttacaaactcctcgttccaagtcacctctcagaatgtcggtcaacttacagtttacttgcatgggaatcacagcaaccaaactgggcctcgaatcaggttcttagttattcgttcttctgctatatcgatcataaatcaggtcattggttggatatacttcgttgcttggtcaatatccttctaccctcaggttataatgaattggagaaggaagtccgtcatcggtctgtccttcgacttcgtcgctctcaacttgacgggcttcgtcgcctatagcgtgtttaacatcggtctgctttgggttccctacataaaggaacaatttctgctcaagtatcctaacggtgtgaatccagtgaattctaatgacgtttttttttccttgcatgcggttgttcttacccttattatcattgtgcaatgctgcctttatgaaagggggggacagagggtatcgtggcctgctataggatttctagtgcttgcatggcttttcgcttttgtcactatgatcgttgctgccgtcggggttactacttggttacagtttcttttttgcttctcttatatcaaactggctgtcaccctagtcaaatatttcccccaagcatatatgaacttttactacaaaagtacagaaggctggtcaatcggcaatgttctgttagacttcactggcgggagtttctcgttgcttcagatgtttctccaaagctataataatgatcagtggacacttatctttggagatcctactaagtttggtcttggcgttttttccattgtttttgatgtggtcttctttatccaacatttctgcctttataggaaacgtccaggatatgaccagttgaac

SEQ ID NO: 10331 - DNA, 1101 bp, Artificial Sequence
  Description of Artificial Sequence: Synthetic coding sequence
atgattcgtaactggctcacaatcttcattctctttccactgaagctggtggagaaatgcgagtctagcgtttcactaactgtgccacccgtcgttaagctggagaacggatctagtacaaacgtgtccctaaccctgaggcccccactaaatgctaccttggtgataaccttcgagattacattcaggagcaagaatataaccattctcgagcttcctgatgaggtagtcgtacccccaggtgtgactaactctagctttcaggtgacctcacagaacgtcgggcagttgaccgtctacctgcatgggaatcactcaaatcaaacaggaccccggatccggtttctggtaatcaggagttcagcgattagtatcatcaaccaggtgattggttggatctatttcgtggcgtggtctatctccttttacccacaagttatcatgaactggaggaggaaatccgtcattggcctgtcctttgattttgtggcccttaacctgacaggattcgtggcctatagtgtgtttaatatagggctgctttgggtaccgtatatcaaagagcagttcctactgaaatatcccaacggagtaaatcctgtaaactccaatgacgtgtttttttcgttgcatgccgttgtcctgaccctgatcattatcgtgcagtgctgcctgtacgaaaggggaggacagagggtttcgtggccagctatcggttttttggtgttggcatggctgtttgccttcgttactatgattgtcgctgcagtcggggtgaccacctggctgcagtttctgttctgcttctcttacataaaactggccgtgactctcgtcaagtatttcccccaggcttacatgaacttctattataagtctaccgagggatggagtataggcaatgtgcttctggatttcacaggcgggagctttagcctcctacaaatgtttctacaatcatataacaatgatcagtggacactgatttttggtgatccaacaaaatttgggctaggcgtcttcagtatcgtgttcgacgtcgtctttttcattcagcacttctgtctttaccgcaagcgccccggatatgaccaactgaat

SEQ ID NO: 10332 - DNA, 1101 bp, Artificial Sequence
  Description of Artificial Sequence: Synthetic coding sequence
atgatccggaattggctgactatttttatcctgttccctcttaaactcgtggaaaagtgcgagtcgagcgtgagcctcaccgtgccgcctgtcgtgaagctggaaaacggatcatctacgaacgtgagccttactctgcggccgcccctgaatgcgactctggtgattactttcgagatcaccttccgctcaaagaacatcacgatcctggaactgccggacgaagtggtcgtcccgccgggagtgacgaacagctccttccaggtcacttcccagaacgtggggcagctgactgtttacctgcacggcaatcatagcaaccagaccggacctcgcatcagattcctcgtgatcaggtcgagcgccatctcgattatcaatcaagtcatcgggtggatctattttgtggcatggtcaatcagcttttacccgcaagtgattatgaactggcgccgaaagtcggtgataggattgtcgttcgacttcgtggctttgaacctcactggattcgtggcatactccgtctttaacatcggactgctgtgggtgccctatatcaaggagcaattcctgctgaaatacccaaacggagtcaacccagtgaactccaatgatgtgttcttttccctgcacgccgtcgtgctcaccctcatcattatcgtgcagtgctgtctctacgagcggggaggacagagggtgtcatggcctgcgatcggtttcctcgtcctcgcctggctgttcgctttcgtaaccatgatcgttgcggccgtgggtgtgactacttggctgcagttccttttctgcttctcctacatcaaattggccgtcaccttggtgaagtactttccacaggcatacatgaatttctactacaagtcgaccgaaggttggtcaattggcaatgtccttctggactttaccggcggctcgttctcgctgctccaaatgttcctgcagtcttacaataacgaccaatggaccctgatcttcggagatccaaccaaattcggattgggggtgttctccatcgtctttgatgttgtgttcttcatccagcatttttgcctctacagaaagcgcccgggctacgaccaactcaac

SEQ ID NO: 10333 - DNA, 1101 bp, Artificial Sequence
  Description of Artificial Sequence: Synthetic coding sequence
atgattagaaactggttgacgatcttcattttgttccccctaaagttggtagaaaaatgcgagtcctccgtcagtctgactgtccctcctgtggttaagttggagaacggttcatctaccaacgtgtccttaacgttgcgacctcccttgaacgccactctggtgatcacatttgagatcacctttcgcagcaagaatattacgatcctagagttaccagatgaggttgttgttccgcccggcgtgaccaacagcagtttccaggtgacgagtcagaatgtgggacaattgactgtttatttgcacggtaaccattctaaccaaaccggcccaaggatccgctttctggtgatccgatccagtgccatctccatcatcaaccaggtcattgggtggatatatttcgtagcctggtccatctcgttctatccccaagtgattatgaattggcgaaggaaatctgtcataggcctgagcttcgatttcgtggctttgaacctgactggcttcgttgcgtactcagtgtttaatatcggtctcctgtgggtgccttacatcaaagaacagttcctgctgaaatatcctaatggagtgaatcccgtcaactctaacgacgtctttttttctcttcatgcggtggtcttaactctcataatcattgtccagtgctgcttgtacgaacgtggcgggcagagggtgtcatggccagcgatcggattcttggtcctcgcctggctatttgcgtttgtcacaatgattgtagcagccgtcggcgtgaccacgtggctgcagtttcttttttgtttcagttacatcaaactcgccgtcaccctcgtcaagtacttcccacaggcttatatgaatttctattacaagtcgacagagggttggtcaatcggtaacgtcctgctggacttcactggcggctccttcagtctgctgcagatgtttctgcagtcctacaacaacgatcagtggactctgatattcggagaccctaccaagttcggcctcggtgtcttttctattgtgtttgatgtggttttctttatccagcacttttgcctttaccgcaagcgtccaggatacgatcaactgaac

SEQ ID NO: 10334 - DNA, 1101 bp, Artificial Sequence
  Description of Artificial Sequence: Synthetic coding sequence
atgatccggaactggctgaccatttttattctgtttcccctcaaactagtcgagaaatgcgaatcaagcgtgtcacttactgtccctccagttgtgaaactcgaaaacggaagctccacaaatgtcagtctgacgttacggccacctttgaatgctacactggtaataaccttcgaaattacgttccggtcaaagaacataactatattagaacttccggatgaggtggtagtgccaccaggcgtcacaaatagctcttttcaggttaccagccaaaacgttgggcagttaactgtctatctccacggtaaccactcgaatcagaccggtccaaggatcagattcttagtcattaggtccagcgcgatatctatcatcaaccaggtcatcggttggatttacttcgttgcatggagcatcagcttttatccccaggtgatcatgaattggcgtcgcaaatcagtcatagggctatcctttgactttgtcgctctaaacctgactggcttcgttgcatatagtgtattcaatattggtctgctctgggtgccatatattaaggagcagtttttattaaagtatcctaacggagtcaatcccgtaaactccaatgatgtttttttcagcctgcacgcggttgtgctgacgctgatcataatcgtccagtgttgcctgtatgagagaggagggcagcgagtgtcctggcccgccatcgggttcttggtgctggcctggctgtttgcttttgtgactatgatcgtcgccgccgtgggcgtgacaacatggcttcagtttctgttctgtttttcctacatcaagttggccgtgaccctggtgaagtattttcctcaggcatacatgaacttctattataaatccacagagggatggagtattggcaacgtcctgctggattttacaggcggaagtttttcacttctacagatgtttttgcagtcttacaataacgaccagtggacactaatcttcggtgatcctacgaagtttgggctgggggttttttccattgttttcgatgtggtgttcttcatacagcatttttgtctttacagaaagagacccggctacgaccaattgaac

SEQ ID NO: 10335 - DNA, 1101 bp, Artificial Sequence
  Description of Artificial Sequence: Synthetic coding sequence
atgatccggaactggctcacgattttcatcctcttccctttaaaactggttgaaaagtgcgagagctccgtgagcctcacagtaccccccgtcgttaagttggaaaacgggagtagtaccaatgtgtccttgacactgcgtccaccgctgaacgcaacgcttgtgatcacattcgagataaccttccggtcgaaaaacatcaccatcctggagctgccggatgaagtagtcgtgccccccggtgttacaaactcctcgttccaagttacctctcagaatgtgggacagctaactgtgtacctgcacggaaaccacagtaatcagaccggtccgagaattagattcctagtgatccggagtagtgcgatctccatcataaatcaagttattggatggatttacttcgtggcctggagcatctctttctatccgcaggttataatgaattggcgccggaagagtgtcatcggattgagcttcgacttcgtcgcactaaacttgaccgggttcgtcgcttacagcgtgttcaatattggactgctgtgggtgccttatatcaaggaacaattcctgttaaagtaccccaacggcgtaaatccggtgaacagcaacgatgtattcttctccttgcatgccgtggtgttgactctgattattatcgttcagtgctgcctctatgagagaggcgggcaaagggtttcctggccagctattggcttcctcgtgctcgcgtggcttttcgcatttgttaccatgatagttgccgctgtcggtgtgacaacctggttacagttcctgttttgcttctcttacattaagctagccgtcacactcgtgaagtatttccctcaggcatatatgaatttctactataagagcactgaaggctggtctattggcaacgtgctgctcgactttacagggggttccttttcccttctccagatgttcttacagagttacaacaatgatcagtggacgctcattttcggggatcccacaaagttcgggctaggagtgttttccattgtctttgacgtggtgttttttattcaacacttttgtctttacagaaaacggccggggtacgatcaactcaat

SEQ ID NO: 10336 - DNA, 1101 bp, Artificial Sequence
  Description of Artificial Sequence: Synthetic coding sequence
atgatacgtaactggctgacaatatttattctcttccccctaaaactagtggagaaatgcgagtctagtgtgagtctcacagtgccacctgtcgtgaaactagagaatggatctagtacgaatgtgtccttgactctgcgcccacctctgaatgctacactagtgattacatttgaaataacatttaggtcaaaaaacataacaatactcgaactccccgatgaagtggtagtaccccctggggttactaactcttcatttcaggtgacatcccagaatgttggacagttaactgtttacctccatgggaatcattctaatcagacaggacccagaatcaggtttttagtgatccgctcttccgccatatcaatcataaaccaagtgattggatggatatattttgtcgcttggtctatctctttttatccacaggttataatgaactggaggcgcaaatcggttatagggctctcatttgatttcgtggcactgaatctcacagggttcgtggcctattctgtgtttaatattgggttgctttgggtaccctatataaaggaacagtttctactcaaatatccaaatggggtaaatccagtgaattcaaacgatgttttcttctccctgcacgccgtcgttctgactctcatcattatcgtacaatgttgcctttatgaacgaggaggacagcgggtgtcctggcccgccatagggttccttgttctcgcttggctcttcgcgttcgtcacaatgatagtggccgcagtcggagtgacaacttggctgcagtttcttttctgcttttcctatatcaaactcgcagtgacactcgtaaaatattttccacaggcatacatgaacttctattataaatcaacagaaggatggagtatagggaacgtgctcctagatttcacagggggatctttctcgctgcttcagatgttcttgcagtcttataataacgatcagtggactctaatattcggagacccaactaaatttggattaggagtatttagtatagtatttgatgtggtgttctttattcagcacttctgtctctacagaaaacggcccggatacgatcagttgaat

SEQ ID NO: 10337 - DNA, 1101 bp, Artificial Sequence
  Description of Artificial Sequence: Synthetic coding sequence
atgattcgtaattggcttacaatttttattttattcccgttaaaattagttgagaaatgcgagtcatccgttagtttaacggtaccgcctgttgtcaaactcgaaaacggctctagcacaaacgttagccttactttacgcccccctctgaatgcaacgttggtgattacatttgagattacattcagaagcaagaacatcacaatattagagctaccggacgaggttgtagtcccgccaggcgttacaaatagttcttttcaagtaacatcacagaatgtgggccagctgactgtgtatcttcatggcaatcactctaatcaaaccggcccgcgcattcgttttcttgtaatacgttcctctgccataagcattatcaatcaggtgattggttggatatactttgtcgcttggtcaatctctttttatccgcaagtgataatgaactggcgccggaagtccgttattggactttctttcgattttgtagccttgaatcttacgggcttcgttgcctattcagtattcaacatagggctgctgtgggtgccgtatattaaagaacagtttcttctgaaataccctaatggagttaaccctgtgaattctaacgatgtatttttcagccttcatgccgtcgttctgacgttaattatcatcgttcaatgttgcttgtacgaaaggggggggcaacgtgtatcttggccagctatcggcttcctggtccttgcttggttatttgcattcgtgaccatgattgtcgctgcggttggggtaacaacgtggcttcaatttttattttgtttctcatatatcaagcttgccgtaactcttgtgaaatattttcctcaggcttatatgaatttctactacaaatcaactgaagggtggtcaattggtaatgttctgttagattttacaggaggaagtttttcccttttacagatgtttttacaatcttacaacaacgatcagtggacactgatttttggggaccctactaagtttggattgggagtattctcaatcgtcttcgatgtcgttttttttattcaacatttctgcctttatcgaaaaagacctggctatgatcagctcaat

SEQ ID NO: 10338 - DNA, 1101 bp, Artificial Sequence
  Description of Artificial Sequence: Synthetic coding sequence
atgattcggaactggctgactatcttcatcctgttccccctgaagttggttgaaaagtgtgagtcgtcagtatctctgaccgtcccaccagtggtgaagctagagaatggatcctccaccaatgtgtcgttgacccttcggccccccttaaatgcaacactggtaataaccttcgaaataacattccgttctaagaatatcaccatcttggaattgcctgacgaagttgtagtaccccccggtgtgacgaactcctcgttccaagtgactagccagaatgttgggcagctcactgtgtacctacatggcaaccatagcaatcagaccggtccacggatcaggtttctggtgattcggtcctccgccatctcgattattaatcaggtgattggttggatctacttcgtggcatggtccatatctttttatcctcaggtgataatgaactggcgcaggaagtccgtcattgggttgtctttcgatttcgtggccctcaacctgacaggcttcgtggcttactcagtttttaacataggcctcctttgggtaccgtacataaaggaacagttcctactcaagtaccccaatggcgtgaaccctgtgaattcaaacgatgttttttttagcttacatgctgtagtcttgaccctgattatcatcgtacagtgctgcctgtacgagcgagggggccaacgcgtgagttggccggcaattgggtttctggtgctggcctggctgtttgcgttcgtgacaatgatagtggcagctgtcggtgtgaccacctggttacagtttttgttctgcttcagttatatcaagctagccgtgacactagtcaaatatttcccccaagcctacatgaacttctattacaagagtactgagggctggtccattgggaatgtattgctagattttaccggcggcagcttttccttactgcagatgttcttgcagtcctacaacaatgatcagtggacccttatcttcggggaccctacaaaattcggtctcggagtgttctccatcgtatttgacgtggttttctttattcagcatttctgcctctatcgcaagcggcccggatatgatcagttaaat

SEQ ID NO: 10339 - DNA, 1101 bp, Artificial Sequence
  Description of Artificial Sequence: Synthetic coding sequence
atgatcagaaactggcttactatcttcatattgttcccactcaaactggtcgaaaaatgcgagtcctccgtaagtctcacagtgccacccgtagttaaactggagaacggaagctccactaacgtgagtctcacactgcggccacccctgaatgctactttggttattacctttgaaatcaccttccggtcaaagaacatcactatcctggaactgcccgacgaggttgtggtccctcctggagtcacaaactcttccttccaggtcacaagccaaaacgtcggacaactcacagtgtatctccacggtaatcactctaaccagacgggccctcggatacgatttctggttattaggtcttccgccatcagtattatcaatcaagtcattggttggatctactttgttgcctggtctatcagtttctacccccaagtgatcatgaattggcgcaggaaatccgtcatcgggctgagttttgattttgtggcactcaatttgaccgggttcgtggcttatagcgtctttaacatcggcctcctgtgggtcccctatataaaagaacagttcctgttgaaataccctaatggggtgaatccagtgaactccaatgatgtgttcttctccttgcacgcagtggtgctcacattgataatcatcgtgcagtgctgtctgtacgaaagaggaggccagcgggtgagctggcctgcgattggctttctggtactggcatggctgtttgcctttgtcactatgatcgtcgcagctgtgggcgttactacctggctccagtttttgttctgcttctcttatattaagctggcagtaaccctggtgaaatattttccccaagcctatatgaacttttactacaaatccaccgagggttggagcataggcaatgttctgctcgactttactggcggctctttttccctcctgcagatgttcctccaaagttacaacaatgatcaatggaccctgatttttggggatcccactaagttcggactcggagtattcagcatcgtgttcgatgtcgtttttttcatccaacacttctgcctctacaggaaacggcctggttacgatcagttgaat

SEQ ID NO: 10340 - DNA, 1101 bp, Artificial Sequence
  Description of Artificial Sequence: Synthetic coding sequence
atgatccggaactggctgaccatcttcatcctgttcccactcaagctggtcgaaaagtgtgagtcttccgtgtcgctaactgtgccaccagtggtgaaacttgagaatggcagcagcaccaacgtgagtctaacactgcgccccccgcttaatgctacattggtgatcacgtttgagatcaccttccgctctaaaaacattaccatcttggagctgcccgacgaggttgtggttcctcctggtgtcaccaattctagcttccaggttacatcccaaaatgtaggtcagctgacagtctatctgcacggcaatcattccaaccagaccggcccccgtatccggttcttggtgatcaggagttccgccatctccatcattaaccaggtcattggctggatttacttcgttgcttggtcaatatcattttaccctcaggtgattatgaactggagacggaagtcagtcataggactatccttcgactttgtggcactcaacttaacaggtttcgtggcttacagcgtatttaacattggcctgctttgggtgccctacattaaagagcagttcctgctgaagtatcctaacggagttaatccagtcaattctaacgacgtgtttttttccctgcacgccgtggtgctgacactgatcatcatcgtgcagtgttgcctctacgaacgaggcggccagcgagtaagttggccagccatcggtttcctggttctggcctggctgttcgctttcgtgaccatgatagtggccgccgttggggtgacgacctggctgcagttcctgttttgtttctcctacattaagctcgcagtgacccttgtcaagtatttcccacaggcttacatgaacttttactataagtcgacagaaggctggagcataggtaacgtgctgctggatttcaccggagggagcttcagcctactgcagatgttccttcaatcctataacaatgaccaatggacacttatctttggcgatcccacaaaattcggactcggcgtgttctcaatcgttttcgatgtggtgttcttcatccagcacttttgtctgtatcggaagcggccaggttatgatcaactcaat

SEQ ID NO: 10341 - DNA, 1101 bp, Artificial Sequence
  Description of Artificial Sequence: Synthetic coding sequence
atgattaggaattggctcactatcttcattctgtttcctctgaaactcgtggaaaagtgcgagagctccgtgtcactaaccgttccacctgtggttaagctggaaaatggctcttctacaaacgtttccctgaccctcagaccccctttgaatgctacccttgttattacttttgagattacgttcaggagtaaaaacattaccatactggagcttccggacgaggtggtggtgccacccggtgtaactaattctagctttcaggtgacatcacagaatgtcgggcagttgactgtgtatcttcatggtaatcacagcaatcagacagggcctcggatccgttttctcgtgatccgctccagtgccatctctatcatcaatcaggtcatcggctggatctattttgtggcatggagcatttccttttacccacaggtcattatgaattggaggaggaagtccgtcatcggcctgagctttgatttcgtggctctgaaccttaccggcttcgtggcttactcggtgttcaatattggtcttctgtgggtgccctacatcaaggaacaatttctcttgaagtaccccaatggggtgaatcctgtgaactcaaacgacgttttcttttccctccacgctgtcgtcctgactctgataatcattgtgcagtgctgcctgtatgagaggggcggccagagagtgtcgtggcccgcaataggttttctggttctcgcatggctgttcgccttcgtcacaatgattgtagctgccgtgggggtaactacttggctgcagttcctgttttgtttttcttacatcaagcttgctgtcacactcgtgaaatacttcccccaagcctacatgaatttttattacaaatccacagagggttggagcatcggcaacgtactgctggactttaccggcggttctttctccctgctgcagatgtttttgcagtcctataacaatgatcagtggacactaatctttggtgatccgaccaagtttggactaggtgttttctcaatcgtcttcgatgtggtgtttttcatccagcatttttgtctctaccgtaagaggccaggctatgaccaactgaac

SEQ ID NO: 10342 - DNA, 1101 bp, Artificial Sequence
  Description of Artificial Sequence: Synthetic coding sequence
atgataaggaactggctgacaattttcatcctgtttccgttgaaactagttgagaagtgcgaatcctcagtttctctgaccgttccccccgtggttaagctagaaaacggctcatctactaatgtctccctcacgctgaggcctccgctcaacgccacccttgtgatcacatttgagatcacttttcgatccaagaacatcaccatactcgagctcccggacgaggtcgtcgtcccaccaggtgtgacgaattcttccttccaagtgacttcccagaatgtgggacagctgacagtttacctccatgggaaccatagcaaccagaccgggccgcggatccggtttctggtcatccgatccagcgcaatttccataattaaccaagttattggctggatttattttgtggcctggagtatttccttctatccacaggtaatcatgaattggcggcgcaagagtgttatcgggctttccttcgatttcgttgccctcaacctgacaggattcgtcgcctacagtgttttcaacattgggttgctgtgggtgccctatatcaaagaacagtttctgctcaaataccccaacggggtcaaccccgtgaacagtaatgatgtgttcttttccctgcatgccgtggtgctgaccttgataatcatcgtccaatgttgcttgtacgaaaggggagggcagagggtcagctggcctgccattggattcctagtgctcgcgtggcttttcgcattcgtgaccatgatcgtggctgccgttggcgtgaccacttggctccaattcctcttctgtttctcttacattaagctcgccgtgactctagtgaagtatttcccacaagcttatatgaatttttattacaagagcaccgagggctggtccatcggaaacgtgctgctggacttcacgggcgggtctttctcactgctgcagatgtttctgcagtcttataataacgatcagtggactctgatattcggagacccgactaagttcggcctgggggtattcagcatcgtgttcgatgtggtctttttcatccagcacttttgcctgtatcggaaacgtccgggttatgaccagcttaac

SEQ ID NO: 10343 - DNA, 1101 bp, Artificial Sequence
  Description of Artificial Sequence: Synthetic coding sequence
atgatacgaaattggctgacgatcttcatattgttcccgctaaagctggttgaaaaatgtgagagtagtgtaagcctaactgtgccacctgtggtgaagttggagaacggaagcagtactaacgtgagtctgacattgaggccacccctgaacgccacactggtgattaccttcgagatcactttccgctctaagaacattacgatcctggagctgccagacgaggtggtggtaccacctggagtgaccaactccagcttccaggtcacttcccagaatgtaggtcaactgacagtgtaccttcatggcaatcactcaaaccaaactggcccacgcattcgatttctcgttatacgctcatcagcaatttccattatcaaccaggtaatcggttggatatatttcgtggcgtggtcgatcagtttctatccgcaggtgatcatgaattggagacgcaagtccgttattgggctgtcatttgacttcgtggcgctgaatctgactggtttcgtagcatattcggtgttcaatataggcctactgtgggtgccctacatcaaggagcagttcttactgaagtaccccaatggtgtgaatcccgtgaactcaaacgatgtcttttttagcctgcatgcagtcgtgctaactctgatcattattgtccagtgctgtctttacgagagggggggccagcgcgtgtcctggcccgccataggatttttggtgctcgcgtggctatttgctttcgtaaccatgatcgtggccgccgtcggtgtcactacatggctgcaattcttgttttgcttctcctatattaagctagcggtgaccctggttaaatacttcccccaggcctatatgaatttctactacaaatcaacagaagggtggtctatcggaaacgtgcttctagatttcaccggcgggagcttttctttgttacaaatgtttctgcaaagttataacaatgatcagtggaccctgatcttcggggaccccactaaattcggtctgggcgtgttctctattgtttttgacgttgtgttctttatccagcatttctgtctctacagaaaacgaccaggctacgatcagcttaac

SEQ ID NO: 10344 - DNA, 1101 bp, Artificial Sequence
  Description of Artificial Sequence: Synthetic coding sequence
atgatacgcaactggttaacgatctttatcttattccccctgaaacttgtggaaaagtgcgagagttccgtctccctgacagttccccccgttgtgaaactggagaatgggtcctcaaccaatgttagcctgacactgagacctccattgaacgctactctcgttatcacctttgagatcacgttccggtcgaagaatattacaatactcgaactcccagacgaagtggtagtgcccccgggcgtgacgaacagttcgtttcaagtaacctcccagaacgttggccagctgaccgtgtatctgcacggaaatcatagcaaccaaaccggacccaggattcgatttctcgtcatcaggtccagcgccatttccattatcaaccaggtaataggctggatttactttgtggcctggagcatctcgttttacccacaagtaatcatgaactggagaaggaaatctgtcataggtctgtcgttcgattttgtcgcactgaatctgaccgggttcgtagcctattctgtttttaacatcgggctgctgtgggtgccatatatcaaggagcagtttcttttgaaatatcctaacggcgtgaaccccgtgaatagcaacgatgtctttttctccctccacgctgttgtccttacgctgattatcattgtgcagtgctgcctgtatgagcggggaggacagagggtctcatggccagccataggatttctggtcctggcctggctgttcgccttcgtcacaatgatagtagcggcggtgggagttactacctggctacagtttcttttttgcttctcttacatcaagttggcagtcacactggttaaatacttcccgcaggcttacatgaatttctactacaaatctacggagggctggtccattgggaacgtgctcttggactttaccggtggcagcttctcactgctgcagatgtttcttcagagttacaataatgaccagtggacactaatatttggagatcccacaaaattcggcctgggtgtattttccattgtttttgatgtggtcttctttatccagcatttttgcctgtatagaaagcgcccgggttacgaccaactgaac

SEQ ID NO: 10345 - DNA, 1101 bp, Artificial Sequence
  Description of Artificial Sequence: Synthetic coding sequence
atgatccggaactggctcaccatctttattctattccccttgaagctggtggagaagtgcgagtcgagcgtgtcgctgacagtccccccggtagttaaactagagaatggtagctcaacgaatgtgtccctaacgctgcggccccccttgaatgccactctggttatcacgttcgagataacgtttcgatcgaagaacatcacgattctcgagttgccggacgaagtggtagtgcctccaggagtcaccaactcgagcttccaagttacgtcgcagaacgttggacagcttaccgtttacctccacggcaatcatagcaaccagacaggtccccgaatcaggttcctggtgatccggagttcggctattagcatcattaaccaggttattgggtggatttattttgtagcgtggtcaataagcttttacccacaagtgataatgaactggcgtcggaagtcagtgataggactgtcgtttgactttgttgcacttaacttgaccggttttgtcgcctactcggttttcaacattggtttgctgtgggtgccgtatattaaggagcagttcctgttgaaatacccaaatggcgtgaatccggtgaactcgaacgacgtttttttctcgctgcacgccgtggtgctcactttaattatcattgttcagtgctgcttgtatgaacgaggtggccagcgcgtatcctggccagccattggcttcctggtcttggcgtggctttttgcatttgtaactatgatagtggccgccgttggcgtcacgacgtggctgcaattcttattctgcttcagctatatcaagctagccgtcacattggtaaaatatttcccccaggcgtacatgaacttctactacaagtcgaccgaggggtggtcaataggcaacgttttgctcgacttcacgggcggaagttttagtctgctgcagatgttcctgcagtcgtacaataatgaccaatggacgttgatttttggagacccaacaaagttcggccttggcgttttctccatcgtgttcgacgttgttttcttcatccaacacttctgtctataccgaaagcggccgggctacgaccagctgaac

SEQ ID NO: 10346 - DNA, 1101 bp, Artificial Sequence
  Description of Artificial Sequence: Synthetic coding sequence
atgatacggaactggctgaccatttttatcctgtttcctctgaaactagtagaaaaatgtgaaagcagtgtgtctttaaccgtcccgcccgttgtcaagctggaaaacggctcctctacaaatgtttcattgactcttcggccgcccctcaatgctactctagtaattaccttcgagattacattccgctctaagaatatcaccatccttgagctcccagatgaggtggtagtcccgccaggcgtgaccaattcttcatttcaggtgacatctcaaaatgtgggccagctgacagtgtatctgcatgggaaccactcgaatcagactggccctcgcatacgctttctcgttataaggtcctccgccataagcattattaaccaggttattggttggatatactttgtggcttggtctatctccttttatccacaggttatcatgaattggcgacggaagtctgtgattggcctctctttcgattttgtagccctgaacctgacaggtttcgtggcctattctgtgttcaacatcgggctgctgtgggtgccctacattaaggagcagtttttgctaaaataccccaatggcgtcaatccagtcaatagcaacgatgtcttcttttctctccatgccgtcgtgcttaccctgattattattgtgcagtgttgcttgtacgagcgcggcggacaacgagtaagttggccagccattggcttcctggtgctggcctggctcttcgccttcgtgactatgatcgttgctgctgtcggcgtcacaacttggctccagtttctcttctgtttctcctatatcaagctggccgtcacacttgtgaaatacttcccacaggcatacatgaacttctattataagagtaccgaaggttggtccatcggtaacgttctgctggatttcaccggcggctccttttctttgttgcaaatgttcctccagagctataataatgaccagtggacgctaattttcggcgaccccacaaagtttgggctgggcgtctttagcatagtctttgacgtggttttcttcattcagcatttctgtctttataggaaacgcccggggtacgaccagttaaac

SEQ ID NO: 10347 - DNA, 1101 bp, Artificial Sequence
  Description of Artificial Sequence: Synthetic coding sequence
atgatcaggaactggcttaccatcttcattctgtttccactaaaattggtagaaaagtgcgagagttctgtttccctgaccgtgcctcctgtggtgaaattggaaaacggatcctcaacgaacgtgtccctgacactccgccccccactgaatgctacccttgtcattacgttcgagatcacctttcgttctaagaacatcaccattctcgaattgcccgacgaagttgtggttcctccaggtgtgaccaacagtagcttccaggtgacctcccaaaacgtgggtcagctgaccgtatacctgcatggtaatcactctaatcagaccggcccaaggatccgttttctggtgatccggtcttccgcgatttctatcatcaaccaggttatcgggtggatttactttgtggcctggagtatctcattctacccccaagtgataatgaattggcgccggaagtccgtgattggactgagtttcgatttcgttgctttgaatcttaccggtttcgtagcatacagtgtattcaacatcggcctcctatgggtcccatatattaaggagcaatttctgcttaaatatccaaacggcgtgaatccggttaactcgaacgatgtctttttttccctgcacgctgtcgtgcttacgctgattatcattgtacagtgttgcctatacgaacggggtgggcaacgagtgtcctggccagcgatcggatttctggttctggcttggctgttcgcctttgttactatgatcgtggccgccgtgggcgttaccacctggcttcagtttttattttgtttttcctatattaagctagctgtgacattggtgaaatatttccctcaggcctacatgaacttctattacaaaagcacagaggggtggtcaattggaaatgtattgctcgattttactggtgggagctttagtctgctgcagatgtttctccagtcctacaacaatgaccagtggaccctgatctttggtgaccccacaaaatttggcctcggtgtatttagcatcgtgtttgacgttgtctttttcatccaacacttttgtctttataggaagaggcccgggtatgaccagttgaat

SEQ ID NO: 10348 - DNA, 1101 bp, Artificial Sequence
  Description of Artificial Sequence: Synthetic coding sequence
atgatcagaaattggctcaccatttttatcttatttcctctgaagttagtggagaagtgtgagtcatcagtgtctttgacggtgcctccagttgtcaagctggagaacggttcttctacaaacgtatccctcaccctgcgaccccccctcaatgcaaccctagtgatcaccttcgagattacattccgcagtaagaatatcacaatcctcgagctccccgacgaggtggtggtccctcccggagtaacaaactcatcctttcaagtgacctcccagaacgtgggtcagttgaccgtttatttacatggcaaccatagcaaccaaactgggcctagaataaggtttttggtcattaggagcagcgcaatttctattattaatcaggttattgggtggatttacttcgtggcttggtcaatttctttttatccccaagttattatgaactggcggagaaagtctgtgatcggactgtcatttgacttcgtcgcgctaaacctgactggattcgtcgcatactcagtgtttaacattgggttgctgtgggtaccctacattaaggagcagtttctcctgaaataccccaacggagtcaatccagtgaattcaaatgatgtgttcttcagtctgcacgcggtagttcttacacttatcattattgtccagtgctgcttgtatgagcgcgggggccaaagggtgagctggccagcgatcggctttcttgtacttgcctggctgtttgccttcgttacaatgattgtcgcggctgtcggggtcacaacttggctgcagtttctcttttgtttctcgtacattaagctcgcagtgacgctcgttaagtatttccctcaggcttacatgaacttctattataagagtactgaggggtggagcatcgggaatgtgttgctcgatttcacaggcggatcattctccttgctacagatgttcctgcagtcctacaacaacgaccagtggactcttatttttggcgatccgacaaaattcggactcggcgtgtttagcattgtgttcgacgtggtcttcttcatacagcatttttgcctgtatcggaagcggccgggttacgaccagttaaac

SEQ ID NO: 10349 - DNA, 1101 bp, Artificial Sequence
  Description of Artificial Sequence: Synthetic coding sequence
atgatccgcaattggctcacaatttttatcctgttcccactgaagctggtcgagaaatgcgaatcaagcgtctccttaacagttcccccagtggtgaaactggaaaacgggtccagcacaaatgtgagtttaactctcagacccccactgaatgccacactcgtgataaccttcgaaataaccttccgaagcaagaatattaccattttagaactgcccgacgaggtagtggtacctccaggagtgactaactcctccttccaggtgactagccagaacgttggacagttaaccgtgtacttgcacggaaaccacagtaatcagaccggacctcgcatcaggttcctggttatacgtagcagcgccatcagtatcataaaccaagtcattggctggatatatttcgtggcctggtccataagtttctatccccaggttattatgaactggaggaggaaaagcgtgataggcctcagcttcgattttgtggcactgaacttaaccggctttgtggcctactcagtgtttaatatcggcctactgtgggtgccctacatcaaagagcagtttctgcttaaatacccaaacggcgtgaatcccgtcaatagcaacgatgtgtttttcagcctgcatgcagtggtcctaaccctgattataattgttcagtgttgcctgtacgaacggggcggtcaacgagtatcttggccagccattggctttttggtgcttgcatggctgtttgctttcgtgaccatgattgtggccgccgtgggcgtcacaacctggttacagtttctcttctgtttttcctacattaaactggccgtcactctggtgaagtatttcccacaggcttatatgaatttttattataaaagcacagagggatggagtatcggcaatgtcctgctggatttcactgggggaagtttctccctgctgcagatgtttctgcagagctacaacaacgatcaatggacactgatcttcggagacccaaccaagtttggcctgggggttttcagcatcgtgtttgatgttgttttttttatacagcacttctgcctatacagaaagcgacccggctacgaccagctgaac

SEQ ID NO: 10350 - DNA, 1101 bp, Artificial Sequence; identical to SEQ ID NO: 10340
  Description of Artificial Sequence: Synthetic coding sequence

SEQ ID NO: 10351 - DNA, 1101 bp, Artificial Sequence
  Description of Artificial Sequence: Synthetic coding sequence
atgatccgaaattggctcacaatattcattctgtttcctctgaagctcgtggagaagtgcgagagttccgtcagtcttaccgtaccaccggtggtgaagcttgagaacgggtcttcaacaaacgtgagtttgacgcttagaccaccgctgaatgcgacactggtgattacatttgagattacatttaggtctaagaacatcacaattcttgaactacctgatgaagtcgtggtgcctcccggtgtgacgaacagcagcttccaggttacctcccagaatgttgggcagcttaccgtatacctgcacgggaatcactcgaatcaaacaggtccaaggattcggttcttagtcatcaggagctctgctatttcaatcataaaccaggtcattggctggatctacttcgttgcctggtcgattagtttctacccccaggttatcatgaattggcgtcggaagtccgtcattggcttgtcgtttgactttgtggcgcttaatctgaccggtttcgttgcatactccgtgttcaatattggcctgctttgggtcccctatattaaggagcagttcctcttgaaataccccaacggcgtcaaccctgtcaactcaaacgatgtattctttagtctacacgccgtggtgctaaccctgatcattattgtccagtgctgcctgtacgagagagggggtcagcgcgtatcctggcctgcaatagggttcttggtgcttgcctggcttttcgcctttgtgaccatgatcgtggcagcagtcggtgtgacaacatggctccagttcctgttttgtttctcttatattaaactggcagtcaccctggtcaagtatttcccacaggcctatatgaatttctactacaaatcaacagaaggttggtccatcggtaatgtccttctagactttacaggggggagctttagtttacttcagatgtttctgcagagctacaataatgatcaatggactctcatcttcggggatcccaccaaattcgggctgggagtattcagcatcgtgtttgatgtagtgttcttcatccagcacttctgtctataccggaaacgcccaggctacgatcagctgaat

SEQ ID NO: 10352 - DNA, 1101 bp, Artificial Sequence
  Description of Artificial Sequence: Synthetic coding sequence
atgatcaggaactggttaacaatattcattctatttcctctgaaactcgtggaaaaatgcgaatcctcagtgtctctcactgtgccacccgtcgtgaaactggaaaatggatccagtacaaacgtatccttgactctccgcccaccactgaatgccactctcgtgattactttcgaaataacattcaggtctaaaaatatcactatcctggagctgccagacgaagtcgtagtcccccctggagtgacaaattcctcctttcaggtcacgtcccagaatgtcggacagttgactgtatacttgcatggaaaccactccaaccagacggggccccggatacgctttctagtgattaggtcctccgccatttctattatcaatcaggtgatagggtggatctacttcgtcgcttggtctatttctttctatccacaggtgatcatgaactggaggcggaaatcggtcattggactcagtttcgatttcgtcgctctcaatctcactgggtttgtggcctatagtgtctttaatattggactattatgggtgccatacatcaaggaacagtttctgctcaaatacccaaatggggtgaacccagttaatagtaatgatgtcttttttagtctccatgctgtagttctcactttaataattatagtccagtgctgtctctatgagcgcgggggacagcgggtttcctggcctgccatagggttcctcgtgctcgcgtggctctttgcctttgtcactatgatcgtggccgctgtgggggtcacaacatggcttcagtttctattctgttttagttatattaaactcgcagtcacgcttgtgaaatattttccccaagcttatatgaacttctattacaaatcaacagaaggatggtcaataggaaatgtcctgctagactttactgggggatcgttctccttgttgcagatgttcttgcagtcctataacaacgatcagtggactctaattttcggagacccaactaaatttgggcttggggtgttttccatcgtgttcgatgtagtgttcttcatacagcatttttgcctatatcgaaaaagacctgggtacgatcaactaaat

SEQ ID NO: 10353 - DNA, 1101 bp, Artificial Sequence
  Description of Artificial Sequence: Synthetic coding sequence
atgatacgaaactggttaactatttttattttattccctctgaaactagtggagaagtgtgagagttccgtcagtttaacagtgccacctgttgttaagctggaaaacggtagttcaaccaacgtgtcactcacccttaggcctcccctgaatgctactctggttattaccttcgaaatcacatttagaagcaagaacattacaattctcgaactgcctgatgaagttgttgtgcctccgggagttaccaactccagcttccaggtcacatcccaaaacgtcggacaactgaccgtgtacctgcatgggaatcacagcaaccagactggtcctagaatcagatttctggttatccgtagctcagccatctcaatcattaaccaagtcatcggatggatctactttgtggcctggagtattagtttctacccccaggtgatcatgaactggcgtcgaaagtcagtgattggcttgtcatttgacttcgtggcccttaaccttaccggctttgtggcatactccgtctttaacatcgggctgctgtgggtcccatacatcaaggagcaattccttctgaaataccccaatggagtcaacccagtcaactccaacgacgtgtttttctctctgcacgcagtggtcctcacactgatcatcattgttcagtgttgtctgtatgagcgcggcggccagagggtaagctggccagcaatcgggtttctcgttctggcttggttattcgctttcgtgacaatgatcgtcgccgcagtcggcgtgaccacctggttgcaatttctgttttgcttcagctacatcaagctcgcagttaccttagttaagtactttccgcaggcgtacatgaatttttactataagtcaaccgaaggatggtccatcggcaatgtgctgcttgacttcacagggggatccttttctctcctccaaatgtttttgcagagttataataacgatcagtggaccctcatctttggggatcccacaaaattcggcttgggagtcttcagtatagtcttcgacgtcgttttctttatccaacacttttgcctttacagaaagagacctggctatgatcaattgaat

SEQ ID NO: 10354 - DNA, 1101 bp, Artificial Sequence
  Description of Artificial Sequence: Synthetic coding sequence
atgatccggaactggctcactatcttcattctgttccccctaaagcttgtcgagaaatgcgagtcaagcgtcagtttgacagtgcctccagtggtgaagctggaaaatggaagctccaccaatgtgtcactgactttacgtccaccattaaacgccacactggtgatcacttttgagatcaccttccgctccaaaaatatcacaatactagaactgcccgatgaagtagtggtccctcccggcgtgaccaattccagtttccaggttactagtcagaacgtcgggcagctaaccgtgtatttgcacgggaatcatagcaaccagactgggccccgcattcgttttcttgtgatacgctcatccgcgatctcgatcattaaccaagtcattggttggatctatttcgtggcttggtcaatctccttctacccacaggtcatcatgaattggagaagaaaatccgtcatagggcttagctttgatttcgttgccctgaacctgacgggcttcgttgcctattctgtgtttaatataggactactgtgggtaccttacatcaaggaacagttcctgctgaaataccccaacggcgtgaatcctgtgaactctaatgacgtgttcttcagcttgcacgcagttgtgctcactctcattattatcgtgcagtgttgtttgtacgagagaggaggtcaacgtgtttcgtggcccgcaattggcttcctggtgctcgcttggctgtttgcttttgtgactatgatagtggcggcggtaggggtcaccacctggctgcagtttttgttctgtttctcatatataaagcttgccgtgacgctggtgaagtactttccccaagcgtacatgaacttttattataagtccaccgagggttggtcgattggcaacgtcctgcttgattttactggcggatcattttcccttttacagatgttcttgcaaagctacaacaatgaccagtggactctgatcttcggcgaccccaccaaattcggcctgggcgtgtttagcatcgttttcgatgtggtcttctttattcaacacttttgcctgtacaggaagcggcctggctatgaccaactcaac

SEQ ID NO: 10355 - DNA, 1101 bp, Artificial Sequence
  Description of Artificial Sequence: Synthetic coding sequence
atgattagaaactggttaaccatatttatcttattccctctcaagctggtcgagaagtgtgagagcagtgtgagtctgacagtgccccccgtggtgaaactcgaaaatggtagcagtaccaacgtctctctgaccctgcgtccaccgctcaatgccacactggtcattacctttgaaattaccttccgaagcaagaacatcacaattcttgagttaccagacgaggtagtggtacctcccggcgtgacaaacagcagcttccaggtgacctcccagaatgtcggccagctcactgtttaccttcatggaaatcactctaatcagaccggccccagaatccggttcctggttatccggtccagcgccattagcattataaatcaggttataggatggatttacttcgtcgcatggtcgattagtttttatccacaagttataatgaattggcgacggaaaagcgtgatcggactttcttttgatttcgtagccttgaacctgacaggcttcgtggcctattcagtcttcaatatcggtcttctctgggttccatacatcaaagagcagtttttgctcaagtacccaaatggcgtgaatcctgtcaactctaacgacgtgttcttttctttgcacgctgtggttctgactcttattattatcgtgcagtgttgcctgtatgagagggggggacagagagtatcgtggcccgctattgggttcctcgtactggcctggctgtttgcgtttgtgaccatgattgtggccgccgttggggtcaccacatggcttcagtttctgttttgtttcagctacattaaactcgccgtgacgctcgtaaagtattttccccaggcatacatgaatttctattataaaagcacagagggctggtccatcgggaatgtgctcctcgactttacaggcgggtccttctcccttctgcagatgttccttcaatcctataacaatgatcagtggactctaatctttggggacccaaccaagttcggcctgggagtctttagtatcgtgtttgatgttgtgtttttcatccagcatttttgcctgtaccgtaagcgccctgggtatgaccaactgaat

SEQ ID NO: 10356 - DNA, 201 bp, Artificial Sequence
  Description of Artificial Sequence: Synthetic coding sequence
atgcgcatccattacttactgttcgccttgttattcttgtttctggtgcccgtaccaggacacggcgggataatcaatacactgcagaagtattattgtcgggtgcgcggcggcaggtgtgcagtgctgtcttgcttaccgaaggaggagcagataggaaagtgttccactcggggaaggaagtgctgtagacggaaaaag

SEQ ID NO: 10357 - DNA, 201 bp, Artificial Sequence
  Description of Artificial Sequence: Synthetic coding sequence
atgagaatccactacttgctcttcgcgctgctgtttcttttcttggtgccagtgcctggccacggtggcatcatcaacacccttcaaaagtattactgtagagtccggggaggtaggtgcgccgtgctgagctgcctgccgaaggaagaacagatcgggaagtgctcgacccgcgggcgcaagtgctgccggcgcaagaag

SEQ ID NO: 10358 - DNA, 201 bp, Artificial Sequence
  Description of Artificial Sequence: Synthetic coding sequence
atgcgaattcattaccttctctttgctctgctgttcctttttctggtgccagtgcctggccacggtgggattattaatacactccagaagtactattgtagagtccggggaggtcggtgtgcagtgctcagttgcctaccaaaggaggagcagattggaaaatgctctaccaggggccgcaaatgttgccggagaaaaaaa

SEQ ID NO: 10359 - DNA, 201 bp, Artificial Sequence
  Description of Artificial Sequence: Synthetic coding sequence
atgagaatacactacctcctgtttgcacttttgttccttttcctggtgcccgttccgggtcacggaggaatcatcaatacccttcagaaatactattgtcgcgttcggggcgggcgatgcgctgtgcttagttgtttgcccaaagaggagcagatcgggaagtgctctacgcgcggcagaaaatgctgtagaagaaaaaag

SEQ ID NO: 10360 - DNA, 201 bp, Artificial Sequence
  Description of Artificial Sequence: Synthetic coding sequence
atgcggatccactatctgctattcgcccttctcttcctgttcctcgtcccagtgcctggacatggcgggatcatcaacacactgcagaaatattattgtcgcgtgcgaggggggagatgtgccgtgttgtcctgtctgccaaaggaagagcagatcggcaaatgctcaaccaggggtcgcaaatgttgcaggcgcaagaaa

SEQ ID NO: 10361 - DNA, 201 bp, Artificial Sequence
  Description of Artificial Sequence: Synthetic coding sequence
atgagaatccattatttgctcttcgcacttctgttcctttttctggtgccagtacctggccacggaggcatcatcaatacactgcagaaatactactgtagggttagaggaggccgctgtgctgtgctgtcctgtctgcccaaggaggaacaaatcggtaaatgcagcacaaggggaagaaagtgctgtcgcagaaagaag

SEQ ID NO: 10362 - DNA, 201 bp, Artificial Sequence
  Description of Artificial Sequence: Synthetic coding sequence
atgcgcatacactaccttctgttcgccctgctttttctgttcctggtgcccgtgccagggcatggaggtatcataaacacccttcagaagtattactgtcgtgtcaggggaggcaggtgtgcagtgctgtcatgcctccccaaggaggaacaaattggaaaatgctctactagagggagaaaatgctgtagacggaagaag

SEQ ID NO: 10363 - DNA, 201 bp, Artificial Sequence
  Description of Artificial Sequence: Synthetic coding sequence
atgagaattcattacctgctgtttgccctcttgttcctgttcttggtgccagtcccggggcacggaggaatcatcaacaccttgcaaaagtattactgtcgtgttaggggaggccgctgtgcggtgctgtcatgcctccctaaagaagagcagatcggcaaatgctccactcgaggacggaagtgctgcaggcgtaagaaa

SEQ ID NO: 10364 - DNA, 201 bp, Artificial Sequence
  Description of Artificial Sequence: Synthetic coding sequence
atgagaattcactatttgttgtttgccttgctgttcctgtttctggtgcctgtcccgggccatgggggcattatcaacaccctgcaaaagtactactgccgggtaagaggcggacggtgcgccgtgctgagctgtctgccaaaagaagagcagatcgggaagtgttccactcgagggaggaaatgttgccgccgtaaaaaa

SEQ ID NO: 10365 - DNA, 201 bp, Artificial Sequence
  Description of Artificial Sequence: Synthetic coding sequence
atgcgaattcactacctgctttttgcccttctgttcctttttctggtcccggtgcccggacatggaggaattatcaacacgctgcagaagtactactgccgcgtccgcgggggtaggtgcgcagtgctgtcctgtctcccaaaggaggaacaaatcgggaaatgcagcactcgtggtcgaaagtgttgtcgtaggaagaaa

SEQ ID NO: 10366 - DNA, 201 bp, Artificial Sequence
  Description of Artificial Sequence: Synthetic coding sequence
atgcggatccactatctgctgtttgccttgctgttcctgttcctggttccagtgcctgggcacggcggaattatcaataccttacagaagtattattgtagagttcggggcggccgatgcgcagtgctgtcctgtttacccaaggaagagcagattgggaagtgtagtacacgcggcagaaagtgctgccgtaggaaaaaa

SEQ ID NO: 10367 - DNA, 201 bp, Artificial Sequence
  Description of Artificial Sequence: Synthetic coding sequence
atgcgtatccattaccttctcttcgccttgctgttcctctttcttgtcccagtgccgggccacgggggaatcatcaacaccctccagaagtactactgccgcgttcggggtggacggtgcgctgtgctctcgtgcctgcctaaggaggaacaaatcggcaagtgcagcactcggggaaggaaatgttgccggcggaagaag

SEQ ID NO: 10368 - DNA, 201 bp, Artificial Sequence
  Description of Artificial Sequence: Synthetic coding sequence
atgcggatccactacctcctttttgccttgttgttcctgtttctcgtgcccgtgccaggacatgggggaatcatcaacacccttcagaaatactactgtcgcgtcagaggtgggcgctgtgcagtgctgtcctgccttccaaaggaagagcaaattggtaaatgctccactaggggacgcaagtgttgtaggcgcaagaag

SEQ ID NO: 10369 - DNA, 201 bp, Artificial Sequence
  Description of Artificial Sequence: Synthetic coding sequence
atgagaatccactaccttctgttcgcgctcctattcctcttcctagtccctgtgccgggtcatggcggcataatcaacaccttgcagaagtactactgtcgagttcgaggtggccgctgtgcggtcttgtcctgcctgcccaaggaggagcagattggcaaatgcagcactaggggccgtaagtgttgccgcagaaagaag

SEQ ID NO: 10370 - DNA, 201 bp, Artificial Sequence
  Description of Artificial Sequence: Synthetic coding sequence
atgaggatacattacctccttttcgcactcttgtttctcttcctggtgcctgtgcctggacacggtggaatcataaacaccttgcagaagtactactgtcgtgtgaggggtgggcggtgcgccgtcctgtcctgtctgccaaaggaagagcagattggaaagtgctccaccagaggtcgcaagtgttgccgtcgcaaaaag

SEQ ID NO: 10371 - DNA, 201 bp, Artificial Sequence
  Description of Artificial Sequence: Synthetic coding sequence
atgcgcatacattatctcctcttcgcactcctgtttctattcctggtacctgtccctggacacgggggaatcataaacacactccagaaatattattgtcgcgtgcgcggagggagatgcgccgtgctgtcatgcctaccaaaagaagaacagattgggaaatgctccactcgcggaaggaaatgctgcaggcgcaaaaaa

SEQ ID NO: 10372 - DNA, 201 bp, Artificial Sequence
  Description of Artificial Sequence: Synthetic coding sequence
atgagaatccattacctgctgttcgctctgcttttcctcttcctggtcccagtccccgggcacggtgggattattaataccttgcagaagtactactgcagagtcaggggaggacggtgtgcagtcttgagctgccttcccaaggaggagcagatcggcaagtgcagtaccagagggcggaagtgttgccgccgaaagaag

SEQ ID NO: 10373 - DNA, 201 bp, Artificial Sequence
  Description of Artificial Sequence: Synthetic coding sequence
atgcggattcattaccttctgttcgcattgctgtttttgttcttggtgccggtccccgggcacggtggtattataaacactttacagaagtactactgcagagtacggggcggacgttgcgccgttcttagttgtctaccaaaagaagagcagattggcaagtgttctacccgagggcgtaaatgttgccgccggaagaaa

SEQ ID NO: 10374 - DNA, 201 bp, Artificial Sequence
  Description of Artificial Sequence: Synthetic coding sequence
atgcggatacactaccttctgttcgccctccttttcctcttcttggtgcccgtgcctggacatggtgggattatcaatacattacagaagtattattgccgtgtgcggggaggtcgttgcgcagttttgtcgtgtttgccaaaggaggaacagattggcaaatgcagcactaggggaaggaagtgttgcagacggaaaaaa

SEQ ID NO: 10375 - DNA, 201 bp, Artificial Sequence
  Description of Artificial Sequence: Synthetic coding sequence
atgcggatacactatctgctgttcgcccttctgttcttgttcttggtgcccgtcccagggcatggcggcataataaacacgcttcaaaaatactactgcagagttaggggcggcaggtgtgcagtcctcagctgcctcccaaaggaagaacagatcggcaaatgtagtactcgcggccggaagtgttgcagacgaaagaaa

SEQ ID NO: 10376 - DNA, 201 bp, Artificial Sequence
  Description of Artificial Sequence: Synthetic coding sequence
atgcggattcattacttgctctttgccctgctctttctcttcttagttccagtacccggtcatggcgggatcataaacaccctccaaaaatattactgccgagtgcgcggtggccgttgtgcagtgctcagctgtcttcccaaggaagaacaaattggaaaatgttcaacacgcggacgaaagtgttgtagacggaagaag

SEQ ID NO: 10377 - DNA, 201 bp, Artificial Sequence
  Description of Artificial Sequence: Synthetic coding sequence
atgagaattcattaccttctcttcgcactgctgtttttgttcctagtgcctgtccccggacatggaggcataattaatacactccagaaatattactgtagggtgaggggcggcagatgtgccgtcctgagttgccttcctaaggaggagcaaatcgggaagtgcagcactagggggagaaagtgctgcagacgtaaaaaa

SEQ ID NO: 10378 - DNA, 201 bp, Artificial Sequence
  Description of Artificial Sequence: Synthetic coding sequence
atgagaatccactatctcttattcgcgttacttttcctgttccttgtgcctgtacctggtcatggcgggatcattaacaccctgcagaagtactattgccgggtccgcggaggacgatgcgctgttttatcctgtctgcctaaggaggaacaaattggcaaatgcagcaccagagggcggaaatgttgtagacgaaagaag

SEQ ID NO: 10379 - DNA, 201 bp, Artificial Sequence
  Description of Artificial Sequence: Synthetic coding sequence
atgcggatccactacctgctctttgctcttttatttctatttcttgtacctgtccccggacacggagggataatcaacactctacaaaagtattactgccgagtgcgtggaggccgttgcgccgtcttgtcttgtctgcccaaggaagagcagatcggaaagtgctccactcgcggcagaaaatgttgcaggcgtaaaaag

SEQ ID NO: 10380 - DNA, 201 bp, Artificial Sequence
  Description of Artificial Sequence: Synthetic coding sequence
atgcggatccactaccttctcttcgcgctgctgtttctgttcctcgtgccggtgccaggacacggcggcatcatcaacactctgcagaagtattactgtcgcgtccggggtggtcggtgcgcggtgttgtcctgccttccaaaggaggagcaaatcggaaagtgcagcacccgcgggcgtaaatgctgcaggagaaagaaa

SEQ ID NO: 10381 - DNA, 201 bp, Artificial Sequence
  Description of Artificial Sequence: Synthetic coding sequence
atgaggattcattatttgctttttgccttgttattcctctttcttgtgcctgtacctggacacggtggaattatcaacactcttcagaagtactattgcagggtgagagggggtagatgtgcggtactttcttgtctcccaaaagaggaacaaattggaaagtgttccactcgtggcaggaagtgctgtagacgaaagaag

SEQ ID NO: 10382 - DNA, 201 bp, Artificial Sequence
  Description of Artificial Sequence: Synthetic coding sequence
atgaggatccactacctgctctttgcactcctgtttcttttcctcgtgccagtgccgggacacggtggaattatcaataccctccagaaatactattgtagagttcgcggaggacgatgcgccgtcctttcgtgtttgccaaaggaagagcagatcggtaagtgttcgactcgtggcagaaagtgttgtcgaagaaaaaag

SEQ ID NO: 10383 - DNA, 201 bp, Artificial Sequence
  Description of Artificial Sequence: Synthetic coding sequence
atgcggatccactatctgttgttcgccctcttgtttctgtttctcgtgccagttccaggtcacggtggcattatcaatactttgcagaagtactattgcagagtgcggggaggccgatgcgcagttttgtcttgcttgcccaaggaagaacagatagggaagtgcagtacaaggggcaggaagtgctgcagaaggaagaag

SEQ ID NO: 10384 - DNA, 201 bp, Artificial Sequence
  Description of Artificial Sequence: Synthetic coding sequence
atgcgtatacattatctactatttgcgctattatttctatttttagtaccggttccgggtcatggtggtataataaatacgttacaaaaatattattgtcgtgttcgaggtggtcgttgtgcggttctatcgtgtctaccgaaagaagaacaaataggtaaatgttcgacgcgtggtcgtaaatgttgtcgacgaaaaaaa

SEQ ID NO: 10385 - DNA, 201 bp, Artificial Sequence
  Description of Artificial Sequence: Synthetic coding sequence
atgcgcatccactacttgttgttcgctctgctgtttttgtttcttgtgccagtgccgggacacgggggaattatcaacactcttcagaaatactactgcagagtgcgcgggggacgctgcgcagtgctgagctgcttgccgaaggaagagcaaattggtaagtgctcgacccgggggcggaagtgttgtcgcagaaagaag

SEQ ID NO: 10386 - DNA, 201 bp, Artificial Sequence
  Description of Artificial Sequence: Synthetic coding sequence
atgcgtattcactatttgctctttgcccttttgtttcttttcctggtgccggtgccaggacatggtggtattatcaacaccttgcagaagtactactgtagggtgagaggaggacgttgtgcagtgctctcctgcctgcctaaagaagagcagatcggaaaatgttcaactcgcggtcggaaatgttgcaggcgcaagaag

SEQ ID NO: 10387 - DNA, 201 bp, Artificial Sequence
  Description of Artificial Sequence: Synthetic coding sequence
atgagaattcactatctgctgtttgcccttctgttcctgttccttgtccccgtccctggtcacggcgggatcattaacactctccaaaaatactactgtcgagttcgagggggacgatgtgcagtgctgtcatgtcttccaaaggaagaacagattggcaaatgtagcacaaggggtagaaagtgctgccgtcgaaagaaa

SEQ ID NO: 10388 - DNA, 201 bp, Artificial Sequence
  Description of Artificial Sequence: Synthetic coding sequence
atgcgtatccattacttactgtttgcactccttttcctgtttctggtccccgtccccgggcatgggggaattattaacactttacagaagtattactgtcgggtgcgcgggggacgctgcgctgtgttatcctgccttcccaaggaggagcagattggaaagtgctcgaccagaggaaggaaatgttgccgacggaaaaag

SEQ ID NO: 10389 - DNA, 201 bp, Artificial Sequence
  Description of Artificial Sequence: Synthetic coding sequence
atgcggatccactacctgctattcgctttgctgttcctcttccttgtaccagtccccggtcacggcggaataattaacacactgcagaagtattactgtagggtgaggggaggccgttgcgctgtcctgtcttgtctgcccaaagaggagcagatcggtaaatgcagcacacgcggacgaaagtgttgtcggcggaagaaa

SEQ ID NO: 10390 - DNA, 201 bp, Artificial Sequence
  Description of Artificial Sequence: Synthetic coding sequence
atgagaatccactatctactgtttgccttgttgtttctgttcctggttcctgttcccgggcacggtggaatcatcaacacactgcaaaagtattattgccgagttaggggtgggcgctgcgctgtcctcagctgcctgccgaaggaggagcagattggtaaatgtagcacccgggggagaaaatgctgccgccgaaaaaaa

SEQ ID NO: 10391 - DNA, 201 bp, Artificial Sequence
  Description of Artificial Sequence: Synthetic coding sequence
atgcgtatccattacctgctctttgccctgctgtttctgtttctggttccagtgcctggccatgggggcataattaataccctgcagaagtactattgtcgggtccgaggcggtcgctgcgctgttctgtcctgcctgcctaaggaggagcagatcggtaagtgttccacccgcggacgaaagtgctgccgccgcaagaag

SEQ ID NO: 10392 - DNA, 201 bp, Artificial Sequence
  Description of Artificial Sequence: Synthetic coding sequence
atgcgcatccattacctgctgttcgcgctgttgttcctgtttcttgtgccggtcccaggacatggaggaatcatcaacaccctgcagaaatactactgccgcgtgaggggagggcggtgcgccgtgctttcgtgtctgccgaaggaagagcagataggcaagtgttcgactagaggacgcaaatgttgccgccgcaaaaag

SEQ ID NO: 10393 - DNA, 201 bp, Artificial Sequence
  Description of Artificial Sequence: Synthetic coding sequence
atgcgcattcactatcttctctttgccttactctttctttttctagtaccagtgcctggacacgggggaataatcaacacattacagaaatattattgtcgggtacggggaggaagatgtgcagtactttcttgccttcccaaagaagaacagatcgggaagtgctctacacgcggacgcaaatgctgcagaaggaaaaag

SEQ ID NO: 10394 - DNA, 201 bp, Artificial Sequence
  Description of Artificial Sequence: Synthetic coding sequence
atgagaatccattacctgttgttcgccctgctcttcctgtttctcgtgccggtgcctggccacggaggcatcatcaacacccttcagaaatactactgccgcgtcagagggggtaggtgtgcggtgctgtcgtgcctgccaaaagaagagcaaattggaaagtgctccactcggggacgcaagtgttgccgccggaagaag

SEQ ID NO: 10395 - DNA, 201 bp, Artificial Sequence
  Description of Artificial Sequence: Synthetic coding sequence
atgcgcatccattatctcctctttgccctgctattcctgttcctggtccctgtgccgggtcacggcggcatcattaacaccctacagaagtactactgccgcgttcggggcgggaggtgcgctgtgctctcatgtctcccaaaggaggagcagatcggcaaatgttccactcgcggaagaaaatgctgtcgtcgcaagaag

SEQ ID NO: 10396 - DNA, 201 bp, Artificial Sequence
  Description of Artificial Sequence: Synthetic coding sequence
atgagaatccactatctcctcttcgcactcctcttcttgtttctggtccctgtccctggtcacggaggtatcatcaatacactgcaaaagtactactgcagagtcagaggtggacgctgtgccgtgctgagctgcctccctaaggaggaacagatcggtaaatgctctactagaggcagaaaatgctgccgcagaaaaaaa

SEQ ID NO: 10397 - DNA, 201 bp, Artificial Sequence
  Description of Artificial Sequence: Synthetic coding sequence
atgagaattcattacctgcttttcgcgctgctcttcctgttcctcgtgccagtacccggacatgggggaataataaatacccttcagaagtattattgccgagtgagaggagggcgatgcgcggtgctctcatgtctgcctaaagaagaacagatcggcaagtgtagcacacggggccgcaagtgctgcaggagaaagaaa

SEQ ID NO: 10398 - DNA, 201 bp, Artificial Sequence
  Description of Artificial Sequence: Synthetic coding sequence
atgcgcatccactatctcttgttcgcgttactttttttattcttggttccggtgcccggccacgggggtataataaacactcttcagaagtattattgccgggtgcgcggcgggagatgtgccgttttatcttgtttgcctaaggaagagcaaattgggaagtgttccactcgtggaagaaaatgctgtagaagaaagaag

SEQ ID NO: 10399 - DNA, 201 bp, Artificial Sequence
  Description of Artificial Sequence: Synthetic coding sequence
atgcggatccattacctgctcttcgcccttctctttctttttcttgtgcctgtgcctggtcacggtggaatcattaacactctgcaaaagtactactgtagagtgagaggaggtcgttgtgcagtgcttagctgtctgcccaaagaagaacagattggcaagtgttcaacgcgcggcagaaagtgttgtagaagaaagaaa

SEQ ID NO: 10400 - DNA, 201 bp, Artificial Sequence
  Description of Artificial Sequence: Synthetic coding sequence
atgcgcatccactaccttctgttcgcacttttgttcctgtttctcgtgccggtgccaggacatggcggtattatcaacacccttcaaaagtactactgcagagttcgtgggggcaggtgcgccgtgctcagctgtctcccgaaagaggaacagatcgggaaatgctccaccagaggccgcaaatgttgccgccgcaagaag

SEQ ID NO: 10401 - DNA, 201 bp, Artificial Sequence
  Description of Artificial Sequence: Synthetic coding sequence
atgaggatccattacttgctttttgctctgctgttcctgttcctcgtcccggtgccaggacacggtggaatcattaacactttgcaaaagtactattgcagagtgcgtgggggccgttgcgccgtgttgagctgcctccccaaagaagagcagataggaaagtgttccaccagaggccggaaatgttgccgccgcaagaaa

SEQ ID NO: 10402 - DNA, 201 bp, Artificial Sequence
  Description of Artificial Sequence: Synthetic coding sequence
atgcgaattcattacctgctttttgcgttgcttttcctgtttctcgtgcctgtgccgggtcatggcggaataatcaacacccttcagaagtactactgccgtgtgagaggcggaagatgtgcggtcctgtcatgccttcccaaagaagaacaaatcggaaaatgcagcactagagggcggaaatgttgtaggagaaagaag

SEQ ID NO: 10403 - DNA, 201 bp, Artificial Sequence
  Description of Artificial Sequence: Synthetic coding sequence
atgcgcatccattacctcctgtttgccctgctgtttctgtttctggttccagtgcctggacacggcggtatcatcaacaccctgcagaagtactactgcagagtgcggggtggcagatgcgccgttctgagctgtctgccgaaggaagagcaaattggtaagtgtagtacccgtggacggaagtgctgccgccgtaaaaag

SEQ ID NO: 10404 - DNA, 201 bp, Artificial Sequence
  Description of Artificial Sequence: Synthetic coding sequence
atgcgcatccactacctcctctttgccctcttgttccttttcctggtaccagtccctggacacggcggaatcattaataccctgcaaaagtattactgtagagtgaggggaggcagatgtgctgttttgtcttgtctgcctaaggaagagcagatcgggaaatgtagtacacgaggaagaaagtgctgcaggaggaagaaa

SEQ ID NO: 10405 - DNA, 201 bp, Artificial Sequence
  Description of Artificial Sequence: Synthetic coding sequence
atgcggatccactaccttcttttcgctcttctgtttcttttcctggtccctgtgcccggacacggtggaattatcaacactctgcagaagtactactgtcgcgtgcgcggtgggcgttgtgcggtgctttcgtgtctccctaaagaagaacaaatcggtaaatgttcaacccggggacgcaagtgctgtcggaggaagaag

SEQ ID NO: 10406 - DNA, 201 bp, Artificial Sequence; identical to SEQ ID NO: 10359
  Description of Artificial Sequence: Synthetic coding sequence

SEQ ID NO: 10407 - DNA, 201 bp, Artificial Sequence
  Description of Artificial Sequence: Synthetic coding sequence
atgaggatacattacctattgttcgccttacttttcctctttctcgttccagtccctggacatggaggaattattaatactttgcaaaagtactattgccgtgttcgcggaggtcggtgtgcggttcttagctgcctaccgaaggaagagcaaattgggaaatgttccacaaggggtcgaaaatgctgtcgacgcaaaaag

SEQ ID NO: 10408 - DNA, 201 bp, Artificial Sequence
  Description of Artificial Sequence: Synthetic coding sequence
atgcgaatccattacttgctgttcgcactactgttcctgttcctcgtgcccgtccccggacacggagggatcattaatacattgcagaagtactactgccgggtgcgaggaggccgctgtgccgtcctgagttgcctaccaaaggaagagcagattgggaagtgctctacacgtggacgcaagtgctgccgacggaagaaa

SEQ ID NO: 10409 - DNA, 201 bp, Artificial Sequence
  Description of Artificial Sequence: Synthetic coding sequence
atgagaatccattacctgctttttgcattgcttttcctcttcttggtgccagtgccagggcacggaggtatcattaacaccctgcaaaagtattactgtcgtgtgagaggcggtaggtgtgccgtgctctcgtgtctgcccaaggaggagcaaattggcaagtgctccactaggggtcgcaaatgctgtaggcggaagaag

SEQ ID NO: 10410 - DNA, 201 bp, Artificial Sequence
  Description of Artificial Sequence: Synthetic coding sequence
atgcggatccattacctgctgtttgcccttctgtttttgttcttggtgccggtgcctggtcatggtgggataatcaataccctgcagaagtactactgtcgcgtgcgaggtggccgttgcgcagtgctctcctgtctcccaaaggaagagcaaattgggaagtgttccactagaggaaggaagtgctgtagaagaaagaag

SEQ ID NO: 10411 - DNA, 201 bp, Artificial Sequence
  Description of Artificial Sequence: Synthetic coding sequence
atgaggatccactacctgctgtttgctttactattcctgtttttggtgcctgtgcctgggcatggaggcatcattaatacgctgcagaagtactactgtcgcgtacgcggaggcagatgcgccgtgctcagctgcttgccaaaggaggagcagattggaaagtgctccacacggggcaggaagtgctgtcgacgcaagaaa

SEQ ID NO: 10412 - DNA, 201 bp, Artificial Sequence
  Description of Artificial Sequence: Synthetic coding sequence
atgagaatccattacctgctgtttgcactcttatttttgttcttggtgcctgtcccgggccacggaggcattattaataccttacagaagtactattgcagagtaagaggagggcgctgtgcagtattgagctgcttgccgaaggaagagcagattggcaagtgttcaacacgtggaaggaaatgttgccgccgcaaaaag

SEQ ID NO: 10413 - DNA, 201 bp, Artificial Sequence
  Description of Artificial Sequence: Synthetic coding sequence
atgagaatccattaccttttgttcgccctgctcttcctctttctggtcccggtgccaggccacgggggaatcatcaacaccttgcagaagtactattgcagagttaggggtggacggtgcgctgtgttgagctgcctgcctaaagaagagcaaataggaaagtgctccactcgggggcgcaagtgttgtagacgcaaaaag

SEQ ID NO: 10414 - DNA, 201 bp, Artificial Sequence
  Description of Artificial Sequence: Synthetic coding sequence
atgaggatccattacctcctctttgcattgctgttcttgtttctggtgcccgtacccggccatggaggtatcataaatacactacagaaatattattgccgcgtccggggcggcaggtgtgccgtgctttcttgccttccaaaggaagaacagatcgggaaatgcagtacgcgcggccggaagtgctgcaggaggaaaaag

SEQ ID NO: 10415 - DNA, 201 bp, Artificial Sequence
  Description of Artificial Sequence: Synthetic coding sequence
atgagaatacattatttgttatttgctttattgtttctattcttagttccagttccaggacatggaggtattattaatactcttcaaaaatattattgtagagttagaggaggaagatgtgcagttttaagttgtttaccaaaagaggaacaaattggaaaatgttcaactagaggaagaaagtgttgtagaagaaaaaag

SEQ ID NO: 10416 - DNA, 201 bp, Artificial Sequence
  Description of Artificial Sequence: Synthetic coding sequence
atgaggattcattatttgctgtttgcactgttgtttctgttcctggtcccagtgcctgggcacggaggcataataaacactctgcagaagtactactgccgcgtgagagggggtcggtgtgccgtgctgtcatgcctgcccaaggaagaacagatcggcaagtgctccacacgtggacgcaaatgctgcaggcgcaagaag

SEQ ID NO: 10417 - DNA, 201 bp, Artificial Sequence
  Description of Artificial Sequence: Synthetic coding sequence
atgcgcattcactacctactgttcgcactattattcttatttttagtacctgttcccggtcatggtggcattataaataccttacagaagtattattgccgagtgagaggtggccgctgcgcggtgctttcctgtcttcccaaagaggagcagatcggcaaatgtagcacacgcgggagaaagtgctgccgccggaagaag

SEQ ID NO: 10418 - DNA, 201 bp, Artificial Sequence
  Description of Artificial Sequence: Synthetic coding sequence
atgcggatccattacctgctgtttgcgctgctgttcttgttcctggtgccagtgccgggacatggaggcattatcaacactctgcagaagtactactgtcgggtgcggggcggccgctgcgccgttctgtcatgcctgccaaaggaagagcaaatcggaaaatgctccacccgcgggcgaaagtgctgtcgaagaaaaaag

SEQ ID NO: 10419 - DNA, 201 bp, Artificial Sequence
  Description of Artificial Sequence: Synthetic coding sequence
atgcggatccattacctgctttttgccctcctgttcctcttccttgtgcccgtccctgggcacggcggaatcattaacactcttcagaagtattactgcagggttcgcggtggaagatgcgccgtgctgtcgtgccttccgaaagaagagcagatcggaaagtgttccaccagaggaaggaagtgctgtcgccgtaagaaa

SEQ ID NO: 10420 - DNA, 201 bp, Artificial Sequence
  Description of Artificial Sequence: Synthetic coding sequence
atgcgaatccattacctgctgttcgccctcctcttcctgtttctggtcccggtgccagggcacggcggaatcatcaacactcttcaaaagtattactgtagagtgaggggaggacggtgcgcagtgctgtcctgcttgcccaaagaagagcaaatcggtaagtgctcgactcggggccggaagtgttgtcggcgcaagaag

SEQ ID NO: 10421 - DNA, 201 bp, Artificial Sequence
  Description of Artificial Sequence: Synthetic coding sequence
atgcggattcattaccttctgtttgcactcctgtttctgttcttggtcccggtgcccgggcatggcggtatcataaacactctgcaaaagtactactgtcgcgttcgaggaggtcggtgcgccgtgttgtcatgtctgccaaaggaggaacagatcgggaaatgctccaccagaggccgaaagtgttgccggcgcaagaag

SEQ ID NO: 10422 - DNA, 201 bp, Artificial Sequence
  Description of Artificial Sequence: Synthetic coding sequence
atgagaattcactatctactcttcgccctgctcttcctgtttttagtgccagtgccgggacacggtgggatcataaacaccctgcaaaagtactattgccgggtgcgcggcggccgatgcgccgtattgagctgtctgcctaaggaagagcagatcggtaagtgttccaccagaggccggaagtgctgcaggagaaaaaag

SEQ ID NO: 10423 - DNA, 201 bp, Artificial Sequence
  Description of Artificial Sequence: Synthetic coding sequence
atgaggattcactatctgctcttcgccttgttattcctattccttgttccagtgcctggccatgggggaatcatcaataccctccagaagtactactgtagggttagaggcggtaggtgcgcagttctgagctgccttcctaaagaggagcagattggaaaatgcagcacacggggacgtaaatgttgccggcgcaagaaa

SEQ ID NO: 10424 - DNA, 201 bp, Artificial Sequence
  Description of Artificial Sequence: Synthetic coding sequence
atgcgtatacattacctcctgtttgcgctcctgtttctcttcttggtgccagtgccgggacacggcggaatcattaacaccttgcagaaatactattgtcgggttaggggaggccggtgcgccgtgctgagctgcctgcctaaagaggaacaaatcggtaagtgttccactcgcggcagaaaatgctgccggagaaagaag

SEQ ID NO: 10425 - DNA, 201 bp, Artificial Sequence
  Description of Artificial Sequence: Synthetic coding sequence
atgagaatccactacctcctgttcgcccttttgtttctgttcttggtgccggtcccgggtcatggtgggatcatcaacaccctgcagaaatactactgtcgggtgaggggaggtcgctgcgcggttctgtcctgtctgcctaaggaggaacaaattggcaaatgttcgaccagaggtcgtaagtgctgcaggagaaagaag

SEQ ID NO: 10426 - DNA, 201 bp, Artificial Sequence
  Description of Artificial Sequence: Synthetic coding sequence
atgcggatccattacttgctgttcgccctgctttttctgttcttggtcccggtccctggacacggaggaatcattaacaccctgcagaagtactactgtcgtgtgcgcggaggtcggtgtgcagtgctctcgtgcctcccaaaggaggaacagatcggaaagtgctctactcgcggacggaagtgctgtcgcaggaagaaa

SEQ ID NO: 10427 - DNA, 201 bp, Artificial Sequence
  Description of Artificial Sequence: Synthetic coding sequence
atgcgaatccattacctcctttttgcactcctctttttgtttcttgtgccggtgccaggccacggaggtatcataaacactcttcaaaagtactactgcagagtgcgcggcgggcgctgcgcagtgctgtcgtgtctgcctaaggaagaacaaattggaaagtgcagcacccgcggtagaaaatgttgtcggcggaaaaaa

SEQ ID NO: 10428 - DNA, 201 bp, Artificial Sequence
  Description of Artificial Sequence: Synthetic coding sequence
atgcgcatccattacctcctttttgcactgctgtttctatttctagtcccagtccccgggcatggcggaataattaatacccttcagaaatattactgtagagttagaggcggaaggtgtgcagtcttatcctgccttcccaaggaggaacaaatcggaaaatgctctacccggggacggaagtgttgtagacggaaaaag

SEQ ID NO: 10429 - DNA, 201 bp, Artificial Sequence
  Description of Artificial Sequence: Synthetic coding sequence
atgcgcatccattacctgctcttcgcgctcctgttcctgttcctggtgccagtccctggtcatggggggattatcaacaccctgcaaaagtactactgcagagttcgagggggacgctgcgccgtgctctcatgtcttccaaaagaagagcagattggaaaatgtagcaccagaggacggaagtgctgccgccgcaagaag

SEQ ID NO: 10430 - DNA, 201 bp, Artificial Sequence
  Description of Artificial Sequence: Synthetic coding sequence
atgaggatacactacctgttgttcgctttgttgtttttgtttcttgtgccggttcctgggcatggaggaatcattaataccttgcagaaatattactgtcgggtgcggggcggtcgctgcgcggtgttgtcttgcctgccaaaggaggaacagatcggcaaatgcagtaccagaggccgaaagtgttgcaggcgcaagaag

SEQ ID NO: 10431 - DNA, 201 bp, Artificial Sequence
  Description of Artificial Sequence: Synthetic coding sequence
atgcgcatccattacctcttgttcgctcttctcttcttgttccttgttcccgtcccaggacacggtggcattatcaatacattgcagaaatattactgccgcgttaggggcggaagatgcgccgtgttgtcctgcctgcctaaggaagagcagatcggcaagtgttccacacgcggtaggaagtgttgtcgtagaaagaag

SEQ ID NO: 10432 - DNA, 201 bp, Artificial Sequence
  Description of Artificial Sequence: Synthetic coding sequence
atgcgaatccactaccttttgtttgcactgctgtttctgttcctggtccccgtgccagggcatggtggaatcatcaacaccctccagaagtattactgcagagtgaggggaggtagatgcgccgtgctgtcgtgtttgcctaaggaggaacaaatcggaaaatgtagcactcggggtagaaaatgctgtagacgcaagaag

SEQ ID NO: 10433 - DNA, 201 bp, Artificial Sequence
  Description of Artificial Sequence: Synthetic coding sequence
atgcgaatacattatttgctgttcgccctgttgttcctatttttggtgccggtgcccgggcacggggggattatcaacacactccagaagtattactgcagagtccgtggtggtcgatgtgctgtgctgtcatgccttccaaaggaagagcaaataggaaaatgctccacgaggggccggaagtgctgccgaaggaagaag

SEQ ID NO: 10434 - DNA, 201 bp, Artificial Sequence
  Description of Artificial Sequence: Synthetic coding sequence
atgcggatccattatctgttgtttgccctgcttttcctctttctggtacctgtgcccggacatggaggaattatcaacactctgcagaagtattactgtcgggtccgcgggggacgctgtgccgtcctgagttgcctgcctaaagaggagcagatcgggaagtgtagcactagaggcagaaaatgttgtcgccgaaagaaa

SEQ ID NO: 10435 - DNA, 201 bp, Artificial Sequence
  Description of Artificial Sequence: Synthetic coding sequence
atgcggattcactacctgcttttcgctctgctgttcctcttcttggtacctgttccaggccacgggggcatcattaacacgctgcagaagtattactgtcgcgtccgcggggggagatgcgctgtgctgtcttgcttaccaaaagaggagcaaattggcaagtgctccacacgcggtcgaaagtgctgtcgcaggaaaaag

SEQ ID NO: 10436 - DNA, 201 bp, Artificial Sequence
  Description of Artificial Sequence: Synthetic coding sequence
atgcggatccattacctcctgttcgccctgctgttcttgttcctcgtgcctgtgcccggacatggcggaatcatcaataccctgcagaagtactattgtagggtgcggggaggaagatgcgctgtcctgtcctgcctgcctaaggaggaacagattggtaagtgttcaaccaggggcagaaagtgttgcagacggaagaaa

SEQ ID NO: 10437 - DNA, 201 bp, Artificial Sequence
  Description of Artificial Sequence: Synthetic coding sequence
atgaggattcattatctcctcttcgctctgttattcctatttttagtgccagtgccaggccacggaggaataattaatactctgcagaagtattactgtcgcgtgcgtggaggaagatgcgccgtcctctcatgtctgcccaaagaggaacagataggcaagtgcagcacccgaggacggaaatgttgccggcgcaaaaag

SEQ ID NO: 10438 - DNA, 201 bp, Artificial Sequence
  Description of Artificial Sequence: Synthetic coding sequence
atgagaattcactacctgctttttgcgctcctctttctgttccttgttcctgtgccaggccatggtggaataatcaacaccctgcaaaagtactactgtcgggtcagaggaggacgctgcgccgtgctttcgtgccttcccaaagaagagcagattggtaaatgttcgacccgcggtcggaagtgttgtcggagaaagaag

SEQ ID NO: 10439 - DNA, 201 bp, Artificial Sequence
  Description of Artificial Sequence: Synthetic coding sequence
atgaggatccattacctccttttcgcattgctgttcctctttctcgtgcctgtccccggacacgggggaatcatcaacactcttcagaagtactactgtcgggtccggggaggacgatgtgctgtgctgtcctgcctgccgaaggaggaacaaattggtaaatgctcaaccagaggacggaagtgctgtcggcgcaagaaa

SEQ ID NO: 10440 - DNA, 201 bp, Artificial Sequence
  Description of Artificial Sequence: Synthetic coding sequence
atgaggatccactacctgctcttcgcactcctctttttgtttctcgtccccgtcccagggcacggaggcattattaacaccctgcagaaatattactgtcgcgtccgagggggccgttgtgctgtcctgtcctgtctccccaaggaagaacagatcggcaagtgctccaccaggggcaggaagtgctgtcgacgaaagaaa

SEQ ID NO: 10441 - DNA, 201 bp, Artificial Sequence
  Description of Artificial Sequence: Synthetic coding sequence
atgagaattcattacctgctgtttgcactcctttttctgttcttggtacctgtccccggtcacggcggcataatcaacacgctgcaaaagtactactgtcgagtgcgcggcggtcgatgtgccgtgctttcctgcttgccgaaggaggaacagattggcaagtgttcaacccggggtaggaaatgttgtcgacgcaagaag

SEQ ID NO: 10442 - DNA, 201 bp, Artificial Sequence
  Description of Artificial Sequence: Synthetic coding sequence
atgaggatccattacttgctgtttgcgctcctgtttcttttccttgtcccagtgcctggacacggtgggattatcaatactcttcagaaatactactgtcgggtgaggggtggacgctgtgcagtgctgtcatgtctgcctaaagaagaacagattggaaagtgtagcactcgcgggagaaagtgttgtagaaggaagaaa

SEQ ID NO: 10443 - DNA, 192 bp, Artificial Sequence
  Description of Artificial Sequence: Synthetic coding sequence
atgagagtcctttatctattgttctcgtttctgttcatttttttgatgccgctgcctggggtcttcggtgggatcggagatcctgtcacatgtcttaaatccggagccatttgtcatcccgtgttctgccctcgcagatataagcagatcggcacctgcgggctccctgggacaaagtgttgcaaaaagccc

SEQ ID NO: 10444 - DNA, 192 bp, Artificial Sequence
  Description of Artificial Sequence: Synthetic coding sequence
atgcgggtcttgtacttactattttcttttctttttatctttttgatgcctttgccaggggtgtttggtgggatcggtgacccagtgacttgccttaagagcggagcaatctgtcacccagtgttctgtccacgtagatataaacagatcggtacttgtgggcttcccggaacaaagtgctgcaagaagcct

SEQ ID NO: 10445 - DNA, 192 bp, Artificial Sequence
  Description of Artificial Sequence: Synthetic coding sequence
atgagggtgctgtatctcctgtttagctttctatttatcttcctgatgcccctgcccggcgtgttcggcggcataggtgacccggtaacctgtctgaaatccggggctatttgtcacccggtattttgccctcggcgctacaagcagatcgggacatgtggcctgcctggtaccaaatgttgcaagaaacca

SEQ ID NO: 10446 - DNA, 192 bp, Artificial Sequence
  Description of Artificial Sequence: Synthetic coding sequence
atgcgtgtcctgtatctactcttctcttttctttttatttttttgatgccactacccggagtcttcggtggcatcggagatcccgtgacttgtttgaagtctggggccatctgccatccagttttctgcccgcgtcgttacaagcagataggcacctgcggcttgcctggtactaagtgctgcaagaagcct

SEQ ID NO: 10447 - DNA, 192 bp, Artificial Sequence
  Description of Artificial Sequence: Synthetic coding sequence
atgagagtcctgtaccttctgttttcgttccttttcattttcctcatgccccttccaggagtgtttggaggtattggcgacccggtgacttgccttaaatcgggtgccatttgtcatccggtgttttgtcctagaaggtacaagcaaatcggaacctgtggactccctggtactaaatgttgtaagaagccc

SEQ ID NO: 10448 - DNA, 192 bp, Artificial Sequence
  Description of Artificial Sequence: Synthetic coding sequence
atgagagtcctgtacctgctgttcagttttctgtttatctttctaatgcctctaccaggggtgtttggcggaatcggtgatccggtaacatgcttaaaatccggagcaatctgtcacccagttttctgccctcggcgttataaacaaatcggaacttgtgggctccctggcactaagtgctgcaaaaaacct

SEQ ID NO: 10449 - DNA, 192 bp, Artificial Sequence
  Description of Artificial Sequence: Synthetic coding sequence
atgcgcgtgctgtatctgttattctccttcctctttatatttctgatgccattaccaggtgttttcgggggaatcggggacccagtgacgtgtctcaaatccggggctatctgccatcccgtcttctgtcccagacgatacaaacaaattggcacttgtgggctcccaggcacaaaatgctgtaagaagcca

SEQ ID NO: 10450 - DNA, 192 bp, Artificial Sequence
  Description of Artificial Sequence: Synthetic coding sequence
atgagagtcctgtaccttctgttttcctttctgttcatcttcctgatgcccctcccaggagtcttcggcgggatcggggatccagtgacctgcctgaagagcggagctatctgccatcctgtgttctgcccgcgccgatacaagcagatcggcacctgcgggctgcctggaaccaaatgttgcaagaaacca

SEQ ID NO: 10451 - DNA, 192 bp, Artificial Sequence
  Description of Artificial Sequence: Synthetic coding sequence
atgagagtcctatatttattgttctcgtttctgttcattttcctaatgccactccccggggtcttcgggggaatcggagacccagttacatgtctgaaatccggagcaatctgccatcctgtgttttgtcctcgccggtataagcagatcggaacatgtggactacccgggacaaaatgctgtaaaaagccc

SEQ ID NO: 10452 - DNA, 192 bp, Artificial Sequence
  Description of Artificial Sequence: Synthetic coding sequence
atgcgcgtgttgtacctcctcttctcgttcctgttcatctttctgatgccgctgccaggcgtgtttggaggaatcggggacccagtcacctgcctgaaaagcggcgccatctgtcatccggtgttttgtccgcgacggtacaagcaaatcggaacgtgtggactccctggaactaaatgctgcaagaaacca

SEQ ID NO: 10453 - DNA, 192 bp, Artificial Sequence
  Description of Artificial Sequence: Synthetic coding sequence
atgagggtgctgtacctccttttctcattcctctttatcttcctcatgccgctacctggggtctttgggggaatcggagacccagtgacatgtctcaaatctggagcaatctgtcatccagtgttctgtccccggcgatataaacagataggaacatgtgggctccccgggactaaatgctgtaagaaaccc

SEQ ID NO: 10454 - DNA, 192 bp, Artificial Sequence
  Description of Artificial Sequence: Synthetic coding sequence
atgagggtgttgtacctactgtttagcttcctgtttatctttcttatgccattgcccggggtgttcggcggtatcggagaccccgtaacgtgcctgaaaagtggtgcaatctgccatcctgtcttctgtcccagaagatataagcagatagggacctgtggactccctggaacaaagtgctgtaaaaaaccc

SEQ ID NO: 10455 - DNA, 192 bp, Artificial Sequence
  Description of Artificial Sequence: Synthetic coding sequence
atgcgggtcctctatctgctgtttagtttccttttcatcttcttaatgcccctgccgggagtgtttggcggaatcggcgatcccgttacatgcctaaagagcggggccatttgccaccccgttttttgccccagaagatataaacagatcggtacctgcggactgccagggacaaagtgctgcaagaagccg

SEQ ID NO: 10456 - DNA, 192 bp, Artificial Sequence
  Description of Artificial Sequence: Synthetic coding sequence
atgcgcgtgctctaccttctgttcagcttcttgtttatctttctgatgcccctgccgggagttttcggcgggatcggtgacccggtcacttgtctgaagtcgggagcaatctgccatccggtcttttgcccccgccggtacaagcagattggaacctgcggattgccggggactaagtgctgcaaaaaaccc

SEQ ID NO: 10457 - DNA, 192 bp, Artificial Sequence
  Description of Artificial Sequence: Synthetic coding sequence
atgcgcgtgctctacctgcttttttcctttctcttcatcttcctcatgcctctcccgggagtgttcgggggcatcggcgacccggtgacttgtctgaagtcgggcgccatctgccacccggtcttttgcccacggcgctacaaacagattggaacctgtggtctgccgggaacgaagtgctgcaaaaaaccg

SEQ ID NO: 10458 - DNA, 192 bp, Artificial Sequence
  Description of Artificial Sequence: Synthetic coding sequence
atgagggttttgtacctgctgttcagctttctatttatcttcctcatgccgcttcctggcgtgtttggaggcataggggaccccgtgacttgcctcaaatctggggcaatctgccacccagtgttctgcccccgccggtataagcagataggtacttgtggccttcccggcacgaaatgctgtaaaaagcca

SEQ ID NO: 10459 - DNA, 192 bp, Artificial Sequence
  Description of Artificial Sequence: Synthetic coding sequence
atgcgagtgctttatctgctgttttcatttttgttcatcttcttgatgcctttgccaggcgtatttgggggcattggagatcctgtgacctgtttgaaatcaggagcaatctgccacccagtgttctgtccccgtaggtataaacagatcggcacctgtggcctgccagggactaagtgctgcaagaaaccc

SEQ ID NO: 10460 - DNA, 192 bp, Artificial Sequence
  Description of Artificial Sequence: Synthetic coding sequence
atgcgggtcctttacttactgtttagtttcctgttcatctttctaatgcctctccctggagtctttggcggcatcggcgaccctgtgacatgcctgaagtcaggagccatctgccaccccgttttctgtccaaggcggtacaagcagatcggcacatgtggcctccctgggactaaatgttgtaagaagcca

SEQ ID NO: 10461 - DNA, 192 bp, Artificial Sequence
  Description of Artificial Sequence: Synthetic coding sequence
atgagagtcctttacttgctgttcagtttcctcttcatttttctgatgccacttccgggagtgttcggcgggattggcgaccccgtgacgtgtcttaaaagcggtgccatttgccacccagtgttctgcccgcgcaggtataagcagatcggtacctgcggactgcccggcactaaatgctgcaaaaagcct

SEQ ID NO: 10462 - DNA, 192 bp, Artificial Sequence
  Description of Artificial Sequence: Synthetic coding sequence
atgagggttctctatctcctgttttcctttctcttcatctttttgatgcccctgccgggagtctttggcgggattggagatcctgtgacttgtttgaagtcgggggctatttgtcatcccgtcttttgccctcgaagatataagcagatcggcacatgcggtttgcctggtaccaaatgttgtaaaaagccc

SEQ ID NO: 10463 - DNA, 192 bp, Artificial Sequence
  Description of Artificial Sequence: Synthetic coding sequence
atgcgggtcttgtacctcctattctcctttctgtttatttttctgatgcccctgcccggggtgttcggtggcataggggaccctgtgacatgcctcaagtccggcgctatttgtcatcctgtgttctgccccaggcggtacaagcagatcggaacctgtggactaccaggtacaaagtgttgcaagaagccc

SEQ ID NO: 10464 - DNA, 192 bp, Artificial Sequence
  Description of Artificial Sequence: Synthetic coding sequence
atgagagtgctctacctgctcttttcctttcttttcatttttctcatgcctctgcccggtgtgtttggaggcatcggtgaccccgtgacctgcctgaagtcgggtgcaatttgccatccggtgttctgtcctcgacggtacaagcaaataggaacctgcgggcttcctgggactaagtgctgcaaaaagcct

SEQ ID NO: 10465 - DNA, 192 bp, Artificial Sequence
  Description of Artificial Sequence: Synthetic coding sequence
atgagagtgctttaccttctgttctccttcctgttcatttttctcatgcctctccctggcgtgttcggtggcattggagatcccgtcacttgcctcaagtcgggagcaatctgccatcctgtcttttgtccccgaagatacaaacaaatcggtacctgtggcctgccgggaactaaatgttgtaaaaagcca

SEQ ID NO: 10466 - DNA, 192 bp, Artificial Sequence
  Description of Artificial Sequence: Synthetic coding sequence
atgcgtgtgctatacctcctgttctcatttctctttatctttctgatgccactgccaggcgtttttggtggaatcggcgatcctgtaacatgcctgaagagcggggccatttgccatcctgtgttctgtccccgaaggtacaagcaaatcggtacatgtggcctccccgggacgaaatgctgtaaaaaacct

SEQ ID NO: 10467 - DNA, 192 bp, Artificial Sequence
  Description of Artificial Sequence: Synthetic coding sequence
atgcgtgttctgtacctcctgttttcttttttatttatctttctcatgcctctccccggtgtgttcggtgggataggagaccctgtgacatgtctcaaaagtggagcaatttgtcaccccgtattctgcccgagaaggtacaaacaaatcggtacctgcgggctgcccggcacaaaatgttgcaagaagccc

SEQ ID NO: 10468 - DNA, 192 bp, Artificial Sequence
  Description of Artificial Sequence: Synthetic coding sequence
atgcgggtgctctacctcctgttttcgttccttttcatcttcctgatgccattgcctggagtgttcggagggattggcgaccccgtgacctgcctgaagtccggagccatctgccacccggtcttttgcccgcgcagatacaaacagatcggaacttgtggcctgccgggtaccaaatgttgcaagaagcca

SEQ ID NO: 10469 - DNA, 192 bp, Artificial Sequence
  Description of Artificial Sequence: Synthetic coding sequence
atgcgagtgctgtatctgctttttagcttcctgttcatctttctcatgcctctgccaggagtctttggtggaatcggcgatccagtgacgtgtcttaaatcgggagcgatttgccaccctgtgttctgcccgagacgctacaaacaaatcggaacctgtggactgccaggtactaagtgttgtaagaagccg

SEQ ID NO: 10470 - DNA, 192 bp, Artificial Sequence
  Description of Artificial Sequence: Synthetic coding sequence
atgagggtcctttacttgctgtttagctttctcttcatcttcctgatgcctctccccggggtatttggcggcataggagacccagtaacttgtctgaaatctggtgcgatctgccatccagtcttctgtcctcggcgatacaagcagatcggcacttgcggcttgcctgggaccaagtgttgcaagaaacct

SEQ ID NO: 10471 - DNA, 192 bp, Artificial Sequence
  Description of Artificial Sequence: Synthetic coding sequence
atgcgagtcctctacctgctgttttcctttctgtttatcttcctgatgccattgcctggggtctttgggggtatcggagatccagttacttgccttaagtccggtgcaatttgtcacccggtgttttgtcccagacggtacaagcaaatcggtacctgtggactccctggaacgaagtgttgcaagaagcct

SEQ ID NO: 10472 - DNA, 192 bp, Artificial Sequence
  Description of Artificial Sequence: Synthetic coding sequence
atgcgcgtgctgtaccttctgttctcctttctctttatctttctcatgccattgcctggagtctttggcggcattggtgacccagtgacctgcctgaagtcgggcgcaatctgtcatcctgtgttttgccctcgtcggtataaacaaattggcacctgcgggctgccaggaaccaagtgttgcaagaaaccc

SEQ ID NO: 10473 - DNA, 192 bp, Artificial Sequence
  Description of Artificial Sequence: Synthetic coding sequence
atgagagtcctgtacctgctgttttcgtttcttttcatattcctcatgcctctccccggcgtctttggtggcattggcgatcccgtgacatgcctgaaatctggagccatctgtcacccagtgttctgtcctagaaggtataagcaaataggaacctgcgggctcccaggaacgaagtgttgtaaaaaaccc

SEQ ID NO: 10474 - DNA, 192 bp, Artificial Sequence
  Description of Artificial Sequence: Synthetic coding sequence
atgcgggtcctgtacctcctcttctcattcctgtttatcttcctcatgccgctgccaggggtttttggtggcatcggggacccggtgacttgcttgaagtccggagcgatttgtcacccagtgttctgcccgagacgatacaaacagatcggaacctgcggcctgccgggtacgaagtgctgtaaaaagcct

SEQ ID NO: 10475 - DNA, 192 bp, Artificial Sequence
  Description of Artificial Sequence: Synthetic coding sequence
atgagggtcttatacctgctcttttccttcctgtttatttttcttatgcctcttccgggcgtattcggaggaattggggatccggtcacatgcttgaagtctggtgccatttgccaccccgtcttctgcccacgcagatataagcagatcggtacctgtggccttccgggcaccaagtgttgcaagaagccc

SEQ ID NO: 10476 - DNA, 192 bp, Artificial Sequence
  Description of Artificial Sequence: Synthetic coding sequence
atgagagtcctgtacttgctcttttccttcctgttcatctttttaatgcccctgccaggtgtgtttgggggcataggagatccggtcacctgtttgaagtctggagccatctgccaccccgtgttttgcccaaggagatacaagcaaattgggacctgtgggctccctggcaccaagtgttgtaagaaacct

SEQ ID NO: 10477 - DNA, 192 bp, Artificial Sequence
  Description of Artificial Sequence: Synthetic coding sequence
atgagggtgctttatctcctgttctccttcctcttcatcttcttgatgccactacccggcgtttttggcgggataggtgatccggtgacctgcctgaagtccggagccatttgccatccagtgttctgtcctcgccgatataaacagatcggtacgtgcggcctacccggtacgaagtgttgtaagaagccc

SEQ ID NO: 10478 - DNA, 192 bp, Artificial Sequence
  Description of Artificial Sequence: Synthetic coding sequence
atgcgggtgctttacctgctgttctcgtttctgtttatcttccttatgcctctgcctggagtgtttggcggcataggagatccagtcacctgcctgaagtccggggcaatttgccatcccgtcttttgcccaagacgttacaagcaaattggcacttgtggacttcccggtactaaatgttgtaaaaagcct

SEQ ID NO: 10479 - DNA, 192 bp, Artificial Sequence
  Description of Artificial Sequence: Synthetic coding sequence
atgagagtgctgtacctcctcttcagctttctcttcatttttttgatgcccctgcctggcgtattcgggggaatcggcgatcccgtgacgtgcctgaagtctggtgccatctgccatccggtgttctgtcctcgacgatataagcagatagggacctgcggactcccgggcacaaagtgttgcaaaaaacca

SEQ ID NO: 10480 - DNA, 192 bp, Artificial Sequence
  Description of Artificial Sequence: Synthetic coding sequence
atgcgagttctgtaccttttgttctccttccttttcatttttctcatgcctctgcccggggtgtttggcggcatcggggaccctgttacatgtctaaaatcgggcgccatctgccatccggtgttctgcccaagacgatacaagcagataggcacatgtggccttcctgggacgaagtgttgcaagaagcca

SEQ ID NO: 10481 - DNA, 192 bp, Artificial Sequence
  Description of Artificial Sequence: Synthetic coding sequence
atgcgggtgttgtatttactgtttagttttcttttcatctttttaatgccactacctggggtgtttggtgggattggggaccccgtaacctgtctcaaatccggcgcgatttgtcaccccgtcttttgcccgagaaggtataagcagatcggaacgtgcggacttcccggcaccaagtgctgcaaaaagccc

SEQ ID NO: 10482 - DNA, 192 bp, Artificial Sequence
  Description of Artificial Sequence: Synthetic coding sequence
atgcgtgtcttgtatctgctcttcagtttcctgttcatctttttgatgcccttgcccggcgtcttcggcggaatcggagaccctgtgacttgtctgaagagtggtgctatctgccatccagtgttctgtccccgtcgctacaagcaaatcggtacctgcggtttgcctggtacaaagtgctgtaagaagccc

SEQ ID NO: 10483 - DNA, 192 bp, Artificial Sequence
  Description of Artificial Sequence: Synthetic coding sequence
atgcgggtcctttaccttcttttctcgtttctcttcatattccttatgcctctgccaggagtgttcggcgggattggcgacccagtcacttgccttaagtccggagcaatttgccatccggtgttttgtccacgaaggtacaagcagattggtacttgtggcctgccaggaaccaagtgttgtaagaagcct

SEQ ID NO: 10484 - DNA, 192 bp, Artificial Sequence
  Description of Artificial Sequence: Synthetic coding sequence
atgagggttctctacttgctcttttccttcctttttattttcctgatgcccctgcctggtgtcttcggcggcatcggtgatccagtgacctgcctgaaatctggtgcaatctgccacccggtgttctgccctcgccgctacaaacagataggaacctgtggtctgccgggtactaaatgttgtaaaaagcca

SEQ ID NO: 10485 - DNA, 192 bp, Artificial Sequence
  Description of Artificial Sequence: Synthetic coding sequence
atgcgcgtgctgtacctcctcttctcattcctgttcatcttcctcatgccactgccaggtgtgttcggcggaatcggagatcctgttacttgcttgaagtccggggccatctgccaccccgtgttctgtccgagacggtacaagcaaattggaacctgcggcttgccgggaaccaaatgttgcaagaaaccg

SEQ ID NO: 10486 - DNA, 192 bp, Artificial Sequence
  Description of Artificial Sequence: Synthetic coding sequence
atgcgggtgctctatctactgttcagctttctatttatcttcctgatgccattgcccggcgtttttggaggaatcggggatccagtgacttgcctgaagagcggtgcaatctgccacccagtattttgcccacgtagatacaagcagataggcacttgtggcctgcctggaaccaagtgttgcaagaagccc

SEQ ID NO: 10487 - DNA, 192 bp, Artificial Sequence
  Description of Artificial Sequence: Synthetic coding sequence
atgagagtgctctaccttctgttttcgttccttttcatcttcctgatgcccctgccgggtgtattcggtggaatcggtgaccctgtgacctgcttgaagtccggcgccatctgtcacccagtgttttgtccacggcgctacaagcagattgggacttgcggactgcctggaactaagtgctgcaaaaaaccg

SEQ ID NO: 10488 - DNA, 192 bp, Artificial Sequence
  Description of Artificial Sequence: Synthetic coding sequence
atgcgcgttctgtaccttctgttttccttcctgttcatcttcctgatgcccttgccaggggtgttcggcgggatcggagatcccgtcacctgtctcaagtcgggcgccatctgccacccagtgttctgcccgcgccggtacaaacagatcggtacttgtggcctgccaggcaccaagtgctgcaagaaacca

SEQ ID NO: 10489 - DNA, 192 bp, Artificial Sequence
  Description of Artificial Sequence: Synthetic coding sequence
atgcgagtgctgtaccttttgttttcgtttcttttcatcttcctgatgcctctccctggtgtgtttgggggtattggtgaccctgtgacgtgcctcaagtccggtgcaatctgtcatcctgtgttttgcccacggagatacaagcaaattgggacttgtgggcttccgggtaccaaatgttgtaaaaagcct

SEQ ID NO: 10490 - DNA, 192 bp, Artificial Sequence
  Description of Artificial Sequence: Synthetic coding sequence
atgcgcgttctgtacctgctgttttccttcttgttcattttcctcatgcccctccccggcgtgttcggaggcattggggacccagtcacatgcttaaagagcggggccatttgccaccctgttttctgtcccaggcgctataaacagatagggacatgcggactgcccggtacaaagtgctgtaaaaagcca

SEQ ID NO: 10491 - DNA, 192 bp, Artificial Sequence
  Description of Artificial Sequence: Synthetic coding sequence
atgagagtgttatacttgctgttcagtttcctttttatttttctgatgcccctgccaggcgtttttggcgggataggggatccagttacctgcctgaagagcggcgctatatgccaccccgtgttctgcccaaggcggtacaagcagattggcacttgcggcctacctggcacaaaatgctgtaaaaaaccc

SEQ ID NO: 10492 - DNA, 192 bp, Artificial Sequence
  Description of Artificial Sequence: Synthetic coding sequence
atgcgagtgctatatcttctgttttcgtttctttttatttttttgatgccattgccgggagttttcggcggaattggagacccagttacttgtttgaagtcaggcgccatctgtcatccagtattttgtccgagacgatataagcaaatcgggacatgtggactcccgggaacaaaatgctgtaaaaaacca

SEQ ID NO: 10493 - DNA, 192 bp, Artificial Sequence
  Description of Artificial Sequence: Synthetic coding sequence
atgcgggtgctttacttgttgttctccttcctgtttatctttttgatgcccctgcctggagtctttggcggaatcggggatccggtgacctgcctgaagtcgggcgcaatctgtcatccagtgttctgccctagacgttacaagcagattggtacttgtgggttgccaggtactaaatgttgcaagaagcct

SEQ ID NO: 10494 - DNA, 192 bp, Artificial Sequence
  Description of Artificial Sequence: Synthetic coding sequence
atgcgcgtgctttatctgctgttctccttcctctttatctttctcatgccactgccgggagttttcggaggcattggtgatccagtgacttgcctgaagagcggcgcgatctgtcaccctgtgttttgtccaagaagatacaaacagatcggaacgtgcgggctgccaggaaccaaatgctgcaagaagccg

SEQ ID NO: 10495 - DNA, 192 bp, Artificial Sequence; identical to SEQ ID NO: 10466
  Description of Artificial Sequence: Synthetic coding sequence

SEQ ID NO: 10496 - DNA, 192 bp, Artificial Sequence
  Description of Artificial Sequence: Synthetic coding sequence
atgcgcgtgttgtacctgctgttcagcttcctgtttatcttcctcatgcctctgcctggggtgtttggcggaatcggcgaccctgtgacttgccttaaatcaggggccatttgccacccagtgttttgcccccgcaggtataagcagatcggaacctgcggcctccctggcactaagtgctgtaaaaagccg

SEQ ID NO: 10497 - DNA, 192 bp, Artificial Sequence
  Description of Artificial Sequence: Synthetic coding sequence
atgcgggtattgtacctgttgttcagtttcctatttatttttcttatgcctctgcccggcgtgttcggcggcatcggtgatcccgttacgtgcttaaaaagcggagccatctgccaccccgtattctgcccaaggcgatataaacagatcggtacctgtggcttgccaggcaccaaatgctgtaagaagcct

SEQ ID NO: 10498 - DNA, 192 bp, Artificial Sequence
  Description of Artificial Sequence: Synthetic coding sequence
atgagagttctctacctgctgttctctttccttttcatcttcttgatgccgttgcccggcgtcttcggtggtataggtgaccccgtaacgtgcctgaagagcggggcaatatgccatccagtcttctgtccacggcgctacaaacagataggaacctgtggccttccaggcactaagtgctgtaagaagccg

SEQ ID NO: 10499 - DNA, 192 bp, Artificial Sequence
  Description of Artificial Sequence: Synthetic coding sequence
atgagggtgctgtacctgttgttctccttcctgtttatcttcctcatgccgctgccgggagtttttggaggcatcggggacccagtcacttgcctcaaaagcggtgccatatgtcacccagtgttctgtcctcgtcggtacaaacagatcggaacctgcgggcttcccggaaccaagtgctgcaagaagccg

SEQ ID NO: 10500 - DNA, 192 bp, Artificial Sequence
  Description of Artificial Sequence: Synthetic coding sequence
atgagagtgctctacctcttgttctcgttcctctttatctttctgatgccccttccgggggtctttggaggaatcggagatccagtcacgtgtctcaaatcgggtgcaatttgccatcctgtgttttgtcctcggaggtacaagcaaataggtacttgtggactgcctggcaccaagtgctgcaagaagcca

SEQ ID NO: 10501 - DNA, 192 bp, Artificial Sequence
  Description of Artificial Sequence: Synthetic coding sequence
atgagagtgctctaccttctctttagctttttgtttatcttccttatgcctttgcctggggtgttcggaggaataggagatccagtgacctgtcttaagtccggggcaatttgtcatcccgttttctgcccccggcgctacaagcaaataggaacttgtggccttccggggactaagtgttgcaaaaaaccg

SEQ ID NO: 10502 - DNA, 192 bp, Artificial Sequence
  Description of Artificial Sequence: Synthetic coding sequence
atgcgggtcctgtaccttctgttttcgttcctgttcatcttcttgatgccgctcccgggcgtattcggaggaattggtgacccagtgacctgcctcaaatcaggggccatctgccaccctgtgttttgcccaagacgatacaagcagatagggacttgcggactgcccggaaccaaatgttgcaagaagccg

SEQ ID NO: 10503 - DNA, 192 bp, Artificial Sequence
  Description of Artificial Sequence: Synthetic coding sequence
atgcgtgttctgtacctgctgttctcctttctgttcatattccttatgcctttgcctggagtcttcggaggaataggcgaccctgtaacctgtctcaagtctggggccatttgccaccctgtgttctgtccaagaaggtataagcagatagggacatgtggcctgccaggcaccaaatgctgcaaaaagccc

SEQ ID NO: 10504 - DNA, 192 bp, Artificial Sequence
  Description of Artificial Sequence: Synthetic coding sequence
atgcgagtactatatttattattttcgtttctatttatatttttaatgccgttaccgggtgtttttggtggtataggtgatccggttacgtgtttaaaatcgggtgcgatatgtcatccggtattttgtccgcgtcgatataaacaaataggtacgtgtggtctaccgggtacgaaatgttgtaaaaaaccg

SEQ ID NO: 10505 - DNA, 192 bp, Artificial Sequence
  Description of Artificial Sequence: Synthetic coding sequence
atgcgagttctctacctcctgttctcatttttgttcatctttctgatgccactgcctggtgtgttcggaggaatcggagatccggtcacgtgtctgaagtccggcgcaatctgccaccccgtgttctgcccgagacggtacaagcagataggtacttgtgggctgcccggcaccaaatgctgcaaaaagccg

SEQ ID NO: 10506 - DNA, 192 bp, Artificial Sequence
  Description of Artificial Sequence: Synthetic coding sequence
atgcgagttttgtatctgctcttctccttcctgtttatcttcctgatgccccttccaggagttttcggcgggatcggggatcccgtgacctgtctgaaatcaggagcgatttgccatcctgtcttttgccctagacgatataagcagatcgggacatgcggcctgccgggtacaaaatgctgcaagaaacct

SEQ ID NO: 10507 - DNA, 192 bp, Artificial Sequence
  Description of Artificial Sequence: Synthetic coding sequence
atgagggtgctttacctgctgttcagcttcctctttatattcctcatgccactgcccggggtgttcgggggcatcggagatcccgtcacatgcctgaagtctggagcaatatgccaccccgtgttctgtcccagacggtacaagcagattgggacctgcgggctccccggcaccaagtgctgcaagaaaccc

SEQ ID NO: 10508 - DNA, 192 bp, Artificial Sequence
  Description of Artificial Sequence: Synthetic coding sequence
atgcgcgttttgtacttgttgttttccttcctgtttatctttcttatgcctctgcccggcgtcttcgggggaattggagatccagtgacgtgtctgaagtcaggtgccatctgtcatccggtgttctgcccacggaggtataagcagatagggacctgtgggctgcctggaactaaatgctgtaagaagcca

SEQ ID NO: 10509 - DNA, 192 bp, Artificial Sequence
  Description of Artificial Sequence: Synthetic coding sequence
atgagagtgctctatctcttgttctctttcctctttatcttcctgatgccactccccggtgtatttggcgggattggggatccagtcacatgcttgaagtctggggcaatatgtcaccctgtattctgtcctagacgttataagcagattggcacatgtggtctccctggcactaagtgctgtaagaaacct

SEQ ID NO: 10510 - DNA, 192 bp, Artificial Sequence
  Description of Artificial Sequence: Synthetic coding sequence
atgagagtcctttacctgcttttctcatttcttttcatattccttatgccgctgcctggagtgttcggggggattggcgaccccgtgacctgtctcaagtcgggggccatctgtcaccctgtcttttgcccacgaaggtacaagcagattggaacctgtggtctgccaggtaccaagtgctgtaaaaagcca

SEQ ID NO: 10511 - DNA, 192 bp, Artificial Sequence
  Description of Artificial Sequence: Synthetic coding sequence
atgagagtactttatttattattttcttttttatttatttttttaatgccattaccaggagtttttgggggaattggtgatccagtaacttgtttaaaatcgggagcaatttgtcatccagttttctgtccaagacgttataaacaaattggaacatgtggattaccaggaacaaaatgttgtaaaaaacca

SEQ ID NO: 10512 - DNA, 192 bp, Artificial Sequence
  Description of Artificial Sequence: Synthetic coding sequence
atgcgcgtactatacctactatttagttttctgtttatattcctaatgcctttacctggtgtttttggaggcataggagaccctgtgacttgcctgaaatcaggggcaatttgccaccctgttttctgcccacgccgttacaaacagataggaacctgcgggcttcccggtactaaatgctgtaagaaaccg

SEQ ID NO: 10513 - DNA, 192 bp, Artificial Sequence
  Description of Artificial Sequence: Synthetic coding sequence
atgagggttctgtatctcctgttcagttttctctttatttttctgatgcccctacctggagtgttcggaggaattggagaccctgtcacctgccttaagtctggggcaatctgtcatcctgttttttgtcccaggcgatacaagcaaataggaacctgcggtttgcctggcaccaaatgctgtaagaaacca

SEQ ID NO: 10514 - DNA, 192 bp, Artificial Sequence
  Description of Artificial Sequence: Synthetic coding sequence
atgagagtcctctacctgcttttctcatttctctttatctttcttatgcccctgccgggtgtgttcggcggtataggggatcctgttacctgccttaagtccggcgccatttgtcatcccgtgttctgtccgcgccggtacaagcaaattggaacttgtgggctgcctggcaccaagtgttgcaaaaaacca

SEQ ID NO: 10515 - DNA, 192 bp, Artificial Sequence
  Description of Artificial Sequence: Synthetic coding sequence
atgcgggtgttgtacctcctcttttcctttcttttcatctttctgatgccactgcccggagttttcggtggaatcggagatcctgtgacctgtctgaagtcaggagcaatatgccatccagtgttttgccctcgtcgctacaagcaaattggaacctgtggtctgccaggaacgaagtgttgtaagaaacca

SEQ ID NO: 10516 - DNA, 192 bp, Artificial Sequence
  Description of Artificial Sequence: Synthetic coding sequence
atgagggtcctttacctgctcttttcatttctctttatcttcctgatgccgctgccgggagttttcggaggaatcggagatccggtgacgtgtttgaaatccggcgcgatctgccacccagtgttctgcccgcgccggtacaaacagattggcacctgtgggcttccgggaactaagtgctgcaagaagccg

SEQ ID NO: 10517 - DNA, 192 bp, Artificial Sequence
  Description of Artificial Sequence: Synthetic coding sequence
atgagggtcctgtacctgttgttctccttcctgttcatctttctgatgccacttccgggagtcttcggaggaatcggcgacccggtgacctgtttgaagagcggagccatctgccacccggtcttctgcccaagacggtataaacagatcggcacttgtgggctgcctggaaccaagtgttgtaaaaagcct

SEQ ID NO: 10518 - DNA, 192 bp, Artificial Sequence
  Description of Artificial Sequence: Synthetic coding sequence
atgcgggtgctgtatctgctgtttagcttcttgttcatctttctgatgccgttaccgggcgtgttcggtgggatcggcgatccggttacctgcctgaagtctggagcaatatgccacccggtgttctgcccacgccgctacaaacaaatcggcacctgtggcctgccagggacaaagtgctgtaaaaaacct

SEQ ID NO: 10519 - DNA, 192 bp, Artificial Sequence
  Description of Artificial Sequence: Synthetic coding sequence
atgcgcgtgctgtacctgctgttcagcttcctctttatcttcctgatgccgttgccgggagtctttggcggaatcggcgacccggtgacttgcctgaaatccggagcgatctgccatccagttttttgtccaaggcggtacaaacagatcggaacctgcggactgccaggaaccaaatgttgcaagaagcca

SEQ ID NO: 10520 - DNA, 192 bp, Artificial Sequence
  Description of Artificial Sequence: Synthetic coding sequence
atgagagtgctttaccttctgtttagcttcctcttcatctttcttatgccgttgcccggcgtctttggtggtattggagatccagtcacctgtctcaagtcgggggccatttgccatcctgttttctgcccgagacggtacaagcaaataggaacttgtggactgcctggtacgaagtgctgtaagaaacca

SEQ ID NO: 10521 - DNA, 192 bp, Artificial Sequence
  Description of Artificial Sequence: Synthetic coding sequence
atgcgcgtgttgtacctcctgttctcgtttctgttcatctttctgatgccgcttccgggggtgttcggaggaattggagatccagtcacgtgcctgaaatcaggtgccatctgtcacccggttttctgccctagacgatacaagcagatcggcacttgtggcctgccggggactaaatgctgtaagaagccg

SEQ ID NO: 10522 - DNA, 192 bp, Artificial Sequence
  Description of Artificial Sequence: Synthetic coding sequence
atgcgggtcctgtacctgctgtttagctttctatttattttcctgatgccactgccaggcgtattcggaggaatcggagatccggtgacctgtctcaagtccggcgcgatttgccaccccgtcttctgccctcggcgctataaacagatagggacttgcgggctgcccgggacaaagtgttgcaaaaagcca

SEQ ID NO: 10523 - DNA, 192 bp, Artificial Sequence
  Description of Artificial Sequence: Synthetic coding sequence
atgagagtattatatctcctcttctcgttcctattcatcttcttgatgcccctgccaggagtcttcggaggcattggggacccagtgacatgcttaaagagcggcgctatctgtcaccccgttttctgcccccggcgttataaacagataggtacatgtggtcttcctgggactaagtgttgcaaaaagccc

SEQ ID NO: 10524 - DNA, 192 bp, Artificial Sequence
  Description of Artificial Sequence: Synthetic coding sequence
atgcgtgtcttgtacctgctgttttcattccttttcatattcctgatgccgttaccaggggttttcggcggaatcggtgatccagttacatgtctgaaaagtggggctatttgccatcctgtgttttgtccacgtaggtacaaacagattggtacctgtgggctgcccggcactaagtgctgtaaaaagccg

SEQ ID NO: 10525 - DNA, 192 bp, Artificial Sequence
  Description of Artificial Sequence: Synthetic coding sequence
atgagagtgctctacctgctgttctcgttccttttcatcttcctgatgccgctcccgggagtgttcggcggaattggcgatcctgtcacttgcctgaaatcaggtgcaatctgtcacccagtgttttgcccgcggaggtacaagcagattggtacgtgcggattgcccggtactaagtgctgtaagaaaccc

SEQ ID NO: 10526 - DNA, 192 bp, Artificial Sequence
  Description of Artificial Sequence: Synthetic coding sequence
atgcgtgttctgtaccttttattcagcttcttgttcatattcttgatgcctctgccaggggtcttcgggggcatcggtgacccagtgacttgcctcaagtctggcgccatctgtcatcctgtcttctgcccccgaagatacaagcagattggcacatgcggtttaccaggcacaaagtgttgtaagaagcct

SEQ ID NO: 10527 - DNA, 192 bp, Artificial Sequence
  Description of Artificial Sequence: Synthetic coding sequence
atgcgcgttttgtacctgttgttttccttcctgttcatttttctgatgcctcttcccggggtgttcggtgggataggtgatccggtcacgtgtctcaagtcgggagcaatatgtcatcccgtgttctgtccaagaaggtacaagcagatcggaacctgcggccttcctggtactaaatgctgcaagaagccg

SEQ ID NO: 10528 - DNA, 192 bp, Artificial Sequence
  Description of Artificial Sequence: Synthetic coding sequence
atgcgggtcctgtatttgctgttctctttcctcttcattttcctgatgccactgcccggtgtctttggtggcattggcgatccagtcacttgcctcaagagcggcgcaatttgccatccagttttctgtccccgaaggtacaagcagatcggtacctgcggcttgcccggaacaaaatgttgtaagaaacct

SEQ ID NO: 10529 - DNA, 192 bp, Artificial Sequence
  Description of Artificial Sequence: Synthetic coding sequence
atgcgcgtgctgtacctcttgttcagcttcctgttcattttcctgatgccgctgccgggggtctttggtggaatcggggaccctgtgacttgtctgaagagcggagcaatctgccacccggtgttctgccctcggaggtacaaacagatcggaacttgtggactgccaggaacgaagtgctgtaaaaagcct

SEQ ID NO: 10530 - DNA, 846 bp, Artificial Sequence
  Description of Artificial Sequence: Synthetic coding sequence
atgcgcggaatgaaacttttgggagcccttctggctctcgccgcattactacagggggccgtatcccttaaaatagccgcctttaacatacagactttcggagaaacaaaaatgagtaatgccacactagtgtcatatatagttcagatactctcaaggtatgatatcgctctagtccaggaagtccgtgattcccatctgacagccgtcggaaaactgctggataatcttaatcaagatgcccccgatacatatcactatgtagtttcagagccactagggagaaacagttacaaagaacggtatctattcgtttatcgaccagatcaggttagtgccgtggatagttactactatgacgatgggtgtgaaccatgcggaaacgacactttcaatcgggaacctgctatcgtccgttttttttcacggtttacagaagtgcgggaatttgccatagtacccctgcacgctgctcccggagatgcagtagctgagatagatgccctttatgatgtgtatcttgatgtgcaggagaaatgggggctggaggatgtaatgttaatgggggatttcaacgcgggatgctcatacgtgaggccaagtcagtggtctagtattagactatggacttctcctacattccagtggttgataccagactctgctgatacaactgccacacccactcactgcgcctacgacaggatagtggttgcaggaatgctcctacgcggagccgtagtgcccgattctgctctgccatttaatttccaggctgcgtatgggctgagtgatcagcttgcccaggctatatctgatcattacccggtggaagtcatgctcaaa

SEQ ID NO: 10531 - DNA, 846 bp, Artificial Sequence
  Description of Artificial Sequence: Synthetic coding sequence
atgcggggaatgaagctgctgggggcgctgctggctctcgccgcgctactgcagggtgcagtgagcctgaagattgccgcattcaacattcaaaccttcggtgagacgaagatgtctaacgccacactggttagctatatcgtccagattttgtccagatatgacatagccctggttcaagaggtgcgagattcacatctgaccgccgtgggtaagttgctggacaacctgaaccaggacgcccctgacacctatcattatgttgtcagtgagccactcggtcgtaattcctacaaagagaggtacttatttgtatacaggcctgatcaagtctccgccgttgattcttactattacgacgatggttgtgagccgtgtgggaatgacacttttaacagagaacctgccattgttcgtttcttttcccgattcacggaggtacgcgagttcgcgatcgtgccactccacgccgcgccaggtgacgccgtggctgaaattgatgctctgtacgatgtgtacctggatgttcaagagaaatggggcctggaagacgttatgctgatgggtgatttcaatgccggctgttcgtacgttcgccccagccagtggagctctatccgcctgtggacgtccccgacttttcaatggctgattccagattcggccgatactaccgcaactccaacccactgcgcgtacgaccgtattgtagttgcaggtatgctgctgcgcggtgctgtcgtgccggacagcgcgctgcctttcaattttcaagcggcttatggcctgagtgatcagctggctcaggccatatccgatcactatccagttgaagttatgctgaaa

SEQ ID NO: 10532 - DNA, 846 bp, Artificial Sequence
  Description of Artificial Sequence: Synthetic coding sequence
atgcggggcatgaagctgctgggggcacttttggcactggcagcattgctccagggtgccgtgtccctcaagatcgcggctttcaatatccaaactttcggagaaaccaagatgtccaacgccactctggttagctacatcgtgcaaattctgtcgcggtacgatatcgcactggtgcaggaggtccgggattcgcacctgactgccgtgggcaagttgctggacaacctgaaccaggacgccccggacacctatcattacgtcgtcagcgaaccattgggaagaaactcctacaaggaacgatacctgttcgtctacagaccggaccaggtgagcgccgtcgatagctactactatgacgacggatgtgagccttgcgggaatgacactttcaaccgggagccggccatcgtgagattcttctcaaggtttacggaagtgcgggagttcgctatcgttcctctccacgccgcaccgggagatgccgtggctgaaatcgacgcattgtacgacgtttaccttgatgtgcaagagaagtggggactcgaggacgtgatgctgatgggggactttaatgccggctgctcctacgtgcgcccgagccagtggtcatctatccgcctttggacctcgcctacttttcagtggctcattccggatagcgcagacaccaccgctacccccacccactgcgcgtacgaccgtatcgtcgtggctggaatgctgctgaggggcgctgtggtgccggactccgcccttcctttcaatttccaagctgcgtacggcctgtcggatcagctcgctcaagccataagcgatcattaccccgtggaagtgatgctgaag

SEQ ID NO: 10533 - DNA, 846 bp, Artificial Sequence
  Description of Artificial Sequence: Synthetic coding sequence
atgaggggaatgaagctcctgggggcgctcctggcacttgcggcacttctgcaaggcgctgtgtccctcaagattgcagcgtttaacattcagacttttggagaaaccaaaatgtcgaacgcaaccctcgtgagctacatcgtccagattctctcgcgctacgacatagcactggtgcaagaagtgcgggactcacatctcaccgcggtcggaaaactccttgacaacctgaatcaagatgcccctgatacgtaccattacgtggtcagcgagccacttggcagaaacagctacaaggaaagatatctctttgtgtaccggcctgaccaggtatcagcagtcgattcatactactacgatgatggctgtgaaccttgcggtaacgatactttcaaccgtgagcccgccattgtccgcttcttctcgcgctttactgaagtgagggaatttgcaatcgtgccactgcacgccgcccccggcgacgccgtggcagaaattgacgcactgtacgatgtctacttggacgtgcaggaaaagtgggggcttgaggacgtcatgcttatgggagactttaacgcagggtgttcgtacgtccgcccctctcagtggtcatcaataagactgtggacctcccctacttttcagtggctcatcccagattctgccgacacgaccgcaactcctacgcattgcgcgtacgatagaatcgtggtggccggaatgcttctcagaggagcggtggtccccgattccgcactcccttttaacttccaagccgcatacggacttagcgatcaactggcacaagcgattagcgaccattacccggtggaggtcatgctcaag

SEQ ID NO: 10534 - DNA, 846 bp, Artificial Sequence
  Description of Artificial Sequence: Synthetic coding sequence
atgaggggaatgaagttgctcggtgcactgttggcactggcagcattgctgcaaggtgcagtttctttgaaaatcgcagccttcaacatccagacctttggagaaaccaagatgagtaacgcaactctggtgagctacattgtccagattctgtcgcgctacgatattgccctggtgcaagaggtcagggattcccacctgaccgcagtgggcaaattgcttgataacctgaaccaggatgcacctgacacgtaccactacgtggtcagcgagcctctcgggcgcaattcgtacaaggaacggtaccttttcgtctaccggccagatcaagtgtcagcggtggattcgtattactatgacgacggatgtgagccttgtggcaacgacacgtttaaccgcgaaccagccattgtccgatttttctcccgctttaccgaagtgcgagaattcgccatcgttccgcttcatgcggcaccaggtgacgcagtcgcggaaattgacgctctgtacgacgtttacctcgatgtgcaagaaaagtggggactcgaagatgtgatgctgatgggtgatttcaacgcaggatgctcgtatgtgcgtccatcccagtggtcctcaataagattgtggacctcgcctactttccaatggcttattcctgatagcgctgataccaccgcaactccgacccactgtgcatacgatcgcattgtggtggcaggcatgctcctgcggggagccgtcgtcccggattccgcacttccttttaactttcaagcagcctacggcctgtccgatcaactggctcaagcgattagcgaccactaccctgtggaagtgatgcttaag

SEQ ID NO: 10535 - DNA, 846 bp, Artificial Sequence
  Description of Artificial Sequence: Synthetic coding sequence
atgcgcggaatgaagctcctcggtgcccttctggctctggccgcactgctccaaggtgcggtgtcgctgaagatcgccgcctttaacatacagactttcggagaaaccaaaatgtcgaacgcaaccctggtcagctacattgtgcagatcctctcacgatacgacatcgccctggtgcaggaggtgagagactctcaccttactgcagtgggaaagttgctcgacaacctcaaccaggacgccccggatacttatcactacgtcgtctccgaaccgctgggccgcaactcttacaaagaacggtacctgttcgtgtacaggccagatcaggtttccgccgtcgatagctactactacgatgacggatgcgaaccatgtggcaatgatactttcaacagagagccggcgatcgtgcgctttttcagccgcttcacggaggtgagggagttcgcaatcgttccgctccacgctgctccgggcgacgctgtggcggaaatcgatgcgctgtacgacgtctacctggacgtgcaagagaagtgggggctggaagatgtcatgctgatgggagactttaacgcaggctgctcatacgtcagaccgtcgcaatggagctcaattcggctgtggacttccccaactttccagtggctcattccagattccgctgatactactgctactccaacgcattgcgcctacgaccggatcgtggtggccggaatgctgctcagaggcgctgtcgtgccggactctgccctgcccttcaactttcaggccgcgtacggactctcggaccagctggcccaggcgatctcggaccactaccctgtggaggtgatgctgaag

SEQ ID NO: 10536 - DNA, 846 bp, Artificial Sequence
  Description of Artificial Sequence: Synthetic coding sequence
atgaggggaatgaagctgcttggggctctgctggcactggcagcactgctccaaggagctgtgtcattgaaaattgcagctttcaacatccaaacttttggtgagactaagatgtcgaacgcaaccttggtcagctatattgtgcaaatcttgtccagatacgacatcgcacttgtccaggaagtccgtgattcgcatcttaccgccgtcggaaagctcctggacaatttgaatcaagacgcgcctgatacttaccactacgtggtgtcggaacctctcggacggaactcgtacaaggaacgctacctgttcgtgtaccgcccagaccaggtgtcagccgtcgactcgtactactatgatgacggatgcgagccctgtggaaacgacaccttcaacagagagccggcgattgtgcggttctttagcaggtttactgaagtccgagagttcgcaatcgtgcccctccatgcggcccctggtgacgccgtggccgaaattgatgccctttacgatgtgtaccttgacgtgcaggaaaagtggggtttggaggacgtgatgcttatgggcgatttcaatgcaggctgttcgtacgtcagaccctcgcagtggtcctcgattcgcctgtggacttcacctacgtttcaatggctgatacctgactcggcggatactactgcgactcctacccactgtgcctacgacagaattgtagtggcaggcatgctcttgaggggcgcggtggtgcctgactcggcactgccttttaacttccaagcagcatacggactgagcgatcagctcgcacaggctatttcggatcattatcccgtggaagtgatgctcaag

SEQ ID NO: 10537 - DNA, 846 bp, Artificial Sequence
  Description of Artificial Sequence: Synthetic coding sequence
atgcgcggaatgaagttgctgggagcccttctcgcactcgcagcgctcttgcaaggcgcagtctccctgaagatcgcagcctttaacattcagacttttggagaaaccaagatgtcgaatgcaaccctcgtatcctacattgtgcaaattctgtcgcggtacgatattgcgttggtccaagaggttagagatagtcacctcacggccgtgggaaagctgctcgataacctgaaccaggacgcaccagacacgtaccactatgtcgtgagcgaacctctgggaagaaactcgtacaaagaacgttacctttttgtgtaccgcccggatcaagtcagcgcagtcgattcgtattactacgacgatggttgcgaaccctgtggaaacgacacctttaacagggagcctgcgattgtgaggttcttttcccgattcactgaggtgcgagagtttgcaatcgtgcctctgcatgcggcccccggtgacgcagtggccgaaatcgacgctctgtacgacgtctacctggatgtgcaagaaaaatggggccttgaagatgtgatgctgatgggtgatttcaatgcggggtgttcgtacgtaagaccgagtcagtggtcaagcatcagactgtggacctcaccaacttttcagtggctgatccctgattcggctgacactactgccacgccaacccattgtgcatacgatcggattgtggtggcaggtatgttgctgcggggggcagtagtcccagatagcgctctgccattcaattttcaagcagcctacggcttgtccgatcagctggcacaggccatatctgatcattaccctgtcgaggtgatgcttaag

SEQ ID NO: 10538 - DNA, 846 bp, Artificial Sequence
  Description of Artificial Sequence: Synthetic coding sequence
atgagaggcatgaaattgctgggcgcgcttttggccctggcagcgcttctgcaaggcgcggtcagcctgaaaatagccgccttcaatatccaaacctttggcgaaaccaagatgtcaaatgcgaccctggtgtcatacattgtgcagattctgtcaaggtacgacattgctcttgtgcaggaagttcgggatagccacctgacagctgtgggcaagctccttgataacctcaaccaggatgccccggacacctaccactacgtcgtttcagagccactggggcgcaactcctacaaagaaagatacctgtttgtatacagacccgatcaggtgtcggcagtagactcctactattatgatgacggttgtgagccttgtgggaacgatacattcaatcgagaacccgccattgtcaggtttttcagccgatttactgaggtgcgggagttcgcgatcgtgccacttcatgccgccccaggtgatgcagtcgcggagattgacgccctgtacgacgtgtatctggatgtgcaggagaagtggggacttgaggacgtgatgctgatgggcgacttcaacgcagggtgctcctacgtccgtcctagccagtggtccagcattaggctgtggacaagcccaactttccagtggttgatccccgactcagctgataccactgcaacccctacgcactgtgcctacgataggatcgtggttgctggtatgctgctcaggggcgctgttgttcccgactccgccttacccttcaattttcaggcagcctacgggctatcagaccagctcgcacaggccattagcgaccactaccccgttgaggtgatgctgaag

SEQ ID NO: 10539 - DNA, 846 bp, Artificial Sequence
  Description of Artificial Sequence: Synthetic coding sequence
atgaggggaatgaaattattgggagctctattggctctcgctgctcttctacaaggagctgtaagtctcaagattgcagcattcaacattcaaaccttcggagagactaagatgagtaatgcaactctcgttagttatatagtccaaatactcagtagatatgacattgctcttgttcaggaagttcgcgactcacatctgacggctgtcggtaaactgttggataaccttaatcaggatgcacctgatacatatcattacgttgtctccgagcctctgggccgcaattcatacaaagaaagatatctctttgtgtataggccagatcaagtttcggctgtggattcgtattattatgatgacggatgcgaaccgtgtggtaacgatacttttaatcgtgaaccagcaattgtcagatttttctcccgattcactgaggtccgagagttcgccattgttccactccacgcggctccgggagatgctgtggcagagattgatgctttgtatgacgtgtatttggatgttcaggagaaatggggtctcgaggatgtgatgcttatgggtgatttcaatgctgggtgtagttatgtcagaccatctcagtggtcgagtattaggttatggacttcgccgacctttcaatggttgattcctgattctgccgacactacagccacgccaacccattgcgcatacgatagaatcgttgttgcgggaatgttgttgaggggtgctgttgtgccagattctgctctcccattcaattttcaagcggcctatggtttatcagatcaactcgcccaagccataagcgatcactatccagtagaagtcatgttgaag

SEQ ID NO: 10540 - DNA, 846 bp, Artificial Sequence
  Description of Artificial Sequence: Synthetic coding sequence
atgcggggcatgaaactccttggagcgcttcttgcactcgcagccctgcttcaaggggcggtttcattgaagatagcagcgttcaacatacagacatttggagaaacaaaaatgtcaaatgcgacgctggtttcatacattgtgcagattcttagtaggtatgacatcgcattagtgcaagaagtaagagattcacatctcacagcggtcggcaaattgctggacaacttaaaccaagatgcgcccgatacgtatcattacgtggtttcagaacctctgggccgtaacagctataaggagcgatacttatttgtgtatcgccctgaccaggtcagcgctgtagattcatattactatgacgatggttgtgagccttgcggaaatgatacatttaacagggaaccagcaattgtgagatttttttcaaggtttacggaagtaagagagtttgcgattgttccgttgcatgctgcccccggggacgctgtcgcggaaattgacgcactatatgatgtttacttggacgtgcaagaaaaatggggattggaagacgtaatgttgatgggtgacttcaacgctggttgttcttatgtgcgtccaagccagtggtcctctataaggctgtggactagtccaacctttcagtggctgatcccggattcagccgatacgacagcgacccctacgcactgtgcttacgacagaatcgtggtagcagggatgttattgcggggcgcggtagtgccggactcagcgctgccattcaactttcaagccgcctatggcctgagcgatcagctggcccaagcgatttcggatcactatccagttgaagtaatgttaaaa

SEQ ID NO: 10541 - DNA, 846 bp, Artificial Sequence
  Description of Artificial Sequence: Synthetic coding sequence
atgcgtggaatgaagctgctcggcgcacttctggcactcgccgctttattgcagggtgctgtcagtctgaaaatagcggccttcaatatccagacgtttggtgaaactaaaatgtccaacgctactttggtcagctatatcgtacagatccttagtaggtatgatattgccttggttcaggaggttcgagatagtcacctgacggcagtgggcaagctcctggacaatttaaaccaggacgctccagacacctatcactatgtagttagcgaaccccttggaagaaattcttacaaggagagatacttgttcgtctatcgacccgatcaggtaagtgccgtcgactcttactactatgacgacggttgcgagccctgcgggaacgatacatttaacagggaaccggccattgtgagattcttttctcgatttacagaggtgagagagtttgcaatagtgcccctgcacgccgcaccaggtgacgcggttgcggagatcgacgcactctatgacgtgtaccttgacgttcaggaaaaatggggactagaggacgtcatgttgatgggcgactttaatgccgggtgttcgtacgtgcgtccaagtcagtggagctccatcagactctggacatcaccaaccttccagtggcttatcccagacagcgcagacaccaccgcgactccaacacactgtgcctacgatagaattgtggtggcaggcatgctgctgcgaggcgcggtggttccagacagcgctctgcccttcaatttccaggccgcttacggactaagcgatcagctcgctcaggcgatatcagatcattatcccgtcgaggtgatgcttaag

SEQ ID NO: 10542 - DNA, 846 bp, Artificial Sequence
  Description of Artificial Sequence: Synthetic coding sequence
atgaggggtatgaagctgctgggcgccctcctggcactggccgcgttgctacaaggtgccgtgtctctaaaaattgcggccttcaacatccaaactttcggcgagaccaaaatgtctaacgccactctggtgtcttatattgtacagattctttcacggtatgacatcgctttggtgcaggaagtgcgcgattcccacttaacagccgtcggtaaactgctggacaacctgaaccaggatgcccctgatacttaccattatgtcgtttctgaaccgttaggaaggaactcttacaaggagaggtatctgtttgtatatcgacctgaccaggtcagcgccgtggattcttactattatgacgacggttgtgaaccctgtgggaacgatacctttaaccgggaaccagctattgtgcgcttcttctcaagattcacggaagtgagggagttcgctatcgtgccgctccacgctgccccaggggatgctgtggcagagatcgacgccctctacgacgtctacctggatgtccaggagaagtggggtctggaggacgtcatgctgatgggagactttaatgcggggtgctcatatgtaagacccagtcaatggtcctccataaggctatggacgagcccgacatttcagtggttgatacccgattcggctgatactacagcgacccctacacattgtgcctatgaccgcatcgttgttgcagggatgttgctccggggtgctgttgtcccggactctgcattgcccttcaacttccaggcagcgtacggactcagtgatcaactggctcaggccattagtgaccattatccagtagaggtcatgctgaag

SEQ ID NO: 10543 - DNA, 846 bp, Artificial Sequence
  Description of Artificial Sequence: Synthetic coding sequence
atgcgcggaatgaaactgctgggagccctccttgccctggccgcgctcctccagggagccgtctcgcttaagatcgccgctttcaacatccaaaccttcggggagactaagatgtcgaatgccaccctcgtgtcgtacatcgtgcagatcctgtcacggtacgacatcgcgctggtgcaagaagtaagagacagccacttgaccgccgtgggaaagctcctggacaatctcaaccaagacgcgccggatacctaccactacgttgtttccgaacctctgggacgcaactcctacaaggagcgataccttttcgtttatcgtccggatcaggtgtcggctgtggattcatactactacgacgacggatgcgaaccgtgcggcaatgatactttcaacagggaaccagcgatcgtccggttcttttcacggtttacggaagtgcgggagttcgcgatagtgccgctccacgcagcaccgggcgacgcggtggcagaaatcgatgccctttacgatgtctaccttgacgtgcaggagaaatgggggctggaggacgtgatgctgatgggagacttcaacgctggttgctcctacgtccgaccttcgcagtggtcctccatccggctctggacctcacccacgtttcaatggctcatcccagactccgcagacactacggcgaccccgactcactgtgcatacgatcgaatcgttgtcgcggggatgctgctcagaggggcagtggtgccagattcggccctgcctttcaactttcaggctgcctatggcctctccgaccaattggctcaggcgatttcagaccattacccggtcgaggtgatgctgaag

SEQ ID NO: 10544 - DNA, 846 bp, Artificial Sequence
  Description of Artificial Sequence: Synthetic coding sequence
atgcgcggcatgaaactccttggagctttgctcgctctcgccgcactgctgcaaggcgctgtctccctgaagatcgcagcgttcaatatccagacgttcggagagacgaaaatgtcgaatgcaactctggtgagctatatcgtccagatacttagtagatatgatatcgccttggtccaagaagtgcgagattctcatctgacagccgtaggtaagctactggacaacctaaaccaggacgcccccgacacatatcactatgttgtgagcgagcccctgggaagaaactcatacaaagagaggtatctgtttgtgtaccgtcccgatcaggtgtctgccgtggatagctattattacgacgatggatgtgaaccatgcggcaacgacacgttcaaccgggaacctgcaatagtgcggttcttttctcgcttcactgaagttcgcgaattcgccatcgtccccctccacgccgcccctggcgacgctgtggccgagatagatgctctatatgatgtgtaccttgatgtccaggagaaatgggggctggaggatgtgatgctgatgggagatttcaacgccggatgtagctatgtgaggccttcccagtggtcatccattagactctggacttctcccaccttccaatggctcatccctgactccgccgacacaaccgccactccgacacactgcgcttatgacaggattgtagtagccggaatgttgctgcgcggcgctgtcgtgcctgattctgcactgcccttcaacttccaggcagcatacggtttgtccgaccagttggcccaggcaatatccgaccattaccctgtggaagtcatgctgaag

SEQ ID NO: 10545 - DNA, 846 bp, Artificial Sequence
  Description of Artificial Sequence: Synthetic coding sequence
atgcggggtatgaagctcctgggtgcgctcctggcactggcagccctgctgcagggagcagtgtcgcttaagattgcggcgttcaacattcaaacgtttggcgaaactaaaatgagcaatgctacccttgtgtcgtacattgtccaaattcttagccgatacgatattgcgctcgtccaggaggtcagagattcgcatctcactgcggtcggcaagttgttggacaatctgaatcaggatgccccggacacctatcattacgtggtcagcgagcctcttggacgtaacagctacaaggagagatacctcttcgtgtaccgccccgaccaagtctctgcagtcgactcgtactactacgatgacggttgtgagccttgtggtaatgatacttttaaccgggaacctgccattgttcgtttcttttcccggtttaccgaagtcagagaatttgccattgtgccgcttcacgcagcaccaggagatgctgtggccgaaatcgatgcactgtacgatgtctacctggatgtgcaggaaaagtggggactcgaagatgtgatgcttatgggagactttaatgccggctgctcctacgtgcgaccaagccagtggagctctattagactgtggacttcgcctacctttcaatggcttattcctgactccgctgacaccaccgcaactcctactcactgcgcatacgaccgcatcgtggtcgccggaatgcttctgaggggggcagtggtgcccgacagcgctttgcccttcaattttcaagccgcatacggactgtccgatcaactggcacaagcaatctcagatcattaccctgtcgaggtgatgcttaag

SEQ ID NO: 10546 - DNA, 846 bp, Artificial Sequence
  Description of Artificial Sequence: Synthetic coding sequence
atgcgcggcatgaagctccttggcgcactgttggctctggccgccctcctccaaggtgcggtgtctctgaaaattgcggccttcaacatacaaaccttcggagaaaccaagatgtctaacgctactcttgtgtcgtatatcgtccaaattcttagccgctacgatatcgccctggtgcaagaagtgcgggacagccatctgacggctgtggggaagctgcttgataacctcaaccaggacgcaccagacacttatcattacgtcgtgagtgaacccctgggacgcaattcctacaaagaacggtaccttttcgtgtacaggccggaccaggtgtcggcggtggactcgtattactacgacgatggttgcgaaccatgcggaaacgatacgtttaatcgcgaaccggccatcgtgaggttcttctcccggttcactgaagtccgggaattcgcgatcgtcccactccatgccgcgcctggagatgcagtggccgaaatcgacgctctgtatgatgtgtacctggacgttcaggagaagtgggggctggaggacgtgatgcttatgggagacttcaatgcaggatgtagctacgtgcggccgtcacagtggtcgtcaatccgcctgtggacttcgcctaccttccaatggctgatcccggatagcgccgacaccaccgccactcccactcactgcgcctacgataggatcgtcgtggcgggaatgctcctgcggggtgccgtggtgccggacagcgctctgcccttcaatttccaggcggcgtacggcctgtcggatcagcttgcccaggccatctccgaccactacccggtcgaagtgatgctcaag

SEQ ID NO: 10547 - DNA, 846 bp, Artificial Sequence
  Description of Artificial Sequence: Synthetic coding sequence
atgcggggcatgaaactgttgggagccctgctcgcactggcggctctcctccagggagccgtctcgttgaagattgctgccttcaatatccagactttcggcgaaactaagatgagcaacgcgactctcgtgtcgtacatcgtccagatcctcagcaggtacgacattgcacttgtgcaagaggtacgcgactcgcacctgacggcagtggggaaactcctggacaacttgaaccaagatgctccagatacttaccactatgtcgtgtccgagccgcttggtagaaattcgtacaaggaacggtaccttttcgtgtaccgcccggatcaagtgtcggccgtggactcgtactattacgatgacggctgcgagccttgcggaaacgatacgtttaacagagagccggcaattgttcggttctttagccggttcactgaagtcagggaattcgcaatcgtgccgctgcatgcggcccccggcgacgcagttgcggaaatcgacgctctgtacgatgtgtacctggatgtccaggaaaagtggggactcgaagatgttatgctcatgggtgactttaatgccggatgcagctacgtgcggccaagtcagtggtcgagtatccgcctgtggacctccccgacctttcagtggctgatacctgacagcgcagacactaccgcgaccccaacccactgtgcctatgaccgtatcgtggtggccgggatgctgttgaggggagcagtggtccccgactccgcacttcctttcaacttccaggctgcctacggtctgtctgaccaacttgcccaggctatctccgaccattacccggtggaggtgatgctcaag

SEQ ID NO: 10548 - DNA, 846 bp, Artificial Sequence
  Description of Artificial Sequence: Synthetic coding sequence
atgagaggaatgaagcttttgggagccttgctggctttggcagccttgctacaaggtgccgtttctctcaagattgctgcctttaacattcaaacttttggcgagacgaagatgagcaacgcgactctggtttcttacatagttcagatcctgtcccgttatgacatcgcattggtgcaggaggtgcgtgattcacaccttaccgctgttggaaaacttctcgacaacctcaatcaggatgcacctgatacgtatcattacgttgtgtcagagccactcggtcgtaattcctacaaagagagatacctgtttgtgtatcgtcccgatcaggtatccgctgtcgactcttattattatgatgatgggtgtgagccatgtggcaacgatactttcaacagggagcctgcaatagtgaggtttttttcgagattcactgaagttcgggagttcgctatcgtgcctttgcacgccgctcctggggacgctgttgctgaaatagatgccctctatgatgtttatctagatgtacaagagaagtggggacttgaagacgtcatgttaatgggcgatttcaacgccggctgtagctatgtaaggccatcgcaatggtcatctatacgcctctggacctctccaacctttcagtggttgattccagatagcgcagatacaaccgccacgccaactcattgcgcatacgacaggattgttgtggcaggtatgctacttcgtggagcagttgttccagacagcgcgcttcccttcaactttcaggctgcctatggactttcggatcagctcgctcaggccatctctgatcactatccagtggaagtgatgttgaaa

SEQ ID NO: 10549 - DNA, 846 bp, Artificial Sequence
  Description of Artificial Sequence: Synthetic coding sequence
atgcggggaatgaagctgctgggcgcgcttctggccttagccgcgttgcttcagggggccgtgtctctgaaaatcgcggcattcaatattcagaccttcggggagacaaaaatgtctaatgccaccttggtcagttacatagtccagatcttgagtcgatacgacatcgccctcgtacaagaggtcagggatagccacctgaccgccgtgggaaagctgctcgacaatcttaatcaggacgcccctgatacttatcactatgtggtatctgagcccctgggaaggaattcatacaaagagaggtacttgttcgtttacagaccagaccaggtctccgctgtcgactcctactattacgacgacggttgcgaaccttgtgggaacgacaccttcaacagggagccagccatcgtgcgcttcttcagcagattcacagaagtacgtgagttcgccatcgttcccctgcacgccgcccccggcgacgcagtcgcggaaattgatgcactgtacgacgtgtacctggacgtgcaggagaaatggggtttagaggatgtcatgcttatgggcgatttcaatgcgggctgcagctacgtgagaccctcccagtggagcagcatccgcctctggacttcacctacgttccagtggctcataccagattccgccgataccaccgctaccccaactcattgcgcctacgaccggatagtggtcgccggcatgctgctgcgtggcgctgtggtgcctgactctgctctgccttttaatttccaggccgcctatggactgagcgaccagctggcccaggccatctccgaccactacccggtcgaggtcatgcttaag

SEQ ID NO: 10550 - DNA, 846 bp, Artificial Sequence
  Description of Artificial Sequence: Synthetic coding sequence
atgaggggcatgaagctgctaggggccttgctagcactggccgccttgttacaaggagccgtctccctgaagattgcagcattcaacatccagaccttcggcgagaccaagatgtcaaacgcgacattagtctcgtatatcgtccagatcctgtcaagatatgacattgctttggtgcaggaagtgagggactcccacctgactgctgtgggtaagttactggataacctaaaccaggacgcacctgatacgtaccattatgtcgtgtctgagccacttggccgaaacagctacaaggaaaggtatctgttcgtgtataggcccgaccaggtatctgccgtagacagctattattatgacgatggatgcgagccctgtggaaacgataccttcaacagggagcctgcaattgtgagattcttctctagatttaccgaggtgcgtgagttcgccatcgttcctcttcacgctgcccccggggatgcggtggctgagatcgatgcgctttatgacgtctacctggatgtccaggagaagtgggggctagaagacgtgatgcttatgggggacttcaacgctggttgctcttacgtgcgcccatcccagtggtcgtctatcaggttgtggacctctcctacattccagtggttgattccagactccgcagatactacggccacacctacccactgtgcttacgatagaatagtggtggcaggtatgcttttacgtggggccgtagtaccggatagcgccctccctttcaacttccaggcggcttatgggttgtccgatcagctagcccaggcaattagtgatcattacccggtggaagtaatgctgaaa

SEQ ID NO: 10551 - DNA, 846 bp, Artificial Sequence
  Description of Artificial Sequence: Synthetic coding sequence
atgcgagggatgaagttgctgggtgccttactggccttggctgcccttctccagggcgcagtttctctgaagattgcggcctttaatatccagacctttggcgagacgaagatgtccaacgccacactcgtctcctatatagttcagatcctgagcaggtacgacatcgccttggtgcaggaggtacgagactcccatttaacagccgtgggaaaattgttggataacctgaaccaagacgcccccgacacctaccattacgtggtgagcgagcctctcggcagaaactcatataaagagagatatctcttcgtatataggccggaccaggtttccgcagtggactcttactattatgatgacggctgtgaaccttgtggcaacgacacttttaacagggaacccgctatagtaagatttttctcaagattcacagaggtgagagagttcgcgatcgtccctcttcacgcggcccctggggacgccgtagcagaaatcgatgcgctttacgacgtgtacctcgacgttcaagaaaaatggggcctggaagatgtcatgctgatgggcgactttaatgcaggatgttcctacgtgagacctagccagtggtccagtataagactttggacaagcccaacctttcagtggctcattccagattcagcagacaccacggctacaccaacccactgcgcttatgataggatagtcgtggcaggaatgctcctccgaggcgcagtggttccggactcagcactgccattcaactttcaggctgcttatggcttgagcgatcagttggcacaggcgataagcgaccattaccctgtcgaggttatgctgaag

SEQ ID NO: 10552 - DNA, 846 bp, Artificial Sequence
  Description of Artificial Sequence: Synthetic coding sequence
atgcgcggcatgaagttgctcggcgctctgctggcgttggccgcattgttgcagggtgctgtgtctttaaagatcgctgcctttaacatccagacctttggggaaactaagatgtcgaatgcaactctggtgtcctatatcgtccagattttgtcgcgatacgatattgccctagtccaggaggttcgcgatagccatctcacagccgttggaaaactgctggataacctcaaccaggatgctccggatacctatcattatgttgtttctgagccccttggtcggaactcctacaaggagcgctatttattcgtctaccgcccggaccaggtctccgctgtcgatagctactactatgatgacggatgcgagccctgcggtaacgacaccttcaaccgcgagcccgcaatcgtccgcttcttctcccgatttaccgaggttcgcgaattcgcgatcgtccctcttcatgctgctccaggcgatgccgtcgccgagattgacgctctgtacgatgtatatttggatgtgcaggaaaagtggggcctcgaggatgtcatgctgatgggcgacttcaatgcgggttgttcttatgtccgtccctcgcagtggtcgtccattcgcctgtggacctccccgacgttccaatggctcattcctgatagcgccgatactaccgccacccccacccattgcgcgtatgataggatcgtcgtcgccggtatgcttctgcggggcgcggtcgtcccggactccgcgctacccttcaacttccaggcagcctacgggctcagcgatcaattggctcaggccatcagcgatcactatccagtcgaggttatgctcaag

SEQ ID NO: 10553 - DNA, 846 bp, Artificial Sequence
  Description of Artificial Sequence: Synthetic coding sequence
atgcgcggtatgaaactgcttggagctctcctggccctcgccgctctgctgcagggtgcagtgtctctgaaaatcgctgctttcaacatacagacattcggagagactaagatgtcaaatgccaccctcgtaagctacattgtgcagatccttagcaggtacgatattgcactcgtgcaagaggtaagagactcccaccttaccgcggtcggtaaactgctggacaacttgaatcaagatgcacccgatacctaccactacgtggtatccgaaccactgggaaggaattcctacaaggagcgctacctctttgtgtatagaccggatcaggtatcagcggtcgatagctactattatgatgacggttgcgaaccatgtggcaatgacaccttcaacagggaaccggcaattgtgaggttcttcagcaggtttacagaagtaagggagttcgctatcgtgcccctgcatgcagctcccggtgacgcagttgcagagatcgacgctctctacgatgtctacctggatgtccaagagaagtggggtctggaggatgttatgcttatgggtgacttcaacgctggatgctcttatgtgagaccctcacaatggtccagcattcgcttgtggacatcccctaccttccagtggctgatccctgacagcgcggacaccaccgcaaccccaactcactgtgcttacgacaggatcgtggtggccggcatgctgctcagaggcgctgtcgtgcccgattccgctttgccttttaattttcaagctgcatatggactgtccgatcagttggcacaggccatctccgaccactacccagtggaagtgatgctgaag

SEQ ID NO: 10554 - DNA, 846 bp, Artificial Sequence
  Description of Artificial Sequence: Synthetic coding sequence
atgcgcggtatgaagctcttgggagccctgctcgccctcgccgctctcctgcaaggcgcagttagcctcaagatagccgctttcaatattcagacctttggcgaaaccaaaatgtctaacgccacactcgtgtcttacatcgtgcagatcctgagcaggtacgacatagctctcgtacaggaagtacgcgactcacacctgactgccgtcggaaagctgttggataacctgaaccaggatgcccccgacacctatcactacgtcgtgtctgagcctctcggcaggaattcctacaaagaacgctatctctttgtgtaccgccccgaccaggtgagcgctgtcgacagctactactacgacgacggttgcgaaccgtgtggtaatgatactttcaaccgcgaacccgccatagtgagattcttctcccggtttaccgaagttcgggaatttgcgattgtgccgctgcacgcggcaccaggcgatgctgtagcagaaatcgatgccctttacgatgtgtatcttgacgtccaagagaaatggggactggaagatgtgatgctgatgggagattttaacgcggggtgcagctacgtccggccctcccagtggagttcaatccgattgtggacatcacctacatttcaatggctgatcccggattccgcagacaccactgcaacaccgacccattgcgcatacgataggatcgtcgttgcgggtatgctgctccgcggcgcagtggtgcccgattccgctctccctttcaattttcaggctgcctacggtctgtccgatcagttggcgcaggccatctcagaccattacccggttgaggttatgctgaaa

SEQ ID NO: 10555 - DNA, 846 bp, Artificial Sequence
  Description of Artificial Sequence: Synthetic coding sequence
atgagaggaatgaagctgctcggtgccttgcttgcactcgcagcacttctgcagggcgcagtgtctctgaagattgccgcatttaacatacagacttttggcgaaaccaagatgtcgaacgcaactctggtcagctacatcgttcaaatcctctccagatacgatatagcgctggtgcaagaagtccgtgattcccatcttaccgcggtcggaaaactgcttgacaatctcaatcaagatgcgcccgatacttaccactatgtggtgtcggagcctctgggacggaactcatacaaggagcgctacttgtttgtgtaccgaccagaccaagtgtcagcggtggacagctactactacgatgatggatgcgagccatgtggcaacgacacttttaacagagaacctgcgatagtgcgcttcttttctcgatttactgaagtgagagaatttgccattgtgccacttcatgcagcacccggagatgccgtcgcggaaatcgatgcgctctatgatgtgtacctggatgtccaggaaaaatgggggcttgaagatgtgatgcttatgggagatttcaacgcaggttgttcctacgtcagaccatcccagtggtcctcgataagactgtggacttccccaacctttcaatggctgatcccggatagcgcagacactacggcaactcctacccattgtgcgtacgatcgcattgtggtcgccggtatgctgctgcgtggtgccgtggtgccagattcggcccttccatttaactttcaagcagcttacggactgtcggatcagcttgcccaagccatttcggaccactaccctgtcgaggtgatgctgaag

SEQ ID NO: 10556 - DNA, 846 bp, Artificial Sequence
  Description of Artificial Sequence: Synthetic coding sequence
atgaggggtatgaagctgttaggggcactcctggcactcgctgctctgctccagggggctgtgtccttaaagatagccgcctttaatatccaaactttcggagagactaaaatgtcaaacgccactcttgtgtcctatattgtgcagatcctatcaagatacgacatagcactggtgcaagaagtgcgtgacagccatctcacggccgtggggaagctattggacaatttaaatcaggacgcgcctgacacgtaccactacgtagtctctgagcctttaggtcgcaacagctataaagagcggtatctgttcgtgtacaggccagaccaagtgtccgcagttgacagttattactacgatgatggctgtgaaccttgcggaaatgacactttcaaccgggaaccagccattgtcagatttttttctcgctttaccgaagtacgggaatttgctatcgtccccttgcacgctgccccgggggacgccgtagcggagattgacgccctttacgatgtctacctcgacgtccaggagaagtggggcctggaagatgtgatgcttatgggtgattttaatgccggctgtagctacgtccgtccgagccagtggagctccattagactgtggacatcccccacgttccagtggctgatcccggacagcgccgacacgaccgcaacaccaactcactgcgcctatgataggatcgtggtcgcaggaatgctgctgcgcggtgccgtagtcccggactccgccctgccgtttaattttcaggctgcctatgggctgtccgaccagctcgcccaggcaattagtgatcattatccggtcgaggtgatgctgaag

SEQ ID NO: 10557 - DNA, 846 bp, Artificial Sequence
  Description of Artificial Sequence: Synthetic coding sequence
atgcgtggtatgaaacttctgggagccctcctggcccttgcagcgcttctgcagggagcagtctcgctgaagattgctgcatttaacatccagacgttcggggaaactaagatgtctaatgcaacgctcgtcagctacattgtacagatattgtcccgatatgatattgcactcgtgcaagaagtcagagattcgcacttgactgcagtaggtaaacttctcgacaacctgaaccaggatgcgccagatacctaccactacgtggtgagcgagccacttggcaggaattcgtacaaggaaaggtacttgtttgtctacagaccggatcaagtctcagcagtcgacagttactattacgacgacggatgtgagccttgtggcaacgacaccttcaaccgtgaacccgcaatcgtgcgcttctttagcaggtttactgaggttcgagaatttgcaattgtgcctctgcatgcggctcctggtgatgccgtcgcagagatcgacgcactgtacgatgtgtaccttgacgtgcaagagaaatggggactggaagatgtgatgcttatgggagatttcaatgccggttgctcgtatgtccgaccctcccaatggtcatcaattcgcctttggacctcccctacctttcaatggctgatccccgattccgctgataccactgcaactcctacccattgtgcgtatgaccgtattgtggttgccggcatgctccttaggggagcagtggttcccgattcggcactccctttcaattttcaggccgcctacggcctttcagatcaactggcacaggccattagcgaccattaccctgtggaagtgatgcttaag

SEQ ID NO: 10558 - DNA, 846 bp, Artificial Sequence
  Description of Artificial Sequence: Synthetic coding sequence
atgcgcggtatgaagctcctgggagccctcttagcactggctgcactgctgcagggagccgttagtctcaaaatcgccgcttttaatatccagacctttggggagactaagatgagtaatgccaccctcgtctcatatattgttcagatactgtcgagatacgatatcgccctagtgcaggaggttcgcgactctcacctcactgccgtcgggaagcttctggacaacttgaaccaggacgcacctgacacgtaccattacgtcgtttcggaacctctgggacgcaatagttacaaagagcgatacctgtttgtgtatcggcctgaccaagtgagcgcggtagactcatactactacgacgacggctgtgaaccgtgtgggaacgacaccttcaacagggagcctgcaatagttagatttttttcaagatttaccgaagtgagagagtttgcaattgtgcctctgcacgccgctcctggtgacgccgtggcggaaatcgatgctctgtatgacgtgtatttggatgtccaagagaagtggggattggaggacgtaatgctaatgggcgacttcaacgcaggctgttcttacgtcaggccgagtcaatggtcttctatcagattatggacaagtcctacttttcaatggctcatacccgacagcgccgacaccactgccacccccacacattgtgcatatgacagaatagtggttgcaggaatgcttctgcgcggagccgtagttcctgacagcgccctgcccttcaattttcaggccgcttatggactgagcgaccaactagctcaggcaatcagtgaccactacccggtcgaggtcatgctcaaa

SEQ ID NO: 10559 - DNA, 846 bp, Artificial Sequence
  Description of Artificial Sequence: Synthetic coding sequence
atgcgcggcatgaagctgctgggcgcccttctcgccttggccgctctgttgcaaggagctgtgagcttgaagattgcagcgttcaatatccaaaccttcggagaaaccaagatgtcgaatgcaacgttggtcagttatatcgtgcaaatcctgagcagatacgacatcgccctcgtgcaggaggtccgggactctcatctgaccgcagtgggaaaactcctcgataatctcaaccaggacgcccctgacacttaccactacgtggtgtccgagccgttggggcggaactcgtacaaggagcggtacctttttgtgtaccggccagatcaagtgtccgcggtggattcgtactactatgatgacggctgcgaaccgtgcggaaatgacactttcaacagggaacctgccatcgtcaggttcttctcgcgattcacggaagtacgggagttcgcaatcgtgcctctgcatgcggcaccgggggacgctgtggcggagatcgatgccctctacgatgtctacctcgacgtgcaggagaagtggggcctggaggatgtgatgctcatgggagatttcaacgcaggatgctcatacgtgaggccatcccagtggtcgagcatccggctgtggacctctccgacctttcagtggctgattccagactccgcggacaccacggccaccccgacccattgcgcttacgatcggatcgtggtggccggaatgttgttgaggggtgccgtcgtgccagacagcgctcttccattcaacttccaggcagcgtacgggctttcagaccagctcgcccaggcgatctcggaccactaccccgtcgaagttatgctgaaa

SEQ ID NO: 10560 - DNA, 846 bp, Artificial Sequence
  Description of Artificial Sequence: Synthetic coding sequence
atgagaggaatgaaactactgggggccctgttggccctggccgctcttctgcaaggagccgtgagcctaaagattgccgcgttcaacatccaaacctttggagagacaaagatgtcaaacgccaccttggtgtcctatattgtgcagatactgagccgatacgatattgccctagtgcaggaagtgcgcgacagtcacctcaccgcggtgggcaaattacttgacaacctcaatcaggacgctcccgacacctatcactacgtggtgtccgagcccttagggaggaattcgtacaaggagcgctatcttttcgtgtatagacccgaccaggtgtctgcggtagactcgtactattatgacgatgggtgtgagccgtgtggaaacgacacctttaatcgagaaccagccatcgtgcggtttttctccagatttacggaggtgcgggagttcgcaatcgtcccactgcatgcagcccccggcgatgccgtcgccgagattgatgccctgtacgacgtgtatctggacgtgcaggagaagtggggtttagaggacgtgatgctgatgggagactttaatgcgggctgctcttatgttaggccttctcagtggtccagcatacggctgtggacgagtcccaccttccagtggctcataccagacagcgctgacacaaccgccacccccacacattgcgcttatgaccggattgtggtcgcaggtatgctactgcgcggggctgtcgttccagactcggccctgcccttcaacttccaggccgcctatgggctgagcgaccaacttgctcaggccatatccgatcactaccctgttgaagttatgcttaaa

SEQ ID NO: 10561 - DNA, 846 bp, Artificial Sequence
  Description of Artificial Sequence: Synthetic coding sequence
atgcggggaatgaaactcttgggagccctcttggctctggcagcgctgctgcagggcgcagtgtccctgaagatcgcagccttcaatattcagacttttggagagactaagatgtccaatgctaccctggtgtcatacatcgttcagatcctctccagatacgacatcgcgcttgtacaggaagtgagagattcgcacctcaccgccgtcggcaagttgctggacaacctgaaccaggacgcaccggatacttaccactacgtcgtgtctgagccgctcggacgcaactcgtacaaggagaggtaccttttcgtgtacagacctgaccaggtgtcagcagtggattcctactactacgatgacggatgcgagccctgcggtaacgatacctttaatcgcgagccggcgatcgtgcgctttttcagccgctttactgaagtcagagaatttgccatcgttccgttgcacgctgcccccggagatgccgtcgcggaaattgacgcactctacgacgtgtacctggatgtgcaagagaagtggggccttgaagatgtgatgttgatgggagatttcaacgccggatgcagctacgtgcggccgtcgcagtggtcctcaatccggttgtggacttcgccgactttccaatggctcatcccagactccgcagacactaccgcaaccccgactcactgcgcttacgatcgcattgtggttgccggaatgcttctgcgaggagcggtcgtgccagatagcgccctgccgttcaactttcaggcagcctacggactctcggatcaactggcacaagcgatcagcgaccattaccctgtggaggtcatgctgaag

SEQ ID NO: 10562 - DNA, 846 bp, Artificial Sequence
  Description of Artificial Sequence: Synthetic coding sequence
atgcggggcatgaaactccttggagcccttctggcattggcggctctgctgcagggagccgtcagcctgaaaatagccgcttttaatatccagacattcggggagactaaaatgtccaacgccactcttgtgagctacatcgtgcagatccttagcaggtacgacattgcgttggttcaggaagttcgcgatagtcacctaaccgctgtgggcaaactgttggataacctgaaccaagatgcaccggatacttaccattatgtggtttcagaacccctgggacgcaattcctacaaggagagatacctcttcgtgtaccggcccgaccaggtcagcgccgtggattcctactattatgacgacggctgcgaaccctgcggcaatgatacttttaaccgcgagcctgcaatagtacgattttttagccgattcacggaagttcgtgagttcgcaatcgtccctttgcacgctgcccccggagatgccgtcgccgagatagatgccttgtatgatgtgtaccttgacgttcaggagaaatggggcttagaggacgtgatgctgatgggggacttcaacgcaggctgtagctacgtccgccctagccaatggtcttccatacgcttatggacttctccgaccttccagtggttgatccctgattccgcggacacgacagccacccccacccattgcgcatatgataggattgtcgtagcgggcatgctcctgagaggcgcggtcgtgccggacagcgccctgccatttaactttcaagcagcttatggactgagcgatcagctcgctcaagccatatccgatcattaccctgtagaagtcatgcttaag

SEQ ID NO: 10563 - DNA, 846 bp, Artificial Sequence
  Description of Artificial Sequence: Synthetic coding sequence
atgcgcggtatgaagttgttaggggccctcctggctttggctgccctactgcagggcgctgtttccttgaaaatagctgcatttaacatccagaccttcggggaaacaaaaatgagcaatgccactctggtatcctacattgtgcaaatccttagcagatatgatatcgcgctcgtgcaagaagtccgcgattctcaccttactgcagtggggaagctcctcgacaatctcaatcaggacgctccagacacgtatcattatgtggtgtcagagcccttaggaaggaacagctacaaggagcgatacctcttcgtatacagaccagatcaagtctctgccgtcgactcttactattacgatgacgggtgtgaaccctgcgggaatgacacttttaatcgtgagccggctatcgtgcgtttcttctctcgtttcactgaggtgcgagagttcgcgattgtgccactacacgcagccccaggcgatgccgtggccgagatcgatgctttatatgatgtctacctcgacgtgcaggagaagtgggggctggaagacgtgatgcttatgggggactttaatgccggttgtagctatgtccgcccttcccaatggtcttctattcggttgtggacatcccccactttccaatggctgattcccgatagtgcagatactacggccacgcccacccactgtgcatatgataggatcgttgtagccgggatgctactgcgcggcgccgtagtgcccgattccgcgctgccgttcaacttccaagctgcctatgggctttccgaccagctcgctcaggccatttcagaccattaccccgtcgaggtgatgctgaag

SEQ ID NO: 10564 - DNA, 846 bp, Artificial Sequence
  Description of Artificial Sequence: Synthetic coding sequence
atgcgggggatgaagctccttggggcacttctcgccctggcagctctgctgcagggcgctgtctcgctgaagatcgcagcattcaatattcaaacttttggagaaaccaagatgagcaacgcaacgctggtgtcctacatcgtccagattttgtcccgctacgacattgctctggttcaagaagtgcgggattcgcatcttaccgcagtgggaaaactgctcgataacctgaatcaggatgcccctgacacctaccattacgtggtatcggaaccgctgggacgaaactcctataaggaaagataccttttcgtgtaccgtcccgaccaagtgtctgcagtagattcgtactactacgacgatggttgcgagccatgtggcaatgatacctttaacagagagccagcgatcgtgcgattctttagccgctttactgaggtccgggaattcgctattgtgcctttgcatgcggcaccaggagacgcagtcgccgaaattgatgcattgtatgacgtgtaccttgatgttcaggaaaagtggggactcgaggatgtgatgcttatgggagatttcaacgcaggttgtagctacgtgcggccctcacaatggagctcgatacgactgtggactagcccgactttccagtggcttatccccgactctgccgataccaccgcaactccaacgcactgtgcctacgatagaattgtcgtggcaggtatgctgctcaggggcgcagtggtgccagattcggcactcccgttcaattttcaagcggcgtatgggttgtccgaccaactcgcgcaagcgatatcagaccactacccagttgaagtgatgctgaaa

SEQ ID NO: 10565 - DNA, 846 bp, Artificial Sequence
  Description of Artificial Sequence: Synthetic coding sequence
atgagaggtatgaagctgctcggagcactcctggcgctggccgctctgctgcaaggcgcagtgtcgcttaagatcgcagcgttcaacatccagactttcggcgaaaccaaaatgtccaatgcaaccttggtgagctacatcgtgcagatccttagccgctacgatatcgcgttggttcaagaggtgagagacagccaccttactgccgtcggaaaactgttggacaacttgaaccaagacgcccctgacacttaccactacgtcgtgtcagagcctctcggacgcaactcatacaaggaaaggtacttgttcgtgtacagaccggatcaggtgtccgctgtggactcatactactacgacgacgggtgtgaaccctgtggaaacgataccttcaacagggaaccggcgatcgtccgcttctttagccggtttaccgaagtccgcgaatttgccatcgtccctctccatgccgcaccaggagacgccgtcgctgaaatcgatgccctgtacgacgtgtacctcgatgtgcaagaaaagtggggactggaagatgtgatgctgatgggggacttcaacgccggatgctcgtacgttcgcccgtcccagtggtcgtcaattagactctggacgtcacctactttccaatggctcatcccagactcggccgataccaccgcgaccccgacccattgcgcctacgatcgaatcgtggtggccggtatgctgcttcgaggagcggtggtcccagattccgcgctcccgttcaattttcaggcagcctacggcttgtcggatcagttggcacaagcaatcagcgatcactaccctgtggaagtgatgctcaag

SEQ ID NO: 10566 - DNA, 846 bp, Artificial Sequence
  Description of Artificial Sequence: Synthetic coding sequence
atgcgggggatgaagctccttggagcgcttcttgccctcgcagcattgctgcaaggagctgtgtcgcttaagatcgcagcattcaatattcagacctttggtgaaactaaaatgtccaatgctactctcgtgagctacattgttcagattctgagccgttacgatattgcacttgtgcaggaagtgagagactcccatctgaccgccgtgggaaagctgcttgataaccttaaccaggatgcaccagatacttaccattacgtggtgtcggaacctctcggaagaaatagctacaaggaaagatacctgtttgtctatcgtcctgatcaggtatcggcagtggattcgtactactacgatgacgggtgcgaaccatgtggcaacgataccttcaatcgcgaaccagccatagtccgcttcttttcgagatttaccgaagtgcgagaattcgcaattgttccactgcacgcagcacctggcgatgccgtcgccgaaatcgacgcactgtatgacgtgtacctggatgttcaggaaaaatggggtctggaggatgtcatgctgatgggtgactttaacgcaggttgttcttacgtccggccttcacaatggtcgtcaatccggctttggacctcccctacttttcagtggctgatccccgattcggcagatactaccgctacgcccacccactgtgcatacgaccgcatcgtggtggcaggaatgcttcttcgaggggcagtcgtgcctgattcggcactgccatttaactttcaggcagcttacggcctctcggatcaactcgcacaggctatctcggatcactatcctgtggaagtcatgctgaaa

SEQ ID NO: 10567 - DNA, 846 bp, Artificial Sequence
  Description of Artificial Sequence: Synthetic coding sequence
atgagagggatgaagctgttgggcgcacttctggcgctcgcagctctcttgcaaggggcagtttctctgaaaatcgcggcttttaacattcaaacgtttggtgaaaccaaaatgtctaatgcaaccttggtaagttacatcgtacagattctgtcgcggtatgatatcgcacttgtgcaagaagtgcgggactcccacctcactgcggtgggcaagctgctcgataatcttaatcaagacgccccagacacctaccattacgtggtgtccgagcccctcgggcgtaactcgtacaaggagcgctacctgttcgtctatagacctgaccaagtgagcgcagtcgattcgtactattacgacgacggttgtgagccttgtggtaacgacacttttaacagagaaccggccattgtgaggttcttttcgcgatttactgaggtgcgcgaatttgccattgtgccattgcacgcggcaccaggagacgcagtcgcagaaatcgatgccctttacgatgtgtaccttgatgtccaagagaagtggggcctggaggacgtgatgcttatgggagatttcaacgcaggttgttcgtacgtccgcccaagccagtggtcaagcataagactctggacttcccctaccttccagtggcttatccccgattccgcagacactactgcaaccccgacccactgcgcctacgatcgcatcgtggtcgctggtatgctccttaggggagctgtggtgcctgatagcgcactgccgttcaactttcaagctgcttatggactgtccgatcagcttgcacaggcgatttcggatcattaccctgtggaagtgatgctgaag

SEQ ID NO: 10568 - DNA, 846 bp, Artificial Sequence
  Description of Artificial Sequence: Synthetic coding sequence
atgcgtggaatgaaactcctcggagctctgcttgcactggcggcacttcttcaaggagcagtgagcttgaaaattgcagccttcaatatacaaacttttggagaaaccaaaatgtcgaatgccaccttggtgagctacattgtccaaattctctcaagatacgatattgcccttgtccaagaggtgagagattcgcatcttaccgcagtgggcaaactgctcgacaacctcaatcaagatgctcccgatacctaccattacgtcgtgtcggagcctctcggcagaaactcatacaaggaacggtatctttttgtgtaccgccccgatcaggtgtcggcagtggattcatactactatgatgacgggtgcgagccttgcgggaacgataccttcaaccgagaaccggccatcgttcgctttttcagccgtttcactgaagtgagggagttcgcaattgtgcccctgcacgcagcacctggagatgcagtggcagagatagacgccctctacgacgtctacctggacgtgcaagagaagtggggactggaggacgtgatgctgatgggggactttaatgccggttgttcctacgtgcggccttcccaatggtcctcgatcaggctttggacctcccctacctttcaatggctcatcccggactccgcggatactactgccactccaactcattgtgcctacgatcgaattgtggtcgccggaatgctcctgaggggagccgtggtgcctgattccgctcttccctttaactttcaggccgcatatggtctttcggatcaactggcccaagccatatccgaccattacccagtcgaagttatgcttaag

SEQ ID NO: 10569 - DNA, 846 bp, Artificial Sequence
  Description of Artificial Sequence: Synthetic coding sequence
atgcgaggaatgaaactccttggcgctctgctggcgttggcagcattgcttcaaggagccgtcagtctgaagatcgcagcgttcaacatccaaaccttcggagaaacgaagatgtcgaatgcaactttggtttcgtacatcgtccaaattctgagcagatacgatattgcacttgtgcaggaggtgcgtgactcccaccttaccgccgttggtaagctgcttgacaacctgaatcaagatgccccagatacttaccactacgtcgtgtcagagcctctgggcagaaatagctacaaagaaaggtatctcttcgtgtaccggccggatcaagtgtctgcagtggattcctactactacgatgacgggtgcgaaccttgcggaaacgatacctttaaccgggaaccagcgatcgtgagattcttttcaaggttcaccgaagtgcgcgaattcgctatcgtccctctccatgcagccccaggggatgcagtcgcggagatcgatgccctctacgatgtctacctggatgtgcaagagaagtggggtcttgaagatgtaatgctgatgggagatttcaatgcgggatgttcgtacgtccggccgtcacagtggtcgtctatacgtctttggacttcgccgacttttcagtggcttattcctgactcggcggatactaccgctaccccaactcattgcgcatacgatagaattgtggtggctggcatgctccttaggggcgcagtcgtgcccgattcagcgctcccttttaactttcaagctgcctacggactttccgatcagctcgcacaggcaatttcagaccactacccggtcgaagtcatgctcaag

SEQ ID NO: 10570 - DNA, 846 bp, Artificial Sequence
  Description of Artificial Sequence: Synthetic coding sequence
atgagaggaatgaagctgctcggagcacttctggcgctcgccgcgctgctgcaaggagcggtgtcgctgaaaatcgctgccttcaatatccaaacttttggagaaaccaagatgtcaaacgcaaccttggtgtcctacattgtccagatcctctcgcggtatgacatcgctctggtgcaagaagtcagggattcccacctgactgctgtgggaaagctgctcgacaacctcaatcaggacgctcctgatacttaccactatgttgtctcggagccgctcggccgcaactcgtacaaagaacgctacctgttcgtgtaccggcctgaccaggtgtccgcggtcgactcctactactacgatgacggctgcgagccgtgtggaaatgacaccttcaaccgtgagccggcgattgtgcggttcttctcaagattcactgaagtccgggagttcgcgattgtgccgctgcacgccgccccaggagacgcggttgcggaaatcgatgccctttacgacgtgtacctcgacgtgcaggaaaagtggggtttggaggatgtgatgctcatgggagacttcaatgcggggtgtagctacgttcggccgagccaatggtccagcattagactttggacgtcgcctactttccagtggctgatccctgactcggccgacacgaccgccactccgacccactgcgcctatgaccgcatcgtcgtggccggcatgctcttgagaggagcggttgttcccgatagcgctctgccattcaactttcaggccgcatacggcctctccgaccagctggcccaggccatttcggaccactacccagtggaggtgatgctcaag

SEQ ID NO: 10571 - DNA, 846 bp, Artificial Sequence
  Description of Artificial Sequence: Synthetic coding sequence
atgcgcgggatgaagctgcttggagccctgttggccctcgccgctttgctgcaaggtgcagtgtccctgaagattgcagctttcaatatccagacctttggagaaactaagatgagcaacgcaactcttgtgagctacatcgtgcagattcttagccgttacgacatagcgctggtgcaggaggtgagggattcccatctgactgcagttggaaaactgctggataacctgaatcaagacgcacctgacacgtaccattacgtggtgagcgaaccacttggaaggaactcgtacaaggagagatacttgtttgtgtaccggccagatcaagtctccgccgtggattcctactactacgatgacggctgtgaaccgtgcgggaacgataccttcaatcgcgaacccgcaattgtgaggtttttcagtagattcaccgaagtgagagagtttgcaattgtgcccctccacgcagcacccggtgatgccgtcgcagaaatcgatgcattgtacgacgtttacctggacgtgcaggagaaatggggtcttgaggacgtcatgctgatgggggatttcaatgccggctgtagctacgttagaccttcccagtggtcgtctatccgcctttggacctcccccacttttcaatggcttattcctgactcagcggataccactgctaccccaacgcactgtgcctatgatcgtattgttgtagccggaatgttgcttcgaggagcagtggttccagattcagcgcttccgtttaactttcaagccgcctatggtctttcagatcaacttgcccaagcaatttctgaccattaccctgtggaagtgatgcttaag

SEQ ID NO: 10572 - DNA, 846 bp, Artificial Sequence
  Description of Artificial Sequence: Synthetic coding sequence
atgagaggaatgaaacttttaggagcactgctcgccttggctgccctcctgcagggagcagtcagtctaaaaatcgccgcttttaatatacagacgtttggagaaactaaaatgagtaatgcaacattagtttcatacatagtccagatactttcacgctacgatatagccctcgttcaggaggtccgggattcccaccttactgctgtcgggaaattattagacaatctgaatcaggatgctcctgacacataccattatgtcgtttccgaaccactcgggagaaactcgtataaggaaaggtatctcttcgtgtatagacccgatcaggtctctgctgtggattcctactactatgacgatggatgtgaaccctgtgggaacgacacatttaatagggaacctgctatcgtgcgctttttttctagatttactgaagtgagggagtttgcaatagtacctcttcatgccgcaccaggagatgctgtggcagaaatagatgctctgtatgatgtgtatcttgatgtgcaggagaaatgggggctggaagatgtaatgcttatgggagatttcaacgcggggtgttcctacgtccggccctctcagtggtcctcaatcaggctatggacatcaccaactttccagtggctgatccctgattccgctgacacaactgccactccgactcattgtgcctacgatcggatagtagtggctggaatgttacttcgaggagcagtagtgcccgattctgctctgccattcaatttccaggcagcttacgggctgagtgatcagttagcacaggctatatcagaccattatcccgtggaggttatgctgaaa

SEQ ID NO: 10573 - DNA, 846 bp, Artificial Sequence
  Description of Artificial Sequence: Synthetic coding sequence
atgagagggatgaagctgctcggggcgctcctcgccctggccgcacttcttcagggagccgtgtcgttgaagatcgcggccttcaacatccagaccttcggcgagacgaagatgtcgaacgcaaccctcgtgtcgtacatcgtgcagatcctttctcgctacgacatcgcgttggtgcaggaggtccgcgactcgcatttgacggcggtgggaaagctgctggataacctcaatcaagatgcgccggacacctatcattatgtcgtgtcggaaccgcttggtcggaattcgtacaaggaacgctacctgttcgtgtaccggccggaccaagtgtcggccgttgattcgtactattacgatgacggctgcgagccatgtggtaacgacacctttaatcgggaaccagcaatcgtgcgcttcttttctcggttcaccgaagtccgggaatttgctatcgtccctctgcacgcagcaccgggcgacgccgtggccgagattgacgcgctgtacgatgtttatctggatgtgcaggaaaaatggggcctggaggacgtcatgcttatgggcgatttcaacgcaggatgctcgtacgtgaggccgagccagtggagttcaatccggctgtggacgtcaccaaccttccaatggctgattcccgatagcgccgacactactgccactccaactcactgcgcgtacgaccgcatcgtcgtggctggcatgctcctccgcggagccgtggtcccggattcagctctgccgttcaacttccaggctgcatacggtctgtcggatcaactggcccaggcaatttcggatcactacccagtggaggtgatgctgaaa

SEQ ID NO: 10574 - DNA, 846 bp, Artificial Sequence
  Description of Artificial Sequence: Synthetic coding sequence
atgagagggatgaaactgctcggcgcacttctcgccttggcggcgctgctgcagggagccgtgtccttgaaaatcgcagctttcaacattcaaacattcggagagacaaagatgagtaatgcaaccctggtctcatatatcgtgcaaattttgtcccgatacgatatagccctggtgcaagaagttcgggatagtcatctgaccgccgtcggtaagctgttggacaacctgaatcaggatgctcccgacacctatcactacgtcgtatccgagcctttgggaagaaacagctacaaggaaaggtacctcttcgtgtatcgccccgaccaggtgagcgcagtagattcctattactatgacgatggatgcgagccttgcggcaatgacactttcaatagagagcccgcaattgtcagattttttagcagattcacggaagtgcgggagttcgctatcgtaccgcttcatgctgccccaggcgacgctgtggccgagattgacgccctttacgatgtttacctcgacgtgcaggagaagtggggcctggaggacgtcatgctgatgggcgatttcaacgcaggctgttcctacgtgcgccctagccaatggtcatcaatccgactgtggactagtcctacgttccagtggctgatcccggattctgctgatactactgcgactccaacccactgcgcttatgacaggatcgtggtggcaggtatgctcctgcgaggggctgtagtccccgactccgcccttccatttaacttccaggcagcctatgggctgagcgatcaactggcgcaagctatttcagaccactacccagtggaagtgatgctgaag

SEQ ID NO: 10575 - DNA, 846 bp, Artificial Sequence
  Description of Artificial Sequence: Synthetic coding sequence
atgagaggcatgaagctgctgggcgcccttctcgcactggcagcactgctgcaaggtgcagtgtcccttaagatcgccgccttcaacattcaaaccttcggagagactaaaatgtcgaatgccactttggtgtcgtacatcgtccaaatactctcacgatacgatatcgcattggtgcaagaagtgagagattcccatcttactgcggtgggtaagctgctcgataacctgaaccaagacgcgccagacacctaccactacgtcgtgtcagaaccgctggggaggaacagctacaaggaaagatatctctttgtgtaccgtcctgaccaggtgagcgcagtggatagctattactacgatgacggatgtgagccttgcggaaatgacacctttaatcgtgaacccgcaatagtgcgatttttctccagattcactgaagtgcgtgaattcgccatagtccctctgcatgctgcaccaggagatgcagtcgcagaaattgacgcgctttatgacgtgtacctcgatgtgcaagagaagtggggacttgaggacgtcatgctgatgggtgatttcaacgcaggctgttcctacgtccggccgtctcaatggagcagcatcagactgtggacctcaccaaccttccaatggctcattcctgatagcgccgacactactgcaactcctactcattgtgcatacgaccgtattgtggttgcaggtatgcttctcagaggcgctgtggttcctgactccgcgctccctttcaactttcaggctgcatacggtctttccgaccagcttgcacaggcgatatcagatcactacccagtggaggtgatgctgaaa

SEQ ID NO: 10576 - DNA, 846 bp, Artificial Sequence
  Description of Artificial Sequence: Synthetic coding sequence
atgcgaggtatgaagctgcttggggcgctcctcgcactcgctgctttgcttcagggcgcggtgtctttgaaaatagctgcttttaatatacagacttttggggagacgaaaatgagtaatgcaaccctggtgtcctacatagtgcaaatcttgtccagatacgacatagctttggttcaggaggtccgcgacagccatctcacggccgtcggtaaattactggataatctaaatcaggatgcccccgacacatatcactacgtagtttccgagccacttgggcgcaactcatacaaagaacgctatttgttcgtgtatcgccccgatcaggtgtcagctgttgattcctactactacgatgatgggtgcgagccctgcggcaatgacactttcaaccgcgaacccgcaattgtccggttcttctcacgcttcacggaagtgcgagagtttgctattgtgcctctgcacgcagcccccggagatgctgtcgcagaaatcgatgctctatacgacgtctaccttgacgtccaagagaaatggggcctggaggatgtgatgctcatgggcgacttcaacgctgggtgctcgtatgtgagaccctcccagtggtccagtatcaggctgtggacttcaccaaccttccagtggctcattcctgattcagccgataccaccgcgactcctacgcattgcgcatacgaccggattgtggtggctggcatgctgctccgcggagctgttgtgccagactccgcgcttccctttaattttcaggccgcgtacgggctgtcggatcagctggcccaggccatcagtgatcactatcctgtcgaggtgatgttgaaa

SEQ ID NO: 10577 - DNA, 846 bp, Artificial Sequence
  Description of Artificial Sequence: Synthetic coding sequence
atgcgggggatgaaactgctcggtgccctccttgcacttgccgccctactccagggcgccgtctctttgaagatagctgcttttaatattcagacctttggggaaacgaagatgagtaacgctacgctggtctcctatattgtccagatcctctcccgttatgacatagctctggtacaagaagtcagggactcccacctgaccgcggtaggaaaactgctcgacaacctgaaccaggatgcacccgatacttatcactatgtggtgtccgagcccttggggcggaactcctacaaagaacggtatctcttcgtgtaccggcccgatcaggtgtctgccgttgactcctattattacgacgatggctgtgagccatgtggcaacgatacctttaatcgtgaacctgccattgtgaggtttttttctcgtttcacggaggtccgagagttcgctatagttccccttcacgctgcccctggagatgccgtggctgagatagatgctctttacgatgtgtatctggatgtacaggaaaagtggggcctggaagacgtcatgctgatgggggacttcaacgccggctgttcctatgtgcggcccagtcagtggagtagtatcagactgtggactagtcctactttccagtggttgatccctgactctgcggatacgacggctacacctacccactgcgcctacgatcggatcgttgtcgctggaatgctgttgagaggagccgttgtccccgactccgcattaccattcaatttccaagcagcctatgggctaagtgaccaactcgcacaggctatcagcgaccattatccggtggaagtcatgttgaag

SEQ ID NO: 10578 - DNA, 846 bp, Artificial Sequence
  Description of Artificial Sequence: Synthetic coding sequence
atgagaggtatgaaattacttggagctttacttgcattagcagcacttcttcaaggagccgtaagtttaaaaatagcagcttttaatattcaaacatttggtgaaacaaaaatgtctaatgcaactttagtctcatatatcgttcagattttatcaagatatgatattgcattagttcaagaagttagagattcacatcttacggctgttggtaaacttcttgataatcttaatcaagacgctcctgatacatatcactatgttgtcagtgaaccacttggaagaaatagttataaggagcgttatttatttgtttacagaccagatcaagtaagtgctgtggattcttattactatgatgatggttgtgaaccatgtggaaatgatacattcaatagagaacctgctattgttagattcttttcacgttttacagaagtaagagaatttgctattgttccattacatgctgctccaggtgatgcagttgcagaaattgatgcactttatgatgtttatttggatgtacaagaaaaatggggattagaagatgttatgcttatgggtgattttaatgcaggatgttcctatgttcgaccaagtcaatggtcctcaattcgattatggacatcaccaacttttcaatggttaattccagattcagcagatacgacagcaactccaactcattgtgcatatgacagaatagttgttgctggaatgttacttcgtggagctgttgtccctgactcagcacttccttttaattttcaagcagcttatggactttctgatcaattagcacaagctatatctgatcattatcctgttgaagttatgttaaaa

SEQ ID NO: 10579 - DNA, 846 bp, Artificial Sequence
  Description of Artificial Sequence: Synthetic coding sequence
atgcgaggaatgaagctactgggggcacttcttgctctggcagcgcttctgcagggcgctgtgagcttgaagatcgccgcattcaatatccagacatttggcgagaccaaaatgtcaaatgcaaccctggtgtcgtacattgtacaaattttgagccggtacgatattgccctcgtacaggaggtgcgggactcacacttaacggctgtgggcaagctcctggacaatctcaatcaagacgctcctgatacataccattacgtggtttccgagcccctgggcaggaacagctacaaggaacgctatctgttcgtttataggcccgatcaagtatctgcagtggactcttattattatgatgatggctgtgagccatgtgggaacgatacctttaatcgcgagcctgccatagtgcgcttcttttcacgctttacagaagtgagggagtttgccatcgtgccgctgcacgccgcacctggagatgcggtcgctgaaatcgacgcactttacgatgtgtacctggatgtgcaggagaagtggggactggaagatgtgatgcttatgggagactttaatgcaggctgttcctatgtacgcccttcccaatggtcctccattcgactttggacttcacccacgtttcagtggctgattccagactcagcagacaccaccgccacccctacacattgcgcctacgacagaattgtggttgcaggtatgctgttgcggggcgcggtggtgcccgactccgccctccccttcaacttccaggccgcatatggcctgagtgaccaactcgcacaagccatttccgatcactacccggtcgaggtgatgctgaag

SEQ ID NO: 10580 - DNA, 846 bp, Artificial Sequence
  Description of Artificial Sequence: Synthetic coding sequence
atgaggggtatgaaattactgggggccctcctcgcattagctgcactgctgcagggggcggtctctctgaagatcgcggccttcaacatccagacatttggcgaaaccaaaatgtctaacgctactctggtcagttatattgtgcagatcctctccagatacgatattgccctggtgcaagaagtcagagattcacatttgaccgcagtaggcaagctgctggacaacctgaatcaggacgctccagatacataccattacgtggtaagcgaacctctgggccgaaactcctataaggagcgatacctgtttgtctatcgtcctgaccaggtttctgcggtggactcttattactacgacgatggctgcgagccttgtggtaatgacacatttaatcgagaacctgccattgtgcgattttttagcagattcactgaggtccgagagttcgcaatcgtgcctttacacgccgctcctggcgacgcagttgcagaaatcgacgccctgtatgatgtgtatctcgacgtgcaggaaaagtggggtctagaggatgtgatgttaatgggcgacttcaacgcaggctgcagctacgtgagaccctctcagtggtcctctatcaggctgtggacctccccgacctttcagtggctgatccccgattcagcggacaccacggccactcctactcattgtgcctacgatagaattgtagtggccggaatgctgctgcgaggcgctgttgtgccagattcagctttgcccttcaacttccaggctgcctacggactcagtgatcaattggcgcaggccatcagcgaccactatcccgttgaagtgatgttgaag

SEQ ID NO: 10581 - DNA, 846 bp, Artificial Sequence
  Description of Artificial Sequence: Synthetic coding sequence
atgaggggcatgaaactgctgggcgctttgctggcgctggccgcattactacagggtgcggtcagtctgaagatcgcagccttcaacatccagacctttggcgagactaagatgagtaacgctaccctggtgtcgtacatcgttcagattttatctcgctacgacatagcccttgttcaggaagtgagagattctcacctgactgccgtcggcaagctgcttgacaatctaaaccaggacgcacctgacacctaccattatgtggtgagtgaaccactgggcagaaatagttacaaggaacggtatctgtttgtgtacagacccgaccaagtgagcgccgtcgatagctactactacgatgatgggtgtgaaccgtgtggcaacgataccttcaaccgggagcctgctattgtgcgcttctttagccgtttcaccgaggtccgggaattcgctatcgtgcctctccacgcagcacctggagatgctgtggcagaaatcgacgcactctatgacgtgtatctagacgtgcaggaaaaatgggggttagaggacgtaatgttaatgggcgatttcaatgctggctgctcatatgtgaggccctcccagtggtcttcaatccggctgtggacatctcccacattccagtggttaatccccgactccgctgacactacggcgactcctactcactgtgcttatgaccgcatcgtggttgcgggtatgctgctcagaggtgctgtggttcctgacagtgccttaccctttaacttccaggccgcctatgggttatctgaccagctcgctcaggccatctctgatcattaccctgtcgaagtgatgctgaaa

SEQ ID NO: 10582 - DNA, 846 bp, Artificial Sequence
  Description of Artificial Sequence: Synthetic coding sequence
atgcgtggaatgaagctcttgggagcacttctcgcccttgctgcacttcttcagggcgcagtcagcctgaagatagcagcattcaacatccaaacctttggtgagactaaaatgtcgaacgcaaccctggtatcctacatagtgcaaatactttcccgctacgacatcgcacttgtccaggaggtgagagatagccacttgaccgcggtgggaaaactgctcgacaacctcaatcaagacgcacctgatacttaccattacgtggtgtcggagccccttgggcgcaactcctacaaagaacgttatcttttcgtctaccggcctgaccaagtgtccgcggtggattcgtactactacgacgacgggtgtgaaccatgtggaaatgacacctttaaccgagagcccgcaattgtgcgctttttctcgcgttttaccgaggtgcgagaatttgccattgtgccccttcacgccgctcctggtgacgccgtcgcagaaattgacgcactctacgacgtgtacctcgatgtccaagaaaagtggggtttggaggacgtgatgctgatgggagatttcaacgcagggtgctcctacgtgcgcccaagccagtggagcagcatccgactttggacttcaccaacgtttcaatggctgatcccagattcagcagatactacggctactccgactcattgcgcctacgatcgtatcgtggtcgccggaatgctgcttagaggggccgtggtgccggattcggccctgccctttaacttccaggccgcctacggtctgtccgatcaactggcccaagccatctccgatcattatcctgtggaagtgatgcttaag

SEQ ID NO: 10583 - DNA, 846 bp, Artificial Sequence
  Description of Artificial Sequence: Synthetic coding sequence
atgcgggggatgaagttgttaggggctctcctggctctggccgcgctccttcagggtgcggtcagcctgaaaatcgctgctttcaacattcaaacgtttggggagaccaagatgtcaaacgccaccctcgtgagctatatagtacagattctgtcgcggtacgatatagccctggtgcaggaggtgagggactctcatttaacagcagtgggtaaactgctggacaacctgaaccaggacgcccctgatacctatcattacgtggttagtgagcccctcggaaggaactcctacaaggagagatacctgttcgtgtacagacccgatcaggtcagcgccgtcgatagttactattacgatgacggatgcgagccatgtggcaacgacacctttaaccgcgagccagcgatcgtgcgcttcttctcgcgcttcacagaagtgagggagttcgccatagtgcctttgcacgctgcccccggtgacgccgtggccgagatcgatgccctgtacgatgtttacctggacgtccaggagaaatggggcctggaggatgttatgctgatgggtgactttaatgcgggctgtagttacgtacgcccgagccaatggtcgtcgattcggttgtggacctctccaacctttcagtggctcatccctgactccgccgataccacggcgactcctacgcattgcgcatacgaccgaatagtcgtggcaggaatgctcctgagaggtgcagtcgtgccagactccgctctgcccttcaactttcaggcagcctatggcctgagcgaccagctggcgcaggcaatttccgatcactaccccgtggaggtgatgttaaaa

SEQ ID NO: 10584 - DNA, 846 bp, Artificial Sequence
  Description of Artificial Sequence: Synthetic coding sequence
atgcggggcatgaagctgctcggcgcactccttgccctggctgcgctgctccaaggagctgtgtcactcaaaatcgcagcattcaatatccagactttcggagaaaccaagatgtccaatgccactctggtgtcatacattgtccagattttgtcccgttatgacatcgcgctggtccaagaggtgcgcgactcccacctgacggccgtgggtaaacttctggataacctcaaccaggacgcaccggatacctaccactacgtcgtctcggaacccctgggacgtaactcatacaaggaacgctacctgttcgtctaccggcctgaccaagtctccgctgtggactcgtactattacgatgacgggtgcgaaccctgcggcaacgacactttcaatcgggaacctgcaatagtgcgctttttctcacggttcaccgaagttagggagttcgccatcgtgccgttgcacgcggcaccgggagatgccgtggcagagatcgatgcgctgtacgatgtgtatctcgatgtgcaggagaagtggggactggaggacgtcatgttgatgggcgatttcaacgcgggctgttcatatgtccgcccttcccagtggtcatcgatccgactctggacctccccgactttccagtggctgatcccagacagcgcagatactaccgcgaccccaactcattgcgcttacgaccgcatcgtcgtcgctggtatgctgctgcggggagccgtcgtgccggactcggcgctccctttcaactttcaagcggcctacgggctgtccgaccaactggcccaggcgatcagcgatcattacccggtggaagtcatgctcaag

SEQ ID NO: 10585 - DNA, 846 bp, Artificial Sequence
  Description of Artificial Sequence: Synthetic coding sequence
atgcgcggcatgaagttgttgggcgcacttctggcccttgccgcgctgctgcagggggcagtgagtttgaagattgctgcctttaacatccagacctttggcgagactaaaatgtccaatgctaccttagtgtcctatatcgtgcagattctgagccgctacgatatcgctctggtgcaggaagttagggattcgcatctaacggctgtcggcaaattactcgataacttgaaccaggacgcccctgacacataccattacgttgtttcagaacccctcggccgcaactcatataaggaacggtatctgtttgtttatcgacctgatcaggtgagcgcggttgatagctactactacgacgacgggtgtgagccttgcggtaacgacacatttaacagggaacccgccatcgtccgattcttttctcgcttcaccgaggtgagagagttcgctattgtacctttgcacgccgccccgggcgatgccgtggctgaaatagacgcgctttacgatgtttacctggatgttcaagaaaagtggggcctggaagatgtgatgctgatgggggatttcaacgcaggatgtagttatgtgagaccatcccaatggagttccattcggttgtggactagccctaccttccagtggttgattccagattccgcagataccacagccacccctacgcattgcgcgtatgaccgtatagtcgtggccggcatgcttctgcgaggcgcagttgtgccagacagcgccctcccctttaatttccaggctgcttacggcctgagcgaccagctagcccaagccattagcgaccattaccctgtcgaggtgatgttaaaa

SEQ ID NO: 10586 - DNA, 846 bp, Artificial Sequence
  Description of Artificial Sequence: Synthetic coding sequence
atgcgcggtatgaaactcctgggcgccctcctggcgctcgccgcgcttctgcaaggcgcggtttccctgaagatcgccgcctttaacatacaaacctttggggagactaaaatgtcgaacgcgaccctggtgtcatacatcgttcaaattctgtcccggtacgacattgcgctcgtccaggaagtgcgcgattcgcacctgactgcagtcggaaaactcctcgacaacctcaaccaggacgcacctgacacttatcactacgtggtcagcgaacccctgggccggaactcgtacaaagaaaggtacctcttcgtctaccggccggaccaggtgtccgccgtggattcgtattactacgatgatggatgcgagccctgcggaaatgataccttcaaccgggaacctgcaattgtgagattcttcagccggttcactgaagtccgggagtttgcgatagtgccacttcatgccgctcctggggatgccgtggcagagatcgatgccctgtacgacgtctacctggatgtgcaagaaaagtggggcctggaggacgtcatgctcatgggagacttcaacgcaggatgttcatacgttcggccgtcccagtggtcctccattcgcctgtggacctcgcctactttccagtggctgatcccagacagcgccgatacgactgctacccccacccattgcgcttacgacaggatcgtggtggcaggaatgcttctgagaggagcagtcgtccctgactcagcactgccgttcaacttccaggcagcctacggcctgagcgaccagctcgcccaggccatctcagaccactacccagtcgaggtcatgctgaaa

SEQ ID NO: 10587 - DNA, 846 bp, Artificial Sequence
  Description of Artificial Sequence: Synthetic coding sequence
atgagaggcatgaagctcctaggggcactcctcgcgctcgccgcactgctccagggggcagttagtctgaagatcgccgcatttaacatccagacatttggggagacaaagatgagcaacgcgactctagtctcatacatcgtgcagatcctcagccggtatgatattgccctggtgcaagaagtcagagatagccacctgacagcagtgggaaaactactcgacaacctgaaccaggacgctccagacacctatcattatgtggtctcagagccactcgggaggaacagttacaaggaaagatacctcttcgtctacaggcccgaccaggtctcagcagtagacagctactattacgatgacggatgcgagccgtgcggtaacgatactttcaacagggaaccagcgatcgttaggttcttttctcgcttcaccgaagtcagagaatttgccatagtccctcttcatgcagcccctggcgatgctgttgccgaaattgacgccctctacgacgtctaccttgacgttcaagagaagtggggcctcgaagacgtcatgctcatgggagatttcaacgctggctgctcctacgttaggcccagtcagtggtcgtctataagattgtggaccagccccacattccagtggctgattcccgacagcgcagatacaaccgccactcctacccattgcgcttacgataggatagttgtggccgggatgctcttgcggggcgctgtggtgccagacagcgctctgccttttaattttcaggcagcctatggcctgagcgatcaactcgcgcaagcaatcagtgatcactaccccgttgaagtcatgctgaag

SEQ ID NO: 10588 - DNA, 846 bp, Artificial Sequence
  Description of Artificial Sequence: Synthetic coding sequence
atgagagggatgaaactcctcggcgcattgctggccctcgctgctctactacagggtgcagtaagccttaagatagccgcctttaacatccaaactttcggtgagacaaaaatgtctaacgcaaccctggttagctacattgttcaaatcctgtcacgttacgatatcgccttagtccaggaggtcagagatagccatctcacagcagttggaaagctccttgataatcttaatcaggacgcaccggatacttatcattatgtcgtcagtgaacccctagggcggaactcatacaaggagcgatacctatttgtgtatcgacctgatcaagtgagcgccgtggattcttactactatgacgacggctgtgagccttgcgggaacgatacttttaacagagaacccgcaatcgtgcgcttcttcagccgctttactgaggtgcgggaatttgctattgtgcctttgcatgccgcccccggagacgccgtcgcagagattgatgctctgtatgacgtctatctcgacgtgcaggagaaatggggtctggaggacgtgatgttgatgggagattttaatgctggctgctcctatgtgcgcccttcacaatggagttcaattaggctgtggacatcgccaacgtttcagtggctgatccccgacagtgctgataccactgccacaccgacccactgcgcctacgatcggatcgtggtcgctgggatgttgttgcggggagctgtggtgccagactcagccctgccattcaatttccaggctgcctatggcctgagcgaccaattggctcaggctatctccgaccactaccccgttgaagtcatgctgaag

SEQ ID NO: 10589 - DNA, 846 bp, Artificial Sequence
  Description of Artificial Sequence: Synthetic coding sequence
atgcgggggatgaagttgttgggtgcccttctcgcgctcgctgccctgcttcagggggcagtgagcctgaaaatcgccgcgtttaatatccagactttcggcgagactaagatgtcaaacgccaccctcgtctcctatatcgtacagatcctgagcaggtatgatattgctctggtccaggaggtgcgggattcccatctgacagccgtgggcaagttacttgataacctcaaccaggacgcccctgacacataccactacgtcgtttctgagccactgggacgcaattcatacaaggagagatacctgttcgtgtatcgaccagaccaggtcagcgcggttgatagttactactacgatgacgggtgcgaaccttgtggaaacgatactttcaacagggagcccgccatcgtgaggttctttagcagattcaccgaggtacgagaattcgccatcgtgccgctccatgcagcccctggagatgccgtcgctgaaatcgacgctctctatgacgtctacctggacgttcaggaaaagtggggcttggaggacgttatgttaatgggagactttaacgctgggtgctcctacgtgagaccttcccagtggagctcaattagattgtggacttcacctactttccagtggttaataccagacagcgctgacacgactgctacccctacacattgcgcatacgaccgtatcgtggtggcggggatgttattgaggggagccgtagtccctgactccgccctgccgtttaatttccaggccgcatatggcctttctgaccaactcgcacaggcaatctctgatcattatcctgtggaggtgatgctaaag

SEQ ID NO: 10590 - DNA, 846 bp, Artificial Sequence
  Description of Artificial Sequence: Synthetic coding sequence
atgcggggaatgaaactgctcggggcgctgttggcactggcggccctcctgcaaggagccgtgtccctgaagatcgcagctttcaacatccaaaccttcggcgaaacgaagatgtccaacgccaccctggtgtcctacatagtgcagatcctgtcccgctacgacatcgcacttgtgcaagaagtgcgcgactcgcatctgactgccgtcggtaaactcctggacaaccttaaccaggacgctccggacacctatcactacgtggtgtccgaaccactcggacggaacagttacaaggagcgctacctctttgtgtaccgccctgaccaggtgagcgcggtggactcgtactactacgacgacggctgcgagccttgcggaaatgatactttcaaccgcgaaccggccattgtgcggttcttttcccgcttcactgaagtgagggagttcgccattgtgcctctccatgccgcgccgggagatgctgtggcagagatcgacgccctctacgatgtgtacctggacgtgcaagaaaagtggggacttgaagatgtgatgctgatgggggactttaatgccggatgcagctacgtcaggccgtcgcaatggtcatcaatccggctctggacctctcctactttccaatggctgatcccggattccgcagatactaccgcgaccccaacccactgcgcatacgatcgaattgtcgtggccggaatgctccttcgcggagcagtcgtgccggatagcgccctgccgtttaacttccaggcggcgtacggactgtcggaccaactggcgcaggccatctctgatcactatccggtggaagtgatgctcaaa

SEQ ID NO: 10591 - DNA, 846 bp, Artificial Sequence
  Description of Artificial Sequence: Synthetic coding sequence
atgcgcggtatgaagctgttaggagcgctattggctttagccgccttgttgcagggcgctgtgagtctgaagatcgcggcattcaatattcagaccttcggcgaaaccaagatgagtaacgcgacgctggtctcttatattgtccaaattctctctaggtacgatatagctctcgtgcaagaagtgcgtgattcgcacttgacggctgtgggcaagctattagataatcttaatcaggatgcgccggatacatatcactacgtcgtgtccgagccgctgggaaggaactcgtacaaagagcgctacctttttgtttatcgcccagaccaggtctccgcagtggattcgtactattatgacgacggatgcgaaccatgcgggaatgataccttcaaccgtgaaccggccatcgtgcgattcttctcccggttcactgaagttagagagtttgccatcgtcccgttgcatgctgctccgggcgatgccgttgcagagattgatgcgctgtacgatgtgtatctagacgttcaggagaagtgggggttggaggacgtgatgctgatgggagacttcaacgctggctgctcgtatgtgcgcccgagccagtggagttctatccgactgtggaccagcccaacgttccagtggctgatacccgacagtgcggacacaactgccactccgacgcattgtgcctacgatcggattgtggtcgcaggtatgctgctccggggagccgtggtgcccgatagcgcactgcccttcaatttccaggcagcatatggcctaagcgaccaactggcacaggcgatctccgaccactatcccgtggaagtgatgttgaag

SEQ ID NO: 10592 - DNA, 846 bp, Artificial Sequence
  Description of Artificial Sequence: Synthetic coding sequence
atgagaggaatgaaacttctcggagcgctgctcgcattggcagctctgttacagggcgcggtctccctaaagatcgcggcctttaacatccaaacctttggcgagacaaagatgtcaaacgcgactttggtaagttacatcgtccagattctgtcccgttatgatattgccttggtgcaggaagtgcgcgacagtcatctaacagccgtcggcaagcttttggacaacctgaaccaggacgctccggacacttaccattatgtcgtaagtgagccgctgggccgcaactcttataaagagcggtatctgtttgtgtatagaccagaccaagtctctgctgtggatagttattactatgatgatggatgcgagccgtgcggcaatgacactttcaatcgggagccagcgattgtgcgcttcttttctcgtttcaccgaggtccgggagttcgcgatcgtcccgcttcacgcagctcctggagacgcagtggccgagatcgacgcgttatacgacgtctaccttgacgtccaggagaagtgggggctggaggacgtgatgctgatgggggactttaatgccgggtgcagctatgtcaggcctagccaatggtcctctatcagactgtggacatctcccacattccagtggttgatcccagacagcgccgatactacggctacacctactcattgcgcctatgatcgcattgtggtggctgggatgttattgcgaggggcggtagtacctgattccgcactacccttcaacttccaggcagcctacggtctctcggaccagctcgcacaggcgatatccgaccactatcccgtcgaagtgatgctgaaa

SEQ ID NO: 10593 - DNA, 846 bp, Artificial Sequence
  Description of Artificial Sequence: Synthetic coding sequence
atgcgcggcatgaaacttctgggtgctcttctcgccctcgccgccctgctgcaaggagctgtctctctgaagatcgcggccttcaatatccagacctttggagagactaagatgtctaacgccaccctcgtctcctacatagtgcagatcctctcccgctacgatattgcccttgtgcaggaggtgcgggacagccacttgactgcggtcggaaagctgctggataacctgaatcaggatgcccctgacacgtatcactacgtggtgagcgaaccgctggggcgcaactcctacaaagaaagatacctttttgtctacagaccggaccaggtgtctgctgtggactcatactactacgacgatggttgtgagccgtgcggaaacgacacctttaatcgtgagcccgctattgtcagattcttctcgcggttcactgaagttcgagagttcgcgatcgtgccattgcacgccgcaccgggagatgcagtagcagaaatcgacgcgttgtacgacgtgtacctcgacgtccaagaaaagtggggcctggaggacgtgatgctgatgggagactttaacgcaggatgcagctacgtaaggccatcccagtggagctccatccgcctctggaccagccctactttccaatggctgatcccagactcggctgatactaccgctacccccactcattgcgcctacgatcgcatcgtggtggctggcatgctgctcaggggggcagttgtgcctgattccgccctccctttcaacttccaggccgcctatggtctgtcggaccaacttgcacaggcaatctcggatcattacccagtggaagtgatgcttaag

SEQ ID NO: 10594 - DNA, 846 bp, Artificial Sequence
  Description of Artificial Sequence: Synthetic coding sequence
atgaggggcatgaagttgctgggggccctgctcgcactggctgcccttcttcaaggggccgtgtcccttaagatagctgcctttaatattcagacattcggtgaaactaagatgtctaatgcaaccttagtatcttacattgtgcaaatcctctcacggtatgacatcgctctggtccaggaggtgagagatagtcacctgacagccgtcggcaaactgttggacaacctcaaccaggacgccccagacacttatcattatgtggtgagcgagcctttaggtcgcaacagttacaaagaacgttacctatttgtatacaggccagatcaagtgtcagccgtggattcttactactacgatgacggctgtgagccatgtggtaacgacacatttaatcgagaacctgccattgtgcggttcttttcccgattcactgaagtccgtgagtttgccatcgtgcccttgcacgcagcccccggcgacgccgtggccgagattgacgccctgtatgacgtgtacctcgacgtccaggaaaaatggggcctcgaggatgtgatgctcatgggagactttaacgctggctgttcatatgttcggccaagtcagtggagcagtatccggctctggacctccccaacctttcagtggttgatacctgattctgcagacaccactgcgacacccacacattgcgcttacgaccgcatcgtggtcgctggaatgctccttaggggcgcggtggtgccggattcagctctcccttttaattttcaggccgcatatggactgtccgaccagctggctcaggctattagcgaccattatccagttgaagtaatgctgaag

SEQ ID NO: 10595 - DNA, 846 bp, Artificial Sequence
  Description of Artificial Sequence: Synthetic coding sequence
atgagagggatgaagctgctgggggcattactggcattggcagccctcttgcagggagccgtctccctcaagatcgcagctttcaacattcaaacattcggagagaccaagatgtccaatgcaacgctggtgagttacattgtgcaaatcctgagccggtatgatatagccctggtgcaagaagtgcgggactctcatctcacagccgttggtaaattgctagataatctgaatcaggatgccccagacacgtatcattatgtggtaagcgaaccgctgggtaggaattcatacaaggagcgctatctctttgtgtaccgcccagaccaggtcagtgcagtggattcctactattacgacgacggatgcgagccttgtggaaacgacacattcaatagggaacctgccatcgtgaggtttttctctcggttcaccgaagtgcgggaatttgccatcgtaccactacacgccgccccaggagatgccgtggctgaaatcgacgccctgtatgatgtatacttagatgtgcaggaaaagtggggtctggaagatgtgatgttaatgggagattttaacgctgggtgcagctatgtacggccctcgcagtggtcatcgatccgactgtggacctcacccacttttcagtggctaattcccgactccgccgacacaacagctaccccgactcactgcgcctatgaccgaatcgtggtggccgggatgctgctgcggggagcagtagttccagactcagccctgccttttaattttcaggcagcatatggactaagtgatcagctggcccaggcaataagcgatcactatccggtggaagtgatgctgaag

SEQ ID NO: 10596 - DNA, 846 bp, Artificial Sequence
  Description of Artificial Sequence: Synthetic coding sequence
atgagaggaatgaagttgctcggagcgcttcttgctcttgcggctctgctccagggcgcggtgagtctaaagattgctgcctttaacatccagactttcggggagactaaaatgagcaacgccactctggtgagctatattgtacaaattctttcacggtacgatatcgcgttggtccaagaggtgcgcgactctcaccttaccgcagtcggcaagctcctggacaacctgaaccaagacgcacccgatacttatcactatgtggtttccgaacctttgggccggaattcctacaaagagagatacctgtttgtctatcgcccggatcaggtgtctgcggttgactcttactactacgacgatggctgtgaaccttgtggcaacgataccttcaaccgagaacctgccattgtgaggtttttttcccgtttcactgaggtaagggagttcgccatcgttccactgcacgcagctcctggcgacgccgtcgccgaaatcgatgcactatatgatgtatatctcgatgtacaggaaaagtggggcctcgaggatgtgatgctaatgggcgatttcaacgccggttgctcgtacgtccgtcctagtcagtggtcctctattcgtctgtggactagtccgacttttcagtggctgatccctgactctgctgataccacggccacacccacgcactgtgcttacgatcggatcgtcgtagctggcatgctgcttagaggtgctgtggtgcccgacagcgctttacctttcaacttccaagctgcctatggtctgtcagaccagttggcacaggcaatctccgatcactaccccgtggaggtgatgctcaag

SEQ ID NO: 10597 - DNA, 846 bp, Artificial Sequence; identical to SEQ ID NO: 10595
  Description of Artificial Sequence: Synthetic coding sequence

SEQ ID NO: 10598 - DNA, 846 bp, Artificial Sequence
  Description of Artificial Sequence: Synthetic coding sequence
atgagaggcatgaaactgctcggagcactgctggccctcgcggcgctgctgcaaggcgcagtgtcactcaagatcgccgccttcaacatccagactttcggtgagacgaagatgtcaaacgcaactttggtgagctacattgtccagatcctcagcagatacgatatcgccctggtgcaggaagtcagggatagccacctgactgcagtcggaaaactgctggacaacctgaatcaggacgcccctgacacgtaccattacgtggtttcggaacctctcggaagaaactcctacaaggagcgatacctcttcgtgtaccggcccgatcaagtctcggccgttgactcgtactactacgatgatggatgcgaaccctgcgggaacgatactttcaaccgggaaccagcaatcgtgcgcttcttctcccggttcactgaggtgcgcgaatttgccattgtgccgttgcacgcggcgccgggagacgccgtggccgaaatcgatgcgctgtacgatgtgtaccttgatgtgcaggaaaagtggggtctggaggacgtcatgctgatgggagatttcaatgccggatgcagctacgtccgcccgtcgcagtggtcctccattcgcctgtggactagcccgaccttccagtggctcatcccggactccgccgacaccaccgcaactccaacccattgtgcttacgaccggatcgtggttgcggggatgctcctgcgaggagcagtcgttccagattctgctctgccattcaacttccaagcagcctacggcttgtccgaccaactggcacaggctatctcggatcactacccggtggaggtcatgttgaaa

SEQ ID NO: 10599 - DNA, 846 bp, Artificial Sequence
  Description of Artificial Sequence: Synthetic coding sequence
atgcgcggtatgaaattgctaggggccctgctggcgctagccgctctgctccagggagcagtcagcctgaagattgccgcttttaacattcaaacttttggtgagactaaaatgtccaacgctaccctcgtctcttatatagtccaaatcctctcccgctacgacatcgctctggtccaagaggtaagagatagccatctgacagccgtgggcaaactgctcgacaatctgaaccaggacgcaccagacacttaccactatgttgtgtccgagccactgggccgaaattcgtacaaggaaaggtacttgtttgtttatcggccagatcaagtgagtgccgtagatagctattactatgatgacggatgcgagccctgcggaaacgataccttcaacagggagcccgccattgtgaggttcttcagccgattcacagaggtgcgtgagtttgccatagttccattacatgcagctcccggcgacgctgtcgcagagatcgatgcgctgtacgatgtgtacttggatgtgcaggaaaagtggggcttggaggatgtgatgctgatgggtgacttcaacgcaggatgctcctacgtccgaccttcacagtggtcatccattcgcctgtggacttcgccgacctttcaatggctcatccccgatagcgcagatacaacagcaacccctactcactgcgcttatgatcgcatagtagtcgccgggatgctactgagaggagctgtcgttccagactctgccttgccattcaattttcaggccgcgtatggattgtctgatcagcttgctcaggcaattagcgatcattacccagttgaagtcatgctcaaa

SEQ ID NO: 10600 - DNA, 846 bp, Artificial Sequence
  Description of Artificial Sequence: Synthetic coding sequence
atgcgaggtatgaaactattaggtgcgttactagcgttagcggcgctattacaaggtgcggtatcgttaaaaatagcggcgtttaatatacaaacgtttggtgaaacgaaaatgtcgaatgcgacgttagtatcgtatatagttcaaatactatcgcgatatgatatagcgctagttcaagaagtacgagattcgcatctaacggcggtaggtaaattattagataatctaaatcaagatgcgccggatacgtatcattatgtagtatcggaaccgttaggtcgaaattcgtataaagaacgatatttatttgtatatcgtccggatcaagtatcggcggtagattcgtattattatgatgatggttgtgaaccgtgtggtaatgatacgtttaatcgagaaccggcgatagtacgttttttttcgcgttttacggaagttcgtgaatttgcgatagttccgttacatgcggcgccgggtgatgcggtagcggaaatagatgcgctatatgatgtttatttagatgtacaagaaaaatggggtttagaagatgttatgctaatgggtgattttaatgcgggttgttcgtatgtacgaccgtcgcaatggtcgtcgatacgactatggacgtcgccgacgtttcaatggttaataccggattcggcggatacgacggcgacgccgacgcattgtgcgtatgatcgaatagtagtagcgggtatgttattacgtggtgcggtagtaccggattcggcgctaccgtttaattttcaagcggcgtatggtttatcggatcaactagcgcaagcgatatcggatcattatccggttgaagtaatgctaaaa

SEQ ID NO: 10601 - DNA, 846 bp, Artificial Sequence
  Description of Artificial Sequence: Synthetic coding sequence
atgcgaggaatgaagctgcttggcgctctgctcgccctcgctgctctgctccagggtgccgtttctctaaaaatagccgcatttaatatccagacatttggcgagacaaagatgagtaatgcaaccctggtgtcttatattgttcagattttatctcggtatgacattgctctcgtacaggaggttagggactctcatctcactgctgtgggaaagttattggataacctgaatcaggatgcaccagatacatatcactatgtggtgtccgagcctctggggagaaattcctacaaggaaagatacctgtttgtctatcgcccagaccaggtgtccgccgtcgactcatattactacgacgacgggtgcgagccttgcggcaatgatacattcaatagggaacctgccatagtgcgtttcttctctcgctttaccgaggtccgagagtttgcaatcgtgccactccatgccgctcctggcgatgctgtcgctgaaatagacgccctgtacgatgtgtacttagacgtgcaggagaagtggggcctggaggacgtgatgctgatgggtgatttcaatgcaggctgtagttacgtgcgtcctagccagtggtcttcaattagactatggacctccccaacttttcagtggctgatccccgattctgcagacactaccgcaacaccaacccactgcgcctacgatcgcattgttgtggcaggaatgcttctgaggggcgctgtggttcccgattccgcattaccctttaacttccaggccgcttacgggttgtctgatcagctggcccaggccatctccgatcactaccctgtggaagtgatgctcaag

SEQ ID NO: 10602 - DNA, 846 bp, Artificial Sequence
  Description of Artificial Sequence: Synthetic coding sequence
atgcgtgggatgaagcttcttggggctctgctggctttggcagccctgctacaaggggcagtatctctcaagatcgcagcattcaacatccagacatttggagagactaaaatgtcaaacgcaaccttggtgagttacatcgtgcaaatcttgagccgctacgatatcgcgctcgtgcaggaagtaagggacagccaccttactgctgtcgggaaactgctggacaacctgaatcaggacgcccccgacacgtatcattatgttgttagcgagccccttggacgtaactcttacaaggaaaggtatttgttcgtatacaggcccgaccaggtgtccgcagtcgattcatattactacgacgacgggtgcgagccatgtggcaatgatacttttaatcgagagcctgctatcgtcaggttcttctcccgcttcacggaagttcgggaatttgccatcgtgcctctgcacgccgcacccggcgatgcggttgccgagattgatgccctgtacgatgtgtacttagacgtgcaggagaaatgggggctcgaagacgtcatgctgatgggagacttcaacgctggctgtagctatgtgaggccctcgcagtggtcttccatccggttatggacctcacccacattccaatggctcatccccgacagcgcggatacaaccgccacccctacccattgcgcttacgacaggattgtggttgcagggatgcttctcaggggcgccgtcgtgcctgattctgccctgcctttcaatttccaggcggcatatgggttgtccgaccagctggcgcaggccatttccgatcactaccctgtagaagtgatgttgaag

SEQ ID NO: 10603 - DNA, 846 bp, Artificial Sequence
  Description of Artificial Sequence: Synthetic coding sequence
atgcgaggcatgaaattgctgggagcgctgctcgccctggccgctctcctacaaggcgcagtgtcgctgaaaattgcggcattcaatattcagaccttcggcgagaccaagatgtcgaatgccaccctggtgagttatattgtgcaaatcctgagccggtacgatattgctctggtgcaggaggttcgggattcccatttaaccgccgtgggcaagctgttggataacctcaaccaagatgcccctgatacttatcattacgtggtttccgagcccctgggcagaaactcttataaggaacggtacctgtttgtgtatcgcccagaccaagtgtcagcagtcgactcctactactacgatgatggctgtgagccctgcgggaacgataccttcaaccgcgaaccagccatagtgcgcttcttttcacgattcaccgaggtaagggagttcgccattgtgccccttcatgccgcaccaggtgacgcggtcgccgagatagacgctctgtacgatgtctacctggatgtccaggagaaatggggactggaggatgtgatgctgatgggggatttcaacgccggctgttcatacgtcaggccgagccagtggtcctccatacgactctggacttcccctacatttcaatggctcatccctgacagcgcggacaccacggctacacccacccactgcgcatatgacagaattgtggtagccggcatgctcctccgcggcgcagttgtgccagacagcgccctaccattcaacttccaggcggcgtacgggctctctgaccagttggcacaggccatatccgatcattatcccgtggaggtgatgctgaag

SEQ ID NO: 10604 - DNA, 846 bp, Artificial Sequence
  Description of Artificial Sequence: Synthetic coding sequence
atgagaggtatgaaactgctgggcgccctgctggccttggcagccctgttgcagggtgccgtcagcctcaagattgcggccttcaacatccaaaccttcggtgaaactaagatgtccaatgccactctggtgtcctacatcgttcagattctgagtaggtatgatattgcccttgtccaagaggtccgggatagtcacctgacggctgtcggcaaactgttggacaacttgaatcaggatgcaccggatacttaccactacgtggtttctgagcctctcggaaggaactcctataaggagagatacctgttcgtctaccggcccgatcaggtgagcgccgtggacagttactattatgacgacgggtgcgaaccctgcggcaacgatacttttaatcgggagcctgccattgtacgatttttttcacggtttaccgaggtgcgggaattcgccatcgttcccctccacgcagcccccggggacgcagtcgccgaaatcgatgccttgtacgacgtgtatctggacgtgcaggagaagtggggcctcgaggatgtcatgctgatgggagatttcaacgcagggtgcagctacgtccgcccaagccagtggtcatcaattagactgtggaccagtccaaccttccaatggctgattcccgactcagcggataccactgccactccaacacattgcgcctacgacaggattgttgtagcggggatgttgctgcggggggctgtggtgcccgattctgccctgccctttaacttccaggccgcctacgggttgagtgaccaactcgcacaggctatttccgatcattatcccgtggaagtaatgttgaaa

SEQ ID NO: 10605 - DNA, 846 bp, Artificial Sequence
  Description of Artificial Sequence: Synthetic coding sequence
atgagaggcatgaagctcctgggtgctcttctggcactcgcggcactgcttcagggagctgtctcgctcaagattgcggctttcaatatccaaacctttggagagactaaaatgtccaacgctaccctggtgtcgtacatagttcaaatactttcgagatatgacattgcattggttcaggaggtcagagattctcaccttactgccgttggaaagctgttggacaatctgaatcaagacgctccagacacttatcattacgtcgtctccgaacctctgggtcgcaatagctacaaagagcgatacttgtttgtgtaccggcctgatcaggtgtcagcagtggactcgtactactacgatgatggctgcgaaccgtgtggaaacgataccttcaacagggaacctgcaatcgttcgctttttcagcaggttcaccgaggtcagggaatttgctatcgtgccattgcacgcagccccaggagatgccgtcgctgaaatcgatgcactttacgatgtgtaccttgatgtgcaagaaaagtgggggcttgaagatgtgatgctgatgggggactttaacgcaggttgttcatacgtgcgaccgtcacagtggtcgagcatccgcttgtggaccagccctacttttcagtggcttattcctgattcggcagatactacggcgaccccaactcattgcgcctacgatagaattgtggtcgcaggtatgcttcttcgcggcgcagtggtgcctgactcggcactgcccttcaacttccaagcagcatacggtcttagcgatcagctcgcacaagcaatttcggatcattaccccgtggaggtgatgcttaag

SEQ ID NO: 10606 - DNA, 846 bp, Artificial Sequence
  Description of Artificial Sequence: Synthetic coding sequence
atgcgaggaatgaagctcctgggcgcacttctggcgctcgcggcacttctgcaaggagcagtgtctttgaaaattgctgccttcaatatacagacctttggggaaactaagatgtcgaatgctacccttgtctcatatatcgttcaaatcctcagtagatacgatatcgcgctcgtgcaggaagtgcgcgactcacaccttaccgccgtgggaaagctgctcgacaacctcaaccaggacgcaccggatacctaccattatgtggtgagcgaaccacttgggaggaattcctacaaggaaagatacctttttgtgtacagaccagatcaggtgtcggccgtggattcgtactactacgacgatggttgcgaaccctgtggaaacgatacgtttaacagagaacctgcaattgtgcggtttttctcgcgttttaccgaggtgcgggagtttgccattgtgccacttcacgcagcgcctggagatgccgtggcagaaatcgatgccctttacgatgtgtacctcgacgtccaggaaaagtgggggctggaagatgtgatgcttatgggcgacttcaacgccgggtgttcttacgtcagaccttcccagtggagctccatcagactttggacttcaccaacgttccagtggctgatcccagattcagcagatactactgcaactcctacccattgcgcgtacgatcgtatagtggtggccgggatgttgcttaggggagcagtggtcccagactcggctctgccatttaactttcaggcagcatacgggttgtccgatcagctggctcaagccatttcggatcattacccggtggaagtgatgctgaag

SEQ ID NO: 10607 - DNA, 846 bp, Artificial Sequence
  Description of Artificial Sequence: Synthetic coding sequence
atgcgcggtatgaaactgctgggggcactgctcgcactcgctgccctgctgcagggtgccgtgagcctgaagatcgccgctttcaacatccagactttcggcgaaactaagatgtcgaacgcaaccttggtcagttacattgtgcaaatcctctcgcggtacgatatcgcactggtgcaggaagtgcgggactcacatctcacggccgtgggaaagctcttggacaatctcaaccaggacgcccccgacacttaccattacgtggtgtccgaaccgctcggaaggaattcgtacaaagaacggtacctgttcgtgtatcgcccagaccaggtgtcagcggtggattcctactattacgacgacggatgcgaaccatgcggaaacgatactttcaatcgggagccagccatcgtgcgcttcttctccagattcactgaggtgagggaattcgccatcgtgccactgcatgccgcaccaggagacgcggtggctgaaattgacgctctgtacgacgtgtacctcgacgtgcaagagaagtggggacttgaggatgtgatgttgatgggcgacttcaatgccggttgcagctacgtgcggccgtcgcagtggtcgtccatccgcctgtggactagcccgaccttccagtggctgattccggacagcgccgacaccaccgctaccccgacccactgcgcatacgacagaatcgtggtggccgggatgcttcttaggggcgcggtggtgcccgactcggccctgccattcaacttccaagcggcctacggattgtcggatcaactggcgcaggcgatctcagaccactacccggtggaggttatgctcaag

SEQ ID NO: 10608 - DNA, 846 bp, Artificial Sequence
  Description of Artificial Sequence: Synthetic coding sequence
atgagaggaatgaagctccttggcgccctccttgccctcgctgctcttctgcagggagccgtaagcctgaagatcgccgccttcaatatccaaacattcggtgagaccaagatgtccaacgctacattggtttcatacattgtacagatcctgtcaaggtacgacatcgccttggtgcaggaagtgcgtgacagtcaccttacagcagttggaaaactcttggataatctgaaccaggacgcccctgacacatatcactatgtggtctccgaaccacttggtcgtaattcatacaaggagaggtatctgttcgtctacagaccagatcaagtatcagcagttgattcttactattacgatgacggctgtgaaccttgcggtaacgatacctttaaccgcgagcctgctattgtgaggttcttctccagattcactgaagtccgtgaattcgcaatcgtccccctccatgccgccccaggcgatgccgtagcagagattgatgccctttatgatgtttacctcgatgttcaggaaaaatggggtctcgaggacgtcatgcttatgggtgacttcaacgctggctgttcttacgtccgcccaagccaatggtcttctatccgtctgtggacttctcccacttttcagtggctgatacctgacagcgctgataccaccgctaccccaacccactgcgcatatgacagaattgtagtagccggcatgctgctgcgtggtgctgtagtcccagactcagcactccccttcaattttcaggcagcttacggactgtcagaccagctggcccaggctatctccgatcactacccagtcgaagtaatgcttaag

SEQ ID NO: 10609 - DNA, 846 bp, Artificial Sequence
  Description of Artificial Sequence: Synthetic coding sequence
atgaggggaatgaagctgcttggtgcgctcctggcactggcagccctcctgcaaggagccgtgtccctgaaaattgcggcctttaacatccaaacctttggtgaaactaagatgagcaacgccacgctcgtgtcgtacatcgtccagattctttcccgctatgacatcgccctcgtgcaggaagtgagagattcgcatctgaccgctgtcggaaaactgctggacaatcttaaccaggatgcgccggacacttaccattacgttgtgtcagagcctctgggccgcaactcgtacaaggaacgatacttgtttgtttatagaccggatcaagtcagcgcagtggactcctactactacgacgacggatgcgaaccttgtggaaatgataccttcaatagggagcctgcgatcgtccggttcttctcacgcttcactgaggtgcgggaattcgcaatcgtgcccctccacgcagctccaggcgacgcagtggctgaaatcgacgcgctgtacgacgtgtacctggatgtccaggagaagtggggactggaggacgtgatgctgatgggggatttcaacgctgggtgcagctacgtccggccatcccagtggagttcaattcgcctctggacctcgccgactttccagtggttgatcccggacagcgccgacactaccgcgacgcccacccactgcgcctacgatagaatcgtggtggccggcatgttgctgcggggcgccgtggtgccggattctgccctcccattcaacttccaggctgcgtacggattgtcggatcagctggcccaagccatctccgaccactacccggtggaagtcatgctcaag

SEQ ID NO: 10610 - DNA, 846 bp, Artificial Sequence
  Description of Artificial Sequence: Synthetic coding sequence
atgcgagggatgaagctcctcggggccttgctggccctggccgccctcctgcagggcgcggtgagcctcaaaatcgccgcattcaacattcagaccttcggagaaactaagatgtcgaacgcgaccctcgtgtcatacatcgtgcagatactgtcacggtacgatatcgccctggtccaggaggtgagagattctcatctgaccgccgtgggcaagttgcttgataacctgaatcaggacgccccagatacctaccactacgtagtctcagagcccctgggaagaaacagctacaaagaacgctacttgttcgtgtacagacctgaccaagtgtccgcagttgattcatattactacgacgatggatgtgaaccttgcggtaatgacacgttcaatcgagaaccggcaatcgttcggttcttcagccgctttactgaggtgcgggagtttgctatcgtcccgcttcacgcagctccaggagacgcggtggcagaaatcgacgcgctgtatgacgtctatctggacgtgcaggaaaagtggggactggaggacgtcatgttgatgggtgacttcaacgctggatgcagttacgtccgcccctcccaatggtccagcatccgcttgtggacgtcaccaactttccaatggctgattccggattcggctgacactacggccacccctacccactgcgcttacgacaggattgtagttgcggggatgctcttgaggggcgccgtggtgccagattccgcgttgccgtttaactttcaagcggcttacggactttcggatcaactggcgcaagcgatcagcgatcattacccggtcgaggtgatgcttaag

SEQ ID NO: 10611 - DNA, 846 bp, Artificial Sequence
  Description of Artificial Sequence: Synthetic coding sequence
atgcgggggatgaaactgctgggagcgcttttggcactggccgccctccttcaaggagccgtctcactcaagatcgccgccttcaacattcaaacgttcggagagacgaagatgtccaacgcgactctggtcagctacattgtgcaaattcttagcagatacgatatcgcgctcgtgcaggaagtcagggactcacacctgactgctgtgggaaaacttctcgataatcttaaccaagacgccccagatacctaccactacgtggtgtcggaaccgctcgggagaaacagctacaaggaacggtacctcttcgtgtaccggccggatcaggtcagcgcggtggactcgtactactacgacgatggctgcgagccatgtggaaatgacacctttaaccgggagccggctatcgtgcgattcttctccagatttacggaggtccgcgaattcgctatcgttcccctgcacgccgccccgggtgacgcggtggccgagatcgacgccctgtacgatgtgtatctcgatgtccaggaaaagtggggacttgaggacgtgatgctcatgggtgacttcaatgcgggctgctcatatgtgcggccctcgcagtggtcctcgatccgactctggactagcccgaccttccagtggcttatcccggactccgcggacactaccgccacccctactcattgcgcatatgatcgcatcgttgtggccggaatgttgctgcgcggcgcagtggtgccggactcagctctgcccttcaatttccaagcggcgtatgggttgtcggatcagctggcccaggcaatcagcgatcattacccggtggaagtgatgctgaag

SEQ ID NO: 10612 - DNA, 846 bp, Artificial Sequence
  Description of Artificial Sequence: Synthetic coding sequence
atgcgagggatgaagctgttaggcgcactgttagctctggccgcattgttgcaaggcgcggtgagcctgaagattgccgccttcaatatacaaacctttggagagaccaaaatgagcaatgctacactcgtctcctacatagtccagattctgagcagatatgacatagccctagtccaggaggtgcgggactcccatctcaccgctgtggggaaattactggataacctgaatcaagatgcacccgacacctaccactatgtggtctcagaaccattgggtcgcaactcatacaaggaaaggtatctatttgtctacaggccagaccaggtgtcagcagtagattcctattactatgacgatgggtgtgaaccatgtgggaatgatacctttaatcgcgaacctgccatcgtgcgtttcttctcacggttcacggaagtgcgagaatttgccatcgtaccactccatgcagctccaggggacgcagtggccgagatcgacgccttgtacgacgtgtacctggacgtacaggaaaagtggggacttgaggacgtgatgttgatgggcgactttaacgcaggatgctcgtatgtccgaccctcacagtggtcttccattcgtctgtggacgtcaccaactttccaatggctgatcccagatagcgctgataccacagccacccctactcactgcgcctatgatcggatagtcgtagctgggatgctactgagaggagctgtcgtccccgatagcgcccttccatttaatttccaggccgcctatggtctcagcgaccagttggcccaggctatatctgatcactatcctgttgaagtcatgttaaag

SEQ ID NO: 10613 - DNA, 846 bp, Artificial Sequence
  Description of Artificial Sequence: Synthetic coding sequence
atgcgggggatgaagctcttgggagctctgctggcacttgccgcactactgcagggggctgtgagcttgaagatcgctgcctttaatatccagacatttggcgaaacaaaaatgagtaatgccactctggtttcatatatagtccagattctcagtcggtacgatatcgctctggttcaggaagtgagagatagccacctaaccgctgtcggcaagctgctagacaaccttaaccaggacgctccggacacatatcactacgtcgtgagcgaacctctgggaagaaactcctataaagaacggtatctattcgtatatcgccccgaccaggtgtcagccgtagatagttattactatgatgacggctgcgaaccatgtggaaacgacactttcaaccgcgaacctgcaatcgtgcgctttttttcccgattcacagaggtccgagaattcgccatcgtgccgctccacgccgccccgggtgatgcagtagccgagatcgacgctttatatgacgtttacctggatgtgcaagagaaatggggactcgaagatgtcatgcttatgggcgactttaacgcagggtgttcctacgtgcgtccgagtcaatggtctagtatcagactctggacctcacctacatttcagtggcttatccctgatagcgcggacactacagccactcccacccactgcgcgtacgatcgcatagtcgtcgctggcatgctgctccgtggcgccgtggtgcctgacagcgccctgcccttcaatttccaagctgcttatggcctcagcgaccagttggcacaggccattagtgaccactaccccgtggaggtcatgctcaag

SEQ ID NO: 10614 - DNA, 846 bp, Artificial Sequence
  Description of Artificial Sequence: Synthetic coding sequence
atgcggggaatgaagcttctcggagccttattggcgctagcagctctattacaaggagctgttagcctgaagatcgctgccttcaatatacaaacgttcggagagaccaaaatgtcgaacgcaacattagtatcttatatcgttcagattcttagtcggtacgatatcgccctagttcaggaggtaagagattcacatcttaccgcggtggggaagctcctggataacctaaatcaggatgcacctgacacctatcattacgtcgtctcggaaccactgggcaggaattcttataaagagcgttacttgttcgtttacagaccagatcaggtcagcgcagtcgactcctattactatgatgacgggtgtgaaccgtgcggcaatgataccttcaaccgcgaacctgcgatagtccgattcttcagccgttttaccgaagtacgcgagttcgcgattgtgccgttgcacgcggccccgggtgatgcagttgcggagattgacgcattgtatgacgtatacctagacgtgcaagagaagtggggattagaggacgttatgttgatgggcgactttaacgctggatgttcatacgtacgcccctcccagtggtcctctatccgcttgtggactagtcccacgtttcaatggctgatccccgactccgcagacacgacggcgacgccaacacattgcgcatacgatagaatcgtcgtcgccggaatgctcctccgaggtgctgttgtcccagactcagccctgccattcaactttcaggccgcatacggactgtctgaccaactggcgcaggcaatttccgatcattatccagtcgaagttatgctgaaa

SEQ ID NO: 10615 - DNA, 846 bp, Artificial Sequence
  Description of Artificial Sequence: Synthetic coding sequence
atgcggggaatgaaactcttgggagcgttgctcgccctggccgcgctgctgcagggggccgttagtttgaagatcgccgcatttaatatccaaacctttggcgaaaccaaaatgagcaacgccacattagtctcctacatcgtccagattctgtctagatacgatattgccctcgtgcaggaggttcgcgactcgcaccttactgccgtgggcaaactcctcgacaaccttaaccaggacgcaccagacacttaccactatgttgtgagtgagcccctgggtcgaaacagctacaaggaacggtatttgtttgtgtacaggcccgatcaggtgtctgcggtggactcctattactacgatgatggctgtgaaccctgtggcaacgacacctttaacagagagcctgctatcgtgcgcttcttctctcggtttaccgaagttagagagttcgcaatagtccctctccacgccgcccctggggacgctgttgccgagatcgatgccctctatgacgtttatttagatgtgcaggaaaagtggggtctggaggacgtcatgctgatgggtgacttcaatgcgggatgttcttatgtccgtccttcccaatggtcatcaatacgcctctggacctcccctacttttcaatggttgataccagattctgcagataccacggcaacccctacccactgtgcctacgaccgcatcgttgtagccgggatgctgctgagaggcgccgtagttcctgattctgcacttcctttcaactttcaggctgcctatgggttgtcagaccagcttgcacaggccataagtgatcactacccggtggaggttatgttaaag

SEQ ID NO: 10616 - DNA, 846 bp, Artificial Sequence
  Description of Artificial Sequence: Synthetic coding sequence
atgaggggaatgaaactgctgggggccctcttagcacttgccgccctgttgcagggcgcggtaagtctaaagattgctgctttcaacatccagaccttcggggagacgaagatgtcaaacgctactttggtgtcctacattgtgcaaattttgagcaggtacgacattgccctggttcaggaggtgagagatagtcaccttacggccgttggcaaactgctcgataacctgaaccaggatgccccggatacctaccactacgtcgtgtcagagcccctgggtaggaatagttataaggagagatacttgttcgtctataggccagaccaagtgtctgccgtcgactcatactattacgacgatgggtgcgaaccttgcggcaatgatacgttcaatcgggaaccagccatagtgaggttcttttcaaggtttactgaggtccgggagtttgcaatcgtgcccctgcacgcagctccaggtgacgcagtagcagagatcgatgccctgtacgatgtatatctggacgttcaagagaagtggggcctagaagacgttatgctcatgggggattttaacgctggctgcagttacgtgcggccatcgcaatggtcttccattcgcttatggaccagcccaaccttccaatggttgatcccggatagtgccgacacaaccgccactcctactcattgcgcgtatgataggatcgttgtggctggcatgctgctccggggtgccgttgtgcctgactcagcacttccatttaactttcaggcagcgtatggcttaagtgaccaattagcgcaggccatctcggatcactatccagtggaggtgatgctgaag

SEQ ID NO: 10617 - DNA, 6243 bp, Artificial Sequence
  Description of Artificial Sequence: Synthetic coding sequence
atgctctgttgtttgctggtcagagcctccaacctgccttccgcaaagaaagaccgcaggagcgatccggttgctagtctgacgtttcggggcgtgaaaaagaggacaaaagtgattaaaaatagcgtgaaccccgtttggaacgagggtttcgagtgggacctcaaagggattcccctcgaccagggcagcgaacttcatgttgtagttaaagaccatgagacaatggggcgaaaccggttccttggcgaggctaaagtacccctgagggaagtcctggcaacaccatccctttccgccagtttcaacgccccgcttctggacacgaagaaacagcctactggcgcttctttggtgctacaagtgagctatacccccttgccaggagccgtacccctgttccccccccctacgccactggagccatctcctacactacccgatcttgacgtggtggcggatacaggaggcgaggaggataccgaagaccaggggttgacgggtgatgaggcagaacccttcctcgaccagtccggcggccccggcgcccccaccacccctcggaagctacctagccggccacctccgcactaccctggcataaagcgcaagcggtcggcacccacttctcgaaaactcctgtccgacaaaccgcaagacttccagatccgggttcaagtgattgaaggccgccagcttcctggcgtcaatattaagcctgtcgtgaaagtcaccgccgctggccaaaccaaaagaacaagaatccacaaaggcaattcacccttgttcaacgaaacgctattcttcaacctgttcgactcaccaggcgagctcttcgatgaaccaatctttatcacagtagtggattcgcggtcactccggactgatgccctgctgggagaatttcggatggatgtcgggaccatctatagagaaccgcgccacgcttaccttcggaagtggctactcctgtctgatcccgacgatttttcagccggcgcaagagggtacttaaaaaccagtctgtgcgtactagggcctggcgatgaagcccccctggagagaaaggacccgagtgaggataaagaggatatcgaaagcaacctactgcgtcccaccggcgtggctctccggggagcacatttctgtctgaaagtctttcgtgcggaggatctcccccagatggatgacgctgtgatggataacgtcaaacagatcttcggctttgaaagcaataaaaagaacttagtggatccctttgtagaggtgtcgttcgctgggaaaatgctgtgttctaagattctggaaaaaactgccaatccacagtggaatcagaacataaccctgccagctatgtttccgtctatgtgcgaaaagatgcggatccgaattatcgattgggacagactcacacataacgacattgtcgctacgacttatcttagtatgtccaagatctcagcgcctggaggggaaattgaggaggagcccgctggcgccgtgaagccatccaaagcgagcgacctcgacgactacctcggttttctccctaccttcggaccctgctatattaatttgtacggaagtccccgcgagttcaccggatttcctgacccttatacagaactgaacacaggtaagggcgagggagtggcctataggggccggcttttactgagtttggaaactaaactggttgaacactcggaacagaaggtagaggatcttcctgccgatgacatcctgagagtggaaaagtacctgcgcaggaggaagtatagtttatttgccgccttttattcagcaacaatgctgcaggacgtagacgatgccattcagtttgaggtatccatcggcaactatgggaacaaattcgacatgacgtgccttccactggcgagtaccacacaatatagtagggctgtcttcgacggctgtcactactactatctcccatggggtaacgtgaaacctgtggtcgtgctgtcatcttattgggaggatatctcacaccgtatagagacccaaaaccagctactgggaatagcagataggttggaagcaggcctcgagcaggtgcatcttgccttaaaggcacagtgttccactgaggacgtggatagtctggtagcacagctcacggacgaacttatcgcagggtgctctcagcccctgggggacatccacgagaccccatccgcaacacatcttgatcagtatctttatcaactgagaacccatcacctatcccagattacagaggccgctctggcgctcaaactgggtcatagcgagttgccagccgcccttgaacaggcagaagactggctgctcaggttgagagccctggccgaggaaccccaaaattccctcccggatatagtgatctggatgctccaaggggataaacgggtggcttatcagcgagtccctgctcaccaggtgcttttctctaggaggggagctaactactgcggtaagaattgcggcaaattgcagacgatatttttgaaataccctatggaaaaagtaccaggagcgcgcatgccagtccaaataagggtgaagctgtggtttggactcagtgtggacgaaaaggagtttaaccagttcgcagaggggaagttgagtgtgtttgccgaaacctacgagaatgaaaccaagttggctctagtgggaaattggggtaccactgggctaacttatccaaagttttctgacgtgaccggcaagatcaaactgcccaaagactctttccgcccaagtgctggttggacatgggcgggcgactggttcgtttgcccagagaagacattgttgcacgatatggatgcgggacacttgtcattcgttgaggaggtgttcgagaaccagacacgcctcccagggggtcagtggatttatatgagcgataattacacggatgttaatggagagaaagtgctccctaaggatgatatcgagtgtccgctcggttggaagtgggaagacgaggagtggtcaactgatctcaatagagctgtggacgagcagggatgggagtatagcataacaatccccccagagagaaaaccgaaacactgggtccccgctgagaaaatgtattacacccaccgccgaaggaggtgggttagactgcgacgacgtgacctctctcaaatggaggcgctgaaaaggcaccgacaggcagaggccgagggtgagggatgggaatatgccagtttattcggctggaaattccacctggagtacaggaaaacggatgcattccgacgtcgacgctggaggcgccggatggagccactggagaagacgggacccgcagcggtctttgcgcttgagggggctctcggaggggttatggatgataagtcagaggacagcatgtccgtctcgacactctcctttggagtgaacaggccaaccatcagctgcatttttgattatggcaaccgatatcatttgcggtgctatatgtatcaagctagagacctggccgccatggacaaagacagcttctccgacccttatgccattgtgagtttcctgcatcagtcacagaagactgtggttgtcaaaaatacactgaacccgacgtgggaccaaacgttaattttctacgagatcgaaattttcggcgagcctgcgacagtggctgaacagcctccatctatagtagttgagctgtacgaccacgatacatatggagccgatgaattcatggggcgttgtatatgccaacctagccttgagcgcatgcctcggctggcctggttccccctgacccgagggagccagcccagcggggagctcctggcttcattcgagctgattcaaagagagaagccagcaatccaccacataccgggtttcgaagtccaggaaacttccaggatcctggacgaatcggaagacacagatctgccatatcctccaccacagcgagaggccaatatttatatggtaccccaaaacattaagcccgcgttgcaacggaccgcgatagagatccttgcttgggggttgaggaacatgaagtcctatcagctcgcaaatatatcatcaccttctctggtcgtggagtgcggaggtcaaaccgtacagagttgcgtcattcggaatctgagaaaaaatcctaactttgatatctgcacgttgtttatggaagtgatgttaccacgcgaggaactgtattgtcccccaattaccgtgaaggtgatagataaccggcagttcggtcgacgtccagtggtgggacaatgcacaattcgctcgctcgagagcttcttgtgtgatccttacagtgcagagagcccctctccccagggcggacctgatgacgtctctctactgtctccaggggaagatgtgctgatagatattgatgacaaggagcctctgatccccatccaggaggaggagtttattgattggtggtcaaagttcttcgcttctatcggcgagagggaaaagtgcggctcttaccttgaaaaggactttgacacacttaaagtatatgacacccaactagagaacgtggaggctttcgaggggctgagtgatttctgcaacaccttcaagctatacagaggtaaaacccaggaggagaccgaggatcctagcgtgattggtgagtttaaaggtcttttcaagatctatccactccccgaagatcccgctatcccgatgccaccccgacaattccaccagctggccgcccagggtccgcaggagtgcctggtcagaatctatattgtgagagctttcggcctccagcccaaagatcctaacggcaagtgcgacccgtatatcaaaatcagtatagggaaaaagtcggtttcggaccaggacaattacattccttgtactctcgaacctgttttcggtaagatgtttgagttaacatgcacactccctctggagaaagacttgaaaattactttatatgattatgacctgcttagtaaagacgagaagattggagagacagttgtggacctggagaatcgactcctcagcaagttcggagctaggtgtgggctgccccaaacctactgtgtgtccgggcccaaccagtggagggatcagctgcgacccagccaactgcttcacctgttttgtcagcaacacagagtgaaagctcctgtctaccggacggacagagtgatgttccaggacaaggagtatagtattgaggagatcgaagccggccgtatcccaaatcctcatcttggaccagttgaagagcggttggccctacacgtgttgcagcagcagggtttagtgcccgaacatgtcgaatccagacccctatacagtccactgcagccagacatcgagcaggggaagctgcagatgtgggtagatctctttccaaaggctctggggcgccccggtccaccgtttaacatcactccaaggcgcgcccgccggttcttcctacgctgtatcatctggaacacccgagatgttattctcgacgatcttagcctgacaggtgagaaaatgagtgacatctacgtgaagggatggatgattggctttgaggaacataaacagaagacagacgtgcactataggtctttggggggtgagggcaattttaactggcgattcatatttcccttcgattatttgcctgcagaacaggtttgcactattgcgaaaaaggatgcattttggaggttagacaaaacggagagcaaaattcccgccagagtagtgttccagatctgggacaatgataagttctcattcgacgatttcttggggtcccttcagcttgatttaaacagaatgcctaaacctgcaaagaccgcaaaaaagtgctccctagaccaactggatgatgcttttcacccagagtggtttgtgagcctgtttgaacagaagaccgtcaaagggtggtggccctgtgtagcagaagaaggcgagaagaagatcttagcaggcaagttagagatgacattagagatcgtcgccgagtctgagcacgaggagcgcccagccggccagggaagggatgaacccaatatgaacccaaagctggaggacccccggaggccagatacatcctttctctggttcacaagcccttacaagaccatgaaatttatactttggaggcgctttcggtgggcaataatcttattcattatcctgttcatactgctactgttcctggccatttttatctacgcctttccgaactacgcagctatgaagctggtgaagccgttctcc

SEQ ID NO: 10618 - DNA, 6243 bp, Artificial Sequence
  Description of Artificial Sequence: Synthetic coding sequence
atgctgtgctgtcttcttgtgagagccagtaacctacctagtgccaagaaggatcggcgatcagatccggtggcttctctgaccttccgtggtgtcaagaagcgaaccaaggtgatcaagaattctgtcaaccccgtgtggaatgaggggtttgaatgggaccttaaaggcattccgttagaccaggggtctgagctacacgtggtggtgaaggaccacgagaccatgggccgcaaccgatttctgggtgaggccaaagttcctttgagggaggtgctggctactccctccctttctgccagcttcaacgcccccctgctggacactaagaagcagcctaccggggctagcctcgtcctgcaggtctcctatacccctctcccaggagcagtgccattatttcccccacccaccccccttgagccctctccaacgttgcctgacctggacgtcgtggctgacacgggcggggaggaggatacagaggatcagggtcttacaggggacgaagccgagccattcctggaccagtccgggggccccggggctcctaccactcctaggaagcttccgtccaggcccccgccccattaccctgggattaagaggaaaagaagtgcccccacgtctaggaagttgctttccgataagccgcaggatttccagattcgagttcaggtcatcgaagggcggcagttacccggcgtgaatatcaaacctgtggtgaaggtaactgccgccgggcagacaaagcgtaccaggattcacaaaggaaattcccccttgtttaacgagacactctttttcaatttgttcgactcaccaggggagctgtttgacgagccgatctttattaccgtcgtcgactcccggtctcttagaactgatgccctgctcggagagttccgcatggatgtgggcacgatctaccgggagccaagacacgcttacttgcgcaagtggctcttgctgtctgatcctgacgacttctccgcaggggcccgaggttacctaaagaccagcctgtgtgtgttggggcccggcgatgaggccccccttgagcgcaaggatcctagcgaggataaggaagacatagaatcaaatctgctacggccaaccggtgtggccctgcgaggggcccatttctgcttaaaggtcttccgggccgaagatctgccgcagatggatgatgcagttatggataatgtcaagcaaatcttcggtttcgagagtaacaaaaaaaacttggtcgacccatttgtcgaggtatcttttgctggaaaaatgttgtgttccaaaatattggagaaaaccgccaatccacagtggaaccagaacattacattgcctgcgatgttcccctccatgtgcgagaaaatgcgcattaggatcatcgattgggacaggctgactcataacgatatcgtggccaccacctatctgtccatgtctaagatctcagcgcccggaggcgagatcgaggaggagccagccggggccgtgaagccttccaaggcctctgacctcgacgattacctgggctttctgccgacatttggtccctgttatataaacctttatggaagccctagagaatttacaggattccccgacccctacaccgaattgaacacagggaagggggagggagtcgcctaccggggtcggctcttgctctcactggagactaagcttgtggaacacagcgaacagaaagtggaggatctgccagccgatgacatattacgcgttgagaagtatctccgccggagaaaatactccttgtttgccgcattttactctgccactatgcttcaggatgtggacgacgcaattcagttcgaagtctcgatcggaaactacggcaataagtttgacatgacatgcctgcccctcgcgtccaccacacagtattcgagggcagtattcgatggttgtcactattactacttgccttgggggaatgtcaagcctgtggtcgtcctttcctcgtattgggaggacatctctcatcgcatagagacacagaaccagctgctggggatagctgatcgactggaggcgggtctcgaacaggtccacctggcccttaaagcccagtgcagcactgaggatgtcgatagtctggtcgcccagctgacggatgagcttatcgccgggtgctctcaacccctgggggacatacacgagactcctagtgcaacgcatctcgatcaatacctgtatcagctgcggacacaccatctatcccagataacagaggcggcattggcccttaagctagggcacagcgagctgcctgctgcactcgaacaggccgaagattggctgttgaggctgcgggctctagccgaggagcctcagaattctctccccgacatcgttatctggatgcttcaaggagataagcgcgtggcctaccagcgcgttcctgcacaccaggttctgttttcacgccggggtgcgaattactgcgggaagaactgtgggaagctgcagacaatttttctgaagtaccctatggagaaggtgcctggggctcgaatgcctgtgcagatccgagtgaaactctggttcggtctgagcgtggacgagaaggaatttaatcagtttgctgaaggcaagttatcagtgttcgccgagacctatgaaaacgagacaaagctggcgctcgtaggcaactggggcaccacagggctcacttaccctaaattctcagacgttacagggaagatcaagctgccgaaggattccttcaggccttcggctggctggacctgggccggggactggttcgtctgtcctgagaagactctactgcacgacatggacgcagggcatctgagtttcgtggaggaagtctttgaaaaccagacacgcctgcccgggggacagtggatttatatgtccgacaactacacagacgttaacggagagaaggttctgcctaaggatgatatcgagtgccccctgggctggaagtgggaggatgaggagtggtccactgacttgaatcgcgcagtagatgagcaggggtgggagtactctatcactattcctcccgagcgcaagccaaagcattgggttcctgcagagaaaatgtattacactcataggagacgtagatgggttaggttacgtagaagggatctgtcccagatggaagccttgaaacggcatcgacaggccgaagctgagggggagggctgggagtatgccagtctgttcggctggaagttccacctcgagtatcgcaagaccgatgcattcaggcggagaaggtggagaagaaggatggagccattggagaagacaggacccgccgcggttttcgcactggagggcgcactggggggggtgatggatgataagagcgaggacagtatgtccgtgtcaacgctgtctttcggggttaatagaccaaccattagctgtattttcgactacggaaaccggtatcatctgcggtgctacatgtaccaggcaagagacctggcagctatggacaaggactcattctctgacccatatgccattgtttcattcctccaccagagccagaaaactgtggtcgtaaaaaacacactgaaccctacctgggaccagaccttgatcttctatgagattgagattttcggagaacccgcaactgtggctgagcagcctccttcaatcgttgtcgaattgtacgaccacgatacatatggtgcagatgagttcatgggaaggtgtatttgtcaaccatctttagagcgcatgccccgactagcctggttccctctgactaggggctctcagccctccggtgagcttctggccagcttcgaactgatacaacgcgaaaaacctgccattcatcatatccccggattcgaggtccaggaaacctcgaggatcttggatgagtctgaggacactgacctgccctacccacccccacagcgcgaggcgaacatctacatggtgcctcaaaacattaagcctgcccttcagaggaccgccattgaaattctcgcctggggccttaggaatatgaagagctatcagttggccaatatttcttctccgtccctggttgtagagtgcgggggccagactgtgcaatcttgcgttattcggaacctcaggaagaaccctaatttcgacatttgcactctgttcatggaagtgatgttacctcgtgaggaattgtattgcccccctatcaccgtgaaggtgatcgacaacagacagtttggcagacggcctgtcgtgggacagtgtactatccgctccctggagtcattcctgtgtgacccctatagcgcggagtcccccagcccccagggcggtccagacgacgtgtccttgctgagccccggcgaggacgtactgatcgacatcgacgacaaggagccactcattccaattcaggaggaggagttcattgactggtggtctaaatttttcgcgtccataggggaacgtgagaagtgcgggagttaccttgagaaggacttcgacactctcaaggtgtacgacacacagctcgaaaatgtggaagcttttgagggcctttccgacttctgtaatacttttaagctgtacaggggcaaaacacaagaagagacagaggacccttcggtgatcggcgaattcaagggcctttttaagatatacccgctgcccgaagaccctgcaatccccatgcctcccaggcaatttcaccagttggccgcacagggcccacaggagtgtctcgtgcggatttatattgtgagagcgtttgggctccagccaaaagatccaaatggtaagtgtgatccgtatatcaaaatctctattggcaaaaagagtgtgtctgatcaagacaattatatcccgtgtacactggagccggtgttcggcaagatgtttgaactgacctgtacactgccactggaaaaggatctcaaaattaccctctatgactacgatctgttatcgaaggacgaaaaaattggggagaccgtcgtggatctggagaaccgattactcagcaagtttggggctcgatgcggcctcccgcagacgtactgtgtgtcaggtcctaatcagtggcgcgaccagctgcgcccttcccaactgctgcacttattttgccagcagcacagggtgaaagcccctgtttatcggacggatcgcgtcatgttccaggataaggaatacagtatcgaggagatcgaagctggtaggattcccaacccccacttggggcccgtggaagagcggctggccctgcacgtcctgcagcagcagggtctcgttccagaacatgtggaatcgagaccactctactcccctctgcagccggatattgagcagggcaagttgcagatgtgggtggatctgttccctaaggccctcggtaggccaggaccccctttcaatataaccccaaggagagcaaggagattctttctgaggtgcataatctggaacaccagagatgttattttggatgatttgtctctcacgggggaaaaaatgtccgacatttacgtcaagggctggatgattggtttcgaagagcataagcagaaaactgatgtgcactataggagccttggtggcgagggaaacttcaattggcgcttcatcttccccttcgactatctcccagctgagcaggtgtgcactatagcaaaaaaggacgcgttttggaggctggacaagaccgaaagtaaaatcccagccagagtggtgtttcagatctgggacaatgataagttttcttttgacgacttcctgggcagtcttcaactagacctcaaccggatgcctaaacctgccaagaccgcaaagaaatgttccctcgaccagctggacgacgcttttcatcctgagtggttcgtgtccctgttcgagcagaaaactgtgaaagggtggtggccttgtgtggccgaggaaggtgaaaaaaagattttggccggcaaactggaaatgaccttagagatcgtcgccgaatccgagcacgaggagcgccccgcgggtcagggtagggatgagccgaacatgaaccccaagctggaagatccccgtcgccctgacacatccttcttatggttcacttccccatacaagaccatgaagtttatactgtggaggagatttagatgggcaataatactgttcattattctgtttatacttctcctgtttttggccatattcatttacgccttccccaattacgctgccatgaaactggtcaagccattcagc

SEQ ID NO: 10619 - DNA, 6243 bp, Artificial Sequence
  Description of Artificial Sequence: Synthetic coding sequence
atgctgtgttgccttctggtcagagcatcgaacctcccatcggcgaagaaggacagaaggagcgatccggtcgcatccctgaccttccgcggtgtgaaaaagcgcacgaaggtcatcaaaaactccgtcaatcccgtgtggaatgagggcttcgaatgggatctcaaaggaattccactggaccaagggtccgaactgcatgtcgtggtcaaggatcatgaaactatgggccgcaatcggttcctgggcgaagcaaaggtgccactcagggaagtgcttgctactccttccctgagcgcatcgttcaacgcaccactgttggacaccaaaaaacaaccgactggagcgtcgctggtgctgcaagtgagctacactcctttgcccggagcagtgccgctctttccaccacctacccctctggagcccagccctactcttccagatcttgatgtcgttgcagacaccggaggagaggaagataccgaggaccagggattgactggagacgaagctgagccttttcttgatcaatcaggtggcccaggggcacctactacccctcggaagttgccctcccgcccgccaccccactacccaggaattaagcgtaagcgctcggcccctacctctaggaagctcctttcggataagcctcaagactttcaaatcagagtgcaagtgatcgaggggagacagcttcctggtgtgaacattaagcctgtggtcaaggtgactgctgcaggtcagaccaagaggactagaatccataaagggaactccccacttttcaatgaaacccttttctttaatctgttcgattcccccggtgagttgttcgacgagccaatcttcattactgtggtggactcaagatccctgagaaccgatgcactgctgggagagtttcgtatggatgtgggaaccatctaccgcgaaccacggcacgcctaccttagaaagtggctcctgcttagcgatcctgatgatttttcagcaggtgcacggggttacttgaaaacctcactgtgcgtcctgggacccggtgatgaggcaccacttgaacgaaaggatccttccgaggataaagaagatatcgaatcgaacttgctccgcccaactggtgtggcactcagaggggcccacttttgtcttaaggtgttccgagccgaagatctcccccaaatggacgacgcagtgatggataacgtgaagcaaatcttcggatttgaatccaacaagaagaacttggtggatccattcgtggaagtctcttttgctgggaagatgctgtgttctaagattctggagaaaacggccaatcctcagtggaaccaaaacataacgcttcctgcaatgtttccaagcatgtgcgagaaaatgaggatcagaatcattgactgggatagattgacgcataatgatattgtggcaaccacctacctttccatgagcaagatcagcgctcccgggggagaaattgaagaggaaccggcaggcgcggtgaagccctcgaaggcatctgatttggatgattacctcggatttctgcctacctttggtccttgttacattaacctgtacggctcaccaagggaatttaccggatttcccgatccatacaccgaactcaacactggcaagggtgagggtgtcgcctaccgcggacgactgcttctcagcctcgagacgaaactggtggaacactccgaacaaaaggtggaggatcttcccgcagacgatattctgcgcgtcgaaaagtacctgaggagaagaaagtatagcctttttgcagccttctactcagccactatgctgcaggacgtcgatgatgcaattcaatttgaagtctccattggaaattacggaaacaagtttgacatgacttgtctcccccttgccagtaccacccagtactcgcgcgcagtgtttgatggatgtcattactactacctgccatggggtaacgttaaaccagtggtggtcctgtcgagctactgggaagatatttcgcacagaattgaaacccaaaaccagctcctgggtattgcggatcgcctggaagccgggcttgaacaggtgcacctcgccctgaaggcccaatgctcaactgaggacgtggattctcttgtcgcgcagctgactgatgagcttatcgccgggtgtagccaacccctcggggatatccacgaaaccccaagcgcaacccatcttgaccaatacctgtaccaactccggactcatcacctctcgcagattactgaggcagccctcgcactcaagctggggcattcggaactgcccgcggcgctcgagcaggcagaggactggctgctgcgcctccgcgcactcgcagaagaacctcaaaattcgctgcctgacatagtgatctggatgctgcagggcgataagcgtgtggcgtaccaacgtgtgccagctcaccaagtgctttttagcagacggggagcaaactactgcggtaagaactgtggtaagctgcagacgatttttctgaagtacccgatggaaaaggtgccaggcgcccgtatgccagtgcagattcgggtgaaactgtggttcggactgtcagttgacgaaaaggaattcaaccagtttgcagagggcaaactgtcggtctttgcggagacttacgaaaacgagactaagctggcccttgtgggaaactgggggaccactgggctgacttaccctaaattctcggatgtgaccggaaagatcaagctgccaaaggattctttcaggccttcagcaggctggacttgggcaggtgactggtttgtgtgtcccgaaaagaccctgctgcatgacatggatgccggccaccttagcttcgtggaggaggtattcgagaatcagaccaggttgccaggaggtcaatggatctacatgtcggacaactacactgatgtgaatggcgaaaaggtgttgccaaaagatgatattgagtgccctcttggatggaagtgggaagatgaggaatggagcaccgatttgaatcgggcagtcgatgaacagggttgggaatatagcatcaccattccacccgaaagaaaaccaaaacattgggtgccagcagaaaagatgtactacactcaccgaaggcgcaggtgggtcagacttagacggagagacttgagccaaatggaagcactgaagcggcaccgacaagcagaagctgaaggggaaggatgggaatacgcgtcgctctttggctggaaatttcatcttgaatacagaaagactgatgcattcagaaggcgacgttggagaaggagaatggagcctcttgaaaagactggacctgcggcagtgtttgcactggaaggtgcactgggaggtgtcatggatgataagagcgaggattcgatgtcggtgagcaccctgtcatttggcgtgaacagacctaccataagctgtatctttgattacggtaacaggtaccatctgagatgctacatgtatcaggcacgggaccttgcagcgatggacaaggattcgttcagcgatccttatgcgatcgtgtcatttctgcatcaatcgcagaaaactgtggtcgtgaagaacaccctgaatccaacttgggaccaaaccttgatcttttatgaaattgagattttcggtgagcctgccactgtggcagaacagcctccgtcgatagtagtggagctgtacgatcacgacacctacggggcagacgaattcatgggaaggtgcatatgccaaccgagcctcgagagaatgccacggcttgcgtggtttcctctcactcgcggttcgcaaccttcaggagagttgctcgcatcattcgagctgattcagcgggaaaagcccgcaattcatcatattcccggattcgaagtgcaggagacttcgcgcattttggacgaaagcgaagatactgacctgccctacccacctccacagagggaggcaaatatctatatggtgcctcagaacataaagcctgctctccagcggaccgctatagaaattctggcatgggggcttcggaatatgaagtcgtaccaactggctaacatcagctccccttccctcgtcgtggagtgcggtggtcaaaccgtgcagagctgtgtcatcaggaacctgcgtaaaaacccaaactttgatatctgcaccctgtttatggaagtgatgctgccgcgagaagagctgtactgccctcccattaccgtcaaggtgatcgacaaccgacagttcggacggcgccccgtcgtgggtcagtgcactattagaagccttgaatcatttctgtgcgacccttactcggcagaatcacctagccctcaagggggaccagatgacgtctcacttctctcccccggcgaagatgtgcttatagatattgatgataaggagccattgattccaatacaggaggaagaattcattgactggtggtcgaagttttttgcatcgatcggcgaacgggagaagtgtggaagctaccttgaaaaggactttgacaccttgaaggtgtacgacactcagctggagaatgtcgaggcatttgaaggactctcggacttttgtaacacttttaagctgtacagaggaaagacgcaagaagaaactgaagatccatcagtgatcggagagttcaaaggtttgtttaagatttacccactgccggaagatcccgccattccaatgcctccaaggcaattccatcaactggcagcacaaggtccgcaggaatgcctggtgcgtatttacatcgtgagagcatttggcctccagccgaaagatccgaacggcaaatgtgatccttacatcaagattagcatcgggaaaaagtcggtgtctgatcaggacaactacattccctgtactctggaaccggtgtttggcaagatgttcgagctcacctgtactctgcctctggaaaaggatttgaagataaccctttacgattatgatcttctgtccaaggatgaaaagattggcgagacggtggtggatctcgagaatcgccttctctcgaaatttggcgcaaggtgtggccttccccagacgtactgtgtgtcgggacccaaccaatggcgagatcagctgcgaccctcccagctcttgcatctcttttgccaacaacatcgcgtgaaggctccggtgtaccgcaccgatagggtgatgtttcaggataaggagtacagcatcgaagaaatcgaggcaggtagaattcctaatccccacctgggaccggtggaggaacgtcttgcactgcatgtcttgcaacaacaagggctggtgccagaacatgttgaaagcagacctttgtactcgccacttcaacctgatattgaacaaggcaaattgcagatgtgggtcgacctgttcccgaaggctctcgggcgcccaggtcctccttttaacattaccccaaggcgcgcgagaagattcttcctgcggtgtattatctggaacacccgagatgtgatcctcgatgacctgtcgcttactggggagaagatgtccgatatctacgtcaagggctggatgattggatttgaagaacacaagcaaaaaaccgatgtgcactacagatcactgggaggcgagggcaatttcaactggagattcatctttcccttcgattaccttcctgcagagcaggtgtgcaccattgcaaagaaggatgcattttggcgcctggataaaaccgagtctaagatccctgcgagagtggtgtttcaaatctgggataacgacaagttctctttcgatgattttctgggatccctccagcttgaccttaatcgcatgcccaaacctgcaaagacggctaagaagtgttcccttgatcaacttgacgatgcatttcacccagaatggttcgtgtctctgtttgaacaaaagactgtgaagggctggtggccctgtgtcgccgaagaaggggagaaaaagattctggcaggaaaacttgagatgacgcttgaaattgtggcagagtccgagcatgaggaaagacctgccggacagggacgagatgaaccgaacatgaatcctaaacttgaagatccacgaaggcccgacacctccttcctttggttcacctcgccttacaaaactatgaagtttattctgtggaggcggtttagatgggcaattatcttgtttatcattttgttcattctgctcctcttccttgccatctttatctacgctttcccaaattacgccgcaatgaaacttgtgaagcctttctcg

SEQ ID NO: 10620 - DNA, 6243 bp, Artificial Sequence
  Description of Artificial Sequence: Synthetic coding sequence
atgctctgttgcttattggtgagggccagcaacctgccatccgcgaagaaagatcgcaggagcgatccggtggccagtctgacattccgcggagtcaagaagagaacgaaagttatcaaaaactctgtcaatccggtctggaacgagggctttgaatgggacttgaaaggaatacccctggatcagggctcagagctgcatgtcgtggtgaaagaccatgagacaatgggtagaaacaggttcctgggagaagccaaggttccacttcgggaggtccttgctacgccgtcactgtctgcatcatttaacgcacctcttcttgataccaagaaacagcccacaggggctagcttagtcctgcaggtgtcctacactcccctccctggcgccgtgcctctctttccccctccaacccccctggaaccatctcccaccctcccagacttggacgtggtagccgacactggaggagaggaggacaccgaggatcagggattgaccggagacgaggccgagccttttctagaccagagcggcggccctggcgctccaacaaccccacgaaaattgcccagcaggcctcctcctcactatcccggtataaagagaaagagaagtgctccgacaagcagaaaattgctgtccgacaaaccacaggactttcagattcgtgtgcaggtaattgaaggcagacagctccctggggtgaatatcaaacctgtcgttaaggtcaccgctgcgggccagacgaagaggacacgcatccataaagggaatagccccctttttaacgaaacccttttctttaacctttttgactctcccggagagctgtttgacgagccaatcttcattaccgttgtggactctcggtctcttcggacggacgctcttctgggcgagttcagaatggatgtgggaaccatttatagagagccaagacatgcatacctgaggaaatggttacttttgagtgacccagatgatttttcagcgggtgcccgcggttaccttaaaacaagcctctgcgttctgggacctggggacgaggcacctcttgagcggaaggatccaagcgaagacaaagaggacattgagagcaacttactgcgccccacgggcgtggctttgagaggagctcatttctgcttgaaggtttttagagcggaggatctcccccagatggacgatgcagtgatggacaacgtcaaacagatcttcggttttgaaagtaacaagaaaaacctcgtggacccattcgtggaggtgagtttcgcaggaaaaatgctttgtagtaagatattggaaaaaactgctaacccccagtggaaccagaacattaccctgcccgctatgttccctagcatgtgtgaaaagatgaggatccggatcatcgattgggacagattgacacataatgatattgtggccactacctacctgtctatgagcaaaatctccgccccaggcggcgaaatagaggaggagccggcaggcgctgtcaagcccagtaaagctagcgacctggacgattatctgggcttcttgcccactttcggaccatgctatattaacctctatggtagtccgcgggagtttacaggttttcccgatccatatacggaactgaataccggcaagggagaaggagtggcttacagaggacggttgttgctctctctggaaaccaagcttgtggagcattccgaacagaaagttgaagatctccctgcagatgatatcctgcgtgtcgagaagtacttgcgcaggagaaagtacagtctttttgccgcattctattctgcaacaatgcttcaagacgtcgacgacgccatccagttcgaagttagcatcggcaactatggcaacaagtttgatatgacctgtctgccactggctagcaccactcaatacagccgggccgtctttgacgggtgtcactattactaccttccttggggaaatgtgaaacctgtggtcgtcttgagctcctattgggaagatatctcgcacaggatagagacccagaatcaactgttggggatagcagatcggttggaggcaggcctggaacaggttcacctggctctgaaggcccagtgttcaactgaggatgtggattccctggtggcacagcttaccgacgaactgattgctggttgtagccaacctctgggagacatccacgaaactcctagcgccacccatctggaccagtacctctatcagcttcgcacacaccaccttagccagattactgaggcagcccttgccctgaaattgggacactccgaacttcccgctgccctggaacaggctgaagattggctgctcagactcagagctcttgctgaggaaccccagaacagcttacccgatatcgtcatctggatgctgcagggcgacaagagggtcgcttaccagcgcgtccccgcgcatcaggttttattttcccgcagaggggccaactattgcggaaaaaactgtggaaagttgcaaacaatcttcctcaaataccccatggagaaagtcccaggtgctcgcatgccagtgcagatcagggtaaagctctggtttggactgagcgtggacgagaaagagttcaaccagtttgcagaaggcaagctgtctgtgtttgcagagacctatgagaatgagacgaaattggctctggtcgggaattggggcacaactgggctgacctaccctaagtttagcgacgttacaggaaaaatcaagctgcccaaagattcctttcgcccatccgctggctggacttgggctggggattggttcgtgtgtcctgaaaaaaccctgctgcacgatatggatgctgggcatcttagttttgtggaggaagtgttcgaaaaccagactcggcttcccggcggccagtggatttacatgtctgacaactataccgacgtcaatggagagaaggtgctcccaaaggacgacatcgagtgccccctaggctggaagtgggaggacgaagagtggtctactgacctcaatcgtgctgtggacgagcagggttgggagtacagcatcacaatccctccagagagaaaacctaagcactgggtgcccgccgagaagatgtattacactcaccgccggagacgttgggtgaggctgaggagaagagatctgagtcaaatggaagcattgaagcgccacaggcaggcagaagctgaaggcgaggggtgggagtacgcctcactgtttggttggaagttccatctggagtatcgcaaaaccgacgccttccgtcgccgccgttggcgtagacgaatggagccactggagaagacaggccctgcagcagtgttcgcacttgaaggtgctcttgggggagtgatggatgacaagagcgaggatagtatgagcgtgagtaccttgtcatttggcgtgaacagaccaaccataagttgcatcttcgactatggcaaccgatatcaccttcgttgttacatgtaccaagcgagagaccttgcagccatggacaaagattccttctctgatccgtacgccattgtgtcattcctgcaccagagccagaaaacagttgttgtcaagaacactttaaacccaacatgggaccagactctcatcttttatgaaatcgagatcttcggagaacctgcgactgtggcagaacaaccaccgagtattgtggtggaactgtacgaccacgatacctatggcgctgatgagtttatgggtagatgcatatgccaaccgtccttagagaggatgccacgcctcgcatggttccctctgacacgcggttcccaaccctctggggaacttttggctagctttgaactcatccagagagagaaacccgctatacaccacattcctgggtttgaggtgcaagaaactagtagaatcctcgacgagtccgaggatacggatttgccatacccccctcctcaacgcgaggccaacatctatatggtgccgcagaatattaagcccgctctgcaacgcaccgcgatcgaaattctggcgtggggactgagaaatatgaagtcataccaactcgcgaacatcagcagtccgagtttagttgtggagtgcggaggacagactgtgcagtcttgcgtcatccgtaatctcagaaaaaacccaaatttcgatatttgcactttgtttatggaggttatgctgccacgagaggagctgtattgtcctccaatcactgtcaaggtgatcgataataggcaatttggacggcggccagtggtcggacaatgcactattagatcgctggagagcttcctctgcgacccttacagcgccgaaagtccctctcctcagggcgggcccgatgacgtgtccttgctctcacccggtgaagacgtgctgattgacattgacgacaaagagcccctgatcccgatccaggaggaggagtttatagactggtggagcaaatttttcgcgagtatcggagagcgggagaaatgtggatcatacttggaaaaagactttgatacactgaaagtctacgacacgcaactggagaatgtggaggcattcgagggcctttccgacttctgcaacacattcaagctttaccgtggcaaaacgcaggaggagacagaagatcctagcgttatcggcgagtttaagggcttatttaaaatctatccactgcccgaggatcctgccattccgatgccccctagacagtttcatcagctggctgcacaaggcccacaggagtgcctggtgcgcatctacattgtgagagctttcggcctccagcccaaagaccccaacggcaaatgcgacccctatatcaaaatcagtatcggcaaaaaaagtgtctctgaccaggacaactacattccctgtacactcgaaccagtgttcggaaagatgtttgaacttacttgtacccttccacttgagaaggatctgaaaatcacgctctacgattacgatctgttgtctaaagacgagaaaatcggcgagaccgtagtagatttggagaacaggcttctgagcaaatttggcgcaagatgcggactgccccaaacctattgcgtatctggtcctaaccaatggagagatcagctcagaccgagtcagctgttacacctcttctgccagcaacaccgggttaaggccccagtgtatagaactgacagggtgatgtttcaggacaaggaatactcaatcgaagaaattgaggctgggcggataccaaacccacatctggggcccgtggaagagcgcctcgctttgcacgtgctgcaacaacagggccttgtgccagaacacgtggaatctcgccctttatactcgcccctgcaaccagatatcgaacagggcaagctccagatgtgggtcgacttgttcccaaaagcccttggacgtccagggccaccttttaacatcacacccaggagagcaaggagattcttcctcaggtgtataatctggaacactagagatgtgattttggatgacctgtcactcaccggagagaaaatgtccgacatctacgtcaaagggtggatgattggatttgaagaacacaaacagaaaacggatgtccactacagaagtttgggcggcgagggaaactttaactggaggtttattttcccattcgactaccttcccgctgagcaggtgtgtacaatagccaagaaggatgcgttctggcgcctggataaaacagaaagcaaaatccctgccagggtggtctttcaaatctgggataatgataagtttagctttgacgactttctgggaagccttcagctggatctgaaccgtatgcctaagcccgctaaaactgctaaaaagtgcagcctggatcagcttgacgacgcatttcaccctgaatggttcgtaagcctgttcgaacagaaaacagtgaaaggctggtggccttgtgtcgcagaggagggtgagaaaaagatcttggcagggaaactggaaatgacactcgaaatcgtcgcagaaagcgagcatgaggaacgccccgctggtcagggtagggatgaacctaacatgaatcccaaactggaagatccaagaagacccgacacctcttttctgtggtttacaagtccttacaagaccatgaagtttatactgtggcgcagatttaggtgggccatcatactgtttatcatcctcttcatcttgttactgtttctggctatctttatatacgcgttccctaattatgcggctatgaagttggtgaaaccattcagc

SEQ ID NO: 10621 - DNA, 6243 bp, Artificial Sequence
  Description of Artificial Sequence: Synthetic coding sequence
atgctgtgttgcctcctggtgagggcaagcaaccttcctagcgcgaagaaagatagaaggagcgatccagtggcatccctcacttttcgtggcgtcaaaaagagaactaaagtcattaagaactccgtgaaccctgtgtggaacgaagggttcgagtgggacttgaagggcatacctcttgatcaaggaagcgagctccatgtggtggtgaaggatcatgaaactatggggagaaaccgctttctgggcgaggccaaagtcccactccgggaagtgcttgcaactccaagcctttcagcgtcatttaacgctccacttttggatactaagaaacaaccgaccggagcgtccctcgtgctgcaagtgtcgtacactcctctgccaggggcggtgccactgttcccacctcccaccccgctggagccttcccctactctgcctgatctcgatgtcgttgcagatactgggggagaggaggacaccgaggatcaggggcttaccggtgatgaggcagaacccttcctcgaccagagcggtggtccaggtgctccaactaccccgcgcaagttgccatcacgaccacctccacactaccccggaatcaaaagaaagagatcggcaccgacctcaagaaagctgctgtccgataagcctcaagattttcagatacgcgtccaggtcatcgaagggcgccagcttcctggcgtcaacataaagcctgtcgtgaaggtgaccgcagcaggacagactaaacgcactagaatacacaagggcaattcgccactctttaacgaaacgcttttcttcaaccttttcgatagccctggcgaactgtttgatgagcccatctttatcaccgtcgtggattcacgctctctgagaactgacgccctgctcggagagttccggatggacgtgggaacgatttaccgagagccgcgtcacgcataccttcggaaatggctgctgttgtcagacccggacgacttttcagccggggcaagaggataccttaagactagcctttgcgtcctgggaccaggagacgaggccccactggaaagaaaagatcctagcgaagataaggaggatatcgagtcgaacctcctgcggccaactggagtggcactgagaggcgcacatttctgccttaaagtgttccgggcagaggaccttccacaaatggatgatgcggtgatggacaatgtgaagcagatatttggatttgaatcgaataagaagaatctcgtggacccattcgtggaagtgtccttcgctgggaagatgctttgctcgaagatactggaaaaaaccgccaacccccaatggaaccaaaacatcacccttcctgccatgtttccttctatgtgtgagaaaatgagaattcgaataatcgactgggatagactgactcataacgacattgtggcaactacctacctctcgatgtccaaaatctcggcacctggcggtgaaatcgaagaggagccagcaggagcagtcaaaccaagcaaggcatctgacctggatgattacctgggatttttgcctactttcggtccttgttacattaatctctatgggtcaccgagagagtttaccgggtttcctgacccgtacaccgagcttaacaccgggaagggagaaggagtggcgtatcgtggtcgcctgcttctgtcacttgaaactaagctcgtggaacattccgaacagaaggtggaggatctcccagcagacgatattctcagagttgaaaagtaccttaggaggcgcaagtactccctttttgctgctttttactccgcaactatgcttcaagatgtggacgatgcaattcagtttgaagtgtcgatcgggaactacggcaacaaatttgacatgacttgcctccccctggcatccaccactcaatattcacgcgccgtgtttgacggatgtcattactactacttgccttggggtaacgtgaagcccgtggtcgtgctttcatcctactgggaggacatatcccaccgcattgaaactcagaaccagctccttggtattgcagatcggctcgaagcagggcttgaacaagtgcatctggccctcaaggcacagtgctcgaccgaagatgttgatagcttggtggcgcagctcacggatgaactgattgcaggatgttcgcaaccactgggagatatccatgagacgccgtcagcaactcatctggaccaatatctttaccaactgagaactcatcatttgagccagattaccgaggcagctctcgcgcttaaacttggtcactctgagcttccagccgcacttgagcaggccgaagattggttgcttagactccgggccctggccgaagagcctcagaactcccttccggacattgttatttggatgctccaaggggataagcgggtggcttaccagcgagtcccagcgcaccaagtcctgttttcgcgtcggggagcaaactactgcggaaagaattgtgggaagctgcaaactatctttttgaagtacccaatggagaaggtgcccggcgctcgcatgcctgtccagattcgcgtgaagctgtggtttggattgtccgtggatgaaaaggaattcaatcaattcgccgaaggcaaactttccgttttcgcggaaacctacgaaaatgagactaaacttgcactcgtggggaattggggaaccaccggcttgacctacccgaagttttccgacgtgaccggtaagatcaaattgcccaaagattccttcagaccatcagcaggttggacctgggcgggagattggttcgtgtgtccagaaaagacgctcctgcatgacatggatgcaggacacctgagctttgtcgaagaagtttttgagaaccaaactagattgcccggcggtcaatggatttacatgtctgacaattacaccgacgtcaatggtgaaaaagtgctgccaaaagatgacatcgaatgtcctcttggatggaagtgggaggatgaggagtggagcaccgatctgaatagagccgtggatgaacagggctgggagtacagcatcaccattccaccagagagaaagcccaaacattgggtgccagcagaaaagatgtactatacccatagacggaggcgatgggttaggctccggcgccgcgacctttcacaaatggaggccctcaagaggcataggcaagcagaggcagagggtgaaggctgggagtatgcatcacttttcggttggaagtttcatctcgaatatcggaaaactgatgcattccgacgacgccggtggcggcggcgcatggaaccgctcgaaaagacgggacctgcagcagtgtttgcactggaaggcgcactgggcggagtcatggatgacaagtcggaagattccatgtcagtgtcaaccctgtccttcggtgtgaaccgccccactatttcatgtatcttcgattacggaaatcgttaccatctgaggtgttacatgtaccaggcacgcgatctggccgcaatggataaagattccttttcggacccttacgcaatcgtgtcgtttcttcaccaatctcagaaaacggtggtcgtcaagaacacccttaatccaacctgggaccagaccctcattttctacgaaattgagatttttggtgaacctgccaccgttgcggagcagcccccctcaatcgtggtcgaactgtacgatcacgacacctacggagctgacgagttcatggggcggtgtatatgtcaaccctccctcgaaaggatgccacgactggcctggtttccactcactcgaggatcacagccatccggtgaactgcttgctagctttgagctgattcagcgagaaaagcccgcaatccatcatatccctggatttgaagtccaggaaacgtccaggatcctcgatgaatccgaagatacggaccttccctacccaccacctcagagagaagcgaatatctatatggttcctcaaaacattaagcctgctctgcaacggacggcgatcgagatcctggcatggggactcaggaacatgaagagctaccaactggcgaacattagcagcccctccctcgtggtcgaatgcggtggacagaccgtccagagctgcgtcatccgcaacctcagaaagaatccgaattttgacatctgcaccctgtttatggaagtcatgttgccacgggaagaactgtactgtccccccattacggtcaaagtgattgacaatcgtcaatttgggaggaggccggtggtgggccagtgcactattagatcgcttgaatcatttctttgtgacccttactccgccgaatcaccatcccctcaaggtggacctgatgacgtgtcccttctctcccctggcgaagatgtgctcattgatatcgatgataaagagcctcttatacctattcaagaagaagagttcatcgattggtggagcaagttctttgcatctattggtgaacgagaaaagtgtggttcctacttggagaaagattttgatactcttaaggtgtacgacacccaactcgaaaacgtcgaagcatttgaaggactcagcgacttttgtaatacctttaagctgtatagaggtaagactcaagaagaaaccgaagatccttcagtgattggagagtttaagggtttgtttaagatttacccactcccggaagatccagcgattcccatgccccctagacagtttcatcagctcgccgcacagggacctcaagaatgtctcgtgaggatctacattgttcgagcctttggactgcaaccaaaagatcccaacggaaaatgcgacccttacattaagatttccataggaaagaagtccgtgagcgaccaggataactacatcccatgtactctggagcctgtctttggtaaaatgtttgaactcacttgtacgttgccacttgaaaaggatctcaagataactttgtacgattacgacttgctttcgaaagacgaaaagatcggagaaactgtcgtggacctcgagaacagactgcttagcaagttcggagccagatgcggtttgcctcaaacctactgcgtctcgggtcctaaccaatggagggaccaactccgcccttcccaacttcttcacttgttttgtcagcaacaccgggtgaaggcaccagtttaccgaactgaccgcgtgatgttccaagacaaagaatactcgatagaagaaatcgaagcaggtagaattcctaaccctcaccttggtccggtggaagaacggctggcactgcacgttctccaacaacagggtctggttcctgaacacgtggaatcacgccctctttacagcccactgcagccggatattgagcaaggaaagctccaaatgtgggtggatcttttccccaaggcccttggccgccccggcccaccatttaacattaccccccgtcgcgcaagacgctttttcttgagatgtatcatatggaacactagagatgtgatacttgatgatctgtcgctgaccggggaaaagatgtcggacatctacgtgaagggatggatgatcggcttcgaggaacacaagcaaaagactgatgtgcattaccgtagccttggaggagaaggtaacttcaactggcggttcatcttcccctttgattacttgccagcggaacaagtctgtactatagcaaagaaggatgcattttggcggcttgacaagactgaaagcaagattcctgcgcgtgtcgtgttccagatttgggataatgataagttttccttcgacgatttcttgggatcgcttcagctggacctcaacaggatgccgaaaccagcaaagaccgctaaaaagtgctccctggatcaactcgatgacgcctttcatccagaatggtttgtctctctttttgaacaaaagaccgtcaaaggatggtggccctgtgtggccgaagaaggcgaaaagaagattcttgccggtaaacttgagatgaccttggagatcgtcgcagaaagcgagcatgaagaacggcccgcgggacagggtagagatgagcctaatatgaatccaaaacttgaagatccgaggcgtccagatacctcctttctgtggtttacctctccctacaaaaccatgaagtttatcctgtggcgtcggtttcgttgggccattatcctgttcataattctgtttatcttgcttctttttctggccattttcatatacgcatttccgaattatgcggctatgaagctcgtgaagcctttttcg

SEQ ID NO: 10622 - DNA, 6243 bp, Artificial Sequence
  Description of Artificial Sequence: Synthetic coding sequence
atgctgtgttgcctcctggtgcgggccagcaacctcccatctgcaaagaaagatcgacgatcagacccagttgcgagtctgacctttcgaggggtcaagaagcggacaaaggtgatcaagaattccgtgaatcccgtatggaacgaagggttcgaatgggacctcaaggggattccgctggaccagggtagtgagctgcatgtggttgtgaaggaccacgaaaccatggggagaaatagatttctgggtgaagctaaagttcctttgagggaggtactagcgaccccttccctgtccgccagtttcaatgctcccttgttggacacaaaaaaacagcctaccggtgctagcctcgttctgcaagtgtcatacactccgttgcctggagcagtgccactgtttccacctcctactcccctcgagccatcccccacgctacctgacctagacgtcgtggcggacacaggaggtgaagaggatactgaggaccaggggctgacaggcgacgaagccgagcccttcttggaccagagcggggggccgggggctcccacaacgcctagaaaactcccaagtagaccccccccccattacccgggaataaaacgaaagaggtcggctcccacttctcgcaaactgctaagtgataaaccccaggactttcagatccgcgttcaagtgattgagggcaggcagctgcctggcgtgaacattaaacccgttgtgaaagtgaccgccgcagggcaaaccaaaaggactagaatacacaaaggcaactcgccactctttaacgagacactttttttcaacctgtttgacagcccgggcgagctatttgatgagccaatcttcatcaccgttgtggatagtaggagtctgcgaacagatgccctcctgggtgaatttaggatggacgttggcaccatttatagggagcctcggcatgcgtacctgaggaagtggcttctgttatccgaccccgatgacttcagcgctggagctcgtggatacctcaagacctctctttgcgtgctggggcctggtgacgaagccccactggagcgcaaggatccctcagaggacaaagaggatatcgagagtaatctgctccgccctacgggtgtagctctgaggggcgcccacttttgcctgaaagttttccgggcagaggacctgccgcagatggatgacgccgtcatggacaacgtcaagcagatcttcggattcgagtccaacaaaaaaaatctggtggacccattcgtcgaagtaagctttgccggcaaaatgctctgctcgaaaattttagagaaaaccgccaacccccaatggaatcaaaacataactctacctgccatgttcccctcaatgtgcgagaaaatgcggatccggatcattgactgggataggctcacccacaacgacattgtggctactacctatctgtccatgtctaagatctctgcgcccgggggggaaatcgaggaggagcccgccggcgcagtgaaaccatcaaaggcctccgatctggatgactacctggggttcctacctacattcggtccgtgttacatcaacctgtacggatcgccccgagagtttaccggattccccgacccctatacggagctgaatacaggcaaaggggaaggtgtcgcctatcgaggccggctactcctgtcccttgagaccaaacttgtggagcattccgagcagaaggtagaggaccttccggccgacgacattcttcgcgttgagaaatacctgagacgccggaagtattccttgtttgctgcattttactccgcaacaatgctacaggacgtcgacgacgccattcaatttgaggtttcaataggcaactacggcaacaagttcgatatgacttgcctgcctctggcaagtacaacgcagtatagccgtgcagtttttgacggctgccactactattatctcccgtggggaaatgtgaaacccgtggtggtactgagctcttactgggaagacatctcacaccgaatcgagacacagaatcaactgctgggcatagccgatcgactcgaggccggcctggaacaggtgcaccttgccctaaaggcacagtgttcaacagaagacgtggacagtctggttgcacagcttacggatgagcttatcgcagggtgtagccaacccctaggcgatattcatgaaacgcccagcgcaacccatctggatcagtacctgtatcagttgcggactcatcacctcagtcagattactgaggcagctctggctttgaagctgggccattccgagttacctgctgccctggagcaggcagaagattggttgctgaggttgcgcgcccttgcagaggaacctcagaacagtctgccagacattgttatatggatgctgcaaggcgataagcgggtcgcgtaccaaagggtaccagcgcatcaggtgctgtttagtcgaagaggggctaattattgtggaaaaaattgtgggaagttgcaaaccattttcttaaagtatcccatggaaaaggtgcctggggcacgaatgcccgttcagattcgggtgaagctatggtttggcctctccgtggatgagaaagaatttaaccagttcgccgagggcaagttgtcggtgttcgctgagacttacgagaatgagaccaagctggccctcgtcggcaattggggcacgacagggttgacataccctaagttctccgacgtaactggtaagataaaactccctaaagattcctttcgtcccagcgccggttggacctgggctggagactggtttgtctgccctgagaaaaccctcttgcacgacatggatgcggggcacctgagttttgtcgaggaagtgttcgagaatcagacgcgtctcccggggggtcaatggatctacatgagtgataactatactgatgtgaatggcgagaaggttcttccaaaggacgacatcgagtgccctctggggtggaagtgggaagacgaagagtggtccacggaccttaaccgggccgtggacgagcaaggctgggaatacagcatcaccatccctccagaacgcaagcccaagcattgggtgccagcagagaagatgtactacacacatagacgtaggcgatgggtgcgcttacgcaggagggacctctcccagatggaggccctcaaacgtcaccgccaggccgaggcagagggggaggggtgggaatacgcctccctgtttggctggaagttccatctggaatatagaaaaactgatgcgtttaggcgccgcagatggagacgccggatggagcccctggagaaaaccgggcctgccgcagtctttgccctggagggggcactgggcggtgtgatggatgataaatctgaggactccatgtcagtctctaccttgtccttcggagtgaataggcctaccatttcgtgcattttcgactatggcaacaggtatcacctgcggtgttatatgtatcaggctagagacctggcagcaatggacaaggacagtttctcagatccctatgctatcgtgagttttttacatcagagtcaaaaaaccgtagtagttaagaacaccctcaacccaacctgggaccagactctgattttttacgagatagaaatctttggcgaacctgcaactgttgctgagcagcctccaagtatagtggtggagctctacgatcatgacacatacggggcagatgagttcatgggtcgctgtatctgccaacctagcctggagaggatgcccaggctcgcctggtttccgctgaccagaggctctcagcctagtggcgaacttctggcttctttcgaattgatacagcgggagaagcctgccatccaccacataccgggattcgaggtgcaggagacttcacggatactggatgagagcgaagataccgacctcccttacccacccccgcagcgggaggctaacatctatatggtgccccagaatattaagcccgccctgcagcgcaccgccattgaaatactggcgtgggggttgaggaatatgaagagctaccagcttgccaacatttcttcgccaagccttgtagtggagtgtggcggtcagacagtgcagtcgtgcgttattcgcaatctccgcaagaatccaaatttcgatatctgcaccctgtttatggaagttatgctcccccgggaagagctgtactgtccgcctataacggtgaaagttatcgacaaccgccaatttggccgccgcccagtcgttggccagtgcacaattcgcagcttagaaagcttcctatgcgacccttactcagctgagtccccgagccctcaggggggccccgacgatgtgtctctactgagtcccggagaagatgtccttatcgacattgatgataaagagcccctgattcccatccaggaggaggagttcatagattggtggtccaagttttttgccagcatcggggagcgagaaaagtgtggttcatatcttgaaaaagacttcgacacacttaaggtgtatgacactcagctggaaaacgtggaggccttcgagggcctcagcgatttttgtaacacgttcaaactgtatcgtggcaagacacaagaagagacagaagacccatccgtgatcggggagtttaagggactttttaagatctaccctctccccgaggaccccgctatccctatgccaccgcgtcaatttcaccagttagctgcccagggtccacaggagtgccttgtcaggatctacatcgtgcgggcctttggtctgcagcctaaagaccctaatggcaagtgcgatccctacatcaaaatctcaataggaaagaagagcgtaagtgaccaggataactatatcccttgcaccttagagcctgtgtttggaaagatgttcgagcttacctgtactttaccactagaaaaagacttgaagatcaccctttatgactatgacctgctttccaaagacgaaaagattggagagactgtggtggatctggagaatcgactcctgagcaagtttggcgcccgatgtggccttcctcagacctactgcgtatctgggcctaaccagtggcgtgaccagctgcgtccctcccaactactgcatttgttttgccagcaacatagagtgaaagcccccgtttacagaactgatcgagtgatgttccaggataaagagtacagcatagaggagattgaggccggccgaataccgaatccccacttaggcccagttgaggagaggctggctctccatgtcctgcagcagcagggcttggtgcctgaacacgtggagtcgagacccttgtattcacctctccaacctgacatcgaacagggcaaactgcagatgtgggtggacttgtttcccaaagctctagggcgcccaggccctccgtttaacattaccccacggcgagccaggcggttttttttaagatgcatcatctggaataccagggacgtcatcctggatgacctctctctaaccggcgagaaaatgtctgacatttatgtaaaaggatggatgatcggcttcgaagagcataaacagaaaacagacgtgcactacaggagtttaggaggggagggtaacttcaactggcgattcatattccctttcgattatctgccagccgagcaggtttgcacaatagcaaaaaaagacgctttctggcgcctggacaagaccgaatccaagatccccgcccgagttgtattccaaatttgggacaatgacaagttcagtttcgacgactttcttggatctctgcagttggatcttaatagaatgccgaagccagctaagactgccaagaagtgctccttggatcagttagatgacgccttccatccagagtggttcgtgagtctgttcgagcagaagacagtgaaaggttggtggccatgcgtggctgaggagggggaaaagaagatcctcgcggggaagcttgagatgacccttgagatagtggcagagtccgagcatgaggagcggccggcgggccagggacgggatgagcccaacatgaaccccaagttggaagatcccaggcggccggacacctccttcctctggtttacctcaccgtacaaaacaatgaaattcatcctctggagacgattccggtgggcaattatcctgttcattatcctgtttattctcctcttatttttagcaatcttcatctacgctttcccaaattacgcagccatgaagttggtgaaaccatttagc

SEQ ID NO: 10623 - DNA, 6243 bp, Artificial Sequence
  Description of Artificial Sequence: Synthetic coding sequence
atgttgtgttgcctgttggtgagagcctccaacttgccctcagctaagaaggataggaggagtgaccctgtggccagcctgactttccgcggtgtgaagaagagaacaaaagtcatcaagaatagcgttaaccccgtgtggaacgaaggatttgaatgggacttgaagggtatcccgctggatcagggctcagagctgcacgttgtcgtgaaggatcacgaaacgatgggtagaaacagattcttgggcgaggcgaaggtgccgctgcgcgaggttctggccacccctagcttgtctgcttcctttaacgcccccctgctggacactaagaagcagcccactggcgcatccctggtgcttcaggtgagctacacccctttgccaggagccgtgccgttgttccctcctccgacaccgctcgaaccgagcccaacactgccagatctggacgttgtggccgacactggcggagaagaggacactgaggaccaaggcttgaccggcgacgaagcagaaccgttcttggaccaaagcggcggccctggcgctcctaccacaccgagaaagctcccttccagaccccctccccactatccaggaattaagcgcaaacgcagcgcacccaccagcaggaagctcctttcagataaaccacaggacttccagataagagttcaggtgatagaaggtagacaactgcccggtgtcaacatcaaacccgtcgtcaaagtgaccgcagcaggccagacgaagagaactcgcattcacaagggcaactcacccctgtttaacgaaaccctgtttttcaatctgtttgattcaccgggcgagcttttcgatgagccaatcttcataacagtcgtagactctcgctcacttagaacagacgcattgctgggcgagtttagaatggatgtaggaacgatatacagagaacctaggcatgcttacctccgcaagtggctccttctctcagacccagacgatttcagtgctggcgcacgcggttacttgaaaacatccctctgtgtgctgggcccaggtgacgaggctcctctcgaaagaaaagaccccagcgaggacaaagaggacatcgagagcaatctgttgaggcctactggtgtcgctctgcgcggcgcccacttctgtctcaaggtgtttagggccgaagacctgcctcagatggatgacgcagtcatggataatgtgaagcagatcttcggatttgagtccaacaagaaaaacttggttgatccgttcgtggaggtgtcctttgccggaaaaatgctctgctccaaaatccttgagaagaccgccaatccccaatggaatcagaacattaccctgcctgctatgtttccttccatgtgcgaaaagatgcgcattaggattattgattgggacaggctcacccataatgatattgtggcaaccacttacctgagtatgtccaagatctccgcccctggcggagaaattgaagaagagcccgcaggagcggtgaagccatctaaagcatctgaccttgatgattacttgggtttcctcccaacctttggcccttgctacatcaacctgtacggtagtcctcgcgagttcactggattccctgacccctataccgagctgaacactggaaagggagagggtgtcgcatacagaggccgcctgttgctgagcctcgaaacaaagttggtcgaacactccgagcagaaggtggaagatctgccagccgatgacatcctgagggtggaaaagtatctccgcaggaggaagtattctctgtttgccgccttctattccgcaactatgctgcaggatgtagacgatgctattcagtttgaggtgagcatcggcaactacggaaataagttcgacatgacctgcctgcccctggcctccactacccagtactctcgcgccgtcttcgacggctgccattactactacctgccatggggaaacgtgaagccagtggtggtgctcagtagttattgggaagacatatcacataggatcgagactcagaatcagctgctgggaattgcagacagactggaggccggtctggagcaggtccaccttgcgctcaaagcccagtgctctaccgaagacgtggatagccttgttgctcagctcactgacgaactgatcgccggttgtagccagcctcttggtgacatacatgagactccatcagctacccatttggaccagtacctttatcaacttcgcacccaccacctgagtcagatcacagaggctgccctggccctgaagttgggacatagcgagctccctgccgctctcgaacaagccgaggactggctgctgagattgcgcgcgctcgcggaggagcctcagaacagcctgccggatattgttatctggatgctgcagggcgacaaacgcgtggcttaccagcgcgtacccgcccaccaggtgctcttttccaggcgcggtgctaactactgtggcaagaattgtggaaaacttcagaccatctttctgaagtaccccatggagaaggtgccaggagcgaggatgcctgtgcagatccgcgtcaagctgtggttcggactctcagtcgacgagaaggagttcaaccagtttgctgagggtaagttgagcgtttttgctgagacttatgagaacgagactaaactcgcccttgttggcaattggggtaccactggcctgacttatccaaaatttagcgatgtaacaggaaagataaagctgccaaaggacagcttcaggccgagtgcaggctggacatgggcaggtgattggttcgtgtgcccggaaaagacactgctgcatgatatggacgcgggacacttgtcatttgttgaggaagtctttgagaaccaaacccgcctcccaggtggacaatggatctacatgagcgacaactacaccgacgtgaacggagagaaggtgctgccgaaggatgatatagagtgtccgcttggatggaagtgggaggacgaggagtggagcaccgacctgaacagagctgttgacgaacagggatgggaatacagtataacaatcccacctgagagaaagccaaaacactgggtgcctgccgaaaagatgtactacacgcacagacgccgcagatgggtcagactgagacgccgcgacctcagtcaaatggaggctctcaaacgccaccgccaggcagaggcggagggtgagggatgggaatacgcctctctgtttggctggaagttccacctggagtaccgcaagaccgatgcattcaggagaaggagatggcgcagaagaatggagccactcgaaaagaccggacccgccgctgttttcgccctggagggcgccctgggaggcgtgatggacgacaagtcagaggattccatgtctgtctccaccctgagttttggtgttaacagaccaacaatttcttgtatcttcgactatggaaataggtaccatctgaggtgctacatgtaccaagccagagacctggccgctatggataaggactccttctccgatccctacgctatcgtaagttttcttcatcagtcccaaaaaaccgtcgtggtaaaaaacactctgaatcccacttgggaccaaactctcatcttctatgagattgagattttcggcgaacctgcaacagtggccgaacagccgccgtcaatcgtcgtcgagctttacgaccacgacacatacggagcagacgagttcatgggaaggtgcatctgtcaaccatccctggaacgcatgcctcgcctcgcttggtttccgctgacccgcggaagccaaccttccggagagctgctggcctccttcgagctcattcagcgcgaaaagcccgctatccaccacattcccggcttcgaagtgcaggaaacctcacgcatcctggatgaatccgaagacactgatctgccatatcctccacctcagcgcgaggctaatatctatatggtgccccagaatatcaagcccgcactccagagaacggccattgaaattctggcttggggtctcagaaacatgaagagctaccagttggcgaatatttcttctccatctttggtcgtggagtgtggcggtcagacggtgcaatcatgtgttattaggaatctccgcaaaaatccgaatttcgatatctgcacactgtttatggaggttatgctgccccgcgaggaactgtattgccctcccattacggttaaagtgatcgacaacagacaattcggcaggcgcccggtcgttggccagtgtacaattaggtctttggaaagctttctgtgcgacccttacagtgcagagtctccctcaccacagggaggtcccgatgatgtcagtttgttgtctcccggcgaggacgttttgatagacatcgatgacaaggagccactgatcccaattcaggaggaggaattcatcgattggtggagcaagttcttcgcttccattggtgaaagggagaaatgcggtagctatctggaaaaggatttcgacacgctcaaggtgtatgacacccagttggagaatgttgaagcctttgagggactgtccgacttctgcaacactttcaagctctaccgcggcaaaacacaggaagagaccgaagaccccagcgttatcggagagttcaagggcttgttcaagatttaccctcttccggaggaccccgcaatccccatgccgccgagacaatttcatcaactggctgcccagggccctcaggagtgcctcgtcaggatttatatagtgcgcgcttttggtctgcagcctaaagatccgaatggtaaatgcgacccctacattaaaataagtattggcaagaagtccgttagcgaccaggacaactacatcccttgcaccctggagcctgtgtttggtaagatgttcgaattgacatgtacactccctctggagaaggacctgaagataactctgtacgattatgatcttcttagcaaagacgagaagattggcgaaactgtagtggatttggagaaccgcctgctgtccaaattcggtgcccgctgcggtctgccccaaacctattgcgttagtggaccgaaccaatggcgcgaccagctcagaccttcccagctgctgcatctgttttgccagcagcacagagtgaaggcacccgtataccgcaccgacagggtaatgtttcaggataaagaatacagcatagaggaaatcgaggcaggtaggattccgaatccccatctcggccccgtggaggagaggctggccctgcatgtgctccagcagcaaggtctggtgccagagcatgtcgagagccgcccactctactcccccctgcagcctgacatagagcagggcaagttgcaaatgtgggttgacttgttccctaaggcgttgggcagaccaggacctcccttcaatattaccccacgccgcgccaggcgcttcttcctgagatgcatcatttggaatacacgcgatgtaattcttgacgacctgagcttgacaggcgagaagatgtccgacatatatgtcaagggatggatgatcggttttgaggagcacaagcagaaaacggacgtgcactataggtcactgggcggcgagggcaacttcaactggaggtttattttcccatttgattatctcccagctgaacaggtatgcacaatcgctaagaaggatgcgttctggagattggataaaactgaatccaaaatccccgctcgcgtggtgtttcaaatctgggataacgacaagttctctttcgacgattttctgggctccctccaactggatctcaataggatgccaaagcctgctaagaccgcaaagaaatgttcactggatcaactggacgacgccttccatcctgagtggttcgtttccctttttgaacagaaaacggtgaaaggctggtggccatgtgtagcagaggaaggagagaagaagatattggctggaaaactcgagatgaccttggaaatcgtggcagagagcgagcatgaggaacgcccagctggtcaaggtagagatgagcccaatatgaatcccaagttggaggatcctagaaggccagacacctcattcctgtggttcacctctccgtacaagacgatgaagttcattctgtggcgccgcttccgctgggccattatcttgtttattatcttgtttatcttgctcctcttcctggctatctttatctatgccttccccaattacgctgctatgaaattggtaaagccctttagt

SEQ ID NO: 10624 - DNA, 6243 bp, Artificial Sequence
  Description of Artificial Sequence: Synthetic coding sequence
atgctttgctgcctgctggtcagagctagtaacctgccctccgcaaagaaggacagacgaagtgaccctgtcgcctcactgacttttaggggggtcaaaaagcgaacaaaagtcataaagaattcagttaatccagtctggaacgagggatttgaatgggatctcaagggcatccctctggatcagggtagcgagctccacgtggtggtgaaagatcacgagaccatgggtaggaacaggtttctgggagaagctaaagtccctctgcgagaggtcctggctaccccatcgctgagcgcttcattcaatgcccccttactggataccaagaagcaaccaacaggcgcctcacttgttctgcaggtaagctatactcctttgcccggggcggtgcctttattcccaccccccacccccctcgagccttcccctacactgcccgacctcgacgtcgtagccgacactggcggcgaagaagacacggaggaccagggactcacaggggatgaggcagaaccttttctggatcagagcggcgggcccggagcgcccacaacaccccgaaagttgcccagtcgacccccaccacactaccccggcataaaaaggaagcgctccgcaccaacctctaggaaactgctcagcgacaaacctcaagatttccagatccgagtccaagtcatcgaaggacgtcagctgcccggcgtcaatattaaacccgtggtgaaggtgactgcggccggccagactaaacgcacaaggatccacaagggaaatagccctctgtttaacgagaccctgtttttcaacctttttgattctcctggcgaactgtttgatgagcctatcttcataacagttgtagactctaggagtctgagaaccgacgcattgctgggggagtttagaatggatgtgggaacgatctaccgagagcctcgacatgcttatcttcgcaagtggctactgctgtccgaccctgatgacttttctgcaggagccagaggttatctgaaaacctccttgtgcgttctgggtcccggtgatgaggcgcccttagagaggaaagatccctccgaagataaggaggatatcgaatcaaatcttcttaggcctaccggagtcgctctccgaggggctcacttttgtcttaaggttttccgagccgaggatttgccccagatggatgacgctgtcatggataacgtaaagcagatcttcgggtttgaaagcaataagaaaaacctagttgatccttttgtggaggtctctttcgctgggaagatgttatgttccaagatccttgagaaaacggcaaatcctcagtggaaccagaacatcaccctgcccgccatgttcccttcgatgtgtgaaaaaatgcggatcagaattatagattgggatagactcactcacaacgatatcgtggccaccacgtaccttagtatgtcaaagatctccgctcccggtggggaaatcgaagaagagcctgcaggggcagtaaaaccatctaaggcatctgatctggatgactacctgggtttcctgccaacattcggaccatgctatatcaacctgtatgggtctccccgcgagtttacagggtttccggacccatacaccgaactcaatactggaaaaggcgaaggtgttgcttatagaggtagactgttactttccctggaaaccaagctcgtggaacattccgaacagaaagtggaagacctccccgcagatgatattctgagggttgaaaagtatctgagaaggcgtaagtattcgctgttcgccgccttctattcagcaactatgttgcaggacgttgacgatgccatccagttcgaggtttcgatcgggaattacggaaataagttcgacatgacctgcttgcccctcgctagcaccacccagtactcccgggctgtgttcgatggatgccattattattaccttccatggggaaacgtcaagcctgtggtcgttttgtcttcctactgggaagatatttctcacagaatcgaaactcagaaccagctcttgggcattgccgatcgtttggaggctggtttggaacaggtgcacctcgctctgaaggcccagtgctctacagaggacgtggactctctcgtggcacagcttacagacgaactgatcgctggctgctcgcagcctctaggcgatatccacgaaaccccttccgccactcacctggatcagtacctctaccaactccgaacccaccacctgtcccagattactgaggccgctctagcgctcaagctggggcacagcgagctaccggccgcactggagcaggctgaggattggctgctaagattgcgagcattggctgaagagccccagaacagtctgcccgacatcgtcatctggatgctgcagggggataaaagagtcgcatatcaacgagtccccgcacatcaagtgctgttctcacgacgaggcgccaattattgcggtaagaattgtggtaaactccagaccatcttcctcaaataccctatggagaaggtccccggcgcaaggatgccagtccagatcagagtgaagttgtggttcgggctgtccgtagacgagaaggaattcaaccaatttgctgagggcaaactcagtgtgttcgccgagacatacgaaaatgaaacaaaattggcgctcgtgggcaattgggggaccactgggttgacctaccctaagttttctgatgtgaccggaaagattaagctgccaaaagacagtttccgaccctccgcggggtggacgtgggcgggggattggttcgtttgccccgagaaaacacttcttcacgatatggatgcagggcacctgagttttgtcgaggaggtgtttgaaaaccagacacgactgccagggggacagtggatctatatgtccgacaactacaccgacgtgaacggggagaaggtgctgccaaaagatgatatcgagtgcccgctggggtggaagtgggaagacgaagagtggtctaccgacttgaacagggcggtcgacgagcagggatgggaatattctatcaccattcccccagaaaggaagcccaagcactgggtccccgctgaaaaaatgtactatacccataggcggcgcagatgggtaaggctgcgacgccgagatctgtcccagatggaagcactgaagagacaccgccaagcagaggcagaaggcgaaggatgggaatatgcaagtctttttggatggaaatttcacctggagtaccgaaaaacagatgccttccgtcgaagacgatggcgaaggaggatggaacctttggaaaagacaggcccagccgcggtctttgcactggagggggccttaggcggggtgatggatgacaagtccgaggattctatgtctgtatcaaccctttcctttggggtgaaccgtcccacaatctcttgcattttcgactacggcaaccggtatcatctccggtgttatatgtaccaggccagagatttggcagcaatggacaaagatagtttttccgatccgtatgcaatagtgagtttcctacatcagtcacagaaaacagtcgtggtcaagaatacccttaatccaacttgggatcagacactgattttctacgaaatcgagatttttggagaaccagccaccgttgccgagcaacccccttccatcgtcgtcgagctttatgatcatgacacctatggggcagacgagtttatgggccggtgcatttgtcagccttccctggagcggatgccacgactggcctggtttcctctgaccagggggtcccagccgtccggcgagcttcttgcttcatttgaactcattcaaagggagaagccggccattcaccatatcccaggctttgaggtccaggaaacatcgagaattctcgacgaatccgaagatactgatctcccataccctcctccacaacgagaggcaaatatatacatggtgccacagaacataaagccagcactccaaaggaccgccattgagattctggcttggggcctacgaaatatgaaatcttaccagctggccaatattagctctcccagcctcgtggtggagtgtgggggacagacagttcagtcttgtgttatccgcaacctccgaaagaatccaaactttgacatctgcacactgtttatggaagtgatgctgcccagagaggagttgtactgtcctcccatcaccgtcaaagtgatagacaatagacagttcgggaggaggcctgttgtgggccagtgcactatacgtagcctggaatctttcttgtgcgatccttattcagcagagagcccctctccgcagggcggacctgatgatgtatcgctgcttagccccggcgaggatgttttgatcgacatagatgacaaagagccacttatacctattcaagaggaggagttcatcgactggtggagcaagttcttcgctagtataggagagagggaaaagtgtggctcatacctggaaaaagactttgatacacttaaggtttatgacacgcagctggagaatgtggaggccttcgaaggtctctctgatttctgtaatacgttcaagctctacagggggaagacgcaggaggaaaccgaggacccttctgtgattggggagtttaagggcttatttaagatataccctctaccagaagaccctgccataccaatgcctccccgtcagtttcaccagctcgccgctcagggtccacaggaatgcctagtcagaatctacattgtccgcgcattcggattgcagccgaaagatcccaatggtaaatgcgatccttacattaagatctctattgggaaaaagagcgtgagcgaccaggacaactatattccttgtaccctggaacccgtgtttggaaagatgttcgaattgacctgcacattgcctctggaaaaggacctgaaaatcaccctgtatgattatgacttgctcagcaaggacgaaaaaattggggagacagtcgtggatctggaaaaccgtctgttgtctaagttcggcgctagatgcggactaccacagacgtactgcgtaagtggccctaatcagtggagagatcagctgagaccatcccagctgctccacctcttctgtcaacaacacagagtcaaggcacccgtttataggaccgatagagtcatgtttcaggacaaggagtacagtatagaggaaattgaggctggcagaatcccaaatcctcacctagggcccgtggaagaaaggctggccctgcacgtgctccaacagcaaggcttagtacccgagcatgtcgaaagtcgacctctatactcgccactgcagccagacatcgaacaggggaaactccagatgtgggttgatctcttccccaaagctttgggcaggcctggaccgccgtttaatataacccctcgacgggcacgacgattcttcttgaggtgcatcatttggaatactcgcgatgtaatcctggatgacctgtcactcacaggggaaaagatgagcgacatctacgtcaaaggttggatgattggattcgaggagcataaacagaagacggatgtgcattataggtccttggggggcgaaggcaacttcaattggcggttcatttttccgttcgactacctccccgctgaacaggtttgcacgatcgccaagaaagatgcattctggagattagacaagacagagtccaagatacctgcacgggtggtgttccagatctgggacaatgataaattctcctttgatgatttcctcggaagtctacagctcgatctcaaccgcatgccaaaacccgctaagacagccaagaagtgttccctggaccagctggatgacgcctttcatccagaatggttcgtgtctctgtttgagcagaaaacagtgaagggctggtggccatgcgtcgccgaggagggtgaaaagaagatcctggctggcaaactggagatgaccctggagatcgttgctgaatcggaacatgaggagcgacccgcgggccagggtagggatgaacctaatatgaatccaaagctggaggaccctagaaggccagatacatctttcttgtggtttacatccccatacaaaacaatgaagttcatcctgtggcggagattccgatgggctatcatcctcttcatcatcctctttattctgttgctattcctagcgatttttatatacgcatttcctaactacgcagcgatgaagctggtgaaacccttcagt

SEQ ID NO: 10625 - DNA, 6243 bp, Artificial Sequence
  Description of Artificial Sequence: Synthetic coding sequence
atgctgtgttgccttctagttagggcttccaaccttccttccgccaagaaagacagacgttctgatcctgtcgcatccctgacctttcgaggtgtgaaaaagcgcacaaaggtgataaagaactcggtaaacccggtttggaatgaggggtttgagtgggacctgaaggggattccactcgatcagggttctgagctgcacgtcgtggttaaagatcatgaaaccatgggtagaaatcgctttctgggggaggctaaagttcctttaagggaggtcctggccaccccctcactctcggcctcctttaatgcgcccctccttgacaccaaaaaacagccgactggtgccagcctggtccttcaagttagttacacacccctgcccggcgccgtgcccctgttcccccccccaacccccttggagccttcccccactctccccgatttagacgtcgtagcagacacaggcggggaagaggacactgaggaccagggccttacaggagatgaggccgagcccttccttgaccagagcgggggccctggcgccccgactacaccccgaaaattaccgagcagaccgcccccccactatcccggcattaaaaggaaacggtcagccccgacttccagaaagctactctccgataaacctcaggattttcagatcagagtgcaagtaatagagggccgtcaactacccggcgtgaacatcaaacctgtggttaaggttacagccgcggggcagactaagcgcacccgcatacacaagggcaactcaccactgttcaatgaaactctcttcttcaatctgttcgattcaccaggcgagttattcgatgagcccatctttatcaccgtggttgactctaggagccttcggactgatgctttgctgggggaatttcggatggatgtggggacaatttaccgcgaaccccgacacgcatatcttagaaaatggctcctgttgagtgatcccgacgacttcagcgctggagccagaggatatctaaagacttccctgtgtgttctgggcccgggggatgaagcccctctggagagaaaagacccatctgaagacaaagaagatatagaaagcaacctgctccgccccactggcgttgcactgcggggagcgcatttctgcctcaaagtatttagggctgaggacttgccccagatggacgatgcagtcatggacaacgtgaaacagatctttggattcgagagcaataagaagaacctggttgatccctttgtggaggtatcattcgcaggcaaaatgctttgtagcaagattctcgaaaagaccgctaatcctcagtggaatcaaaatatcaccttgcccgccatgtttcctagcatgtgtgaaaagatgaggatccggattatcgactgggatcggttgacacataatgatatcgtggccacgacctacctgtccatgtccaagatctctgcccctgggggcgagattgaagaggaacccgctggtgcagtgaaaccgtcgaaagcatcagacctcgacgattacctcggatttctccccacatttggtccttgctatattaatctgtatggctcccctagagaatttacgggtttccctgacccctacacagaactcaatacaggcaaaggggaaggcgtcgcgtatcgcgggcgactactgctctctctcgagacgaaactggtcgaacatagtgagcagaaggtagaggatctgcctgctgatgacatcctgcgtgtggagaaatacctgcggcggaggaagtactcattattcgccgccttctactccgccacgatgttgcaggacgtagatgatgctatacaatttgaagtgtctattggcaactacggcaacaaatttgacatgacatgcctgccacttgccagcactacgcagtattcaagggcagtctttgatggctgtcactactattacctaccatggggaaacgttaagcctgtggtggtgctgtcttcctactgggaggacatcagtcacaggattgaaactcagaatcagctgctgggcatcgcggaccgacttgaagccgggctcgagcaagtgcatctcgccctgaaagctcagtgttccacagaggatgtggacagcctcgtagcacagctgaccgatgaacttattgcaggctgctcccagcccctgggggatatccacgaaaccccatccgcaacgcatttagaccagtacctgtatcagctgaggactcatcatctgtcccagatcacagaagctgcactagccctaaagctcggacactccgagctaccagccgcattggaacaggccgaagactggcttctgcgcctgcgtgcattggccgaggagcctcaaaattcccttcctgatatcgttatctggatgttgcaaggggacaaacgtgtggcctaccagcgcgttcctgctcaccaggtcctattctctagacggggggccaattattgtggaaagaactgcggcaaactccagaccatctttctcaagtatcctatggagaaggttcccggcgcccgaatgcccgtgcagatcagagttaaactctggttcggacttagtgtcgacgaaaaggagttcaatcagtttgccgaggggaagttgagtgtcttcgcagaaacatatgagaacgagacgaaactcgccctggtagggaactgggggacaaccgggttgacctacccaaagttcagcgatgtgacaggcaaaatcaaattacccaaggactccttcaggccttcggccggttggacttgggcgggggactggttcgtgtgcccagaaaagaccttgctccacgacatggacgccggccaccttagcttcgtggaagaggtcttcgaaaaccagacgcgactgcccggtggccagtggatttacatgagcgataattatacagacgtcaatggggaaaaagtcctgcccaaagatgatatagagtgtccacttggctggaaatgggaagacgaagagtggtccacggatttgaacagagccgtggatgagcaggggtgggagtatagcatcacgattccccccgaacgtaaaccaaagcattgggtgccagcggagaagatgtattatacacaccgcagaaggcgttgggttagactgaggcgccgtgatctgtcccagatggaagctctcaagagacatcgccaggccgaggccgagggcgaggggtgggagtacgcgagtctcttcggttggaaattccatcttgagtacaggaagacggacgcatttaggagacgtcgctggagacggagaatggagcccctagagaaaacgggacctgccgcagtattcgccttggaaggcgcactaggaggcgtgatggatgataaatctgaggattccatgtccgtgtccaccctgtcctttggtgtcaacagaccgactatcagctgtatttttgactatgggaaccgatatcacctccgctgctatatgtaccaggccagggatctggcggcaatggacaaagacagcttcagcgatccatacgcaattgttagctttctgcaccagtcccaaaagaccgtagtcgtcaagaacacactgaaccccacgtgggaccagactttgatcttttatgaaatcgagatttttggcgagccggcaactgtcgccgagcagcctccgagcatagtggtggaactctatgatcatgatacttacggcgccgacgaattcatgggtaggtgcatttgtcagccttccttggaaagaatgccccgcctggcttggttcccgcttacgcggggctcccagccttcaggcgagttattggcctcgtttgagctcatacagcgagagaagcctgcgatccaccacatccccggctttgaagtgcaggagacatctcggatcctggatgaatcagaagacacagatcttccgtatcctcccccccagagggaagcaaatatttatatggtcccacaaaacattaaacccgcactccaaagaaccgcaattgagattctggcctggggtctgcggaacatgaaaagctaccaactggcaaacatatctagccccagccttgtcgtggaatgtggtgggcaaaccgttcagagctgtgtgattcgaaatctgaggaaaaatcccaacttcgatatttgcaccctgtttatggaggtgatgctcccgagagaagagctgtactgcccacccataaccgtgaaggtgattgacaaccgacagttcgggaggcggccagtggtagggcaatgtacaatccgcagtcttgagagtttcctgtgcgacccctacagcgccgagtcaccttcaccccagggtggtccggatgatgtgtctcttttgagtcccggcgaggatgtgctgatcgacatcgatgacaaagaacccctgattcctattcaggaagaggagttcattgactggtggagtaagttcttcgccagtattggcgagcgggagaaatgtggctcctatctggagaaggattttgatacattaaaagtttatgatacccaactagaaaacgttgaagctttcgaggggctgagcgacttttgcaacaccttcaaactttaccggggaaagacacaagaagagactgaggacccttctgttatcggggaatttaaggggctgttcaagatctatccgctgccagaagatcccgcgatccccatgcctcccagacagtttcaccagttagcggctcaggggccccaagagtgcctggtgcgcatctatatagtgcgtgcgtttggactgcagcctaaggaccccaatgggaaatgcgacccatatatcaaaatcagtattggcaagaagagcgtctctgatcaggacaattatataccatgcacactggagccagtttttggcaagatgtttgagctcacctgtaccctgccattggagaaggatctgaaaattactctttatgactatgatctcctttctaaagacgaaaagattggcgaaactgtagtcgatctggagaatagactgttgagtaagttcggagcgcggtgtggtttgcctcaaacgtactgtgtctctggacccaatcaatggcgcgaccaactgaggccgagtcaactgttgcacttattttgtcagcagcatcgcgtgaaggcgcctgtgtacaggaccgaccgggtgatgttccaggacaaagagtattctattgaagaaatcgaggctgggcgaataccaaaccctcacctaggcccggtggaggaacgactggctttgcatgtgttgcaacagcagggtctggttccagagcatgtggagtcccgccctttatacagtccattgcagccggacatagagcagggaaaattacagatgtgggtcgacttgtttcctaaggcactggggcggccaggtccaccctttaacattactccccgccgcgctagaaggttttttctgagatgcattatttggaatacgcgagacgtcattcttgatgatctgtctctaaccggcgaaaagatgtccgatatttacgtcaagggatggatgatcggttttgaggaacataagcaaaagaccgatgtacactatcgatctctggggggcgagggcaacttcaactggcggtttatctttcctttcgactatctcccggccgaacaagtgtgcaccattgcgaagaaggatgcattttggcgcctcgacaagaccgagtccaaaatcccagctcgagtggtctttcagatctgggacaatgacaaattttcctttgacgactttttgggttcccttcagttggatctgaaccggatgcccaagcccgctaaaaccgcaaaaaagtgctctctcgaccaactggacgatgccttccaccctgagtggttcgtgtctctgtttgagcagaaaacagtcaaggggtggtggccctgcgttgcagaggagggtgagaaaaaaattcttgccggcaagctggaaatgaccctggaaatcgtagccgaaagtgagcacgaagagcgccccgctggccagggacgggacgagccaaacatgaaccccaagctggaggatcctcgcaggccagatacttcatttctgtggtttacctccccctacaagacaatgaagtttattctctggcgccgatttcgatgggctatcattctattcattattctttttatcctcctcctttttttagccatcttcatctatgcttttccaaactacgccgctatgaagctggttaaacctttctcc

SEQ ID NO: 10626 - DNA, 6243 bp, Artificial Sequence
  Description of Artificial Sequence: Synthetic coding sequence
atgttgtgttgccttctggtgagggcaagcaatttgccgagcgcaaagaaggatcgtcgatcagacccggttgcgtccctcacgtttcgtggtgtcaaaaagagaacgaaggtgatcaaaaactccgtgaacccggtctggaacgagggattcgaatgggatctgaaggggataccacttgatcaaggctcggagcttcatgtcgtggtaaaggatcacgaaacgatgggacgtaaccggtttctgggcgaagcgaaggtgcctctgcgggaagtgctggcaactcctagcctgtccgcatcctttaatgcaccactgcttgatactaagaaacaacctactggagccagcctggtgctgcaagtgtcctacactccattgccaggcgcagtgccactgtttccaccgccaactcctctggaaccatcgcccactctcccagatctcgacgtggttgcagacacgggaggtgaagaggacaccgaagatcaaggactgaccggcgatgaggcagagccttttcttgatcaatcaggtgggcctggagcccctactaccccacgcaagctccccagcagacccccaccccattaccctggtattaagagaaagcggtccgcacctacctcaaggaaactgctgtcggacaagcctcaagattttcaaattcgtgtgcaggtgatcgaaggtagacaactcccaggagtgaacataaagccagtggtcaaagtgaccgcagcaggacagactaaacgtaccagaatacacaagggaaatagccctctctttaacgaaaccctctttttcaacctctttgacagcccgggagaacttttcgatgaacccatctttatcactgtggtcgacagccgatcgcttcgtaccgatgcccttctgggggagtttcggatggatgtgggcaccatttaccgggagccacgacacgcgtacctgcggaaatggcttctgctctcagacccggacgatttctcggcaggagcacgaggataccttaagacttcgctttgtgtgctcggacccggagatgaagcaccccttgaacgaaaggacccatcggaagataaggaagatatcgaatcgaacctgcttagacccacgggtgtcgcactcaggggagcacacttttgtctgaaggtgttccgcgctgaggacctccctcaaatggatgatgctgtcatggacaatgtaaagcaaatctttggttttgaatcaaataagaaaaacttggtcgatccctttgtggaagtgtcctttgcgggaaagatgctgtgttcaaagatccttgagaaaacggcgaatcctcaatggaaccagaacataactctgcctgcgatgttcccctcaatgtgtgaaaagatgcgaattaggattattgactgggatagacttacccataatgacatcgttgcgactacttacctctcaatgtccaagatatccgcgccaggtggggagattgaagaagagcccgccggggctgtgaaaccttcaaaggcatcagaccttgatgattaccttgggtttctgcccacctttggtccgtgctacatcaatctttacggttccccgcgggagtttactggattccctgacccttacaccgagctgaacactgggaagggagaaggggtcgcataccgggggagattgctgctttcgctcgaaactaagctcgtggagcattccgaacagaaggtggaagatttgccagcagatgatatcctgcgcgtcgaaaagtatctgaggcggcgtaagtactccctgtttgcagcattctacagcgcaaccatgctgcaggacgtggatgatgcaatccaattcgaagtgagcataggcaactacgggaacaaattcgacatgacctgcctcccactggcatcaaccactcaatactcaagggccgtgtttgacggatgtcactactactaccttccttggggaaacgtgaagcctgtggtcgtcttgtcatcatattgggaagatatcagccatcgtattgaaactcaaaatcagcttcttggaattgcagacagactcgaagcaggactggagcaggtgcatctcgcccttaaagcgcaatgttccaccgaggatgtggattccctggtggctcaacttaccgatgaactcattgcggggtgctcgcagcctctcggtgatattcacgagactcctagcgcgactcatcttgaccagtacctgtaccaactgcgaacccatcacctcagccagatcacggaagctgcactcgctctgaaactcggtcacagtgaacttccagccgccctggaacaggcggaggattggcttctcagacttcgcgctcttgcagaagaacctcagaactcattgccagacatcgtcatatggatgctgcaaggagataaaagagtggcgtaccaacgagtgcctgcacatcaggtgctctttagcagaagaggtgcaaattactgtgggaagaactgtgggaagctccagaccatcttcttgaaatacccaatggaaaaagtcccaggagcccgcatgccagtgcaaattagagtgaagctgtggttcggactgagcgtggatgaaaaggagtttaatcagtttgcagaagggaagctgtcagtgtttgcagaaacctacgaaaacgaaactaaactggcactcgtgggtaactggggaacgaccggcctgacgtaccccaagttttcagacgtgacgggcaagattaagttgccaaaggatagctttcggccatcggcaggttggacctgggccggtgattggtttgtgtgccctgagaaaacgcttcttcatgatatggacgcaggacatctcagctttgtggaagaagtctttgaaaaccaaacccggctccctggaggccagtggatctacatgagcgataactatactgatgtgaacggtgaaaaagtgcttcctaaagatgacattgagtgccctctcgggtggaaatgggaggacgaagaatggtcaaccgacctgaacagagccgtggatgagcaagggtgggaatatagcatcactattccaccagagcggaagccaaagcactgggtgccagccgagaagatgtactacacccaccggaggaggagatgggtgaggctgcgtcggagagatctttcgcaaatggaagcactgaaacgtcatcggcaagcggaagcagaaggcgaaggatgggagtatgcgtccctgtttggatggaaatttcatcttgaatacagaaaaaccgatgcatttcggagaagaagatggcggcggcgcatggagcctcttgaaaagaccggacctgcagccgtttttgcactggaaggcgcattgggaggagtcatggatgataaatccgaagattcaatgtcagtgagcactcttagctttggggtgaacagaccaactatttcctgcatctttgactatggaaataggtaccacctgagatgttacatgtaccaagcccgggatctggctgcaatggataaggattcgttctccgacccatacgccattgtgtcgtttctccatcaaagccaaaagacggtcgtggtcaagaacactctgaatcctacctgggatcagactctcattttctatgagattgagatctttggggaaccagcaactgtcgcagaacagcctccaagcatcgttgtggaattgtacgatcatgacacgtatggggcagatgaattcatgggaaggtgtatttgccaacccagccttgaaagaatgcctcgccttgcgtggtttccactgactagaggttcgcagcctagcggcgagctgctggcatcattcgagcttatccaaagagaaaagcctgccattcaccacatccctggatttgaagtgcaggagacgtcgagaatactggatgaatccgaggacactgacttgccatacccaccgccccaacgtgaggcaaatatctacatggtgccacaaaacattaagcctgcactccaaagaaccgcaatcgaaatcttggcatggggacttcggaacatgaaatcataccaactggcgaacataagctccccaagccttgtcgtggaatgtggaggccagactgtccaatcatgtgtgatcagaaaccttagaaagaaccccaactttgacatctgtaccctcttcatggaggtgatgttgcctcgcgaagaactttattgtccccctatcaccgtgaaagttattgataaccgccagttcggtcgcagacctgtcgtgggacaatgtaccatccgctccctcgaatcatttctttgtgatccctactcggctgagtcgccatcgcctcaaggaggtcctgacgacgtgtcacttctttcgcctggcgaagatgtgcttattgatattgacgataaggagcctttgataccgatccaagaagaggaattcattgattggtggtcgaagttcttcgcttccatcggagaaagagaaaagtgtggatcatacctcgagaaggattttgacacccttaaggtctacgacacccagctggaaaatgtcgaggcgttcgaaggtctttcggatttttgtaacacgtttaagctgtaccgaggtaagactcaggaggagactgaggacccctccgttattggggaattcaagggactctttaagatctaccctttgcctgaggatcctgccattcctatgccgccccggcaatttcaccagcttgccgcacaaggtcctcaggaatgcctggtgagaatatacattgtgcgcgcattcggtctgcagcccaaggacccaaatggtaaatgtgatccatacataaagatttctatcgggaaaaagtctgtttcagatcaggacaattacatcccttgtaccctcgaaccggtctttggtaagatgttcgaactgacctgtaccctgccgcttgaaaaggatctgaagataactctgtacgattacgatctgctttcgaaggatgaaaagatcggggaaaccgtggtggaccttgagaacagacttctgtcgaaattcggcgcaagatgtggactgcctcaaacctattgcgtctccggtccgaaccagtggcgagatcaattgcgtccatcgcagctgttgcaccttttctgtcaacagcatagagtgaaagccccggtgtacaggaccgatcgggtcatgtttcaagataaggagtatagcatagaagagattgaggctgggcgtattcctaacccacacctgggccctgtcgaggagaggctggccctgcatgtgcttcagcagcagggactcgtgcctgaacatgttgaatcgaggcctctctacagcccactccagcctgacattgaacaaggaaagctgcaaatgtgggttgaccttttccctaaagcacttggacggcccggcccgccgtttaacataactcccagaagagcgagacgcttttttcttcgctgcatcatttggaacacgagagatgtgatactggatgatctgtcactgaccggagaaaagatgtcggatatctacgtgaagggttggatgattggttttgaagaacacaagcaaaagaccgacgtgcattaccgttcgcttggtggagaagggaactttaactggagattcatattcccttttgactacctgcctgcggagcaggtgtgtactattgctaaaaaggatgcattttggcggcttgataaaaccgagtcaaaaatccctgcaagagtggtgttccagatctgggataacgataagttctcttttgacgactttctgggatctcttcagcttgatcttaaccgaatgcctaagccggcaaagactgccaagaagtgctccctggaccagcttgacgacgcatttcatccagaatggttcgtgtcgctcttcgagcaaaagactgtgaaagggtggtggccctgcgtggccgaagaaggagagaaaaagatcctggcgggtaagctggaaatgacccttgaaatcgtggctgaatccgaacatgaggagcgacccgctggtcaagggagagatgaacctaacatgaatccaaaacttgaggatcctcgtagacctgacacttccttcctttggttcaccagcccatacaagaccatgaagtttatcttgtggcggcggttcaggtgggcaatcattctgttcattattctcttcattctgctgctctttctcgcgattttcatatacgcatttccaaattacgcagcaatgaaactcgtcaagccttttagc

SEQ ID NO: 10627 - DNA, 6243 bp, Artificial Sequence
  Description of Artificial Sequence: Synthetic coding sequence
atgctgtgttgcctcctggtcagagcctccaacctgccgtctgcaaagaaggacagaagatcggacccagtggccagccttacctttagaggagtgaaaaaacggacgaaggtgataaagaacagcgtgaatccagtgtggaatgaaggatttgaatgggacctcaagggaatacctctcgaccagggaagcgagcttcatgtggtggtgaaggatcatgaaacgatgggccgaaacaggttcctgggagaagcaaaagtgcctcttagagaagtgttggcaaccccatctctcagcgcatccttcaacgcccctttgcttgacaccaagaaacagcctaccggagcaagccttgtccttcaggtgtcgtatactccgctgcctggcgctgtgcctctttttcccccacctacccctcttgaaccatcgcccactctcccagatctcgacgtggtggccgataccggaggagaagaagatactgaagatcaaggcctgactggcgatgaagcagaacctttccttgaccagtccggcgggcctggcgcgccaactaccccccgcaagctccctagcagaccaccaccacattatcctggcatcaagagaaagaggtcggccccaacgtcgcgtaagctgctcagcgataagcctcaagacttccagattagggtccaggtgattgaaggacgacagcttcctggagtgaacattaagcccgtggtgaaagtgaccgcagcaggacaaaccaagcgcactaggatccataagggaaactctccacttttcaatgaaactttgtttttcaatctgtttgactcccccggggaacttttcgatgaacctatattcattactgtcgtggatagcaggagcctcagaacggatgctttgcttggggagtttcgaatggatgtggggaccatctacagagagcctcgacacgcgtacttgcgaaagtggcttctgctgagcgatcccgacgacttttcggcaggggctcgaggttacctgaaaacgagcctctgcgtcctcggacctggagacgaagcccctcttgaaagaaaggacccttccgaggacaaggaggacattgaatcgaacctgctgcggcctaccggtgtcgcgctcagaggagcgcacttttgtctgaaggtgtttcgtgcagaagatctcccgcaaatggatgatgcagtgatggataatgttaaacagatctttggttttgagtccaacaagaaaaatcttgtggatccttttgtggaagtgagctttgctgggaagatgctttgcagcaaaatcctggagaaaaccgcaaatccacaatggaaccagaacataacgctccccgccatgtttccttcaatgtgtgaaaagatgcgcataagaattatcgattgggataggctgacccataatgatattgtggcaaccacctacctttcgatgtcgaagatttccgcaccaggcggagaaatagaggaggaacctgcaggcgcggtgaaaccctcgaaagcgtcagatctggatgactacctgggttttctgcctactttcggaccttgttacatcaatttgtacgggagcccgcgcgagtttaccggatttcccgatccctacactgagctcaacactggtaaaggagaaggagttgcgtacagaggcagattgctgctctcactggaaactaagctcgtggagcattccgagcaaaaggtcgaagatctcccagcagatgacattttgagggtcgagaagtacctccgcagacgcaagtactctttgtttgccgcattttactccgcgaccatgcttcaagacgtcgacgatgccatccagtttgaagtgagcattggaaactacggtaataagttcgatatgacttgccttccgcttgcatcaactacccaatattctcgcgcggtctttgatggctgtcattactactacctgccatgggggaatgtgaagccagtggtggttttgtcatcatactgggaggacatatcccatcgcattgagacgcaaaatcagctgctgggaattgctgatcgtcttgaggctggtcttgaacaagtgcatctggccctcaaggcacaatgttcaactgaagatgtagactccttggtggcgcaattgacggatgaactgatcgccgggtgttcccaacctcttggagacatacacgaaactccttcagcaactcatctggatcagtacttgtaccagcttcgcacccatcatctgtcccaaatcaccgaagccgctctggcgctgaagttgggtcactcggagcttccagcggcacttgaacaggcagaggattggttgctcagacttcgggcacttgcggaggaaccacaaaacagcctccctgatattgtgatctggatgttgcaaggagataagagagtcgcatatcaacgagtgcccgcgcatcaggtgcttttttcacgtaggggagcaaactactgtggcaagaattgtggaaaacttcagaccatttttcttaagtatcctatggaaaaagtccctggtgcccgcatgcctgtgcagattcgagtcaagctctggtttggactctcggttgatgagaaggagtttaaccaattcgctgaaggaaagctgtccgtgtttgctgaaacctacgaaaatgaaacgaagctcgcactcgtcggaaactggggaaccactggactcacctacccaaagttctcggatgtcaccggtaaaatcaagttgccaaaggactcgtttcggcctagcgcaggttggacctgggccggcgattggtttgtgtgtcccgaaaagaccctgctgcatgacatggacgccggtcaccttagctttgtcgaagaagtgtttgaaaaccagactcgactgcccggcgggcagtggatctacatgtcagataactacaccgatgtgaacggtgagaaggtcctgcccaaagatgatatcgaatgtccactgggctggaaatgggaggacgaggaatggagcaccgacctgaatagagcagtagatgaacaaggttgggaatactcaatcacgatacctccagaacgaaagccaaagcattgggtgccagcagaaaagatgtactacactcatcgtaggagacgttgggtcagactgcggagacgggatctttcgcaaatggaagccctgaagcggcaccggcaagcggaagcagagggtgaaggttgggagtacgcgtcgctgtttggatggaagttccatcttgaataccgtaaaaccgatgctttcaggaggcgtaggtggcggcgtaggatggagccactcgagaaaactggcccggcagcggtctttgcactggaaggtgcgctcggtggtgttatggacgataagtccgaagattcaatgagcgtctccactctgtccttcggagtgaaccgtccgactatcagctgtatctttgactacgggaacagataccatcttcggtgctacatgtatcaggccagggatcttgcagcaatggataaggacagcttctccgatccttacgcaatcgtctcgttcctgcaccaatcgcagaaaacggtggtcgtgaagaatactcttaaccctacctgggatcaaactctgatcttttacgagatagagatttttggcgagccagcgaccgttgccgaacaacccccttccatagtggtggaactttacgatcatgatacctacggcgcagatgagttcatgggtcgatgtatctgccagccttcgcttgaaagaatgcctcggctggcctggtttccgctcacccggggatcgcaaccttccggagaactcctggcatcctttgagttgatccaaagagagaagcccgctattcatcatataccgggtttcgaagtgcaggaaacctcccgcattcttgatgagtccgaagatactgacctgccttacccaccgccccagagagaagcaaacatctacatggtgccgcaaaacataaagcccgccctgcagcgcactgcgattgaaatactcgcctggggactccggaatatgaaatcgtaccagctggcaaatatctcatccccttcgctggtggtggagtgcggtggtcaaaccgttcaatcctgcgtgatccgcaatctccgcaagaatcctaactttgatatttgtaccctcttcatggaagtgatgcttccacgtgaagaactttactgtccaccaattactgtgaaagtcatcgataataggcaattcgggagacgccctgttgttggtcaatgcaccattcgcagcctggaatcatttctctgcgatccctactcggcagagtcaccatcccctcagggtgggccagatgatgtgtcgctcctttccccaggtgaggatgtcctcattgacatcgatgacaaagagcccctgatccctattcaagaagaggaattcattgattggtggagcaagtttttcgcatccatcggtgaacgcgaaaagtgtggatcctacctggaaaaggacttcgatacccttaaagtgtatgacacccaactcgagaacgtggaagccttcgaaggactcagcgatttttgtaacaccttcaaactgtaccggggaaagactcaagaagaaactgaggacccctcagtgatcggtgagtttaagggtttgtttaagatctaccctctccctgaagatcctgccattccaatgcctccacggcaatttcatcaactggcagctcaagggcctcaagagtgccttgtcaggatttacatagtacgggcctttggcctgcagccgaaggatcctaatggtaagtgtgatccttacattaagatctcgatcggcaagaaaagcgtctccgaccaagataactacatcccatgtactctggagcctgtgttcggcaaaatgttcgaactgacctgcaccctccctcttgagaaggacctcaagattaccctgtacgactatgacctgctgtccaaggatgaaaagatcggagaaaccgtggtggacctcgaaaaccgccttctttcaaaattcggagctcgatgtggtttgccccaaacttattgtgtctcgggaccgaaccagtggagagatcagcttagaccatcccagctcctccatcttttttgccaacaacacagagtgaaggcacccgtgtaccggaccgatagagtgatgtttcaagataaggaatacagcatagaagagattgaagcaggaagaatcccaaaccctcatctgggtcctgtggaagaacgcctggcacttcatgtgctgcaacagcagggccttgtgccagaacatgtggagtcgcggcctctgtactcgcctcttcagcctgatatagaacagggtaagctccaaatgtgggtggatttgttccccaaggcgcttggacgtccaggaccaccttttaacattactccaagacgcgcacgtaggttttttctccggtgtataatctggaacacgagggatgtcatcctggacgatctgtccctgaccggcgaaaagatgtcagacatctacgtgaagggatggatgattggatttgaggagcacaaacagaaaaccgatgtgcactaccgctcgctggggggagagggaaatttcaattggagattcatttttccttttgattacctgcctgcagagcaggtgtgtaccatcgccaaaaaggatgccttctggagacttgataagaccgaatctaagattcctgcccgggtggtattccaaatctgggacaacgataagttctcatttgatgatttcctcggatccctccaacttgatctgaaccgaatgcccaaaccagcaaagaccgccaagaagtgctcactcgatcagctggatgatgccttccatccagagtggttcgtgtccctcttcgaacaaaagacggtcaaaggatggtggccgtgcgtcgcagaggagggggaaaagaagattctggcaggaaagttggaaatgaccctggaaatagtggcagaatcagaacacgaagaacgacctgcagggcaaggacgtgatgaaccaaacatgaacccaaaactggaggatccacgaaggccagatacttcattcctctggttcacctcaccctacaaaaccatgaagtttatcctgtggcgacgatttagatgggctattatccttttcataatccttttcattctgctgctgttcctggctatcttcatatacgcattccccaattacgcagccatgaagctggtgaaacctttttcg

SEQ ID NO: 10628 - DNA, 6243 bp, Artificial Sequence
  Description of Artificial Sequence: Synthetic coding sequence
atgctgtgttgtctgctggtccgggcgagcaatcttccctccgcaaaaaaagatcgtaggagcgatcctgtcgcatccctcactttcaggggggttaagaaaagaacgaaggtcattaaaaatagcgtcaacccagtctggaacgaagggttcgagtgggatttgaaaggcatccccctggaccagggaagcgagttgcacgttgtagtgaaagaccatgaaacgatgggtcggaacaggtttttaggagaggcaaaggtgcccctgcgggaggtactcgcgaccccttcactcagcgctagttttaatgctccccttctcgataccaaaaaacagcccactggggccagcttagtgttgcaggtgagttacacacctttgccaggagctgtgcctctgttccctccccctactcctctggagccatctcctacattgcctgatctcgatgtcgtcgccgacaccggtggcgaggaagacacagaagaccagggcctgaccggtgatgaggcggagccgttcctcgatcaatccggcggtccaggcgccccaacaactcctcgcaaattgccgtccagaccaccgcctcactatcctggcattaagcggaagcgatcggcacccactagtaggaagttactgtcggataagccacaggattttcagatccgcgtgcaagtgattgaaggtaggcaattgcctggcgtcaatatcaaacctgtcgtgaaagtaacagcagccggtcagactaagcgaacacgtatccataaggggaactctcctttgttcaacgaaaccctcttcttcaatctgttcgacagccccggcgagctgttcgatgagccaatattcatcacagtggtcgattcaagatccctcagaaccgacgctctgctgggcgaattccgtatggacgtgggaactatctacagggaacccagacatgcgtacctgcgaaaatggctgctgctgtccgacccggatgacttcagcgccggcgccaggggctatcttaaaaccagcctttgcgtccttggaccaggtgacgaggccccgttggagagaaaggatccatcagaggacaaagaggatatagaaagcaatctgctcagaccaacaggggtggcactgaggggcgcccacttctgccttaaagtcttcagggctgaagacctgcctcagatggatgatgcggttatggacaacgtaaagcagatcttcgggttcgagtctaacaaaaaaaatctggtagacccgttcgtggaggtctcctttgccgggaaaatgctgtgctcaaagatccttgaaaaaactgccaatccccaatggaaccaaaacataactcttcccgcaatgtttcccagcatgtgcgagaagatgaggatccgcatcatcgactgggataggctgacccacaacgacatcgtagctacgacttatttgtctatgtcaaagatttctgctcccggtggagaaatagaggaggagccagctggcgccgttaaaccctccaaggcatcagatctggacgattacctgggttttttgcctactttcggtccttgttacattaatttgtatggcagtccacgtgagtttacagggttccccgatccttacactgagttgaatacgggcaagggagagggggtggcataccggggacggcttttgctgagtctcgaaaccaagctagttgagcactccgaacagaaagtggaagatctccccgccgacgacatacttcgcgtggagaaatatctgcgaagacggaaatactcactattcgcagccttttatagcgcaaccatgctgcaggacgtggatgacgcgatacagtttgaggtgagtatcggtaactacggaaacaaattcgacatgacctgcctgccgttggcctccacgacccagtacagcagagccgtcttcgacggatgccactattactatcttccctggggaaatgttaagcccgttgtagttttgtcctcctactgggaagacatctctcatcgaattgagacccagaaccaactcctgggaattgccgatcggctcgaagctggcctggagcaagtgcacctggccctgaaggcgcaatgtagtactgaggacgttgactccctcgtggctcaactgacagatgaactgatcgcgggttgttcccagccactaggggatatacatgaaacaccctcagcaacccatcttgaccagtatctgtatcaactgcgtacacaccacctgtcacagataaccgaggccgccctggcactgaagctggggcactctgagttgcctgccgcactcgaacaggccgaggattggcttctgaggttgagggctctggctgaggaaccccaaaatagtttaccagatattgttatttggatgctacagggggacaagcgtgtggcataccagcgggtgcccgcgcatcaggttctcttttcccgccgcggggcaaattactgcggaaagaattgtggaaaactccagaccatttttcttaagtatcctatggaaaaagtcccgggtgctaggatgccagtacaaatccgggtgaaactctggttcgggctgagcgtagacgagaaggagttcaaccagtttgccgagggaaagttgagcgtttttgcggagacctatgaaaacgagaccaagctagccttggtgggcaattggggtaccacaggtttgacgtaccccaaatttagtgatgtgaccggaaagatcaaactgccgaaggatagcttcaggccatcagcagggtggacgtgggccggagactggttcgtatgtcccgagaagacactgctgcacgatatggacgctggacacctgtctttcgtcgaagaagtgtttgaaaatcagacacggcttcctggagggcagtggatttatatgagtgataactatacggacgtgaatggggagaaagtcctcccgaaagacgatattgagtgccctttaggatggaagtgggaagacgaggaatggagcaccgatctgaaccgggccgtggatgagcaaggctgggaatactcgattaccatcccacctgagcgaaaacctaagcactgggtgcctgcagagaaaatgtactacacccacagacgcagacgctgggtgcgccttagaaggcgagacctatctcagatggaggccctcaaaagacaccggcaagcagaggcggagggggagggatgggaatacgcttctctctttggttggaaatttcacctagagtataggaagaccgatgcattcagaaggagacgctggcggcggcgaatggagccactcgagaagaccgggccagcagctgtttttgcgctggagggggcgctcggaggagtgatggatgataagtcagaggacagtatgtccgtcagtaccctgtccttcggtgtcaacagacctactatatcatgcatcttcgattacggcaataggtaccacctgcgatgctacatgtatcaggcgagggaccttgcagcaatggacaaagatagctttagcgacccatatgctattgtgtctttccttcaccagtcacagaaaaccgtcgtggtaaaaaacacgttgaaccccacatgggaccaaaccctgatcttttacgagatagaaatcttcggggagcccgccaccgtggctgaacagcccccctctatcgttgtggagctctacgatcacgatacatacggggctgacgaattcatggggcgttgtatatgccagccttcactggagcgaatgcctcggttagcttggttcccactgactaggggctcccagccatccggagaacttctggcaagcttcgaactaatccaaagggaaaaaccagccatccaccatatccccggtttcgaagtgcaggagactagcagaattcttgatgagtcggaggacaccgacctcccctaccctcctccccagcgggaagccaacatctatatggtcccgcagaatattaagcccgctctgcagcgcacagcaatagagatcctggcctgggggctgcgcaatatgaagtcctatcagctagccaatatctcatccccctcactagtagtagagtgcggcgggcagaccgtgcagtcgtgtgtaatacggaacctgcgaaagaatcctaattttgatatctgtactttgtttatggaggtcatgctgccgcgagaggagctgtactgtcctcctatcacagtgaaagtaattgataaccgccagtttgggcgaaggcccgtggtgggacagtgcacaattagatccctcgagagtttcttatgtgatccttactcagccgagagcccatcaccgcagggaggccctgatgacgtcagtttgctttccccgggcgaggatgtgctcattgacatagacgataaggagcctcttatacctatccaagaagaagagtttattgactggtggagcaagttcttcgcgtcaattggcgaaagagagaaatgcggcagctatctggaaaaagatttcgatacccttaaggtctacgatacacaactcgaaaacgtcgaggccttcgaaggactgtccgatttttgcaacactttcaagctttacagggggaagacgcaggaggagacggaagatcccagcgttatcggagagttcaagggcttgtttaagatctatcctttacctgaggacccggccatcccaatgccgcctcggcagtttcatcaattggcagcccagggccctcaggaatgcctggttcggatctacatagtcagagcatttggtctgcagcccaaagaccctaacggcaagtgtgatccctatattaagatctcaattggaaagaaaagcgtctccgatcaggacaactacatcccctgcacacttgaacctgtgtttggaaaaatgttcgaattgacatgcacacttcccctggaaaaagatctgaaaattacgttgtacgactatgacctgctgagtaaagacgagaagatcggggagaccgtcgtcgatctggagaaccgcctgctatcaaaattcggtgccaggtgcgggctgccacagacctactgcgtatccggacctaatcaatggcgagaccaactaaggccatctcagctgttacatcttttctgccagcagcaccgggtgaaggctcctgtttatcgtacagacagggtgatgtttcaagacaaggaatatagtattgaggagatcgaggccggcagaatacctaacccccatctcggccccgtagaggagaggttggctttgcacgtgctgcaacagcaaggattggttccagaacacgtcgaatcccgcccgctgtactctcctctgcagcctgacatagaacaagggaagctgcagatgtgggtggatctgtttcccaaagctctgggcagacctggaccacccttcaatatcacgccccggagggctcgccggttttttctgaggtgcattatctggaatacaagggacgttattctagacgacttgtcactgacaggcgagaagatgagtgatatatatgtgaaaggttggatgattggtttcgaggagcacaagcagaagacagatgtacactacagatccttgggtggtgaaggcaacttcaactggcggttcatcttccccttcgactatctgcccgctgagcaggtgtgcaccatcgcaaaaaaagatgccttttggaggctagacaagacagagtccaaaattccagcacgcgtcgtttttcagatatgggataatgataagtttagctttgacgactttctcggaagtctgcaactcgatctaaatcggatgcctaaacccgccaaaacagccaagaaatgctccctggatcagctagatgacgctttccaccctgaatggtttgtgtccctatttgaacagaaaactgttaaaggctggtggccctgtgtcgctgaggaaggagagaagaagatcctggccgggaaattagagatgaccttggaaatagtagcggagtctgaacacgaggagcgacctgcgggacagggccgtgacgaacccaatatgaacccgaagctggaagatcctcgcagacctgatacatccttcttgtggttcacttctccttacaagactatgaaattcatactttggaggcgttttaggtgggcaattatactgttcattattctttttatcctgcttttgttcctggcaatattcatctatgctttccccaattacgcagccatgaaactggtcaagcccttcagc

SEQ ID NO: 10629 - DNA, 6243 bp, Artificial Sequence
  Description of Artificial Sequence: Synthetic coding sequence
atgctgtgttgtctgttggtgcgagcatccaacttgccttcagccaagaaagatcgcaggtccgaccctgtggctagtttgactttcagaggggtaaaaaaacggactaaggtgatcaaaaattctgtgaatccggtgtggaatgaaggcttcgaatgggacctcaagggaattccccttgatcagggttctgagctgcacgtggttgtgaaagatcacgagacaatgggaaggaaccgcttcctcggcgaggccaaggtgcccctgcgcgaggtcttagcgacaccatctttatctgccagctttaacgccccactgctggacacaaagaagcagcctacaggagcttctctggtactgcaagtgagctatacacctctccccggagccgtacccctgttccccccccctacccccctggaaccttcacccacacttcctgatcttgatgtggtcgccgacacgggtggggaagaggacaccgaggaccagggcctaactggggatgaggccgaacccttccttgaccagagcggggggccaggcgcaccgactacccctaggaagctgccctcccgtccccctccccactatcctggtatcaagcgcaagcgctcagcacctacatcccgcaaacttctgagtgacaagccccaggatttccagatcagggttcaggtcattgagggtcgtcagttgcccggagttaatatcaagcccgtcgtgaaagttaccgccgctggacaaaccaaaagaacccgaattcacaagggaaattcacctctgtttaatgaaaccttgttctttaacttgttcgatagcccgggcgagttgtttgacgagcctatctttatcactgtcgtcgacagccgctctctgcgcactgacgcattgctcggcgagtttaggatggatgttggtaccatttaccgggagccaaggcacgcatatctgcgcaagtggctcctcctgtctgaccccgacgacttttccgccggagcacggggttacctcaaaacttccctatgtgttttggggcctggcgatgaggcccctctcgagcgcaaggatcccagtgaggacaaggaagatatagaatcaaatcttctgagaccgactggggtggccctgcggggtgcacatttctgcctaaaggtgtttcgcgcagaggaccttccccagatggacgatgcggtaatggataacgtgaaacagattttcggattcgaatccaataaaaagaacctcgtggatccttttgtggaagtgagttttgctggcaagatgctgtgcagtaagatcctagaaaagacagctaatccacagtggaaccagaacattacactacccgcaatgttcccctctatgtgcgagaaaatgaggatacgcatcatcgactgggataggctgacgcacaacgatatagtggcgacaacctacctgtctatgagcaaaatttccgcccctggaggggagattgaagaggaaccagctggagctgtgaagcccagtaaagcatcagatctggacgactatctgggtttcttgcccactttcggcccatgctacatcaatctgtatggatctcctagagagtttactggattcccagatccatacaccgaactcaatacgggcaagggcgagggtgtcgcctacaggggtcgattgctcctctctctggaaactaaacttgtagaacattccgagcagaaggtggaagacctgcctgccgatgatattctccgggtggagaagtacttacgcaggcggaaatatagcctttttgccgcgttctatagcgctacaatgttgcaggacgttgatgacgccatacagttcgaagtgagcatcggaaattatggaaataaattcgacatgacttgtcttccactggcttccaccacccaatattcccgcgctgtctttgacggttgccactattactatctgccatggggcaatgtgaagccggtggtggtactgtcgtcctactgggaggatatcagccacagaattgaaactcagaatcaactactgggtatagccgatcgtctcgaggcaggcttggagcaggtgcacctcgccttgaaggcccagtgttcaactgaggatgtggacagcctggttgcccagctcaccgatgaactgatcgcagggtgtagccaacccctgggcgatattcatgaaaccccatccgccacacaccttgaccaatatctctaccaactcaggacccaccatctgtcgcaaattactgaggccgccctggcactaaagttaggtcacagtgagctgccagcagcacttgaacaggctgaggattggctactccggcttcgagcgctcgcagaagagccacagaattcgctccctgatattgtgatctggatgctccagggggataagagggtggcctaccagagggtcccagcacaccaggtcctgttcagccggcggggagcaaattactgtggcaagaattgtggtaagctacagacaattttccttaaatatcccatggaaaaggtgccaggggctcgaatgccagtgcagataagagtgaaactgtggtttggattgtccgtggacgagaaagagttcaaccaatttgccgaggggaaactttccgtttttgccgagacatatgagaatgaaaccaaactggccctcgtggggaattgggggacaaccggactgacctaccctaagttctccgatgtgacaggaaagatcaagttgcctaaggatagctttcgcccgtctgctgggtggacctgggcgggcgattggtttgtttgtcccgaaaaaactttgctgcacgatatggatgcgggccacctgagcttcgtggaggaagtgtttgaaaaccaaacgcggctcccaggcggacagtggatctacatgtccgacaactatacagacgtgaatggtgagaaggtgctgcccaaagatgacatcgaatgtcctctggggtggaagtgggaagatgaagaatggtccactgacctgaaccgggctgttgatgagcagggctgggagtacagcatcaccataccacctgagcgcaagcctaaacattgggtgccggctgaaaagatgtactacacccatcggcggagacgctgggtcaggttgcggcgtcgcgatcttagccagatggaagccttgaagcgtcaccggcaggccgaggccgagggggaagggtgggaatatgcttcccttttcggttggaagttccaccttgagtatcggaagaccgacgcattccgtcgacggcgttggagacgcagaatggaaccactggagaagaccggtccagctgccgtctttgcgctagaaggcgcattggggggagtgatggacgataagagcgaagatagtatgagtgtgtccactttgagcttcggcgtgaataggccaaccatttcatgcatctttgattacggcaataggtatcacctcagatgttatatgtatcaagctagggacctcgccgctatggataaagattccttcagcgatccatatgcaatagtgagctttctgcaccagagccagaagacagtggtggtgaagaacaccttaaacccaacctgggaccagactctgatcttctatgagattgagatattcggcgagcctgcgactgtggctgaacagccccccagtattgttgtcgaactgtacgaccatgatacttacggcgcggatgagttcatgggtcggtgtatctgccagccctccctggaacggatgcccagacttgcttggtttcccctaacgcggggttcacaaccctctggtgagctgctggctagcttcgaactgatacagcgcgagaagcccgctatccatcacattccaggcttcgaggtgcaggaaaccagcaggatactggacgagtccgaagatacagatctgccgtaccctccccctcagcgagaagctaacatctatatggtgccccagaacatcaagcccgcgttgcagaggaccgctatcgagatcctggcatgggggctgcgaaacatgaagagctaccaacttgcaaacatctcgtccccgagtcttgtagtcgaatgtggcggacagaccgtgcagtcttgtgtcatcaggaacctcaggaagaatccaaactttgacatttgcactcttttcatggaagttatgttgccaagagaagaactgtattgcccccccattactgtgaaggtcatcgataatcggcaatttggcagacgacccgtggtcgggcaatgtaccatccgctccttggagtcattcctctgcgacccttattccgctgaaagcccctcccctcaagggggccccgacgatgtctcactgctatcaccaggcgaagatgttctcatcgatattgacgacaaagaacctttgatcccgatccaggaagaggagttcattgattggtggagcaagttctttgcatcgattggagaaagagaaaaatgcggatcataccttgaaaaagactttgacacactgaaggtctacgacacacaacttgagaacgtagaagcatttgagggcctatcagacttctgcaataccttcaaactgtacagagggaagacccaggaagaaaccgaggatccgagtgtgataggggaatttaaaggtctcttcaaaatctacccactcccggaggatcctgccatccccatgcccccacgacagtttcatcaacttgcagcgcagggcccccaagagtgcctcgtgcggatttacatcgttcgggctttcggcctgcaaccgaaggatccaaacggtaaatgtgacccttatataaaaatcagcattggtaaaaagagtgtctccgatcaggacaattatatcccctgtacgttggagccagtgtttggaaaaatgtttgaattaacctgtacccttcccttagagaaagatctgaaaattacactgtacgactatgacttattgtctaaggacgaaaaaattggagaaactgttgtagatctcgagaatcggctcctttcaaaattcggggccagatgcggtctaccacagacgtactgcgtctcaggacctaaccaatggcgggaccaactcagacccagtcaactgctgcatctcttttgccagcagcaccgggtgaaagcccctgtctatcgaacagatcgggtgatgtttcaggataaagagtacagcatcgaggagattgaggcagggaggatacccaatccacacttaggaccagtggaagaacgcctggccctgcatgtgttgcagcaacagggcttagttcccgaacacgtagagtcgagacctctctactcccccctgcagcccgacattgagcagggtaagctgcaaatgtgggtggatctcttcccgaaggcgctgggtcggcctggccccccattcaacattaccccgagacgcgcacgacggttctttctccggtgcatcatctggaatactcgcgatgtaattctggacgacctctccctcaccggtgaaaaaatgtccgatatttacgtcaaaggttggatgatagggtttgaggaacataagcagaaaacagacgtacattacaggtccctcggtggagaaggaaacttcaattggcgctttatcttcccttttgattatctgccagcggaacaggtttgcactatagctaagaaagacgcattttggcggttagataagaccgagagcaaaatacccgctagggtggtgtttcagatctgggacaacgataaattttcctttgatgacttccttggatctctccagcttgacctcaacaggatgccaaagcccgcgaaaaccgcgaagaagtgctccctcgaccagctcgatgatgcgttccacccagagtggttcgtgagcttgttcgagcagaagactgttaagggctggtggccctgcgttgctgaagaaggtgaaaaaaagattctcgctggcaagctggagatgacccttgagatagtggccgaatctgaacatgaggagagaccagctggacagggacgggatgaacccaacatgaatcctaagttagaggacccaagacggccagacaccagcttcctctggttcacatctccctacaagacgatgaaattcatcctgtggcgcaggtttagatgggctatcattctgttcataatactgtttattctcttattatttttggcaatattcatttatgcttttcctaactacgcggcaatgaaactggtgaagcctttctcc

SEQ ID NO: 10630 - DNA, 6243 bp, Artificial Sequence
  Description of Artificial Sequence: Synthetic coding sequence
atgctgtgctgtctcctcgtccgggctagcaatctccctagtgcaaaaaaggatcgacggtctgacccggttgcatccctcacgttcaggggggtgaaaaagcggaccaaggtcatcaagaactctgtaaatcctgtgtggaacgaggggttcgaatgggacctcaagggcattcccctcgatcaaggctctgaattgcacgtggtcgttaaggatcatgaaacaatgggcaggaatcggtttctgggagaggcaaaggtgccacttagggaagtactggcaacaccttcactgtcagcctcattcaacgcaccattgttggacacgaagaaacagccgactggagcatcccttgttcttcaagtctcttacacgcctttgcctggcgccgtgccactcttcccaccacctactccgctcgagccttccccaacacttcctgaccttgacgttgtcgccgatacaggtggcgaggaggatactgaggatcagggcttgaccggcgatgaggctgagcctttcctggatcaaagcggaggaccgggagctcctacaacacccaggaaacttccctcaaggcctcccccccattacccaggaatcaagcggaaaagatctgccccgaccagccgcaaactgctttccgataagcctcaggacttccaaatcagagtgcaggtaattgaagggcggcagctgcctggggtgaatataaagcctgtggtgaaggttactgctgccggccagacgaagaggacccggattcacaagggaaacagccccctctttaacgagacactgttttttaacctgtttgactcacctggcgagctgttcgacgagccaatttttatcaccgtggtggacagcagatcattgaggaccgacgccctgctcggcgagtttcgaatggacgtagggacgatctatcgggagcctaggcacgcgtacctgcggaagtggctgctgctcagcgatccggatgatttcagcgctggagcgcggggatatctcaagaccagcctctgtgtgctcgggccaggggacgaggctcctcttgagagaaaggacccatctgaggacaaggaggatatcgaaagcaacctgctgcgccctaccggggtggctctgagaggcgcacacttttgcctgaaggtgttcagggccgaggacctgccacagatggatgacgctgtaatggacaacgtaaagcagatctttggcttcgagtcaaataagaagaacctcgtcgatccatttgtggaggttagttttgctggcaagatgttgtgtagcaaaatcctcgaaaagacagccaatccccagtggaatcaaaacataaccctccctgctatgtttccctctatgtgtgaaaagatgagaatccggattatagattgggacagacttactcacaacgatattgtggctaccacgtatctgagcatgagcaagataagtgcacccggcggggagatcgaggaggagcctgcaggggccgtcaagcccagtaaagcctccgaccttgatgattatcttggtttcctgcccacattcggcccatgctatataaatctgtatgggagccctagggaattcactggatttccagatccctatacagaactcaacacaggaaaaggggaaggcgttgcctaccgcggtcggctgcttctttctctggaaaccaaactggtggaacactccgaacagaaggtagaggacctcccagctgacgacatcctgagagttgagaagtatttgcggaggcgcaagtattccctcttcgctgccttctactctgcaacaatgctgcaggacgtggatgacgccatccagttcgaggtctctataggaaattacggcaataaatttgatatgacctgtctgccactcgcttctacaacacagtattcccgagccgtgttcgatgggtgtcactactattacttgccatgggggaacgttaagcccgtagtagtgctctcctcttactgggaagatatctcccatagaattgaaacgcaaaaccagttgctgggtattgctgatagactggaagccggtctggaacaggtgcacctcgccttgaaagctcagtgcagtactgaagatgttgactcccttgtggcccaactgacagatgaactgattgctggatgctctcaacctctgggggacattcacgagacgcccagtgccacgcaccttgaccagtacctctaccagctgcgaacccatcacttgtctcagattacagaagccgcccttgcgctgaagctgggccactctgagctcccagctgctttggagcaggccgaggattggctgctccgcttgagggccctggctgaagaaccccaaaatagtttgcctgatattgtcatatggatgctgcagggagacaaaagagtggcgtatcaacgggtgcccgcccaccaggtgctgttcagtcgccggggggcaaactactgtggaaaaaactgtgggaagctgcagactatctttctgaaataccccatggagaaagtccccggggcgcgcatgcctgtgcagattcgcgtgaagctctggttcggattgtctgtggacgagaaggaattcaaccagtttgcagagggaaagttgagcgtattcgctgaaacttacgagaacgagaccaaactcgccctcgttggcaattggggcaccaccgggcttacttatcccaagttttccgatgtgactggaaagataaaactcccaaaagactccttccggcccagcgcaggatggacgtgggctggagactggttcgtatgccctgagaaaacactgctccacgacatggatgccggtcacctctcattcgtcgaggaagtttttgagaaccaaacccgactccctgggggacagtggatctacatgagcgacaattacactgatgtgaacggggaaaaagtactgccaaaggacgacatcgagtgtccgctgggctggaaatgggaggatgaagagtggtccactgacctcaacagggccgtggacgagcagggctgggagtattcaatcactattccgcctgaacgcaaacctaaacactgggtcccagccgagaagatgtactacacccacaggcggcgccggtgggttaggctgcggaggagggacctgtctcagatggaggcactcaagaggcatcgacaagccgaggcagaaggcgaaggctgggagtatgccagccttttcggctggaaatttcatctcgaatacagaaaaaccgatgcctttcgaaggaggagatggcggcggcggatggagccgctcgaaaagaccggccccgccgccgtgttcgctctggagggggccctggggggcgtgatggacgacaagtccgaggacagcatgagcgtttcaactttgtcatttggcgtcaatcgacctactatttcttgtatctttgattatggaaacagatatcaccttaggtgttacatgtaccaggctagggacttggccgctatggacaaggatagtttctcagatccatatgcgatcgtgagctttctgcaccaatcccagaaaacagtcgtggttaagaataccctgaaccctacctgggaccagaccctgattttctatgaaattgaaattttcggggaaccagctactgtggcagagcaaccacccagcatagtggtggagctctatgatcatgacacttacggggccgatgagttcatgggtcggtgcatttgccagcccagccttgagcgcatgccgagactggcttggttcccattgacgcgaggatcccagccttccggcgagctgctcgcgtcttttgagcttatacaaagagaaaagcctgcaatccatcatatacctggatttgaagtgcaggaaacctccagaatcttggacgaatctgaagacactgatttgccttacccaccacctcagagagaagcaaacatctatatggtcccccagaacataaaaccagctctgcagcgcacggctattgagatccttgcttgggggctgcggaacatgaaatcttatcagctggcaaacatctcaagtcctagtctcgtcgttgaatgtggcggacagactgtacaaagctgtgtgattcgaaatttgagaaagaaccctaacttcgatatctgtacactgttcatggaagttatgctccctcgagaggaactgtattgcccccctataacggtgaaggtgatcgacaaccgccaattcggacgaaggcccgtcgtggggcagtgtaccatacgaagtctggagagcttcctttgcgacccatattcagcagagtctccttcaccgcagggggggcctgacgatgtatccctcctgtctcctggagaggacgtgctgatagacatcgatgacaaggagcccctgatcccaatccaggaggaagagtttatcgactggtggagcaagttcttcgcttctattggggagagggagaagtgcggcagctatctggagaaggactttgataccctgaaagtatatgatacccaactcgagaatgtggaggcctttgaggggctcagcgacttttgtaacaccttcaagctgtacagggggaagacacaggaagagacagaggaccctagcgtgataggggaattcaagggactctttaagatttaccccctcccagaggaccctgctatcccaatgccaccgcggcagttccatcaacttgcagcccaaggtccccaggagtgcttggtgcggatatacatcgttcgggcgttcgggctgcagcccaaggaccctaacggcaagtgcgatccctacattaaaatctccatcgggaagaaatccgtgtccgaccaggacaattatatcccgtgcacactcgagcctgtgtttggaaagatgtttgaactgacctgtactctgcccctggagaaggacctgaagatcactctttatgactacgatctcctttctaaggacgagaaaattggagaaaccgtggtagacctggagaaccgccttctcagcaaatttggcgctcggtgcggacttccccagacatattgtgtaagtgggcccaaccagtggagggaccagcttcgaccatcccaactcctgcaccttttctgccaacagcaccgggtaaaggcccctgtgtaccgcactgatcgggtgatgtttcaggataaggaatactccatcgaggaaatcgaggcaggcaggatcccaaaccctcacctcggccctgttgaggaaagactcgcactgcacgtactccaacagcagggtctggtccctgagcatgttgagagtcgccccctgtacagccccctgcagcctgacatcgaacaggggaagctgcaaatgtgggttgacctgttccctaaggccctcgggagaccagggccgccctttaacatcaccccacgaagggccagacgcttttttctgcggtgtatcatatggaacactcgggatgttatcctggatgatctgtccttgacaggagagaaaatgagcgatatctatgtcaaggggtggatgataggatttgaggaacataagcagaagaccgacgtgcactatcgaagcctgggcggggaaggaaatttcaactggagatttattttccctttcgactatctgcccgccgaacaagtgtgtactatcgcaaagaaagatgccttttggcgactggacaaaactgagagtaaaattccagcacgggtcgtttttcagatctgggataatgataaattctcctttgacgactttctgggttctctgcagctggatctgaatcgcatgcctaagcctgccaaaacagctaaaaagtgctctctggatcagctggatgacgcatttcaccccgaatggttcgttagtctgtttgagcagaagaccgtcaaaggctggtggccgtgtgttgcagaggaaggagagaagaaaatcctggctggcaaacttgagatgaccctggaaattgtcgcagagtctgagcacgaggagaggccagccggccagggccgggacgagccaaatatgaaccctaagctggaggacccacgcagacccgatacgtcttttctgtggtttaccagtccatataaaacaatgaaatttattctttggcgaaggttcaggtgggccatcatcttgttcatcatcctgttcatactgcttttgttcctggcaattttcatctatgcctttcccaactacgctgcgatgaagcttgtgaagcctttctcc

SEQ ID NO: 10631 - DNA, 6243 bp, Artificial Sequence
  Description of Artificial Sequence: Synthetic coding sequence
atgctgtgctgtttgctagttcgagcctccaacttgccatctgccaagaaagatcgccgcagcgaccccgtggcctccctgacgttccgcggggttaagaagcgcacgaaggttattaagaacagcgtgaacccggtgtggaatgaaggatttgaatgggatctgaagggtatccccctggatcaaggaagtgagttgcacgtggtggtgaaggatcatgaaaccatgggacgtaatcggtttctcggagaggcgaaggtgccacttcgcgaggtcctcgcaacccccagcctgtcggcctctttcaacgcgccgctcttggacactaagaagcaaccaaccggagcgtccttagtattgcaagtcagctatacaccattaccaggagctgtaccattgttccctccaccaacgccactggagccaagccccacattgccagatttggacgttgtggccgataccggcggcgaggaggatactgaggaccagggtttaactggtgatgaggccgagcccttcctcgaccaaagtggcggccctggcgcaccaaccacgcctcgcaaactgccgagccgcccgccgcctcactacccaggcatcaagagaaagcgtagcgcacccactagccgtaagctgctgagtgataagccacaggatttccaaatccgagttcaggtcatcgagggccgccagctgccgggtgtcaacatcaagccagtggttaaagtgactgccgctggacagaccaagagaactcgtattcacaagggaaacagtcccttatttaacgaaacgctctttttcaatttgttcgacagcccaggagagctgtttgatgagcctatttttatcacagtggtggatagccgatccctgcgcactgacgctttgctgggcgaattcagaatggatgtgggtaccatttaccgggaaccccggcatgcgtacttgcgtaagtggctgcttctaagtgaccctgatgatttcagtgccggtgcgcgcggctacctgaagacctcgttatgcgtgctgggaccgggcgacgaagctccgctcgagcggaaggacccgtcggaggataaggaggacatcgagtcgaatctcctgcggcccactggcgtcgctctgcgcggtgcccatttctgcttgaaggtgttccgggccgaggatttgccgcaaatggatgatgccgtgatggataacgtgaagcaaattttcggattcgagtcaaacaagaagaacctagtagatccatttgtggaggttagctttgctggaaagatgctatgctccaagatcctggaaaagaccgcgaatccccagtggaaccagaatattaccttgccggccatgtttccgtccatgtgtgagaaaatgaggatacgcatcatcgattgggatcgtcttacacacaacgatattgtcgccaccacttacttgtctatgtcgaagataagtgccccgggtggtgagatcgaggaagaacccgcgggcgcagtgaagccgtccaaggccagtgatctggacgattacttgggcttcctgccgactttcggtccgtgctacatcaacctgtatggaagccctcgcgagttcacagggttccctgatccctatacggaactcaataccggcaaaggagaaggagtggcctatcgtggtcgcctgctcctgtccctggagaccaagctcgtggagcactctgagcagaaagtggaggacctgccggcagatgatatcctgcgagttgagaagtatttgcggcgacgaaagtattccctgttcgctgctttctactccgcaaccatgctccaggacgtagatgatgcaattcagttcgaggtgtcaattggaaattacggaaataaattcgatatgacctgcttgccactagcaagcacgacacaatatagccgcgccgtgttcgacggctgtcactattattacctgccgtggggaaacgtgaaaccggtggtggtgctctcgtcctactgggaggatatcagccaccgcattgagacccagaaccaacttctaggcatagctgatcgtttggaggcgggcttggagcaagtgcacctggccctgaaagcccaatgcagcacggaagacgtggactcattggtggcccaacttacagacgagctgatcgcgggctgctcccaacccctgggagatatccatgagacaccctctgctacacacctggatcaatacttatatcagctcaggacccaccatctatcccaaattactgaggcggccctggccctgaagttgggccacagcgagttgccggcagccttagagcaagcggaagattggctgctgaggcttcgtgccctcgcagaggagccacagaacagcctgcccgatatcgtgatatggatgctgcagggagacaagagagttgcataccagagggtgccagcgcatcaggtgctgttcagccgccgcggagcaaattattgcggaaagaactgcggcaagttgcagacgatcttcctgaagtatccaatggaaaaagtgcccggcgcccgtatgcctgtgcagatccgcgttaagctatggttcggtctgagtgtggacgaaaaggaatttaatcagtttgccgagggtaagctgagcgtcttcgcggagacgtacgaaaatgagacgaaactggcgctggtaggaaattggggtacaaccggcctgacgtatccaaagttcagtgatgtcacaggtaagattaagcttcccaaggactcgttccgtccttcagcgggctggacatgggctggcgactggtttgtctgcccggagaagaccctcctgcatgatatggacgccggtcatctctccttcgtagaggaggtctttgagaaccagaccagattaccaggtggacagtggatctatatgagtgataattacacggacgtcaacggcgaaaaggtgcttccaaaggatgatattgagtgtccgctcggctggaaatgggaggatgaagagtggtcgaccgatttgaatcgggcggttgacgagcaggggtgggagtacagcatcacgattcccccagagcgcaagccgaagcactgggtgcccgctgagaaaatgtattatacacatcggcgtcgtcggtgggtgcgcctgcgccgtagggacctgtcgcaaatggaagctctgaagaggcatcggcaagctgaggccgagggtgaaggttgggagtatgcatcactgttcggttggaagttccacctggaataccgaaagaccgacgcttttaggcgaagaaggtggcgtcgccgaatggaaccgctcgagaaaactggcccggcggccgtgttcgccttggagggagctcttggaggtgtcatggatgataagtctgaggattcaatgtcggtctccacgctatcgtttggcgtcaaccgccccaccatctcctgtatatttgactatggcaaccggtatcatttacgttgctatatgtaccaagcgcgagacctagccgctatggacaaagattcgtttagcgatccctatgctatcgtctcgttcttacatcagagccaaaagactgttgtcgtcaagaataccctgaatcccacgtgggaccaaactttgattttttatgagattgagatctttggagagcccgccacagtggcagaacaaccgccttcaatcgtagtggaactgtatgatcacgacacgtacggcgccgacgagttcatgggccggtgcatatgccagcccagcctggagcgaatgcctcgtttggcatggtttcccctgacgaggggatcacagcccagtggcgaactgcttgccagctttgaactgatacagagggaaaagccagccatacatcatatcccaggttttgaggtgcaggagacgagccgcatcctggacgagagtgaggacactgacctgccgtatccgcctcctcagcgcgaagcgaacatctacatggtgccacagaatatcaagccggcactgcagcgcaccgcaatcgagattctggcatgggggttaaggaatatgaaatcctatcagctcgcaaatatctcctccccgagtctggtggtagagtgcggcggccaaacggtgcaatcttgcgtgatccgcaacctgcgaaagaatccgaactttgacatttgtacgttgttcatggaagtgatgctgcccagggaggagctctactgcccgcccataaccgtaaaggtgattgataatcggcagttcgggcgtaggcccgttgtcggtcagtgtactatcagatccctggaaagctttttgtgcgacccctactccgccgaatctccgagtccacaaggcggtcccgacgatgtctctctgttgagcccgggcgaggatgtcttaatagacatagatgataaggaaccgcttattccaatccaggaagaagagtttattgactggtggagtaaatttttcgccagcatcggcgaacgtgagaagtgcggatcatacctggaaaaggacttcgacaccctcaaggtctacgacacgcagctggaaaacgtcgaggcatttgaaggactgtctgatttctgcaatactttcaaattgtaccggggcaagacccaggaggaaacggaagatccctccgtgataggagaattcaaggggctcttcaaaatctacccactgcccgaggatccggcaattcctatgccgccgagacagttccaccagctcgccgcgcagggaccccaggagtgcctggtgcgaatctatattgtccgtgctttcgggcttcagcccaaagacccaaatggtaaatgtgatccctatattaagatcagcatcggcaaaaagtctgtctccgaccaagacaattacataccatgcaccctggagccggtgtttggcaagatgttcgaactaacgtgcaccctgccgttggagaaggatttgaagataacgctgtacgactacgatctactgtcgaaggacgagaagatcggagagaccgtagttgatctcgagaatcgtctactgtcgaagttcggcgcccggtgcggactgccgcagacatattgcgtatccggccccaaccagtggcgcgatcagctacgaccaagccaactgctccacttgttctgccagcagcaccgtgtgaaggcccccgtctatcgcacagaccgagtcatgttccaagataaagaatacagtatagaagagatcgaggccggacgcattccaaacccgcatctaggcccagtggaagagcgcctcgcgctgcatgtgttgcaacagcaaggtctcgtgccggaacatgtggaatcccgccctttgtactccccactgcagcccgacatcgagcagggtaagcttcagatgtgggtggatctatttcccaaggcgcttgggcgtccgggaccccccttcaacatcacaccgcgccgagcccgcaggttctttttacgatgtatcatttggaacacgcgcgatgttatcttggatgacttgtcgttgaccggtgagaagatgagcgacatttacgtaaagggatggatgattggcttcgaagaacacaagcagaagacagatgtccactacaggagtcttggaggtgaaggaaacttcaattggcggtttatctttcccttcgactatctgcctgctgagcaagtttgtacaattgctaagaaagatgccttttggcgcttggacaaaactgagagcaagattccagctcgtgtcgtcttccagatctgggataatgataagtttagtttcgatgactttttgggcagcttgcagctagatctcaaccgcatgccaaagccggctaaaacagccaagaaatgcagcctagaccagctggacgatgcctttcatcccgaatggttcgtgtctctgttcgaacagaaaacagtgaagggttggtggccgtgtgttgccgaagagggggagaagaagattctggctgggaaactcgaaatgaccctggagattgtagctgagtccgagcatgaagaacgacccgcgggccaaggacgtgacgaaccaaatatgaatcccaagttggaggatccgcgtcgccctgacaccagtttcctgtggttcacctcgccctacaaaaccatgaagttcatcctctggcgccgcttccgctgggccattatcctgtttataatcctgtttatcctattgttgtttctggccatctttatttacgccttcccgaattacgcagccatgaagctggttaagccgttctcc

SEQ ID NO: 10632 - DNA, 6243 bp, Artificial Sequence
  Description of Artificial Sequence: Synthetic coding sequence
atgctgtgttgtcttctggtgcgcgcgtctaacctgccgtcagcgaaaaaggatagacggagcgacccagttgcttccctgactttccgcggcgtgaagaaacgcacaaaagttatcaaaaacagcgttaacccggtctggaatgaaggattcgagtgggacctgaaaggcattcctctggaccaaggtagcgagctgcacgtggtcgtcaaggatcatgagaccatggggcgaaaccgctttctgggtgaggcgaaagttccactccgtgaggtcttggcgaccccttcgctgagcgccagctttaatgcaccactgctggacacgaaaaagcaaccgaccggtgcaagcttggtgctgcaagtgagctacactccgctgccgggcgcagttcctctttttccaccgcctaccccactggagccatcaccaaccctgcccgatctggacgttgtggcggatacgggcggggaggaggacaccgaggatcagggtctgacaggtgatgaagctgagccatttctggatcagagcggcggtccaggtgcccctacgacgcctaggaaactgccttcacgaccccctcctcattacccgggcataaaacgcaaacgtagcgcgccaacctccaggaagctgcttagcgataagccacaggactttcagattagagttcaagttatcgagggtcggcagctgccgggcgtgaacatcaagccagttgttaaggtgaccgccgccggtcagacgaagcgcactcgcatccacaaaggcaattccccgttgttcaacgagaccctgttctttaacctatttgacagcccaggcgagctcttcgatgaacctattttcatcactgttgttgattctcgctctttgcgcaccgatgcactgctgggcgaattccgaatggacgtcggaaccatctaccgggagccgcgccatgcgtatctgcggaaatggttattgctgagtgatccagatgacttctctgcaggcgctcgaggttacctaaaaacttcactgtgtgtgctggggccgggagacgaagcgccactggaacgcaaagatccgagcgaagacaaagaggatattgaatcaaacctgttgcgcccaactggcgttgctctgcgaggtgcgcacttttgtctgaaggtgtttcgcgctgaggatctcccgcagatggatgatgcggtaatggataatgtcaaacaaatttttgggtttgaaagcaataaaaaaaatctggtcgatccattcgtggaggtatccttcgcaggcaaaatgctgtgttctaagatactggagaaaaccgctaatccacagtggaaccagaacatcacgctgccggccatgttccctagcatgtgtgagaaaatgagaatccgcattattgattgggatcgcctgacccataacgacattgtcgctaccacgtacctgtcgatgagtaaaattagcgcgccgggtggtgagatcgaggaagaacctgccggcgccgtgaaaccgagcaaggcaagtgatctggacgactacctgggttttctgccgactttcggtccttgctacatcaatttatacggtagccctcgcgagtttactggtttcccggacccttacactgagttgaataccggtaagggtgagggggttgcgtaccggggacgactgctgcttagcctggaaaccaaactggttgagcacagcgagcagaaggtggaagatctgccagcggatgatatccttcgggttgagaagtacttaaggaggcgaaagtactccctgttcgcagcgttttatagcgcgaccatgcttcaagacgtcgacgacgcaatccaattcgaagtctctattggcaattacggtaacaagtttgatatgacttgcctgccactggcctcgactacccaatactcccgcgccgttttcgacggttgccattattactacctgccgtggggtaacgtgaagcctgttgtggtcctctccagttattgggaggacattagccaccgcattgagactcaaaatcagcttctgggtatcgctgacaggctggaagctggattagaacaagtgcacctggcgctgaaagcgcagtgctcgaccgaagacgttgactcgctcgtagcacagctgactgacgagctaatcgccggatgcagccagccgttaggcgatatccacgagactccctcagcgactcatctggaccagtatttatatcaactgaggactcaccatctgagccagatcacggaggccgcgctggccctgaaactgggtcacagtgaactgccggctgccctggaacaagcagaggactggctgctgcgcctgagggcgctggcagaggaaccacagaactctttgccagacattgttatctggatgttgcagggcgataaacgcgtcgcctaccagcgcgttcccgcccaccaggtcctgttcagccgccgtggcgccaattactgcggcaaaaattgtggtaaactgcagaccattttcctgaagtacccaatggagaaggtcccaggagcgagaatgccggtgcagattcgcgtcaaactgtggtttggactgagcgttgacgagaaagagttcaaccaatttgccgaaggtaaattgtcagtattcgcggaaacctacgagaacgaaactaaactggcgctggtgggtaattggggcaccaccggtttgacctacccaaagttcagcgatgtcaccggtaagattaagttaccaaaagactcatttcggccgagcgccggctggacctgggctggggattggttcgtttgtccagaaaaaactttgctgcacgatatggacgctgggcacctgagctttgtcgaggaggtgttcgagaaccaaaccaggctgcctggtggtcagtggatctatatgagcgacaactatacggacgtcaacggtgaaaaggtcctgccgaaagatgatatcgagtgcccactgggttggaagtgggaagacgaagagtggagcactgatctgaatcgtgcggttgacgagcaaggctgggaatacagcattaccatcccccctgagcgcaagccaaagcactgggtgccagcggagaagatgtattatacgcaccgacgccgaaggtgggtgagactgcgccgcagagacctgagccagatggaggcactcaaaaggcaccgccaggctgaagcggaaggggaaggttgggagtatgcaagcctcttcggctggaaatttcacctggagtatcgcaagaccgatgcatttcgacgtcgaaggtggcgcagacgcatggagccgctggagaaaaccggtccggcggccgttttcgccttggagggcgcattaggcggcgtgatggacgacaaatctgaagacagcatgagcgttagcactctgtctttcggagttaaccgacctaccatctcgtgtatcttcgattacggcaatcgttatcatctgagatgttacatgtaccaggctcgggacctggcggcgatggacaaagatagctttagcgatccgtacgccattgtcagctttctgcatcaaagccagaagaccgttgtcgtcaagaacacgctgaatcctacctgggaccagactcttattttctatgagattgagatctttggcgagccggcgactgttgctgaacagcctcctagcatagttgtggagttgtatgaccatgatacctacggcgcagacgaattcatgggtcgctgcatatgtcaaccttccttagaacgcatgccaagactggcgtggttccctctaacccgcgggagccagccatccggtgagctgctcgcctcttttgaactgattcagagagagaaaccagcaatccatcatatccctgggtttgaagtgcaagagaccagccgtatcttggacgagagcgaggacacagatctgccgtacccgccaccgcagcgggaggccaatatttacatggtgccacaaaatatcaaaccagccctgcagcgcaccgcaattgagatcttggcatggggcttgagaaacatgaaaagctatcaattagcgaatattagttcaccttcactggtggtggaatgtggggggcagaccgtacagtcttgtgtcattcgcaacttgcgcaaaaaccctaattttgacatctgtaccctgtttatggaggtgatgctgccacgtgaggaactgtactgcccacctataaccgtcaaagtgattgataatagacagtttggccgccggcccgtggttggccaatgtaccatccgctctctggaatcttttctctgcgacccatattcagctgaaagcccatcccctcaaggcggcccggatgatgtaagcctgttgtcaccaggtgaggacgtcctcattgacattgacgacaaagagccgctgatccctattcaggaagaagaattcatcgactggtggtccaagttcttcgcctcaatcggtgaaagggaaaagtgtggttcctacctggagaaagactttgacaccctgaaagtctatgatacacaactggagaacgtcgaagctttcgaaggtctgagcgacttctgcaacacgttcaaattgtatcgtggtaagactcaggaagaaacggaagacccgagcgttataggcgaatttaaaggcctgttcaagatttaccctctgcctgaagaccccgcaattcctatgccaccgcgccagttccaccagctggcagcccagggcccacaagagtgtcttgttcgaatctatatcgtgcgggcattcggcctgcagcccaaggatccgaatggtaagtgcgatccctatatcaagatttccatcggcaaaaagagcgtgtccgaccaagacaactacatcccttgtaccctggagccggtgtttggcaaaatgtttgagctgacttgcactttacctctggaaaaggacctgaagatcacattgtacgactatgatctgttgagcaaggatgaaaaaataggagaaaccgtggtcgacctggaaaatcgcctgctgagtaagttcggagcgcggtgtggccttccccagacctactgcgtgtcaggaccaaatcagtggcgcgaccagctgcgcccaagtcaactgctgcatctgttttgccagcagcatcgcgttaaggcgcccgtttaccgcaccgatagggtgatgttccaagataaggaatatagtattgaggagatagaagcaggtaggatacctaatccccacctggggccggtggaggagcgcttagcactgcacgttctacagcagcaggggctggttcctgagcacgttgagagccgcccactgtactcgcctctgcagccggatatcgaacaaggaaagctgcagatgtgggttgatctgttcccgaaggcgttgggtcgcccaggtccgccgttcaacattactcctcgtcgggcgcgccgtttctttctgcgttgcattatctggaatacgcgagacgtcattctggatgacctgtccctgactggtgaaaagatgagcgacatttacgttaagggctggatgattggttttgaggaacataaacaaaaaacggacgtccactatcggagcctgggtggcgagggtaactttaactggcgcttcatcttccctttcgactacctgccagccgaacaggtttgcaccattgccaagaaggatgctttttggagactggataaaacggagtcaaagattcctgcgcgagtggtctttcagatctgggataatgataagttctccttcgatgactttctgggctctctgcagctggacttgaataggatgccgaagcctgcaaaaacggcaaagaagtgctccctggaccagttggatgacgcatttcatccagagtggtttgtttccttgtttgaacagaaaacggttaaaggctggtggccttgtgtggctgaagaaggtgagaaaaagatcctggcggggaagctagaaatgacgctggagattgtggcagagagcgagcacgaggagcgtccagcaggccaaggccgcgatgagccaaacatgaaccccaagctggaggaccctcgccgcccggatacttcctttttgtggttcacgagtccctacaagacaatgaagtttattttgtggcgccgttttcgctgggccattatcctttttattatcctgttcattctgttgctgtttctggccattttcatttatgcctttcctaattacgccgccatgaagctcgttaaacctttcagc

SEQ ID NO: 10633 - DNA, 6243 bp, Artificial Sequence
  Description of Artificial Sequence: Synthetic coding sequence
atgctgtgttgcctcctggttagggcaagcaaccttccttcagctaaaaaagatcgcagaagcgatccagtcgcttccttaacttttcgtggggtgaaaaaacgaacaaaggtcattaagaacagtgtaaatcctgtgtggaatgagggctttgagtgggacctgaaggggattcccctggaccagggctcagagctccatgtagtcgttaaggatcacgagaccatgggccgcaacagattcctgggagaagccaaagtcccacttcgagaagtgctggctactccctccctctcagcttcttttaatgcccccttactggacacgaaaaaacaacctacgggggccagcctggtgttgcaagtttcatatactccgctccccggtgcggtgccacttttcccaccaccgacccccctcgaaccgtcacccaccctcccagaccttgatgtggtggctgacacaggcggagaggaggatacggaggatcagggattaaccggagatgaagctgagccattcctggatcaaagcggtggccccggggcgcctaccactcctcggaagctgccatcacggcctccaccgcactatcccgggattaaacggaagcgttcagctccaacatcaagaaaactactcagtgataaaccccaggacttccagatacgggtccaggtgatcgaggggcggcagctccctggggttaacatcaagccagttgtgaaagtgactgctgccgggcaaaccaagagaactagaattcacaagggcaattctcctctgtttaacgaaacactgttcttcaatctgtttgacagccccggcgagctgtttgacgagcctatcttcatcacggttgtggacagccgatcactgcgcaccgacgcactgctgggcgagtttcgaatggatgtcggcactatatacagagagccccgacacgcctacctgcgtaagtggttgctccttagcgacccagacgatttctctgctggagcccgggggtacctaaaaacctctctctgcgttcttggtcctggcgacgaagctccccttgagcgaaaggatcctagtgaggataaggaggatattgagtcaaacctccttcgacctacaggcgttgccctgcgcggagctcacttttgtttgaaggtttttagggccgaagacttgcctcagatggacgatgccgtgatggacaatgtgaagcagatcttcgggttcgagagcaacaagaagaacctggtagacccctttgtagaagtgagcttcgccggtaagatgttgtgcagtaagattctcgaaaaaaccgcaaacccacagtggaatcagaacattactttgcctgccatgtttccaagcatgtgtgagaagatgagaatccgtatcattgactgggataggctgacacataatgacatcgttgcaaccacttatttatcgatgtcaaaaatcagtgcccctgggggagaaatagaggaggagcctgccggggccgttaagcccagtaaagccagtgacttggacgattatctaggtttcctgcccacatttggcccatgttacattaacctctatggtagtcctcgcgagtttaccggtttccccgacccttacaccgagctgaataccggaaaaggcgaaggtgtcgcgtacaggggacgtctcctcctgtcccttgagactaagctggttgagcactcagagcagaaggtcgaagaccttccagcagacgatattctgagggttgaaaagtaccttcgacggcgtaagtatagcctcttcgccgctttttattccgccaccatgctgcaagatgtggatgacgctattcagtttgaggtgtcaatcgggaattatggtaacaagtttgacatgacgtgtcttcccctggcatctactacacagtacagcagagccgttttcgatggctgtcattattattatctgccttggggaaacgtgaaacccgtggtagtgttatcatcttactgggaggatatcagccatagaatcgagactcagaaccaactgctggggattgccgataggctggaggctgggctcgagcaggtccacttggccctgaaagctcagtgcagtaccgaagacgtcgattcgctggtcgctcagctcaccgacgagctgatagctggctgttctcaacctctgggagatatccacgaaacaccaagcgcaacacacctagaccagtatctgtaccagttgcgaacccaccacctgagccaaatcacagaggctgcacttgctcttaagttagggcattcagagcttccagctgcactggagcaggcagaggattggctcctgaggctccgagctctcgctgaggagccccagaattcgctgcccgatattgtgatctggatgctgcagggagataaaagagtggcatatcaaagagttcctgcccatcaggttctcttctcgcgacgtggagctaactactgtggtaagaactgcgggaagctccagacaatttttcttaagtacccaatggagaaggttcctggagcccggatgcccgtgcagatcagagtcaagctttggtttggcttgagcgtggacgaaaaggagtttaaccagttcgcggagggcaagctgtctgtctttgccgagacctacgagaacgagaccaaattggctctagttggcaattgggggacgaccggcctcacctacccgaaattcagtgacgtcacggggaagatcaagttgcccaaggattcattcagacccagtgcaggttggacgtgggcaggcgattggtttgtttgtcccgaaaaaacattgctgcacgatatggacgccggacatttgtctttcgtggaagaggtatttgagaatcagactagactgcccggaggacagtggatctacatgagcgataattacaccgatgtgaacggtgaaaaagtcctacctaaagatgacatcgaatgtcccttgggttggaaatgggaggatgaagagtggtccacagatctgaaccgggcagtggacgagcagggctgggagtattccattactatccctcccgaaagaaaaccaaaacattgggtgcctgcggagaagatgtattacacccatcgccgaaggcggtgggtgaggctccgccgaagggacctgagccagatggaagcactcaagaggcacaggcaggccgaggctgaaggggaaggttgggaatacgcctcactgtttggttggaagtttcatcttgagtaccgaaaaactgacgcattccggaggcgcagatggcggcgcaggatggaacccctagagaagaccggccctgctgccgtattcgccttggagggggctctcgggggggtaatggacgacaagtccgaggattcaatgtctgtatctaccctgagcttcggcgtgaatagacccaccattagctgcatctttgattatggaaatcgataccacctccgctgctacatgtaccaggctagggacctagccgcgatggacaaagactcattttctgatccatatgcgattgtttcttttttgcatcagtcccagaagactgtggtggtgaagaatacactgaaccccacatgggaccagacgctgatattttacgaaattgagatcttcggcgagccagcaaccgtcgctgagcagcctccctccattgtggttgaactctacgaccacgacacatacggagcagatgaattcatggggcgctgtatctgccagccctctctagagcggatgcctcgcctggcctggttccccctgacacgaggctcccagccaagcggcgaactgctggcctcttttgagctgattcaaagggaaaagcctgccattcaccacatccccggattcgaagtgcaagagacatcacgtattctagatgagagtgaagacacggatcttccataccctccgcctcagcgtgaggcgaatatttatatggttcctcagaacatcaagcccgccctgcagcgaacagccatagagatcctggcgtggggcttaagaaatatgaagagttaccagctggccaatattagctctccaagtttagttgtcgaatgtggcggccagacagtgcaaagctgtgtaataagaaatttacgcaaaaaccccaatttcgatatctgtaccctgtttatggaggtaatgttgccgcgcgaggaactgtactgccctcctattacagtgaaggtcatcgacaataggcagtttggcagacgccctgtggttggacagtgcacaattcgctcactagaatcgttcttatgtgacccatattctgctgagtctccgagccctcaagggggtccagacgacgtgtctctgttatctccaggggaggacgtgttaatcgatatcgacgacaaggagcccctcattccgattcaggaagaggagttcatcgactggtggagcaaattttttgcgagcattggcgagagagagaagtgtggaagctacctagagaaggacttcgataccctaaaagtatatgatacacagttagagaacgtagaggcctttgagggtctttctgacttctgcaacactttcaaattgtatcgtgggaagacccaagaggaaactgaggaccccagtgtcattggcgagtttaaaggtttgttcaagatctaccctctccccgaagacccagccataccaatgccaccaaggcagtttcatcaactggcagctcagggccctcaggagtgtttggtgcgcatctatattgtccgcgcattcggcctgcagcccaaggacccaaacggcaagtgtgatccttacattaaaatcagtattgggaagaaaagcgtgagcgatcaggataactacattccctgtaccctggagcccgtattcgggaagatgttcgagcttacctgtactctccccctggagaaggacctgaagattacgctctacgactacgacctcctcagcaaggatgaaaagatcggtgagacagtcgtggacctggaaaaccgcttgctgagtaagttcggggcacggtgcggtttgccccagacatactgtgtgagcggtccaaatcagtggagagatcagctgcggccgtcccagctgctgcacctcttctgccagcaacatcgggttaaagcgcctgtatatagaactgatagggttatgttccaggacaaagagtacagtattgaagaaatagaggcgggaagaatccccaatcctcatctggggcctgtagaggaaaggcttgcgttgcatgtgctccagcaacagggattggtccccgaacacgttgaatcaagaccattatatagccccttgcagccagacattgaacagggtaaactgcaaatgtgggtcgaccttttcccaaaggccctgggccgacccggacccccatttaacattacaccacgacgcgcaagacgcttctttctcaggtgcataatatggaacacccgtgacgtgattttggatgatctgtcattaaccggtgaaaagatgagcgatatctatgtgaaaggctggatgattggctttgaggagcacaaacaaaagacagacgtccattacaggtctcttggcggcgaggggaacttcaactggagatttattttcccctttgattatctcccagctgagcaggtttgtactatcgccaagaaagacgccttttggcgcctcgacaaaaccgaaagcaaaatcccagcaagggtggtcttccaaatttgggataacgataagttttccttcgacgatttccttggatccctgcaattggacctaaaccgcatgcctaagccagctaaaactgccaagaagtgctctctcgatcaactcgatgacgccttccaccccgagtggtttgtctctttattcgaacaaaagactgtgaagggctggtggccgtgcgtggcggaagagggcgaaaagaagattttggcgggcaagctagaaatgaccttggagatagtcgccgagtccgagcatgaggagaggcccgcaggccaggggcgagacgagcccaacatgaatcccaagctggaagaccccagacgaccagacacaagcttcttgtggtttacgagcccatataagactatgaagtttatcctgtggcggcggtttcgttgggccatcatcctgttcattatcctgttcatcctgctcttgtttctggctatattcatctacgcgttccccaattacgctgccatgaagcttgtgaaaccattcagc

SEQ ID NO: 10634 - DNA, 6243 bp, Artificial Sequence
  Description of Artificial Sequence: Synthetic coding sequence
atgctgtgctgcctcctggtgagagcttccaatctgccgtcggctaagaaggatagaagaagcgacccggtggcgagcctcacgttccggggcgtgaagaagcggaccaaggtcatcaaaaactccgtcaacccggtgtggaacgagggattcgagtgggatctgaagggaatcccgctcgaccagggctcggaacttcatgtcgtggtcaaggaccacgagacgatgggccggaatcgcttccttggtgaagcgaaagtgccactgcgggaggtcttggcaacgccgtcgctgagcgccagcttcaatgcccctctgttggacacgaaaaagcaacccactggagcttccctggtgttgcaggtgtcatacacgccgcttccgggagccgtcccgctgttcccaccaccaaccccgttggaaccaagccctactctgcctgacctggacgtggtggccgatacgggtggagaggaggacaccgaggaccagggcctgactggagacgaggctgaaccgttcttggaccaatcaggaggaccgggtgcgcctaccactccacgcaaattgccgagcaggcctcctcctcattaccctggaatcaagcgcaaaagatctgcaccaactagccgcaaattgttgtcagacaagccacaggacttccagatcagagtgcaggtgatcgagggccgccaacttccgggcgtgaacattaagccagtggtgaaagtcactgcggccgggcaaactaaaagaacccgaatccataaaggaaattctccattgtttaatgagactctctttttcaacctgttcgatagcccaggagaactctttgatgaaccaattttcatcactgttgtcgactcccgctcactcagaaccgacgcgctgctgggcgaattccgcatggatgtcggaaccatctaccgcgagccgcgccacgcatacttgcgtaaatggctgctgttgtccgaccccgatgacttctcggctggcgctcgaggatatctgaaaacttcgctgtgcgtgctgggaccaggagatgaagcaccgctcgagcgcaaagatccttctgaagataaggaggacatagagtcgaacctcctcagacctaccggtgtcgctctgcggggcgcgcacttctgtctgaaagtctttcgcgcagaggatctgccgcaaatggatgacgcagtgatggataacgtgaaacagatttttggtttcgaatcaaacaagaagaatctcgtggacccatttgtggaggtgtcgtttgccggaaagatgctttgctcaaaaatcttggaaaaaaccgccaatccgcagtggaaccaaaacattaccctgccggcaatgttcccttccatgtgcgaaaagatgagaatccgcatcattgactgggatcggcttactcataacgatattgtggccaccacctacctgagcatgtcaaagatcagcgcgccgggtggcgaaatcgaagaagagccagctggagcggtgaaaccctccaaggcatcggacctggacgactacctgggattcctccctaccttcgggccatgctatatcaacctgtacggttcgccgcgggaatttactgggtttccggacccgtacaccgagctcaatacgggcaagggtgaaggagttgcctaccgcggacgccttctcctctcgctggaaactaagctggttgaacattcggagcaaaaggtggaggatttgcccgccgatgacatcctccgcgtggaaaagtacctccggagacggaagtattccctgttcgccgccttctactccgccaccatgctgcaagacgtggacgatgccatccagttcgaagtgtcgatcggcaattatggaaacaaatttgacatgacctgccttccgctggcgagcactactcaatactcccgggctgtgtttgacggatgccattactattacctgccttggggaaacgtcaaaccggtggtggttctctcgtcgtactgggaggacatatcgcaccgcatcgaaacccagaatcaactcctgggcatcgctgatcgactggaggcgggactggagcaggttcacctggccctcaaggcccagtgctcaactgaggacgtggactcgttggtggcccagttgactgacgaactgatcgcgggatgcagccaaccactgggggacatccacgagacgccgtccgccactcatctcgaccagtacctgtaccagcttcgcactcatcatctgagccagatcaccgaggcggcgttggccttgaagctcgggcactcggaactgccagccgcactggaacaggcagaggactggctcctgcgcctgcgcgccttggcagaagagccacagaactcgttgccggacatcgtgatctggatgctccagggagataagagggtggcctaccagcgcgtcccggcgcaccaggttctcttctcccgccggggcgcgaattactgcggcaagaattgtggaaaactgcagaccatctttcttaagtacccaatggagaaggtgcctggagcgcggatgccggtgcagattcgcgtgaagctgtggttcggactctcggtggatgaaaaagaattcaaccagttcgccgagggaaagctgtccgtgttcgcagaaacgtatgagaacgaaaccaagctggccttggtgggaaactggggtactaccggtcttacctacccaaagttctccgacgtcaccggaaagatcaagctcccgaaggactcattccgcccatctgctggttggacgtgggctggtgattggttcgtttgtccagaaaagactctcctgcatgacatggatgcgggccacctctccttcgttgaggaggtgttcgaaaatcaaactcgcctgccgggaggacagtggatctacatgtcggacaattacactgacgtgaacggcgaaaaggtgctgccgaaggacgatatcgagtgcccgctcgggtggaagtgggaggatgaggaatggtcgaccgacctgaaccgcgcggtcgacgagcaggggtgggagtactcaatcaccatcccaccagagcgcaagccgaaacattgggtccccgctgaaaagatgtactacacccacagacggcggaggtgggtccgcttgaggcggcgggacctgagccaaatggaggcccttaagcggcatagacaggcagaagctgaaggagaagggtgggaatacgcatcgctgtttggctggaaattccacctcgaatacagaaagaccgacgcgtttcggaggcggcggtggcgccgccgcatggaaccattggagaaaaccggtcccgccgcagtgttcgccctcgaaggggcgctcggaggagtcatggacgataagagcgaagattcaatgtcagtttccacccttagctttggtgtgaaccgccccaccatcagctgcatcttcgactacggaaatcgataccacttgagatgctacatgtaccaagcccgggacttggcagcgatggataaggactcattttcggatccttacgccatcgtgtccttcctgcaccagtcccagaaaactgtggtcgtcaaaaacacgctcaacccaacttgggatcaaaccctgatcttctatgagatcgaaatcttcggcgagcccgcgacggtcgcggaacagcccccttcgatcgtggtggaactctacgatcacgacacctacggagcggatgaattcatggggcgatgcatttgtcagccttcactggagcgcatgccgcggctggcctggttccctcttacgcgcggaagccagccatcaggagaactgcttgcgtcattcgagctgattcagcgcgaaaagccggccatccaccacattccgggcttcgaggttcaagaaacttctcgcatcctggacgagagcgaagataccgatctcccttacccgccgccccaaagagaagctaatatctacatggtcccgcaaaacatcaaaccggccttgcaaagaaccgctattgaaatcctggcctggggccttcgcaatatgaagtcctaccaactggccaatatctcctcgccgtcactcgtggtggagtgcgggggtcagactgtgcagtcatgcgttatccggaaccttagaaaaaacccgaactttgatatttgcactctcttcatggaggtgatgctgccgcgtgaggagctgtactgtccgccaatcaccgtgaaggtgatcgacaaccggcaattcggtagacggcctgtcgtcggacagtgcaccatccggagcctggagtccttcctctgtgacccatactcagcggaaagcccttccccacaaggaggccccgatgacgtgtctctcctgtcaccgggagaagatgtgctcatcgatatcgacgacaaggaacctctgatcccgatccaagaagaggagtttatcgactggtggtccaagtttttcgcaagcatcggagagcgagaaaagtgcggatcctatctggaaaaggatttcgatactctcaaggtttacgatactcagctggaaaacgtggaggcttttgaaggcctctccgacttttgtaataccttcaagttgtaccgcggcaaaacccaggaggaaaccgaggacccgtcggtcataggcgaattcaagggacttttcaagatctaccctctccccgaggacccagcgatccccatgcccccgcggcagttccaccaactggcagcgcagggaccgcaagaatgtttggtgagaatctacatcgtccgggcatttggactccaacccaaggaccctaacggaaagtgtgatccctacatcaagatctccatcggaaagaagtccgtgagcgatcaagacaactacattccatgcactcttgaaccggtctttggcaagatgttcgagctcacttgcactctccccctcgagaaggacctcaagattactctttatgactacgacctgctgtcgaaggacgaaaagatcggagaaactgttgtggatctggaaaatcggctgctttccaaattcggagctcgctgcgggttgcctcaaacctactgtgtttcgggacctaaccagtggcgggaccagcttagacccagccaactgttgcacctgttctgccaacagcaccgcgtcaaggccccggtgtaccggactgaccgcgtgatgttccaagataaggagtactcgatcgaagagatcgaagcaggaaggatcccgaacccgcacctggggccggtcgaagagcggctggcacttcacgtgttgcagcagcaagggctggtgccagaacacgtggagtcccgcccactttactcccctctccaaccagacattgaacagggcaaactgcagatgtgggtggacctgtttccgaaggccctgggtaggccgggtccaccgttcaacatcaccccccgccgtgctcgcagattcttcctcagatgcatcatctggaacactagggacgtgatcctggacgatctctcgctgaccggcgagaagatgagcgacatttacgtcaaaggatggatgattggctttgaggagcataagcagaaaacggacgtgcattaccggtcgctgggcggcgaaggcaatttcaattggcgattcatctttccgttcgattacctccctgctgaacaagtgtgcaccattgccaagaaggacgccttctggcggctcgataagactgagtcgaaaatcccggcccgcgtggttttccagatctgggataacgacaagttcagctttgatgactttctgggctctctgcagctggaccttaacagaatgccgaagccagcgaaaaccgctaagaagtgctcgctggaccagctggatgatgctttccatccggagtggttcgtctcactcttcgagcaaaagaccgtgaaggggtggtggccgtgtgtggcagaagagggcgagaaaaagatcttggcaggaaagctggaaatgactttggaaattgtcgccgagtcagaacacgaagaaagacccgcggggcaagggcgcgatgaacccaatatgaacccgaagctcgaggatccccgtcggccggatacctcattcctgtggttcactagcccgtacaaaaccatgaaattcatcctctggcgccggttccgttgggccatcattctgtttatcatcctgtttatcctgctcttgttcctggcgatcttcatctatgcgttccctaactacgcagctatgaaattggtcaaaccgttctcc

SEQ ID NO: 10635 - DNA, 6243 bp, Artificial Sequence
  Description of Artificial Sequence: Synthetic coding sequence
atgctttgctgtctattagttagagcttctaatttaccatcagctaaaaaggatagaagaagtgatcctgttgcatctttaacatttcgaggtgttaaaaaacgaactaaagttataaaaaatagtgttaatccagtatggaatgaaggatttgaatgggatttaaagggaattccattagatcaaggtagtgaacttcatgtagtagtaaaagatcacgaaactatgggtagaaataggtttcttggagaagcaaaagttccattaagagaagtattagctacaccatcattatctgctagttttaatgcaccacttctagatacaaaaaaacaaccaactggagcttctcttgtgcttcaagtatcatatacaccacttcctggagctgttccattattcccaccaccaactccattagaaccatcaccaacattaccagaccttgatgttgttgcagatactggaggagaagaggatacagaagatcaaggacttacaggtgatgaagcagaaccatttcttgatcaaagtggtggaccaggtgctccaacaacaccaagaaaattaccaagtcgtcctccaccacattatccaggtattaaaagaaaaagatcagcaccaactagtagaaaattattatcagataaaccacaagattttcaaatacgtgtccaagtgattgaaggacgtcagcttccaggagttaacattaaaccagttgtaaaagttacagctgctggtcaaactaaaagaacaaggatccacaaaggaaactcaccattatttaatgaaacattattttttaatttatttgatagtccaggtgaactttttgatgaaccaatttttattacagttgttgactctcgttcacttagaactgatgcattacttggtgagtttaggatggacgttggaacaatttatagagaaccaagacatgcttatcttagaaaatggttacttctttcagatcctgatgacttctcagcaggggctagaggatacttaaaaacttctctttgcgttcttggaccaggagatgaagcaccattagaaagaaaagacccttcagaagataaggaagacatagaatcaaatcttttaagaccaactggagttgcattacgtggagctcatttctgtttaaaagtattcagagctgaagatttacctcaaatggatgatgctgttatggataatgttaagcaaatttttggatttgaatcaaataaaaaaaatttggtcgatccatttgtagaggtttcattcgcagggaaaatgttatgttcaaaaattttagaaaaaacagcaaacccacaatggaatcaaaatattactttaccagcaatgtttccttctatgtgtgaaaaaatgcgtataagaattattgattgggatagattaactcacaatgatattgttgccacaacatatttatctatgtcaaaaatttcagcaccaggaggagaaattgaagaagaaccagcaggtgcagttaaaccatccaaggcaagcgatttagatgactatcttggatttttaccaactttcggaccatgttatattaatctttatggatcaccaagagaatttacaggatttccagatccatatacagaattaaatactggaaaaggagaaggagtagcttatagaggaaggcttttattatcacttgaaacaaaattagtagaacattctgaacaaaaagttgaagatttaccagctgatgatatcttaagagttgagaaatatctacgaagaagaaaatattcattatttgctgctttttatagtgcaactatgcttcaagatgttgacgatgctatccaattcgaagtaagtattggtaattatggaaataagttcgacatgacatgtttaccattagcatctacaacacaatactctagagcagtttttgatggttgtcattactattatttaccatggggaaatgtaaaaccagtagtagtattatcatcatattgggaggatattagtcatagaattgaaacacaaaaccaattacttggaattgcagatagattagaagctggtcttgaacaagttcatttggcacttaaagctcaatgttccacagaagatgtggatagtttagttgcacaacttacagatgaattaattgctggatgtagtcaacctcttggagacattcatgaaacaccttcagcaactcatttagaccaatatctttatcaacttagaacacatcatcttagtcaaattactgaagctgctcttgcactaaaattgggacattcagaattaccagcagcattagaacaagctgaagactggttacttcgtcttcgtgcattagcagaagaaccacaaaattcacttccagatatagtaatttggatgcttcaaggagataaaagagttgcttatcaaagagttccagctcaccaggttttattttcaagaagaggagcaaattattgtggaaaaaattgcggaaaattacaaactattttcttaaaatatccaatggaaaaagtaccaggggcacgtatgccagttcaaattcgagttaaactttggttcggtttatcagttgatgaaaaagaatttaaccaatttgctgaaggtaaattgtctgtattcgcagaaacttacgaaaatgagaccaaattagcacttgttggaaactgggggactacaggattaacatatccaaaattcagtgacgtaacaggtaagattaaattacctaaagattcttttcgtccatcagcaggatggacatgggcaggtgattggtttgtttgtccagaaaaaacattacttcacgatatggatgcaggacatttaagttttgttgaagaagttttcgaaaaccaaactcgtttgccaggaggacaatggatttatatgtcagataattatactgatgttaatggagaaaaggttttaccaaaggatgatattgaatgtccattaggatggaaatgggaagatgaagaatggtcaacagatcttaatagagcagttgatgaacagggatgggagtactcaattactatacctccagaaagaaaaccaaaacattgggtaccagctgaaaaaatgtattatacacataggagaagaaggtgggttcgtcttcgtagaagagacttatcacaaatggaagctttaaaacgtcatagacaagcagaagctgaaggtgaaggatgggaatatgcatctttatttggatggaagtttcatcttgagtatcgtaaaactgacgcatttagaaggagaagatggagaagaagaatggaaccattagaaaaaacaggaccagctgcagtatttgcattagaaggagctcttggaggtgttatggatgataaatcagaagactctatgtctgtttctactctttcattcggtgttaatagaccaactatttcctgtatttttgactatggaaatcgataccatctcagatgttatatgtatcaagcaagagatcttgctgcaatggataaagattcttttagtgacccttatgctattgtttcatttttacatcaatcacaaaaaactgttgttgttaaaaatactcttaatcctacatgggatcaaactcttattttttatgaaattgaaattttcggagagcctgcaacagttgctgaacagccaccatcaatagtcgttgagttgtatgatcatgatacttatggtgctgatgaatttatgggaagatgtatttgtcaaccatcattagaaaggatgccaagattagcttggttcccattaaccagaggatcgcaaccatcaggagaacttctagcatcatttgagcttattcaaagagaaaaaccagctattcatcatattccaggatttgaagttcaagaaacttccagaattttagatgaatctgaagatactgatcttccttatcctccaccacaaagagaagcaaatatttatatggttccacaaaatattaagccagctcttcaacgtacagctatagaaattcttgcttggggtttaagaaatatgaagtcttatcaattggcaaatatttcttcaccatcattagttgttgaatgtggaggacaaacagtacaaagttgtgttataagaaatctaagaaagaatccaaattttgatatttgtacattgtttatggaagttatgttaccaagagaagaactttattgccctccaattactgtaaaggtaattgataacagacaattcggaagaagaccagttgtaggacaatgtactattagatcattagaatcattcttatgtgatccatatagtgcagaatcaccatcaccacagggaggacctgatgacgtttcattattaagtccaggtgaagatgtattaattgatattgatgataaagaaccattgattccaatccaagaagaggaatttatagattggtggtcaaaatttttcgcttctattggagaacgtgaaaaatgtggatcatatttagaaaaagatttcgatacacttaaggtttatgatactcagcttgaaaacgtagaagcatttgaaggtttatcagatttttgtaatacttttaaactttatcgaggtaaaacacaagaagaaactgaagatccttcagttattggagaatttaaaggtctttttaaaatttatccacttccagaagatccagctattccaatgccacctagacaatttcatcaattagcagctcaaggaccacaagagtgtttagtaagaatttatattgttagagcttttggattacaaccaaaagatccaaatggaaaatgtgatccttatattaaaatttcaattggtaaaaaaagtgtttctgatcaagataattatattccatgtactcttgaaccagtttttggaaaaatgttcgaattaacgtgtactcttccacttgaaaaagacttaaaaattactctttatgactatgatttactttctaaagatgaaaaaattggagaaactgtagtagatttagaaaatagattactttcaaagtttggagctagatgtggattaccacaaacatactgtgtttcaggaccaaatcaatggagagatcaacttcgtccatcacaattattgcacttattttgtcaacagcatcgtgtaaaagcaccagtatatagaacagatagagttatgtttcaagataaagaatattcaattgaggaaattgaagctggaagaattccaaatccacatttagggcctgttgaagaaagattagctttacatgttttacaacaacagggattagtaccagaacatgtcgaatcaagaccactttattctccattgcaaccagatattgaacaaggaaaattacaaatgtgggttgatttgtttccaaaagcattagggagaccagggccaccattcaatattactccaagaagagcaagaagatttttcttaaggtgtattatttggaatacacgtgatgttattcttgatgatctttcacttactggtgaaaagatgtcagatatttatgtaaagggatggatgattggatttgaagaacataaacaaaagacagatgttcattatagaagtttaggaggtgaaggaaatttcaattggagatttatcttcccattcgattatcttccagctgaacaagtttgtacaattgcaaaaaaggatgctttttggagattagataaaacagaaagtaaaattccagcaagagttgtttttcaaatttgggataatgataaattttcttttgatgattttttaggaagtttacaattagatttaaataggatgcctaagccagctaaaactgctaaaaagtgttcacttgatcaattggatgatgcattccatccagaatggtttgtgtcattatttgaacaaaaaactgtaaaaggatggtggccatgtgttgcagaagaaggagaaaaaaaaattttagctggaaaattagaaatgactttagaaattgttgctgaaagtgaacatgaagaacgacctgctggtcaaggtagagatgaaccaaatatgaatccaaaacttgaagatccaagacgaccagatactagttttctttggttcacatcaccttataaaactatgaaatttatcttatggagaagatttagatgggctattatacttttcattattttattcattttattattatttttagcaatttttatttatgcatttcctaattatgcagctatgaaattagttaaaccatttagt

SEQ ID NO: 10636 - DNA, 6243 bp, Artificial Sequence
  Description of Artificial Sequence: Synthetic coding sequence
atgctatgttgtttattagtgcgggccagcaacttaccatcagccaaaaaggatagaagatcagaccctgtggcaagcctaacattccgcggcgttaagaaaagaaccaaggtcataaaaaactcagtgaacccagtgtggaacgagggatttgaatgggatctgaaaggaataccactcgatcagggatccgaactccacgtggtggtgaaggaccacgaaaccatgggccgcaaccgttttttgggcgaggctaaagtgcccctgagagaagttctcgctacccccagcctgtccgctagcttcaatgcacccttacttgacacaaagaagcagcccaccggggccagcctggtgctacaggtgagctacacccctctgcccggggctgtgcccctatttcccccccctacacctttagagccgtcaccaaccctgcctgatctagatgtggtggccgataccggcggcgaggaggacaccgaggaccagggactgaccggcgacgaagccgaaccatttctagaccagagcggtggtcccggggcacctaccactccaagaaaactgccatctcgccctcctccacactacccaggcatcaaacggaagcggtccgctcctacttctcgcaaactgctgtccgataaaccccaggattttcaaatccgcgtgcaggtcatagagggccgacagttgcctggtgtcaacattaagcctgtggtgaaggtgactgcagctggccaaaccaagcgtacccgcatccacaagggcaattccccactattcaacgaaaccctgttcttcaatctgtttgattctcccggcgagctattcgacgagcctattttcatcaccgttgtcgactcccggagtctgcgaactgacgccctgctcggggagttcaggatggacgttggcaccatctatcgggagcctaggcacgcctatttgaggaaatggttgctactgtccgatcctgacgattttagcgcaggcgcacgcggctacttaaaaacttccctctgtgttctgggaccaggcgatgaggcaccactggaaagaaaggacccaagtgaggataaagaagacatagaaagtaacctactgcggccaactggcgtggctctgagaggcgcacacttttgcctgaaagtgttccgtgccgaggatctacctcaaatggatgatgccgttatggacaatgttaagcagatctttgggtttgaaagcaataagaaaaatctggtggaccctttcgtggaagtttcttttgccggaaagatgctttgctccaagatcctcgaaaaaactgccaacccccagtggaaccagaacataactttacctgccatgtttccctcaatgtgcgaaaaaatgcggatccgcatcatcgactgggaccgtttgacccacaacgatattgtggccaccacctacctgagcatgagcaagatatccgcaccaggcggagagatagaggaggaacctgccggcgccgttaaaccttccaaggcctctgacctggacgactacctcggcttcctgccaacttttggcccctgttacattaatctctacggctcaccaagggagttcaccgggtttcctgatccatatacagagttaaacacaggtaagggcgagggcgttgcctatagaggccgcctattgctatccctcgagaccaagttagtcgagcatagcgagcagaaggtggaagatctcccagccgatgacatcctccgcgtggagaaatatcttcgcagacgtaaatattcattattcgccgcattttactctgccacaatgctgcaagatgtggatgatgcaatacagttcgaagtttctatcggcaattacggtaacaaatttgatatgacctgtctgcctttagcaagcactacccaatatagccgcgccgtttttgacgggtgccactattactatctgccatgggggaacgttaagcccgtggtggtgttatcaagctactgggaagacatttctcacaggatcgagactcagaaccagctgctcggcatcgccgacagactggaagctggcctggaacaggttcaccttgccctgaaggcccagtgttcaaccgaggatgtggactccctggtggctcagttgacagacgaactgattgctggatgtagccagcctttgggcgatatccacgagaccccctctgctacccatctagaccagtacctgtaccagttacggacccatcacctgtctcagatcacagaggctgctctggctttaaagctggggcactctgaactacctgccgctttagagcaggcagaggactggctgctgcgcctccgtgccctggctgaggagccacagaactctttgccagacattgtcatttggatgctgcagggcgacaagagggttgcataccaacgtgtgcctgcccatcaggtgctgttctccaggagaggggccaactattgtggtaagaattgcggcaagctccagactatatttctgaaatacccaatggagaaagtcccaggcgcaaggatgcctgttcagattcgggtgaagctgtggtttgggctgagtgtggatgagaaagaattcaatcagtttgccgaaggcaagctgagtgtgttcgctgaaacttacgagaatgagaccaaactggcactagtgggaaattgggggaccaccggcctgacctaccccaagttctctgatgtgaccggtaaaatcaagcttccaaaagacagttttaggccctctgcagggtggacctgggccggagactggttcgtttgccccgaaaagaccctccttcacgacatggatgccggtcatctaagtttcgtggaggaggtttttgagaatcagactagactccccggtggacagtggatttatatgagcgataattatacagacgtgaacggcgaaaaggttttacccaaggatgacatagagtgcccactgggatggaaatgggaggacgaagagtggtccaccgacttaaatagggctgtggatgaacaaggatgggaatatagcataacaattccccccgagagaaaaccaaagcactgggtgcctgcagaaaaaatgtattacacccaccggagaagacgatgggttagactgcgacgacgagatctgtctcagatggaagcccttaagaggcatagacaggctgaggccgaaggggagggatgggagtacgcttccctattcggctggaagttccatctggaataccggaaaaccgatgcatttaggagaagacgctggcgacgccgtatggagcctctggagaaaactgggcctgctgccgtgtttgccctggagggcgctctaggcggtgtgatggacgacaagagcgaggattccatgagtgtatccacattatcctttggagtcaatcggcctactatttcctgtattttcgattacggaaatcggtaccatctcaggtgttacatgtatcaggctcgggacctcgccgccatggataaggatagttttagtgacccatatgctatagtgagctttctgcatcagtcccagaaaacagtggtggtgaaaaatacactcaaccctacctgggaccagaccctgatcttttacgagattgaaatcttcggagaaccagctaccgtggccgaacagcctccttccatcgttgttgagttatacgaccacgatacctatggcgcagacgaattcatgggacgttgtatttgtcagcctagcctagaaagaatgcctagactcgcttggttccccctcactaggggctctcaacccagtggcgagctgctggccagcttcgagctgatccagagggagaagcctgcaatccaccacatccccggattcgaggttcaggagactagccgaatacttgacgaatctgaagacacagatctcccgtatcctcctccccagcgagaggcaaacatatacatggtcccccagaatatcaaaccagccctgcagcggaccgcaattgaaattctagcctggggactgcgcaacatgaagtcctaccagctggctaacataagttctccaagcttagtagttgaatgtggcggacagactgttcagtcctgtgtgatacgcaatctacgaaaaaatcctaatttcgacatctgcactctgttcatggaagtgatgctgccacgggaggaactatattgtcctcctataacagtaaaagtgattgataatcggcagtttggcaggcggccagtggtaggacaatgtactatccgctcactcgagtctttcctatgcgatccatactctgccgagagtccttcccctcaggggggccctgatgacgtgtccctgctgagccctggggaagacgtgctgatcgatatagacgacaaagaacctctgatacccattcaggaagaagagtttatagactggtggagcaaattctttgctagcataggcgagcgggaaaagtgtggcagctacttagaaaaggatttcgacaccctaaaggtgtacgacactcaacttgagaacgtagaagccttcgaaggcttaagtgatttctgcaacactttcaaactttacagggggaagacccaggaggaaactgaagaccctagcgttattggggaatttaaaggcctatttaaaatttatccactgcctgaagatcccgctattccaatgccaccaaggcagttccatcagctggcagcacagggcccacaggagtgcctggtgagaatctacatcgttcgggccttcggtttacagcctaaggatccaaacggtaagtgcgacccatacataaaaattagcatcggtaaaaagtctgttagtgaccaggataactatatcccatgtactttagaacccgtgttcggcaagatgttcgagctaacatgtactctgcctctggagaaagacctgaaaattaccctctatgattacgaccttctgagtaaagacgaaaagataggtgagacagtggtggacctcgagaatcggttactgagtaaatttggagccagatgtggccttccccagacatactgcgtttctggccccaatcagtggcgcgatcagctaaggccaagtcagctgttacacttattctgccagcagcacagagtgaaagcaccagtttacaggaccgatcgggttatgtttcaagataaggaatatagcattgaggagatcgaagctggtagaatacctaatccacaccttggtcccgtggaagaaaggttggccctgcacgtactgcagcagcagggtctggtgccggaacacgtggaaagtcgtccactctactctccattacagccagatatagagcaaggcaagttacagatgtgggttgatttatttcccaaggccctggggaggcctggccctccttttaatattacacctcggagagcccgtaggttctttttaagatgtattatatggaacacccgagacgtcatcctagatgatctgtcccttacaggggagaagatgtccgacatttacgtgaagggctggatgataggttttgaagaacacaaacagaagaccgatgttcattaccggtccctgggcggtgaaggaaacttcaattggaggtttatattcccctttgactatctgccagctgagcaggtgtgtactattgcaaaaaaagacgcattttggcgactggacaaaaccgagagtaagatcccagctcgggtggtgttccaaatatgggataacgacaagttctcttttgacgatttcctaggatccctacaactggatttgaacagaatgcccaagcccgccaaaacagccaagaaatgctccctcgatcagctcgacgacgcatttcatcctgagtggttcgtcagcctgtttgagcagaaaaccgttaagggatggtggccttgcgttgctgaggaaggcgagaagaaaattctggccggcaaactggagatgactctcgagatcgtagcagagagcgaacacgaggagcgtcccgcagggcaggggcgcgatgaaccaaacatgaaccctaaattagaagatcctcggcggcccgacacctctttcctgtggtttacaagcccctataaaacaatgaaattcattctctggcgcagattccggtgggccataatcctgtttattattctgtttatcctgctgctgtttctagctatcttcatctatgctttccccaactatgctgctatgaagctggtgaagcctttttcc

SEQ ID NO: 10637 - DNA, 6243 bp, Artificial Sequence
  Description of Artificial Sequence: Synthetic coding sequence
atgctatgctgcctgcttgtccgagcgagcaatcttccatctgcaaagaaggatagacggtcagatcccgtcgcatccctgaccttccgaggtgtcaaaaagcgcacaaaagtgatcaagaattccgtcaatccagtctggaacgaaggatttgagtgggacctcaagggcatcccactcgatcagggcagtgagctgcatgttgtcgttaaggatcatgaaacgatgggtcggaaccgttttctcggcgaagcgaaggttcccctgagggaggtcttggccacgcctagcctgtccgcatcgttcaacgcacccctactggacaccaagaagcagccgacgggcgccagcttggtcctacaggtttcatatacccccttgcctggggctgtgcctcttttccctccacccacgccacttgagcctagtccgacactccccgatctggacgttgtggccgataccgggggagaagaagatacagaagatcaaggtttaacaggcgatgaagccgagccgtttctggaccaatctggtggaccaggagcccctactacccctcgcaagttgccctcccggccgccgccccactatcctggcatcaagcgaaagcgctcggctccgacaagccgcaagctcttatccgataagccccaggatttccagattcgggtacaggtgatcgagggacggcaattgcccggagttaacattaaacctgttgtaaaggtcaccgccgctggtcagacgaaacgcacacgtatccacaagggaaactcgcctctcttcaacgagactttgttcttcaatctcttcgattcgcctggtgaactgttcgatgaaccaatattcattactgtcgttgacagccgatccctacgcactgatgcactactcggtgagttcagaatggacgttggcaccatttatcgtgagcctagacatgcctaccttcgaaaatggttgcttctctcggacccggacgatttttcagcaggtgcgcgtggttatttaaaaaccagtctgtgtgtgcttggtccgggagacgaagcgccccttgagcgcaaggacccgtctgaagacaaggaggacattgagtcgaacctacttagacccaccggcgtcgccctccgtggagcccatttttgtctgaaagtgttccgcgccgaagatctcccgcagatggacgatgccgtgatggataatgtcaagcagatttttggcttcgaaagtaacaaaaaaaaccttgtcgacccttttgttgaggtgtcttttgctggcaagatgctgtgctcgaaaatcctagagaaaacggcgaacccccaatggaaccagaatatcaccctgccagcgatgttccctagtatgtgcgagaaaatgcgcatcaggatcatcgattgggatagattgacacataatgacattgttgctacaacttatctttccatgtccaagatctctgcgccgggcggcgagatagaggaggaacctgctggggccgtcaagccatcaaaagccagtgatctagacgattatctgggtttcttgccgacgttcggtccctgttacatcaacctgtacgggtctccccgtgagttcaccggctttccagacccgtatactgagttgaacacaggtaaaggagagggggtcgcatatcgtggtcgccttctgctgtcacttgagactaagctagtagaacactcagagcagaaggtggaggacctcccggccgacgacattctccgcgtagaaaaatacctacgaaggcgaaaatattcactatttgctgccttctactcggccacgatgcttcaagatgttgacgacgctatccagttcgaggtttccatcggcaattatggtaacaaattcgacatgacgtgcttgcccttggcttcgacgactcagtactcgcgggcagttttcgatggatgtcattactactacttaccttggggcaacgtcaagccagtcgtcgtgcttagctcgtactgggaggatatctcgcatcggattgagactcagaatcagttattgggcatcgccgaccgtctcgaggctggtctcgaacaggttcatctcgcgttgaaggcccaatgtagtactgaggacgtcgattccctcgtcgcccagcttacagatgaactcatcgccggatgcagccagccactcggggatattcacgaaacaccatcggcaactcatctggatcaatacctctatcagttgaggacccatcatctctctcagataacggaagccgctcttgctttaaagcttggacatagcgagttgcctgccgcccttgagcaggccgaggattggctccttcggcttcgcgccttggccgaggaaccccagaattcactccccgatatagtaatctggatgctgcaaggcgacaaaagggtcgcgtaccagagggtccctgcccaccaggtgcttttctctcgccgaggtgcaaattattgtgggaaaaactgtgggaagttacagaccatcttcctaaagtatccgatggagaaagttccgggagctaggatgcctgttcaaatcagagtaaagctttggttcggtctcagtgtcgatgagaaagagttcaaccaatttgctgagggcaagttatctgtgttcgcggagacctacgagaatgagacgaagttggctcttgtcggtaactggggtaccaccgggttgacatatccgaaattttcagacgtaaccgggaagattaagctgccgaaggactctttccggccgtcggcggggtggacttgggccggcgactggtttgtttgcccggagaagacgctcttgcatgacatggacgccgggcacttgtcgttcgtggaggaagtgttcgaaaaccagacgcgtctgcccggaggacaatggatttacatgagtgacaactacactgatgtgaacggcgaaaaagtcttaccaaaagacgatatcgagtgcccccttggttggaagtgggaggatgaggaatggagcacagatctaaaccgggccgtcgacgaacagggatgggagtactccattacgattccacccgaacggaagccaaagcactgggtgcccgctgagaaaatgtattatacccatcgccgtcgtcgatgggtgcgccttagaaggcgggacctatcgcagatggaggccctgaagcgccatagacaagcagaggccgagggagaaggctgggagtatgcatctctgtttggatggaaatttcatttggaataccgaaagaccgacgcattccgccgtcggcggtggcgccggaggatggagcctttggagaagactgggcccgccgctgtgttcgctctcgaaggtgcgctcggcggtgtcatggacgacaaatccgaagattccatgagcgtctctacactcagcttcggagtaaatagaccgactatttcctgtattttcgattacggcaatcgatatcatctgcggtgctacatgtatcaggcgcgagaccttgcggctatggataaggatagtttctccgacccgtatgcgattgtgtcgttccttcatcagtctcaaaaaacagttgtcgttaaaaacacgctaaaccccacctgggaccaaacactaatcttctacgaaattgagatctttggcgagcccgccaccgttgctgaacaaccaccgagcattgtggtggaattgtacgatcacgatacctacggggcagacgagttcatggggcgatgtatctgccagccttcgctagaacgtatgccgcgactagcctggttcccattgacccgtgggtcacaaccgtccggtgaacttttggcaagctttgaattgatccaacgggagaaaccggcaatccatcacattccaggcttcgaggtccaggaaacgagtcgtattttagacgaatctgaggataccgatctcccctacccgccacctcagcgtgaagctaacatctacatggttcctcagaatattaagccggccctgcaaaggacagcgatcgaaatcctcgcgtgggggttgcgcaatatgaagtcgtatcagttggccaacatcagtagtccgtcgctcgtagtcgagtgtggtggtcaaacagtacaatcctgcgtcattcgaaatttgcgaaaaaatcccaactttgacatctgcacccttttcatggaagtgatgcttccacgggaggaactctactgtcctccgatcacagttaaggtgatcgacaaccgccaattcggacgacgcccggtcgttggacagtgtaccattcgcagccttgagtcattcttgtgtgatccctactctgcggagtcccctagcccgcagggggggcccgatgatgtgagcctcttgtctcccggggaggacgtcctgatcgacatagacgacaaagagcctctcatacccatacaagaggaagaatttattgattggtggtcgaaattcttcgcatcgattggcgagcgggaaaagtgcggttcatacctagaaaaggatttcgatacattaaaggtatacgatacgcagctggaaaatgtcgaggcgttcgagggtctctcggatttctgcaacacttttaaactctatcggggaaaaacgcaagaggaaacagaagacccaagcgtaattggggagtttaagggcctcttcaaaatttatcctttgcctgaggaccctgcaatacctatgccgccgcgacagttccatcagcttgctgcacagggtcctcaggaatgcctggtgcgtatatacatcgtgcgcgcgtttggccttcagccgaaggacccaaatggcaaatgcgatccatacatcaaaatcagtattggtaagaagtccgtctccgaccaggataactacataccatgtaccctcgagccagtttttggaaagatgttcgaactgacatgcaccctgccactcgagaaagatttgaaaattactttgtacgactatgacttgcttagcaaggatgaaaaaataggcgaaacggtcgtggatctcgagaaccgactgttgtccaagtttggtgcccgctgcggtctccctcagacctactgcgtaagcggtccgaaccaatggcgcgaccagcttcgtccaagccaactccttcatctgttttgccaacagcatcgtgtcaaggctcccgtctatagaaccgatagggtgatgttccaggacaaggagtattccattgaggaaattgaagcgggaagaatcccgaacccacatctcggtcctgtggaagagcgcctggcactgcatgttttgcaacaacagggactggtcccagagcacgtggagtcccgacctctttattcgcctcttcagcccgacatcgaacaagggaaattgcagatgtgggttgatctattcccgaaagcgctggggcgcccaggtccacctttcaacatcacgccgcgccgtgccagaaggttttttcttcgctgcatcatatggaacacacgcgacgtgatcttagacgatctctctcttacaggcgagaagatgtccgatatctacgtgaagggctggatgatcggctttgaagaacacaagcagaaaactgatgtgcattaccggtcgcttggcggcgaaggaaattttaattggcgctttatcttcccgttcgattatctgcctgcagagcaggtatgtacgatcgcgaagaaggatgcattctggcgccttgacaagaccgagtcaaaaatcccggcgcgtgtggtgttccagatctgggataacgataagttctctttcgacgactttttggggtccctccaactagacttgaaccgtatgcctaaaccagcaaaaacagctaagaagtgctctctagatcagctggacgacgcatttcatcccgagtggttcgtcagcctgtttgagcagaagaccgttaagggctggtggccttgcgttgctgaggagggggaaaagaagatcctggctgggaagctcgagatgaccttagagattgtggcggaaagcgagcatgaagaacgacccgcaggccaaggcagggacgaaccaaacatgaatccgaagttggaagaccctcggcgcccggacacctctttcctctggtttacgtccccctataagactatgaaattcatcctttggcgtagattccggtgggccatcatactatttataattctgttcattctgctcctgtttcttgcaatcttcatatatgcttttcccaattacgccgcgatgaagttggttaagccattttcc

SEQ ID NO: 10638 - DNA, 6243 bp, Artificial Sequence
  Description of Artificial Sequence: Synthetic coding sequence
atgctttgctgcttgctggtgcgggccagcaacctgcctagcgccaaaaaggatagacgctcggacccagtggcttccctcactttccggggtgtgaagaaacgcacgaaggtgatcaagaactcagtgaacccagtatggaacgagggattcgaatgggaccttaagggcatcccgctcgaccaaggaagcgaactgcacgtagttgttaaggatcacgagactatggggaggaatcgctttctcggagaagccaaagtccctctgagagaggtccttgccactccgtcactcagtgcctccttcaacgctccacttctggacactaaaaagcaaccaaccggcgcttcgctggtgctgcaagtgtcgtatactcctctgcccggagctgtgccgctgtttcctccaccgactcccttggagccatccccaactctgcctgacctcgacgtcgtggccgatactggaggagaggaggacaccgaggatcagggattgacgggtgacgaagcggaaccatttctggatcagtctggtggcccaggcgcaccgaccaccccgagaaagctcccgtcccgcccacccccgcactacccaggaatcaaacggaagaggagcgcgccgacgagccggaagctgctttccgacaaaccccaggacttccagattagagtccaggtgattgagggccgccagctgccgggagtgaatatcaagccagtcgtaaaagtcaccgccgccggccagactaagagaactagaatccataaaggaaattcaccgctcttcaacgagactctgttctttaatctgttcgactccccaggagaactctttgacgaaccgatcttcattaccgttgtggattcgcgcagcctccgcaccgacgccctgttgggagaattccgcatggacgtgggcaccatctaccgtgaaccgcggcacgcctacctgcggaagtggctgttgctgagcgacccggatgacttcagtgccggcgcccgcggttacttgaaaacttcgctctgcgttctcgggcccggagacgaagccccgctcgaacgcaaggatccgagcgaggacaaggaggatatcgagtcgaatctcctcagacccaccggtgtggccctcaggggtgctcacttctgcctcaaggtgtttcgggcagaagatctgccgcaaatggatgatgccgtgatggacaacgtcaagcagatctttggttttgaatcgaacaaaaagaacctcgtcgacccgttcgtggaggtgtcattcgccgggaagatgctctgcagcaagattctggaaaagactgccaacccacagtggaaccagaacatcacgcttccggcaatgttcccgtcgatgtgtgaaaagatgcggattaggatcatcgactgggacagactgacccacaacgacatcgtggccactacctacctgagcatgtccaagatctccgccccgggtggagagattgaggaagaaccggcgggagccgttaagccctccaaagcgtccgacctggacgactacttgggtttcttgccgaccttcggcccgtgctatatcaatctgtatggttcaccacgcgagttcaccggattccccgacccttacactgaactcaacaccggaaagggagaaggagtcgcataccgcggaaggctcctgctctcgctggaaaccaagctggtggagcattcggaacaaaaggtggaggacctgccggctgatgacatcctccgcgtcgaaaagtacctgagacgacgcaagtacagcctgttcgcagctttctacagcgccactatgcttcaggacgtggacgatgcaatccagttcgaagtgtcgatcggtaactacgggaataagttcgatatgacttgcctgccgctcgcttcaaccacccaatactcccgggccgtgttcgacggatgccactattactacctgccgtggggaaacgtgaagccggtggtggtgctgtctagctactgggaggatatctctcaccggatcgaaacgcagaatcaactgctgggaatcgccgacagactggaggcaggccttgagcaggtccacttggccctgaaagcacagtgctcgactgaagatgtggacagcctggtggctcaactcaccgacgagctcatcgcgggttgctcccagcctctcggcgacatccatgaaactccttcagcgacccacttggatcaatacctctaccaattgcggactcatcatttgagccagatcaccgaagcagcactggcacttaagctggggcactcagagctccctgcagctctggaacaggcagaagattggctgctgcgcctgcgcgccctggctgaagaaccacagaattcgctcccggacatcgtaatctggatgctccagggggacaagagagtggcttaccagagagtgccagcgcatcaagtgctgttttcgcgccgcggagcgaactactgcgggaagaactgtggcaagttgcaaacgatctttctgaagtaccccatggagaaggtgccaggcgcacgcatgccggtgcaaatccgcgtcaagctctggttcgggctgtctgtggatgaaaaagaattcaaccaattcgccgagggcaagctgtccgtgtttgccgaaacctacgagaatgaaaccaagttggcactggtcggcaactggggaaccaccggcctgacttacccgaagttctcggacgtcaccggcaagattaagttgcctaaggattcgttccgcccttccgccggctggacctgggccggggattggttcgtctgtccggaaaagaccctgctgcatgatatggacgcgggacacctgtcctttgtggaggaggtgtttgaaaaccagacccgactgcctgggggacagtggatctacatgtccgataactacaccgatgtgaacggggaaaaagtccttccaaaagatgacatcgaatgcccactgggatggaaatgggaggacgaggaatggtccactgaccttaacagggcggtggatgaacagggatgggagtattcaataacgatcccgccagagcgtaaacccaagcactgggtgccggctgaaaagatgtactacacgcatcgtagaaggcgctgggtcaggcttagacggcgggatttgtcgcagatggaagctctgaagcgccaccggcaggcggaagctgaaggggaggggtgggagtacgcaagcctgttcggatggaaattccaccttgaataccgcaaaaccgacgcttttagaaggcggaggtggagaaggcggatggaaccacttgaaaagacgggacctgcagcagtgttcgcactggagggagcactcggaggagtgatggacgataagtcagaagattccatgtcagtctctaccctgagcttcggagttaaccggccaacgatctcctgcatcttcgactacgggaacaggtaccatctgcgctgctacatgtaccaggcccgggacctggccgcgatggataaagacagcttctccgacccgtacgctatcgtgagctttttgcaccagtcccaaaagactgtcgtcgtgaagaatactttgaaccctacctgggatcaaacgctgatattctacgaaatcgaaatctttggagaaccggccaccgtggcggaacagcctccgagcatcgtggtggagttgtacgatcatgatacctacggggctgacgagttcatgggacggtgcatctgtcagccttccctcgagcggatgccccgcctggcgtggttcccgttgactcgcggcagccagccctccggagagctgctcgccagcttcgaattgatccagagagaaaagccagcaattcaccatatccccggattcgaagtgcaagaaacttctcggatcctggacgagtctgaagatactgacctgccgtaccctccaccgcaacgggaggctaatatctacatggtgccgcagaacattaagccagccctgcagagaaccgccattgaaattctggcttggggcttgcgcaacatgaagtcctaccagctggccaacatctcgtcgccgtctctggtcgtggagtgtggaggacagaccgtccagagctgcgtgattaggaatctgcggaagaacccgaacttcgacatctgcactctcttcatggaggtgatgctgccgcgggaggaactttattgtcctcccatcacggtcaaagtgatcgataaccggcaattcggaagaaggccggtggtgggccagtgtactatccgctcgcttgagtcctttttgtgcgatccttactcagcagaatccccaagccctcaaggcggacccgacgacgtgtcactgttgtcgcctggggaagatgtgctgatagatatcgatgacaaagaaccgttgatcccaattcaggaagaagaattcattgattggtggtccaaattcttcgcctccatcggagagagggagaagtgtggatcgtacttggagaaggatttcgacactctgaaggtgtatgacacccaactggaaaatgtggaagccttcgagggactgtccgacttttgcaacactttcaagctctaccggggaaagacccaagaggagactgaggacccgtcagtcatcggcgaattcaagggcctgttcaaaatctaccctctcccagaagatccggcgatcccgatgccaccgcgccaattccatcagctcgccgcgcagggcccacaggaatgcctggtgcgcatttacatcgtgcgggcattcggcctgcagccaaaagatccgaacggaaagtgcgatccgtacatcaaaatctcaataggaaagaagtcagtctcagaccaggacaactacataccatgcaccctcgaacccgtgtttggaaagatgttcgagctgacctgtactcttcctctcgagaaggacctcaagatcactttgtatgattacgatctcctgtccaaggatgaaaagatcggggaaactgtggtggatctcgaaaaccgcctcttgtccaagttcggcgcgcggtgtggactgcctcagacctactgcgtgtccgggccgaaccagtggagagatcaactccgaccttcccagctgctccatctcttttgccagcagcaccgggtgaaggcgccagtgtaccggactgatcgcgttatgttccaagacaaagagtactcaatcgaggagatcgaggcaggccggattccaaaccctcacctgggtcctgtggaagagagacttgccctgcacgtcctgcagcaacagggactcgtcccggaacatgtggagtcgcgcccactgtactcaccactgcagccggacatcgaacaaggcaaactgcagatgtgggtcgacctgtttccgaaagcgctggggcgcccgggaccacctttcaacatcacgccaaggagagcacggcgcttctttctccgctgtatcatttggaatacccgggatgttatcctcgatgatctgtcactgactggagagaagatgagcgacatttatgtgaaggggtggatgataggtttcgaggagcacaaacaaaagaccgacgtgcattatcgcagcctgggaggcgaaggcaatttcaattggcggtttatctttccattcgactacctgcctgcagagcaagtgtgcaccatcgctaaaaaggatgctttctggcgcctggacaagaccgaatcaaaaatcccggcccgcgttgtattccaaatctgggataatgacaagttttcctttgacgactttctgggatcgctgcagctcgacctgaatcggatgcctaaaccggctaagactgcgaagaagtgctcgctcgaccaactcgatgacgcgttccaccctgagtggttcgtctcgctgtttgaacagaaaaccgttaaaggttggtggccttgcgtcgccgaagaaggagagaagaaaatcctcgcgggaaaattggagatgactctcgagatcgtggcggaaagcgaacacgaggaacgcccagcaggccaaggacgcgacgagcctaatatgaatcctaagttggaagatccgcgccgacctgacacctctttcctgtggtttacttcaccgtacaagactatgaagttcattttgtggaggcggttcaggtgggccatcatcctcttcattatcctgttcatcttgctcctgttcctggccatctttatctacgccttccccaattacgccgctatgaaattggtcaagccgttctca

SEQ ID NO: 10639 - DNA, 6243 bp, Artificial Sequence
  Description of Artificial Sequence: Synthetic coding sequence
atgctgtgctgcctgttagttagggcttccaacctaccatctgcgaaaaaggatcgccggtctgatccagtggcaagcttgacattccgaggagtcaagaagagaaccaaggtgattaaaaactccgttaaccctgtttggaacgagggattcgaatgggatttgaagggcatacccctcgatcagggatccgagcttcacgtcgtagtcaaagatcatgagacgatggggaggaacagatttctgggggaggcaaaggtccctcttcgagaggtgctggctaccccgagcctgtccgctagtttcaatgcgcctcttctggacaccaaaaaacagcctacaggggcgtcactggtcctgcaggtctcctatactcctctgcccggtgctgtgcccctctttccaccaccaacacctctggaaccgagtccgactctgcctgatctggacgtagtggctgacactgggggtgaggaagatacagaagatcaaggactgactggagacgaggctgagccgtttttggaccagtcaggtgggcccggagcgcccacaacgcctcgcaagctcccaagccgcccccccccacactatcctgggatcaagagaaagcggtcagcaccaacaagtcgcaaattactgtccgataagccccaggacttccagatcagagtgcaggtgattgaaggccgtcaactgcccggggtgaacatcaagcctgttgtgaaggtgacggcagccgggcagacaaagaggacccgcatccacaaggggaactcccctctgtttaatgagactctgttttttaacctctttgatagtcccggagaattgtttgatgaacctatattcattacggtagtcgattccagaagtttgaggactgacgccctgctcggcgagtttcgcatggatgtgggcactatctaccgagagcctaggcacgcctacctgaggaagtggttgctcctgtctgatcctgatgacttttccgcaggagcgaggggctatctgaaaaccagcctttgcgtcctgggccctggagacgaagcccctctggaacgaaaggatcctagcgaagacaaggaggacatagaaagcaacctgctgcggcctactggtgttgcgttgagaggcgcacacttttgtttgaaggtcttcagagctgaagatctgccgcaaatggatgacgccgtcatggacaatgtgaaacagatttttggcttcgagagtaataaaaagaacctggtcgatccttttgtagaagtgagttttgccgggaaaatgctttgctccaaaatcctcgaaaagactgccaaccctcaatggaatcaaaatattaccttaccagccatgttcccctcaatgtgcgagaaaatgaggattaggatcatagactgggataggcttacacataatgacattgtagcaaccacatacttaagcatgtcaaaaattagcgctccaggcggggagatcgaagaggagccagctggagccgttaagccttccaaggctagcgatttagatgattacctgggcttcttgcccaccttcggcccatgctatatcaacctatacggcagccccagggaattcacgggctttccagatccatatactgagctaaatactggcaaaggggaaggtgtggcctacagaggaagacttcttctttccctcgagaccaagctggttgagcacagcgaacagaaggtggaggatctccctgccgacgacatcttacgggtcgaaaagtacctgagaaggcgcaaatactctctgtttgcagcgttttattccgccaccatgctgcaggatgttgacgacgctattcagttcgaggtttctatcggcaattacggcaataaattcgacatgacatgcctcccactcgctagcaccacccagtactcacgggccgtgttcgatggatgtcattactactacctgccctggggtaatgttaaacccgttgttgttctgagtagctattgggaagatatctcgcacagaatcgaaactcaaaaccaactgctcggaattgctgataggctggaagctggtttagagcaggtgcatctcgcccttaaggcacaatgctccacggaggacgtggactcgctggtcgctcagctcaccgacgagcttattgcaggatgctcccaacctcttggtgatattcatgaaactccaagcgccacccacctcgaccagtacttgtatcagctgcggactcatcatctctcccagatcaccgaagctgcactggctctgaagctgggtcattccgagctgccagctgccctggagcaggcagaagactggctactgaggctacgggccctcgctgaggagccacagaatagcctacccgatatcgtcatatggatgttacagggcgacaagcgggtggcctaccagcgggttcccgcccaccaagtattattctctcgccgcggcgcaaattactgtggcaagaactgcgggaagttacagaccatttttttgaagtatcctatggaaaaggtccctggcgcccgcatgccagtgcagatcagagtcaaactgtggttcggtctgtctgttgatgagaaagagtttaaccagttcgctgaaggaaagcttagcgtgttcgcggagacttacgagaacgagaccaaattagccctcgtggggaattggggcaccactgggctcacgtacccaaagttcagcgacgtgaccgggaagatcaaacttcctaaggattcatttaggccttccgccgggtggacgtgggctggggactggttcgtgtgccctgaaaagacacttctgcacgacatggatgctggccacctgtcatttgtagaagaggttttcgaaaaccagactaggcttcccgggggccagtggatttacatgtccgacaactacaccgatgtgaacggcgagaaagtgcttccaaaggatgacattgagtgccctctgggctggaaatgggaagatgaggaatggtcaacagacctcaatcgcgcagttgatgaacagggatgggaatattctatcacgattcctcctgagcgtaaacccaagcactgggtgccagccgagaaaatgtactacactcatcgaaggaggcgctgggtgcggttacgccgcagagatttgtcacagatggaggctcttaagcgtcaccggcaggctgaggccgagggggaggggtgggaatacgcctcactattcggttggaagttccacctggagtaccggaagacagatgctttcagaaggaggcgatggagacgcagaatggaaccgctcgaaaaaacaggccctgcggcagtgttcgctttagagggagccctagggggcgtgatggacgataagtctgaggacagtatgtcagtcagtacgcttagttttggcgtcaataggcccacaatctcgtgtattttcgattacgggaacagataccatctgcggtgttacatgtatcaggcccgagacctggcagcaatggataaggactccttttcggatccctacgccattgtgagcttcctccatcaatcccaaaagaccgttgtggtcaaaaacaccctgaatcctacttgggaccagactctgatattctacgagatcgagatcttcggggaacccgccaccgtagccgaacaaccacccagcatcgtggttgagctatatgaccacgatacatacggcgccgatgaatttatgggccgctgtatctgccagccatctctggaacgcatgcccagattggcctggttccccctcacaaggggctcgcaaccaagcggcgagctgctggcctcatttgagctcattcaacgcgagaaacccgccatccatcacattccaggattcgaggtgcaggagacgtcgcggattcttgacgagagcgaagatacagacctcccatatcctccaccacagcgcgaggcaaacatctacatggttccacaaaacatcaagccagcgcttcagcgcactgcaattgagattcttgcatgggggctgcgcaatatgaaatcttaccagctggccaatatttcatcacccagcctggttgttgagtgtggcggtcagaccgtacagtcctgtgtgataagaaacttgaggaaaaacccaaacttcgacatctgtaccctttttatggaggtcatgctgcctcgcgaggaattatattgtcccccaattacagtgaaggtcatcgacaacagacagttcggaagaagacccgtagtgggccagtgcaccatcaggtcgctcgaaagtttcctatgcgacccttactcagccgaaagccctagcccacagggaggaccggacgacgtatcactactgagcccaggtgaggatgtcctgattgacatcgacgacaaggaaccactgatacccattcaggaagaagaatttatcgattggtggagcaaattctttgcatccattggggaacgcgagaaatgcggctcatatctcgagaaggactttgacacactgaaggtttacgacacccagttggagaacgtggaagcttttgagggcctttcggatttctgcaatacatttaagctgtatcggggcaaaacccaggaggaaactgaagatccaagtgtcatcggcgaatttaagggtttgtttaagatttaccctcttccggaggatccagctatacctatgcccccccgtcaatttcatcagctggccgcccagggcccccaggagtgcctggtgcgcatatatatcgtgagagcgtttggtctgcagcctaaagatcctaacggaaagtgcgacccctatataaagatttcaatcggcaagaaaagcgttagcgaccaagacaactatatcccatgtacactggaaccagttttcggcaagatgttcgaactgacttgtacgctgcctctagaaaaggacctgaagattactttgtacgattatgatttgttgtccaaagatgagaagatcggggagacagtggttgacctggaaaacaggctgctgtcaaagtttggcgcgcgttgtggcctgccacagacatactgtgtgtcgggtccaaaccaatggagagatcagctgagaccaagccagcttctacacctcttctgtcagcagcaccgggtgaaggctcctgtctaccgcaccgatcgcgttatgttccaggataaagaatacagcatagaagagattgaagctgggcggattccaaatccacacttggggcctgtggaagaaaggttggctctccacgtattgcagcagcagggccttgttcctgagcatgttgaatcaaggcccctctactctccgctgcagcccgatatcgagcaggggaagttacagatgtgggttgacttgtttcccaaagcactggggagaccaggtcctccatttaacataacaccacggcgcgcacgcagattctttcttcgttgtattatctggaacactcgggacgttattctcgatgatcttagcctaaccggtgagaagatgtctgatatctatgtcaagggatggatgataggcttcgaggaacataaacagaagactgacgttcactaccggtcgcttgggggcgagggcaatttcaattggaggttcatcttccccttcgactatctccctgctgagcaggtgtgcaccattgccaagaaggacgccttctggagactggataagactgagagtaagattccagcccgcgtggttttccagatttgggataatgacaagttctcatttgacgacttcctcggctctctacagctggacctgaaccgcatgcctaagcccgctaagaccgccaaaaaatgttctctggatcagctggacgatgctttccatcctgagtggtttgtctctctgttcgagcaaaagacagtgaaggggtggtggccatgcgtggcggaggagggggaaaagaagatccttgccggtaaactggaaatgaccctggagattgtggcagaatccgaacacgaggaacgacccgcggggcaaggccgcgatgagcccaatatgaatcccaaattggaagacccaagacggccagatacatctttcctctggttcacctccccttacaagacgatgaaattcatcctgtggcgcaggttcagatgggctatcatattgtttatcatcctattcattctcttgctgttcctggctatcttcatatacgccttccctaactacgccgctatgaaactggtaaaaccgttcagt

SEQ ID NO: 10640 - DNA, 6243 bp, Artificial Sequence
  Description of Artificial Sequence: Synthetic coding sequence
atgctctgctgtctactggttagggctagcaatctcccctcggccaagaaagaccgcaggagcgatcccgtggcgagcctcactttcaggggagtcaagaaacgcacaaaggtcatcaagaatagcgttaatcccgtctggaacgagggtttcgagtgggacctcaagggcatccccctcgaccaaggctccgaactgcacgtcgtggtcaaggatcacgagacgatggggcgtaaccggttcctcggcgaggcgaaagtgcctctccgcgaggtgctggccaccccgagtctgtccgctagcttcaacgccccccttctcgacaccaagaaacagcccaccggcgcttcgttggtgctccaggtctcatacacaccgctgcccggcgccgtgcccctcttccccccccctacaccgttggagccctcccccaccctcccagacctagacgtcgtcgccgacaccggtggagaggaggatactgaagaccagggtctcacaggcgatgaagccgaaccatttcttgaccagtccggtggtcccggtgcccccacgacaccccgtaaactgccgagtcgccccccgcctcactaccccggcatcaagcgtaagcgctccgcgcccactagccgaaagctactatctgataagccacaggactttcaaattcgggtccaggtcatcgagggccgccagctgcctggcgtgaatatcaagcccgtggtgaaggttactgccgctgggcagacgaagcggactcgcatccacaagggcaacagtccgctcttcaacgagactttgttctttaaccttttcgactctcccggggaattgttcgacgagcctatctttattaccgtggtcgattcccgttccttgcgaacggacgcacttctgggtgagtttaggatggacgtgggtaccatttatcgcgagccgcgacatgcatacctccggaagtggttgcttctgagtgatccagatgacttttccgctggtgcccgtggttatttgaaaacctctctatgtgtcttgggccctggtgatgaggctcctttagagcgtaaggacccctccgaagacaaggaagatatcgaaagcaacctcttgaggccaaccggtgtagcgttgcgtggagcccatttctgccttaaggtgttccgggccgaggacttgcctcagatggacgatgccgttatggataacgtcaagcagatctttggctttgagagtaataagaagaacctggtcgacccgttcgtggaagtctcgtttgctggtaagatgctgtgttcgaagattctcgagaagacggccaacccgcagtggaaccagaacattacgctacctgccatgttccccagcatgtgcgaaaagatgagaatccgtatcattgattgggaccgcctgacgcacaacgatatcgttgcaaccacgtacttgtccatgtcgaagatcagcgccccgggcggagaaatcgaggaagaacccgctggggccgtcaagcctagcaaggcctcggatctggacgactacctgggcttcctgcctaccttcggtccgtgttacattaacctgtacggctcgcctcgtgagttcaccggctttcccgacccttacacggaactgaacacgggcaagggcgaaggagtggcctaccgcggcaggctccttctctccctcgagaccaagctcgttgagcactcggagcagaaggtcgaggacctgcctgcagacgacatcctccgcgttgagaagtacctccggcggcgtaagtacagtttgttcgccgccttttactcagcgaccatgctgcaggacgtggacgacgctatccagttcgaggtctccatcggcaactacggtaataagttcgatatgacgtgccttccgttagcttctaccacgcagtacagccgagctgttttcgatggttgtcactactactatcttccctggggcaacgtcaagcccgttgtcgtcctgtctagttactgggaagatatttcgcaccggatcgagactcagaatcagctgctaggtatcgccgatcggctggaggccggtcttgagcaggtgcacctcgcccttaaagcccagtgctctaccgaggatgtagacagcctggtggcccaactgacggatgagctgattgcaggctgtagccagcccctaggagatatccacgagactcccagcgccacccatctggaccaatatctgtaccagcttcggacccaccacctaagccagatcactgaagccgccctggctctcaagcttggccactccgaattaccagccgctctggagcaggccgaggattggttgctccggctgcgcgccttggcggaggagccccaaaactctcttccagacatcgttatttggatgttgcaaggcgacaagcgcgtcgcgtaccagcgtgtgccggcccatcaggtgctgtttagccgccgcggtgcaaactactgcggcaagaactgtggaaagttgcagactatatttctgaagtaccccatggaaaaggttccgggagcgcgtatgcccgttcaaatccgtgtcaagctgtggtttggcctctccgttgacgagaaggagttcaaccagttcgccgagggtaaactgagcgtcttcgctgagacttatgagaacgaaaccaagctcgccctagtgggcaactggggtaccaccggcctcacctacccgaagttctccgacgttaccgggaagatcaagctgccgaaggattcattccgtccctccgctggatggacgtgggcaggtgactggttcgtctgtccggagaagacgttgttgcacgacatggatgccggccacctctcgtttgtggaggaggtcttcgaaaaccagacccgtcttcccggcggccaatggatttatatgagcgacaattacaccgacgtcaacggcgagaaggtactgcctaaggacgacatcgagtgtcctctcggatggaaatgggaagacgaagaatggtcaacagacctcaaccgcgcggtcgacgaacagggttgggaatattctattaccattcctcccgaaaggaagcctaagcattgggtgccggccgagaagatgtactacacccaccgccgccggagatgggtacgtctgcgtcggcgtgatctgtcgcaaatggaagcactgaagagacaccgccaggcagaagcggagggcgagggatgggagtatgccagcttgttcggttggaagtttcacctggagtatcggaagacagatgcattccgcagacgccgctggaggcgtcgtatggagcctttggaaaagaccggtcccgccgccgtttttgcgttggaaggcgccctcggcggagtcatggacgacaaatccgaagattcaatgtccgtcagcactttgagctttggtgtaaacagaccgacgatcagctgcatcttcgactacggcaataggtaccatctgcgctgctacatgtaccaagcacgcgaccttgcggctatggataaagattctttctcggatccttacgccatcgtcagcttcctccatcagagccaaaagaccgtcgtcgttaagaacacactcaacccgacatgggaccaaacgcttatcttctacgaaatcgagatctttggagagcccgctactgtggctgaacaacctccaagcatcgtggttgagctgtatgaccatgatacttacggtgccgacgaattcatgggacgttgcatatgtcagccctctctggaacgtatgccccgtttggcgtggtttcccctcacccgcggtagccagcccagcggcgagctcctcgctagcttcgagcttatccagcgggagaagccggccatccaccatatccctggctttgaggtccaagagacctcacgcatcctagatgaatctgaggacaccgaccttccgtacccgcccccacagcgcgaagccaatatttatatggttccccagaacatcaagcctgcccttcagcgcacggccatcgagatccttgcttggggtctgagaaacatgaagtcctaccagctcgccaacatctcaagtccctccctcgtggtggaatgcggcggtcagacagtccagtcgtgcgtcattcgcaaccttcgcaagaacccaaacttcgacatatgtactctgtttatggaggtgatgttgccccgcgaggagctctattgccccccgatcacagtgaaggtcatcgacaataggcaattcggacggcgccccgtcgtcggccaatgcactatccgctccctggagagttttttgtgcgatccttattccgcagaaagccccagcccgcagggcggccctgacgacgtctcccttctttccccgggagaggacgtcctaatcgacatcgacgataaggagcccttgatccctatccaggaggaggagttcattgactggtggtctaagtttttcgccagcattggcgagcgcgaaaaatgcgggagttacctcgagaaggacttcgatactctgaaggtctacgacactcagctcgagaacgtggaagccttcgagggtctttctgacttctgcaacaccttcaagctctatcgcggcaaaacccaagaggagacggaggatccttcggtgatcggggagtttaagggactgtttaagatctaccctttgcccgaagatcccgcaattcccatgccgccgcgccagttccatcagttggcggctcagggtccacaagaatgcttggttcgcatctacattgtccgggctttcggccttcaacctaaagacccaaatggtaagtgcgatccttacatcaagatttcgatcggtaagaagtccgtctcagaccaggacaattatattccttgcaccctggagcctgtcttcggtaagatgttcgagcttacatgcaccctgccactcgagaaggacctcaagattaccctctacgattacgaccttttgtccaaggatgaaaagatcggcgagactgttgttgatctggagaaccgtctccttagcaagtttggtgctcgctgcggtttgccccaaacgtattgcgtaagcggtcctaaccagtggcgtgaccaactccgacctagccagctcctccatctcttctgtcagcagcatagggtcaaagcgcctgtctaccgtaccgatcgcgttatgttccaggataaggaatactcgattgaggagatcgaagccggccgtatccccaacccgcacctcggtcccgtcgaagagcggctcgctctgcacgtgctgcagcagcagggcctcgtgcctgagcacgtggaatcccgcccgctatacagccccctccaacccgacattgaacagggtaagttgcagatgtgggtcgatttgttccctaaggctctcggacgtcctggccctcccttcaacataaccccccgcagggcccgtcggttcttcctgcgctgcatcatttggaacacccgcgatgtgattctggacgacctttcactgaccggcgaaaagatgtccgatatctacgtcaagggttggatgattggcttcgaggaacacaagcaaaaaacagacgtgcactacagatcccttggaggcgagggcaatttcaactggcgcttcatttttccttttgactacctccccgctgaacaggtgtgcaccatcgcgaagaaggacgccttctggcggctggataagaccgagtccaagatccctgcccgcgttgtgttccaaatttgggataacgacaaattctcgtttgacgacttcctgggctccttgcagctcgacctgaaccgcatgccaaagcctgccaagacggctaaaaagtgcagcctcgaccagctcgatgatgctttccacccagaatggtttgtctctttgttcgaacagaagactgtcaagggttggtggccttgtgtcgctgaggagggcgaaaagaagatcttggccggtaagttggaaatgaccttggagatcgtcgcagagtctgagcacgaggaacgcccggctggtcagggtcgggacgagcccaatatgaaccccaagctggaagaccctcggcgtcctgatacctcgttcctctggttcacctccccttacaagacgatgaagttcatcctttggcgtagattccgctgggccatcattcttttcatcatcctcttcatattgctgctcttcctggcaatctttatctacgccttccctaactatgccgccatgaagctggttaagccattctcg

SEQ ID NO: 10641 - DNA, 6243 bp, Artificial Sequence
  Description of Artificial Sequence: Synthetic coding sequence
atgttgtgttgtctattagtccgcgcctctaacctgcctagtgctaagaaggaccgtcggagcgatcccgtcgcctcgctgactttcagaggagtcaaaaagcgcaccaaagttatcaaaaacagcgtcaaccctgtttggaatgaagggtttgagtgggatctgaagggaatcccactggatcaggggtctgagctacacgtcgtggttaaggatcacgagaccatgggcagaaaccgctttttaggggaggccaaggtcccactgagagaggtccttgctaccccctccctgagcgcgagctttaatgccccattacttgataccaaaaagcaacccaccggagcctccttggtcctgcaggtcagctacacaccgctgccaggagccgtgcctcttttcccaccacctacccctctagagcctagccccaccctgccggatctcgacgttgtcgctgatactgggggagaggaggatactgaggaccagggcctcaccggcgatgaggctgagccatttctggatcagtctggaggaccaggtgccccaaccacccctagaaagctaccctctagaccccctccacactatcctggtattaagaggaagaggtccgccccaacctcccgcaagctgttgagtgacaagcctcaggactttcagattagggtgcaggtaatcgagggccgccaacttcccggcgtgaatataaagcccgtggtgaaagttaccgcagcaggacagaccaagagaacacgcatccacaaaggtaactctcctctgtttaacgaaacattgttttttaacctctttgactcgccgggtgaattgttcgacgagccaattttcattacagtagtcgattctagaagcctaagaaccgacgccctgttaggggagtttcgcatggatgtggggaccatctatcgggagcccagacatgcctacctgcgaaaatggctgctgctgtctgaccccgacgatttcagtgccggggctcgcggatacttaaaaacttcgctttgtgtccttggtcctggcgacgaggcgcccctggagcgcaaagatccttcagaggacaaggaggatatcgaatccaacctgctcaggcctactggagtggccctgcggggcgcccatttttgcctgaaagtgtttagggccgaggacctgcctcaaatggacgatgcggtgatggacaacgtgaaacagatattcgggttcgagtcgaataagaagaatctggttgacccttttgtcgaggtgtccttcgccgggaagatgctttgcagtaagatactggaaaaaacggcaaatccgcagtggaaccaaaacatcacccttcctgctatgttccccagcatgtgcgagaaaatgcggattagaattattgactgggataggctcacgcacaatgacatcgtagctaccacatatctcagtatgtctaagataagtgctcccggaggcgagatagaggaagagccggccggcgcagtgaagccttccaaggcatctgacctggacgattacctcggttttttgccaacctttggaccatgctacatcaacctctatggctctcccagggaattcaccggattccccgatccttacacggagctgaatacgggaaaaggcgagggagtcgcgtatcgcgggagactcttgttatctttggaaacaaaactggtcgaacacagcgagcagaaagtagaggatttgcccgccgatgatatcttgagggtagaaaagtatcttagacgccgcaagtattctctcttcgcagccttttacagtgccaccatgctgcaagatgttgacgacgccatccagtttgaagtatctatcggtaattacggaaacaaattcgacatgacctgcctgccccttgcatctactacacagtacagccgtgcagtgttcgacggttgccactattattacctgccttggggcaatgtcaaaccagtcgtggttctcagctcatactgggaagacatatcccatcggatcgagacacagaatcagcttctgggcatagcagataggctggaagcgggcctggaacaggtgcatctcgctcttaaggcccagtgcagcacggaagatgtggatagcttggtcgcccagcttaccgacgaactgatagccggctgtagtcaacctctgggtgacattcatgagaccccttccgccacacatctggatcagtatctctaccaactgcgtacccaccatctatcccaaattactgaggctgccctggccttgaagcttgggcacagtgagctcccggccgcccttgagcaagctgaagactggctgctgcgcttgcgagctctggcagaggaacctcagaatagcctccccgatattgtgatctggatgctccagggcgacaagagggtagcctaccaacgtgtccccgcccatcaagttctgttcagcaggcgtggtgccaactactgcgggaagaactgtggaaagctgcagactatcttcttgaagtaccctatggagaaagttcccggggctaggatgcctgtccagattcgggttaaactgtggttcggtctcagcgtggacgagaaggagtttaaccagtttgcggaggggaagctcagcgtttttgcagaaacatatgagaatgagactaagctggctctggtgggcaattgggggaccaccggtctgacatatccaaagttcagtgacgtgaccggcaaaattaagctgccaaaagatagcttccgcccttcagcaggctggacatgggcaggagattggttcgtgtgtccagagaagaccctcctacatgatatggatgccggccatttgtcattcgtcgaagaggtgttcgagaatcagactcgcctccctggggggcaatggatctacatgtccgacaattataccgacgttaatggtgagaaagttctgcccaaagacgatatagaatgtccactgggatggaagtgggaagacgaggagtggtccactgatctaaaccgtgctgtcgatgagcagggctgggagtatagtatcactatccctcctgagagaaagcctaaacattgggttcctgctgagaagatgtactacacccatcgacggcgcagatgggtcagattacgccggcgagatctatcacagatggaggccctcaaacgtcatcgccaggctgaggccgaaggcgagggatgggaatacgcgtccctttttggctggaagtttcacctggagtataggaagactgatgcattcaggcgaaggagatggagaaggaggatggaacctctcgaaaagacaggaccagctgcagtgttcgcactcgaaggagcactagggggagtgatggatgacaagtctgaggatagcatgagcgtgtccaccctgagtttcggcgtgaaccgcccgacaatatcttgcatttttgactacggtaatcggtatcacctgcgctgttatatgtatcaggcccgggaccttgccgcgatggataaggactccttttctgacccgtatgccatcgtctcttttctgcaccagtcccagaagaccgtggtcgtcaagaacactctgaatcccacatgggaccagacactaatcttttatgagattgaaatcttcggagagcctgcgacagttgccgaacagccaccgagtatagtcgtcgagctctatgatcatgatacctatggcgccgacgagttcatgggacggtgcatttgccaaccctcactagagcgcatgccccgcctggcctggttccccttgacacgcggctcccagccctctggcgaactcctcgcttcgtttgagctgatccagagggaaaagcccgccatacaccacatcccaggattcgaggtgcaggaaacgtcccgaatactggacgaaagcgaggatactgatctcccctatccacctccgcagagagaggcaaatatttacatggttccgcagaacatcaagccagcactccagcgaactgccattgagattctggcatggggccttagaaatatgaagtcctatcagctcgcaaatatctcaagtccctctctggtggtggagtgcggaggacaaacagttcaatcttgcgtgatccgcaatctacgaaagaacccaaattttgacatctgtactctcttcatggaagtgatgctgccacgggaggagttgtactgcccaccgattacagtgaaagttatagacaatcggcaatttggtcgccgccctgtggtgggacagtgcacaatcaggagtctggaaagcttcctgtgtgacccatactcggcggagtcgccctcacctcaaggcggtccagacgatgtgtcactactgagcccaggcgaggatgtgctcattgatatagacgacaaagagcctctcattccaatacaagaggaggaattcatagactggtggtcgaaattttttgcttccataggagagcgggagaaatgtgggtcataccttgagaaagacttcgacaccctgaaggtgtatgatacgcagcttgaaaacgtggaagcctttgaagggctgtcggatttctgcaatacctttaaactatataggggtaagacccaggaggaaactgaggatccctccgtaataggtgaatttaaagggctgtttaagatataccccttgccagaggaccctgcaattcctatgccaccacgccagttccaccagttagccgcacaagggcctcaagagtgtcttgtcagaatctatatcgtgagagcgtttggactccagccaaaggacccaaacggaaagtgcgatccttacatcaaaatcagcataggcaaaaagtcggtctcagatcaggacaattacatcccctgcacactggagccggtttttgggaagatgtttgaactgacttgtaccctgcccctggaaaaggatcttaaaatcacattgtacgactacgacctgctgtccaaggatgagaagatcggggagactgtggtggacttagaaaatcggctgctctcgaaatttggggctcgctgtgggctgccacagacgtactgcgtgtctggaccaaatcagtggagagatcaacttcgtccctcccaactcctgcatctgttttgccagcagcatcgtgtgaaggctccagtgtaccggacagaccgggtcatgtttcaagataaggagtattctatcgaagagatcgaagccgggaggatcccaaacccacatctcgggcctgtagaggagcgtcttgcgctccatgtgcttcagcagcagggtctggtgcccgagcacgtcgaaagccggcccctatacagtccacttcagccggacattgagcaagggaagctgcagatgtgggtagacctgttcccaaaggctctggggaggcctggccccccgtttaacattacccccaggcgtgcaaggcgattcttccttcgatgtatcatttggaatactcgggacgtgatcctcgatgacctgagcctaaccggtgagaagatgtcagatatttatgtgaagggctggatgattggttttgaggaacacaaacaaaagaccgacgtgcattatcgctccctggggggggagggcaactttaattggcgttttatttttccattcgattatctccccgctgagcaagtttgcacaattgctaaaaaagacgccttctggagattagataagactgagtctaaaatacccgcccgcgttgtgttccagatctgggacaacgataagttttcgtttgacgatttcctgggcagcctgcagctagatctgaatcgtatgccgaaacctgccaagacggcgaagaagtgttccctggaccaactggatgatgcttttcatcccgaatggttcgtgtccctgtttgaacaaaagaccgtaaagggatggtggccgtgtgtcgcagaggagggtgaaaagaaaatcctggcaggcaaattggagatgactctggaaatcgtggccgagagtgagcacgaagaacggccagccgggcagggccgcgatgagccaaacatgaaccccaagctggaggatccccgcagacctgacacttcctttctgtggtttacaagtccgtacaagactatgaaattcattctctggagacgattccgatgggcgattattctgttcatcatcttatttattctgttgttgttcctggcgatttttatttacgccttcccaaattatgcagctatgaagctcgtgaaaccattctcg

SEQ ID NO: 10642 - DNA, 6243 bp, Artificial Sequence
  Description of Artificial Sequence: Synthetic coding sequence
atgctctgctgtttgttagttagggcgtccaacctgccttccgcgaaaaaagatcgaagaagtgacccagttgccagtctgactttccggggagtcaaaaagagaactaaagttatcaaaaattccgtcaatcccgtgtggaacgaaggatttgaatgggatcttaaaggaataccactagaccagggatcagaattacacgtagtggtgaaagatcatgaaactatggggaggaatcggtttctcggagaggctaaagtgccgctacgagaggtgcttgccacacccagtctgtccgcttcttttaacgccccactgctagatactaaaaaacagcccactggagcctccctcgtactccaagtgtcctatacacctctccccggagctgtacccttatttcccccacccactcctctggaaccctctccaactcttcccgatcttgatgttgtggctgatactggaggggaagaagatactgaagatcagggactgacaggggatgaagctgaaccctttctggatcagtcaggaggacctggagctccaacaacacccaggaaacttccttctagacctcctccgcactatcccggaataaaaagaaaaagaagtgctcccactagtaggaaactactcagtgacaagccacaggatttccagatacgggtacaggtaatagaagggagacaactgcctggagttaatattaagcctgtggttaaagtgacggccgccggacagactaaaagaacaaggatacacaaagggaattcacctctttttaatgaaacactcttctttaaccttttcgattctcccggagaactttttgatgagccaatctttattactgtggttgattctagatccctcaggacagacgctcttcttggggaattcaggatggatgttgggacgatctatagagaaccccggcatgcatatcttcggaaatggctcttgttgagtgatccagatgatttctccgcgggggcacgcggatatcttaaaacttccctctgtgtactaggacccggggatgaagcaccgcttgagcggaaagatcctagtgaagataaagaagacatcgaatccaaccttttaagacccacaggagtagcgctgcgcggagcccatttctgtctcaaagtttttagagccgaggatctgccacagatggatgacgcagtcatggataacgtcaagcagatatttgggtttgaatccaataagaagaatctagtcgatcccttcgtcgaagtgtcttttgccgggaaaatgttgtgttctaaaatcctcgaaaaaacagcaaatccccagtggaatcagaatatcacactccctgccatgttcccttccatgtgcgaaaaaatgcgcatccggatcatagactgggatcgcctcacacataatgatattgtcgccacaacttatctatccatgtcgaaaatctccgcgcctggaggagaaattgaagaagaacctgccggggccgtgaaaccatccaaagcttccgatctggatgattatttggggtttcttccaacatttggaccttgctacatcaacttatacgggtcaccaagggaatttacagggttcccagatccatatactgagttgaacacagggaagggagaaggggtggcctatagaggacgtctccttttgagtctggaaacgaaattagtcgagcattctgagcagaaagttgaggatctccccgctgatgatatactcagagtggaaaaatacctgagacggagaaagtattccttgttcgccgctttttattcagccactatgctgcaggatgtggatgacgctattcaatttgaggtctctataggaaactatggaaacaaattcgatatgacatgcctcccactggcttctacaactcagtatagtcgggccgtatttgacgggtgccactattactatcttccctggggaaatgttaaacccgtggttgttctgtcctcttattgggaagatatctcgcacaggatagaaacacagaatcagctactggggatcgcagacagactggaagccggacttgaacaagtacatctcgccctaaaagcccagtgttctacagaggatgtcgactccctcgtggcccagttgacggacgaattaattgctggatgctcacagcctctcggagatatacatgaaacacctagtgccactcaccttgaccagtatttgtatcagttacgaactcaccatctatcccaaataactgaggctgccctcgccctgaaactaggacactcagaattgcccgctgcactggaacaggctgaagattggctcctcagactgcgggctctagctgaggaaccccagaactcactccccgatattgtcatctggatgcttcagggagataaaagggtagcatatcagagggttcccgctcatcaggtgctgttctcacgccgcggagctaactattgcgggaaaaattgtgggaaactacagactatattccttaaatatcccatggaaaaagttccaggggctcgaatgccggtgcagatcagagtaaaactctggtttgggctatccgtggatgaaaaggaattcaatcagtttgcagaagggaagttatctgtgttcgcagaaacatatgaaaatgagacaaaattagccttagttggaaattggggaacaacagggttaacttatccaaaattctctgatgtcacaggaaaaatcaaactccccaaggattcattcaggcctagtgccgggtggacatgggctggagattggtttgtatgcccagagaaaactctattacacgatatggatgccggacacttatcatttgtggaggaagtcttcgaaaatcagacacggcttcccgggggacagtggatttatatgtcggataactatacagacgtgaatggagaaaaagtgcttccaaaggatgatatcgaatgtccccttggatggaagtgggaggatgaagagtggtccactgatcttaacagagctgtagatgagcaaggatgggagtattccatcacaatcccaccagaaaggaaaccaaagcattgggtcccagcagaaaaaatgtattatacacatagacggagacggtgggtgagacttaggaggagagatctctcacagatggaagctcttaaacggcacagacaggcggaggctgaaggggaagggtgggaatatgcttccttattcgggtggaaatttcatctcgaatatcgcaagacagatgccttccgaagacgcaggtggcggcggaggatggaaccccttgaaaaaactgggcctgctgccgtttttgccctggagggagcactcggaggggtaatggacgataaatccgaagacagtatgtccgtatcaacactttccttcggagtcaaccgccctactatttcgtgcatcttcgattacgggaatcgctatcaccttcgctgctatatgtaccaggccagggacctcgctgcgatggataaagattcattctctgatccttatgctatcgtttctttcctgcatcagagtcagaaaactgtagttgtaaaaaatactttaaacccaacatgggaccagacactgatcttctacgaaatagaaattttcggggagccagcaacagtagctgagcagccacctagtatcgtcgtcgaattgtacgatcatgatacatacggagccgacgagtttatggggcggtgtatatgtcagccctcactagaaagaatgccacggttagcttggttccccttaactcgggggagtcagccctctggagaacttctagctagttttgaactcatacagcgcgaaaaaccggcaatccatcacatccctgggttcgaagtgcaagaaacttctagaatcctggatgagtcagaagatactgatctaccataccccccaccccagagggaagccaatatatatatggtacctcagaatataaaacccgccctgcagaggacagccatcgaaatcctggcatgggggctcaggaacatgaaatcctatcagctggccaatatctcctctccaagtttagtagtggaatgtgggggacagactgtccagagttgcgtgatccgaaatctacggaaaaatcctaatttcgatatatgcacactgttcatggaagtaatgctccccagagaagaactttattgccctcccattactgtgaaagtgatagataacaggcagtttgggaggaggcctgtggtcgggcagtgcacaataagatccctcgaatccttcctatgtgatccatactcagccgaatcgccgtcacctcaaggagggcctgatgatgtatctcttctctcacccggggaagatgtcctaattgatatcgatgataaggaacccctaattcctattcaggaagaagaatttatagattggtggtccaaattcttcgcctctatcggagaacgggaaaaatgtggatcttatctagagaaggattttgatacactcaaggtttatgacactcaactggaaaatgtcgaagcattcgaaggactatctgacttctgtaatacttttaaactatatcgcgggaagacacaggaagaaactgaggatccaagtgtgatcggagagtttaaagggctctttaaaatatatccacttcccgaggatccagccatccccatgccccctagacagtttcatcagcttgctgcccaaggaccacaggaatgtctagtcagaatctatatagttagagcgttcgggcttcagccaaaagatcccaacgggaagtgtgatccatacataaaaatatccatcgggaaaaagtccgtgagtgatcaggataattatatcccctgcactctagaacctgtgttcggaaaaatgttcgaattaacatgtacactacctctggaaaaagacctaaaaataacattgtacgattatgatcttttatccaaagatgagaaaattggggaaacagttgttgatctcgaaaatcggctgttaagtaaattcggagcgcgctgtggattaccccagacttactgcgtgtccgggccaaaccagtggcgtgatcagctcagaccctcacagctcctccatttattctgtcagcaacatagggtgaaagccccagtttataggactgatcgagtaatgtttcaggataaagaatactccattgaagaaatcgaagcagggcgaatccctaatcctcatttagggccagttgaggaaaggttggccctccatgtactccagcagcaggggctggtgcccgaacacgttgaatctcgcccactgtattctccgctacagcccgatatagagcagggaaagctccagatgtgggtcgatttgttccccaaagcattgggaaggcccggacctcccttcaatatcacacccaggcgggctcggcggttctttctcaggtgtatcatttggaatactagggacgttatcctggatgatctatctctgactggggaaaaaatgagtgacatctatgtaaaggggtggatgatcgggtttgaggaacacaagcagaaaactgacgtgcattatcgatcactcggaggagaaggaaatttcaactggcgattcatttttccatttgattatctccccgccgaacaagtctgtacaatcgcgaaaaaagacgctttttggaggctagataaaacagaatctaaaattcccgctagagtggtcttccaaatatgggataatgataaattttccttcgatgatttcttgggatccctccagctagatctcaaccgcatgcccaagccagcaaaaactgctaaaaaatgttctcttgaccagctcgatgatgctttccaccccgaatggtttgtctccctcttcgaacagaaaactgtgaaagggtggtggccctgcgttgctgaagaaggagaaaaaaaaattcttgcagggaaacttgaaatgactcttgagattgtcgctgagagtgaacacgaagagagacctgcagggcagggaagagatgaacctaacatgaaccccaagcttgaagatcccaggcgaccagatactagtttcctgtggtttacatccccttataaaactatgaaatttatcctctggaggaggtttaggtgggccatcatactctttataatactgtttatcctactgctattcctggctatcttcatctatgcttttcctaactatgccgctatgaagcttgtgaaacctttctca

SEQ ID NO: 10643 - DNA, 6243 bp, Artificial Sequence
  Description of Artificial Sequence: Synthetic coding sequence
atgttgtgctgcctgctggtgcgcgcttccaacttgccgagcgcaaaaaaggacagacggagcgaccccgtcgcctcgctcaccttccggggagtcaagaagcgcaccaaagtgatcaagaattcagtgaatcccgtgtggaacgagggattcgagtgggacctcaagggaattcctctcgatcaaggctcggaactccatgtggtggtcaaggatcacgagactatgggtcggaatcggtttctcggagaagcaaaagtgccactgcgagaggtgctggcaaccccatccctgtccgcctcctttaacgctcctcttctggacaccaaaaagcagccgaccggagcgagcctggtccttcaagtctcgtacacgccacttccgggcgccgtgccactgttcccgccgcccaccccgctcgaaccctcccctacccttccagacctcgatgtggtcgccgacaccgggggagaagaggacaccgaggaccagggccttaccggagatgaagcggaaccgtttcttgatcagtccggcggccctggtgcacctaccaccccgcggaaactgccctcgcgcccgcccccgcactacccggggatcaagcggaagcggtccgccccgactagccggaaactgctgtccgacaagccgcaggattttcagatccgggtgcaggtgatcgaaggaaggcagctgccgggcgttaacatcaagcctgtggtgaaagttaccgcagctgggcagaccaaacgaactcggatccacaaaggtaactcgccactgttcaacgaaaccttgtttttcaacctgttcgactcgccaggagagctgtttgatgaaccgattttcatcacggtggtggactcgagaagcctgcgtaccgatgccctgctgggcgagtttagaatggacgtcggaacgatttaccgcgagccgagacacgcttacctccgcaaatggctgctgcttagcgatccagacgattttagcgctggggcccgggggtatctgaaaacgtcgctgtgcgtgctgggaccaggcgacgaagcacctctggagcgcaaggatccaagcgaagataaagaggacattgaatcaaacctgctgcggcctactggagtggccttgaggggagctcacttctgtctgaaagttttccgggccgaggacctcccgcagatggacgacgcggtgatggacaatgtgaaacaaatcttcgggttcgaatctaacaaaaagaaccttgtggatccttttgtggaagtctcctttgcggggaagatgctttgctccaaaatcctcgaaaagactgcgaatccacagtggaaccagaatatcacgctgccagccatgttcccctcgatgtgtgagaagatgcgcattagaatcatcgactgggaccgcctgacgcataacgatatcgtggccactacctacctctcgatgtccaagatctctgccccaggaggcgagatcgaggaggagccggctggagcagtgaagccttccaaggctagcgatcttgatgattacctgggattcttgccgacctttggaccgtgctacatcaacctttacggctcgccacgcgaattcaccggcttcccggacccgtacaccgaactgaacaccggaaagggcgaaggagtggcctacagagggaggctcctgctgtctcttgaaaccaagctggtcgaacattcggagcagaaggtggaagatctcccggctgacgatatcctgcgcgtcgagaagtacctgaggcgcagaaagtactccctgtttgccgctttctactcggcaaccatgctgcaagacgtggacgatgcgatccaattcgaggtgagcatcggtaactacggaaacaagtttgatatgacctgcctgccgcttgcgtccactacccagtacagccgggctgtgttcgacggatgccactactactacctgccgtggggaaatgtgaagccggtggtggtgctgtcctcgtactgggaagatatctcacaccgcattgaaactcagaaccagttgctcggcatcgcagatcggctggaagctggactggagcaggttcatctggccctcaaggctcaatgctcgactgaagatgtcgactcgctcgtggcccaacttactgacgagctgatcgctgggtgctcccagccgctgggagacatccacgagactcccagcgccacccacctggatcagtacctttaccagctgcgcactcatcacctgtcccagatcactgaagccgctcttgctctgaaactgggtcactccgagctcccggctgccctggaacaggccgaggactggctgcttagactgcgcgccctggcggaggagccacaaaacagcctcccggacatcgtgatctggatgcttcaaggagataaaagggtggcctaccagagggtgccggctcaccaagtgctgttttctcgtcggggtgccaactactgcggtaagaactgcggaaagttgcagactatctttttgaagtacccaatggaaaaagtcccgggtgcacggatgccggtccaaatcagggtcaagctgtggttcggactgtcagtggatgaaaaagagttcaaccagttcgccgaagggaaactgtccgtgttcgcagaaacttatgaaaatgagactaagctggcgctggtcggaaattgggggacgaccggactgacctacccgaagttcagcgacgttaccggaaagatcaaactgccgaaagactcgtttagaccatcggcaggatggacctgggccggagactggtttgtgtgccccgaaaagaccctcttgcacgacatggacgccggtcacctgtcgttcgtggaagaagtgttcgagaatcagactcgcctgccgggagggcaatggatctatatgtcggacaactacacggacgtcaatggagaaaaggtgctgccaaaggacgacatcgaatgtcctttggggtggaaatgggaggacgaggaatggagcaccgacctgaatcgcgccgtggatgagcagggttgggaatattccatcactatccctccggagagaaaaccgaagcattgggtgccggccgagaagatgtattacacccacagaagaaggcgctgggtccggctgcggcgacgcgatctgtcacaaatggaagcgctcaagcggcacaggcaagcggaagcagaaggggagggatgggagtacgccagcctgtttggatggaagttccatcttgagtaccggaaaactgacgctttccgccggcgcagatggcgccggcgcatggaaccgctggagaaaaccggcccggctgccgtgttcgccttggagggcgcgctcggaggagtgatggacgacaaatcagaggattcgatgtcggtgagcactctttccttcggtgtcaaccgcccaacgatcagctgcatcttcgattacggcaaccgctaccatctccgctgctacatgtaccaggcgcgcgatctggccgcgatggacaaggactcattttccgatccatacgccatcgtgagcttcctccaccagtcacaaaaaactgtggtggtgaagaacaccttgaacccaacctgggaccagactctcatcttttacgaaattgaaatcttcggtgaaccggctaccgtggcggagcaacctccgtcaatcgtggtggagctttacgaccatgacacttatggagccgacgaattcatgggacgctgtatctgccagccttcgctggagaggatgccacgcctcgcctggttcccgctcactcggggctctcagccgagcggagaactgttggcgtcgttcgagctgatccagagggagaagccggcgattcaccacatcccgggtttcgaagtgcaagaaacttcacgaatcctggatgagtcggaagatacggacctgccttaccccccgccacaacgcgaggctaacatatacatggtcccacaaaacatcaagccagcactccaaagaactgcgattgagatcttggcatggggactgcggaacatgaagtcataccaactcgcaaatatctcgtccccgagcttggttgtcgaatgcggtggacaaactgtccagtcctgcgttatcaggaatctccggaaaaaccctaacttcgacatctgcaccctctttatggaggtcatgctcccacgcgaagagttgtactgtccccccatcactgtgaaggtcatcgacaatcgccagtttggtagacggccggttgtgggtcaatgcactatcagatcgttggagtctttcctctgcgacccttactcggctgaatcaccatcaccgcagggaggtccggacgacgtctccctcctgtcacccggcgaggatgtgctcatcgatatcgacgacaaggagccactcatccctatccaggaagaggaattcatcgattggtggtccaagttcttcgcctcgatcggagagcgggaaaagtgcgggtcctaccttgagaaagactttgataccctcaaagtctacgatacccagctcgaaaatgtggaagcctttgaaggacttagcgacttctgtaacaccttcaaactttaccgcggcaaaactcaagaagaaaccgaagatccctcggtgatcggagaattcaaggggctgtttaagatttacccgctgcccgaggacccggccatccccatgccacctagacagttccaccaacttgccgcccagggaccccaggagtgcctggttagaatttacatcgtgagggccttcggcctgcagccaaaggacccgaatggaaagtgtgatccgtacatcaagatctcgatcggaaagaaaagcgtgtcggaccaggacaattacattccctgcaccctcgaaccggtgttcggaaaaatgttcgaactgacctgcacgctcccgcttgaaaaggacttgaagatcaccctgtacgactacgaccttctcagcaaggacgagaagatcggagaaaccgtcgtcgatctggagaatagattgctgtcgaaatttggagcacggtgtgggctgcctcagacttactgcgtctcaggtcctaaccagtggcgggaccaactgcggccctcccagctgcttcacctgttctgccaacaacaccgcgtcaaggcgccggtctaccgcactgacagagtgatgttccaggataaggagtactcaattgaggagattgaagccggaaggatcccgaatcctcacctgggtcccgtggaagaacggctggcgctgcacgtgctccagcagcaaggcctggtgcccgagcacgtggagtcgcgcccgctttactccccactgcagccagatatcgagcaaggaaaattgcagatgtgggtggacctcttcccaaaggcgttgggcagaccaggacccccgttcaacatcactccgagaagagcgcgccgcttctttctccggtgtatcatctggaacaccagagatgtgatcctggatgatctctcactcactggagaaaagatgtcagacatctacgtgaaggggtggatgattggatttgaggagcacaagcagaaaacggatgtgcactacagatcgctgggaggagaggggaacttcaactggaggttcatctttccgttcgattatctgcccgctgaacaggtgtgtactatcgccaagaaggatgccttctggagactggataagaccgaatccaagatcccggctcgcgtggtgtttcagatctgggacaacgacaaattctcgttcgacgactttctcggatcactgcagcttgacttgaatcggatgccaaagccggcaaagactgctaagaaatgctccctcgaccaactggacgacgcgtttcaccctgagtggttcgtttccctcttcgagcagaaaactgtgaaaggatggtggccatgcgtcgccgaagagggagaaaagaagatcctggcaggcaagctggagatgactttggagatcgtggccgaaagcgagcatgaggagcggccggcgggacagggccgcgacgaaccgaacatgaatccaaagctcgaggatccgcggcggccggacacgagcttcctctggttcacttcaccgtacaaaaccatgaagttcatcctgtggcgtcgcttcaggtgggcgattatcctgttcataatcctgtttatcctccttttgttcctggccatcttcatctatgcgttccctaattacgcggcgatgaaactggtgaagccgtttagc

SEQ ID NO: 10644 - DNA, 6243 bp, Artificial Sequence
  Description of Artificial Sequence: Synthetic coding sequence
atgctttgttgtctgcttgtccgcgccagcaatctgccaagcgccaagaaggacagacggtcggatccggtggcctccctgacttttagaggggtgaagaagagaactaaggtcattaagaactctgtcaatccggtgtggaatgagggatttgagtgggatctgaagggcatccctctcgatcaaggttccgaactgcacgtggtcgtgaaagaccatgagactatgggacgcaacagatttcttggggaagcaaaggtgccactgagggaggtgctcgccactccttcgctgtcggcatcgtttaatgcaccactgctggatactaagaagcagcctactggggcatcgcttgtgctgcaggtcagctacaccccactgcccggggcagtgccactttttcctccgcctacccctctggaaccttccccaactctccctgatcttgacgtggtcgccgatacgggcggtgaggaggacacggaggatcagggtctgaccggtgacgaagcagaaccattcctggaccaatctggtggaccgggagcgcctaccaccccacgaaagctgccttcacggcccccaccacactaccccggaatcaagcggaaaagaagcgcaccaaccagccgcaagctcttgtcagataagccgcaagattttcagatcagagtgcaagtcatagaagggagacagctcccgggtgtgaacattaaacctgtggtgaaggttactgcagccgggcagactaagagaactcgcattcataaaggtaactccccactgttcaacgaaaccttgttctttaacctttttgattcaccaggagaactctttgatgaacccattttcatcaccgtggtggactcgagatcgctgcgaactgatgcactcctcggagaatttcgcatggacgtgggtactatttacagagagccaaggcacgcatacttgcgtaaatggctcttgctgtcggatccggatgatttttcagcgggtgcaaggggataccttaagacctcgctctgtgtccttggaccaggagatgaagccccgcttgaacggaaggaccctagcgaagataaggaggacatcgaatcgaacctcctgaggcctaccggagtcgcccttagaggagcgcatttctgtctgaaagtttttcgggccgaagatctgccccaaatggacgatgccgtgatggacaacgtcaagcagatatttggctttgagagcaacaaaaagaacctggtggatccatttgtggaggtgtcctttgcgggaaaaatgctgtgttcgaagatactcgaaaagacggccaatccacaatggaaccagaatatcactcttcctgcgatgtttccttcgatgtgcgagaagatgaggattcggattatcgactgggatcggcttacccacaacgatattgtcgctactacctatttgagcatgtcgaagatctccgcaccaggtggagaaattgaagaagagccagcaggagccgtcaaaccttcgaaggcctcggaccttgatgactaccttgggttcctgcctacttttggtccttgctacatcaacctgtacggaagcccacgtgaattcactggattccctgatccttacactgagctgaacaccggcaagggtgaaggcgtggcatacagggggagactgctgcttagcctcgagactaaactcgtggaacactccgaacagaaggtggaggaccttccagcagacgacatcctgcgcgtggagaaatacctgcgtcggagaaaatactccctctttgcagccttttactcggcaactatgctgcaagacgtggatgacgcaatccaatttgaggtgtccattggtaactacggaaacaagtttgatatgacttgccttccactggcatcgaccacgcaatattcgcgagcagtgttcgatggatgccattactactacctgccctggggcaatgtgaagccggtcgtggtcctttcctcctactgggaagatatctcccatagaattgaaacccaaaatcaactgcttggcattgcagatcgactggaggcaggcctggaacaagtgcatcttgcactgaaagcccagtgttccactgaagatgtggattctcttgtggcacaactcactgatgaactgatcgcaggttgttcgcaacctcttggtgacattcatgagactccttcggcaactcatcttgatcaatacttgtaccaactgcgtactcatcaccttagccaaattactgaagcagcacttgcgctgaagctgggtcatagcgaactccctgcagcgctggagcaagcggaagattggcttctgagactcagagccctggcggaagagcctcagaattccctcccagatatcgtgatttggatgctgcagggcgacaagcgtgtggcttaccagagagtgcctgcacaccaagtgctcttctcgcgtcggggagcgaactattgtgggaagaactgtgggaagctgcaaaccatttttctcaaatatcctatggaaaaggtgccaggtgcgaggatgccggtccagattagggtgaagttgtggttcggtctttccgtggatgagaaggagttcaatcagtttgccgaaggaaagctcagcgtctttgccgaaacctacgagaacgagactaaattggcacttgtcggaaattgggggactaccgggcttacctaccccaagttttcggatgtcaccgggaaaatcaagctgccaaaggatagctttcgaccctcagcaggttggacgtgggctggagattggttcgtgtgtccagaaaagacccttcttcatgacatggatgcgggacatttgtcatttgtcgaggaagtgtttgagaatcagactagacttcccggtggtcagtggatttacatgtccgataactacaccgatgtcaacggagaaaaggttctgcctaaggacgacattgaatgcccactgggatggaaatgggaggacgaagaatggtcaaccgatcttaatagggcagttgatgagcaaggatgggaatactcgattactataccacctgagcggaagccaaaacattgggtccccgcagaaaagatgtactacactcatagaagaagaagatgggtgcgattgcgcagaagagacttgtcgcagatggaagcccttaaacgtcatagacaggccgaagcagagggagagggatgggagtacgcgtcgctctttggatggaaattccatctcgaatatagaaagacggatgcctttcgtcgccgtagatggcgacggcgcatggaaccactggaaaagactggacctgccgctgtctttgctcttgaaggcgcacttggaggtgtcatggacgataagtctgaggattccatgtcggtgtcgactctgtcgttcggggtgaaccgaccaaccatttcttgtattttcgattatggtaaccgataccatctgaggtgctacatgtaccaagcgagggatcttgcagcaatggacaaggattccttctccgatccatacgcaattgtctcctttcttcaccagtcacaaaaaactgtcgtggtgaagaacacccttaatcctacgtgggatcagacgttgatcttttatgaaattgagatatttggcgaacccgcaaccgtcgccgaacagcctccatccattgtggtggaactgtacgaccatgatacctacggtgcggatgaattcatgggacggtgtatatgtcagccatcccttgagcgaatgcctagacttgcatggtttcctcttacgagaggaagccagccatccggagaactcctcgcatccttcgagcttatccaaagagaaaaaccagcgattcaccatattcctggttttgaagtgcaagaaacttcaaggattcttgatgaatcagaagataccgacctcccttacccccctccccaaagggaggcgaacatctatatggtgcctcagaacatcaagcctgctctgcagcggaccgctattgaaatccttgcatggggtcttagaaacatgaagtcctaccagctcgccaacatctcatcgccttccctcgtcgttgaatgcggcgggcagactgtgcaatcctgcgtcatccgcaacctcagaaagaaccccaatttcgacatatgcacgttgtttatggaagtcatgttgcccagagaggagttgtactgtccgcccatcactgtcaaagtgatcgacaatcggcaatttggacggcggcctgtggtgggccagtgcaccattcgatcgcttgagagcttcctgtgtgatccgtacagcgcagaatcaccctcgccccaagggggtcctgacgatgtctcactgctttcacctggtgaggatgtgcttatagacatcgacgacaaagaaccactgattccaattcaagaagaagagttcatcgattggtggtccaagttttttgcgtccatcggtgaaagggagaagtgtggttcgtacctcgaaaaagattttgacacccttaaagtttacgacacccagctggaaaacgtcgaagcgttcgaaggtctttcagatttttgcaacactttcaaactttaccgtggaaagacccaggaagagactgaggatccgagcgtgattggagagtttaaaggcctctttaagatttacccactgccggaggacccggcaattcctatgcctccgcggcaattccatcaactggccgcacagggaccgcaggagtgccttgtgaggatttacattgtgcgtgcattcgggctgcaacctaaggaccccaacggaaagtgcgatccgtacatcaaaatctcaatcggaaaaaagtcagtgtcagatcaggacaattacattccttgcacccttgaaccagtgtttggtaagatgttcgagctgacctgtaccctccctcttgaaaaggatctgaagatcacgctttacgattacgaccttctctcgaaagatgagaagatcggcgaaacggtggtcgacttggaaaatcggttgctttcgaagttcggtgcaagatgcggactcccccagacgtactgtgtgagcggacctaaccagtggagggatcaacttcgaccatcgcagcttcttcacctgttttgccagcagcaccgggtgaaggcacccgtgtaccgcactgatcgagtgatgttccaggacaaggaatacagcatagaagaaattgaggctggcagaattcccaatcctcatctgggacccgtggaagagagactggccctgcatgtgcttcagcagcaagggctcgtgcctgagcatgtggagagccgacccctgtattcacccctgcagccggacattgaacagggcaagttgcagatgtgggtggacctctttccaaaagcactcggacgcccgggaccaccattcaacatcactccaagaagagcgcggcggttttttctcagatgtatcatatggaacaccagagatgttatcctggatgatctgagcctcaccggagagaagatgtcggacatttacgtgaaaggatggatgattggctttgaggagcacaaacaaaagaccgacgtgcactaccgttcccttggaggtgaaggtaacttcaattggcgatttatcttcccttttgactacctccctgccgagcaagtctgtaccattgcaaagaaagacgcattttggaggctggacaagactgaatcgaaaattcccgcaagagtggtgtttcagatctgggataatgataagttcagctttgacgactttctgggctcccttcagcttgatctgaaccgcatgcccaagccagctaagactgcaaaaaagtgttcccttgatcagctcgatgatgcgttccatcccgaatggttcgtgtccctctttgagcaaaagacggttaagggttggtggccttgtgtggcagaagaaggtgaaaagaagatactcgcggggaaacttgagatgactctcgagattgtggccgaaagcgagcacgaggagaggccggcaggacaaggtagagacgagcctaacatgaatcctaagctcgaagatccacgccgaccggatacctcgttcctctggttcacctcgccctacaaaacgatgaagttcatcttgtggagacgttttagatgggccatcattctcttcatcattcttttcatactgctgctgtttctggccattttcatctacgcatttcccaactacgcagctatgaagttggtgaagcctttttca

SEQ ID NO: 10645 - DNA, 6243 bp, Artificial Sequence
  Description of Artificial Sequence: Synthetic coding sequence
atgctctgctgtctgttggtacgcgctagcaatctcccatcagccaagaaggaccgaaggtctgatcccgtagcctctctgacgttcaggggcgtcaagaagcgcactaaagttataaagaattcagtcaatccagtctggaacgaaggatttgaatgggacctgaaaggaatccccctggaccagggctcagaactccatgtggtggtgaaagatcatgaaacgatgggacgaaatcggttcctgggcgaggcaaaggtccctttgcgtgaggtgctagccactccaagtttaagcgcatccttcaacgcacctcttctggacaccaagaaacagcccactggagccagtctcgtccttcaagtgagctacacgccgctgcccggagccgtgcctcttttcccaccacccactccgctggagccgagccccaccctcccggacctggacgtagtcgctgatacaggaggagaagaagatactgaggatcagggcctgaccggggatgaggcggagccgttcctggaccagtctggaggtccaggagcacctaccacaccccgaaagctgcctagtcggccgccccctcactaccccgggattaaacgcaagcgcagcgcccctacctctcggaaattgctgagtgataagccgcaggattttcagatccgagtgcaggtaattgaaggcaggcagcttccaggggttaatattaaacccgtcgtgaaggtcacagcggcgggccagaccaaaagaacccgcatccataagggcaactctccactgttcaatgaaacgctcttttttaatctgttcgacagcccaggtgagctgtttgatgaacctattttcataaccgtggtcgatagtagatctctgcggacagacgccttgctgggcgaatttaggatggacgtcggaaccatctacagagaacctcgccacgcctatcttcgaaaatggcttttattgagcgaccccgacgactttagtgcaggagccagaggctacctcaagacctctctatgcgtgctgggcccaggggatgaggctccgctggagaggaaagacccaagcgaagataaggaagacattgagtctaatctcttgcggccgaccggggtggcactccggggagctcacttctgcttaaaagtctttcgggcagaggaccttccccaaatggacgacgccgtgatggacaacgtgaaacaaatctttggatttgaatctaacaagaagaatttagttgaccctttcgtagaagttagcttcgccggcaaaatgctctgtagcaagatcctggaaaaaaccgccaaccctcagtggaaccagaatatcactctccccgccatgttcccaagcatgtgcgaaaaaatgcgaatacgtatcatcgactgggaccgtttaacccacaacgatattgtggccacgacctacctttcgatgtccaagatttcagcccccggaggggaaattgaagaggaacccgcaggtgctgtaaaaccaagtaaggcatcagacttagatgactacttgggatttttaccaacctttggcccttgctatattaatttatatggatctcctcgggaattcactggtttcccggacccttatacagagctgaatactggcaagggagaaggcgtcgcatatcgcggaagactgctgctgagcttagaaaccaaacttgtggaacattccgaacaaaaagtggaagatcttcccgccgatgacatcctgcgagtggagaagtacctcaggcgacgaaagtatagtctgtttgcagccttttattcggccacaatgctgcaggatgtggacgacgcaatccagttcgaagtgtccatcggaaactacggaaataaatttgatatgacctgtctcccactcgcatcaacgacccagtatagtagggcggtatttgacggctgccactactattatttgccttggggaaatgttaagcctgtggtggtccttagctcttactgggaggatataagtcaccggatcgagacccaaaatcagctgttaggcatcgctgatcggctcgaagctggactcgaacaggtacacctagccctcaaagcccagtgcagcacagaagacgttgattctctcgtggcgcaactgacggatgaacttatcgctgggtgctctcagcctctgggggacatccatgagactccttcagccacgcatcttgaccagtatctttaccagttgcgtactcaccacctctctcaaattaccgaagcagctctggctttaaagctcggacattcggaacttcctgcagccttggagcaggccgaggattggctcctacgattgcgcgcgttggctgaggagccacaaaattctctgcctgacatcgtcatttggatgctgcagggtgataaacgagtggcttaccagcgggtgccagctcatcaagtcttgttcagcaggcgaggggccaactattgtggcaaaaactgtggcaagctgcagactatctttcttaaataccctatggagaaagtgcccggtgctagaatgcctgttcagattcgagtgaaactgtggtttggcctttcggtagacgagaaagagtttaaccagttcgccgagggaaaactgagtgtgtttgccgaaacctacgagaatgagaccaaattggcgttggtgggcaactggggcactaccgggctgacgtatccaaagttcagtgacgtgaccggcaaaatcaagctgccaaaggatagcttcagaccaagcgcaggatggacctgggcaggggattggtttgtgtgtccggagaaaactttgctccacgatatggatgccggccatctatcctttgtcgaagaagtgtttgagaaccaaacaagactgccagggggccagtggatctacatgtccgacaactacactgatgtgaacggagaaaaggtactccccaaagatgatattgagtgcccgctgggatggaaatgggaagacgaggagtggagtacagatctcaacagggccgtcgacgagcaggggtgggagtattccattacaatcccacctgaaagaaaaccgaaacactgggtgcctgcagaaaaaatgtactacactcatcgtcggaggcggtgggtccgtctccggcggcgcgacctgtctcagatggaggcactcaagcgccacaggcaggcggaggcggagggcgaagggtgggaatacgcaagcctgtttggatggaagttccatctggagtataggaaaaccgatgccttccgcagaagacgttggaggcgtagaatggagccattggaaaagacaggccccgccgccgtattcgcattggagggagccttggggggtgtgatggatgataaatccgaggattcaatgagcgtgagtacgctatcttttggggtgaacaggcctacaataagttgtatcttcgactacggaaacaggtaccatttgcgttgttacatgtatcaggctcgagacctggccgcgatggataaagattcttttagtgacccatacgccatcgtcagcttcctgcatcaatctcagaagacagtggtagtgaagaatactctgaacccaacttgggatcaaaccctcatcttctatgaaatagaaattttcggagagcctgcgaccgtcgcagagcagccccctagtatcgtcgtcgagctttatgaccatgacacttatggcgctgatgaatttatgggccggtgtatctgccagccatcgcttgagcgaatgcccaggttggcatggtttccccttacccgtggctcacagcccagcggggagttgctggcctcgtttgagctgattcagcgagagaagccggccatccatcatatccccggttttgaggtgcaagagacatcacgcattctcgacgagtcagaggacaccgacttgccctatccgcccccacagcgggaggctaacatctatatggttccacaaaatatcaagcctgccctacaacgaacagccattgagatcctggcctgggggctacgcaacatgaaatcgtatcaactggcaaacatctccagccccagcttggtggtcgagtgtggggggcaaacagtccagtcttgcgttatccggaacttacggaaaaatcccaacttcgacatttgtacactgttcatggaggtcatgctcccccgcgaagaattgtactgtccgccaattacagttaaagtaatcgacaacaggcagttcggccggcggccagtcgtggggcagtgtacaatccgatcgctggaatccttcctttgtgacccctattcagcagaatcaccatcaccccaaggcggaccagacgacgtgagtcttttatctccgggcgaggatgtgctgatagacatcgacgacaaggagccgctcattcccatccaggaggaggaatttatcgactggtggagtaagttctttgcatctattggcgaaagggagaaatgtggcagctacttagaaaaggactttgatacgctgaaggtttacgacactcaactcgagaatgtggaagcatttgaaggccttagtgatttctgtaataccttcaaactataccgggggaaaacccaagaggagacagaagacccctcagtcataggggaatttaagggcctgttcaaaatatatcccctccctgaagatcccgcgatccccatgcccccacgacaattccaccagctcgcggcacagggacctcaagaatgccttgtccgaatctacatcgtgcgagccttcggactacaacctaaggatcccaatgggaaatgtgacccatacataaagatttccatcggcaagaagagcgtgtccgaccaggacaattacattccctgtacactggaacctgtgttcggtaagatgtttgaattgacctgcacattgccacttgaaaaggacctcaaaattaccctgtacgattacgacctgctgagcaaagatgagaaaatcggtgaaaccgtggttgaccttgaaaataggcttctatcaaagtttggggcccggtgcggtttgcctcagacctattgtgtgtccgggcctaaccagtggcgcgaccagcttaggccatcccagctgctgcatctattttgccaacagcatagagtgaaggccccagtgtacaggaccgaccgagtcatgtttcaggacaaagagtatagtatcgaagaaatcgaggcgggccggatacccaatccccacctcggcccggtcgaggaacgcctggccttgcatgtgctgcagcagcagggcctagtcccggaacacgttgagagccgccctttatactcaccccttcagcccgacattgagcagggcaaattgcagatgtgggtggacctgtttcccaaagcactggggcgaccaggcccaccattcaacattactccaagaagagcacgtcgctttttcctgcggtgtataatctggaatacacgtgatgtgatattagacgacctcagcctgactggtgagaagatgagtgacatctatgtgaagggatggatgattggctttgaggagcacaagcagaaaactgatgtgcactaccggtccctcggcggagaaggaaactttaattggcgttttatttttcccttcgactacctcccggccgaacaagtgtgcacaatcgctaaaaaggacgctttttggagactcgacaagactgagtctaagattccagcaagagtggtgttccaaatctgggacaacgataaattctcttttgacgactttcttggttcattacagttagacctgaatcggatgccaaagccagcaaagaccgcgaagaagtgttccttagatcagcttgatgacgcattccatcctgagtggttcgtgagtctgttcgagcagaagactgtgaaggggtggtggccatgcgtcgcagaggagggtgaaaaaaagattctggccggtaagctggagatgaccctggagatcgtggcggagagtgaacacgaggagcgcccagcaggacagggcagagacgaacccaatatgaatcccaagctggaagacccgcgaagaccagacaccagctttctctggttcacaagtccatacaaaaccatgaagtttatcctatggaggcgttttagatgggctattatcctgtttattattctctttattttactgttatttctagcaatcttcatctacgcatttccgaactatgcagctatgaaactggtgaaacccttctct

SEQ ID NO: 10646 - DNA, 6243 bp, Artificial Sequence
  Description of Artificial Sequence: Synthetic coding sequence
atgttgtgctgcctgcttgttagagcaagcaacctgccatccgcaaaaaaggacagacggtcggaccctgtggcttcattgactttccggggcgtgaaaaaacggactaaggtcattaagaattccgtgaatccggtttggaacgaaggcttcgagtgggatttgaagggaatccccctcgatcagggctctgaactgcacgttgtggttaaggatcacgaaaccatgggaagaaatcggttcctgggagaggccaaggttccactgagagaagtcctggccacaccttctctctctgccagcttcaacgcccctcttttggacaccaaaaagcagcctactggggcctctttggtactccaggtgtcatacacacctctgcctggggctgtgcctctgttcccaccccccactcccctggaacctagccccacattgcccgatctggacgtggtggctgatactggaggagaggaggatactgaggaccagggccttactggcgatgaggccgagcctttcctcgatcaatcgggcggccccggtgcacccaccactcccagaaaactcccttccagaccgccaccccattaccctggcatcaaaaggaagcggtctgcaccaacttcacgcaagctgctgagcgacaaaccccaggacttccaaatccgcgtgcaggtcatagagggcaggcagctccccggtgtcaacatcaagccggttgttaaggtgacggctgccggtcaaacgaaacgcaccagaatccataagggaaactcccctttgtttaacgaaacgcttttcttcaatctgtttgactcacccggtgaactgtttgacgaacccatcttcattactgtggtggatagccgttcattaagaactgacgcgctgctgggagagtttagaatggacgtcggaactatatacagagaaccgcgccacgcctatctgaggaaatggctgctgctttcagatcctgatgatttttcagcaggcgcgcgaggctacctgaagacgtctctctgcgtgctgggcccaggggacgaggctccactcgaacgaaaggatccatccgaggacaaagaggatatcgagtctaacctcctccgacccactggtgtggcactgcggggagcacacttctgcctgaaagtgttccgggctgaagatctcccacagatggacgatgccgtgatggataacgtgaaacagatattcggctttgaatccaataagaaaaatctggtagacccattcgtggaggtgtcctttgcaggaaaaatgctgtgctctaaaatcctggaaaagaccgccaaccctcagtggaaccagaacatcactctccccgctatgtttccaagtatgtgtgaaaagatgcgaatacggattattgactgggaccggctaacgcacaatgacatcgtggctactacatacttgagcatgagtaagattagcgcccccggaggagagatcgaagaggaaccagcaggcgcggtgaaacccagtaaagcctccgatctcgacgattacttagggttcctgccaacgttcggaccctgttatatcaacctctatggtagccccagagagttcacaggcttcccggacccatatacagaattgaacactgggaagggcgaaggagtggcttatagaggaaggcttctcttgtcccttgagacaaagctcgtagaacattctgaacagaaggtggaggatctcccggcggatgacatccttcgcgtggagaagtatctacgaaggcgtaaatacagcctctttgcggcattttactccgcgacaatgctgcaggacgtagatgatgctattcagtttgaagtgtccattggcaactatggcaacaagtttgatatgacgtgtctacctcttgcttccaccacgcaatactcgcgggctgtctttgacggatgccactactactacctgccctggggcaacgtaaaacctgtggttgttctcagttcctattgggaggacattagtcaccgcatcgaaactcagaatcagcttctgggtatcgccgataggctggaggctggcctggaacaggtccacttggcgctgaaagctcagtgtagcacagaagatgttgactctctcgtcgcacagttgactgacgagctgattgctgggtgttcacaaccgttgggtgatatccacgagaccccgtctgctacacacctagaccagtacctgtaccagctgcggacgcatcacctgtcccaaatcaccgaggccgccctggcccttaagttgggtcattcagagctgcctgctgccctggagcaggcggaggattggttgctacgtttgcgggccctggctgaagaaccccagaattctctgcctgacatcgtcatctggatgctgcagggcgacaagagggtggcatatcagcgggttcctgcacatcaggtgctgttttccagaaggggagccaactattgcggtaagaactgcggcaagctgcagactattttcctgaagtacccaatggaaaaagttccaggggctagaatgcccgtgcagattcgggttaagctctggttcggcttatcggtagacgagaaagagtttaatcaattcgcagaggggaagctctccgtcttcgcagaaacttacgaaaacgaaaccaaacttgctctagtggggaactggggcactacaggcctaacataccccaagttctccgacgtgacaggaaagatcaagctccctaaggacagttttaggcccagtgctggttggacatgggctggcgactggttcgtttgccccgagaagacccttcttcacgatatggatgcagggcacctgagcttcgttgaagaggtgtttgaaaaccaaaccagattgccgggcgggcaatggatttacatgtcggacaattacactgatgtcaacggggagaaagttctgcctaaagatgatattgaatgcccactgggatggaaatgggaggacgaagaatggtccaccgatctcaatagagcagtggacgaacagggctgggagtactcgatcacgattcctcctgaacgaaaacccaaacattgggttcccgctgagaaaatgtattatactcaccggcgaaggcgttgggtccggttacggaggagagatctttctcagatggaggccttgaaacgccaccgccaggccgaagccgaaggggaaggttgggaatatgctagcctgtttggctggaagttccacttggagtatcggaagaccgacgcatttaggcggagacgctggcgacgaagaatggaaccgctcgagaaaacagggcctgctgcggtgtttgcactcgagggagcactggggggagttatggacgataaatccgaggattctatgtcagtatctacgttaagcttcggggtgaacagaccgaccatttcctgcattttcgactacggaaaccgctatcatcttcggtgttacatgtatcaggctagggacctggccgcaatggacaaggacagttttagcgacccctacgccatcgtttccttccttcatcagtctcagaaaaccgtagtcgtgaaaaataccctcaacccaacttgggaccagacactgattttttatgagatagaaatttttggagagcctgcgactgtcgctgagcagccaccctctatcgtggtcgaattgtatgatcacgatacctacggggctgacgagtttatggggcggtgtatttgccagccctctctggaacgcatgccaaggctggcttggtttcccctgaccaggggttctcagccttctggcgagctgttagcgtcattcgagctgatccaaagggagaaacccgccatacaccatatccctgggtttgaggtccaggagacaagccgcattttggacgagtccgaagacacggacctcccgtacccccctcctcaacgcgaagccaatatctatatggtcccacagaacattaagcctgccctccaaagaacggccatcgagattctagcttggggattacggaacatgaagtcataccagttggcaaatatctcttctccatcacttgtggtcgagtgcggtggacaaaccgtccagtcatgcgttatcaggaacctacggaaaaatccgaattttgacatttgtaccctttttatggaagtgatgttgccgcgggaagagctgtattgtccccccatcacagtgaaggtgattgataatcgtcagtttggccggcgtcccgtcgtaggtcagtgtaccatccgaagcttggaatcctttctgtgcgacccctactcggcggaaagcccttcaccccagggcgggccggacgacgtctctttactctctcccggggaagatgtactgatcgacatagacgataaggagcccctcatcccaattcaggaggaggagttcattgactggtggtcgaagttctttgcatcaattggagagagagagaaatgcggaagttatctggaaaaagactttgacaccctaaaggtgtacgacacacagctcgagaacgtcgaggccttcgaaggactgtctgatttttgtaacacgttcaaactgtaccgggggaaaacacaggaagagacagaggatcctagcgtcatcggcgagttcaaggggctgttcaaaatctatccgctgcctgaggaccctgctatacctatgccacctcgccagtttcatcaactcgcggcacagggaccccaggaatgcttggtgcgcatctatatcgtgcgagcattcgggctccagcctaaggacccaaatggcaaatgtgacccgtacatcaagatcagtattgggaaaaaatctgtgtctgaccaggataactacatcccttgtactctggagcccgtgttcggcaagatgttcgaactaacttgcactttacccctggagaaagacttgaagatcactctgtacgattacgatcttctgagcaaagatgaaaagatcggggagactgttgtcgatttggagaacagactcctgagcaaattcggagcccgatgcggcctgccacagacctattgtgtatctgggccaaatcagtggagagaccagttgaggccttcccagctcttgcatctgttctgtcagcaacaccgtgtgaaggctcccgtttataggacagaccgtgtgatgtttcaagataaggagtacagtatcgaggaaatcgaggcaggaagaatcccgaatccacatctcggacctgttgaggagcggttggcgttgcatgtccttcagcagcagggtctggtgccagagcatgtagagtcgaggcccctctacagccccttgcagccagatatcgagcagggaaaactccagatgtgggtggacctattccccaaagctctgggcagaccaggcccacctttcaacattaccccgcggagggctaggcgttttttcttgaggtgtatcatctggaacaccagggatgtcattctggatgacctaagtctgaccggggaaaaaatgtctgatatttatgtgaagggatggatgatcggcttcgaggagcacaaacagaagacagatgtgcactacaggtccctgggtggagagggcaattttaattggaggttcatctttccattcgattacttgccagccgaacaggtttgtacaattgccaagaaagacgccttttggcgactggacaaaaccgagagtaagatccctgccagagttgtgtttcagatctgggataatgataaattcagcttcgatgatttcttggggagccttcagctggatctaaaccgtatgccaaaacccgccaagacagcaaagaaatgttcgctggatcaactggatgatgctttccatcccgagtggttcgtgtctctgtttgagcagaagacagttaaaggctggtggccatgtgttgctgaagaaggcgagaagaaaatcctagcgggaaagctcgagatgaccttggaaattgtcgctgaatcagaacatgaagagaggcctgccgggcagggaagggacgagccaaatatgaacccaaagctggaggacccaaggcggccggatacatcctttttgtggtttacgtctccgtataaaacgatgaagttcattttgtggaggcgattcaggtgggctatcatattgttcataatactgtttatcctcttacttttcctggccatcttcatctacgctttcccaaattacgccgcgatgaaactagtaaagccattttcg

SEQ ID NO: 10647 - DNA, 6243 bp, Artificial Sequence
  Description of Artificial Sequence: Synthetic coding sequence
atgctgtgttgccttctggtccgcgcatccaacctgccgagcgcgaagaaggaccgccgcagtgaccctgtggcctcgctcaccttcagaggagtcaagaagcggaccaaggtgatcaagaattccgtgaatccggtgtggaacgagggatttgagtgggacctcaagggaatcccccttgaccaaggatcagagctgcatgtcgtcgtgaaagaccatgaaaccatgggccggaacagattcctgggggaggctaaggtgccgctcagggaggtcctggctaccccatcgctgagcgccagctttaacgcgccgctcctggacacgaagaagcagccaactggtgcatccctggtgctccaagtttcatatactccgctgcctggggcagtgcccctgttcccaccgcccactccactggagccgtcacccaccctcccagacctggatgtggtcgccgacactggtggagaggaagatactgaagatcaagggttgaccggagatgaagcggagcccttccttgaccaaagcggaggaccgggagcgccgaccaccccaaggaagttgccatctcggcctcctccgcattacccgggtataaagcggaaacgctctgcgcctacttcgcggaaacttctctcggacaagccgcaagatttccagatccgggtgcaagtgatcgagggacggcaactcccaggagtcaacatcaagccggtcgtcaaggtgactgcagcgggtcaaaccaagcggacccggatacacaagggaaactcgcccctctttaacgagacgctgttctttaacctcttcgactcccccggagaactgtttgacgaaccgatcttcatcaccgtcgttgattcacgctcgctccgcaccgacgccctgctcggagaattccggatggatgtgggcactatctaccgggaaccccgccacgcatacctgcggaagtggctcctcctgtccgaccctgatgacttctccgccggtgcaagaggatatctcaaaacctccctctgcgtcctcggcccaggagatgaagcacctttggaacgcaaggatccgagcgaggacaaagaagatattgagtcgaacctgcttcggccgaccggagtggctttgagaggagcacatttctgcttgaaggtgttccgcgccgaggacctcccacagatggacgacgccgttatggacaatgtcaagcaaatctttggcttcgaaagcaacaagaagaatctggtggacccgtttgtcgaagtcagcttcgcgggcaagatgctgtgctcgaaaatcctggaaaagactgcgaacccacagtggaatcagaacatcacccttccggcaatgtttccctccatgtgtgagaagatgcgaatcagaattatcgattgggatcgcctcactcataacgacatcgtcgcaaccacctacttgtcgatgtccaagatctcggccccgggaggggaaatcgaggaagagccggccggcgcagtgaaaccgtcgaaggcgtccgacctggatgactacctgggatttctgccaaccttcggaccgtgctacattaacctctacggatcgccaagggaatttacgggattcccggacccttatacggagctcaacaccggaaaaggcgaaggggtggcctaccgcggacggctgctgttgtccctggaaaccaaactcgtcgagcacagcgagcaaaaagtggaagatctgccagcggacgatattctgagggtggagaagtacctgcgccgccggaagtactctctgtttgctgcgttctactcagccactatgctccaggacgtggatgacgctatccaattcgaagtgtcgattggaaactatgggaacaagttcgacatgacttgcctgccactggcgtccaccacccagtacagccgcgctgtttttgacggatgccactactactaccttccttggggcaacgtgaagccggtcgtggtgctgagcagctactgggaggacatttcacaccgcatcgagactcagaaccagctgttggggatcgcagatcgactggaggccgggctggagcaagtgcacctggccttgaaagctcagtgctccaccgaggacgtggacagcctggtggcccaactcactgatgaacttattgctggatgctcgcaaccgcttggagacatccacgagactccctccgccacccaccttgatcagtatctgtaccagcttagaacgcaccacctgtcccaaattacggaagcggcactcgccctcaaactgggacacagcgaactcccagcggcgctggagcaggctgaagattggctcctgagattgcgggccctcgcagaggaacctcagaactccctgccggacattgtgatctggatgctccagggcgacaagcgcgtggcctaccagcgggttccggcacaccaagtgctgttttcacgccgcggtgccaactattgcggcaagaattgtggtaagctccagaccattttcctcaagtacccgatggaaaaggtcccgggagcccggatgccagtgcaaatcagggtgaagctgtggttcggcctgtcagtggacgaaaaggaattcaatcagtttgccgagggaaagctgtcggtgttcgccgagacttacgagaacgaaaccaaacttgcgctggtggggaattggggcacgacgggattgacctacccgaagttctctgacgtgaccggtaagatcaagctgccgaaggactccttccgcccttcggcgggttggacttgggccggcgattggttcgtctgcccggaaaagactctgctccatgatatggatgcgggacacctgagctttgtggaggaggtgttcgagaaccagactcgtttgcctggagggcaatggatttacatgtcagacaactatacggatgtcaacggcgaaaaagtgctgcctaaagatgatattgaatgcccactgggctggaagtgggaggacgaggaatggtcgactgatttgaaccgggcggtggacgaacaaggctgggagtactcaatcaccattccacccgagcggaaacctaaacattgggtgccggccgagaagatgtactacacccaccgccgacgccgctgggtcaggctgaggcgccgcgacctttcccagatggaggccctgaaaaggcacagacaagccgaagctgaaggggaagggtgggaatacgcctcgctttttggctggaagttccacctggaataccgcaagacggatgccttcagacgaagaagatggcggcggaggatggaaccacttgaaaagaccggtccagctgcagtgttcgccttggaaggcgccctcggaggagtcatggacgacaagagcgaggactcaatgtcggtgtcgaccctcagcttcggagtcaatcggccgacgatcagctgcatcttcgactacggaaatcgctaccacctcagatgctacatgtaccaggcgcgcgatctggcggccatggacaaagattctttttcagacccgtacgccatcgtgtcctttctgcatcagagccaaaagaccgtggttgtgaagaacacgctgaatcctacctgggatcaaaccctcatcttctatgaaattgagatcttcggcgagcccgctaccgtggcagagcaaccgccatccatcgtggtggaactctacgatcatgatacctacggggcggacgagtttatgggccgctgcatctgtcagccaagcctcgagcgcatgccgcggctggcttggttcccgctgactcgcggatcacaaccaagcggagagcttttggcgtcatttgaactgatccaaagggaaaagcccgccatccaccatatccctggattcgaagtccaggagacgtcacggatccttgacgagtctgaggacacggacctgccgtacccgcccccgcaaagagaggcgaacatctacatggttccgcagaatatcaagccagcccttcagcggactgcgatagaaatcttggcctgggggctgcggaatatgaaatcctatcaactggctaacatctcgtcaccgtcgcttgtcgtcgagtgtggaggtcaaactgtgcagtcgtgcgtgatccgaaaccttaggaagaatccgaatttcgatatctgcactctgttcatggaagtgatgctgccgcgcgaagaactgtactgcccgccgatcaccgtcaaggtgatcgacaaccggcagtttggaaggcggccggtggttggacagtgcactatccggagcctggaatctttcctgtgtgatccgtattcggcggaatcgccctcgccacagggaggtccggatgatgtgtcacttctcagcccgggagaggatgtgctgatcgacatcgacgacaaggagcctcttatcccaatccaggaagaagagttcatcgactggtggtccaagtttttcgcgtctattggagagcgagaaaagtgtggctcatacctcgagaaggacttcgataccttgaaggtgtacgacactcaattggaaaacgtggaggccttcgagggactctccgatttttgcaacacctttaagctgtatcgcggaaagactcaagaagagactgaagatccctccgtgatcggcgagtttaaggggctcttcaagatttatccgctgcctgaagatccggccatcccgatgccaccacgtcagttccatcagcttgccgcccaagggccacaggagtgcctggtgcgaatctacatcgtgcgggcattcggcctgcagccgaaggatccgaatggaaagtgtgacccttacatcaagatctctatcgggaagaaatcggtgtcggaccaggacaactacatcccgtgcactcttgaaccggtgtttgggaaaatgtttgaacttacttgcaccctgccactcgaaaaggatctcaagatcactctgtacgactacgatttgctgtcaaaagacgaaaagatcggagagactgtggtcgaccttgagaaccggctgctctcgaagtttggagcacgctgcggactcccgcaaacttactgcgtctcagggccgaaccagtggcgggatcagctccggccttcccaattgctccaccttttctgccagcagcatcgagtgaaggcgccggtgtaccgtaccgatcgggtgatgttccaggataaggaatactccattgaggagattgaagccgggaggatccctaacccgcacctcggacctgtcgaggagcggctcgctctgcatgtcctccagcaacagggactggtgccagagcatgtggaatcgaggccgctttactccccactccagccggatatcgagcagggcaagctccagatgtgggtggacttgttcccgaaagcgttgggacgtccgggccccccgttcaacataaccccccgcagagcacggaggttctttctgcgctgcatcatctggaacacgcgggatgtgatcctggatgatctgtccctgaccggagaaaagatgtccgatatctacgtgaaaggatggatgatcggattcgaagaacacaaacaaaagaccgacgtccattacagatccctggggggcgagggaaactttaactggagattcatctttcccttcgactacctccccgccgaacaggtgtgtactatcgcaaagaaggatgctttctggcgcctcgataagactgagtcaaaaatcccggcacgcgtggtgttccagatctgggataacgacaaattctcctttgacgacttcctgggcagcctgcaactcgatctgaaccggatgccaaagcccgccaaaactgccaagaagtgcagcctggaccagctggacgatgctttccacccagagtggtttgtgtcgctgttcgagcaaaaaaccgtcaagggatggtggccctgtgttgccgaggagggcgaaaagaaaatcctggctggcaagctcgagatgaccctcgagatcgtcgcagaaagcgagcacgaagaacgcccggcaggccagggacgggacgagccgaacatgaatccaaaactcgaggacccgaggaggcccgacaccagctttctgtggttcactagcccatacaagaccatgaagttcatcctgtggcgcagattccggtgggccatcattctcttcatcatcctgttcatcctgctgctctttcttgccatcttcatttacgccttcccgaattacgccgcgatgaagctcgtgaagcctttttcc

SEQ ID NO: 10648 - DNA, 6243 bp, Artificial Sequence
  Description of Artificial Sequence: Synthetic coding sequence
atgctctgttgtcttctcgttcgagcttcgaacctgcccagtgctaaaaaagacaggcgatccgaccccgtggcgagcctgaccttcaggggtgtaaagaagaggaccaaggtgatcaaaaatagcgtgaatcctgtttggaacgaaggtttcgagtgggatttgaaaggaattcctcttgaccagggaagcgagttacacgtggtggtcaaagatcacgagaccatgggtaggaacaggtttttgggcgaggctaaggtgccacttcgggaggtactggcaactccatcactgtccgcctcttttaacgcccccttgcttgacaccaagaaacagccaacaggtgcttcactggtgctccaggtgtcctataccccgctaccaggggccgttcctctgttcccgcctcctacccccttggagccctcacccaccctccccgatttggatgttgtggctgatacggggggggaggaagacactgaggatcaggggctcacaggagatgaggccgagccattcctggatcagtctggcggtcctggtgcccctaccactccccgaaagctgccatctaggcctcctccgcactatcctgggataaagaggaaacgctccgccccaacttctaggaagttattgtccgacaagccccaagatttccagatcagggtccaggtgatcgaagggagacagttaccgggggtgaatataaaacccgtggtcaaagtgaccgccgcggggcaaaccaagaggacacggatccataagggtaattcgccattgttcaatgaaacactattcttcaatcttttcgacagccccggcgaactgtttgatgagcccatctttatcaccgtggtagactcccggtcactcaggacagacgccttgcttggcgagtttaggatggacgtgggaacaatttaccgcgagccacgccatgcttatctgcggaaatggctactcctttctgatccagacgattttagcgctggggctaggggctacctcaagacatcgttgtgtgtgctgggtcccggcgatgaagcacctttagaaaggaaagatccttccgaggataaggaggacatcgagtccaacctcctgcgccctacaggagtggcactgcggggagcccacttttgcctaaaggtatttagagccgaagatctgccccaaatggacgatgctgtgatggacaatgtcaaacagattttcggattcgaatccaataaaaagaacctggtcgatccttttgtggaagtctcatttgccggaaaaatgttgtgcagcaagatcctggaaaagaccgcaaacccccagtggaatcagaacatcaccctgccagcgatgttccccagtatgtgtgaaaagatgcggataagaatcatcgactgggatcgcctgacgcacaatgacatagtagccactacatatctgtcgatgtccaagataagtgccccggggggggaaatcgaggaagaacccgcaggtgccgtgaagccatctaaggcatcagacctggatgattacctaggttttcttcctacatttgggccttgttatatcaacctgtacggaagcccacgtgagtttactggatttccggatccgtacacagagctgaatacaggcaagggtgagggggtcgcttaccggggcagattgctcctgagcttggaaaccaagctggtggaacacagtgaacagaaagtggaggacctgccggctgacgacatcctgagggtggagaaatacctgagacggaggaagtatagcctgttcgccgctttttattctgcaacaatgctccaggacgtggacgatgctatccagttcgaggtgagtattgggaactacggaaacaaatttgatatgacctgcctaccactggcgagcaccacccagtactctagggccgtctttgatggctgccactactattatctgccatgggggaatgtgaaacccgttgtagttcttagttcctattgggaggatatctcccataggatcgagactcaaaatcagctgctgggaattgccgatcgcctcgaagcgggcctggaacaggttcacctagcactcaaggcccaatgttcaaccgaggatgtagatagtctggttgctcagttgacggacgaattgatcgccggatgtagccagcctctcggagacatccatgagaccccttccgccacgcatcttgaccaatatctctaccagctccgaactcaccatttatcccagatcaccgaagcggcactggccctcaagctgggacactctgaactacctgcggcccttgagcaagcagaagactggctgttacggctgcgagccctcgctgaagaacctcaaaattccctgcccgatatcgttatatggatgctgcagggggataagagagtagcataccagagagtccctgcacaccaggtgttattctctagacgaggtgcaaattactgtggcaaaaattgtggcaaattgcagactatcttcctgaaataccccatggagaaagtccccggagccagaatgccagtgcagatccgcgttaagctgtggtttggactgtcggtggatgagaaagagtttaatcagttcgccgaggggaaactgtctgtctttgcagaaacttacgagaatgagactaagctggctctcgtgggcaactggggcacgacgggtttaacctaccctaagttcagcgacgtgacaggaaagattaagctacccaaggattccttcagaccctcagctgggtggacctgggctggggactggtttgtgtgtcctgagaagacgctattgcatgatatggatgctggccacctttcatttgtggaggaggtctttgagaatcagactcgcttacccggaggtcaatggatctacatgtctgataactacaccgatgttaacggggagaaggtactgcccaaggatgatatagagtgccctcttggctggaagtgggaggacgaggagtggtctaccgacctgaatcgcgcagtggatgaacaaggttgggagtactcaatcacgatccctcctgaaagaaaacctaaacactgggtacccgctgagaaaatgtactacacacatagacggcgaagatgggtacggttgcgacgacgtgacctctctcagatggaggctttgaaacgtcaccggcaggccgaggcagagggtgaggggtgggaatatgcttctttgttcggttggaagttccacctggagtatcgaaagacggacgcattcagacgtaggcgatggagaagaagaatggaaccgttggagaagacggggccagctgcggtctttgcacttgaaggggctctcggtggtgtgatggacgacaaaagtgaggattccatgagcgtgagcacactatcatttggagtcaatcgacctaccattagctgtatctttgattacggaaaccgctatcatctgcgctgttacatgtaccaggcgcgggacctagcggccatggacaaagattccttctcagacccttacgcgatcgtatcttttttgcatcagtcccagaaaactgtggtggtaaagaatactctcaatcccacttgggatcagaccctcatcttctatgaaatcgagatttttggcgagccagccacagtggccgaacagccaccaagcatagtggtcgaactgtacgatcacgacacatacggcgctgacgaattcatgggtagatgtatctgccagccaagcttagagaggatgcctaggctggcctggtttccactgacgcgaggctctcaaccatctggggaactgctcgcctcttttgaattgattcagagggagaagcctgcaattcatcatatcccagggtttgaggttcaggaaacatctagaattctggacgaaagtgaagacacggatttgccttaccctccaccacagagagaggcaaacatatacatggttccccagaacattaagcccgctttgcagcggaccgctatagaaatacttgcatggggactgcggaacatgaaatcttatcagctcgccaatatcagctcaccaagtttggtagtggagtgcggcggccagaccgtacagagttgtgtcattagaaacctccgaaaaaatcccaattttgatatctgcactctcttcatggaggtgatgctgcccagagaggagctgtactgcccacctattacggtaaaggttatcgataataggcagtttggaaggcggcctgttgtcgggcaatgcaccatcaggtcgctggaatctttcctctgtgacccctacagcgccgagtcaccaagcccccagggtggacctgacgacgtctccctgctgagccccggcgaagatgtattgatcgatatagacgacaaggagcctttgatccccatacaggaagaggaattcatcgactggtggtctaagtttttcgctagcatcggagaaagggaaaagtgcgggtcatatctggagaaggatttcgacacccttaaggtctacgatactcagctagagaacgtcgaagctttcgagggactgtctgacttctgtaatacgtttaaactatacaggggaaagactcaagaggagacagaagacccctcggtcatcggagaattcaaaggactgtttaaaatttaccctcttcccgaggatccagcaatcccaatgccccccagacagttccaccagctcgcggcccagggaccacaggagtgtctcgtgcgcatctatattgtgcgcgcgttcggacttcagccgaaggatccaaatggaaaatgtgacccctatatcaaaatcagcatcgggaaaaaaagcgtaagtgaccaggataattatatcccctgtacgctggaaccagtgttcgggaaaatgttcgagctgacatgcacgctccccctcgaaaaggatttgaagattactctttacgactacgaccttttatctaaagatgagaagatcggggagaccgtggtggatttggaaaatcggctcctgagtaagtttggggcccgctgcgggttaccgcagacctattgcgtctccgggcctaaccagtggagagaccaattaagacccagtcagttgttgcacctcttctgtcagcagcaccgagttaaagcccccgtctacagaaccgatagggtgatgttccaggacaaggaatacagtattgaagagatcgaggctggtcggatccctaatccccacctcggtcccgttgaggagagattggcccttcatgtgctgcaacagcaggggctggtgcccgagcacgtagagagtcgtcccctgtactccccactccagcccgatatcgagcagggtaaattgcagatgtgggtggatttattccctaaggccctaggaagaccagggcccccgtttaacatcacgcccaggagggctcgacggttctttctacgctgtattatatggaatacacgagacgtgatactggacgatctgtctctgaccggcgagaagatgagtgacatctatgtgaaaggttggatgatcggtttcgaggagcacaagcagaagaccgacgtccactaccgcagcttagggggcgaggggaacttcaattggagattcattttcccattcgattacctgcctgcagagcaagtgtgcacaatcgccaagaaagatgctttctggcggctggataagaccgaaagtaagattccagcaagagtcgtcttccaaatatgggataacgacaaattttccttcgatgatttccttggcagtctgcaactagaccttaaccgaatgcctaagcctgccaaaacagccaagaagtgttctctggatcaactggatgatgcattccaccctgagtggttcgtttccttgttcgaacagaagaccgttaagggctggtggccatgcgttgccgaagagggcgagaaaaaaattcttgccgggaaactggaaatgacattggaaattgttgccgagtcagaacacgaggagcgaccggcgggccagggccgcgacgagcctaatatgaatccaaaactggaagatccacgcaggccagatactagtttcctatggttcactagcccgtacaagactatgaagttcatcctgtggcggaggttccgatgggccattatcctttttatcatcttgttcatactcttattatttctcgccatctttatctatgctttccccaattacgccgcaatgaagttggtgaagcctttctca

SEQ ID NO: 10649 - DNA, 6243 bp, Artificial Sequence
  Description of Artificial Sequence: Synthetic coding sequence
atgctttgctgtctgctggttagagcctccaacctgccttccgcaaaaaaggataggcgttccgacccagtggctagcctgactttcagaggcgtgaagaaaagaactaaggtgattaagaactcggtgaatcctgtctggaatgaaggattcgaatgggatctcaagggtatccctctcgatcaaggctcggagctccacgtggttgtgaaagatcatgaaaccatgggaaggaaccgcttccttggtgaagccaaggttccgcttcgagaggtcctcgccactccctcgctcagcgcatcattcaacgccccgctgcttgatactaaaaagcagcctacgggggcctctctcgtcctgcaagtgtcatacacccctctgcctggcgcggtccctctttttcctccccctactcctctggaaccatccccaaccctccccgatctggatgtggtcgcagacaccggcggagaagaagatacggaagatcaaggcctcactggtgacgaagcggagccattcctggatcaatccggtgggccaggagcaccaaccaccccccgcaaattgccatcgcgaccgccgcctcactatccaggaatcaagcggaaaagatccgcacctacttcgcggaagctgctgagcgataaaccccaggatttccagattagagtgcaagtgatagagggtcgccagctccctggtgttaacatcaaaccagtcgtgaaggtcaccgctgcaggtcaaaccaagaggaccagaatacataagggaaactctccacttttcaatgaaaccctgttcttcaacctttttgattccccaggcgaactgttcgatgaaccaatctttatcacggtggtcgattcgcgttcgcttcgaacggatgcgctgcttggcgaattcagaatggacgtcggtactatataccgggagccacgccatgcatacctcaggaagtggctgttgcttagcgacccggacgacttttctgcaggtgcacgaggatatcttaagacttcgctttgcgtgctgggaccaggtgatgaagcacctcttgaacggaaagatccatcagaagataaggaggacatcgagagcaacctgctgcggcccactggagtggcacttcgtggcgcacacttctgcctgaaggtgttcagagcagaggacctccctcagatggatgacgccgtcatggacaatgtcaagcagatctttggatttgaatcaaataagaagaaccttgtcgatccgttcgtggaagtctcgtttgcagggaagatgctttgtagcaagattcttgaaaagaccgcgaatccccagtggaatcaaaacatcaccctgcctgccatgttcccctctatgtgtgagaaaatgcgaattcggatcatcgactgggaccgccttactcataacgacattgttgcaaccacttacttgtcgatgtccaagatctcggcacccggtggagaaattgaagaggaacctgccggagcggtgaaaccatcaaaggcgtccgacctcgatgattacctgggatttcttccaacgtttggtccttgctacatcaatttgtacggcagccctcgtgaattcaccggctttccagatccttacactgaacttaacacgggaaagggagaaggagtggcctaccgcgggcgactgctgctgtcgctggaaactaagctggtcgaacattcagagcagaaggtggaggatctccctgctgacgatatccttagagtggagaagtacctcaggcgccgtaagtacagcttgtttgcagccttctatagcgccaccatgctccaggatgtggacgacgccatccagtttgaggtgtcgattggtaactacggaaataagtttgacatgacctgccttccactcgcatcgactacccagtattcccgcgccgtgtttgatggatgtcattactactatctcccgtgggggaacgtgaagccagtggtcgtcctcagttcatactgggaagatatttcccatagaatagaaacccagaatcaacttctcggaatcgcagaccggctggaggcaggtctggaacaagttcatcttgcactcaaggcacagtgctcgacggaagatgtggattcactcgtggcacagcttaccgacgagctgatcgcaggatgtagccagcctctgggagacattcacgaaacgccctcagccacccatcttgaccagtacctctaccaactgaggacccatcacctttcgcaaattaccgaagcagcacttgctctcaaactcggccactccgaactgccagcagcactggagcaggcagaggattggcttttgcggcttagagccctcgccgaagaaccccaaaactcgctccccgacattgtcatttggatgctgcaaggggacaaacgggtcgcataccagcgggtgcccgcccatcaagtgttgttttcacggcggggagccaactactgtggtaaaaactgcggaaagctgcagacgattttcctgaagtaccctatggaaaaagtgcctggggcccgcatgccagtgcaaattcgagtgaaactttggtttggactttccgtcgatgaaaaggagtttaaccagtttgccgaaggaaagctctcagtgtttgcagaaacctacgaaaatgaaacgaagttggcactggtgggtaattggggcacgaccggtcttacgtatccaaagttttcagacgtgactggtaagattaagctcccgaaagatagctttaggccgagtgcaggatggacgtgggcaggggactggtttgtgtgtcctgaaaaaaccctccttcatgatatggacgcaggccacttgagttttgtggaagaagtgttcgagaaccaaactagacttccaggcggacagtggatttacatgtcggataactacaccgatgtcaacggcgaaaaagtgctccccaaggatgacattgagtgccctctgggatggaagtgggaggacgaggagtggtccaccgatctcaatagggcagtcgacgaacaggggtgggaatactcgattacgattccgccagaacgaaagcctaagcactgggtgccagccgaaaagatgtactatactcatcgtaggagaaggtgggtgagactcagacgacgggatcttagccagatggaagcgctgaaacgccatagacaagcagaggctgagggagagggatgggaatacgcgtcacttttcggatggaagtttcatctggaataccgcaagaccgatgcattcagacgcaggcgctggagacgccggatggaaccacttgaaaagactggtccggccgcggtattcgccctggaaggcgcgctggggggcgtgatggacgataagagtgaggattccatgtccgtctctacccttagctttggggtgaaccgtcctactatcagctgcatatttgactacggaaatcgataccatctgcgctgttacatgtaccaagcacgcgacctcgctgccatggataaggactcattctcggacccgtacgcgattgtgtcgtttttgcatcaatcacagaaaaccgttgtggttaagaataccttgaacccgacttgggatcaaactcttatcttctacgagatagagatcttcggagagccagcaactgtggctgaacaacctcctagcattgtggtggaattgtacgatcacgacacttacggggcagatgagttcatgggtcgctgtatctgccaacctagcctggaacggatgcctcgactggcatggttcccgctcacccgcgggagccaaccttcaggagagcttctggcgtcctttgaactgattcaacgtgagaagcccgcaattcatcatatccccgggtttgaggtccaagagactagtcggatcttggatgagtcggaggacaccgatcttccataccccccaccccagagggaggcaaacatttacatggtcccacaaaacattaagcctgcgctccaaagaactgccatagagatccttgcgtgggggctgaggaatatgaaatcgtaccagcttgccaatatctcttccccttccctggtcgtggagtgcggcggacagaccgtccagtcctgtgtgattagaaacctgcggaagaaccctaactttgatatctgtactctgtttatggaggtgatgctgcctagggaagagctttactgtcctccaattaccgtgaaggtgattgacaacagacaatttggtaggcgccccgtggtcggacaatgtactatccgatcgctcgagtcgttcctctgcgatccctacagcgcagaatcgccgtccccgcaaggaggccccgacgacgtgtcgcttctgtcgcctggtgaggatgttcttattgacatagatgataaagaacccctgatcccgattcaagaagaggaattcatcgattggtggtcgaagttctttgcttccattggggaacgagaaaaatgtggttcatacctcgaaaaggatttcgatactctgaaagtctacgatactcaactggaaaatgtggaggcctttgaaggcctgtccgatttttgcaacacgtttaaactgtaccgcggcaagactcaggaagagactgaggacccttcggtgatcggagagtttaagggtctgttcaagatctacccccttccagaagatccagccattccgatgccacctagacagttccatcaattggcggcacaagggcctcaggaatgtctggtaagaatctacatcgtccgcgcgttcggactgcagcctaaagacccgaatgggaagtgcgatccatacatcaaaatctccattggaaagaaatccgtgtccgaccaggataactacatcccttgtacccttgagccggtgtttggaaaaatgtttgagctcacttgtaccctcccactggagaaggatctgaagattaccctttatgattacgatttgctctccaaggacgaaaagattggagaaactgtcgtggatctcgaaaatagactgctgtccaagtttggggcaagatgtggccttccccagacttactgtgtgtcaggtcccaatcaatggcgcgatcaactgcggccatctcagctgctgcacctgttttgccagcaacaccgtgtgaaggcgcctgtgtacaggactgaccgcgtgatgtttcaagataaggaatactccatcgaagagatcgaagcaggacgcatcccaaaccctcatctgggtcccgtcgaagaaagactggcactgcacgtgctccagcaacaaggactggtgcccgaacatgtggaatccagacccctctacagccccctgcagccagacatcgaacaaggcaaactgcagatgtgggtcgacctctttcctaaggcacttggtcgcccgggccctccatttaacattacccccagacgtgcgcgccgctttttcctccgttgcatcatatggaacacccgggatgtgatattggatgatctgtcccttacgggggagaaaatgtcggatatctacgtgaaggggtggatgattggatttgaggaacacaagcaaaaaactgatgtgcactacagatctcttggaggggaaggaaactttaactggagattcatttttccttttgattatctgcctgccgaacaagtgtgtactattgcgaagaaggatgccttttggagactcgacaaaactgagtcgaagattcccgcgagggtcgtgttccagatctgggataacgataagttcagctttgacgatttcctgggatcgctgcagcttgaccttaatcgaatgcccaaaccagcaaagaccgctaagaagtgtagcctcgatcaactggatgatgcttttcaccccgagtggtttgtgtccctttttgagcaaaaaaccgtgaagggttggtggccatgtgtggcagaggagggcgagaagaagattctggcgggaaagctggaaatgaccctcgagatcgtggcagagtcggaacatgaggaaaggcccgccggtcagggaagagatgagccaaacatgaaccccaaactggaagatcccaggcgcccagatacctcgtttttgtggtttacgtcaccttacaagacgatgaagtttattctttggaggagatttcgctgggcgatcatcctctttatcatcctgtttattcttctcctttttctggcgatcttcatctatgcatttcctaattacgcagccatgaagctggtgaagcccttttca

SEQ ID NO: 10650 - DNA, 6243 bp, Artificial Sequence
  Description of Artificial Sequence: Synthetic coding sequence
atgctttgttgtctgcttgtgcgtgcaagcaacctcccatcagcaaagaaagatcgaagatcagatcccgtcgcatcactgaccttcagaggggttaagaagcgcactaaggtgatcaaaaacagcgtgaatcctgtgtggaatgaagggttcgagtgggatttgaagggcattccgcttgaccaaggatccgaactgcatgtggtggtgaaggatcatgaaaccatggggcgcaaccggttccttggtgaggcaaaggtcccgttgagggaagtgctcgccaccccttccctctcggcgagctttaacgcccctcttcttgacactaagaagcagcctaccggtgcatcactggtgctgcaggtcagttacaccccccttcctggcgcggtcccactgttcccaccacctacccctcttgaaccgtcgccgacgctccccgatctcgacgtcgtcgcggataccggcggtgaagaggacaccgaggatcagggattgaccggagacgaagctgaacctttcctggatcaaagcggaggaccaggtgcacctaccaccccaagaaagttgccttcgaggccacctccacattaccctggcattaagaggaagcgttcggcgccaacgtcccggaagctgctgtctgataagccacaagatttccaaattagagtgcaagtgattgaggggaggcagctgccaggcgtgaacatcaaacccgtcgtgaaggtcaccgcagcaggacagactaagaggactcggattcataagggcaactctcctcttttcaacgaaaccctgttcttcaacctctttgactcccctggcgaactgttcgacgaaccaatctttatcactgtggtggattcaaggtcgctccgcaccgatgctctgctgggtgaatttcgaatggatgttggaacgatttaccgcgaaccgaggcatgcatacctccgaaagtggttgcttttgagcgatcctgatgacttttctgcaggtgctaggggttaccttaagacttcactctgcgtgctgggccctggagatgaagcaccactggagcgtaaggatccatcggaagataaggaagatattgaatcgaacctgctcagaccgaccggagtggcactgcggggggcacatttttgtttgaaagtctttcgggccgaggacctgccgcagatggatgatgccgtgatggacaacgtgaagcagattttcggttttgagtctaataagaagaacctggtggacccatttgtcgaggtgtcgtttgcgggtaagatgctgtgttcgaaaattctggaaaaaaccgccaacccacaatggaaccagaacattactctcccggcaatgttcccttcgatgtgcgaaaagatgcgaatccgcataatcgattgggatcggctgactcataatgacatcgtcgcaactacgtacctgtcgatgtcgaagatttccgcaccagggggagaaattgaagaagagccagccggcgccgtgaagccatcaaaagcctcagacctggacgattaccttggattcctgcctacctttggcccttgttacattaatctttacggatcccccagagaatttaccggatttccggatccttacaccgaactgaataccggaaagggagaaggagttgcgtacaggggtaggcttcttctgtcactggaaaccaagctcgtggaacatagcgaacaaaaggtggaagatctgccggccgatgatattctgcgagtcgagaagtaccttagacgccggaaatactcactcttcgcagcattttacagcgcaactatgctgcaagatgtggatgatgcaatccagtttgaggtgtccatcggaaactacggcaacaagttcgacatgacctgtctgcctctggcaagcaccacgcagtacagcagggcggtgtttgacggatgtcattactactacctgccatggggcaatgtgaagccagtcgtggtgctcagctcctactgggaagatatttcacatcggattgagacgcaaaaccagctgctcgggattgcagatagactggaagctggactggaacaagtgcacctcgcactgaaggctcaatgctcgaccgaggatgtcgatagcttggtggcacagcttactgacgagctgattgcaggatgttcccagccactgggtgatattcacgaaaccccttccgcaacgcatctggaccaatatctttaccaactccggactcatcacttgtcgcaaatcacggaagccgcactggcactgaagttgggtcattcggagcttcccgcagctctggaacaagccgaggactggcttcttcgcctgcgcgcacttgccgaagagccccaaaactcgctgcctgatattgtgatttggatgcttcagggagataaacgcgtggcgtaccagagggtgcctgcacatcaagtgcttttctcccgacgaggtgcaaactactgtggtaagaattgtggcaaacttcagaccatctttctgaagtacccaatggagaaagtgccaggcgcacgcatgcccgtgcagattagagtgaagctctggtttgggctgtccgtggatgaaaaggagttcaatcagtttgcagagggaaagctgagcgtgtttgccgaaacctacgagaacgagacgaaactggcccttgtggggaactggggtactactggactgacttaccctaagttttcggacgtgactggtaagataaagttgcctaaggattcatttcggcccagcgcagggtggacttgggcaggtgactggtttgtgtgtcccgaaaaaaccttgctccacgacatggatgccgggcaccttagctttgtggaggaagtctttgaaaaccagaccagactgcctgggggacagtggatttacatgagcgacaactataccgacgtgaatggcgaaaaggtgctgccaaaggatgatatcgaatgtccactgggttggaagtgggaggacgaagagtggagcaccgacctgaatagagccgtcgacgagcaaggatgggagtactcgataactattccgccagaacgaaagcctaaacactgggtgccagcagaaaagatgtactacacccatcgtcgccgtagatgggtccgcctgcgccggagagatctgtcccaaatggaagcactcaagcgccataggcaagcagaagcagaaggcgaaggctgggaatacgccagccttttcggttggaagtttcacctcgaatacaggaaaaccgatgcgtttagaagaaggcgttggaggagacgtatggaacctttggagaaaactggacctgctgcagtgttcgcactcgaaggtgcgctgggcggggtcatggatgataagtcggaggatagcatgtcagtctccaccctgtcgtttggtgtgaatagacccaccatttcatgtatattcgactacggaaaccgttatcatctgcggtgctacatgtaccaggccagagatcttgcggccatggataaagactcgttctccgacccctacgcaattgtgtcgtttctgcatcagtcccaaaagaccgtggtggtcaagaacacccttaatccaacctgggaccagactctgatcttttacgaaatcgagatttttggtgaacccgccactgtggccgaacaacctcctagcatcgtcgtcgaactttacgatcatgatacttacggggcagacgagtttatggggagatgtatttgccaaccaagcctcgaacgaatgcctagacttgcctggtttcctctcacccggggatcacaaccttccggcgagttgctcgcgtcctttgaactcatccaaagagaaaagccagctatccaccatattccagggtttgaggtccaagagacgtctcgaattttggatgagagtgaagatactgatctgccatatcctcctccccaaagagaggccaacatttacatggtcccacagaacattaagccagcactgcagagaaccgccatcgagattctggcttggggccttcgtaacatgaagtcatatcaactggccaacattagctcgcctagcctggtcgtggagtgtggaggacaaactgtccagtcctgtgtcattcgcaacctccggaaaaatccaaacttcgatatctgtacccttttcatggaggtgatgcttccacgagaggagctctactgtcctcctattactgtaaaggtgattgataaccggcagttcggacggcgtccagtggttggacagtgtactattagatcgctggaatccttcttgtgcgacccctactcagcggagagcccctctcctcaaggtgggcctgatgatgtcagcctgctgtcgcctggtgaggacgttcttattgacatcgatgacaaggagcccctgatccctatccaggaggaagaattcattgattggtggtcaaaattcttcgcctccatcggcgaacgggaaaagtgcggttcgtaccttgaaaaagactttgataccttgaaggtgtacgatactcaacttgaaaatgtcgaagcatttgaaggactcagcgatttctgcaacacttttaagttgtatcgtggaaagacgcaagaagaaaccgaagatccgtcggtgataggcgagttcaaaggtctgtttaagatttaccctctgccggaggatcctgcaattcctatgccgcctcgacaatttcatcagctcgcagcacagggaccccaagaatgcttggtgcggatatacatagtgcgtgcctttggacttcaaccgaaagatccaaatggaaaatgtgatccatacatcaagatctcgataggaaagaagtcggtgagcgaccaggacaattacattccctgtacgttggaaccagtgtttggaaaaatgttcgaactgacctgtactctgcctctcgagaaagatcttaagattactctttacgattacgatcttctcagcaaggacgaaaagatcggtgaaaccgtggtggatcttgaaaatcgcctcctcagcaagttcggtgcacgctgcggcctgcctcagacctactgtgtgtccggaccaaaccaatggcgtgatcagctccgcccttcccaacttcttcaccttttctgccaacaacaccgcgtcaaagctccagtgtacagaaccgaccgagtcatgttccaagacaaggaatactccattgaagagattgaagcaggtcgtatcccgaaccctcatcttgggcctgtggaggagaggcttgccctgcatgtgcttcaacaacaaggacttgtgcctgagcacgtggaaagccggccgctgtactccccgctccagccagatattgagcaaggtaaacttcaaatgtgggtcgatctttttccaaaagccctggggcggcctggacctccgtttaacataactcctcgccgagctagaagattctttctgcgctgcattatctggaacacccgagatgttatacttgatgacttgtcgttgacgggcgaaaagatgtccgacatttatgtcaaaggttggatgattggttttgaggaacataagcagaaaaccgacgtgcactacaggagcctgggaggtgaaggaaacttcaactggcgattcatttttccgttcgactaccttccggcggagcaagtgtgtaccatagccaaaaaggacgcattttggagactggacaaaaccgagtccaaaatacctgcaagggtggtgtttcaaatttgggataatgataagttttcgtttgacgattttctgggaagcctgcaacttgatctcaacagaatgccgaagccggcaaagactgcgaagaaatgtagcctggatcaactggatgacgcctttcatcccgaatggtttgtgtcacttttcgaacaaaagactgtcaagggctggtggccgtgcgtggcagaagaaggagaaaagaagattctcgccggaaaacttgaaatgaccctggaaattgtcgcagagtcggaacatgaagagcgtcctgcaggtcagggacgagatgaaccgaatatgaaccctaaactggaagatcctcggaggccagacacctcatttctgtggtttacctcgccatacaaaaccatgaagtttatcctgtggagaagatttcggtgggcgatcatccttttcattatactctttattctgctgcttttccttgctatattcatttatgcattcccaaactatgcagccatgaagctggtgaagcctttttcg

SEQ ID NO: 10651 - DNA, 6243 bp, Artificial Sequence
  Description of Artificial Sequence: Synthetic coding sequence
atgttgtgttgccttctggtgagagcgtccaatctcccctcggctaagaaagaccgccgctcagatccggtggcctctctgactttccgcggagtgaagaagcggaccaaagtcatcaagaattcagtgaatccggtctggaacgaggggttcgaatgggatctcaagggtatcccgctggaccaaggaagcgaactgcatgtggtggtgaaagaccatgaaaccatgggtcggaacaggttcctcggggaagcaaaagtgccacttagggaggtgctggcgaccccctcgctgagcgcctccttcaacgcaccgttgttggacaccaaaaagcagccgactggcgccagcctcgtcttgcaagtctcctacactccactcccgggagcggtgcctctgtttccacccccgactccactcgaaccttcgcctaccctgccagatttggatgtcgtggcggacaccggaggagaagaggacaccgaagatcagggtcttaccggcgacgaggccgaaccattcctggaccagagcggggggccgggagcccctaccactccgcgaaagctgccctcccggccgcctccacactacccgggaatcaagagaaagagatcggccccgacctccagaaagctgctgtctgacaagccacaggacttccagatcagggtgcaagtcatcgagggacgtcaactgccgggtgttaacatcaagccagtggtgaaggtcactgccgccggacaaaccaagcgcacccgtatccataagggaaacagcccgcttttcaacgaaactctgttcttcaacttgttcgattcgccgggagagctgttcgacgagccgatcttcatcacggtggttgactcccggtcgttgcgcaccgatgccttgctgggggaattcaggatggatgtgggaaccatctaccgcgaaccacggcacgcctacctgaggaaatggctgctgctttccgatccggatgacttctccgcaggggctcgaggatatcttaagaccagcctttgtgtgttgggacctggagacgaagcccctctggagcgcaaggacccttcggaggataaagaggacatagagtccaacctgctcaggccgacgggagtcgccctgaggggcgcgcatttctgcctgaaagttttccgcgcagaggacctgccccaaatggatgacgcagtgatggataatgtgaagcagatctttggattcgagtccaacaaaaagaacctggtcgacccgttcgtggaagtctccttcgccggaaagatgctctgctcgaagattctggagaaaactgcgaacccacagtggaaccagaacatcactcttcctgctatgtttccttcgatgtgcgagaaaatgcgcatccggatcatcgactgggacaggctcactcacaacgacattgtggccaccacttacctcagcatgagcaagatcagcgccccaggaggagagattgaagaagagccggcaggagccgtgaagccgtccaaggcgtccgatctcgacgactaccttggattcctccccactttcggcccctgctacatcaacctctatggaagcccgagagagttcactggattcccagacccgtacactgaactcaatactggaaagggcgagggagtggcataccgcggccggctgctgctctccctcgaaaccaagctggtggaacattcagaacaaaaagtcgaagatctgcctgccgacgacatcctccgcgtggaaaagtacctgcgccgccggaagtacagcttgtttgccgccttctattcagcaacgatgcttcaggacgtggatgacgccatccagtttgaagtgtcgataggaaactacggtaataagtttgatatgacctgcctgcccttggctagcaccactcagtacagcagagcagtctttgatggttgccactactactacctgccgtggggcaatgtgaaacctgtggtggtgctgagctcctactgggaagatatctcgcaccggatcgaaacccagaatcaattgctgggcatcgctgatcgccttgaggccgggctggaacaagtacacctcgccttgaaggcccagtgtagcactgaggacgtcgacagcctcgtggcccagctgactgacgagctgattgcgggctgctcgcagcctttgggagatatccatgaaactccgtctgcgacccatctcgaccagtatctgtaccagctgcgcacccatcacctgtctcagatcactgaagcggcacttgcccttaagctgggacactcggagcttcctgcagctctcgagcaggccgaggattggctcctgcggttgagagcgctggccgaggaaccacagaactccctgccggacatcgtgatctggatgctgcagggcgacaaaagggtcgcctaccagagagtcccggctcatcaagtcctcttctcaaggcgcggcgcgaattactgcggaaaaaactgtggaaaacttcagacgatttttctgaagtatccgatggaaaaggtgccgggggcccgcatgccggtgcagatccgcgtcaaactttggttcgggttgtcggtggacgaaaaggaattcaatcagttcgctgagggaaagctgtccgtgttcgctgaaacctacgaaaacgagactaagctggctctggtggggaactggggaaccaccggcctgacttacccgaaattctcggacgtgaccgggaagatcaagctgccaaaagactcgtttcgcccatctgccggctggacctgggctggtgactggttcgtgtgtcctgaaaagactctgctgcacgatatggatgccggccatttgtcttttgtcgaggaagtgtttgaaaaccagaccagactgccgggcggtcagtggatctacatgtcggacaactacacggatgtgaatggagagaaggtcttgccgaaggacgatatcgaatgcccactggggtggaagtgggaagatgaggagtggtcaaccgatctgaaccgggccgtcgacgaacaaggatgggaatattcgatcaccatccctccagagcgaaagcctaagcattgggtcccggcggagaaaatgtattacacccatcgccggagacggtgggtgcgccttcggagacgggacttgagccagatggaggcactgaagcgacaccgtcaggccgaggccgaaggcgaaggctgggaatacgcgtcactctttggatggaagtttcaccttgagtacagaaagactgatgcattccgacggcggagatggagacgccgcatggagcctctggaaaaaacggggccggcggcggtgtttgccctggagggagccttgggtggggtgatggatgacaagtccgaggactcaatgtccgtctccaccctgtctttcggcgtgaaccgcccgacgatttcctgtatcttcgactatggcaacagataccacctccggtgctacatgtaccaagctcgcgatctggctgcgatggacaaagatagcttcagcgacccgtacgcaatcgtgtcgttcctgcaccagtcccaaaagaccgtggtggtgaagaatactctcaacccaacttgggaccagactcttatcttctacgagatcgagatcttcggagagcccgctaccgtagctgagcaaccgccgtcgattgtggtggaactgtacgatcacgacacctacggagccgatgagttcatggggaggtgcatctgtcaaccttcgttggaaagaatgcccaggctggcatggttcccgctgactcggggatcacagccgtccggagagctgttggcctccttcgaactgatccagcgcgagaagccagccatccaccatatcccaggcttcgaagtgcaagaaacttcgcggatcctggacgaatcagaggacacggacctgccctacccaccgccacagcgcgaagctaacatctacatggtgccgcaaaacatcaaaccagcattgcaacggaccgccatcgaaatcctggcgtggggcctgcggaacatgaagagctaccagctggccaatatctcatcaccaagcctggtggtggaatgcggcggacagactgtgcagtcgtgcgtcatccggaacctgcgcaagaacccaaactttgatatctgcaccctgtttatggaagtgatgcttccacgggaagaactgtactgtccgcctattaccgtgaaggtgattgataaccgccagttcggaaggcggccggttgtgggacagtgtacgatccgctcgctggagagcttcctctgcgacccttactcggcggagtcgccttccccgcagggaggcccggacgatgtctcgctgctgtcgcctggagaagatgtcctgatagacatagacgataaggagccgctgataccgatccaggaagaggagttcatcgactggtggagcaaattctttgcatcaatcggagaacgggaaaaatgcggaagctacctcgaaaaggattttgacacgctgaaggtgtacgacacccagctcgaaaacgtggaggcatttgaaggcctgtccgatttctgcaataccttcaagctctaccgtggtaagactcaggaggaaactgaagatccatcggtgataggagagttcaagggtctgttcaagatttatccgttgcccgaggacccagcaattccgatgccaccgcggcagttccatcaactcgctgcacagggtccccaggagtgcctggtcagaatctacatcgtgagagcgtttggccttcagccgaaggaccccaacggcaagtgtgatccgtatatcaaaatctctatcgggaaaaagtccgtgtccgatcaagataactacatcccgtgcacgctcgagcctgttttcgggaagatgtttgagctgacctgcaccctgccgctcgaaaaagacctgaagattactctctacgactacgacctgctgagtaaagacgagaaaatcggcgagactgttgtcgacctcgagaatcggctcctcagcaagttcggcgcacgttgcgggctcccacagacttactgcgtgtccggacctaaccagtggcgcgaccagctgcgcccgtctcaactgttgcacctcttctgccagcagcaccgcgtcaaggcccctgtgtatcggactgaccgcgtgatgtttcaggataaagagtactcgattgaagagatcgaagcaggcagaatccctaatcctcacctgggaccagtggaggaacgccttgcccttcacgtcttgcaacaacaaggcctggtgcctgagcacgtggaatcacggccgctctatagcccgctgcagccagacatcgagcagggaaagctgcaaatgtgggtggatctgtttccgaaagcgctgggacgcccgggacctcctttcaacatcacgccgcgccgcgcccggcggtttttcctgcgctgcatcatctggaatacccgggacgtgattctcgacgatctctcgttgaccggcgaaaagatgtccgacatctacgtgaaaggatggatgattggctttgaggagcacaagcaaaagaccgacgtgcactaccgctcgcttggcggagaaggaaatttcaactggcggttcatcttcccgttcgactacctcccggcagagcaagtctgtaccattgcaaaaaaggatgctttctggagactcgacaagaccgaaagcaagatcccggcgcgcgtggtgtttcagatctgggataatgacaagttctcattcgacgactttttgggctcacttcagctcgacctgaaccggatgccgaaaccagctaaaacggcgaagaaatgctcactggatcaattggacgacgctttccaccctgagtggtttgtttccctcttcgaacagaaaactgtgaagggatggtggccatgcgtggcggaggagggcgagaagaagatcctcgcaggtaagctggaaatgaccctcgagatcgtcgctgaatcagaacatgaagaacgacccgcaggccaaggacgagacgaacctaacatgaatccgaaactggaagatccccggcggccggatacgagtttcctttggttcactagcccgtacaaaaccatgaagtttattctgtggcggcgctttcgctgggcgatcatcttgtttatcatcttgttcatcctgctcctcttcttggcaatattcatctacgccttcccgaattacgcggccatgaagctggtgaaaccgttcagc

SEQ ID NO: 10652 - DNA, 6243 bp, Artificial Sequence
  Description of Artificial Sequence: Synthetic coding sequence
atgctatgctgcctgctcgtgagggcatcaaatcttccttccgctaaaaaggacagacgctcggatcccgtcgcctccctgacatttagaggggttaagaaacggacaaaagttatcaagaattcagtgaaccctgtctggaacgaagggtttgagtgggaccttaagggtattcccctcgatcagggaagcgagctacatgtggttgtaaaggatcatgagacgatgggaaggaatcgtttcttgggcgaggccaaggtgcctctgcgcgaagtgctggcgacgccctctcttagtgcatcattcaacgccccactcctggacactaagaaacagccaacaggagcctctttagtgctgcaagtgtcctatacccctctgcccggagcagtaccactatttccacctccgacgcccctcgagccttcacccacgctccccgatctggacgtcgtcgccgataccggcggagaagaggataccgaggatcaggggctgaccggtgacgaggcggagccattcctcgatcagagtggagggcccggggctcccactacacctagaaagctgccaagcagaccgccacctcactaccccggcattaagaggaagagatccgcgcctacaagccggaagctgctgagcgataaacctcaggattttcagataagagtgcaggtcatagaggggcgccaactgcccggagttaacatcaaacctgtggttaaagtgaccgccgcaggtcagactaagagaactagaatccacaaaggtaactccccattattcaacgaaactctgtttttcaacctgttcgattctccgggggagttgtttgacgagcctatctttatcactgtcgtggatagcagaagtctcagaacagacgctctgttgggggagtttcgcatggatgtgggtactatctaccgagagcctcggcacgcgtacctccgcaagtggttgttgttgagcgaccctgacgattttagtgcaggcgccagaggatatcttaaaacctcattgtgcgtgctgggtcccggagatgaggcacctctggaaagaaaggacccctccgaggacaaagaggacatcgaatctaatttgcttcggccgaccggcgttgcattgcgtggggcccacttttgtctcaaggtctttagagcggaggatttaccgcagatggatgacgccgtgatggacaacgtcaagcaaatcttcggttttgagtctaataagaagaatttggtggacccctttgtagaagtaagtttcgcagggaagatgctttgcagtaagatccttgaaaagacagctaatcctcagtggaaccagaacattactctgccagccatgtttccgagtatgtgtgagaaaatgagaatcaggataattgactgggatcggctgacgcataacgacattgtggccactacatacctgagtatgagcaaaatcagtgctccgggtggtgagatcgaagaggaaccagctggcgcagtaaagccctcaaaagccagcgatctcgacgattacctcggttttctgccgacttttgggccttgttacatcaacttgtacgggtccccgagggaatttaccggtttcccagacccctacacagagctgaacactggtaagggcgagggggtggcttaccgcgggagattactgttgtccctcgaaaccaaattggtcgaacatagcgaacagaaggtcgaagacctcccagcggatgatatactgagggtggagaaatatcttcggaggcggaaatactccctctttgctgctttttactcagcgaccatgctgcaggatgttgacgacgcgatccagttcgaggtcagcattggaaactacggaaacaaattcgacatgacatgcttacccctcgccagtactacgcagtattctcgcgctgtgtttgatggatgccattattattatctcccatggggtaacgtaaaacccgtagtcgtcttgtcatcctattgggaagatataagtcaccgcatcgagactcagaaccagctgctggggattgccgatcggctcgaagcgggtttagagcaagtgcatttagcattgaaggcccagtgtagtactgaagatgttgatagtctggtggcgcaactgactgacgaactgatagccggttgcagccaacccctgggcgacattcacgaaacaccatcagctacacatctcgaccagtatctgtatcagttacgtacacaccacctgagccagattactgaggccgcccttgcgctgaagctgggccactccgagctccccgccgcactggagcaggctgaagattggctattgagactcagggctctcgccgaggagccgcagaacagtcttcctgacatcgtgatctggatgttgcagggagataagcgggtggcgtaccaaagggtgccagctcaccaggtcctgttctctcgtagaggagcgaactactgcggcaagaactgcggaaagctccagaccatattcttgaaatatcctatggagaaggtgcccggagccagaatgcctgtgcagattagagtgaagctttggttcggactgagcgtcgacgaaaaggagtttaatcagttcgcggagggcaaactcagcgtgttcgcggagacttatgaaaacgaaacaaaactcgcactcgtcggtaactggggcacgacgggcctcacctacccgaagttttccgacgtgaccggcaaaataaaactgccaaaggacagcttcagaccatccgctgggtggacttgggccggggattggtttgtgtgccctgaaaagactttactccacgatatggatgccggacacctctcatttgtagaggaggttttcgagaaccagacgaggttgcctggaggacaatggatctacatgagcgacaattacaccgacgtgaacggagaaaaggtattgccgaaagacgacatcgagtgccccttgggttggaagtgggaggatgaggaatggtctacggatctcaatagggctgtagatgaacagggctgggagtattcaattaccataccacctgaaagaaagcccaagcattgggtgcctgcggagaagatgtactatactcataggcgccgaagatgggttaggttgcggagaagggatctgagccaaatggaagccttaaaacggcataggcaagccgaggctgagggggagggctgggaatatgcgagcctgttcggatggaaattccacctggagtatcgaaagacggacgcatttagacggaggagatggcgcaggaggatggagccgcttgaaaaaactggcccagctgctgtgtttgctctagaaggggcgcttggcggagtgatggacgataaatctgaagattctatgtccgtttcaaccctgtctttcggcgtaaataggccaactatctcctgtatatttgattacggaaaccgctaccacctgagatgctatatgtatcaggcaagggaccttgccgctatggacaaagattcatttagcgacccgtacgctattgtaagcttcttacatcagagccagaagactgtagtggtcaagaacacactcaaccccacatgggaccagactcttatcttttacgagattgaaatattcggggagcctgccactgtggctgaacagccgccctccattgtggtcgaactgtatgatcacgacacctacggcgcagacgagttcatgggtaggtgcatttgccagccctccctggaacgtatgccccgactggcctggtttccactcaccagaggaagtcagccaagtggtgagctgctggcatccttcgagctgatccagcgggagaaaccagctatccaccatataccggggttcgaggtccaggaaacatcccgcatcttagacgagtcagaggacacagacttgccctacccaccacctcagagagaagctaacatttatatggtgccccagaacatcaagcccgctctgcagcgaacagctatcgaaattctagcctggggcctgagaaacatgaagagttaccagctcgctaatatttcgtctccctctctggtggttgaatgcggtggacagaccgttcaaagctgcgtgatacgaaatctgaggaagaatccgaacttcgatatttgtaccctgttcatggaggtgatgctaccacgagaggagctgtactgcccgcccatcacagttaaggtgatcgacaacaggcagttcggcagaagacctgtggtgggtcagtgtaccattcggagtctagagtcattcctttgcgatccctactctgctgaatcgcctagcccccagggtggcccagatgatgtaagtctgcttagcccaggggaagacgtgcttatcgacattgatgacaaagagcccctgattccaatccaggaagaggagtttattgattggtggtccaagttttttgcatcgatcggtgagcgggagaaatgcggcagttatctggaaaaggatttcgacaccctgaaagtttatgacacgcaactggagaacgtagaagcgttcgagggccttagcgacttctgtaacactttcaagttgtaccgcggtaagactcaggaagagaccgaggatcctagcgtaattggcgaatttaagggtctgttcaaaatttaccctcttcctgaggacccggccattccaatgcccccgcgtcaatttcatcaattggctgctcagggaccacaggaatgcttggtaagaatctatattgtacgcgccttcggtctgcaacctaaagatcctaatggcaaatgcgatccatacatcaaaatttcaataggtaagaagtccgtgagtgatcaggacaattacatcccctgtaccctcgagcccgtgttcggaaagatgtttgagctgacgtgtaccctgcccttggaaaaggacctaaagataaccttgtacgattatgacctgctgtctaaggatgagaaaataggtgagacggtcgttgatctcgaaaacagactgctctccaagtttggcgcccgctgcggactaccacagacctattgtgtcagcggaccgaatcaatggcgtgatcaattgcggccatcacagctcctgcacctgttttgccagcagcacagggtgaaagcccccgtgtaccgcaccgaccgggttatgttccaggacaaagaatattcaatcgaagaaatcgaagcaggacgcatacctaatccgcacctggggcccgtggaggagaggctggcccttcacgtgttgcagcaacaaggcctcgtgcccgaacacgtggagagcaggcccctctattcaccgctgcaacctgacattgaacaaggcaagctccaaatgtgggttgacttgtttcccaaagcactcgggcgccccggacctccatttaacattactccacggagagccaggcgcttctttctgcgctgtatcatttggaatactcgggacgtgattctggatgatttaagccttactggggagaaaatgagtgatatttacgtgaaaggttggatgattggctttgaggagcacaaacagaagaccgacgtgcactacagatcccttgggggagaggggaacttcaattggcggtttatctttccctttgattatctgcccgccgaacaggtttgcactatagcgaaaaaggacgcgttctggagactcgataagacagagagtaagatccctgcacgagtagtgttccagatctgggacaacgacaagttcagctttgacgattttctcggctcactccagttggatttgaatagaatgcccaagccagccaagaccgcaaagaagtgtagcttggatcagctggatgatgccttccaccccgagtggtttgtgtcacttttcgagcaaaaaactgtcaaaggatggtggccctgcgtcgcggaggagggcgaaaaaaagattttggctggcaaactggaaatgacactggaaattgtggcggaatctgaacatgaggagaggccagctggacagggccgggacgagccaaacatgaaccctaagctggaggacccaaggagaccggacaccagtttcctgtggttcacctcgccttataagaccatgaaattcattctctggcggaggtttcggtgggcaattatcctttttatcatactattcatcttgctcttgttccttgctatattcatctatgcgttccccaactacgccgctatgaagctggtcaaacccttctca

SEQ ID NO: 10653 - DNA, 6243 bp, Artificial Sequence
  Description of Artificial Sequence: Synthetic coding sequence
atgctctgttgcctgctcgtgagagcctcaaaccttccttccgccaagaaagatagacggtccgatccagtggcatccctcacttttagaggagtgaagaagcggaccaaggtgatcaagaacagcgtgaaccctgtgtggaatgagggatttgaatgggacctcaagggaattcctctcgatcagggcagcgaacttcatgtggtggtgaaggaccatgagactatgggacgcaatcgctttctgggagaggccaaggtccctctgagagaagtcttggcaactccctccctttcggcctcctttaacgcgccacttctggatactaagaagcagcccaccggggcatccctcgtgctgcaagtgtcttacaccccactgccaggcgcggtccctctctttccaccaccaacccctctcgagccctcccctactcttcctgatctggatgtggtggcagacaccggcggtgaagaggacaccgaagatcaggggctgactggagatgaagcggaaccgtttctggatcagtcgggcggaccgggagcacctactactccccgcaaacttccatcacgccctccaccccattaccctggaatcaaaaggaaacggtcggctcctaccagccgaaaactgctgtcagacaagcctcaggattttcaaatcagagtccaagtcatcgaaggcagacaacttccaggggtgaacattaagcccgtcgtgaaggtgaccgcagcgggacagaccaagagaacccggatccataagggtaacagccctctgtttaatgagactctcttctttaacttgtttgatagcccgggcgagctgtttgatgaaccaatctttatcactgtggttgactcccgttcgcttcggaccgatgcgcttctcggtgaatttcgaatggacgtgggcactatatacagagaaccccggcatgcctaccttaggaagtggctgctcctgtctgatccagatgacttcagcgcaggggcgcgaggataccttaagacctcgctgtgtgttctcggtcccggtgacgaagcaccacttgagcgaaaggatccttcggaggataaggaggacatagaatcgaacttgcttcggcctacgggcgtggccctcagaggagcacacttctgcctgaaggtctttcgagcagaggatctcccgcagatggacgacgcagtcatggataacgtgaagcagatctttgggtttgagtccaacaagaagaacctggtcgatccttttgtggaagtgtcttttgccggtaagatgttgtgttccaagattctggaaaagactgccaacccgcaatggaaccagaacattacgctgcccgcgatgtttccttcaatgtgcgaaaagatgagaatcaggattattgactgggacagacttacccacaatgatattgtggcaaccacttacctctcgatgtcaaagatttcggcaccaggcggggaaatcgaggaagaaccggcgggtgcagtgaaaccctccaaggcgtccgatttggacgattaccttggattcctgcctacttttggaccctgttacatcaatctgtacggatccccgcgggaatttaccggttttcctgacccttacactgaactgaatactggaaaaggcgaaggtgtcgcatatagggggcgactgctgctgagcctcgaaaccaagctggttgaacactcagagcaaaaggtagaagatctgcctgccgacgatattctcagggtggagaagtacctccgtcgcaggaagtactcgctgttcgctgcattttactccgccaccatgttgcaagacgtggatgatgcaatccaattcgaagtgtccattggtaactacgggaataagttcgatatgacctgccttcccctcgcctcgactactcaatactcacgggccgtgtttgatggatgccattactactaccttccctggggaaatgtgaagccagtggtcgtcctttcgtcgtactgggaagatatttcgcatcggattgagactcagaaccagctccttggaatcgccgatagacttgaagccggactggaacaggtgcatctggccctgaaagcacaatgttccaccgaagatgtcgacagccttgtcgcccaactgaccgacgaactcattgcaggctgttcacaaccacttggagatatacatgaaaccccttcggcaactcacctcgaccagtatctttatcaattgaggacccatcacctctcacagataaccgaagcagctctcgcactgaaattgggacactcggaactgcccgctgcactggaacaggcagaggattggctgttgcgcctgcgcgctcttgcggaggaacctcaaaactcgctccctgacattgttatttggatgcttcagggtgacaagagagtggcttaccagcgggtgcctgctcaccaggtgctgttctcacgtagaggagcaaattactgtggaaaaaactgtggcaagctccagaccatttttctgaagtaccctatggaaaaagttcccggtgcaagaatgcccgtccaaattagggtcaaactgtggttcggcctgtccgtggatgaaaaagaattcaaccaattcgcagaaggaaagctgagcgtctttgcagaaacctatgaaaatgagactaaactggcactggtgggcaactggggaaccaccggtcttacctatcctaagttctcagatgtgacgggtaagattaaactgccaaaggatagcttcagaccctcggcgggatggacctgggcaggggattggttcgtgtgtcctgaaaagacccttctgcacgatatggatgcaggccacctgagctttgtggaagaagtctttgaaaaccaaaccagattgcctggtggtcaatggatctacatgtcggataactacacggatgtgaatggtgagaaagtgctgcctaaagacgacatagagtgtcccctcgggtggaagtgggaagatgaagagtggtcgactgatcttaacagggcagtggacgaacaagggtgggaatattcgattaccattccccctgagcgcaagccaaaacactgggtgccagcagagaagatgtactacacccaccgacgacggagatgggtcaggttgcgacggcgggacctgagccaaatggaggcgctgaagcgccaccggcaagcagaagcggaaggagagggatgggagtacgcatccctgtttggatggaagtttcatctcgagtacagaaagactgatgcgtttcgccggcgccgctggaggcgcaggatggaacctctcgaaaagacgggacctgccgcagtctttgcactcgaaggtgcactgggcggagtgatggacgataagagcgaggactcaatgagcgtctccactctttcgttcggcgtcaaccgcccgacgatttcgtgtatcttcgactacggtaataggtaccatcttagatgctacatgtaccaagcacgtgatctggccgccatggataaagatagcttctcggatccttacgcaattgtcagcttccttcatcagtcgcaaaagactgtggtggtcaagaacactcttaaccctacgtgggaccagactctcatattctacgaaattgagatctttggtgaacctgccactgtcgcagaacagcccccctccatcgtggtcgaactttacgatcacgatacctacggcgcagatgaattcatgggaaggtgcatttgtcagccttctctggaacggatgcctagacttgcgtggtttcctttgacccggggttcacagccatcgggggaacttcttgcatcgttcgagctcattcagagagagaagcccgccatccatcacattccaggttttgaggtccaagaaacctccaggatacttgacgagtcggaggacactgaccttccatatccgccgccacagcgcgaagcgaatatctacatggtgcctcaaaacatcaagcctgctcttcagcggactgccattgaaattcttgcgtggggacttcgtaatatgaagagctaccagcttgccaacatttcgtccccttcactggtggtggaatgtggagggcagactgtgcaaagctgcgttatcagaaatcttcgaaagaatcctaactttgatatctgcacgctgtttatggaagtgatgcttcctcgcgaagagttgtactgtcctcctattacggtgaaggtgatcgacaacaggcagtttggacgacggccagtggtcggacaatgtaccatcagatccctggagagctttctctgtgatccttactcggctgagtccccttcgcctcaaggtggtccagatgacgtgtccctgctgagccctggtgaggacgtcctgattgacatcgatgacaaagaacctttgatccctatccaagaggaagaattcattgactggtggtcgaagttttttgcaagcattggtgaaagggagaaatgcgggtcctaccttgagaaggattttgatactctgaaggtgtacgacactcagctggaaaacgtggaagcattcgaaggattgtccgatttttgtaatacctttaagctgtaccggggaaagactcaagaggaaaccgaagatccaagcgtgattggtgaattcaagggtctgtttaagatctaccctctccccgaagatcccgcgatccccatgcctcctagacaattccatcaactcgccgctcaaggaccgcaagagtgtctcgtgcgaatttacatagtccgcgcattcggacttcaaccaaaggatcctaatggtaaatgcgatccttacattaagatatccattggcaagaagagcgtcagcgaccaagataactacatcccctgtactctggagccggtgttcggaaagatgtttgaactgacctgtactctcccgctggaaaaagatctgaagataaccctgtacgactacgatctcctgtcgaaggatgagaagataggcgagactgtggtcgatctggaaaaccgcctgctcagcaagtttggcgcacgttgtggcctgccgcagacttactgcgtgtcgggccctaaccagtggcgagatcaactgcgccctagccagcttctccatctgttttgtcaacaacatagagttaaggcaccggtctaccggaccgacagagtgatgtttcaggataaggaatactcgatcgaggagatagaagcaggcagaattcccaaccctcaccttgggcccgtggaagaacgactggcacttcacgtccttcagcaacagggacttgtccccgagcatgtggaatcgcgacctctttatagcccattgcagccagatatagaacaaggaaagctccaaatgtgggtggacctgtttccaaaagcacttggtcgacccggtcctcctttcaacataacccctcggcgagcgcgccgcttctttttgcggtgcatcatttggaacacgagagatgttattctggacgacctgtcgctgaccggagagaaaatgtcagacatttacgtgaagggatggatgataggtttcgaagagcataagcaaaagaccgatgtgcattacaggagcctggggggagaaggtaacttcaattggcggtttatcttcccatttgattatctgccagcagaacaagtgtgtaccatagcgaagaaagatgcattttggcgtctggataaaaccgaaagcaagattcctgcaagagtggtgtttcaaatctgggataacgataagttttcgtttgatgactttttggggtcgcttcaacttgatttgaaccgcatgccaaagccggccaagactgccaagaaatgttccctggaccaacttgatgatgcgtttcatcctgaatggtttgtgtcactttttgaacaaaaaacggtgaaagggtggtggccgtgcgtggcagaggaaggagagaagaaaatcttggctggaaaacttgagatgacgctggagattgtggccgagtccgaacatgaagaaaggcctgcggggcaggggagagacgaaccaaacatgaatccaaagttggaagatccacgacggccggatacctccttcctttggttcacttccccctacaagacgatgaaattcattctttggagaaggtttagatgggcaataatcttgttcattattcttttcatcctcctgctttttcttgcaattttcatctacgcatttcctaattacgcagcgatgaaacttgtgaagccattcagc

SEQ ID NO: 10654 - DNA, 6243 bp, Artificial Sequence
  Description of Artificial Sequence: Synthetic coding sequence
atgctgtgttgcctcctcgtgagagcttccaacttacctagtgctaagaaggatcgccggtctgatcccgttgctagtcttacgttcaggggagtcaagaagcggaccaaggtgatcaaaaattctgtaaaccctgtctggaatgagggcttcgaatgggatttgaagggcatccccctggaccaaggcagcgagctgcatgtggtggtcaaggaccacgagaccatgggacgtaatcgcttcctgggtgaggcaaaggtccccctacgagaggtcctcgctaccccctctctgagcgcttccttcaatgcgccacttctggacactaagaaacagcccacgggcgctagcctcgtcctccaggtgtcttacacccctctgcctggtgctgtgccactgttcccccctcctacaccgctggagcccagtcctacacttccagaccttgacgtagtggctgacaccggtggtgaagaggacaccgaagaccagggactgaccggcgatgaggccgagcccttcctggaccagtccggcggccccggcgcccctacgacgccccgaaagctaccctcgcggccccccccacactacccaggaatcaagaggaagagaagtgctccaacttccagaaagcttctgtcagacaagcctcaggatttccaaatacgcgtgcaggtgattgaagggcgccaacttccgggggtgaatatcaagcccgtggtaaaggtgaccgcggctggccagacaaaacggacacgcatccacaaagggaattccccgctgttcaatgagactctgttttttaacctcttcgattctcctggcgagctcttcgatgagcccattttcatcaccgtcgttgattcacggagcctgaggacagacgccctgctgggcgagtttaggatggatgtaggaacaatataccgtgagccaagacacgcgtacctaaggaagtggcttctgttgtcagaccccgacgacttcagtgccggtgccaggggatatttgaagacctctctctgcgtactcggtccgggcgatgaagcgcccctcgaacgcaaagacccgagcgaggacaaggaagatatcgagagtaaccttttgcgcccaacaggggtcgctctccgaggagcgcacttctgcctcaaagtcttcagggccgaagacttaccacagatggacgatgccgtgatggacaacgtaaagcagattttcggttttgaaagcaataagaagaacctggtggaccccttcgtggaagtgtccttcgcagggaagatgctctgcagcaagatcctggagaaaacagccaacccgcaatggaatcagaacatcacattgccggctatgtttcccagcatgtgtgaaaagatgagaatccgaatcatcgactgggacagactgacccataatgacatcgtcgccactacttatctttcaatgagtaaaatctcagcacctgggggagagatcgaggaggagcccgctggggccgtgaaaccatctaaggcttctgacctggatgactacctgggtttcctgcccaccttcggtccatgttacattaacctctacggaagtcccagggagtttaccggattccctgacccctataccgagctaaacacgggtaaaggcgaaggcgtcgcctacagggggagacttctgctgagcctggaaactaaactagtagagcatagtgagcaaaaggtggaggacctccctgcggatgatatcttgcgcgtagaaaaatacctgcgtcgtagaaagtatagcctctttgccgccttctattcagcgacaatgctgcaggacgttgacgatgccatccagtttgaggtctcaattgggaactacggcaacaagttcgatatgacgtgcctcccgctggcgtccacaactcagtatagcagagcggtctttgacggctgccactattattatttaccatggggtaacgtgaagcctgtggtagtcctctcttcctattgggaggatatctcccacagaatcgaaacccagaaccagctgctcggcatcgctgacaggctcgaggctggactcgagcaggtacacctggccctgaaggcgcaatgttctactgaggacgtggacagcttggtggcacagctcaccgacgagctcattgccggctgttcacagcctctgggtgacatccatgagaccccatctgctacacacttagaccagtacctttaccagctgcgaacgcaccacctttcacagatcacagaggcggcccttgccctcaagctgggtcattcagagttaccagcggcccttgaacaggccgaggattggttgttacggctgcgtgccctcgctgaagagccgcagaacagtcttcccgacatagtcatctggatgctgcagggcgacaagcgggtggcctaccagagggttccagcacaccaggttctcttctcccgtcgcggagcgaactactgtggtaagaattgtggcaaacttcaaactatctttcttaaatacccgatggagaaggtcccgggcgctagaatgcccgtgcaaatccgcgtgaaactgtggtttggtttaagcgtggacgagaaggagtttaatcagtttgctgaagggaagctgtcggtgtttgcggagacctacgaaaatgagaccaagttggcgctggtgggaaactggggaacaacgggcctcacctaccccaaattctccgacgtcacaggtaaaatcaagctaccaaaagacagtttccgtccctccgccggttggacgtgggcaggcgactggttcgtgtgcccagaaaaaaccttacttcatgacatggatgcggggcatctcagcttcgtggaggaagtcttcgagaaccagacccgtctgccaggtggacagtggatttacatgagtgataactacactgatgtgaatggggaaaaggtgctgccaaaagacgacattgagtgtccgttgggctggaaatgggaagacgaggaatggagtacggatcttaaccgggcagtcgatgaacagggatgggaatattccataacaatcccaccagaaagaaaacctaaacactgggtgcccgcagagaaaatgtactacacacacagacgaaggaggtgggtgagactcagacgaagggatctgtcacagatggaggccctgaagaggcaccgccaagccgaggccgaaggcgaagggtgggagtacgcatcactatttggctggaagtttcatctcgagtacagaaaaaccgacgcatttcgccggaggaggtggcgccgtcgtatggagcccctggaaaagacggggccggccgccgttttcgcactcgaaggagcccttggtggcgtgatggacgacaagtctgaagattccatgagcgtgtccactctgtctttcggcgtaaacaggcctacaatctcctgtatcttcgactacggaaacagataccaccttaggtgctatatgtatcaggcccgagatctggctgctatggacaaagactccttctcagatccctatgctatcgtgtcatttcttcaccagtcccagaaaactgtggtggtcaagaataccttaaaccccacttgggaccagacactcatcttttacgagatagagatcttcggcgagcccgccaccgtggctgagcaacccccatcaatcgtggtggaactgtacgaccatgatacttacggagcagacgagtttatgggcagatgcatttgccagcccagcctcgagagaatgcctcgactggcttggttccctctcactaggggatcccagccttccggtgagctgctggcctcattcgaactcattcagagagagaaacctgccatccaccatatccctggtttcgaggtccaggagacctcccgtatcctcgacgaaagcgaggacaccgatctgccataccctcctccccagcgcgaagccaacatctatatggtaccacaaaatatcaaacccgccttgcagcgcacggccatcgaaattctggcttggggactaagaaacatgaaatcttaccagctagccaacatctcaagtcctagcctggtcgtcgagtgtgggggtcagaccgtgcagtcttgtgtcatacgtaacctgaggaagaacccaaatttcgatatctgcaccctgtttatggaggtgatgttgccacgcgaggaactgtattgccctccaattaccgtgaaagtcatcgataatagacaatttgggagaaggcccgtggtgggacagtgtaccattcgaagtctagaaagtttcctttgcgacccgtactccgccgaatcgccatccccacagggcggtcctgacgatgtcagcctgttgagccctggtgaggacgtgttgatcgacatagacgacaaggagccacttattccgatccaggaggaggagttcatagattggtggtcaaagttcttcgctagcatcggcgagcgcgagaagtgcggcagctacctggagaaagacttcgacacactcaaagtttacgatacacagctggaaaacgtggaagccttcgagggactgtctgacttttgcaatacttttaaactctatcgaggtaaaacgcaggaggagaccgaggacccgagcgttataggcgaattcaaaggcctgtttaagatctacccgcttcccgaagaccccgccatccctatgccgcctaggcagttccaccagctcgccgcccaggggccccaggaatgcctggtgaggatctacattgttcgggcgttcgggctgcagccaaaagaccccaacggcaaatgcgacccctacattaaaatctccatcgggaagaaatcagtctccgaccaggacaattatattccttgcaccctggagcccgtattcggaaagatgtttgaactgacttgcaccctaccactggagaaggacttgaaaatcaccctgtatgattacgatctgcttagtaaggatgagaagatcggcgagaccgttgtggatcttgaaaacagactgctgagcaaattcggcgctcggtgtgggctcccccagacttactgtgtgagcgggcctaatcaatggagggatcagttgcggccgagccagctgctgcacttattctgccagcagcaccgggtcaaggcccctgtctatcggaccgacagagttatgttccaggataaagagtactcaatagaggaaattgaggctgggcggattcccaaccctcacctgggccctgtggaagaacggctggctctccacgttctgcagcagcagggtctggtgcctgagcacgtggagagtaggcccttgtacagccccctgcagccggacattgagcaagggaagttgcagatgtgggtcgacctgttccctaaagcattgggcaggccgggaccaccatttaatataacaccccgccgcgctcgcaggttttttctgcgttgtatcatctggaatacaagagacgtcatcctggatgacttaagcctgaccggggagaaaatgagtgatatctacgtgaaggggtggatgatcggcttcgaagagcataagcagaaaacagatgtgcactaccggagtttgggtggcgaggggaatttcaattggcgatttatcttcccgtttgactacctgcctgctgagcaggtgtgcactatagccaagaaggatgcgttctggagactggataagactgagtccaagattccagcccgagtcgttttccaaatctgggacaatgacaagttcagttttgacgattttctgggttccttgcaactggacttaaaccgcatgcccaagccagccaaaacagccaagaagtgcagcctggatcagcttgatgatgcgttccaccccgagtggttcgtgtcactcttcgagcagaagactgtaaagggctggtggccatgcgtggccgaagagggagagaaaaagatactggccggtaagctagagatgaccctcgagattgtcgccgagagcgagcatgaggaaaggcccgcaggacagggaagagatgagccaaacatgaaccccaaactggaggatccacgcagaccagacactagttttctgtggtttacatccccctacaaaaccatgaagtttatcttgtggcggagattccgctgggccatcatcctcttcatcatattgttcatacttctgcttttccttgctattttcatttatgctttccccaactatgcagctatgaaactcgtgaaacccttttcc

SEQ ID NO: 10655 - DNA, 6243 bp, Artificial Sequence
  Description of Artificial Sequence: Synthetic coding sequence
atgttatgttgtttactagttcgtgcgtcgaatttaccgtcggcgaaaaaagatcgacgttcggatccggtagcgtcgttaacgtttcgaggtgttaaaaaacgaacgaaagttataaaaaattcggtaaatccggtttggaatgaaggttttgaatgggatttaaaaggtataccgctagatcaaggttcggaattacatgtagtagtaaaagatcatgaaacgatgggtcgaaatcgttttttaggtgaagcgaaagttccgttacgagaagtattagcgacgccgtcgttatcggcgtcgtttaatgcgccgttattagatacgaaaaaacaaccgacgggtgcgtcgttagtactacaagtatcgtatacgccgttaccgggtgcggtaccgctatttccgccgccgacgccgttagaaccgtcgccgacgctaccggatttagatgttgtagcggatacgggtggtgaagaagatacggaagatcaaggtttaacgggtgatgaagcggaaccgtttctagatcaatcgggtggtccgggtgcgccgacgacgccgcgtaaactaccgtcgcgaccgccgccgcattatccgggtataaaacgtaaacgttcggcgccgacgtcgcgtaaattactatcggataaaccgcaagattttcaaatacgtgtacaagtaatagaaggtcgacaattaccgggtgtaaatataaaaccggttgttaaagttacggcggcgggtcaaacgaaacgtacgcgtatacataaaggtaattcgccgttatttaatgaaacgctattttttaatctatttgattcgccgggtgaattatttgatgaaccgatatttataacggtagttgattcgcgatcgttacgaacggatgcgttactaggtgaatttcgaatggatgtaggtacgatatatcgtgaaccgcgtcatgcgtatctacgaaaatggttattactatcggatccggatgatttttcggcgggtgcgcgtggttatctaaaaacgtcgctatgtgtattaggtccgggtgatgaagcgccgttagaacgtaaagatccgtcggaagataaagaagatatagaatcgaatttactacgtccgacgggtgttgcgttacgaggtgcgcatttttgtttaaaagtttttcgtgcggaagatctaccgcaaatggatgatgcggtaatggataatgtaaaacaaatatttggttttgaatcgaataaaaaaaatttagtagatccgtttgtagaagtatcgtttgcgggtaaaatgttatgttcgaaaatattagaaaaaacggcgaatccgcaatggaatcaaaatataacgttaccggcgatgtttccgtcgatgtgtgaaaaaatgcgtatacgaataatagattgggatcgtctaacgcataatgatatagtagcgacgacgtatttatcgatgtcgaaaatatcggcgccgggtggtgaaatagaagaagaaccggcgggtgcggttaaaccgtcgaaagcgtcggatctagatgattatttaggttttttaccgacgtttggtccgtgttatataaatttatatggttcgccgcgagaatttacgggttttccggatccgtatacggaattaaatacgggtaaaggtgaaggtgtagcgtatcgtggtcgtttactattatcgttagaaacgaaattagttgaacattcggaacaaaaagttgaagatttaccggcggatgatatattacgtgtagaaaaatatctacgacgtcgtaaatattcgctatttgcggcgttttattcggcgacgatgttacaagatgttgatgatgcgatacaatttgaagtatcgataggtaattatggtaataaatttgatatgacgtgtttaccgctagcgtcgacgacgcaatattcgcgagcggtttttgatggttgtcattattattatttaccgtggggtaatgtaaaaccggttgtagttttatcgtcgtattgggaagatatatcgcatcgaatagaaacgcaaaatcaactactaggtatagcggatcgactagaagcgggtttagaacaagtacatttagcgttaaaagcgcaatgttcgacggaagatgttgattcgctagttgcgcaattaacggatgaactaatagcgggttgttcgcaaccgttaggtgatatacatgaaacgccgtcggcgacgcatctagatcaatatttatatcaactacgtacgcatcatctatcgcaaataacggaagcggcgctagcgctaaaattaggtcattcggaattaccggcggcgttagaacaagcggaagattggctattacgattacgtgcgttagcggaagaaccgcaaaattcgttaccggatatagttatatggatgttacaaggtgataaacgagttgcgtatcaacgagtaccggcgcatcaagtattattttcgcgtcgtggtgcgaattattgtggtaaaaattgtggtaaattacaaacgatatttctaaaatatccgatggaaaaagtaccgggtgcgcgaatgccggttcaaatacgtgtaaaactatggtttggtctatcggttgatgaaaaagaatttaatcaatttgcggaaggtaaactatcggtatttgcggaaacgtatgaaaatgaaacgaaactagcgttagttggtaattggggtacgacgggtttaacgtatccgaaattttcggatgtaacgggtaaaataaaactaccgaaagattcgtttcgtccgtcggcgggttggacgtgggcgggtgattggtttgtttgtccggaaaaaacgttactacatgatatggatgcgggtcatttatcgtttgttgaagaagtatttgaaaatcaaacgcgattaccgggtggtcaatggatatatatgtcggataattatacggatgtaaatggtgaaaaagtactaccgaaagatgatatagaatgtccgctaggttggaaatgggaagatgaagaatggtcgacggatttaaatcgtgcggtagatgaacaaggttgggaatattcgataacgataccgccggaacgtaaaccgaaacattgggttccggcggaaaaaatgtattatacgcatcgtcgtcgtcgttgggttcgattacgtcgtcgtgatttatcgcaaatggaagcgctaaaacgtcatcgacaagcggaagcggaaggtgaaggttgggaatatgcgtcgctatttggttggaaatttcatttagaatatcgtaaaacggatgcgtttcgacgacgtcgatggcgtcgtcgtatggaaccgctagaaaaaacgggtccggcggcggtatttgcgttagaaggtgcgttaggtggtgttatggatgataaatcggaagattcgatgtcggtatcgacgttatcgtttggtgttaatcgaccgacgatatcgtgtatatttgattatggtaatcgttatcatctacgttgttatatgtatcaagcgcgagatttagcggcgatggataaagattcgttttcggatccgtatgcgatagtatcgtttttacatcaatcgcaaaaaacggtagtagtaaaaaatacgctaaatccgacgtgggatcaaacgctaatattttatgaaatagaaatatttggtgaaccggcgacggtagcggaacaaccgccgtcgatagttgtagaattatatgatcatgatacgtatggtgcggatgaatttatgggtcgttgtatatgtcaaccgtcgttagaacgtatgccgcgtctagcgtggtttccgctaacgcgaggttcgcaaccgtcgggtgaactactagcgtcgtttgaattaatacaacgtgaaaaaccggcgatacatcatataccgggttttgaagtacaagaaacgtcgcgtatactagatgaatcggaagatacggatttaccgtatccgccgccgcaacgtgaagcgaatatatatatggttccgcaaaatataaaaccggcgttacaacgaacggcgatagaaatattagcgtggggtttacgtaatatgaaatcgtatcaattagcgaatatatcgtcgccgtcgttagtagttgaatgtggtggtcaaacggtacaatcgtgtgttatacgtaatctacgtaaaaatccgaattttgatatatgtacgctatttatggaagtaatgttaccgcgagaagaattatattgtccgccgataacggtaaaagttatagataatcgtcaatttggtcgtcgtccggttgtaggtcaatgtacgatacgttcgctagaatcgtttttatgtgatccgtattcggcggaatcgccgtcgccgcaaggtggtccggatgatgtttcgttattatcgccgggtgaagatgtattaatagatatagatgataaagaaccgttaataccgatacaagaagaagaatttatagattggtggtcgaaattttttgcgtcgataggtgaacgtgaaaaatgtggttcgtatctagaaaaagattttgatacgttaaaagtttatgatacgcaactagaaaatgtagaagcgtttgaaggtttatcggatttttgtaatacgtttaaattatatcgtggtaaaacgcaagaagaaacggaagatccgtcggtaataggtgaatttaaaggtctatttaaaatatatccgctaccggaagatccggcgataccgatgccgccgcgacaatttcatcaattagcggcgcaaggtccgcaagaatgtttagtacgaatatatatagtacgtgcgtttggtttacaaccgaaagatccgaatggtaaatgtgatccgtatataaaaatatcgataggtaaaaaatcggtatcggatcaagataattatataccgtgtacgttagaaccggtatttggtaaaatgtttgaactaacgtgtacgctaccgctagaaaaagatctaaaaataacgctatatgattatgatttactatcgaaagatgaaaaaataggtgaaacggttgtagatttagaaaatcgtttattatcgaaatttggtgcgcgttgtggtttaccgcaaacgtattgtgtttcgggtccgaatcaatggcgtgatcaattacgaccgtcgcaattactacatctattttgtcaacaacatcgagtaaaagcgccggtatatcgaacggatcgagtaatgtttcaagataaagaatattcgatagaagaaatagaagcgggtcgaataccgaatccgcatctaggtccggtagaagaacgattagcgctacatgtactacaacaacaaggtctagtaccggaacatgttgaatcgcgtccgctatattcgccgttacaaccggatatagaacaaggtaaattacaaatgtgggtagatttatttccgaaagcgttaggtcgtccgggtccgccgtttaatataacgccgcgtcgtgcgcgacgtttttttctacgttgtataatatggaatacgcgtgatgttatattagatgatttatcgttaacgggtgaaaaaatgtcggatatatatgttaaaggttggatgataggttttgaagaacataaacaaaaaacggatgtacattatcgttcgctaggtggtgaaggtaattttaattggcgttttatatttccgtttgattatttaccggcggaacaagtatgtacgatagcgaaaaaagatgcgttttggcgattagataaaacggaatcgaaaataccggcgcgagtagtatttcaaatatgggataatgataaattttcgtttgatgattttttaggttcgctacaactagatttaaatcgaatgccgaaaccggcgaaaacggcgaaaaaatgttcgttagatcaactagatgatgcgtttcatccggaatggtttgtatcgctatttgaacaaaaaacggttaaaggttggtggccgtgtgtagcggaagaaggtgaaaaaaaaatactagcgggtaaattagaaatgacgttagaaatagttgcggaatcggaacatgaagaacgtccggcgggtcaaggtcgtgatgaaccgaatatgaatccgaaattagaagatccgcgacgaccggatacgtcgtttctatggtttacgtcgccgtataaaacgatgaaatttatattatggcgtcgatttcgttgggcgataatattatttataatactatttatactactattatttctagcgatatttatatatgcgtttccgaattatgcggcgatgaaattagttaaaccgttttcg

SEQ ID NO: 10656 - DNA, 6243 bp, Artificial Sequence
  Description of Artificial Sequence: Synthetic coding sequence
atgctttgctgtttgcttgtgagagcgtcgaatttgccctcggcaaaaaaggaccggcggtccgatcccgtcgcctcacttacgtttcgcggagtgaagaagcggactaaggtcatcaagaactcagtgaacccggtgtggaacgagggatttgagtgggacttgaaaggtataccactggaccagggttcagaactccatgtggtggtgaaagatcacgaaacgatgggaaggaacaggtttctgggagaagcaaaggtgccactgcgagaagtgctggccactccttcgcttagtgcatcattcaacgcacctcttctggataccaagaaacagccaaccggcgcatcgttggtcctgcaggtgtcgtacactcctcttcctggtgccgtgcccttgttccctcctccaactcctcttgaacctagcccgaccctcccagacctggatgtggtcgcggacaccggaggggaagaggacaccgaggatcaaggacttactggggatgaggcagaaccatttttggatcagtcgggtggtcccggagcacctactacgccgcgtaaacttccatcgcgaccccctccacattatccgggaatcaagagaaagcgctctgcacctacttcgcggaagctcctgtccgacaagccacaggattttcaaattagggtccaagttattgagggacgccaactgccgggcgtcaacattaagccagtcgtcaaggtcaccgcggctgggcagaccaagcggacgcgtatacataagggtaattctcctctctttaatgaaaccctgtttttcaatctcttcgacagccctggcgaactttttgacgaaccaattttcattaccgtggtggattctaggagccttcgcactgacgccctcctcggtgagttcagaatggacgtgggcaccatttaccgggaaccccgccatgcctacctgcgaaagtggctgctgctgtccgatcccgacgatttttccgcaggggcaagggggtaccttaagacttcgctgtgtgtgctggggccaggcgacgaagcacccctcgagcgcaaggacccaagcgaagataaggaagatatcgagtccaatctccttcgccctactggcgtcgcacttcgcggtgcccatttctgcctgaaggtgttccgcgcggaggatcttccacaaatggatgatgcagtcatggataatgtcaagcaaatcttcggttttgaaagcaataagaaaaatctggtggatccctttgtggaggtgtccttcgcgggcaaaatgctgtgttccaagattctggaaaagaccgcaaacccacaatggaaccaaaacattactctcccggcgatgtttccttcgatgtgcgaaaagatgaggatcaggattatcgattgggatagactgacccataatgatatcgtggccaccacttacctctcaatgtcaaaaatctcggcccctggcggcgaaattgaagaggaaccggctggtgcagtgaagccttccaaagccagcgacctggatgattaccttggatttctccctaccttcggaccctgctacatcaatctgtacggaagtcctcgagaatttaccggatttcctgatccatacaccgagttgaacactggaaagggtgagggtgtggcataccgtggtcgactgttgctctctctggaaacgaagctggtggaacactccgaacaaaaggtcgaggatcttcctgcagatgatatcctcagagtcgagaaatacctgagacgacgcaaatacagcctcttcgcagcgttttactcggcgactatgcttcaagatgtcgatgatgctatacagttcgaagtgtccatcggaaattacgggaacaaatttgatatgacctgtctgccacttgcctcaaccactcagtactcgcgcgcagtatttgacgggtgtcattactactacctcccttggggtaacgtgaagcctgtggtcgtgctgagctcctactgggaggacatctcacatagaattgaaacgcaaaaccagttgcttggtattgccgatcgtctggaggcaggacttgagcaagttcatctcgcactgaaggcacagtgttcgactgaggacgtggattcgctcgtggctcagctgaccgacgagttgatcgccggctgtagccaaccccttggtgatatccatgaaaccccttccgctacgcacctcgaccaatacttgtaccagcttagaacccaccatctgagccaaatcaccgaagccgcacttgcgctgaaattgggacactccgaactgccagcagccctcgaacaggcggaagattggctgcttcgacttcgcgcactggctgaagagcctcaaaactcgcttcctgacattgtaatctggatgcttcaaggtgataagcgggtggcatatcagcgggtgcctgctcaccaggtgctttttagccggcgcggagcaaactactgtggaaaaaactgcgggaaacttcagaccatttttctgaaatacccgatggaaaaggtgcctggtgctagaatgcccgttcagattcgtgtgaaactctggttcggccttagcgtggatgagaaggaattcaaccagtttgcagaaggtaaactttccgtatttgccgaaacttacgagaatgaaaccaagctggcacttgttggtaactggggaacgaccgggctgacctacccaaaattctcagatgtgacgggcaaaatcaaactccctaaggatagctttaggccgtccgccggatggacttgggcaggagattggtttgtgtgtccagagaaaacccttcttcacgacatggatgcaggtcatttgtcattcgtggaagaagtatttgagaaccaaactagactgcccggtggacagtggatttacatgagcgataactacaccgacgttaacggggaaaaggttcttccaaaggacgatatcgagtgtccccttggatggaaatgggaggacgaagagtggagcaccgatcttaacagagcagtcgatgaacagggatgggagtacagcataaccattcccccagagcgcaaacctaagcattgggtgccagcggaaaagatgtactacactcaccgcaggcggcgatgggtgcggctgcggagaagagacttgtcacaaatggaagcactcaaacgccatcgacaggcagaagcagagggcgaaggttgggagtacgcatccctgttcggttggaaatttcacctcgaatacagaaagactgacgcctttaggagacgtaggtggcggagaagaatggaaccccttgaaaaaactggacctgcggctgtgttcgcccttgagggagcactgggaggtgtgatggacgataagtcagaagatagcatgtcagtatccaccctgtcgtttggcgtcaacagacccactatctcctgtattttcgattatggtaatagataccacctgagatgttacatgtatcaggcacgggatctggccgcaatggacaaggattccttctcagatccatacgcgattgtttcattcctccatcaatcccaaaagaccgtcgtagtcaaaaacaccctcaacccaacgtgggaccagactctgatattctatgaaatagagatcttcggggaaccagccactgttgcggagcaaccaccaagcatcgtggtggagctttacgaccatgatacgtacggggcagatgagttcatgggacgctgtatttgccaaccatcgctggaaagaatgcctagactggcctggtttccactgactcggggctcgcagccttccggagaactgctggcgtcattcgaactcatccagagggaaaagcctgctattcaccatattcctgggtttgaagtgcaggagacttcccggattctggacgagtccgaagataccgatctgccatacccccctcctcagagggaagcgaacatctacatggtgcctcagaatatcaagcctgctcttcaaagaaccgcaatagagattcttgcatggggtcttaggaacatgaagtcgtaccaacttgcaaatatctcttcgccctcgctcgtggtcgaatgcggaggccagactgtccagagctgtgtgatacgcaaccttcggaagaaccctaactttgatatttgcactttgtttatggaagtgatgcttcctagagaagagctgtactgtcctcctattactgtgaaagtgattgacaatcggcaatttggccgccgtcctgtcgtgggccaatgcactatcaggtctttggaatcctttctttgtgatccatactctgctgagtccccctccccacaggggggacccgatgacgtgtcgcttctctcgcctggagaggacgtgctcattgatattgacgataaggaaccactcattcccattcaagaagaagagtttatcgattggtggtcgaagttttttgcatcaataggtgaacgggaaaagtgtggtagctatcttgagaaagattttgataccctgaaagtgtacgatactcaattggaaaacgtcgaggcctttgagggactctccgatttttgcaacacgtttaagctgtaccgcggaaagacccaagaagagactgaggatccgtcagtgataggcgagtttaagggattgtttaagatttacccactgccagaagatcccgcaatcccaatgcccccacgccaatttcaccagcttgctgcacagggtccccaggaatgcctcgtcaggatatacattgtgcgagcattcggactccagcctaaggaccccaacggaaagtgtgacccatacattaagattagcatcggcaagaaaagcgtgtcagaccaagacaactacatcccttgtactctggaacctgtctttggtaaaatgtttgagctgacctgtactctgccactggaaaaggaccttaagatcactctctacgactacgatctgttgtccaaggatgagaagatcggggaaaccgtcgtcgatctggaaaatagacttctgtcgaaatttggtgcaagatgtggactgccccaaacgtattgtgtgtccggtccaaaccaatggagagatcaacttaggccttcccagttgctgcaccttttttgccaacaacatcgcgtgaaggcacctgtctacaggactgaccgagtgatgtttcaagacaaggaatactcgattgaagaaattgaagccggacggattccgaaccctcatctcgggccagtggaagaaagactggcccttcatgtcctccagcaacagggactggtgccggagcatgtggaaagccggcctctgtattcacctcttcaaccggatattgaacagggaaagctgcaaatgtgggtcgatctgttcccaaaggccttgggccgccccggacccccttttaacattacccctagacgcgcacggaggttctttctccgctgcatcatatggaataccagagatgtgatccttgacgatctttctctgaccggagaaaagatgtcggacatttatgtgaagggctggatgatcgggtttgaagaacataagcaaaagaccgacgtgcactaccgtagcctgggaggagagggaaactttaactggagattcatctttccattcgattacctgccggccgaacaggtatgtacgattgcaaagaaagatgcattttggcgcctcgataagactgaatctaagattcccgcgcgagtggtgtttcaaatttgggataatgacaagttctcatttgacgatttcctcggttcgcttcaattggatcttaataggatgccaaaaccggcgaaaaccgcaaagaagtgttccctggatcaactcgatgatgcatttcatccagaatggttcgtgtcactgtttgaacaaaagactgtgaagggatggtggccttgcgtggccgaggaaggagaaaagaagattctcgcaggtaaattggaaatgaccttggaaatagtcgcagaaagcgagcacgaagaacgtcctgcagggcaaggaagagacgaaccaaatatgaatccaaagctggaggaccccagacgaccagacacctcctttctctggtttacctcgccctacaagaccatgaagtttattctgtggagaagattcagatgggcaatcatactgttcattatcctgttcattctcctcctttttctcgccattttcatttacgctttcccgaattacgcagccatgaagttggtcaaacctttctcg

SEQ ID NO: 10657 - DNA, 6243 bp, Artificial Sequence
  Description of Artificial Sequence: Synthetic coding sequence
atgctgtgctgcttgctcgtgagggcttccaatcttccatcagctaagaaggatcgtcgctccgacccagtcgctagcctgacgtttcgcggcgtaaagaaaaggactaaagtgatcaagaacagcgtcaatccagtctggaatgaaggatttgagtgggatctgaagggcattcctctggaccagggatccgaactgcatgtcgtggtgaaggaccacgaaaccatgggacgaaaccgcttcctcggagaggctaaagttccactgcgcgaagtgctcgctactccaagcctgtccgcaagctttaatgctcctcttttggatactaaaaagcagccaacgggcgccagtctggtccttcaggtcagctacactcctcttccaggggcagtgcccctgtttcctccccctacacccctggaacccagccccacactgccagacttggatgtcgttgcagacactggcggtgaagaagacaccgaggaccagggactgacaggcgatgaagctgagccattcctcgaccagagcggaggaccaggggcccctacgaccccgaggaagcttccttcacggccccctccccattaccccgggatcaagaggaagagatctgcgcctacaagtaggaaactactcagcgacaaaccccaagacttccagatcagagtccaagtcatcgaggggagacagctgccaggcgtaaacattaaacccgtcgtcaaggtgacagcagcagggcagaccaagaggaccaggatacacaagggcaatagccctctgtttaatgagaccctcttttttaacctctttgattctccaggagagctttttgatgagcccatctttatcacagtggtggactcccgctctctgagaaccgatgcacttctcggagaatttaggatggacgttggaaccatctacagagaacctcgccacgcgtacctcagaaaatggttgcttttaagtgaccccgacgattttagtgccggagcaaggggctatttaaagacatcactgtgtgttttaggacccggcgatgaggctccattggaaaggaaagacccctccgaggataaagaagatatcgaaagcaacctgctccgcccaacaggggtggcacttaggggggctcacttctgtctgaaagtctttagagccgaggatctcccccagatggacgatgccgttatggataacgtcaagcagatattcggatttgaaagtaacaagaaaaatctggttgatccctttgtggaagtttctttcgccggaaaaatgttgtgttcaaagatcttagaaaagactgctaatcctcagtggaaccagaacatcaccctgcctgccatgtttccttccatgtgtgagaaaatgcgcatcaggatcatagactgggataggctaacccacaacgatattgttgctaccacatacctgtcgatgagcaagatctccgcacccggaggggagatcgaagaagaaccagctggtgctgtgaagccaagcaaggcaagcgacctggatgactacctagggtttttaccaacgttcggaccatgttatatcaacctttatgggagtcctagggagttcactggcttccctgacccctatactgagctcaacaccggcaagggcgagggggtggcctaccgcggcagattgttgcttagcctggagactaaactggtggagcattctgagcagaaagttgaagatctgccagccgacgacattctgcgcgtggaaaaatacctgcggcggagaaaatactcactgtttgctgcattctactcagcaacaatgctacaggatgtcgacgacgccatacagtttgaagtatccatcggtaactatggaaacaaattcgacatgacctgcctcccccttgcgtcaaccacccaatactcacgggccgtgttcgacggatgtcactattactacctgccctggggcaacgtgaaacctgtggttgtcctgagcagctactgggaggatatcagccacaggatcgagacccaaaatcaactgttgggcatcgccgacagactggaggctggtctggaacaggtacatctcgccctgaaagctcagtgtagcaccgaagatgtcgacagcctggtggctcagctcaccgatgagcttatcgcaggttgcagccagcctttgggcgacatccacgaaactccatctgctactcacctagatcagtatctgtatcagttgagaactcatcacttgtcgcagataactgaagccgctctggcgctgaaactgggacattcagaattgcctgcggcactggagcaagcggaagactggttgctccggctgcgcgcattggctgaagaaccccaaaacagcttgccagatatcgtgatttggatgctgcagggagataagcgcgtcgcatatcaaagagtgcctgctcatcaggtgctcttcagcaggcgtggagcaaactactgcggaaaaaactgcggaaagctacaaacaatttttctcaaatacccaatggaaaaggtgcccggagcaagaatgcccgttcagatcagggtgaaactgtggtttggcctgtcagtagacgagaaagaatttaatcagtttgccgagggaaaactctccgtctttgctgaaacttacgaaaatgaaaccaagctcgcactggtgggaaactgggggacaaccggcctcacatatcccaagtttagcgatgtaaccggaaaaatcaaactccccaaggacagcttccgcccttccgcagggtggacctgggccggcgactggttcgtctgccctgaaaaaactcttcttcacgacatggacgctggccatctcagttttgtggaagaggtctttgaaaatcagacccggcttcctggaggacaatggatatacatgagcgataactacaccgacgttaatggcgagaaggtcctccccaaagatgatatcgagtgcccactgggctggaagtgggaagatgaagagtggtccacagatctgaatagggccgttgacgaacagggatgggagtacagcataacaattccgcccgaaaggaagcccaaacattgggtgcccgccgagaaaatgtattacacgcacagacggaggaggtgggtaagactgaggagaagggatctgtctcagatggaagccttgaagaggcaccgtcaggcagaagctgaaggcgaagggtgggagtatgctagtctcttcggatggaaattccatctggagtatagaaaaacagacgcattccgccgcaggaggtggagaagaaggatggagccactggagaagactggccccgccgctgtcttcgctctcgaaggagccttgggtggcgtcatggacgacaaatctgaagactctatgtctgtcagcacacttagtttcggagtcaaccgccctaccatcagttgcatttttgactatggaaacaggtaccacctgaggtgttacatgtatcaagcaagggatttggccgcgatggacaaagactctttcagcgacccttacgctattgtgagctttctgcatcaatcacaaaagacagttgttgttaagaacaccctcaacccaacctgggatcagactctgatcttctacgagatcgagatcttcggtgaacccgctactgtcgcagagcagcctcctagcattgtggttgaactttacgatcacgacacttatggcgccgatgagtttatgggtagatgcatctgccagcccagcctggaacgcatgcctagactggcctggttcccactcacgaggggaagtcagccaagcggcgaattgctggcgagtttcgaattgatccaaagagagaaaccagcaatccaccacatcccaggattcgaggtccaggaaacaagccgaatccttgatgagagcgaggacaccgatctgccatacccaccaccacagcgagaagctaacatctacatggtgccacagaatatcaagcccgctctgcaaaggaccgcaatagagattctggcatgggggctgaggaacatgaaaagttaccaactggcaaatatcagtagcccaagcctggtcgtggaatgcggcggccagaccgttcaaagctgtgtcatacgcaacctgcggaagaaccccaacttcgacatatgcactctgttcatggaggtcatgttgcctcgtgaggaactgtattgcccccctatcacagttaaagtgattgataatcgacagtttggcaggcgcccagtcgtaggccaatgcaccatccgtagcttagagtcttttctttgcgacccatacagcgccgagtccccaagcccacagggcggacctgatgatgtgtctctcctttcacctggagaggatgtgctcatcgatatcgacgataaggagcctctcataccaattcaggaggaagagtttattgattggtggagtaagttcttcgcttctatcggagagagggagaagtgtggttcctacctggaaaaggattttgacaccctgaaagtttacgacactcaactggaaaacgttgaagcttttgaaggtctttctgacttttgtaacacttttaagctgtacagaggcaaaacacaggaagaaactgaggatccgtccgtgatcggagaattcaaggggttatttaagatctatcctctcccagaggatcccgctatcccgatgccacccagacagtttcaccaactggccgcacaaggcccccaagaatgcttggtcaggatctacatcgtgcgtgcattcggcctccaacccaaggatccaaacggtaagtgtgacccatatattaaaatctctatcggcaaaaagagcgtgtcggatcaggataactacataccttgcaccctggaaccagtctttggaaagatgttcgagctgacatgcactctgccgcttgaaaaggacctgaaaataaccctatacgattacgacctcctgtctaaggatgagaaaatcggcgagaccgttgtggatctcgaaaacagactcctgtctaagtttggcgcaaggtgtggtctaccgcaaacctactgtgttagcgggcccaaccaatggcgcgaccagctgaggcccagccagcttttacaccttttttgtcagcagcaccgcgtgaaagctccagtgtacagaacagacagagttatgtttcaggataaagagtacagtattgaggaaatcgaagcaggcaggatccccaatccacatctgggccctgttgaagagagactggccctgcacgtgctccagcagcagggtctggtccctgagcacgtggaatccagacccctgtacagccctctgcagccagatatcgagcagggaaaattacagatgtgggtcgacctttttccaaaagccctcggtagacctgggcctcccttcaatatcacaccaaggcgcgctcgtcgttttttccttcgctgcattatctggaacactagggacgtgatcctggatgatctcagcctcaccggggagaagatgagcgatatctacgtgaagggatggatgatcgggttcgaggaacacaagcaaaagaccgatgtacattaccgcagcctgggaggcgaaggtaattttaactggcgttttatctttcctttcgattatctgcccgcagaacaggtatgcaccatcgctaaaaaggatgctttctggcgtttggataaaactgaatccaagatccctgccagggtagtcttccagatctgggacaatgataaatttagcttcgacgacttcctgggatctttgcagctggacctgaatcgcatgcccaaaccagcgaagaccgcaaagaaatgctccctcgaccaactggacgatgctttccatccagaatggttcgtgagcctgttcgagcagaaaacagtcaagggttggtggccatgcgtggctgaagaaggcgagaagaaaatactggctgggaagctagagatgacactcgagatcgtagccgaaagcgaacatgaggaacgtcccgccggacaaggaagggatgagccgaacatgaaccccaagctggaggacccaagacggccagatacatcttttctatggtttacgagtccgtacaagaccatgaaatttatcctgtggaggcggttccggtgggctatcatcctctttatcatcttgttcatcctgctcctgtttttggcaatcttcatctacgccttcccgaattacgccgctatgaaactggtgaagcctttttca

SEQ ID NO: 10658 - DNA, 6243 bp, Artificial Sequence
  Description of Artificial Sequence: Synthetic coding sequence
atgttgtgttgtttgctcgttcgagctagtaatttacctagtgctaaaaaagaccgccgatccgacccagttgcttcattgacctttaggggcgttaaaaagcggactaaagtaatcaaaaatagcgtaaatcctgtctggaacgaaggtttcgagtgggatctaaagggaattcctcttgatcaaggaagcgagctccacgttgttgttaaggatcacgaaacgatgggtcggaaccggttccttggagaagctaaggtacctttgagggaggtcttggccactcctagtctatcggcttcgtttaatgccccattgcttgacactaaaaagcaacctaccggggcttccctggttcttcaagtatcctacacacccctaccaggagcagtccctttgtttccgcctccgactccacttgaaccatcgcccacattacctgatcttgatgttgttgccgacacaggtggtgaagaagatactgaagatcagggactcacaggagatgaagctgaacccttcttagatcaatctggaggacctggagcccccaccactccccgtaagctcccttcacggccaccccctcactatcctggaattaaacgaaagagatcagctcccacttctagaaaattgttgtcagataagcctcaagacttccaaatcagggtgcaggttatcgagggtcgtcaacttccaggggtgaacattaaacctgtcgtgaaggtcacagctgcaggccagacaaagagaacccgcattcataaaggtaattcccctcttttcaatgagacacttttctttaacctattcgattctccaggcgaattattcgacgagccgatatttatcacggtggttgattcgcgctctcttagaaccgatgctctccttggggaattccgtatggatgttggtacaatataccgagaacctagacacgcctatttgagaaagtggctattactttcagatcctgacgatttttcggccggagctcggggttacctaaagactagcttgtgtgttctaggtccaggtgacgaggccccattagagcgcaaagatcccagtgaagataaagaagatatcgagagtaatttattgagaccaacgggtgttgcattaaggggcgctcatttctgccttaaagtttttcgcgcagaagatcttccacaaatggatgatgctgtcatggacaacgttaagcaaatcttcggattcgaatccaataaaaagaacctcgttgatccgtttgttgaggtctccttcgcaggaaaaatgttgtgttccaagattctggagaaaactgctaaccctcagtggaatcagaatattactttacctgccatgtttccttccatgtgtgaaaaaatgaggattcgcatcattgactgggaccgacttacccacaatgacatcgtggccaccacatatctatccatgagcaaaattagcgcacctggtggtgagattgaggaagagcctgcaggtgccgttaaaccatctaaagcttctgatttggatgactacctaggtttcctcccaacattcggtccttgctatataaatctgtatgggtcaccgcgtgagtttacagggttccctgacccttatactgaactgaatacaggtaaaggggagggggtggcctataggggtcgtttactcttatcccttgagactaagctcgtcgaacactcggaacagaaagttgaagatctcccggctgacgacattctgcgtgtagaaaagtatctgcgcagaaggaagtactctcttttcgcagctttctatagcgctacaatgctccaagatgtggatgatgccattcaatttgaagtttcaataggtaattacggaaataaattcgacatgacgtgtcttcccttggcctcgacaacccagtattcaagagccgtttttgatgggtgccattattattatcttccatgggggaatgttaaacccgttgtggtcctgagttcttattgggaggatatttcacaccgtattgagacacagaatcagttgctggggattgccgacagattagaagctgggcttgaacaggtccatttggcgcttaaagctcaatgctctacagaagatgtggacagcttggttgctcaacttactgacgaattgatagcaggctgctctcagcctctaggagatatacatgaaaccccatctgcaacccacttagatcaatacctgtatcaattgcgtacgcaccatctctctcaaatcaccgaagctgccttggctcttaaattaggtcattcagaacttcccgcagcactcgagcaggctgaggactggctcctcaggctaagagcacttgccgaggagcctcaaaatagtttaccagatatcgtcatttggatgctacaaggagataaaagggtggcttatcagagggtgcccgcgcatcaggtccttttttcgagaaggggagcaaattactgcggaaaaaattgcggtaagttacaaacaatcttccttaaatatcctatggaaaaggttccgggtgcaaggatgcccgtccagattcgcgtcaagctttggttcggtctttcggttgacgaaaaagagtttaaccagttcgctgagggtaaattgtcagtatttgctgagacctacgaaaatgagaccaagctggctctagtgggaaattggggaactaccgggcttacttatcctaaattctcagatgtgactggtaagattaaattacctaaggattctttccgacccagcgccggttggacttgggcgggagattggttcgtgtgtcctgaaaagacattacttcacgatatggatgccgggcatttgtcattcgtggaagaagtttttgagaatcagacccgtcttccaggtggccaatggatctacatgagtgacaactacactgatgtgaacggagaaaaagtgctcccaaaggatgatattgaatgtcctcttggatggaaatgggaggatgaagaatggtctaccgacctgaatcgagctgtggacgaacagggttgggaatactccattactatacctcctgagcgaaagccgaaacattgggtgccagcagagaaaatgtactatacgcatcgtcgtagacgctgggtcaggcttagaagacgagatttgagtcagatggaagcccttaaacggcacaggcaagctgaggctgaaggggagggatgggaatacgcgagtctcttcgggtggaagtttcatttggagtataggaagactgatgcttttagaaggaggcggtggagaaggcggatggagccattggaaaaaacaggacctgccgctgtgtttgctctggaaggtgccctgggaggtgtgatggatgacaaatcggaggattcaatgagcgtttccacactttctttcggggtgaaccgaccaactatatcatgcatcttcgattatggaaataggtatcatttgcgatgttacatgtaccaagcaagagatcttgcggctatggacaaggatagctttagcgacccttatgctatcgtttcctttctccatcagagccagaagaccgtcgtcgtaaaaaacactctgaacccaacttgggatcagacattgatattttatgaaatcgaaatcttcggagagccagctacagtggctgagcagcctcccagcatcgttgtcgagctttacgatcatgacacgtacggtgctgacgagttcatgggtcgttgcatttgtcaaccttctttagagagaatgccaagacttgcttggttccctctgacccgagggagccaaccatcaggtgaactactggccagcttcgagttaatccagcgtgaaaagcctgcaatccatcacattcctggctttgaagtacaagaaacctcccggattctagacgaatccgaggataccgatctgccatacccaccacctcagcgggaggctaacatctacatggtgccgcaaaacattaagcctgcgctgcaaaggacagctatcgagattctcgcttggggtttgcgaaacatgaaatcttatcaacttgcgaatatatcgtcccctagtcttgttgtggaatgtggtggtcagactgtacaatcctgcgtaatcagaaatctccgtaaaaatcctaatttcgatatatgcactctgttcatggaggtgatgctgccaagagaagagctgtattgccctccgattaccgtcaaagttattgataatcggcagtttggaagacgaccagtggtaggccagtgtaccatcaggagccttgagagcttcttgtgcgatccttattccgcagagtctcctagccctcagggtgggcccgacgatgtgtcattgctttccccaggagaagacgtgctgatcgatattgatgataaagagcctctaatacctattcaggaagaggagttcatagattggtggtcgaagttttttgctagcataggtgagcgtgaaaagtgtggatcttaccttgagaaagatttcgatacacttaaggtgtatgatacccagttggaaaatgttgaagcattcgaaggattatctgatttttgtaacaccttcaagctgtataggggcaagactcaagaggagaccgaagacccatctgtgataggagagtttaaaggactttttaaaatttatcccctgcctgaggatccagccattccgatgcccccaaggcagttccatcaattagccgcacagggtccacaggaatgcttggtaagaatctacatagtcagggctttcggtttgcagccgaaggatcccaacggcaagtgcgatccctatataaagataagtataggaaagaaatcagtgtccgatcaagataattatattccctgtaccctggaacctgtgtttggaaagatgttcgaactcacatgtactctccctctggaaaaggatctaaagatcacactatatgactatgacttattgtccaaggacgagaagataggcgaaactgttgtcgatcttgaaaacaggttgttgtcaaagttcggcgcgaggtgtgggctccctcaaacctattgcgttagcggccctaaccagtggagagatcagcttcgaccgtcacagctattgcatcttttttgtcagcagcatagagtcaaggcgcctgtttatcggacggaccgagtaatgttccaggataaggaatactccatagaggaaatagaagctggtcgaatacctaatcctcatctaggccctgtggaagaaagattagctctgcacgtgctacaacagcaaggattggtccccgagcacgtcgagagtcgcccactgtacagtccgttgcaaccggacatcgagcagggtaaactacaaatgtgggtagatcttttcccgaaggcgcttgggagaccaggtccaccattcaatatcacccctcggagagctagacgattttttcttaggtgcataatctggaacacgcgggatgttattctcgatgacctttcgctaacaggagaaaagatgagcgacatctatgtaaaaggttggatgatagggtttgaagagcacaaacagaaaacagacgtccattatcggtcactgggtggcgagggtaacttcaactggagattcattttccctttcgattatctgcctgctgagcaggtttgtacaatcgcgaagaaggatgccttctggcgtctcgataaaacagagtccaaaataccagctagagttgttttccagatctgggataacgataaattttcgttcgatgactttcttggatctttgcagctagacttaaatagaatgccaaaaccagccaaaactgctaaaaaatgttctcttgatcaactcgatgacgcatttcatcctgagtggtttgtctctctattcgagcaaaagaccgttaagggatggtggccttgcgttgctgaggaaggggaaaaaaagatcttggctgggaagctcgaaatgactttggagatagtggctgaatctgaacatgaagaaaggcccgctgggcaaggcagagacgagcctaacatgaatccaaaattagaggatccacggcggccggatactagcttcctctggtttaccagcccatacaagactatgaagttcatattgtggcgccggtttcgctgggcgatcatcttgttcataattctttttattctgctacttttcctagcaatatttatatacgctttcccgaattatgcagcgatgaagttggttaaaccattcagt

SEQ ID NO: 10659 - DNA, 6243 bp, Artificial Sequence
  Description of Artificial Sequence: Synthetic coding sequence
atgctgtgttgcctgctcgtgcgggcgtcgaacctgccttcggccaagaaggatcgcagatcggacccagtcgcatccctcacctttagaggcgtgaaaaagaggaccaaggtgatcaagaactcggtgaaccctgtgtggaacgaaggattcgagtgggacctgaagggaatccctctggaccagggatcggaattgcacgtggtggtgaaggatcacgaaaccatgggtcggaatcgcttcctgggcgaagccaaagtgccgttgcgcgaggtgctggcgactccctccctgagcgccagctttaacgcgccgttgctggacaccaaaaagcaacctaccggcgcgtcgttggtgctgcaggtgtcatacactcccctcccaggcgcagtgccgctgttcccgccgccaacccccctcgaaccgtccccaaccctgccggacctggatgttgtggccgatacgggcggagaagaggacactgaagatcagggattgaccggagatgaggccgaaccattcctcgaccaatccggaggtccgggagccccgaccacgccacgcaagctcccttcgcggccaccgccgcactacccaggcatcaagagaaagcggtccgcaccgacctcacggaaacttctgtccgacaaaccccaggactttcaaattagagtgcaagtgatcgaaggacggcagctccctggcgtcaatatcaagccggtcgtgaaagtgactgcggcaggacagaccaaaagaacccggatccataagggcaactctcctctgttcaacgaaactctgttcttcaacctttttgattcaccaggagagcttttcgacgaacccatctttatcaccgtggtcgactcgagatcactcagaaccgacgccctcttgggtgagttccggatggatgtgggaacgatctaccgcgagcctcgccacgcctacctgcgcaaatggttgctgctgtcggatcccgatgatttcagcgcgggagccagaggataccttaagacttccctgtgcgtcttgggccctggagacgaagccccgctggaacgcaaggacccaagcgaggacaaggaggacattgaatccaacctcttgcggccaacgggggtggccctgcggggagcccacttctgtctgaaagtgttcagggctgaggacctcccgcagatggacgatgcggtcatggacaacgtgaagcaaatcttcggatttgagagtaataagaaaaacctcgtcgacccattcgttgaggtgtcattcgcaggcaagatgttgtgttcaaagatcctggagaaaaccgcaaacccgcagtggaatcagaatatcaccctgccagctatgttcccctcaatgtgcgagaagatgcgcatccgcatcatcgactgggatagactcactcacaacgacatcgtggctaccacctacctgtccatgtcaaaaatctccgctccgggaggcgaaatagaggaggagccggccggtgcggtgaagccatccaaagcatctgatcttgacgactacctgggattcttgccaaccttcggaccttgctacatcaacctgtacgggtcgccgcgggaattcaccggtttcccagacccgtacaccgagcttaacacgggaaagggcgaaggcgtggcatacagaggacggcttctgctgagcctcgaaactaagctggtggagcactccgagcagaaggtggaagatctccctgcggatgatatcctgagggtcgaaaagtacctgcgccgccgcaaatactccctgttcgctgccttctactctgctactatgctccaagacgtcgacgatgcgatccagttcgaggtgtcgatcggaaactacgggaacaagtttgatatgacctgtctccctctggcttcgacgacccagtacagccgggcagtgttcgacggatgccattactactatctcccttggggcaacgttaaaccagtggtggtgctgagctcctactgggaagatatatcgcacagaatcgaaactcagaatcaactcctgggaattgcagatcgactcgaggcgggactcgaacaggtgcatctggcactcaaggcgcaatgttccactgaggacgtcgacagccttgttgctcagttgacggacgaactcatcgccggttgttcccagccgctcggagatatccacgaaactccgagcgccacccacctggaccagtacctgtaccagctgagaacccatcatctctcgcaaatcaccgaggccgctctggccttgaaattgggacattcggaactgccggcggctttggagcaagcggaggattggttgctccgactgcgcgccttggccgaggaaccgcagaacagcctgccggatatcgtcatttggatgctgcagggcgacaaacgggtggcgtatcagcgggtgccggcccaccaggtgttgtttagccgcaggggagccaactactgcggcaagaattgcggaaaactgcagacgatcttcctgaagtaccccatggagaaggtgccgggagctcgcatgcccgtgcagatccgagtcaagctctggtttggactgtccgtcgatgagaaggagttcaatcaattcgcagaaggaaaactgtccgtgttcgcggagacttacgaaaatgaaaccaaactcgctctcgtgggcaactgggggacgaccgggctgacttacccgaagttctcggacgtgactggaaagattaaactgcccaaggactcgttccggccgagcgccggctggacctgggcaggggattggtttgtgtgccctgagaaaacgttgctgcacgacatggatgccgggcacctgtcgttcgtggaggaagtctttgagaatcaaactcggttgcctggcggacaatggatttacatgtcggataactataccgacgtcaacggagaaaaggtgcttccaaaggacgacatcgaatgcccactcggatggaagtgggaagatgaggagtggagcacggatctgaatcgcgcggttgatgaacaggggtgggaatacagcattactatccctccagaacgtaagccaaagcactgggtgcccgccgagaaaatgtactacactcatcgacggcgcaggtgggtccggctccgcagacgcgacctgtcacagatggaagctctgaaacggcaccggcaagccgaagccgagggtgaaggttgggaatacgcgtcgttgttcggatggaaattccacctggagtatagaaagactgatgcgttcaggcgccgccgctggcgtaggcggatggaaccgctggaaaaaactggaccggctgcggtgttcgctctggaaggcgcattgggaggagttatggacgacaagtccgaggactccatgtccgtgtcgaccctcagcttcggcgtgaatcggcccactatcagctgcatctttgactacggaaatagataccacctgcgctgctacatgtatcaggcccgggacctggcggccatggacaaggactctttctccgatccgtacgccatcgtgtcattcctccaccagagccaaaagactgtggtggtcaagaacactctcaacccaacttgggaccaaacgcttatcttctacgagatcgaaatctttggagagccggcaaccgttgcggagcaacccccctcaatcgtggtggagctctacgaccacgacacctacggcgctgatgaattcatgggacgctgtatctgtcagccgagcttggaacggatgcctcggctggcttggtttccccttacccgaggatcccagccatccggcgagctcttggcgtcgttcgaactcattcagcgggagaagccagcaattcaccacatccccgggttcgaagtgcaggagacttcccggattttggacgagagcgaggatactgatctgccgtaccccccgccgcagagagaagcgaatatctacatggtgccacagaacattaagcctgccctgcagcgcaccgcgatcgagatcctggcgtgggggttgagaaacatgaagtcgtaccaactggccaacatctcatccccgtcacttgtcgttgaatgcggtggacagactgtccagtcatgcgtcatcaggaacctgcgaaaaaaccccaacttcgatatctgcaccttgtttatggaggtgatgctccctagagaagaactctattgccctcccattactgtgaaggtgatcgacaacagacaattcggacggcgcccggtcgtcggccagtgtactatccgctccctggagtcgttcctgtgcgacccgtattcagcggaatcgccttcccctcagggtggacctgatgacgtctcgctgttgtccccaggcgaggacgtgctgatcgacattgacgataaggagccactcatccccatccaagaagaggagttcatcgactggtggtccaagttcttcgccagcatcggcgagcgcgaaaaatgcggaagctacctggagaaggattttgatacgcttaaggtgtacgacacccaactggagaatgtggaagcctttgaaggtctgtcggacttctgcaacacctttaaactgtacagaggtaagacccaagaggagactgaggacccgtccgtgattggggagtttaagggactgttcaagatctacccattgccggaggacccggcgatccccatgcccccgagacagttccatcaactggccgcccaaggcccgcaagaatgcctcgttcgcatttacattgtccgagccttcggcctgcagccaaaagaccctaacggcaaatgcgacccttacatcaaaatcagcatcggaaagaagtccgtctccgaccaggacaactacattccgtgcaccctggagccagtgtttggaaaaatgttcgagctgacgtgtactttgccactggaaaaggacctgaagattaccctctacgactacgatctgttgagcaaagatgaaaagatcggcgagacggtggtggacctggagaatcggctgctgtcaaagtttggagcgcggtgcggtctgccgcaaacctactgcgtgtctggtccgaatcagtggagagatcaactcagaccgtcccaattgctgcacctgttttgccaacaacatcgggttaaggcacctgtgtacagaaccgaccgggtcatgtttcaggacaaagagtacagcatcgaggagatcgaggctgggcgcattccaaatccgcatctcggcccggtggaggagcggctcgccctccatgtcctccagcagcagggactggtcccagagcacgtcgagagcaggccgctgtactccccgctgcaaccggatattgagcaaggtaaactccagatgtgggtcgatctgttccctaaggccctggggcggcctggtcccccgttcaacatcaccccacgccgcgccagaaggttcttcctgcggtgtatcatctggaatacccgggatgtgatcctcgatgacctgagcctcacgggcgaaaagatgtccgatatctacgtgaaggggtggatgatcggcttcgaggagcataagcaaaaaaccgatgtccattaccgctccctcggaggagagggaaacttcaattggcgcttcattttcccgtttgactacctgccggccgaacaggtctgcactatcgcgaagaaggacgcgttctggcgattggacaagaccgaatcaaaaatcccagcccgcgtggtttttcagatttgggataacgacaagttctcgtttgatgacttcctgggtagtctgcagctggacctgaatcgcatgcccaagcctgcaaaaaccgccaagaagtgttcgctggatcagttggatgacgccttccacccggagtggttcgtgtccctgtttgagcagaaaactgtgaagggctggtggccttgcgtggccgaagaaggggagaaaaagatcctggccggcaagctggaaatgactctggaaatcgtggcagaatccgaacatgaagaacgcccggccggacagggtcgcgacgaaccaaacatgaatccaaagctggaggacccgcggcgcccggatacttcctttctgtggtttacttcaccgtacaagactatgaaattcatcctgtggagaaggttcagatgggccatcattcttttcattatcctctttatcctgctcctcttcctggccattttcatctacgcctttccgaattacgccgcgatgaaactggtcaaaccattctca

SEQ ID NO: 10660 - DNA, 6243 bp, Artificial Sequence
  Description of Artificial Sequence: Synthetic coding sequence
atgctgtgttgtctcttggtgcgggcttcaaacctccctagcgccaagaaggacaggcggtccgatccggttgcgtcactgactttccgcggagtcaagaagcggactaaagtcatcaaaaactccgtcaaccctgtgtggaatgagggatttgagtgggatctgaaagggattccactcgatcagggctcggagcttcatgtcgtggtgaaagaccacgagacgatggggcggaaccggtttctgggcgaagcgaaggtccccctgagagaagtgctcgcaaccccaagcctgtccgcgtccttcaacgctccactgctggacactaaaaagcaacctaccggtgcgtcgcttgtgcttcaagtgagctacacccctctgccgggggcggtgccgctcttcccgccgccgactccattggagccttcaccgaccctgccggatctcgacgtagtggcggataccggaggagaggaagataccgaggatcagggcctcaccggcgacgaggcggagccatttctggaccagtcgggtgggcctggagcccccaccactccacggaagctcccatcgcgcccgccaccccactatccgggtatcaaacgtaagcgatccgcccctacgtcacgcaagctcctgtccgacaagccacaggatttccaaatcagagttcaagtgatcgaaggacggcaattgcctggggtcaacatcaagcccgtggtgaaagtcactgccgccggacagactaagcgcacgcgcatccacaagggtaactccccgctcttcaatgagacgctgttctttaacttgttcgacagccctggtgagctgtttgacgagccgatctttatcactgtcgtggatagcagatcactgcgcaccgacgccctgcttggcgaattcagaatggatgtgggcactatctacagggaaccgaggcacgcatacctgcgcaagtggctcctgctgtccgacccggacgacttctcggcgggtgctcgcggatacctcaagacctccttgtgcgtgctgggacctggagacgaagcgcccctggagcgcaaagacccatcggaggacaaagaggatatcgagtccaacctgttgcggccaaccggcgtggcgctccgcggcgctcatttctgtctcaaggtctttcgcgccgaggacctgccacaaatggacgacgccgtaatggacaatgtcaagcaaatctttggctttgagtcgaacaagaagaatttggtggatcctttcgtcgaagtgagcttcgcaggcaagatgctctgctccaagattctcgagaaaacggctaacccgcagtggaaccagaatatcaccctgccagcaatgttcccgtcgatgtgcgagaagatgcggatcaggatcattgactgggatcggctgacccacaacgacatcgtcgccactacttacctctcaatgtcgaagatttctgcgcctggaggcgaaatcgaggaagaacccgcaggagcggtgaagccgtctaaggcatcagacctggatgattacctgggattcctgccaaccttcgggccttgctacattaacctgtacggctccccccgcgaattcacgggcttcccagatccttacaccgaattgaacactggaaaaggcgaaggagtggcgtaccggggacggttgctgctgtcgctcgaaactaagctggtcgaacactcggagcagaaagtggaagatttgcccgctgacgacatccttagggtggaaaagtacctgcgcagacgcaaatacagtctgttcgctgcattctactccgcgaccatgctccaagacgtcgacgacgccatccagttcgaagtgagcatcggaaattacggaaacaagttcgatatgacctgcctcccgctggcttccactactcaatactcgcgggctgtgttcgatggctgccattactactacctcccttggggaaatgtgaagccagtggtggttttgtcaagctactgggaggacatcagccatcggatcgaaactcagaatcagctgttggggatcgcagatcggcttgaagctggccttgagcaagtgcatctcgcgctgaaagcccagtgctcaactgaggacgtcgattccctggttgcccagttgactgacgaactcatcgcggggtgcagccaaccacttggtgacatccacgaaaccccatcggccacccacctggatcagtatctgtaccagctgcgcacgcaccacctgagccaaatcactgaagcagccttggctttgaagctggggcattcagagctgcctgccgcgctggaacaagccgaggactggcttctgcgcctccgggccctcgcagaagagcctcaaaattcattgcctgatatcgtcatctggatgctgcagggagataagcgcgtggcctaccagcgcgtgccggcacatcaggtgctgttcagccgcagaggggcgaactactgcggtaagaactgcggcaaactgcagaccatctttctgaagtacccgatggaaaaggtcccaggggcgcggatgccggtgcaaatacgcgtgaagctgtggttcggactttcggtcgatgagaaggaattcaaccagtttgccgagggaaaactgtcagtgttcgcggagacgtacgaaaacgaaactaagttggcgctggtggggaactgggggacgacgggcttgacgtaccctaaattctccgacgtgaccggcaagatcaagctgcccaaggactcctttagaccttcggcgggctggacttgggcaggagattggttcgtctgccctgagaaaacccttcttcatgatatggacgcgggccatctgtcgtttgtcgaagaagtgtttgaaaaccaaactaggctccctggtggacagtggatctacatgagcgataactacaccgacgtgaacggggagaaggtcctgcctaaggatgatatcgagtgtccgctcggctggaagtgggaggacgaagaatggtcgaccgaccttaaccgcgccgtcgatgaacagggatgggaatacagcatcactatcccgccggagagaaagccgaagcactgggtcccggcggagaaaatgtactacactcatagaaggcggagatgggtccggctgagacgacgcgatctctcacaaatggaagcattgaagagacacagacaagctgaagccgagggagagggttgggaatacgcctccctgtttgggtggaagttccatctggagtaccgcaaaaccgacgcgtttcggcgccggagatggcgacgccgtatggagccgcttgaaaagacgggaccggccgccgtgttcgcgctcgagggtgccctcggcggtgtgatggatgacaagagtgaagattcaatgtcggtgtcaacgctgagcttcggcgtgaaccgccctaccatctcgtgcattttcgactacggcaaccggtaccacctgaggtgctacatgtaccaggcccgtgacctggcagcaatggacaaagattcattttccgatccttacgcaatcgtgagtttcctccaccaaagccaaaagacggtcgtggtgaagaataccctcaaccccacttgggaccagaccctgatcttctacgagattgagatcttcggcgaaccagctaccgtggctgagcagccgccgtcaatcgtggtggagctttacgaccatgatacttatggagcggacgaattcatgggaaggtgcatttgccagccgtccctggaacgcatgccccggcttgcttggttcccgctcactagggggtcccagccgtccggagaactcctggcatcgttcgaacttatccagagggagaagcctgccattcaccacatccctggcttcgaagtccaggagacgtcaagaatcctggacgaaagcgaagataccgatctgccatatccaccaccccagcgcgaggccaacatctacatggtgccgcagaatatcaagcccgcgctccaacggaccgctatcgaaatccttgcttggggactccgaaatatgaagtcataccagctggccaacatctcgtcgccatcgttggtggtggaatgtggaggacagaccgtgcaatcgtgtgtgattagaaacctgcgcaagaacccgaatttcgacatctgtactctcttcatggaggtgatgctcccgagggaagagttgtactgtccccccatcaccgtgaaggtgatcgacaaccggcagtttggtcggcggccggtggtgggtcaatgcactatccgctcactggaatcattcctgtgcgacccgtatagcgccgaatctccgtctccacagggtggcccagatgatgtcagcctgctctcgccgggagaggacgtcctgatcgatattgatgacaaagaacctctgattccaatccaggaggaagagttcatcgactggtggtcgaagttcttcgcttccatcggagaaagggaaaagtgcggatcatacctcgaaaaggactttgataccctcaaagtgtacgatacccagttggaaaacgtggaggctttcgaaggactttctgacttctgtaatacgttcaagctgtacagaggtaaaacccaagaagagacggaggatccctcagtcatcggagagttcaagggactgttcaagatctacccactgccagaggaccctgccatcccgatgccacctaggcagtttcatcagcttgcagcccagggaccgcaggagtgtctggtcagaatatacatcgtccgcgcctttggcttgcagccgaaggaccctaacgggaagtgcgacccatacatcaagattagcatcggcaagaagtctgtgtcggatcaagacaattacattccgtgcactctcgaaccagtctttggaaagatgtttgaactgacttgtaccctcccactggagaaggacctcaagattactctgtacgattacgacctcttgtcaaaagatgagaaaatcggtgaaaccgtggtggacctcgaaaacaggctgctgtcaaaattcggagcgcgctgtggtttgccccagacgtactgcgtgtccgggccaaaccaatggagggatcagctgcggccaagccagctgctgcatctcttttgccagcaacacagagttaaagctcctgtctacagaactgatcgcgtcatgttccaagataaggaatactcaatcgaagagatcgaggcaggacggatccctaaccctcacctcggaccggtggaagaaaggctggcgctccacgtgctccagcagcagggcctcgtgccggaacacgtggagtcccgcccgctgtactcgccccttcaaccggacatagaacagggaaagttgcaaatgtgggtggacctgttcccgaaggcgctgggcagaccgggaccaccattcaacatcactcctagaagagcacgccgcttcttcctccggtgtatcatctggaatacgcgcgatgtcatcctggatgacttgtccttgacgggcgagaagatgagcgatatctacgtgaaaggatggatgatcgggtttgaggagcacaaacaaaagactgacgtgcactaccggtcactcggaggtgagggtaacttcaattggcgcttcatcttcccatttgattatctcccggccgagcaggtgtgcactattgctaagaaggatgcgttctggcgcctcgacaagaccgagtcaaagatcccggcacgcgtggtgttccagatctgggacaatgacaagttctcgtttgatgacttcctcgggtcgctccagctcgatctgaacagaatgccgaaaccggccaaaaccgccaagaagtgcagcctggaccagctcgacgatgcgttccaccctgagtggttcgtgtcgctgtttgaacaaaagacggttaaggggtggtggccgtgcgtggccgaagaaggtgagaagaagattctggccggaaagctggagatgaccctcgaaatcgtggcagaatccgaacacgaagaacggcctgcgggacaaggacgggacgaacccaatatgaatcctaagctcgaggatccgagacggcccgacacttccttcttgtggtttacctcaccttacaagaccatgaagtttatcttgtggaggcgcttccgctgggccatcatcctgttcatcatcctctttatcctgctcctgttcttggccatcttcatctatgccttccccaactacgctgccatgaagctggtgaagcctttttct

SEQ ID NO: 10661 - DNA, 6243 bp, Artificial Sequence
  Description of Artificial Sequence: Synthetic coding sequence
atgctgtgctgcctgctggtgcgcgcctccaacctgccgtccgcaaagaaggaccggcgatcggacccggtggcgtcactgactttccgcggcgtgaaaaagaggaccaaggtgatcaagaattccgtgaacccggtgtggaacgaggggttcgaatgggacctcaaaggtatcccgctggaccaggggtcggagttgcatgtggtggtgaaggatcacgaaacgatgggtcgcaaccggtttctgggagaggccaaggtcccgttgagggaagtcctcgccaccccgtccctgagtgcatccttcaacgcccctcttctggatactaagaagcagcctactggggcaagcctggtgctccaggtgagctacacgccccttccaggagctgttcccctcttcccaccgcctacgccactggaaccatcccctactctgccggatctcgacgtggtggccgataccggaggtgaagaagataccgaggaccagggcttgactggggatgaagcggaaccctttctggaccagtccgggggaccgggagccccaaccaccccaagaaaactgccgtcccggcctccgccacactaccccggaattaagaggaagcgcagcgcgccgacctcaagaaagctcctctccgacaagccgcaagactttcaaattcgggtacaagtgatcgagggacgacagctgccgggagtcaacatcaagcccgtggtcaaggtcaccgccgctggccagactaagcggacgaggatccataagggaaattccccactcttcaacgagactcttttcttcaatcttttcgattctccgggcgaactgtttgatgaaccgatctttatcaccgtggtggactcccgcagcctccgcacggatgccctgctgggggaattccgcatggatgttggtaccatctacagggagccgagacacgcctacctccggaaatggctgctcctctcggaccctgatgacttcagcgctggagcgagaggctacctcaagacctcgctgtgcgtgctcggcccaggagatgaggccccgttggaacggaaagacccgtccgaggacaaggaagatattgagtcaaacctgctcagaccgaccggagtcgccctgagaggtgcacatttctgcctcaaggtgtttcgggcagaagatctgccccagatggatgacgccgtgatggacaacgtgaaacagatattcggcttcgaatcaaacaagaagaacctggtggatccctttgtggaagtgagcttcgccgggaagatgttgtgcagcaaaatcctcgaaaaaactgcaaatccgcaatggaaccagaatatcacccttccagctatgttcccatcaatgtgcgagaaaatgcggataaggattattgactgggaccgcctcactcacaacgacatcgtggctaccacctacctgagcatgtccaagatctcagcgccgggaggagagattgaggaagaaccagcgggagccgtgaaaccatccaaggcgagcgacctggacgactacctgggttttctgccgaccttcggaccgtgctacatcaacctgtacggttctccgcgggagtttaccggattcccggatccgtatactgagctgaatactggaaagggagaaggagtcgcctaccgcgggagactgctcctgtcgttggaaactaagctcgtggaacattcagaacagaaagtcgaggacctgcctgccgatgacatcctgcgcgtggaaaagtacttgcgccgcagaaaatattcgcttttcgctgcgttctactcggcaactatgctgcaggatgtggacgacgcaatccagttcgaggtttccatcggaaattacggaaacaagttcgatatgacttgcctccctctggcttcgaccacccagtacagccgcgccgtgttcgacggatgccactactactacctgccttggggaaacgtcaagccggtcgttgtccttagttcgtactgggaggacatctcccaccgcatcgaaacccagaatcagctgctcggcatcgcggaccggctcgaggcagggctggagcaggtacacctggccctcaaagcgcagtgctcgactgaagatgtggactctttggtggcgcaactgaccgatgaactgatcgccggatgttcgcaacctctcggggatatccacgaaactccgtccgccacccacctcgatcagtatctctaccaactccggactcaccacctctcacagattactgaggctgccctcgcactgaagctgggacacagcgaacttccagcagcattggaacaggccgaggattggctcttgagactgcgcgcgctcgctgaggaacctcaaaattcacttccggacattgtgatttggatgctccagggtgacaagagggtggcttaccagcgggttccggcccaccaggtgttgttttcacgcagaggagccaactactgcggaaagaattgcggaaaattgcagacgatctttctgaaatacccgatggagaaagtcccgggggcccggatgccagtccagattcgcgtgaagttgtggttcggactgagcgtcgacgagaaggaatttaatcagtttgccgaaggaaagctgtcggtctttgccgaaacgtatgaaaatgaaaccaagctggccctggtcggcaactggggtactactggactcacttaccctaagttctccgacgtgacgggaaagatcaagctcccaaaggacagcttcagaccgagcgcggggtggacttgggcaggcgactggttcgtttgcccagaaaagaccctgctgcatgatatggacgccgggcacctctcgtttgtggaggaggtgttcgagaaccagacccggctgcccggagggcaatggatttacatgtcggacaactacaccgacgtgaatggcgaaaaggtgcttccgaaggacgatatcgaatgcccattgggctggaagtgggaagatgaggagtggtccacggacctgaacagggctgtcgacgaacaaggctgggaatactcgattacgatccccccggaacgcaagcctaaacactgggtgccggccgagaagatgtactacacccatagaagaagaaggtgggtgagactccgtcgacgcgatctctcgcaaatggaggctctgaaacggcataggcaagcagaggccgaaggagaggggtgggaatatgcctctcttttcggatggaagttccacctggaatacaggaaaacggacgcattcagacggagacgctggcggcgacgcatggagccactcgaaaagactggccctgctgctgtgttcgcacttgagggtgcgctgggcggagtcatggacgacaaatcggaggactcgatgtcggtgagcaccctgtcgttcggcgtgaatcggccgaccatcagctgcatctttgactacgggaatcgctaccatctgcggtgctacatgtaccaggctcgggatttggccgcgatggataaagactcattctcagacccgtacgcgatcgtcagcttccttcatcaatcgcaaaaaaccgtggtcgtgaaaaataccttgaacccaacttgggaccagactctcatcttctacgaaatcgaaatcttcggcgaaccggccactgtcgcagagcaaccgccatcgatcgtggtcgagctgtacgatcacgacacttacggagctgacgagtttatgggacgctgtatctgtcagccgagtttggagagaatgccccggctggcgtggttcccgctgacccgcggatcccagccatctggcgaactgctcgcctccttcgaactgatccaaagggaaaagccggccatccatcatatcccgggcttcgaggttcaagagacttcccggattcttgacgagtccgaggatactgacctgccatacccaccaccgcaacgcgaggcgaatatctacatggtgccacagaacataaagcctgcacttcaacgcaccgctatcgagatcctcgcctggggactccgcaacatgaagagctaccagctggcgaacatttcctcacctagcctggtcgtcgaatgtgggggccaaactgtccagtcgtgtgtgatccgcaatctgcggaagaatcctaacttcgacatctgtactcttttcatggaggtgatgctgccccgcgaggagctgtactgcccgcctattactgtgaaggtgatcgacaacagacaattcggacggcggccagtcgtggggcagtgcactatccgctcgctggaatcatttctttgtgacccttactccgcagaaagcccctcaccgcaaggaggccctgatgatgtgtcactgctttcgccgggcgaggacgtgctcatcgacatcgacgacaaggaaccgctcattccaatccaggaggaagagtttatcgattggtggtccaagttcttcgcatccatcggggaaagagagaaatgcggttcgtacctggaaaaggacttcgacactctgaaagtgtacgacacccagctggagaacgtggaggcgttcgagggtctgtctgacttctgcaataccttcaaactttaccgcggcaagacccaggaagaaactgaagatccttccgtgatcggagaattcaaaggactgtttaaaatctacccactgcccgaagatccagcaatcccgatgcctcctagacaattccaccagttggccgcccagggaccccaagagtgcctcgtgaggatctacattgtccgggcattcggacttcagccgaaggacccgaacggtaagtgcgacccgtacatcaagatcagcatcggaaagaagtccgtctcggaccaggataactacatcccatgcaccttggagccagtgttcggcaagatgttcgagctgacctgcactctgccgttggaaaaagatctgaaaatcacgctctacgactacgacctgctgagcaaagacgaaaaaattggtgaaaccgtcgtcgatctggaaaaccgcttgctttccaagttcggcgcgcggtgtggactgcctcaaacctactgcgtgtcaggacctaaccagtggcgcgaccagctccgaccgtcgcagctgctccatctgttttgccagcaacatcgggtgaaggcgcccgtgtaccggaccgaccgcgtgatgttccaggataaggaatattcgatcgaggagatcgaagcgggacgcatcccaaatcctcacctgggccccgtggaagagcgcctcgccctgcacgtgctccagcaacagggactggttccagaacacgtggaatcacggcccctgtacagccccctgcagccggatatcgagcaaggcaagttgcaaatgtgggtggatctgtttccaaaagcgctgggtagaccgggaccacctttcaacattaccccgagacgcgcccgacgcttcttcctgagatgtatcatctggaacacccgcgacgtcatcctggatgatctgtcgctgaccggcgaaaaaatgagcgatatctacgtaaaaggatggatgatcggattcgaagaacacaagcaaaagactgacgttcactaccgctcgctcggtggagaaggaaacttcaactggcggttcatctttcccttcgattatcttccagccgaacaggtgtgtactattgccaaaaaggatgctttctggcgtctggacaagaccgaatcaaagatcccggcgcgggtggtctttcaaatctgggacaacgataagttctcatttgatgatttcctgggatcgctccaactggatttgaataggatgcctaagcccgccaagaccgccaagaaatgctcgctcgaccagctggatgatgcgttccatccggaatggtttgtgagcctcttcgaacagaaaaccgtcaagggctggtggccttgtgtcgcggaggagggcgagaagaagatcctggctggcaagctggagatgaccctggaaatcgtcgctgagagcgaacatgaggaacgcccagccggacagggacgtgacgaaccaaacatgaatcctaagctcgaggaccccagacggccggacacttccttcctgtggtttacctcaccgtataagactatgaagttcatcctctggagacggttcaggtgggcaatcatcctctttatcatcctgttcatcctgctgctcttccttgctatcttcatctacgcctttccgaactacgccgcgatgaagctcgtgaagccgttctca

SEQ ID NO: 10662 - DNA, 6243 bp, Artificial Sequence
  Description of Artificial Sequence: Synthetic coding sequence
atgctgtgctgcctgctggtgagggcgtctaacctgccaagcgcaaaaaaggatcgacggtctgacccggtggcgagccttacctttcgcggagtgaaaaagcggactaaggtcatcaagaacagcgtcaacccggtgtggaatgaggggtttgaatgggacctgaagggaatccctctcgaccaaggttccgaacttcatgtggtggtgaaggatcatgaaaccatgggacgcaatagattcttgggagaggccaaggtgccgttgagagaagtgctggcaactccatcactgagcgcgtcgtttaacgccccgctgttggatactaagaagcagcctactggagcctcgctcgtgcttcaggtgtcgtacacgccgctgccgggcgctgtcccactgtttcctcccccgaccccattggaaccttcgcctaccctgcctgacctggacgtcgtcgcggacaccggtggagaggaggacaccgaagatcagggactgactggtgatgaagcagaacccttcctggatcagagcgggggcccgggagctccaactacccctagaaagttgccctctcgtccaccgcctcactaccctggaatcaaacggaaacgctccgctccgacttcacgcaagctgctctccgacaagccccaggacttccagatcagggtccaagtgatcgagggcagacagctgcctggagtcaacatcaagcccgtcgtgaaagtcactgccgctggacagaccaagcggacgagaatccacaaaggaaactcaccactgtttaatgaaactcttttcttcaacctgttcgactcccctggagaactgttcgatgagcccatcttcatcacggtggtggactcgcggtccctgagaaccgacgccctgctgggtgaattccgcatggatgtgggcactatctacagagagccgagacacgcctacctgagaaaatggttgctgctcagcgaccctgatgatttctcagcgggcgctcggggatacctgaaaacttccctgtgcgtgctgggaccgggagatgaggctccgttggaacgcaaggatccatcggaagataaagaggacattgagtcaaacctgttgaggccgactggagtcgccctgcgcggcgctcatttctgccttaaggtgtttagggcggaggaccttccgcagatggatgacgctgtcatggataatgtcaagcaaatctttgggttcgaatcaaacaaaaagaacctcgtggaccctttcgtagaggtatcgttcgccgggaagatgctgtgcagcaagatcctggaaaaaaccgcgaacccccagtggaatcagaacatcaccctgccggcgatgtttccctcaatgtgcgaaaagatgcgaatccggatcatcgactgggaccgcctgactcacaacgacatcgttgccactacctacctgtccatgtcgaagatctccgctcctggaggcgagatcgaggaggaaccggccggcgccgtcaagccgtcaaaagctagtgacctggacgactacttggggttcctcccgacctttggcccgtgttacattaatctgtacggctcaccgagagaattcacgggcttccctgacccttacaccgagctgaacaccgggaagggcgaaggagttgcataccgaggacggctgcttttgtcgctcgaaaccaaactggtggaacacagcgagcagaaagtcgaagatcttccggctgacgatatcctcagggtggagaaatacttgcggcggaggaaatactctcttttcgccgcgttctacagcgcgaccatgctgcaggatgtggacgacgcgatacaattcgaggttagcatcggcaattacggaaacaaattcgacatgacctgtctcccactcgctagcactacccagtactcccgcgcggtgtttgatggctgccactactactacctgccatggggcaatgtcaagccggtggtggttctctccagctactgggaagatatttcgcataggatcgaaacccaaaaccaactcctcgggatcgcagatcggcttgaagccggactcgaacaggtacacctcgcgctcaaggcccaatgctctaccgaagatgtggactcgctggtggcacaattgactgatgagctgatcgccggatgctcccagccgctgggggacattcacgagactccgtccgccacccatctcgaccaatacctctaccagctgaggactcatcatctgtcccagatcacggaggccgccctggcgctgaaactgggccactccgagctgccagcggcactcgagcaggcggaagattggctgctccggcttcgcgccctggcggaggaaccacagaattcgctgcctgacatcgtcatatggatgctgcagggcgacaagagagtcgcttaccaacgcgtgccagcccaccaggtgctgttctccagacgcggggcaaactactgtgggaagaattgcggcaaacttcagacgatcttcctcaagtacccaatggaaaaggtgcctggggcgcggatgccagtccagatccgcgtgaagttgtggttcgggctttcagtggacgaaaaggagtttaaccagtttgccgaagggaaactgtcagtttttgcggagacttacgaaaacgaaaccaagctggccctggtggggaattgggggacgaccggtctgacctacccaaaattctcagacgtcactggaaagatcaaactcccgaaggattccttcaggccgtcagccggttggacctgggccggagactggttcgtgtgcccggagaaaactcttctgcacgacatggacgcggggcatctgtcgttcgtcgaggaagtgttcgaaaaccagactcggcttccaggaggacagtggatctatatgtccgacaattacaccgatgtcaatggcgagaaggtgctgccgaaagacgacatcgaatgcccgctcggatggaagtgggaggacgaagaatggtccaccgacctgaaccgcgcggtggatgaacaaggctgggaatattcgatcaccatcccgcctgaacggaagccaaagcattgggtgccagccgagaaaatgtactacacccatcgccgcagacgctgggtgcggctgcgccggcgcgacctttcccagatggaggcgctgaagcggcaccggcaggccgaggctgagggagagggatgggaatacgcatccctgttcgggtggaaattccatctggaataccgcaagaccgatgccttccggcgccgcagatggcggcgacggatggagccgctggaaaagactggtccagcggccgtgtttgccctggagggcgccttgggaggagtcatggatgacaaatcggaagattcaatgtcggtgtcaacgctctcgttcggcgtcaaccgcccaaccatctcgtgcatcttcgactacggaaatcggtaccatctccgatgctacatgtaccaggcccgcgacctggcggcaatggataaagactctttctccgacccttatgcaatcgtttcgtttctccatcagtcccaaaagactgtcgtcgtgaagaataccctgaacccgacctgggaccagactctcatcttctacgagatcgaaatcttcggagagccggcaacggtggccgaacaaccgccttccattgtcgtcgagctgtacgatcacgacacttacggggccgatgaattcatgggccgctgtatctgccaacctagcctggaaagaatgccgcggctcgcctggtttccactgacccgcggctctcagccatcaggagaactccttgcatcgtttgagctgattcaacgcgaaaaaccagcgatccaccatatccccggattcgaagtgcaggagacttcgcggatcttggatgaaagcgaggacactgacctgccgtaccccccaccgcagcgggaagcgaatatctacatggtcccacagaacatcaaacccgcgctccaaaggactgctattgaaatactggcatggggtctgcggaatatgaagtcgtaccaacttgcaaacatctcgtccccgtccctggtggtcgagtgcggaggacaaactgtgcagtcatgtgtcatcagaaacctgcgcaaaaacccgaacttcgacatttgcaccctgttcatggaagtgatgctgccgcgcgaggagctgtactgtccaccgatcaccgtcaaggtcattgataaccgccaattcgggcggcgcccagtggtgggacagtgcaccatccggagcctcgagagcttcttgtgcgacccatactccgccgagtcacccagcccacagggaggaccggatgacgtcagcctcctgtcccccggggaggatgttctgatagatatcgacgacaaggagcccctcatccccatccaggaagaagagtttattgattggtggtcaaaattcttcgcaagcatcggcgagcgggaaaagtgcggttcctacctggagaaggatttcgataccctgaaggtgtacgatactcagctggaaaatgtggaggcatttgaaggactgtcagacttctgcaataccttcaagctctaccgcggaaagacgcaggaagaaaccgaggatccatcagtcatcggagagttcaaggggctgttcaagatctacccactccctgaagatccggccatcccaatgccgccgaggcagtttcaccaactggcagcccagggaccccaggaatgtctcgttcggatctacatcgtgcgggcctttggattgcagcctaaggatccgaacgggaaatgcgacccgtacatcaagatctcaattggaaaaaagtcggtgtcggaccaggacaactacattccgtgtaccctggaaccggtgtttggaaagatgtttgaacttacttgtaccctcccgctcgaaaaggacctgaaaatcactctctacgattacgacctgttgagcaaagatgaaaagatcggcgaaactgtggtggatctcgagaacagactgctgagcaagttcggagccaggtgcggcctgccccaaacctactgtgtgagcggacccaaccagtggcgggaccagctgaggccatcccagctgttgcacctcttctgccaacagcaccgcgtcaaagccccggtgtacagaaccgaccgcgtcatgttccaagataaagaatactcgatcgaagagatcgaagcaggacggatccctaaccctcacctgggcccggtggaggaaagactggccctgcacgtcctccagcaacaaggactggtgccggaacatgtcgaatcacggccgctctactctcctctgcagccggatatagagcagggaaaactccagatgtgggtggacttgtttccgaaggctctgggacggccaggtccgccgttcaatatcaccccgcgccgcgccagacgcttctttttgaggtgcatcatctggaacacgcgggatgtgattcttgacgacctgtcgctgactggagaaaagatgtccgatatctacgtgaaaggatggatgatcggtttcgaagagcataagcaaaaaactgatgttcattaccggtcactgggaggagaaggaaacttcaattggcgctttatctttccattcgactacctgccggccgaacaagtgtgcactatcgccaagaaggacgcgttctggcgcctcgacaaaactgaatctaagattcccgcccgcgttgtgttccagatttgggacaacgacaagttctcgtttgacgacttcctggggagcctccagctcgatctgaaccggatgccgaaacctgccaagactgctaagaagtgctcgctggatcaactggatgacgcttttcaccccgagtggttcgtgtcacttttcgaacagaaaacggtcaagggctggtggccttgtgtggcagaggagggcgagaagaaaatcctggctgggaaactggaaatgacgctcgagatcgtggccgaatcggaacatgaggaacggcctgccgggcagggacgcgacgaacctaatatgaatcctaagctggaggacccgcggcgaccggacacgtcattcttgtggttcacttcgccgtataagactatgaagttcatcctgtggagacggttcaggtgggcaatcatcctcttcattatcttgtttatcctccttctgttcctggctatcttcatctacgccttcccaaattacgccgctatgaagctcgtgaagccgttctcg

SEQ ID NO: 10663 - DNA, 6243 bp, Artificial Sequence
  Description of Artificial Sequence: Synthetic coding sequence
atgttatgctgcctgctcgttagagccagtaatctcccctcagccaaaaaagatcggagatcagatcctgtggcctctctgacatttcggggagtgaagaagagaaccaaggtaatcaaaaacagtgtcaatccagtatggaacgaagggtttgagtgggacctaaaagggatcccacttgaccagggcagcgaactccacgtcgtggttaaggaccacgaaacaatgggcagaaaccgctttctgggagaagccaaggtgccgctgcgggaagttctggccaccccaagcttgtccgctagcttcaacgcaccactgcttgatacaaagaagcagcccaccggcgcctccttggtgctgcaggtcagctacacacccctccctggagccgtccccttgttccctcccccaacccctctcgagccgtctcccacgcttccagatctcgacgttgtggccgacaccggaggcgaagaagataccgaggaccagggcttgacaggcgacgaggccgagccttttctcgatcagagtggcgggccgggcgcgcccaccacaccacgcaaacttccatcgcgtcctcccccacactaccctggaataaaacgcaagcgcagcgcacctaccagcagaaagttactcagcgacaagccacaggactttcagatcagagtacaagtcattgaaggacgacagttacctggagtcaacatcaaaccggtggtcaaggtgaccgccgcaggacagacaaagagaacaaggattcataaaggaaattcccccctatttaacgagactctttttttcaacctgtttgattctcccggggagctatttgatgaacccatctttatcacggtggtggatagcagaagcctccgtaccgacgcactgctgggagagtttaggatggacgtgggaaccatatatcgggagcccaggcatgcatatttgagaaagtggctgctcctgtccgatcctgacgatttctctgctggagcacgtgggtatttgaagaccagcctctgtgtgctggggcctggcgacgaagcccctctcgagcggaaggatcccagcgaggacaaggaggatatcgaatccaatctgttacggccgacaggtgtggcccttcgtggggcacatttttgtctaaaggtcttcagagcagaggacttgcctcagatggatgatgcagtgatggataacgtgaaacagatctttgggttcgaatctaataagaaaaacttagtggatcccttcgtcgaggtgtccttcgcaggaaagatgctgtgcagcaagatcctcgaaaagaccgccaatccacagtggaaccagaacattacgttgccagccatgtttcctagtatgtgcgagaagatgcggatcagaattatcgattgggacaggctgactcacaacgatattgtggccaccacgtatttgtctatgtctaagatctctgcacccgggggtgaaattgaagaggaaccagctggggctgtgaaaccttctaaggcgtctgatctcgacgattatctgggctttcttcctacatttggtccctgctatataaatttgtacggtagcccacgagaatttacaggctttcccgacccctataccgagctcaatacagggaagggcgaaggagtggcttaccgggggcgactcctgctgagcctggaaactaagctggtggaacatagcgagcagaaggtcgaggatttgcctgccgatgacattttgcgagtggaaaaataccttcgtcggagaaagtactcactttttgctgctttttactccgccacgatgctgcaggacgtggacgacgccatccaatttgaggtctccatcggtaactatggaaataagttcgatatgacatgcttgcctctcgcatcgactacacagtattctcgcgctgttttcgatggatgccactactactatttaccatggggtaatgttaagccggtggtcgtgctcagtagctattgggaagatatctcccatcgtatcgaaacacaaaatcaactactggggatcgccgaccgccttgaggccgggctcgagcaggtacaccttgccctgaaggcgcagtgcagcactgaggacgtagactccctggtggcacagttgaccgacgagcttatagctggctgttcgcagcctctgggtgacattcacgagacaccgtctgccacacacctcgatcagtacctttatcagctcaggacccaccatttgtcacaaatcactgaggcagcattggccctgaaactgggtcattctgagctacctgctgctctagaacaagcagaagactggctcctcaggctgcgcgctttggccgaggaacctcaaaatagcctccctgacattgtgatttggatgctgcagggggataagagagtggcttaccagagagtgcccgctcatcaagtccttttcagtagaagaggtgcaaattactgcggaaaaaactgcggcaaacttcagactatatttcttaagtacccaatggaaaaagtgcccggtgccaggatgcccgtgcagattagagtcaaactatggttcgggctgagcgtagacgagaaggagttcaatcagtttgccgaggggaagctttcagtctttgctgagacctacgagaacgagacaaagctagccctggtgggtaattgggggacgacaggccttacatatcccaaattctcagacgtcaccgggaagattaagttgcccaaggacagctttcgccccagtgctggatggacttgggccggggactggttcgtctgccccgagaaaaccttgcttcatgacatggacgcaggccacctgagtttcgtggaggaggtgtttgaaaaccagacaaggctgccaggaggccagtggatctacatgtccgataactacacagacgtgaacggcgagaaggtcctgcccaaggacgacatcgagtgtcccttgggatggaagtgggaggatgaggagtggagcacggaccttaatcgggcagtagacgagcagggatgggagtattcaatcacgattccccctgaacggaaacctaaacactgggtccccgcggagaagatgtattatacacatcgccgccggaggtgggtgcgattgcggcgtcgcgatctatctcagatggaagctctgaagagacaccggcaggcagaggccgaaggagagggttgggagtatgctagcctcttcggttggaagtttcacctggagtatcgcaaaaccgatgcctttcgtcgccggaggtggcgcagaaggatggagcctttggagaaaaccggcccagctgctgttttcgcactcgagggggccctgggaggagttatggatgacaaatccgaggattccatgtccgttagcacactctcattcggcgtaaaccggcctacgatctcctgcatcttcgattacggcaaccggtaccacctgcggtgctacatgtatcaggctcgagacctggccgcaatggacaaggacagctttagtgatccctacgcaattgtatcttttctgcatcagtcccagaagaccgtagtagtgaagaacaccctcaacccgacatgggaccagaccttgattttctacgagattgagattttcggggaaccagcaactgtggccgagcagcccccctctatcgtggtagagctgtacgaccacgatacatatggagcggacgagttcatgggacgctgtatctgccagccttctcttgagcgcatgcctaggctcgcctggttccctttgacacgcggctcacagccatccggagagctgctggcaagttttgaactaatccagcgcgaaaaacctgccatccaccatattccggggttcgaggtgcaagagacctctcgcatactggacgagagtgaggacacagatctgccctatccccctcctcagcgcgaagccaatatctacatggtgcctcaaaatatcaaacctgctctgcagcgcactgctattgaaattttagcatggggtctccggaatatgaagtcctatcagctggcgaatatctcgagcccgagtctcgtggtggagtgtggaggccagacagtccagtcatgtgtcatccgcaacctgcgcaagaaccctaacttcgatatctgcacactcttcatggaggtaatgctcccaagagaagaattgtactgcccacctatcacagtgaaagttattgataaccggcagtttggtcgaagaccggtggtgggccagtgtaccatcagatccctggagagctttctgtgtgacccttactccgccgagtccccatctccgcagggcggtcctgatgacgtgagcttactgtcacccggggaggacgttctcattgatatcgacgacaaggaaccactgatccctattcaggaagaggagttcatagactggtggtcaaaatttttcgcatctatcggcgagcgggagaagtgtggatcctaccttgagaaggacttcgataccctgaaagtgtacgatacacaattagagaatgtcgaagcattcgagggtctgagcgatttctgtaatactttcaagttgtacagaggtaagacccaagaagaaaccgaagacccaagcgtaattggggaatttaagggcctcttcaaaatctaccctctccctgaggaccccgcaatcccgatgcctcccagacagttccatcagcttgccgcccaggggccgcaggagtgtctggtcaggatatatatcgtgagggcctttggtctccagcctaaggaccctaacggcaaatgtgacccttacatcaagataagtatcgggaagaagtccgtgtctgatcaggataactacatcccgtgtaccctggagccagtcttcggcaaaatgttcgagcttacttgtaccctgcccttggagaaagatctcaaaatcacactctacgattacgacctgctttcaaaggacgaaaaaatcggggagacagtcgtggatctggagaaccgcctcctgtcaaaattcggcgcccggtgcggacttccccagacctattgtgtgagcggtcctaatcaatggagagaccagctacgtccatctcaactgttgcatctgttctgccagcagcatcgtgtgaaggcccccgtgtatcgaacagacagagtaatgttccaagataaagaatactctatcgaggaaatcgaagctggccgcatccccaatccccacctagggcctgtagaggagcgcttggcattgcatgtgcttcagcagcagggacttgtcccagagcatgtcgagagtaggcctctttactccccgcttcaacctgatatcgagcaaggaaagctacagatgtgggtcgacctgttccctaaggctttggggagacccggacccccattcaacataaccccgcggcgcgccaggcggttctttcttaggtgcattatatggaacaccagagatgtaatcctggatgacttatcactgactggcgagaagatgtccgatatctatgttaagggatggatgatcggctttgaagaacacaagcagaagacagacgtgcattatcgctctctcggaggcgaagggaattttaattggcggttcatctttccgttcgattacttgcccgctgagcaggtttgtactatagccaagaaggatgccttttggaggcttgataagacggaaagcaagatccccgctcgggttgtgttccaaatttgggataacgataaattctcctttgatgactttttgggaagcttgcagttagacctgaaccgtatgccaaagcctgcgaagacggctaaaaagtgttcgcttgatcaactggatgatgcgttccaccctgagtggttcgtttccttgtttgagcaaaaaactgtgaagggttggtggccttgcgtggccgaggagggggagaaaaaaatccttgcgggcaaactggagatgacactcgagatcgtcgctgagtcagagcacgaggaacgacccgccggccaaggccgcgacgaaccgaacatgaatcctaaattagaagatccccgccgacctgatacttcctttctctggtttacctcaccgtataaaaccatgaaatttatactttggcgcagatttcgctgggctataatcctgttcatcatcctgtttatcttgttgctgttcctggcaatttttatttacgcctttcccaactacgcagccatgaagctggtgaaacccttcagc

SEQ ID NO: 10664 - DNA, 6243 bp, Artificial Sequence
  Description of Artificial Sequence: Synthetic coding sequence
atgctctgttgtttgttagtccgagctagtaacctgccgtctgcaaagaaggaccgacgaagtgaccccgtcgccagccttaccttcagaggagttaaaaagcgtaccaaggttatcaagaactcagtcaatcccgtgtggaatgaaggtttcgagtgggacctgaaaggtattcctctggaccagggctctgagctacatgtagtagtcaaggatcatgaaacaatgggccgtaatagatttcttggggaggccaaggtgccccttagagaggtcctcgcgacaccttcgctgtccgcctcctttaatgctccactcctggacaccaagaaacaacccacaggagccagcctggtactgcaggtgtcctatactcctctgccaggtgctgtgcccttgtttcctcctccgactcccttggaaccgtcaccgactttaccggacttggacgtagtggccgatacagggggggaggaagacaccgaggatcagggtctaacgggggatgaggctgaaccatttttggaccagtcaggggggcccggtgccccgaccacaccaagaaagcttccatccaggccccccccccattaccccggtatcaagcgaaaacgatccgctcctacgtcacgcaaactcttatctgacaagccacaggatttccagatccgtgtgcaggtcatagaggggaggcagcttcccggagtaaatatcaagcccgtggtgaaagtcactgctgccggacagacgaagaggaccagaatccacaagggcaacagtccattgtttaatgaaactctattcttcaatctgtttgacagccctggtgagcttttcgatgagccgatcttcattaccgtggtggattccagaagcctccgaaccgacgcactgctaggtgagttccggatggatgtagggactatttacagagaacctcggcacgcttaccttagaaagtggttgctgctaagtgacccggacgatttttctgctggggctaggggatatctcaaaacttcactctgcgtgcttgggcccggggacgaagctccgttggaaaggaaagatccaagtgaagacaaggaagatatagagtccaacctactgcgccctactggcgtggcactacgaggcgcccacttctgtctgaaggtgtttagggccgaggaccttccacaaatggacgatgccgtgatggacaacgtgaagcagattttcggatttgagtctaacaagaagaacctggtcgaccctttcgtggaagtaagtttcgctgggaagatgctttgctcgaaaatacttgaaaaaaccgctaatcctcagtggaaccaaaacatcactctccccgccatgttcccttccatgtgtgaaaagatgagaattagaataatcgactgggataggctgactcacaatgacatagtggctaccacttatctcagcatgagtaagatttccgccccaggaggagagatcgaagaggagcctgcgggggccgtgaaaccttccaaggcctcggacctcgacgattatctcggatttctgcccacttttggcccgtgttacatcaatttgtatgggagcccaagggagttcaccggctttccggacccatacacggagctgaacacagggaaaggcgaaggcgtcgcctatagaggaaggcttttgttgtccctggagaccaaactggtagaacacagtgagcaaaaagtggaagatcttcccgccgatgatattctgcgagtggaaaaatatctgcgaaggcgaaagtacagtctgttcgcagccttctacagtgcaaccatgctccaggacgtcgacgacgctattcaattcgaagtctctatcggaaattacggcaataagtttgacatgacatgcttgcccctggcgagtacaacccagtactctcgtgctgtgttcgatggctgtcactactattatttaccttggggcaacgtgaagccagtcgtggttttgtcaagctactgggaggatatctcccacaggatcgagacacagaatcaacttctagggatcgccgatcgactagaagctgggctcgagcaggtgcatcttgctctgaaggctcagtgctctactgaggacgttgatagccttgtagcccagctcactgatgaacttatcgctggatgtagtcagcccctcggggacatccatgagaccccgtctgctactcatctggaccagtatctgtatcaacttcgtactcatcacctctctcaaattaccgaggcagcactggctcttaaattgggccacagcgaactgccagcagcactggagcaggcggaagactggctactgaggctgagagccctggccgaggaacctcagaactcactgccagacattgttatttggatgctgcagggcgataagagagtggcctaccagagggtgcctgctcatcaagtgctgttctcgagacgcggtgccaattactgtggcaaaaactgcgggaagctgcagactatctttctaaagtatcccatggagaaggttcctggagcgaggatgccagtgcaaatcagagtgaagttgtggttcggtctgagcgtggacgaaaaggaatttaaccagtttgctgaaggaaagctttctgttttcgctgaaacgtacgaaaacgagacgaaactggcccttgtgggaaactggggtacaaccggcttaacctatccgaagttctctgacgtgacagggaaaatcaagcttcccaaggacagttttagaccttcagcgggctggacttgggcaggcgactggtttgtgtgcccagagaaaactctactgcatgacatggatgcaggccatttgtcgtttgtcgaggaagtgttcgagaaccagacaagacttcccggagggcaatggatatatatgtccgataactatacagatgttaatggggaaaaggtgcttcccaaagatgatattgagtgtccacttggctggaagtgggaggacgaggaatggtccacggatctgaatcgggcagtggacgaacaaggatgggaatacagtattactatcccacccgagaggaaaccaaaacattgggtgcccgccgagaaaatgtactacactcaccggaggagaagatgggtgcgacttaggcgaagggacttgtctcagatggaagcactcaagcggcatcgtcaggcggaggccgaaggcgaaggatgggagtacgcttctctcttcggttggaagtttcatctggagtatcgaaagacagacgctttccgaaggcgacggtggaggaggcgaatggaacccctggagaagacaggtccagctgctgtgttcgccctggagggtgctctcggcggggtaatggatgacaagagcgaggacagcatgtctgttagcaccctgtcattcggtgtcaaccgcccaaccatatcttgtattttcgattatggcaaccgataccacttgcggtgttacatgtaccaggcacgcgatctggcggccatggataaggattccttcagtgatccttacgcaatcgttagcttcctgcaccaatctcaaaagaccgtggtggttaaaaataccctgaatcccacttgggatcagaccctcatcttttatgaaattgagatcttcggtgaaccagctaccgtcgctgaacaacctccctctatagtggtagagttgtacgatcacgacacttatggagccgatgaattcatggggcgatgtatatgccagccatctttggagagaatgcccaggctggcctggtttccattaacccgaggtagccagccctctggtgaattgttagctagttttgaactgattcaacgagagaagcctgctatacatcatatccccgggttcgaggtacaggagacaagtcgaattttggacgaaagcgaagatacagaccttccttatccgccccctcagcgcgaggctaacatatatatggtcccgcagaacattaagccagcactgcagcgaacagccatcgaaattttagcctggggcctacgtaatatgaagtcctatcagcttgctaacataagctctccatctctcgtggtggagtgcggcggacagaccgtccagagctgtgtaattaggaacctccggaagaaccctaacttcgatatttgcacgctgtttatggaagtgatgctccctagagaggaactttattgtccccccataaccgtgaaggtgatcgacaacagacagttcgggagacgacctgtcgtcggtcagtgcaccattaggtcactggaatcctttttgtgcgatccctactccgccgagagcccatcccctcaaggcggcccagatgatgtgtccctcctgagccctggagaggatgtgctgatcgatattgacgacaaggaacctctgattcctattcaggaggaagagtttatcgactggtggagcaagttcttcgccagcatcggggaaagagaaaagtgcgggagttatctggagaaggactttgatactctgaaagtgtacgacactcagctcgaaaacgttgaagctttcgagggtctctcggacttctgcaacacatttaagctttatagaggaaaaacccaggaggagacagaagatccatcagttattggcgagttcaagggcttatttaagatttatcctctgcctgaggacccagccattcctatgcccccaaggcagtttcaccagctggccgctcagggacctcaggaatgtttagtgcgaatctatatcgtgcgggcattcggcctgcagcccaaagatccaaacggcaagtgtgacccctatatcaaaatatctattgggaagaaatctgtgtcggaccaagataactacattccatgtaccctcgaaccggtcttcgggaagatgttcgagctgacttgtacattaccgcttgagaaggatcttaagattactttgtacgattacgatttgctcagtaaagacgaaaagatcggcgagacggtggtcgatttggaaaaccgactgctcagcaagttcggagcccgatgcggcctgccccagacctactgtgtaagtggtccaaaccagtggagggaccagctaagaccctcccaactgctgcatctgttctgtcaacagcatcgagtaaaggcccccgtgtaccgaacagaccgggtgatgtttcaggacaaagagtactctattgaggagattgaagctggtaggatacccaacccacacttggggccagtggaggagcgactggcccttcacgtgctgcagcagcaaggcttggtccccgaacacgtcgaaagccgaccactgtatagtccacttcaacccgacattgagcagggaaagctgcagatgtgggttgatcttttccccaaggcccttggcaggccgggaccgcctttcaatataaccccaagacgtgcacggcggtttttccttcgttgtataatttggaacacaagggacgtaatcctggatgatctatcactgacaggagagaagatgtcggacatctacgtgaaggggtggatgatcggctttgaagaacacaagcagaagactgacgttcactatcgtagtctcggcggtgaggggaatttcaactggcgcttcattttcccattcgactacttgcctgcagaacaggtttgcacaattgctaaaaaagatgctttctggcggctcgataaaactgaatccaagataccagccagagtggtgttccagatatgggacaatgataagttctctttcgacgatttcttgggttcactgcagttggacctgaacagaatgcctaaacctgctaaaacagccaagaagtgtagtctggaccagctggacgacgcttttcaccccgagtggtttgtgagtctatttgaacagaagactgtgaaaggatggtggccgtgcgttgctgaagaaggagaaaagaagatcttggccggtaaacttgagatgacgctggagattgttgctgagtctgaacatgaggagcgaccagcaggccaaggtcgggatgagcctaatatgaatcccaagctagaagatcccaggaggcccgacacctcattcctgtggttcacctcaccctacaagacgatgaaattcatcttgtggcgaaggtttagatgggctataattctgttcatcatccttttcattctgctcctgttcctggctatttttatctacgccttcccaaactatgcggccatgaaacttgtgaagccattctcc

SEQ ID NO: 10665 - DNA, 6243 bp, Artificial Sequence
  Description of Artificial Sequence: Synthetic coding sequence
atgctgtgctgcctcttggtgcgggccagcaatctgccttcggctaagaaggaccggcgatccgatccggtcgctagcctcacctttagaggagtgaaaaagcggaccaaggtgatcaagaattctgtgaaccccgtgtggaatgaaggatttgagtgggatctgaagggaattccactcgaccaggggtcggagctgcacgtcgtcgtgaaggaccatgagactatgggccgcaatagattcctgggcgaagccaaggtgccgctgcgcgaagtgctggctacgccttccctgtcggcctcgttcaacgcgccactgctcgacactaagaaacagccgacgggagccagcctcgtcctgcaagtgtcctacaccccgctgcccggagccgtgccgctgttcccgcctccaacccccctggaaccgagccctaccctcccggacctggacgtggtggcggatactggaggtgaagaggacactgaagatcaggggctgactggggacgaagccgagccctttctggaccaaagcggtggtccgggcgcccctaccacccctaggaaactgccttcccgcccgccacctcactaccctggtatcaaaaggaaacggagcgctccaaccagtaggaaacttctctccgataaaccacaagacttccagatcagagtgcaggtcatcgaaggacggcaactccctggagtgaacatcaagccagtcgtcaaggtgactgccgcgggacagacgaagcgcactcgcatccacaaaggaaactcgccactctttaatgaaactctcttcttcaatttgtttgatagcccgggtgaactgtttgacgagccgatcttcatcactgtggtcgactccagatccctgcggaccgatgcgttgctgggagaattccggatggacgtcggaaccatctacagagaacctagacacgcctatctgcgcaaatggctgctcctctccgacccggacgatttctcagcaggagcccgcgggtacttgaaaaccagcctttgtgtcttgggcccaggagacgaggcacctcttgagagaaaggatccgagcgaggacaaggaggatatcgagtcaaacctcctcaggccgactggggtcgcattgaggggagcgcacttttgccttaaagtctttagggcagaggacttgccgcaaatggatgacgcggtgatggataacgtgaaacagatcttcggattcgagtccaacaagaaaaacctcgtcgaccctttcgtcgaagtgagctttgcgggtaagatgctgtgctctaagatcctggagaaaaccgccaacccgcagtggaaccagaacattaccctgcctgctatgttcccctccatgtgtgaaaagatgcggattagaatcattgactgggaccggctgactcacaacgatatcgtggccactacttatctctccatgtccaaaatctctgccccgggaggggaaatcgaagaggaacctgcaggggcggttaagccttcaaaggcttccgacctcgatgactacctcggtttcctcccaactttcggcccttgctacatcaacctttacggaagccccagagaattcacgggtttccctgacccatacaccgaattgaatactgggaagggggagggagtcgcctaccggggacgcctcctgctgtccctcgaaaccaagctggtggagcactccgaacaaaaggtggaggatctgccggcggacgatattctccgcgttgagaaatacctgaggagacgcaagtacagcctcttcgccgcgttctacagcgccaccatgctccaggacgtcgacgacgcgatccaattcgaagtctcgatcggaaactacggaaacaagttcgacatgacttgcctgcctctggcaagtactactcagtacagcagggccgtgttcgatggatgtcactactactacctgccgtggggtaatgtgaaacccgtggtcgtgctgtcaagctactgggaggacatctcccaccggatcgaaacccagaatcagctgctgggcatcgccgaccgcctcgaagctggcctggaacaggtccatctggcccttaaggcccagtgttcaactgaagatgtggattcgctcgtcgcgcagctgactgacgaactcattgccggatgctctcagcccctgggggacatccatgagactccgtcggccacgcatttggaccagtacctgtaccagctccgcactcatcatctttcccagattactgaagccgcccttgctctgaaactgggtcactcagaactccccgccgccctcgaacaggccgaagattggctgctccggctgcgggccctcgccgaagagccacaaaactcactgccggatattgtgatctggatgctgcaaggagacaagcgcgtggcgtaccaacgggtgccggcacaccaggtgctcttttcccggcgaggagccaactactgcggcaagaactgcggaaagctccagactattttcctgaaatacccaatggaaaaagtgcctggcgcgcggatgcccgtccaaattcgcgtgaagctgtggttcggactctcagtcgacgagaaggagtttaaccagtttgccgaaggcaaactttcggtgttcgccgagacgtacgagaacgaaactaagctggctctggtgggcaactggggcaccaccggactgacctacccaaagttcagcgacgtgaccggcaaaatcaagctgccgaaagacagcttcagacctagcgcaggctggacctgggccggagactggttcgtgtgccctgagaaaaccctcctgcatgacatggacgccggacatctgtcgtttgtcgaagaggtctttgagaaccagactcgcctgccaggtggccagtggatctacatgtccgacaattacactgacgttaacggagagaaagtgctgcctaaagacgacatcgaatgtcccctcggatggaagtgggaggatgaagaatggtcaaccgacttgaaccgtgctgtggatgaacaagggtgggaatactcaatcaccatcccacctgagcggaagcccaaacactgggtgccggccgagaagatgtactacacccaccgcagacgccgctgggtgcgcctccggcgccgcgacctgtcgcagatggaggcgctcaagcggcatcgccaagcagaagccgaaggtgagggatgggagtatgcatcgttgttcggatggaaatttcatctcgaatacagaaagactgatgcattccggaggcggcggtggcgccggcggatggagccgctggaaaagactggaccggccgctgtgttcgcacttgagggtgcattgggcggagtgatggacgacaagtccgaggactcgatgtccgtctccactctgagctttggagtgaatcgccccacgatttcttgcatcttcgactatggcaaccgctaccacctccgttgctacatgtaccaagcacgggatctggccgccatggacaaagattccttctcggatccgtacgcaatcgtttcgttcctgcaccagtcccaaaaaactgtcgtggtcaagaatactttgaacccaacctgggaccaaaccctgatcttttacgaaatcgaaatcttcggcgagccggctactgtggcagaacaacctccatcgatcgtcgtggaactgtacgaccacgatacctatggcgccgacgaattcatgggtagatgtatctgtcagccatccctggaaaggatgcctcggctcgcttggtttccattgacccgcggatcgcaaccctcgggagagctccttgcgagctttgagctcatccaacgagagaagcctgccattcatcacatcccgggtttcgaagtgcaggagacttcgcgtatccttgacgagtctgaggacacggatctgccgtacccgccgccacagcgcgaggcaaacatctacatggtgccgcagaatatcaaacccgctctccagcggactgctatcgagatcctggcttgggggctccggaatatgaaatcctaccagctcgccaatatctcaagcccgtcgctggtggtcgaatgcggtggtcaaaccgtccaatcctgtgtcatcagaaacttgcggaagaatccaaacttcgacatctgcactcttttcatggaggtcatgctgccacgcgaagagctctattgcccgcctatcaccgtgaaggtcatcgacaatcggcagttcggacgacgcccggtcgtcggacaatgcactatccgctcccttgaatcgttcctgtgcgacccatactccgctgaatccccaagccctcaaggaggacccgatgacgtgtcactcctgtcacctggggaagatgtgcttatcgacatcgacgacaaggaacctctgatcccgattcaggaagaggaattcattgattggtggagcaagttctttgcttccatcggagaacgcgaaaagtgtggatcgtacctcgagaaggacttcgacacccttaaggtgtatgatactcagctcgagaacgtcgaagcgtttgaaggccttagcgacttttgtaacaccttcaagctctacaggggtaagacccaagaggaaactgaggatccgtcggtgatcggcgagttcaaagggctgtttaagatttaccccctgccggaggaccctgccatcccgatgcccccgcggcaattccaccaactggccgcccagggaccgcaagaatgtctcgtccgcatttacattgtgcgcgcgttcggtttgcagccgaaagacccaaatggtaaatgtgacccgtacattaagattagcatcggtaagaagagcgtcagcgaccaagataactacatcccttgcaccctcgaaccagtttttggcaagatgttcgagctgacctgtactctcccgctggagaaagatctgaaaatcaccctgtacgactacgacctcctgtcgaaggatgaaaagataggcgaaacggttgtggatctggaaaatagactcctttccaagttcggagcccgctgtgggctgccgcagacctactgcgtgtccggcccaaaccagtggcgcgatcagctccggccgtcgcagctcctccatctcttctgccagcaacacagagtcaaggctccggtgtaccggactgatagagttatgtttcaagataaagagtattccattgaggaaatcgaggccggacggatccctaacccccacctgggtccggtcgaagagaggctcgcgctgcacgtcctgcagcagcaaggactggtgccagagcatgtcgagtccaggcctctgtacagcccgctgcagccggatatcgaacagggaaagctgcaaatgtgggtcgatctcttcccaaaggccctggggcgcccggggccgccgttcaacatcaccccgcggcgcgcacgccggttctttctccggtgcatcatctggaatactcgcgacgtgatcctggacgacctgtcgctgaccggcgagaaaatgtcggacatctacgtgaagggatggatgatcggatttgaagagcataaacaaaaaactgatgtgcactaccggtcgctcggcggggagggaaacttcaactggagattcatcttccctttcgactacctgcccgccgaacaggtgtgcaccatcgccaaaaaggacgcgttttggagactggacaaaaccgagtcgaagattccggcaagagtggtgttccagatttgggacaacgacaagttcagcttcgacgatttcctgggtagcctgcagctggatctcaaccgcatgccaaaacccgcaaagactgccaaaaagtgctctcttgatcaactggacgacgccttccacccggagtggtttgtgtcgctcttcgaacaaaagaccgtgaagggctggtggccttgcgtggcggaagaaggggagaagaagatcctggccggcaagctggaaatgaccctggaaatcgtcgcggaatccgagcatgaagagcgcccagccgggcagggccgcgacgaacctaacatgaacccgaaactggaggacccgagacgcccagatactagctttctgtggttcacttcgccgtacaaaactatgaagttcatcttgtggaggcgcttccggtgggcaatcatcctgttcataatccttttcattctgctgctgttcctggccatcttcatctatgcctttccaaactacgccgccatgaaactcgtgaagccattcagc

SEQ ID NO: 10666 - DNA, 6243 bp, Artificial Sequence
  Description of Artificial Sequence: Synthetic coding sequence
atgttatgttgcctcctggtgcgcgcaagcaatctgccttctgccaagaaggaccgtcgcagtgaccctgtcgctagcctaacttttcgcggggtaaaaaagcgcacaaaggtcatcaaaaacagtgtaaatcccgtgtggaatgaagggttcgagtgggatctgaaagggatccccctggatcaagggtctgagctacacgttgtggtgaaggaccatgagacgatgggtagaaatcgcttcctgggggaggcaaaagtgccactgcgcgaagtcctcgcaacaccgtcactgtcagcttctttcaatgctcctttgcttgatacaaagaagcaacctacgggcgccagcttagtcctccaggtgtcatatactcctttgcctggcgccgtgccactcttcccaccaccaacccctcttgagccttctcctacccttcccgatctcgacgtggtggccgataccggaggagaggaagacacggaggatcagggtctgactggagatgaagcagagccctttctggaccagtcgggcgggcccggagctcctaccacaccccggaagcttcccagcaggccccccccccattacccggggattaaacggaaaaggtcagcccccacaagtaggaagctgctgagcgacaagccgcaggactttcagatccgcgttcaggtcatcgaaggtcggcagctgcccggcgtgaatatcaaacctgtggtaaaggttaccgccgcaggccagactaagagaacacggattcacaaaggaaattcacccttgttcaatgagacccttttttttaacctttttgacagccctggggagctcttcgatgaacccatcttcatcaccgttgttgactccaggtcattacgaacagacgccttattaggcgagtttagaatggacgtgggaacgatttaccgcgaacctcgccacgcataccttcgtaagtggttgctgctcagtgacccagacgacttctcagccggagctagaggctacctgaagacttctttgtgcgtcctaggtcctggcgacgaggcccccttggaacgcaaagacccaagtgaggataaggaagatattgagagcaacctactaagacctaccggtgtagctctccgaggggcccacttctgccttaaagtgttccgagcagaagacttgcctcagatggacgacgctgttatggacaacgtcaagcaaatctttggctttgagtctaacaagaagaatctcgtcgacccttttgtagaggtgtcctttgcaggaaaaatgctgtgcagcaagatcctggagaagaccgcaaacccccagtggaaccagaatatcacccttcccgccatgtttccttcaatgtgcgagaagatgcggattcggataatcgactgggaccgtctgacccataatgacattgtagctacgacgtacctgtcaatgagcaaaattagcgcgccaggcggcgagatagaggaagaaccggccggcgctgtgaagcctagcaaagccagcgatctggacgactatcttggcttccttcccactttcggtccatgttatatcaacctgtatgggtcccctcgggaattcacaggattcccagatccgtataccgaactaaacacagggaagggggaaggcgtggcgtaccgtggccggctgctgctatcactcgagaccaagttggttgaacatagcgagcagaaggtggaagacctccctgcagacgatattctgcgagttgagaaatatctcaggcggagaaaatattccctgttcgcagctttctattcagccactatgctgcaagatgttgacgacgcaatccagttcgaagtgtccatcggcaactatgggaataagttcgacatgacctgcttgccactggcttcgaccacccagtactctcgggcggtgttcgacgggtgccattattactatctgccctgggggaacgttaagcccgtggtcgtgctgtccagttattgggaggatatcagccacaggatagaaacccagaaccaattgctcgggatcgcggacaggctggaagctggtctcgagcaagttcacttagctctcaaagcccagtgcagtaccgaggacgtcgacagcctagtggctcagctcacagacgagctcattgccgggtgttcccagcctctgggcgacatccacgagaccccttccgctacccatctggatcagtacctatatcagttgaggactcaccacctgagtcagatcaccgaggcggcgctggctctaaagctgggacactcagagctccctgccgctctggaacaggccgaagactggctgttgcgcctaagagctttggccgaagagccacagaattccctgcctgacattgtgatctggatgctgcagggtgataagagggtagcttatcagcgggtacccgcacatcaggtcctgttttccaggcgtggggcaaattactgtggcaagaactgcggcaaactgcagaccattttcctgaaataccccatggaaaaagttcccggggcccgcatgcccgtgcagattcgtgtgaagctgtggtttgggttgtctgtggacgagaaagagtttaaccagttcgctgagggcaaactgtccgtgttcgcagagacttacgaaaacgaaacaaagctggcgctcgtgggtaactgggggaccacggggttgacatacccgaagtttagcgacgtcaccggaaaaattaagttacctaaagactcattcagaccatccgcaggctggacctgggcaggagactggttcgtctgtccagagaaaactctgctccatgatatggacgccgggcatctttcattcgttgaggaagtgttcgagaaccaaacacgccttccaggggggcagtggatctacatgtcagacaattatacggatgtcaacggagagaaggtgctgcctaaagacgacatcgagtgcccactaggatggaaatgggaggacgaggagtggtcaacggatttaaatcgagccgtcgatgaacagggctgggagtattcaataactataccccccgaaaggaaaccaaaacactgggtgccggccgaaaaaatgtactatacccacagaaggcgtagatgggtaaggctgcggcggcgagacctgtcccaaatggaggctctcaagaggcacaggcaggcggaagccgagggcgaaggctgggagtacgcttcactgttcggatggaagttccacctggaatatcgtaagacagacgctttcaggcggcgccggtggaggagacgcatggagccgttagagaagacagggcctgcggccgtgtttgcacttgaaggcgcacttgggggggtcatggatgacaagagtgaggattccatgagtgtgtcaaccctgtcttttggagtgaatcggcccaccatatcctgtatctttgactacggaaatcgctaccacttgagatgctatatgtatcaggcacgggacctggctgctatggacaaggatagcttctcagatccttacgctatcgtctctttcctgcatcagtctcaaaagacagtcgtagtcaagaacactttgaacccaacttgggaccaaaccctgattttctatgagatcgagatcttcggtgagccagccacggttgcagagcagcctccttccattgtagtggagctgtacgaccatgatacttacggcgcggacgagtttatgggccgttgtatttgccaaccctcattggagcggatgcccaggttggcctggtttcccctcacccgtggatcccagccgtctggggagttactggcaagttttgagcttatccagagagaaaagcctgccattcaccatatccctggttttgaagtgcaggaaacctctagaatcctggacgagagtgaggacactgaccttccttacccgcccccacaaagggaagccaatatctatatggtgccacagaacatcaaacccgctcttcagcgaaccgcaatagagatccttgcatggggattgcgtaacatgaagtcgtatcagctggcaaatatctcttctccaagcttggtggtagagtgcggaggccagactgtgcagtcctgcgtgattaggaacctacgcaaaaaccccaatttcgatatttgcaccctgtttatggaggtgatgcttccacgagaggaactgtactgtccccctattacagtgaaagtaatcgacaatcgccagtttggccgcaggccggtagttggccagtgtaccatacggagcctagaatcttttctatgcgacccatacagtgcggagtctccaagcccccagggcggacccgacgacgtatcactgctctctccgggggaagacgttctgatcgatatagatgataaggagccactaatcccgattcaggaggaggagttcatagactggtggagtaagttctttgcttcgattggcgagagggagaagtgcgggtcctatctcgagaaagactttgatacactgaaagtttatgacactcaactggagaatgtggaggcttttgaggggctgtctgacttctgcaacacatttaagctttatcgcggcaagactcaggaggaaacggaagacccatccgtgatcggtgaatttaaggggctgttcaagatttacccgttgcctgaggacccggccatccctatgcctcccagacagttccaccagctcgccgcgcaagggccacaggaatgcctcgtgcgcatatatatagtgcgagctttcgggctgcagccaaaggaccctaatggcaagtgtgatccatacataaagatatcaatcggaaaaaaatcagttagcgaccaggataattacatcccttgcacgctcgaaccagtcttcggaaagatgttcgagcttacctgtaccttgcccctcgagaaagatctgaagatcacactgtatgactatgatttgctttcaaaagacgagaaaatcggcgaaacagttgtggacctcgagaatcgcttgctgagcaagtttggggcccgctgtggtctgcctcagacttactgtgtgtcgggtccaaaccagtggagagatcagctacgcccatcacagttgcttcacctgttctgtcagcagcaccgggttaaggcaccagtgtaccgcactgatagggtcatgttccaagataaggaatactctatagaggagatcgaggccggcagaatcccgaacccccacctgggtccggtggaggagcgactggcgcttcacgttttgcagcagcagggactggtgccggagcacgtagagagtcgccccttgtattccccactgcagcctgacattgagcagggcaaacttcaaatgtgggtcgacctgtttcctaaagcgttgggacgcccaggccccccgtttaatatcaccccaagacgcgccagacgcttttttttacgatgtatcatttggaacactagagacgtgattctggacgacttaagtttgacaggtgaaaagatgtcagatatttacgtaaagggatggatgatcggcttcgaggaacataagcagaagactgacgtgcactatcgcagccttggaggcgaaggcaatttcaactggcggtttattttccccttcgattaccttcccgcagagcaggtgtgcacaattgcgaagaaagatgccttttggcggctcgacaaaacggaaagcaagatccccgctcgcgtggtgttccagatctgggataacgataagttcagctttgatgacttcctcggcagcctacaacttgaccttaacaggatgcccaaacccgctaagacagccaaaaagtgctctctagaccaactcgacgatgcatttcatcctgaatggtttgtgtccctgttcgaacagaagaccgtgaaaggctggtggccttgcgtggcagaagagggcgagaaaaagatccttgccggcaagctagagatgaccctggaaatcgtagctgagtccgaacacgaggaacggccggctggccagggcagggacgagcctaacatgaatcccaaactggaggatccacgcaggccagacacttcttttctgtggttcacctccccctacaagaccatgaagtttatcctgtggcgcaggttccgttgggcaattatcctttttatcatcctgtttatcctgctgttgtttcttgccatctttatctacgcatttccaaactacgctgctatgaagttggttaaaccattttct

SEQ ID NO: 10667 - DNA, 6243 bp, Artificial Sequence
  Description of Artificial Sequence: Synthetic coding sequence
atgctctgctgcctcctggtcagagcttcaaaccttccgtccgccaagaaagaccggaggtcggacccggtggcatccctgacttttcggggagtcaagaagcggaccaaggtcatcaagaactctgtcaatcccgtgtggaacgaaggcttcgagtgggatctgaagggcatcccgttggaccagggtagcgaattgcacgtagtggtgaaggaccatgagacgatgggtagaaaccggttccttggagaagcaaaggtgcctctgcgcgaagtgctggcaactccctccctctcggcctcgttcaacgcgccactgcttgatacgaagaaacagcccactggcgcttcgctggtgctgcaggtttcgtacacgccgctccctggcgcggtgcctctgtttccaccgccgacccctctggaaccctcccctactctgccggatctggacgtggtagccgatactggaggtgaagaggatacggaggatcagggcctcaccggtgatgaggctgaaccgtttctcgatcagtccggggggccgggcgcgccgaccactccccgcaagctcccttcccggccgccaccgcactacccgggaatcaagcgtaaaagaagcgcgccgacgtcgcggaagctgctctcagacaagccgcaggactttcaaatccgcgtgcaagtgatcgaaggacgccagctccccggagtgaacatcaaacctgtcgtcaaggtcaccgcggccggacaaactaaacgcactaggatccacaaagggaattccccgctgtttaatgaaacgctgttcttcaacctcttcgattccccaggcgaacttttcgacgaacctatcttcatcactgtcgtggattcacgctcgctgcggaccgatgccctgctgggcgagttccggatggacgtgggaactatttaccgggaaccaaggcacgcctacctccggaagtggttgctcttgtcagacccagacgatttctcggcaggtgcacgaggatatctcaaaacgtcgctgtgcgtgttgggtccaggtgacgaggcccctctggaaaggaaagacccgagcgaagataaagaagatattgagtccaatctgctccggccaaccggagtcgcattgcgcggagcccacttttgcctgaaagtgttcagagcagaagatctgcctcagatggacgatgcagtgatggataacgtcaaacagatcttcggatttgaatctaataagaagaacctcgtcgaccctttcgtcgaagtctcattcgccggaaagatgctttgctccaaaatcctggaaaagacggcgaatccgcagtggaatcaaaacatcaccttgccggccatgtttccgtcgatgtgcgaaaagatgcggatccggatcattgattgggatcgcctgacccataatgacatcgtggccactacctatttgtcgatgtccaagatcagcgcccccggtggagagatcgaagaagagccggcaggagctgtgaagccgagcaaggcgagcgatttggatgactacctcggatttctccctaccttcggaccgtgctacattaacctttacggatcaccacgcgaattcacgggtttccctgatccgtacactgaactgaacactgggaagggcgaaggcgtggcttaccgcgggcgccttctgctctcactggaaaccaagctcgtggaacactcggagcaaaaagtggaggacttgccagcagatgatattctgcgcgtggagaaatatctgagacgacggaaatacagcctgttcgctgcgttctacagcgccactatgctgcaagacgtggacgatgcaatccaattcgaagtgtccatcggcaactacggcaataagttcgacatgacctgcttgccgctggcctcgactacccagtactcacgcgcagtctttgatggatgccactactactacctcccatggggcaacgtgaaaccggtggtggtgctctcttcctactgggaagatatttcccaccggatcgaaactcaaaatcagctgctgggaattgccgatcggctggaagcgggactggaacaagtccatctggccctcaaggcgcaatgctcgactgaagatgtcgatagcctcgtggcccagcttaccgacgagctgatcgcggggtgcagccagccgcttggggacatccacgaaaccccctcagccacccaccttgatcaatacctctaccagctgagaacccatcatctcagccagattactgaggctgctctggccctgaagctcggccactcggaactgccagctgccctggagcaagcggaggattggctcctgcgcctgagagccttggcggaagaaccccagaattcgctgccagatattgtgatctggatgctccagggtgacaagcgggtggcataccagcgtgtcccagcgcatcaggtgctgttttcgagacgcggagctaactactgtggcaagaactgtggaaagctccagactattttcttgaagtacccgatggagaaggtgcctggcgcgaggatgccggtccagatcagagtgaagctctggttcggactctcggttgatgaaaaggagttcaatcaattcgcggaaggcaaacttagcgtgtttgctgaaacctacgagaacgaaaccaagctggctctggtcggaaattgggggactactggactgacctacccgaagttctcagacgtcactggaaagattaagctgccgaaggattcctttagaccttctgccggatggacctgggccggagactggttcgtgtgccccgaaaagaccttgctgcatgatatggacgccggacatctgtcatttgttgaggaggtattcgagaaccagacccggctcccgggaggacagtggatctacatgagcgataactacacggacgtcaacggggagaaggtgttgccgaaagacgacatcgaatgcccgctcggctggaagtgggaggacgaggaatggtcgactgacttgaaccgggctgtggacgaacaaggctgggaatactcaatcactatcccaccggaacgcaagccaaagcactgggtcccagccgagaagatgtactacactcacagacgccgccggtgggtgcgcctgaggcgccgggacctctcgcaaatggaagctctgaaacggcatcggcaagccgaggcggagggagaaggatgggagtatgccagcctgttcgggtggaaattccacctcgaataccgcaagacggatgcgtttcgccgcagacggtggcggcgacggatggagccactggaaaagactggtcctgcggcagtctttgctctggaaggagctctgggcggggtgatggacgacaaatccgaggacagcatgtccgtctcaaccctgagcttcggtgtgaacagaccaaccatctcatgcatttttgattacgggaaccgttaccacctccgctgctacatgtaccaggccagagatctcgccgcaatggataaggactcgttcagtgacccgtacgctatcgtgtcattcctgcatcagtcgcagaaaactgtcgtggtcaaaaacacgctgaatccaacctgggaccaaaccctcatcttctacgaaatcgaaatcttcggagaaccagcaaccgtggcggaacagccgccgtcgatcgtcgtggagttgtacgaccatgacacgtacggcgcagacgagtttatgggaagatgcatctgccagccgtcgctcgagcggatgccgcgcctggcgtggttcccactgacccgcggatcgcaaccgtccggtgagttgctggcctcctttgagctgattcaacgcgaaaaaccagctatccatcatatcccgggattcgaagtgcaggaaacttctaggatcctggatgagtcggaggacaccgacctgccgtatccaccgccgcaacgtgaagctaacatatacatggtcccacagaatatcaagcctgcactgcaacgcaccgcgatcgagatcctggcctggggactgcgcaacatgaagagctaccaactggccaatatctcgtcgccgtcacttgtggtagaatgcggcgggcagactgtgcaatcctgcgtgatccgcaacttgcgcaagaaccccaacttcgacatctgcactctctttatggaggtgatgctgccccgcgaggaactgtactgcccgcccattactgtgaaggtcatcgacaatagacagtttggacgcagacctgtcgtgggacagtgcaccatccgttcgttggaatcgttcctgtgtgacccttactcggccgagagtccatcacctcagggtggacccgacgatgtgtcgttgctgtccccgggcgaggacgtgctcatcgacatcgacgataaggagccactcatcccaatccaggaagaagaattcatcgactggtggtctaagtttttcgcgtccatcggtgagcgggagaagtgtgggagctacctggagaaggacttcgacactctcaaagtgtacgacactcagctggaaaacgtggaagcgttcgaagggctgtccgacttttgcaatacctttaagctctaccgaggtaaaacccaagaggaaaccgaggatcctagcgtgatcggtgagtttaaaggactcttcaagatttatcccctcccggaggatccagctatcccgatgccgccaaggcaattccatcagctggccgctcagggaccgcaagaatgtctggtgagaatctacatcgtccgagccttcgggcttcaacctaaggacccaaatgggaagtgtgatccctatatcaaaatctcaatcggaaagaaatctgtgtcagatcaagacaattacattccgtgcactttggagccggtgttcggtaagatgttcgagctcacctgtactctcccgcttgaaaaggatctgaagattaccctttacgactacgacctcctttccaaggatgagaaaattggtgagactgtggtagatctggaaaacaggctgctgtcgaaattcggtgcgcggtgcgggctgccacaaacctactgtgtctctggacctaaccagtggcgggaccagttgcgcccttcacagttgctgcacctcttctgccagcaacacagggtgaaggccccggtgtaccgcaccgatagagtcatgttccaggacaaggagtattcgatcgaagaaatcgaggcaggaagaattccgaacccgcacctcggtcctgtggaggagcggctcgcgctccacgttctccagcagcagggcctggttccggagcacgtcgaaagccgcccgttgtactcgccactgcagccggacatcgagcagggaaagctgcagatgtgggtggacctgttccctaaagccctcggccggccgggaccaccattcaacatcaccccacgtagagctcgccgcttcttcctccggtgcatcatctggaatacccgcgatgtcatcttggacgacctgtcattgaccggagagaagatgtctgacatctatgtcaagggatggatgattggcttcgaggagcacaagcagaaaactgacgttcattaccggtccctgggtggagaaggaaacttcaattggcggttcattttccctttcgattaccttcctgctgagcaggtgtgcactatcgccaagaaggatgcattctggcggttggataaaaccgagtcgaagatcccagcgagggtggtgtttcagatctgggacaacgacaaattcagcttcgacgacttcctgggatcgctgcaactggatctcaacagaatgccaaagccagccaaaactgccaagaaatgctcactggaccagctggatgacgcttttcatcctgagtggttcgtcagcctgttcgagcagaaaacggtgaaggggtggtggccttgtgtggcagaagaaggcgagaagaagatcttggcaggcaagctggagatgaccctcgaaatcgtggccgagtcggaacacgaggaacgcccagcgggacagggccgcgacgaaccaaacatgaacccgaaattggaggaccctcgccggccggatacgtccttcctgtggtttacttcgccttacaagactatgaagttcatcctgtggcggcgctttcgctgggccataattctgtttatcatcctgttcatcctgctcctgttcctggcaatcttcatctacgcgttccctaattacgcggccatgaaactcgtgaagcccttctcc

SEQ ID NO: 10668 - DNA, 6243 bp, Artificial Sequence
  Description of Artificial Sequence: Synthetic coding sequence
atgctgtgctgtctgctggtgcgtgcaagcaatcttccttccgcaaagaaagacaggagaagcgatccagtggcgagcttgacctttaggggagtgaagaaacgcactaaggtcataaagaattcagtcaatcccgtgtggaatgaaggatttgagtgggacctgaagggaattccactggatcagggctccgagctccacgtggtggtgaaggatcatgaaactatggggcggaaccgatttctgggtgaggcaaaggtgccactgagagaggtcctggcgactccgtcgctgtcagcatcttttaacgcaccgctgctggatactaagaagcaacctactggagcatccctcgtcctgcaagtcagctacaccccactgcctggagcagtgccacttttccctccaccaacccctcttgagccaagccctactctgcctgacctggacgttgtggcagacaccgggggtgaagaggacactgaagatcaaggacttaccggagatgaagcggaacccttccttgaccaatccggtggacctggagcacccactaccccaagaaagctgccttcgcgacctccccctcactaccctgggataaaacgtaaacgcagcgcacccaccagccggaagctgctgagcgataaacctcaggatttccagattagggtgcaggtgatcgaaggacgacaactgcccggtgtgaatatcaagcctgtcgtcaaggtgacggcggcaggccaaaccaagagaactcggattcataagggaaattcccctcttttcaacgaaaccctgtttttcaatctgttcgatagccccggggaactttttgacgaacctattttcatcacggtggtggattcacgatcgctgcgaactgatgcactcctgggagaatttaggatggacgtcgggactatctaccgggagcctcgtcatgcctacctgagaaagtggctgttgctgtccgaccctgatgattttagcgcaggagcaaggggctatcttaagacttccctgtgtgtgctgggtccaggagatgaggcgccactggaaaggaaagatccgtccgaggacaaagaggacattgaaagcaatttgttgcggccgaccggcgtggcgctgcgaggtgctcatttctgtctgaaggtgtttagagcagaggatctcccgcaaatggacgacgcagtgatggataacgttaagcaaatctttggatttgaatcgaacaagaagaacctcgtggacccctttgtggaagtctcgtttgcaggcaaaatgctctgctcgaagatacttgaaaagaccgccaatccacaatggaaccaaaacatcaccctcccggcaatgtttcctagcatgtgtgaaaagatgagaatccgcatcattgactgggataggcttacccacaatgatatcgtggcaaccacttacctctcgatgagcaaaatcagcgcaccaggaggagagatcgaagaggagcctgctggggcggtcaaaccatccaaggcatctgatcttgatgattaccttggcttccttccaactttcggtccatgttacattaacctctacggttcgcctcgagaatttaccggatttccggacccatacactgaactgaacactggaaagggagaaggagtggcgtacagaggaaggcttctcttgtccctcgaaaccaagctggtggaacattccgaacaaaaggtggaggacctgccagcagatgatattcttagagtggaaaagtacctgcgcagacgaaaatactctcttttcgcagcattttactcagctactatgttgcaagacgtggatgacgcaattcaatttgaagtgtccattggaaattacggaaacaagttcgacatgacttgcctccctctggcaagcaccactcaatactcccgggcagtgttcgacgggtgtcactactactacctcccctggggaaacgtgaagcctgttgtcgtgctctcgtcgtactgggaggatattagccacaggattgaaacccaaaaccaactgcttggaattgcggataggttggaggcaggtctggaacaagtgcatttggcattgaaggcacagtgttccacggaggatgtcgattcgcttgtcgcccagctcaccgatgagctgatcgcaggatgttcccagccactgggcgacatacatgaaaccccgagcgcaactcatctggaccagtatctctaccagctccgcactcatcatctttcgcagatcaccgaggcagcactggcattgaagctgggccactcagaactgccagcagcccttgagcaagctgaagattggctgctgcgactgagagcactcgcagaagaaccccaaaattcgctccctgatatcgtgatttggatgctgcaaggcgataagcgtgtagcttaccagagggtgcccgctcatcaagtgcttttttcgagaaggggtgcaaactactgcggaaagaactgtgggaagctccagactatctttctgaagtacccgatggaaaaggtgcctggtgcacgcatgcccgtgcaaattcgggtgaaactttggtttgggttgtcggtcgatgaaaaggaattcaaccaatttgcagaaggaaagctgtctgtgttcgcagagacttacgaaaacgaaaccaaacttgcactggtgggcaactgggggaccaccgggttgacgtacccaaagttttcggatgtgaccgggaaaatcaagctcccgaaggattcgttcagaccatcagctgggtggacttgggcaggggattggtttgtgtgtcctgaaaagacgctgctccatgacatggatgcaggacacttgagcttcgtggaagaagtgtttgagaaccaaactcgacttcctgggggacagtggatatacatgagcgacaactacaccgatgtgaatggggaaaaagtgcttcctaaagatgacatcgaatgcccactggggtggaaatgggaagatgaggaatggtccaccgatctcaatagagccgtggatgagcaaggctgggagtactcgattaccattccacctgaacgtaaacctaagcattgggtaccagcagagaagatgtactatacccataggcgtcgccggtgggtgagactgcggcgcagagatctgtcacagatggaggccctgaagcgccatagacaggccgaagccgaaggagaaggatgggaatacgcgtccctgtttgggtggaagttccacctcgagtacagaaaaaccgatgcctttaggaggcgccggtggcgaagaagaatggagcctcttgaaaaaacgggtcctgccgcagtgtttgccctcgagggtgccctggggggtgttatggatgataaatcagaggactcgatgagcgtgtcgaccctctcgtttggggtgaaccgccccactatatcctgcatatttgactacggaaatcgctaccatcttagatgttacatgtaccaagcccgagatctggcggcaatggataaagattccttttctgatccctatgcaatcgtgtcctttctccaccagagccaaaagaccgtggtcgtgaagaatactctgaatccgacctgggaccagaccttgattttctacgaaattgagatttttggtgagccagcaactgttgcagaacaaccaccctcaattgtcgtcgaactgtatgatcacgacacgtacggtgccgacgaattcatgggaaggtgcatatgtcagccttcccttgaacgtatgccccgcctggcatggtttcctcttacccgggggtcccagccctcaggcgaactgctggctagtttcgagctcattcagcgtgaaaaacctgcgattcaccatattcctggcttcgaggtccaggaaacttcgaggatcctggacgaatcggaggatactgatctcccttaccctccacctcaaagagaggccaatatctacatggtgccgcagaacatcaagccggccctgcagcgaactgcaatcgaaattctggcgtggggattgcggaacatgaagagctaccaactggccaacattagctcccccagcctggtggtggaatgcggcggtcagactgtgcaatcgtgtgtgatacgaaacctgcggaagaatcccaattttgatatctgcacgttgtttatggaagtcatgctgcctcgagaagaactttactgcccaccaattactgtgaaggtgattgataataggcaatttgggcggcggcctgtggttggtcaatgtaccattagatcgcttgaatcctttctgtgtgacccatactcggctgagtcaccaagcccacaagggggccccgatgatgtgagcctcctgtcacctggtgaggatgttctcatcgacatcgacgataaggagccactgattccaatccaagaggaagaattcatcgattggtggtctaagttttttgcgtcgattggtgaacgcgaaaaatgtgggtcgtacctggaaaaggattttgatacgctgaaggtgtacgatacccagcttgaaaacgtggaagcctttgaaggattgtccgacttctgtaacacctttaagctctacagaggcaagacccaggaagaaactgaggatccctcggtcattggggagtttaaaggactcttcaagatttaccctctgccagaggatccagccattccgatgccacctagacagtttcatcagctcgccgcacaaggacctcaggaatgtctggtgagaatttacatcgtcagggccttcggccttcaacccaaggaccctaatggaaagtgtgacccttacatcaagatatcgattggtaagaagtcagtgtcggatcaagataactacatcccttgtacgcttgaacctgtatttggaaagatgttcgagcttacctgtaccctgcctctcgaaaaggatctgaaaatcaccctgtacgactatgacctgctttccaaggatgagaagattggtgaaaccgtcgtcgacttggagaacagacttctgagcaagttcggagctcgttgcggcctgcctcagacctactgtgtcagtggaccaaatcaatggagagatcaactgcgtccttcgcagctccttcaccttttttgtcagcagcatagagtcaaggcaccagtgtaccggaccgatcgagtgatgtttcaggacaaagaatacagcattgaagaaattgaagcgggaaggatccctaatccccacctcggacctgtggaggaacggcttgcgctccacgttcttcaacagcaaggccttgtgccagaacatgtggagtcgcgccctctgtactcgccacttcagcctgatattgaacaaggcaaacttcagatgtgggtcgatctgtttccgaaagcccttgggaggcccggacctccattcaacattactccgcgacgagcaaggagatttttccttagatgtatcatttggaacactagagatgtgattctggatgatctgtcgctcactggagagaagatgtctgatatctacgtgaagggttggatgatcggctttgaagaacacaagcagaaaacggatgtgcactaccggtccctcggaggtgaaggtaactttaactggcgattcatttttcctttcgactacctgccagccgagcaagtgtgcacgatcgctaagaaggatgcgttctggcggctggataagaccgagtccaagattccagcaagggtggtgttccagatttgggacaacgataagttctcctttgatgattttctcggctcgttgcaactcgacttgaatcgtatgcccaaaccggccaagactgctaaaaagtgctcactggatcaactggacgacgcatttcaccctgaatggtttgtctccctttttgagcaaaagactgtcaaaggatggtggccttgcgtcgcggaggaaggagaaaagaagattctggcaggaaagctggagatgacgctggaaatagtggcagagagcgaacacgaagaaagaccagccggacaaggtcgggatgaaccgaacatgaatcccaagttggaggatccaagacggccagataccagctttctttggtttacctcgccttacaagacgatgaagttcatcttgtggcgccggttcagatgggccattattcttttcattatcttgtttattcttcttttgtttcttgcgatcttcatatatgcgtttcctaactatgcagccatgaagctggtgaaacctttttcg

SEQ ID NO: 10669 - DNA, 6243 bp, Artificial Sequence
  Description of Artificial Sequence: Synthetic coding sequence
atgctgtgctgcctcctggtccgggcatcgaatctgccgtcagcaaagaaggatagacggtcagatcctgtcgcctcgcttacctttcgaggtgtcaaaaaacgaaccaaggtgatcaagaattcagttaaccctgtgtggaatgaagggtttgaatgggatctgaagggcattcctctcgatcaaggttcggaacttcatgtggtcgtgaaggaccatgaaacgatggggcgcaaccgttttcttggcgaagcaaaggtcccccttcgggaagtgctcgcaacccccagcttgtcggcatcgttcaacgcaccacttcttgacaccaagaagcagcccaccggtgcttccctggtactgcaagtgagctacactccccttcccggagcagtgccgcttttccctcctcccaccccgctggaaccctcacccactctgccagacctcgatgtcgttgcggataccggaggtgaagaagataccgaagatcaaggccttactggggacgaagcagaaccatttctggaccaaagcgggggcccaggcgcacctaccactcctcgtaagctcccttcgcgcccacccccacattacccaggaataaagagaaagcggagcgcaccaacttcacgaaagctgctttcagataagccccaggattttcaaattcgggtgcaagtgattgagggtcgtcaacttccaggcgtcaacatcaagcctgtggtcaaagtgactgccgcaggtcagaccaagagaactagaattcataagggaaactcgccacttttcaacgaaactctcttctttaatctgtttgattcaccaggtgaactgtttgatgaacctatcttcattactgtggtcgactcacgaagccttcggaccgatgcactgcttggagagtttcgtatggacgtaggaactatttacagagaaccacgtcacgcgtacttgagaaagtggctcctgttgtccgatcctgatgatttctcagcgggtgctcgaggataccttaaaacgtccctttgtgtgcttggaccgggtgacgaggcccccctggaacgaaaggacccttcggaggacaaagaggatatcgaaagcaaccttctgcgcccgactggagtagccctccgcggcgcacacttttgtctgaaggtgtttcgcgcagaagatctgccgcaaatggacgacgccgtgatggacaatgtcaagcagatatttggatttgagtccaataagaaaaaccttgtcgaccctttcgtggaagtctcctttgcaggtaaaatgctctgttccaagattctcgaaaagacggcaaacccacagtggaaccaaaacattactcttcctgcaatgttcccttcaatgtgtgagaagatgagaatacgcataattgattgggatagactgacccataatgatattgtggctactacttacctctcgatgtcaaaaatctcggcaccaggaggagaaattgaagaagagccagcgggggcagtgaagcctagcaaagcatcggatttggatgactaccttggatttttgccgacgtttggaccttgctacatcaacctttacggatcgcctcgcgaatttactgggtttcccgacccatacactgagcttaataccggaaaaggtgaaggagtcgcgtaccgcggacgtctgctcttgtcccttgaaactaaactggtggaacattccgaacaaaaggtggaggacctcccagcggacgatatcctccgggtcgaaaagtaccttcggcggcgcaagtacagcctgtttgcagcattctattcggcaaccatgttgcaggatgtggatgacgcaattcaatttgaggtgtcgattggaaattacggcaacaagtttgacatgacttgtctgccattggcatccactacccagtatagcagggctgtgttcgacggatgtcattactactacctcccatggggcaacgtgaagcctgttgtggtgcttagctcctactgggaggatatatctcatcggatcgaaacccagaatcagcttctgggaattgcagatcgtcttgaagcaggactcgaacaagtccatctcgcacttaaagcccaatgcagcaccgaggacgtggattcgctcgtggcgcaactgactgatgaactgattgcgggatgttctcaacctctgggggacatccacgaaacgccttcggccactcacttggatcaatacctttaccagctgaggacgcatcacctgtcacaaataaccgaggccgcgcttgcgctcaagctgggccactccgagctgcccgccgcgctggagcaggcagaggattggttgttgaggctgagagcactcgccgaagaacctcaaaactcgctcccagacattgttatttggatgctccagggtgataaacgtgtggcataccagcgcgtgccggcacaccaggtgctcttttcgagacgaggcgcaaactactgcggaaagaattgtggaaagttgcagacgatttttctgaagtaccctatggagaaggtgcccggagcaagaatgcctgtgcaaattcgcgtcaagctgtggtttggactcagcgtggatgaaaaagagtttaaccagtttgccgaaggaaagctgtccgtgtttgcggaaacctatgaaaacgagactaagctggcccttgtgggaaactggggaactacgggcctgacttatccgaaattctcggacgtgactgggaagataaaactgccaaaggattcgtttcggcctagtgcaggatggacctgggcgggtgattggtttgtgtgtcccgaaaagactcttcttcatgacatggatgcaggacatctgtcgtttgtcgaagaggtctttgaaaaccagactcggctccctgggggacaatggatctatatgtcggacaattacactgatgtcaacggggaaaaagtgctgcctaaggatgatatagagtgtccccttggatggaaatgggaggatgaagagtggtccaccgaccttaaccgcgcagtggatgaacaggggtgggagtactccataaccattcctcctgaacggaagcctaagcattgggtgccggccgaaaagatgtactacacccatagacgcaggcggtgggtgcgtctccgtcgccgtgacctcagccagatggaagccctgaaaagacatagacaagcagaagcagagggagaaggctgggaatacgcctctctttttggttggaagttccatctggagtacagaaagaccgatgctttccgccgccgcagatggagacgcagaatggaacctcttgaaaagacggggcccgcagcagtgtttgcgctggaaggagcattgggaggcgtcatggatgataaatccgaagattcaatgtcggtttcaactctgagctttggtgtgaacagacccaccatcagctgtatctttgactacggtaacagataccacctgagatgttacatgtatcaagcgagagatctggcagccatggacaaggatagcttcagtgacccatacgccatcgtctctttcctccaccaatcgcaaaaaaccgtagtcgtcaagaatactttgaacccaacctgggatcaaaccctgattttctacgagatcgaaatctttggtgaaccggcgaccgtggctgagcagcccccttccatcgtggtggagctgtacgaccacgatacttacggggctgatgaattcatgggtaggtgtatttgtcagccctcccttgaacgcatgcctagactggcctggtttcctctgacccgcggttcacagccatcaggagaacttcttgcatcctttgaacttattcagagggaaaagcctgcgattcatcatatccctggattcgaagtgcaagaaacttctcgcatcctcgacgaatctgaggacactgatttgccgtacccaccacctcaacgagaagcaaacatttacatggtgccacaaaacattaaaccagccctccaacggacggcgattgaaatcctcgcatgggggttgagaaacatgaaatcgtaccaactggcgaatatcagctccccttcgcttgtggtcgaatgtggaggtcagactgtgcaatcgtgtgtgattcggaacctcagaaagaaccccaattttgacatctgcaccctcttcatggaggtgatgcttcctagagaggaactttactgtccacccatcacggtgaaggtcatcgacaatcggcaatttggccggcgcccagtggtgggacagtgcacgatacgaagcctcgagtcctttctgtgtgacccttactccgctgagtcacccagcccacaagggggcccagacgatgtgtcgttgctgtccccaggagaagatgtgcttattgacattgatgataaagaacctctcattcctattcaggaggaggagtttattgattggtggtcgaaattcttcgcatccatcggagaacgcgagaagtgtggttcgtaccttgaaaaggatttcgatacgcttaaggtctacgatactcaactggagaatgtggaagcattcgaaggtttgtccgacttctgcaacacgtttaaactgtaccggggaaaaactcaggaggaaaccgaggatcctagcgtgattggtgagtttaagggccttttcaagatttaccccctgcctgaggatcctgccattcccatgcctccgagacaatttcatcaattggcagcgcagggacctcaggaatgcttggtgcgcatctacattgtcagggcatttggactgcagccgaaagatccgaatggtaagtgcgacccgtacattaagatttcaataggcaaaaagtcggtatcagatcaggataactacattccatgtactctggaacctgtgtttggaaaaatgttcgaattgacgtgtaccctgccactcgaaaaggatctgaagataaccttgtatgattacgatcttctttcgaaggatgaaaagataggcgaaaccgtcgtggacctggagaatagacttctgtcaaagttcggagcgcggtgcggtttgccacagacttactgtgtgtcaggaccaaaccagtggcgggatcaactccggcctagccagctgctgcatcttttttgtcaacagcaccgcgtcaaggcacctgtgtaccggaccgacagagtgatgttccaagataaggaatactcgattgaagagattgaagccggaagaattccgaaccctcatctcggtcctgtggaagagagacttgcccttcatgtgctgcaacagcaaggcttggtcccagaacatgtggaatccagacccctctactctcctctgcaacctgatatcgagcagggtaagctgcagatgtgggtggatctgttccctaaggcactcggtcggcctgggccaccattcaacataactcccaggcgtgcgcgcaggttctttcttaggtgcattatctggaatacccgcgacgtgatcctcgacgatctgtcactgaccggggaaaagatgtccgacatttacgtgaaaggatggatgatcggctttgaagagcacaagcaaaaaacggatgtccattacaggtccctggggggagaaggaaactttaactggagattcatattcccatttgactaccttcctgcagaacaggtctgtaccattgcaaagaaagatgctttttggagactggataagacggaatccaagatccccgcaagagtggtttttcaaatttgggataatgacaagttctcctttgatgactttcttgggagtctgcaacttgatctgaaccgtatgcctaaaccagccaagaccgccaagaaatgttcgctcgatcagctcgatgatgcctttcatcccgagtggttcgtgagcctgttcgagcaaaagactgtgaaaggttggtggccatgcgttgcggaagaaggagaaaagaaaatcctcgccggaaagctggaaatgaccctggagatcgtggcagaatcggagcatgaagagcgccctgcaggtcaaggtcgcgatgaaccaaatatgaacccaaagctcgaggaccctaggcgtcctgatacctcgttcctttggtttacttcgccatacaagaccatgaagtttatcctttggcgtagatttagatgggcaatcatactctttatcatcctgtttatcttgcttctcttcctggcaattttcatttacgcatttccgaattacgcagcgatgaagttggtgaagcctttcagc

SEQ ID NO: 10670 - DNA, 6243 bp, Artificial Sequence
  Description of Artificial Sequence: Synthetic coding sequence
atgctgtgctgcttgctcgtgcgagcatcaaatctcccgtcggcaaagaaagaccgccgctcggacccggtcgcatcccttacttttcgaggcgtgaagaaaaggaccaaggtgatcaaaaacagcgtcaacccagtttggaacgaaggattcgaatgggacctgaagggcattccacttgatcaaggatctgaactgcatgtcgtggtcaaggatcacgaaaccatgggacgaaatcggtttctcggagaagcaaaagtgccccttagagaagtgctggcaactccatcactttcggcttcgtttaacgcacctctgctggatacgaagaagcaacctaccggtgcctcgttggtcctgcaagtgtcctacaccccactgcccggggcagtccctctgtttcctccaccaacccctctcgaaccctcacctactctgccagatctcgacgtggtcgccgacaccggaggtgaggaggacacggaggaccaaggactgaccggtgatgaggcagaaccatttcttgatcaatcaggcggccctggtgcccctaccaccccgcggaaattgccatcacggccaccacctcactaccctggaatcaaacggaagcgttcggccccgacgtcccgcaagctccttagcgataaaccacaagacttccagattagagtgcaggtgattgagggtagacaactgccaggtgtgaacattaaaccggtcgtgaaggtgaccgcagctggacaaaccaagaggacccggattcataagggaaactcgccacttttcaatgaaactctcttctttaaccttttcgacagtcctggtgaattgttcgatgagcctatctttatcacggtggtcgattcaagatcgttgaggaccgacgccctgcttggggaatttcgcatggatgtcggaactatttaccgggaacctcgccatgcttaccttcggaagtggctcctgttgtccgacccagacgacttttccgcaggagcaagaggctacctgaaaacttctctttgcgttctcggtccgggtgatgaagcacctctggaaagaaaggatccttcagaggacaaagaggatatagaaagcaaccttctccgaccaactggagtggcgttgcggggagcgcatttttgcctgaaagtgtttcgggcagaggaccttcctcagatggacgacgcagttatggataacgtgaagcagatttttgggtttgaaagcaacaagaagaacctcgtggacccctttgtcgaagtgtcgtttgcaggaaagatgctctgttcgaaaatcctggaaaagactgccaatcctcaatggaatcagaacattactcttccagcaatgtttcctagcatgtgcgaaaagatgagaattcggataattgattgggacagactgacccacaacgatatagttgcgaccacgtacctttcgatgagcaaaatcagcgcgcccggaggtgaaatcgaggaggaacctgccggcgccgtgaagccgtccaaggcaagcgatctcgatgattacctcggctttcttccaaccttcggcccttgttacatcaacctgtacgggagtccgagagaattcactggatttcctgatccctacactgagttgaacactggtaaaggagagggagtggcttaccgcggacggctgctcctttcccttgagactaaactcgtggaacattcagaacaaaaggtggaagatctgccagcagacgatattctgagggtcgagaagtacttgaggcggcgaaaatacagcctcttcgcggccttctactcagcaaccatgctgcaagacgtcgatgatgcaatccaatttgaggtgagcatcggtaactacggaaataagtttgatatgacctgcctgccactggcctcaaccacccaatattcgagagccgtgttcgacggctgtcactactactacctcccatggggtaatgtgaagcccgtcgtggtgcttagctcctactgggaggacatctcgcatcggattgaaacccaaaatcaactgctcggaatcgcagaccgacttgaagcgggactcgagcaggttcacctcgcgctgaaggcacaatgttctactgaggacgtcgacagcctcgtggcacaacttactgatgaactcatcgcaggatgttcgcagccgcttggggacattcacgaaaccccatccgcaacccatctcgaccagtacctctaccagcttaggactcatcatcttagccagatcaccgaagccgcgctggccttgaaactcggccatagcgaactgcccgcagcccttgaacaggccgaggattggcttctgcggctgagagctctggcagaagaaccacagaattcgctcccagatattgtgatttggatgcttcagggagataagcgcgttgcatatcaaagagtccctgctcatcaggtgctgttttcgagaagaggtgcgaactactgtgggaagaattgcggaaagctgcaaaccatttttctcaagtaccccatggaaaaagtcccaggtgcacggatgccagtgcagatccgggtgaaactttggttcggactgtcggtggatgaaaaggagtttaatcagtttgctgaagggaaactgtctgtgtttgcggaaacttacgaaaatgaaactaaactcgcgctcgtggggaactggggcaccactggtttgacctaccctaaattctcggatgtcactgggaagattaaactgccaaaggatagcttcaggccctcagctgggtggacctgggcaggagactggttcgtgtgccctgaaaagacgctgcttcatgatatggacgcaggacacctctcatttgtcgaagaagtctttgaaaatcaaactcgccttccaggcgggcaatggatatacatgtcggacaactacaccgacgtgaacggggaaaaggtgcttcccaaggacgatattgagtgtcctctgggatggaagtgggaggacgaagaatggtccactgaccttaacagagcagtggacgaacagggttgggagtacagcataactatccccccggaaagaaaacctaagcattgggttcctgcagagaagatgtattacacccatcgtcgtcgtcgctgggtgcggctcagacgccgtgatctttcccagatggaagcactgaagcggcatcgtcaagcggaagcagaaggagaaggatgggaatacgcttcgcttttcggctggaagtttcacctggaatacagaaagactgatgcattccgtcgaaggagatggcgacgccgtatggaaccactggagaaaaccggcccagcagccgtctttgcactggaaggagcactcggcggcgtgatggatgataagagcgaggacagcatgtcggtgtcaactctgagctttggtgtgaacagacctaccatttcctgtattttcgactacggcaaccggtaccatctgaggtgctacatgtaccaggccagggatcttgctgccatggataaggactcgttctccgatccgtacgcaattgtttcgttccttcatcaatcgcagaaaactgtcgtcgtgaagaatacccttaatccgacctgggaccagaccttgatcttttacgaaattgagattttcggtgaacctgcaactgtggcagaacagcctccttcaattgtcgtagagctgtacgatcatgatacgtacggagcggatgagtttatgggccggtgtatatgccaacctagccttgagagaatgcctagactggcgtggttcccgcttacgcgcggatcgcagccatccggggaactgctcgcatcatttgagcttattcaaagggagaaacccgccatacatcatatccccggctttgaggtccaagagacgtcacggattttggacgagtcagaagataccgacctgccataccctcccccacaacgagaggccaatatctacatggtgccacagaacatcaaacctgccctccagcgaaccgccatagagattcttgcctggggactccgtaacatgaaatcctaccaattggctaacatatcttcaccgagcctggtggtggaatgtggagggcaaacggtccagtcctgtgtgattaggaatctcagaaaaaaccctaacttcgatatttgtacgctgtttatggaagtcatgcttcctcgggaggagctctactgccctcctatcaccgtcaaagtgatcgataataggcaatttggccgcagaccagtcgtgggccagtgtactattcgctcgctcgagagcttcttgtgtgatccttacagcgcggaaagcccttcccctcaaggaggaccagacgatgtttcgctcctgtcaccaggagaggatgtgcttatcgacatcgacgataaagaacctctgattccgattcaagaagaagagtttatcgactggtggtcgaaattctttgcatcgattggtgagcgtgaaaaatgtggatcctaccttgagaaagattttgatactcttaaggtgtacgatacccagttggagaacgtggaggcattcgaaggactctcggacttttgtaacacgttcaagctgtacagaggaaagacgcaagaggaaactgaagatcctagcgtgatcggggagtttaagggccttttcaagatctaccctttgcccgaggaccctgcaattccaatgccccctaggcagttccatcagctcgcagcacagggtcctcaggaatgcttggtgcggatctacatcgtccgggcatttgggcttcagcctaaagatccaaacggtaaatgtgatccatacatcaagatctcaataggaaaaaagagcgtgtctgatcaagacaactacatcccttgtaccctggagccagtctttggaaagatgtttgagctcacctgtacgcttccattggaaaaggatctcaagatcactctgtatgattacgacctgctttctaaggatgaaaagataggggagactgtcgtggatttggaaaaccgccttctttccaagtttggggcacggtgcggacttccccagacgtactgtgtgtcggggccaaatcaatggcgtgatcaattgcgaccatcccagctgctgcatctgttttgtcaacaacatagagtaaaggcacctgtgtatcgcactgatagggtgatgtttcaggataaggagtactccatcgaagaaattgaagcaggaagaattcctaacccgcatctgggtccagtggaggagcggctggcccttcatgtgcttcaacagcagggtcttgtgccggaacatgtggagtcgcgaccgctgtactcgccgttgcaacccgacattgaacaaggcaaactgcagatgtgggtggatctgtttcctaaggcgctggggcgccccggtcctccttttaacattacgccgaggcgcgcaaggagattctttcttcgatgtatcatttggaacactcgagatgttattcttgatgatctttcattgacgggggaaaagatgtcagatatctatgtcaaggggtggatgattggatttgaagaacataagcaaaagaccgacgtgcattacaggtccctcggcggagaaggcaatttcaattggagatttatctttccattcgactaccttccggctgaacaagtgtgtacgatcgcaaagaaggatgcattttggaggttggacaagactgaatccaagatccctgccagagtggtctttcagatttgggataacgataagttttcctttgatgatttcctcggttccttgcaactggacctgaatcggatgccgaagccagcaaagaccgctaagaagtgtagcctggaccaactcgacgacgcatttcatccagagtggttcgtgtcactgtttgagcagaaaaccgtcaagggatggtggccgtgtgtcgctgaggagggagaaaagaagatacttgcaggcaagctggagatgactcttgaaattgtcgccgaaagcgagcacgaagagcggcccgctggccagggccgtgatgagcctaacatgaatcctaaactggaagatcctagacggcccgatacttcgtttttgtggttcacttccccgtacaagaccatgaagtttattctgtggcgcaggttccgatgggcaattatcctgttcatcatacttttcattcttcttctgttccttgctattttcatttacgcatttccaaattacgcagctatgaagctcgtaaagccattttcc

SEQ ID NO: 10671 - DNA, 6243 bp, Artificial Sequence
  Description of Artificial Sequence: Synthetic coding sequence
atgttgtgttgcctcctggtgcgtgcctccaacctgcccagtgcaaaaaaggacaggcggtcagatcctgtggcttcactgactttcagaggggttaaaaaaagaaccaaggtgatcaaaaactccgtgaacccggtgtggaacgagggattcgagtgggacctgaagggcatccccctagaccagggtagcgagttgcatgtcgtcgtgaaggaccacgaaacaatgggccgtaatagattcttaggcgaggccaaagtgccactcagggaggtgttggcaactccctccctgtccgcatccttcaacgcccccctgctagatactaaaaaacagccgacaggcgccagcctggttcttcaggtgtcctatactcctctgcctggtgccgtgcccctgtttcccccccctacaccattggaaccctcccccactctgccggatcttgatgtggtggctgacacaggcggtgaagaagataccgaagaccagggacttaccggtgatgaggccgagcccttcctggatcagagcggaggcccaggcgcccctacaacgccaaggaagctgcccagtagaccccccccacattacccagggattaagagaaaaagatctgccccaacttcccgcaaattactttctgataaacctcaggattttcaaataagagtgcaggtgattgaggggcgacagcttcccggggtcaacatcaagcctgtggttaaagttaccgctgcaggacagacgaaacggacccggatccacaaaggcaattcaccactgtttaacgagaccctgtttttcaacctattcgacagtcccggggagttattcgacgaacctatatttatcacagtggtggacagccgctcactgaggacagacgctttacttggcgagttccggatggatgtaggtactatttatcgtgagcctagacatgcttacttgcgcaagtggctcctgcttagcgaccctgacgatttttctgccggcgcgaggggctacctgaaaacatctttatgtgtattagggcccggcgatgaggctcccctagagaggaaggaccccagcgaagacaaagaggacatcgaatcaaatctactcagaccaacgggagtggccctgcggggggctcatttctgccttaaggtcttcagggcagaagatctgccccagatggacgacgcggttatggataatgtcaagcagatctttggattcgagagcaataagaagaacctggtggatccctttgtggaagtgtcgtttgctggtaaaatgctgtgcagcaagatcctggagaaaacagcaaacccccaatggaatcagaacatcaccctgcccgctatgttcccgtccatgtgcgagaaaatgcgcattcggatcatcgattgggaccggctaacacataatgatattgtagcgactacctatctttccatgtcgaagatctctgctccagggggtgagattgaggaggagcccgctggggcggtaaagccaagcaaagcctcagaccttgacgattatctcgggttcctccctacctttggcccctgctatataaacctgtacggctcacctagggagttcactggattcccagacccttacaccgagttgaacactggaaaaggcgaaggagttgcttacagaggccggctgctcttgtcactggagaccaaactagttgagcacagcgaacagaaggtcgaggatcttcccgctgatgatattcttcgagtcgaaaagtacctgcgccgcaggaagtactctctgtttgcagccttctattccgcaaccatgctgcaggatgtggacgatgcaatccagttcgaagtctccatcggcaactatggaaacaagtttgacatgacttgtcttcccttggcatccacaactcagtattctcgcgcggtgttcgatgggtgtcactattattatctcccctgggggaatgtaaagcccgttgtagtcttgtcctcatactgggaagatatttctcaccgcatagagacacaaaaccagttattaggtatcgctgataggctggaagccggcttggagcaggtccatttggcacttaaggcccagtgctctacagaggacgtggacagcttggtcgctcagctgactgacgaacttatagcaggatgcagccagccacttggtgatatacatgaaacaccgtctgctactcacctcgaccagtatctatatcagctgcggacccatcacctgtctcagatcaccgaggcagcactcgcactgaagctgggccacagtgagctgcctgcggcgcttgaacaggctgaagactggctgttacggcttagggccttggcagaggaaccccagaattcactgcccgacattgtgatctggatgctgcagggcgataaaagagtggcataccaacgcgtgccagcccaccaggtgctattttcgaggagaggcgcgaattactgtgggaaaaattgcggaaagttgcagaccatattcctcaagtaccctatggagaaagtcccaggggccaggatgccagtccagatcagagtgaagctgtggttcggactgagcgttgacgaaaaggaattcaaccagtttgcagaagggaagttgtccgtattcgcagagacgtatgagaacgagacaaagttagcccttgtgggtaattgggggactaccgggctgacgtaccccaaattctctgatgtgacagggaaaatcaagctccccaaggacagctttagaccctcagcgggttggacgtgggcgggagattggttcgtctgcccggaaaagactctgctacatgatatggatgcggggcacctctctttcgtggaagaggtattcgagaaccagacccgcttgccagggggccagtggatctacatgagcgataactacaccgacgtgaacggggaaaaggtgcttcctaaggacgacatcgagtgccctttggggtggaagtgggaggatgaggaatggagtaccgacctcaacagagctgtggacgaacagggctgggaatactccatcactattccccctgagaggaaacctaagcactgggtccccgccgaaaagatgtattatacgcacagacgaaggcgatgggttcgactgcggcgtcgcgatctgagtcagatggaggcgctgaaaaggcatcgtcaggcagaagctgaaggggagggctgggagtatgcaagtctgttcggctggaaattccatctggagtacaggaagacagatgccttcaggagaaggcgatggaggagaagaatggagcccctggagaaaaccggtcccgctgctgtgtttgcacttgagggtgcgctgggaggggtgatggatgataagagcgaggacagcatgtccgtgtcaacactatccttcggggtcaaccggcctaccatttcgtgcatctttgattatggtaacagatatcacctcaggtgttatatgtaccaagcccgcgacctcgctgccatggacaaagactctttctcagatccctatgccatcgtcagctttctgcatcagagccagaagacagttgtggtgaagaataccttaaatcctacgtgggatcagactcttatcttctatgagatcgaaatctttggagaaccagcaacagtcgcggagcagccaccctctattgtggtggagttatatgaccacgatacttatggcgccgatgaattcatgggccggtgcatctgccagccgagtctcgaaaggatgccacgcctcgcatggtttcctttgaccaggggatctcaaccaagtggggagttactcgcaagcttcgaactgatccagagagagaagcccgcgatccaccacataccaggattcgaggtccaggagaccagtcgcattctggacgagtctgaagacacggatctcccttacccgccgccacaaagggaggctaatatttacatggtgccccagaatattaaaccggctcttcagcgaactgctattgaaatccttgcctggggtctgagaaacatgaagagctaccaactagccaatattagcagtccttcactggtggtggaatgtggcggccagaccgttcagagctgcgtgattcggaatcttcgcaagaaccccaattttgacatttgcaccctctttatggaggtgatgttgccccgtgaggagctttactgcccaccaattactgtaaaggtgatcgacaaccgtcagtttggtcgacgacccgtagtgggccagtgcaccatccgatccttggagagctttctgtgtgatccatattcggctgaatcaccttccccgcaggggggcccagacgatgtttcccttctcagtcccggggaagacgtgttgatcgatattgacgacaaagaaccactcatccctattcaggaggaggaatttatcgattggtggagtaagtttttcgccagcatcggtgagagggagaaatgtgggtcttatctggagaaggatttcgataccctgaaggtctatgatacacagctcgaaaatgtggaagcctttgagggcctttccgacttctgcaatacattcaagctttatcggggcaaaacgcaggaggagaccgaggacccgagcgtgataggggagttcaagggcctgtttaagatttatcctcttcccgaggaccctgccatacccatgcctccaaggcagtttcaccagctcgctgcccagggcccccaagagtgtttggtcaggatctacatcgtccgcgccttcggattgcaaccaaaggaccctaacggcaagtgcgacccatatatcaagatctccatcggcaaaaagtccgtgtccgaccaagacaattacattccatgcacattagagcccgtctttgggaagatgttcgagctgacctgcacccttcccttagaaaaggacctgaaaatcaccctgtatgactacgacctgctgagcaaggatgagaaaataggagagaccgtcgtggatctcgaaaataggctcctctctaaatttggagcccgatgtggtctcccgcagacttattgcgttagcggcccgaaccagtggcgcgatcagcttcgccctagccagctgttacacctcttttgccagcagcaccgcgttaaagcccccgtgtatagaaccgatcgcgtgatgttccaggacaaggagtacagcatcgaggagattgaagccggccgcatcccaaatccccacctgggaccagtggaagagcgcctagcattgcacgtgttgcagcagcagggactggtgcccgagcacgtggaatcaaggcccctgtatagtcctctgcaacccgacattgaacagggcaagctgcagatgtgggtcgacctgtttcctaaggccctcggaaggcccggaccgcccttcaacatcacgccgcgtcgggcacggaggttctttctgaggtgcattatctggaacacccgcgatgtgatactggatgacttgtccctgacaggggaaaagatgtctgatatttatgttaagggatggatgatagggttcgaggagcataaacagaagaccgacgtgcattatcggagccttggcggtgagggcaactttaattggcgtttcatctttccctttgactatctgcctgctgagcaggtctgtacgatagcaaagaaagatgccttttggcggctggacaaaaccgagagcaagatccccgccagagtcgtgttccagatctgggacaatgacaagttttctttcgacgactttctgggttctctgcaactcgacctgaataggatgcctaagcctgctaagaccgccaagaagtgcagcctggatcagctggatgatgccttccaccccgaatggttcgtgagcctgttcgaacagaagaccgttaaaggctggtggccatgtgtggccgaagaaggcgaaaagaaaatcctggccggaaagcttgagatgaccctcgagatcgtggccgagagcgagcatgaggaacggccagccggccagggccgggatgaaccaaatatgaatcccaagctcgaggatccgcgcagacctgatacgtcctttctttggttcacctctccgtataagactatgaagttcatcctgtggcgccgatttcgttgggccataatcctctttattattctattcattcttcttctcttcctcgcgatcttcatatatgcctttccaaactatgctgctatgaagctcgtaaaacccttcagc

SEQ ID NO: 10672 - DNA, 6243 bp, Artificial Sequence
  Description of Artificial Sequence: Synthetic coding sequence
atgttgtgctgtctccttgtgagggcctcaaatcttccctccgcaaaaaaggaccgtcggtctgacccggtggcctcactgacgtttagaggggtgaaaaagaggacaaaagtcatcaagaactcagtcaacccagtgtggaacgagggttttgagtgggacctgaaggggattccattagatcagggctctgagctgcatgttgtggtgaaagaccatgagaccatgggacggaataggttccttggagaagcgaaggtcccgttgcgagaggtgctggccacaccctcgctgtcagcttcctttaacgctccgctgctagatacaaaaaagcagccaaccggggcatcattggtcttgcaggtctcttacacaccgctgccgggtgcagtccctctcttcccaccgcccactcccctggagccatctcccactcttccagatcttgatgtggtagctgataccggcggagaggaggacacagaagatcagggcctgactggtgatgaagcggagccttttctagaccagtccgggggcccaggtgcgcctaccactccccggaagctccccagccggcctccgccgcactaccccggcatcaaaagaaagcgtagcgcaccgactagcaggaagttgctttctgacaaaccccaggattttcaaattagggtgcaggtaatcgagggaaggcaactgcctggcgtcaatatcaagcccgtcgttaaggtcacggctgctggccagaccaagcggacccgaatccataaagggaattcacccttatttaacgaaacattgtttttcaacctgttcgacagtcccggtgagcttttcgacgagccaattttcataacagtcgttgactcaaggagcctacggacagacgcgctccttggagaatttcgcatggacgtaggcactatatatagagagcctcgccacgcttatttaaggaagtggttactgctttctgaccccgacgacttctcagcaggcgctagggggtacttgaaaacttccctgtgtgttttggggcccggcgacgaagctccactcgaaaggaaggatccgtcagaagacaaagaggacatcgaaagcaaccttctcaggccgacaggcgtcgcgctgaggggggctcatttctgcctgaaggtttttcgtgctgaggacctgcctcagatggatgatgccgtcatggataatgtaaagcagatattcggtttcgagagcaacaaaaaaaacctagtggaccctttcgttgaagtgtcctttgccgggaagatgctgtgttcaaagatcctcgaaaagactgcaaatccccaatggaatcaaaatataacacttcccgccatgttccccagtatgtgcgagaaaatgagaatccgcatcatcgattgggatagactgacccacaacgatatcgttgctacgacctacctatccatgagcaagatctccgccccaggcggtgagattgaagaggagcctgcaggtgctgttaaaccgtccaaggcctctgacctggatgactatctgggatttctgcccactttcgggccctgttacataaacctgtatgggtcaccccgcgagttcaccggctttcccgacccctacactgaactcaataccgggaaaggtgagggcgtggcgtataggggcaggctcctgctgtctcttgaaacgaaactggtggagcactcagaacagaaagtcgaagaccttcctgccgacgacatcctgcgcgtggaaaagtacctcaggcgcaggaagtattctttgttcgctgctttttactccgccactatgcttcaggacgttgacgatgcaatacagttcgaggtgtccatcggaaattacggaaacaaatttgacatgacctgtttgccactggcatccactactcagtacagtcgggccgttttcgacggttgccactactactacctcccctggggcaacgtgaaaccggtcgtggtcctgagcagctactgggaggatattagccaccggattgagacacagaaccagctgttagggatagccgatcgcctggaggcagggcttgaacaggtgcatctggcgttaaaggcacagtgcagcactgaggacgtggatagtttggtagctcagctgacggatgaactgattgctgggtgcagccaacctctcggagacatccatgaaactccttcagctacacacttagaccagtatctgtatcagcttcggacacaccacctctcacaaatcacagaggccgctctagctctgaagctgggtcactccgaactcccagctgccctcgaacaggcagaggactggctgttaagactcagggcgctggccgaagagccccaaaatagcttgcccgatattgtaatctggatgttgcagggcgacaagcgagtggcatatcaacgagtaccggctcatcaggtgctgttcagccgcaggggcgccaactattgtggcaagaactgcggtaagttgcagacgattttcttaaagtatcccatggagaaggtgccaggcgcgcggatgcctgtccagatccgggtcaagctatggttcgggctctctgtcgatgaaaaggaattcaatcagttcgctgagggaaaactgagtgtctttgcggaaacttatgagaatgagacaaagcttgcgctcgtgggcaactggggcaccaccggcttaacatatccaaagttcagcgacgtgacgggcaaaattaagctacccaaggattcattccggccttccgccggatggacatgggccggcgactggttcgtgtgtcctgagaagacgctgctccacgacatggacgccggacatctctctttcgttgaagaggtcttcgaaaaccagaccagactgcccggaggacagtggatttatatgtctgataattacactgacgttaacggcgaaaaggtgctccctaaagacgatatcgagtgtccattgggatggaaatgggaggatgaagagtggtccacggacttgaaccgcgctgtcgacgaacagggatgggaatattccattaccattccccctgagcggaagccaaaacattgggtgcctgcggagaagatgtactatacccataggcggcgccgctgggtgagattgcggcggagggacctgtcacagatggaggcccttaaaaggcatcgccaggccgaagccgaaggggaagggtgggagtacgcatcactcttcggatggaagtttcaccttgaataccgtaagaccgacgcctttagacgccggcgctggagaagaagaatggagccactcgaaaaaaccggccctgccgcagttttcgcactcgaaggggccttaggcggcgtgatggatgataaatctgaggactctatgagtgtgtcgactctgtcgtttggtgtaaatcgcccaacgatcagctgtatctttgattacgggaatagatatcacctcaggtgctatatgtatcaggccagagatttggccgctatggataaggacagcttctcggacccatacgccatagtgagctttctccaccagtcgcaaaaaactgtggtagtcaagaatacgttgaatcccacatgggaccagaccctgattttctatgagattgaaatcttcggagagcctgcaactgtagccgagcagccacctagtatcgtggtggagctgtacgaccatgatacctatggcgccgatgaatttatgggacgttgcatttgccaacctagcttggagagaatgccaaggctggcctggttcccgttaacgcggggctctcaaccctccggagaacttctggcctcattcgaactgatacagcgcgagaaaccggcaattcatcatatccccggctttgaggtccaggagacaagccgtatcctagatgagtctgaggatacagacttgccctatccaccccctcagcgggaggctaatatatacatggtccctcagaatataaaacctgcacttcagaggactgccattgaaatacttgcttggggcttgcggaacatgaaatcctatcaattggctaacattagttccccatctctggtagtggagtgcggaggacaaacagtgcagagttgtgtgatcaggaacctgcgtaaaaacccaaacttcgatatttgcacactctttatggaagtaatgctcccccgggaggagctatattgtcccccaatcactgttaaggtcatcgacaatcgccagttcggacggcggccagtcgtggggcagtgtacgattaggagtttggagtcatttctgtgcgacccgtattctgcagagtcaccgagccctcaaggcggcccagatgatgtcagcctcttatctccaggggaggacgtgctgatcgacatcgacgataaagagcccctgattcctattcaggaagaagaatttattgattggtggtctaagttttttgcttccatcggggagcgagagaagtgcggtagctacttggagaaagacttcgatacgctgaaggtgtacgacacgcaactcgagaacgtcgaggcctttgagggtctctcagacttttgtaatacgttcaaactttatagaggcaagacccaggaggagaccgaggatccgtccgtcattggtgagtttaagggtctgttcaaaatctatcctctccctgaagaccccgcaatccctatgccgccaaggcagtttcatcagttagccgcccaaggccctcaggagtgtttggtccgcatctacatagtgagagccttcgggctgcagccgaaggacccaaatggcaaatgcgacccttacattaaaatcagtatagggaagaaaagtgtgagtgaccaagacaattacatcccctgcaccttggagcctgtgtttggaaagatgttcgagctcacctgtactcttcctcttgagaaggatctgaagatcacactttacgattatgacttgctgtctaaagacgagaagatcggcgaaacggtagtcgatctagagaatcggttgcttagcaagttcggagcgcggtgcgggctacctcagacatactgcgtctctgggcctaatcaatggcgcgatcagctaaggccatctcagctattgcatctgttttgccagcagcatcgagtgaaggcccctgtgtaccggactgatcgtgtgatgtttcaagataaagaatattccatcgaggagatcgaagcagggagaataccgaacccccacttgggcccagttgaagaacgcctggcactccacgtcctccaacaacagggtctggtaccagagcacgtggaatcaagaccactctactcccccctgcaaccggacatagaacaaggaaagctccagatgtgggtggacctatttcctaaggccttgggccggccagggcctccttttaacattacaccgcggcgcgcccgccggtttttcttgcgctgcataatttggaatacaagggacgtgatcctcgacgatctgagccttacaggcgagaaaatgtccgatatctatgtaaaaggatggatgatcgggtttgaggagcacaaacaaaagactgatgtccactatagatccctgggcggagaagggaattttaactggcgtttcatctttccattcgactatctgcccgcggaacaagtttgtacaatcgcaaagaaggacgccttctggcggctggacaagacagaaagtaaaatacccgcccgtgtggtgttccagatctgggacaacgataagtttagttttgatgacttcctgggctcactgcagttggatttgaacaggatgccaaagccagccaagacagctaaaaagtgttccctcgaccaacttgacgatgcattccaccccgagtggtttgtctcgctcttcgaacagaaaacagtgaagggttggtggccctgtgtggccgaggagggagaaaagaaaatactggccggtaagttggaaatgactctggaaattgttgctgagtccgaacatgaagaaaggccagccggacaaggacgcgacgagccaaacatgaaccccaagctggaagatccgagacgtccagacaccagcttcctctggtttacttcaccttacaagaccatgaaatttatcctgtggcgcaggttccgctgggctattatcctgttcatcattctgtttattctgctgctgttccttgccatttttatttatgcattccctaattatgctgcaatgaagctggttaaaccattttca

SEQ ID NO: 10673 - DNA, 6243 bp, Artificial Sequence
  Description of Artificial Sequence: Synthetic coding sequence
atgctgtgctgcctgcttgtgcgtgctagtaacctgccgtcggcgaagaaagatcgcagatcggaccctgtggccagcctgaccttcaggggggtcaagaaaagaactaaagtgatcaagaactcggtcaacccagtgtggaatgagggattcgagtgggatctgaaagggatcccacttgaccagggcagtgaactgcacgtggttgtcaaggaccatgaaacgatggggcggaacagattcctgggtgaagcgaaggtgcccctgcgcgaagtgctcgctacgccatccctctccgcgtccttcaatgccccgcttctggacaccaagaagcagccaacgggcgcttccttggtgctgcaggtgtcttacaccccactgccgggtgcggtcccgcttttcccgccgcctacgcctctggagccgtcccccaccttgcctgacctcgacgtggtggccgacactggcggagaggaagatacggaagatcagggtctgaccggagacgaagccgagccgttcctcgatcagtcaggcggaccgggcgcacctactacccctagaaaactgccgtcccgcccgccaccacactacccgggaatcaaaaggaagagatccgctccgacttcacggaagctcctgtcagataagccccaggactttcaaatcagagtccaagtgatcgaaggacgccagctccctggtgtgaacatcaagcccgtcgtcaaggtgaccgccgcaggacagaccaagagaacccggattcacaaaggtaattcccccttgttcaacgaaaccctgtttttcaatttgttcgattccccaggagaactgttcgacgaaccgatctttatcaccgtggtcgacagcagatcgctgaggactgacgctctgctgggagaatttaggatggatgtgggaaccatttacagggagccgcgccacgcctacctcagaaagtggcttctgctgtccgaccctgacgacttcagcgccggagcccgcggataccttaaaacctcgctctgcgtgctgggtccaggcgacgaggccccgctggaacggaaagaccccagcgaagataaagaggacatcgaatccaaccttctccgcccgaccggtgttgcactgcggggagcgcatttctgtctgaaggtgttcagagcggaagatctcccacaaatggatgacgccgtgatggacaatgtcaagcaaatcttcggatttgaatcgaacaagaagaatctcgtcgacccatttgttgaagtctcgttcgcgggcaagatgctgtgttctaagatactggaaaagactgctaatccacagtggaaccagaacatcactctccccgcgatgtttccatctatgtgcgaaaagatgcggatccggattatcgattgggaccggcttacccacaacgatatcgtggccaccacttacttgtctatgagcaaaatcagcgccccgggaggagaaatcgaagaggagcctgctggcgcggtcaagccctcaaaggcttcagaccttgatgattacctggggttcctcccgacttttggaccgtgctacatcaatctgtacggaagcccacgggaattcaccggatttccggatccgtacactgaattgaacaccgggaaaggtgagggagttgcctaccgggggagactgctgctgtcactcgagactaagctggtcgaacattcggagcaaaaagtggaggacttgccggccgacgatatcctgcgcgtcgaaaagtacctccgcaggcggaagtactcactgttcgccgccttctactccgcaactatgctgcaggatgtggatgacgccatccagttcgaagtgtccatcggcaattacggcaataagttcgacatgacctgcctgcctctggcatcgacgacccagtacagccgggcagtgttcgacggatgtcattactactacttgccgtgggggaacgtgaagccggtcgtggtgttgtcatcatactgggaagatatttctcaccggatcgagactcagaaccaactgctcggaatcgccgatagactggaggcgggcctcgagcaggtccacctggcgctgaaggcccaatgctccacggaggatgtggatagcctggtggcacagctcactgatgagctcattgcagggtgctctcagccgctgggagacatccacgaaactccttcggcgactcacttggaccaatacctctaccaacttcgcactcaccatttgtcccaaattactgaggctgccctggccctgaagctgggacactccgaactcccggccgctctggaacaggccgaggactggttgctgcggttgcgggccctggccgaagaaccgcaaaattcactcccggacatcgtgatctggatgctgcagggagacaagcgcgtggcttaccagcgcgttccggcacaccaggtgctgttcagtagacggggagcaaactactgcggtaagaactgtggaaaactccagactatcttccttaagtaccctatggaaaaggtcccaggagcaaggatgcctgtgcagattagagtgaaactttggttcggactgtcggttgacgagaaggagtttaaccaattcgccgagggaaagctcagcgtttttgccgaaacttacgagaatgaaactaagctcgctctggtcgggaattggggaaccacgggactcacgtacccaaagtttagcgacgtgaccggtaaaatcaagctgccaaaggattcgttccgcccttcagcaggatggacttgggcaggggattggttcgtctgcccagaaaagactctcctccacgatatggatgcgggacacctgagttttgtggaggaagtgttcgagaaccaaactcgactgccgggcggacagtggatctacatgtcggataactacactgatgtgaatggtgaaaaggtgctgccgaaagacgacatcgaatgcccgctcggctggaaatgggaggatgaagagtggtccaccgaccttaacagagccgtggacgaacagggttgggagtactcgatcaccatcccgccggagcggaagccgaaacattgggtcccggccgagaaaatgtactacactcacagacggcgccgctgggtgaggttgcgccgcagagatctttcccagatggaggcgttgaaacgccaccgccaagcagaagcggaaggagaggggtgggaatacgcatccctcttcggatggaagtttcacctcgagtatagaaaaaccgacgcgttccgtcggcggagatggcgccgccgcatggaacccctggaaaagacgggcccggccgcggtattcgctctcgaaggagccttgggaggcgtgatggacgacaagtccgaagattcaatgtcggtgtcgactctgtcgttcggcgtgaacaggcccaccatctcgtgcattttcgactacgggaatcggtaccacctcaggtgctacatgtatcaagcccgggacctcgctgcgatggataaagactccttttcggacccgtacgcaatagtctccttcctgcatcagagccaaaagactgtcgtggtcaagaacaccctgaatccgacttgggaccagactctgatcttctacgagatcgagatatttggtgaaccggccactgttgctgagcaaccaccgtccatcgtcgtcgaactgtacgatcatgacacctacggcgcggacgagttcatgggtaggtgtatttgtcagcctagcctggaacggatgccgcggctggcttggttcccgctgactcgcgggtcgcaaccgagcggagaactgctcgcttcctttgagctgatccagcgggaaaagcccgcgattcatcacatcccgggtttcgaagtacaggagacttccaggatcctcgatgagtccgaggataccgatctgccctacccaccgccgcagcgcgaagctaatatctatatggtcccacagaacatcaaaccggccctccagcgcacggcgatcgaaatcctcgcttggggactgcgaaatatgaagtcctaccaactggccaacatctcctccccttcgctcgtggtggaatgcggcggacagactgttcaatcctgcgtgatcagaaatctgcgaaagaaccctaatttcgacatttgcactttgtttatggaagtcatgctgccccgggaagagttgtactgccctcctatcaccgtcaaagtcatcgacaaccggcaattcggtcgccggccggtggttggccagtgtaccatcaggtcgctggaatcgtttctttgcgacccatacagcgcagaatcccccagcccgcagggcgggcctgatgatgtgtcgctgctctcacctggggaagatgtgttgattgatatcgatgacaaagaaccgctgattccgattcaggaagaggagttcatcgactggtggagcaagttcttcgcgtccattggcgaaagagaaaagtgcggatcatacctcgaaaaggatttcgacacgctgaaggtgtacgacactcaacttgagaacgtcgaagccttcgaagggctttccgatttctgtaacacttttaagctgtaccggggcaagacccaagaagagactgaagatccatccgtgatcggagagttcaagggcctgttcaagatctaccccctgcccgaagatccggctatccctatgccaccacgccaattccaccaattggccgcgcaaggcccgcaggaatgcctggtgagaatctacatcgtgcgggcattcggacttcagcctaaggatccgaacggaaagtgtgacccctacatcaagatctcgatcgggaaaaagtcagtctccgaccaagacaactacatcccctgtactttggagcctgtgttcggcaagatgttcgaactgacctgcactttgcccctcgagaaagacctgaagatcaccctgtacgattatgatctcctgtcgaaagatgaaaagatcggagagacggttgtggacctggagaaccgcctgttgtcgaaattcggagcccgctgcggactcccacagacgtactgcgtgtccggaccgaatcagtggagggatcagctccggcctagccaactgttgcacctgttctgtcagcagcacagagtcaaggctcctgtgtaccggactgatcgcgtgatgttccaggacaaagagtactcaatcgaagaaatcgaagcgggtagaatcccgaatcctcacctgggccccgtggaagaacgcttggccctccatgtgctgcagcaacagggacttgtgccggaacacgttgaaagcagaccactgtactcgccgctccagccagacatcgaacaaggcaagctccaaatgtgggtggatttgttcccgaaggccctggggcgcccagggccccccttcaacatcactcctcgcagagccagacgattctttcttcggtgcatcatctggaacactagggatgtcatccttgacgacctgagccttaccggagagaaaatgtccgacatttacgtcaagggttggatgatcggattcgaagagcataagcaaaagaccgacgtgcactaccggtcgctcggaggagaaggcaacttcaactggagatttatctttcctttcgactacctcccggccgagcaggtgtgcaccatcgcgaagaaggacgcgttctggcgcctggacaaaactgagagcaagattcctgcacgcgtggtgtttcaaatctgggacaacgataagttctcgttcgatgacttcttgggttccctgcaactggatcttaataggatgccaaaacctgctaagactgctaaaaagtgctccctggaccagctggacgacgccttccatccggagtggttcgtgagcttgttcgagcagaaaactgtgaagggatggtggccgtgcgtggcggaagagggcgagaagaagatcctggccggaaaactggaaatgactctcgaaatcgtggcggaatccgaacatgaagagcggcctgcggggcagggaagggatgaaccaaacatgaatccgaagctggaagatccccggaggccagacacttcgttcctctggttcacttccccatacaaaaccatgaagtttattctctggcgtagatttagatgggcgatcatccttttcattattctgttcatcctgctgctcttccttgcaatcttcatctacgcgtttcccaactacgcggcaatgaagctggtgaaacctttcagc

SEQ ID NO: 10674 - DNA, 6243 bp, Artificial Sequence
  Description of Artificial Sequence: Synthetic coding sequence
atgctctgctgccttctggtgcgcgcttccaacctgccttctgcaaaaaaggatcggagaagcgatccagtcgcgagcctgacttttcggggggtcaagaagagaacaaaggttatcaagaattcagttaatcccgtgtggaatgaggggtttgagtgggatctgaagggtattcctctggaccaggggtctgagctccacgtcgtcgtgaaggatcatgaaacaatgggtaggaacagatttctgggtgaggccaaggtgccgcttagggaggtcctggcgactccatctcttagcgctagctttaacgctcctcttctggacaccaagaagcagcctacaggtgcgtcactggtgctgcaggtcagttacactcccctgccaggagccgtacccctctttccacctccaacccccctggaacccagcccgacactgcccgacctcgacgtggtagccgacacaggtggggaggaagatacggaggatcagggcctcaccggagacgaggccgagccattcctggatcaatccggcgggccaggggctcccactacccctcggaagctccccagtagaccaccccctcattatccaggaataaagcgaaagcggagcgcacccacctctaggaagcttttgtccgataagccccaggacttccagataagggtgcaggtgattgagggccggcagctgccaggcgtgaacataaagcccgtggtgaaggtgaccgcagctggccaaacgaaacgcacgcgcatacacaagggcaattctcctctgtttaacgaaacgctgttctttaacctgttcgatagccctggcgaactgttcgatgagcccatcttcatcacagtcgtcgactctcggagccttaggacagacgccctcttgggtgagttccggatggacgttggtaccatctatagggagcctcgccatgcatacttgcgaaagtggctgctcctgagcgacccagacgatttttctgcaggcgcacggggttacctcaaaacctccctgtgcgtactgggtcctggcgacgaagcgcctcttgagagaaaagaccccagtgaagataaggaagacatcgaatctaatctgctgcggccaaccggggtggctctgcgcggtgcacatttttgtctgaaggtattcagggccgaagacttgccacagatggacgatgccgtcatggataatgtcaagcagatattcgggttcgagtccaataaaaagaatctggtcgacccatttgtagaagtctcttttgcagggaagatgctttgcagtaagattctggagaagacagctaaccctcagtggaaccaaaatatcacccttcccgcgatgtttccaagtatgtgtgaaaaaatgcgaatccggatcatcgactgggatcggctgacgcacaacgatatagtggctacgacatacctgagcatgagcaagatttctgcacccggaggggaaatcgaggaggagcctgccggggctgttaagcccagcaaggcatccgacctggacgattacctcgggtttctgccgacattcggcccctgctatatcaatctgtacgggtcacctagagaattcaccggctttcctgacccctacactgagctcaacactgggaagggggaaggggtggcataccgcggccggcttctgctctctctcgagactaagctggtggaacacagtgagcaaaaagtggaagacctccccgccgatgacatccttagggttgagaaatatctgaggagaagaaagtacagcctgtttgccgccttctacagtgccactatgctccaggatgtcgacgatgcgatccagtttgaagtgtcaattggcaactatgggaataaatttgatatgacctgcctgcctttggcatcaacgacacagtacagccgggctgtgttcgacggatgccactattattatctgccctgggggaatgtaaaacctgtggtcgtgttgtcctcctattgggaggatatttcacatagaatcgagacacagaaccagctcctcggaattgctgatagattggaggctggccttgagcaagtgcatctggccctgaaagctcagtgctccaccgaagacgtcgacagcttggtggcccagttgactgatgagttgatagccgggtgtagtcagccactgggcgatattcacgaaacccctagcgccacccaccttgaccagtacctgtaccagctgaggactcatcacctgtcccaaattaccgaggcagctctggcccttaaactgggtcacagcgagctgcccgctgccctggaacaggccgaggattggctgttgcgactgcgagccctcgcggaagaacctcagaattcactgcccgatattgtgatttggatgttgcagggggataaacgggtcgcctatcagcgggtccccgcgcaccaagtactcttttcacggcggggagcaaattattgtgggaaaaattgtgggaaactgcagaccatttttcttaagtatccaatggaaaaagtccccggcgcccggatgccggtgcagatccgcgtgaagttgtggtttgggctttcagtggacgaaaaggaattcaaccagtttgctgaaggcaagttgtctgtgttcgccgagacctatgaaaacgaaacaaaactcgccctcgtgggaaattgggggacgacgggccttacttaccccaagttctccgatgtgacaggcaagataaagctgcccaaagattccttcaggccgagtgccggttggacatgggctggagactggttcgtgtgcccagaaaaaacattgctgcacgatatggatgcggggcatctgtcttttgttgaggaggtcttcgagaatcaaactcgccttcccggaggtcagtggatttacatgtccgacaactacaccgacgtcaacggtgagaaggttctgccaaaagacgatatcgaatgccccctgggctggaagtgggaagatgaggagtggagtacagatctgaaccgggcagtcgacgagcagggttgggagtattctattactattcctccggaacggaagccaaaacactgggtcccagctgagaagatgtattacacccacagacggcgccgctgggttcggcttagaaggagagacttgagtcagatggaggcccttaaacggcacaggcaggctgaagccgaaggcgagggctgggaatacgcttctctgttcggctggaagttccaccttgaataccggaagacagatgcttttcggcgcagacgctggaggagacggatggaaccgctggagaagaccggccccgcggccgtgttcgcacttgaaggagctctgggcggagtgatggatgacaagagcgaggacagcatgagtgtgtcaaccctgagctttggggtcaaccggcccacgatcagttgtatttttgactacggaaatagatatcacctcagatgctacatgtatcaggcccgggatctggcagccatggacaaagactccttttcagacccctacgccatcgtgtcctttctgcaccaatctcagaagacagtggtcgtcaaaaatacgctcaaccctacgtgggatcagacactcattttctatgagatagagatctttggggagcctgctaccgttgcagaacagcctccctctatcgtcgtggagctgtatgatcacgatacttatggagcagacgagttcatgggtcggtgtatctgtcagccttccctcgagcggatgccccgactggcctggtttccactgacccgggggtcccagcctagcggcgagctccttgcaagctttgagctgattcagcgagagaagcccgccatccaccacataccggggtttgaagtgcaggagaccagtcgcattctcgatgagtctgaggatacagatctgccctaccctcccccccagcgcgaggctaatatctacatggttccccagaacatcaagcccgccctgcaacggaccgcgatcgagattctggcatggggtctgcgcaacatgaagtcctaccagctggccaatatatcttcccccagcctggtcgtcgagtgcgggggacagactgtgcagagctgcgtcatccgaaacctccgcaagaatcccaacttcgatatttgtaccctgtttatggaagttatgcttccacgcgaggagctgtactgtccaccgattaccgtaaaggtgatcgataatcggcagtttggacggaggcccgtggtgggacaatgcactatcaggagtttggagtcctttctctgcgatccctacagcgctgagagcccttccccccagggtgggccagacgacgtgtccctcctgtctcccggagaagatgtgctgatcgacatcgatgataaggagcccctgattcctatacaggaagaggagtttattgattggtggtctaagttcttcgccagcatcggagagcgggaaaagtgtggcagctacctcgagaaggattttgatacgcttaaagtgtacgatacccaactggaaaacgtggaagcgttcgaaggacttagcgacttttgtaacaccttcaagctctacagaggtaagacccaggaggagactgaggatccctccgtgattggcgaatttaagggactgtttaaaatttacccccttcccgaggatcctgccattcccatgccacccaggcagttccaccagttggccgcgcaggggccgcaagagtgtcttgtgcgcatctacatagtgcgcgctttcggcctgcagccaaaggacccaaacggaaaatgtgatccatacatcaaaattagcattggcaagaaatcagtttctgatcaggataactatattccatgcacgctggaacctgtcttcggaaaaatgttcgagcttacgtgcaccctgccgttggaaaaagacctgaagattaccttgtacgattatgatctgctgtccaaggacgagaagattggagaaacggttgtagacttggaaaaccggctgttgtccaaattcggagctaggtgtggattgccccagacctactgtgtatccggtcccaatcagtggagagaccaacttcgaccgagtcagttgcttcacctgttctgccagcagcatagagtgaaggccccagtgtatcggactgatagggtgatgttccaggacaaggagtattcaatcgaggaaatcgaggctggaagaatccctaaccctcatttgggtcccgtagaggagaggttggcacttcatgttttgcaacagcagggattggttccagagcatgtggagtccaggccactctattcccctctgcagcctgacattgagcagggcaagttgcagatgtgggttgatcttttcccaaaagccctgggtcgcccgggccccccgtttaatattacacctaggcgcgcaagaaggttctttctgagatgtattatatggaatacccgcgacgtcatcctcgatgatctgtcactgactggcgaaaagatgtctgatatttatgtaaagggatggatgatcggttttgaagagcacaagcaaaaaacagacgtgcactacagaagcctgggtggtgaaggaaacttcaattggcggttcatctttcccttcgactacttgcctgccgaacaggtctgcacaatcgcaaaaaaggacgccttctggaggctggacaaaaccgagagcaagatcccagctcgggtagttttccaaatttgggataacgataagttcagttttgacgatttcctgggaagcctgcagcttgacctcaatcgaatgccaaagcctgccaaaaccgcaaaaaagtgttccctcgaccagctggatgatgcttttcaccctgagtggtttgtgagcctttttgaacagaagacagtgaagggctggtggccttgtgtggccgaagaaggagagaagaaaatcctggcaggtaagcttgaaatgacattggaaatcgtagcggagagcgaacacgaggagcgaccagctggtcagggacgggatgaacctaatatgaatccaaagctcgaagacccgcgccgacctgatacctcttttctgtggttcacctccccctacaagaccatgaaatttattttgtggcgaagatttcggtgggcaattatcctctttattattctgttcattctgctgctcttcctggcgattttcatctacgcatttccaaactatgccgccatgaaattggtcaagccattcagt

SEQ ID NO: 10675 - DNA, 6243 bp, Artificial Sequence
  Description of Artificial Sequence: Synthetic coding sequence
atgttgtgctgcctccttgtccgtgcatccaatcttcccagcgctaagaaggaccggcgtagcgatcccgtggcgagtctaacctttcgaggagtgaagaagcggaccaaggtgataaaaaacagtgtgaaccccgtgtggaacgaaggattcgagtgggacctaaaaggaatcccactcgaccagggatcagagttacatgtagtggtgaaagaccatgagaccatggggcggaatcgcttcctgggggaggcgaaggtgcccctccgggaagtgctggctactcccagcctgagcgccagtttcaacgctccactactggatacaaagaagcagccaactggagcttccctagtgctacaagtgtcttataccccccttcccggagctgtgccactttttcctccacccactcccttggagccttctccgacgcttccagatctggatgtggtcgccgatacggggggagaggaggataccgaagaccaggggttgactggcgacgaggcagagccgttcctcgatcagtctgggggtcccggggcccctacaacaccccgaaaactcccaagccgaccccccccccactatcctggcatcaagaggaagcggagcgctcccacatccagaaagcttctatccgataaaccacaggatttccagattcgggtccaggtgatcgaagggcgtcagctgcctggagtcaatattaagcctgtggttaaagttaccgcagccggtcagacaaaaagaacccgtatacataaggggaattccccgctcttcaatgagaccttgttctttaatttgttcgacagccccggcgagctgttcgacgagccaatctttatcacagtcgtggacagtcgatcgctcagaactgacgcgctgctaggggagtttcgaatggatgtgggtaccatataccgcgagccgcggcatgcttacctgagaaaatggttgttgttgtctgacccagatgatttctcggctggtgcccgggggtacctgaagactagcctttgtgtgcttgggcccggcgacgaagcacccctggagaggaaggatcccagtgaagacaaggaagacatcgagtcaaacctcctgaggccaaccggggtggctcttagaggtgcccacttttgtctgaaggtttttagagcggaggacttgccgcaaatggacgacgcggtgatggacaacgttaagcagatattcgggttcgagtcgaacaagaagaatctcgtggacccttttgttgaggtgagtttcgcgggaaaaatgctttgcagcaaaattctcgagaaaactgctaacccacagtggaatcagaacataacattaccggccatgttcccttccatgtgtgagaagatgagaattcgtataatcgattgggaccgcctaacccacaatgatatagtggcgacaacctacttgtccatgagcaaaatctccgcccctggaggcgagatcgaggaggaacctgccggggccgtaaagcccagcaaagcttccgatcttgacgattacttgggcttcctgcccacttttggtccttgttatatcaatctgtacggctcaccccgcgagtttaccgggtttcccgacccttacaccgaactaaacactggcaaaggggagggcgtggcctaccgcggaagactcctcctcagcctagagaccaagctcgtcgaacactctgagcagaaagtcgaagaccttcctgccgacgatatcctcagagtggagaagtacctgcggagacggaaatactccctgttcgctgccttctattcagctacaatgttacaggatgtcgatgatgccattcaattcgaggtgagcatcggcaactatggcaataaattcgacatgacttgcctgcccctcgcttctaccacccagtatagccgcgcagtgttcgacggatgtcactattattatcttccatgggggaacgtcaaaccagtggtggtcctgtcttcatactgggaggacataagtcatcggatcgaaacacagaaccaactgctgggcatagctgacaggctcgaagccggcctggagcaagtgcatctcgccttgaaagctcagtgctcgacagaggacgtggattctctcgttgctcaactgaccgatgaactgatcgccggatgctcacagcccctgggagatatacatgaaacacccagcgcaacacaccttgaccaatatctgtaccaactacgcacacaccacctgagccagattaccgaggcagcattggcccttaaactaggccacagcgaacttccggccgctctggagcaggcagaggactggttgttgcgacttagggccctagccgaagagccccagaacagtttgccagacattgttatctggatgctacagggggacaaacgagtggcataccagcgcgtgcctgcccatcaagtcttgttctccaggagaggagccaactactgcgggaagaattgtggaaagctccaaacaatattccttaaataccccatggagaaggttcctggagctcgaatgcctgtccagatccgggtgaaactgtggtttggcttgtctgtggacgaaaaagaattcaatcagtttgcggaaggaaagttgtccgtcttcgcagaaacctacgagaacgaaacaaagttggctctggtaggcaactgggggacaacagggctgacatatcctaagttctcggatgtgactggcaagatcaagttaccaaaagattcgtttagaccaagcgcaggatggacatgggccggcgattggtttgtgtgccccgaaaagacactcttgcacgatatggatgctgggcatctgtccttcgtggaggaggtgtttgagaatcagaccagactccctggcggccagtggatttacatgtccgacaactacaccgacgtaaacggcgagaaggtgttgcccaaagacgacatagaatgccctctgggctggaagtgggaggatgaggagtggagcaccgatctgaaccgtgctgtggatgagcaaggctgggagtattctataaccatcccgcccgagcgtaaaccaaaacactgggtccccgcagaaaagatgtactacacccatcgccggcggcgctgggtccgcttacggcggcgagatctctcccagatggaagccctaaagaggcatcggcaggccgaagctgagggtgagggatgggaatatgcatccctatttgggtggaagttccacctggagtatcgcaaaaccgatgcgttcaggcggagaaggtggagacgccggatggaacccttagaaaagacaggcccggctgcggtctttgcgctggagggcgctctggggggagtcatggatgataaatccgaggactctatgagtgtttcaaccctgtcctttggggttaacaggccaacgatcagctgtattttcgactatggcaatcgctaccacctacgatgttatatgtaccaggctcgcgatttagccgcgatggacaaggactcgttcagcgacccctacgccattgtttctttcctgcatcagagccagaaaacggttgtggtgaaaaataccctaaatccgacgtgggatcaaactctcatcttctatgagatcgagatcttcggggagcccgcgaccgtagcagaacagccacccagtatagtggtggaactttacgatcatgacacttacggcgccgatgagtttatgggccggtgtatctgccaaccgtcactcgaaagaatgccacgcctcgcgtggtttccccttacaagaggatctcagccctccggagagcttctcgcatcatttgagttgattcagcgggagaaacctgcaattcatcacattcctggtttcgaagtacaggaaacctcacgtattctggacgagtccgaggataccgaccttccctacccaccaccccagagggaggccaatatctatatggtcccgcagaatatcaaacctgcacttcagcgaacagctattgaaattttagcatgggggttacgaaacatgaaatcataccaactcgcgaacatcagctctccgagcctggtggtggagtgtggagggcagactgtccagtcttgcgtcattagaaatttacggaagaaccctaatttcgacatatgcaccctgtttatggaagtaatgctaccgcgggaggaactctactgccctcccataacggtgaaagtgatcgacaaccggcagtttgggcgcaggcccgttgtcggccagtgtaccatacggagccttgagtcatttttatgcgatccatattctgcggagtcccccagcccacaaggagggcctgacgatgtgagtctgttgtctccaggagaggacgttttgatcgatattgacgacaaagagcctcttatccctattcaggaagaagagtttatcgactggtggtccaagttctttgcttctatcggcgagcgcgaaaagtgtgggtcataccttgagaaggattttgacactctcaaggtgtatgatacccaactggaaaatgttgaagcattcgaggggctgagtgacttctgtaatacttttaaattataccgtggaaaaactcaggaggagactgaggacccgtccgtgatcggagagttcaaagggttgtttaaaatttaccccctgccggaggatccggctatccccatgccacccaggcagttccatcagttggcagcgcagggcccacaggaatgcctggtacggatctacattgtgagagccttcgggttgcagccaaaggatcctaacgggaaatgcgatccgtacatcaagatctcaatcggtaaaaaaagcgtctccgaccaggataattatatcccttgtaccctcgaaccagtgttcggcaaaatgttcgagctgacctgtaccttacccctggagaaggacctcaagatcaccttatacgactatgacctgttgagtaaggacgagaaaataggggagaccgtggtcgacctcgagaaccggctgctttcaaaattcggggctcggtgtggtcttcctcagacttactgcgtgagtggaccaaatcagtggcgggaccaattgcgccccagccagctgctccacctgttttgtcagcaacatcgggtgaaggccccagtctatcggaccgacagagtgatgtttcaggacaaggaatattcgatcgaggaaattgaggcaggccgcatcccaaaccctcatttggggcccgttgaggagcggctggcacttcacgttctgcagcaacagggtctggtaccagagcatgtggaaagtcgccccctgtacagtcctctgcaaccagatattgagcaaggtaaactccagatgtgggttgacttatttcctaaggccctgggtcggccaggtcctccttttaacattacacccagacgggcacgtagattctttctgcgatgtataatttggaacactcgggatgtcatcctggatgatttatctctcactggagaaaaaatgtctgatatatacgtgaaaggctggatgattgggttcgaggagcataaacagaaaaccgatgttcattacaggtctttgggtggcgagggaaatttcaactggaggttcattttcccgttcgactacctgcccgctgaacaggtgtgtacaattgctaaaaaagacgctttctggaggctggacaagaccgaatcaaaaatcccagcacgggtggtgtttcagatctgggacaacgataagttcagctttgacgacttcctgggcagccttcaactggatcttaatagaatgccaaagccggcaaagacagcaaaaaaatgttcactcgaccagctggatgatgcattccatcctgagtggttcgtctcattgtttgagcaaaagactgtaaaaggttggtggccatgcgtagcggaggagggagaaaaaaagattctcgccggtaagctggaaatgactttggagatcgtggctgagagtgagcacgaggagcggccagcaggacaggggagggatgaacctaacatgaatcccaagctggaggacccgcgccggccggacactagctttctctggtttacatccccctataaaacaatgaagttcatcctatggcgcagatttcgctgggcaatcatcctcttcatcatcttattcatcctcctcttatttttggccattttcatttacgcatttcctaattacgccgctatgaagctggtaaaaccctttagc

SEQ ID NO: 10676 - DNA, 6243 bp, Artificial Sequence
  Description of Artificial Sequence: Synthetic coding sequence
atgctttgctgtctgctggtgcgggcgagcaatctgccgtctgcaaaaaaggatcgtcgttcagacccagtcgccagcttgacctttcggggagtgaaaaagcgaactaaggtgattaagaactccgttaatcctgtgtggaacgagggcttcgaatgggatttgaagggtatccccctcgaccagggatctgagctgcatgtcgtggtgaaggatcacgaaaccatgggccgcaatcggtttctgggagaggccaaggtgccactcagagaagtcctcgcgacgccctccttgtcggcttcatttaacgcaccactgctggatactaagaagcagcctacgggggcttccctggtgctccaagtgagctacaccccgctgcctggagccgtgcctttgttcccgccgcctaccccactcgagcccagccccactctcccagacttggatgtggtggcggacactggcggagaagaagatactgaggaccagggcctgaccggagatgaagcagaaccgttcctggatcaatcaggagggcctggagccccgaccactccgcggaagctgccctcccggcctccgccgcactaccctggcatcaagagaaagcggtccgccccgacgtcacgtaagctcctctcggataagccacaagactttcaaatccgcgtccaggtcatcgagggtaggcaactcccgggtgtgaatatcaaaccagtggtgaaagtgacggccgcgggtcagaccaaacggaccagaatccacaaaggtaactccccgctgttcaacgagactctgtttttcaatctcttcgacagcccgggggaacttttcgacgagccgatcttcatcaccgtggtcgactcaagatccctgagaactgacgctctgcttggagagtttcgaatggacgtgggaaccatatacagggaaccgcggcacgcgtacctgaggaagtggttgctgctgagtgacccggacgatttttcagcgggggctcgcggatatcttaagaccagcttgtgtgtgttggggccaggagacgaggcaccgttggaacgcaaagatccgtccgaagataaggaggacatcgaaagcaacctgctcaggccgactggagtcgccctgcgaggggctcatttctgcctcaaagtctttagagcggaggacctcccacagatggacgatgccgtgatggataacgtgaagcagatcttcggattcgagtcaaacaaaaagaatctcgtggacccgtttgtggaggtgtcctttgccggcaagatgctgtgcagcaaaattctggaaaaaacggcaaatccacaatggaaccagaacattactttgcctgcaatgttcccgtcgatgtgcgagaagatgcggatcagaatcatcgattgggatcggctgacccataacgatatcgtggcgaccacgtaccttagcatgagcaagatctccgctcctggcggagaaatcgaggaggagccggcaggggcggtgaaaccatccaaagcctccgatctggacgattacctgggattcctcccaactttcggaccgtgttacatcaacctgtacggatcgccgagagaattcaccggtttcccagacccgtatactgaactgaataccggcaagggggaaggagtggcttaccgaggccggctcctgctttcgctggaaaccaagctcgtggagcactcagagcaaaaggtggaagatctgccagccgacgatatcttgagagtagagaaatacctccgccgccgaaagtactctttgttcgcagccttctactcggccaccatgctccaggatgtcgacgatgcgatccagtttgaggtttccattgggaactacggaaataagttcgatatgacttgcctgccactggcaagcactactcagtacagtcgggctgtgttcgatggatgccactactactaccttccgtggggaaacgtgaagccagtcgtcgtgctctccagctactgggaggacatttcgcaccgaattgagactcagaaccaattgctgggcatcgcagaccggctggaagccgggctggagcaagtccatctcgcactgaaggcacaatgtagcaccgaggacgtcgactctctcgttgcccaattgaccgacgaactgatcgccggatgtagccagcccctgggggacatccatgaaactccctcggcaactcacctcgatcagtacctgtaccagctgcgcacccaccacctgtcccagatcaccgaagcagccctggcgctgaagctgggtcacagcgaactgccggcagcgctcgagcaggctgaggactggctgctgcggctgagagcgttggccgaagaacctcaaaattccctgccggatatcgtgatttggatgctccagggagacaagcgggtcgcgtaccagcgggtcccggcccatcaggttttgtttagtcgcaggggagccaattactgcggtaaaaactgtggaaagctccaaaccatcttcctgaagtacccaatggagaaggtcccaggcgcccgcatgccggtccagatccgcgtgaagctgtggttcggactctctgtagacgaaaaggagtttaaccagttcgccgagggtaagctgtcggtgttcgctgaaacctacgaaaatgaaaccaagctggctctggtgggaaattggggtactaccggcctgacttacccaaagttctcggacgtgactggaaaaatcaaactccctaaggacagctttagacccagtgccgggtggacttgggctggcgattggttcgtgtgcccagaaaagaccctgctgcatgatatggacgccggccatctgagcttcgtggaagaagtgttcgaaaaccaaactcgcctcccggggggacaatggatttacatgtcagacaactataccgatgtgaatggagaaaaggtgttgccaaaggacgacatcgaatgccctctgggatggaagtgggaggacgaggagtggtcgactgatcttaaccgcgccgtggatgaacagggatgggagtactccattacgatcccgcccgaacgcaagccaaagcactgggtgccggccgagaagatgtactatacccatcgccgtagacgatgggtcaggctgagacgccgcgacctctctcaaatggaggcactgaagcggcaccgccaagcagaagctgagggcgagggatgggaatacgcgtccttgttcggttggaagttccacctggaataccgaaagactgacgcattccgccgccgcaggtggagacggcggatggaacctctggagaaaactggcccagctgcggtgtttgcgttggaaggagccctcggcggagtgatggatgataaatccgaggactcaatgtccgtgtccacccttagcttcggagttaatagacctactataagctgcattttcgactacggaaaccgctaccatctgcggtgctacatgtatcaggctcgggatctcgccgctatggataaggactcatttagtgacccgtacgccatcgtgtccttcctccatcagtcgcaaaagaccgtggtggtcaagaacacgctgaatccaacctgggatcagaccctgatcttttacgaaattgagatcttcggcgaaccggctaccgtggccgaacagccaccatcgatcgtggtggaactctacgaccacgatacttacggtgccgacgaattcatgggtaggtgcatctgtcaaccgtcattggaacggatgcctcgactcgcctggttcccgctgaccagaggtagccaaccgtccggagaactgctggcctccttcgaactgatccagagagaaaagccggccattcatcacattcccggctttgaggtccaggaaacctccaggatcctcgatgagtcggaagatactgacctgccatacccgcccccacagagagaggccaacatctacatggtgcctcaaaacatcaaaccggctttgcagcgcactgcaatcgagattctggcgtggggactgaggaacatgaagtcgtaccaacttgctaacatctcaagcccttcgctggtggtagaatgcggaggccagacggtccagtcgtgcgtgatcagaaaccttcgcaaaaatccgaatttcgacatttgcacccttttcatggaagtcatgctgcctagagaagagctttactgccctcctatcaccgtcaaggtgatcgataaccggcaattcggacggaggcctgtcgtgggacaatgcaccatcaggtcattggagagcttcctctgcgacccttattccgcagaatcgccatccccgcagggtggcccagatgacgtcagcctcctctcccccggcgaggacgtgctgattgacatcgacgacaaagaacccctcatcccaatccaggaggaagaattcatcgactggtggtcgaaattcttcgccagcatcggggaacgggaaaaatgcggctcgtacctggagaaggacttcgatacgctgaaggtctacgacactcagctcgaaaatgtcgaggccttcgaaggactgtcggacttttgtaacactttcaagctgtaccggggaaagacccaagaggaaactgaagatccgtcggtgattggagagttcaagggacttttcaaaatctaccccctgccggaagatccggcaatccccatgccgccacggcagtttcatcagctggccgcccagggaccccaggagtgcctggtccgcatttacatcgtgcgggcgttcggactgcaacccaaggacccgaacgggaaatgtgacccttatatcaaaatcagcatcggcaagaagtcggtgtcggaccaggataactacatcccctgcacccttgaaccagtgttcgggaaaatgttcgaattgacctgcacgctccctttggaaaaagacttgaaaatcaccctctacgactacgatctcctctcgaaggatgagaagatcggtgagactgtggtggacttggaaaaccggctcttgtcaaagttcggtgcgcggtgtggactgcctcagacgtactgcgtgtcaggcccgaatcaatggcgcgaccagctccggccttcacagctccttcacctcttctgtcagcagcaccgggtgaaggcgccggtctaccgaaccgatcgcgtcatgttccaagacaaagaatactcgatcgaagagatcgaggccggacgcatcccaaacccacacctcggccctgtggaggagcgcctggccctgcacgtgctccagcagcagggactcgtcccggagcacgtggaaagccgcccactttactcccctctgcagccggacattgagcagggaaagctgcagatgtgggtggatctgtttccgaaggcactcggccgcccgggaccccctttcaacataacccctagaagggcccgccgcttcttcctgcgatgcatcatctggaacactagggacgtgatcctggacgacctgtcactgaccggcgagaagatgtcggacatctacgtgaaaggatggatgataggattcgaggagcacaagcaaaaaaccgacgtccattaccgttcactgggcggggagggaaactttaactggaggtttatcttcccgttcgactacctgcctgctgagcaggtctgcaccatcgccaaaaaggacgcgttctggcggctggataagaccgaatctaagatcccggctcgcgtagttttccaaatctgggataacgataagttttcattcgatgattttctgggctcgttgcagctggacctgaatcggatgcctaagccggcgaaaacggcaaagaagtgctcccttgatcaactggacgacgcgttccacccggaatggttcgtttcccttttcgagcaaaaaactgtgaagggctggtggccatgcgtcgcagaagaaggagaaaagaagatccttgcgggaaaactcgaaatgactcttgaaatcgtggccgaaagcgaacatgaggagcggccggctggtcaagggagagatgaaccgaatatgaaccccaagctggaggacccccgccgccctgacacttcgttcctttggttcacctcgccgtacaagacgatgaaattcatcctgtggcgcaggttccgctgggccattatactctttatcatcctgtttatactcctcctctttctggccatcttcatttatgcatttccaaattacgcagcgatgaagttggtaaagccattctca

SEQ ID NO: 10677 - DNA, 6243 bp, Artificial Sequence
  Description of Artificial Sequence: Synthetic coding sequence
atgctctgttgtctccttgtgagagcctcgaacttgccaagcgcaaagaaggatcgacgctccgatcctgtcgcctcgctgacgtttagaggcgttaagaagcgaacgaaggtgatcaagaactcggtgaatccagtttggaatgaagggttcgaatgggatcttaaaggaataccactggatcaaggctctgaactgcacgttgtggtgaaggatcacgaaaccatgggccgtaatcgctttcttggtgaggcaaaggtgcctctccgcgaagtgctggcgaccccatccctctccgcatcatttaacgctcctcttctcgacactaagaagcagcctaccggcgcaagcctggtcctgcaagtgagctacacccctctcccaggtgctgtgcctctgtttcctcctcctactccactggagccatcgccaactctgccggatctcgatgtcgtggccgacactggtggagaggaggataccgaagatcaaggtctgactggggacgaggcagagccattcctcgatcaatcaggtgggcctggggcacccactaccccaagaaagctgccgagcagacctccaccacattaccccggaattaagagaaagcgaagcgcaccaacttcgcgcaaactgctgtcggataagccccaagacttccaaattcgtgtgcaagtgattgaaggacgccaacttcctggagtgaatatcaagcctgtggtgaaagtgaccgcggcagggcagacgaaacgaactcggattcataagggaaactcgccattgtttaacgaaactctctttttcaatctgttcgattcccctggcgaactgtttgacgagcctatctttatcaccgtggtggattcacgttcgcttaggactgatgcacttcttggtgagtttagaatggacgttggtactatttacagggaaccaagacacgcatacttgagaaagtggctccttctgtcggatccagatgactttagcgctggcgcccgcggatacctgaaaacctcgctgtgcgtcctgggacctggtgacgaggcccctctggagagaaaagatccaagcgaagataaggaagatattgaatccaaccttcttaggcctaccggtgtggcactgcgaggagcccacttttgtctcaaagtgttcagagcagaggaccttccacaaatggatgatgccgtgatggacaacgtgaagcagatttttgggttcgaatcgaataagaagaacctggtggacccatttgtggaggtgtcctttgcaggaaaaatgctttgcagcaagattctggaaaagaccgcgaacccccagtggaaccagaacattactcttcctgcaatgttcccttccatgtgtgagaaaatgcgaattcgaataatcgattgggacagactgacccataacgacattgtggcaactacttacctctcgatgtcgaagatatcggcccctggtggagaaattgaggaggaacctgcaggcgctgtcaagccatcgaaggcatcggatctggatgattaccttggttttcttccgacctttgggccttgctacattaacctgtatggttccccgcgggaatttactggattccctgatccgtacaccgaactcaacaccggtaagggcgaaggtgtggcatacagagggagactgttgctgagcctcgaaactaaactcgttgaacattccgagcagaaggtcgaagatcttccagcagacgacatcctgagagtggaaaagtacctcagacgacgtaagtactcactctttgcagcattttactccgcaaccatgctgcaggacgtggatgatgcaatccagtttgaggtgtcgattggaaactacgggaataagtttgatatgacttgtctgccactcgcctcgaccacgcaatactcacgggcggtgttcgatggctgccattactactaccttccttggggaaatgtcaaacccgtagtggtgctgtccagctattgggaggatatcagccacagaattgaaactcagaaccaacttctgggtattgctgatcggctggaagcaggactcgagcaggtgcatcttgccctcaaagctcagtgttccactgaagatgtggactcgctcgtggcccagctcaccgatgaactcatagcagggtgtagccaaccccttggagatattcacgagactccttccgcaacccaccttgatcaatacttgtaccaactgcgcactcaccatctttcccaaatcacggaggctgcactcgcgctgaagttgggtcactcagaactgcccgccgcactggaacaggccgaggattggcttctgaggctgcgagcacttgcagaagaaccccaaaactcacttccagacatcgtgatttggatgttgcaaggggacaagagggttgcgtaccaaagagtgcctgcacatcaggtgctgttttcacggagaggagctaattactgcggtaaaaactgtggtaaacttcaaaccatctttcttaagtacccgatggaaaaggtgccaggcgccagaatgcccgtgcaaattcgagtgaaattgtggttcgggctgtcggttgatgagaaagagttcaaccaatttgcagaggggaagctgagcgtgttcgcggaaacctatgagaatgaaaccaagctcgcactggtcggtaactggggaacgactggacttacctacccaaagttctcggacgtcaccggaaagataaaactgccgaaagactcctttcggcctagcgccggctggacttgggcaggagactggtttgtgtgccctgaaaagaccctgttgcatgatatggacgcaggacacctgtcattcgtggaggaggtctttgaaaaccaaaccagactgccaggcggtcagtggatttacatgtccgacaactatactgatgttaacggagaaaaggtgcttcctaaggacgacatcgagtgtccccttggctggaagtgggaggatgaggaatggagcaccgacctgaacagagcggttgatgagcaaggttgggaatactccatcactattccgcccgaaaggaagccaaaacattgggtgccagctgaaaagatgtactacacccatcgacggcggcgctgggtgcggcttcgtcggcgagatctgtcccagatggaggcattgaagagacacagacaagccgaggcagagggtgaagggtgggagtatgcctccctgtttgggtggaagttccatcttgaataccgaaaaactgatgcttttagacggaggcggtggcgtcggagaatggaaccgcttgaaaaaaccgggcccgcggcggtgtttgcccttgaaggagcacttggaggcgtgatggacgataagtcagaggattccatgtcggtgtccaccctgtcgtttggagtcaaccggccaactattagctgcattttcgactacggtaaccggtaccatttgcgctgttacatgtaccaagcccgggatcttgcagcgatggataaggacagcttttccgatccttacgcaatcgtttcatttctgcaccagagccaaaaaaccgtcgttgtgaagaatacccttaacccaacctgggatcaaactcttatcttctacgagattgagatattcggagagccagcgactgtcgcggaacaaccgcctagcattgtcgtcgaactttacgatcatgatacctacggtgccgatgaattcatgggaaggtgcatctgtcagccgtcgcttgagagaatgcctagacttgcatggtttcctctcactagaggttcgcagccatcaggagaacttcttgcatcattcgaactgattcagagagagaagcccgcaatccatcacattccaggctttgaggtgcaggaaacctcaagaatccttgatgaatccgaggacaccgatctcccgtacccacctccgcaaagggaagcgaacatctacatggtcccccagaacattaagcctgcccttcaaaggaccgcgatcgagatcctggcgtggggactgcgcaacatgaaatcgtatcaattggcgaatatctcctcgccatcgcttgtggtcgaatgtggagggcagaccgtgcaaagctgtgtcataagaaaccttaggaagaaccctaatttcgatatatgtactctctttatggaagtcatgcttccgcgggaggaactgtactgccctcctatcaccgtgaaggtcattgataatcgacaatttggtcgtagacccgtggtgggacaatgtaccatccgtagcttggagagctttctgtgtgatccttacagcgcagagtcgccttcacctcaaggcgggcctgatgatgtgtcactcctgtctccaggagaagatgtgcttatcgacattgatgacaaggagccactgattcctattcaggaggaggaattcatagattggtggagcaaattcttcgcatccattggggaacgcgagaagtgtggttcctatcttgagaaggactttgacacccttaaagtctacgatacccagctcgaaaatgtggaagcatttgagggtctgtcggatttctgtaatacgtttaaactctaccgcggaaagactcaggaagaaaccgaggacccttccgtgataggggaattcaagggattgtttaagatttaccccctgcctgaagatcctgcaattcccatgccacctaggcaatttcatcagcttgcagcacaaggccctcaagaatgtcttgtgcggatctatatagtcagggccttcggtctgcagccaaaggatcccaacggtaagtgcgacccgtacattaagatttccattggaaagaaaagcgtgtccgaccaagacaactatatcccttgtaccctcgaaccagtgttcggtaaaatgttcgagcttacctgtacccttccccttgagaaggatcttaagattaccctgtacgattatgaccttctttcgaaggatgaaaagattggcgaaactgtggtggaccttgaaaaccgcctgctgtcgaagtttggcgcgcggtgtggactccctcaaacctactgtgtttcaggacctaatcaatggcgagatcaactccggcctagccagcttcttcatctgttttgtcagcaacacagggtcaaggcccctgtttacagaaccgaccgagtgatgttccaagacaaagagtattccatagaagaaatcgaagcaggtaggatccctaacccacacctcggaccggtggaagaaaggctggctcttcatgtccttcagcagcagggactggttccagagcatgtcgagagcagaccattgtactccccactccaaccagatattgaacagggcaaacttcaaatgtgggtggacctgtttcctaaagcacttggtcgcccaggaccaccttttaacatcactccaagacgggcgcgccggttttttcttagatgtattatctggaacacccgcgacgtgattcttgacgatctgtcacttaccggtgaaaagatgtccgatatctacgtgaaaggctggatgatcgggtttgaggaacataagcaaaagacggatgtccattacagaagcctcggaggagaaggaaacttcaactggaggttcatatttccatttgactatcttccggcagaacaagtgtgtactattgctaaaaaggatgcattttggaggcttgacaagactgaatctaagatacccgcaagagtcgtgttccagatttgggacaatgataagttttcgtttgacgactttctcgggtccttgcagctcgatctgaataggatgccaaagccagccaaaaccgcgaaaaagtgctccctggatcagctcgatgacgcgtttcatcccgaatggtttgtctcgctcttcgaacagaaaaccgtcaagggatggtggccatgcgtggcggaagagggagaaaagaaaatcttggctggtaagctcgagatgactcttgagattgtggccgagtccgaacatgaggaacgtcctgccggacaaggccgtgatgagcccaatatgaaccccaagctcgaagatccgcggcgtccagacacttcgtttctttggttcactagcccctacaagaccatgaagtttattctttggcgaaggtttagatgggctattatccttttcataattctctttatcctgcttctgtttctggccatctttatctacgcttttccaaactacgcagcaatgaagctcgttaagccttttagc

SEQ ID NO: 10678 - DNA, 6243 bp, Artificial Sequence
  Description of Artificial Sequence: Synthetic coding sequence
atgctttgctgtcttctggtgagggcaagcaatctgccttcagcaaagaaggataggcgatccgatcccgtcgcttcgcttacgttcaggggcgtgaaaaagagaacgaaggtgattaaaaactctgtgaacccggtgtggaacgagggatttgagtgggacctcaagggcattccactggaccaaggaagcgaactgcacgtcgtggtaaaagatcatgagaccatgggccgtaatcgtttcctcggagaggccaaagtgcctctaagggaggtacttgcaaccccatccctgtctgcttctttcaatgcacccctcctggacacaaaaaagcaacccacgggagcatcactggtcctacaggtaagctacactccccttcctggggcggtacctttgttcccaccaccgacccccctggaaccaagtcccacacttcccgacctcgacgtcgttgccgataccggcggtgaggaagacaccgaagaccaaggattaaccggagacgaggctgagccattcctggatcagtcaggagggccaggggctcccacgacccctagaaagctgccatctcgcccaccgccgcactaccccgggatcaagcgcaagcggtctgccccaacctcccggaaactgctcagcgataagcctcaggatttccaaatacgtgtgcaggttattgagggaaggcaattacccggcgtgaacatcaagcctgtcgttaaggttacagccgctgggcagacaaagcggactagaattcacaaaggaaactctcctcttttcaacgagacactgttcttcaacctttttgactcccccggggagctgtttgacgaacccatctttattaccgttgtcgacagccggagccttcggacggacgctctgctcggagaattcagaatggatgttgggaccatttacagggagccgcgtcatgcttacctgagaaagtggctgctgctctctgatccggatgacttctcagccggcgcaaggggataccttaagaccagcctgtgcgttctcgggcccggcgacgaggccccactagaacgcaaggatccctccgaagataaggaggacatagaatctaacctattgcggccaactggagtggcacttaggggggcccacttctgtctgaaagtttttagagccgaggatctgccacaaatggacgacgctgtgatggataatgtgaaacagatctttggctttgagagcaataaaaaaaacttagtggacccctttgttgaggtgtccttcgccggcaagatgctgtgcagcaaaatattagaaaagactgccaacccccagtggaatcagaacataactctccctgccatgttcccctctatgtgcgagaaaatgcgcatccgcattattgattgggacagactcacccacaatgatatcgtggccactacctacctctctatgtccaagatctctgcgcccggcggggagattgaagaagagcctgccggcgccgtaaagccgagtaaagcctccgacctggacgactacttgggttttctgcccaccttcggaccctgctatatcaatttatatggatctccaagggagttcactgggtttcccgacccttacacagaactgaacactggcaagggcgaaggagtcgcataccgtggtagactacttctgtctttggaaacaaagcttgtcgagcattccgagcagaaggtggaggatctgccagccgatgatattttaagagtggaaaagtatctcaggcggcgcaaatacagcttattcgctgcattttactcggcgacaatgctgcaggacgtggacgacgctattcagttcgaggttagcataggaaattacgggaataaatttgacatgacctgcctgcccttggctagcaccacgcaatacagtagggccgtattcgacggctgtcattactactatctgccttggggaaacgtcaaaccagtagtggtgctatcctcatactgggaagatatttctcatcgcatcgaaacgcagaatcagctcctcggcatcgccgacagattagaagccggcctggagcaggtgcacctagctttgaaggcacagtgcagcacagaggacgtggactcactcgttgctcagctgaccgacgagttgattgcagggtgtagtcaaccgttgggggacattcacgaaacgcccagtgcgacacatctcgaccaatacctatatcaactgcgaacgcaccacctgagccagatcaccgaggccgccctcgcactgaagttgggccattcagagttaccagccgctctagagcaggcagaggattggctgctccgcctgcgggcactcgctgaggaaccgcaaaactccctcccagacattgtgatctggatgctacaaggcgacaaacgagtggcttaccagcgagtacctgcccatcaggtgctattttcccgtaggggtgccaactactgtgggaagaattgtggaaaacttcagacaatctttctcaagtaccctatggagaaggtgcctggcgccagaatgccggttcagatccgggtcaaactctggttcggcctatctgtggacgagaaggaatttaaccaattcgcagaggggaagctgagcgtctttgcggagacatacgaaaacgagaccaagctcgccttggttggcaactggggaaccactgggctgacatatccaaagttctcggacgtcaccggtaagatcaagctacccaaggattcatttagaccatctgccggctggacatgggccggggattggtttgtgtgtccagaaaaaactcttctccatgatatggacgcaggtcacctttcattcgtagaggaggtgttcgaaaatcagactcgactcccaggcggtcagtggatctatatgtctgataattacaccgacgtcaacggcgaaaaagtgttaccgaaagacgacatcgaatgtcccctggggtggaagtgggaggatgaggagtggagtacagacctcaatcgggcagtcgatgagcagggctgggaatactctatcaccattccgcccgagcgcaaacctaagcattgggtgccggccgaaaaaatgtattatacccatcggcggcgacgatgggtgaggctccgcaggagagatcttagccagatggaagctttgaaaaggcatcgccaggcagaggctgaaggtgaggggtgggaatacgccagtttgttcggctggaaatttcacctcgaatatagaaagaccgatgccttccgccggcggcgatggcgcaggagaatggagcccctagagaagacaggacccgctgcggtcttcgctctggagggtgcgttgggtggcgttatggacgacaaatcggaggactctatgtccgtcagtaccctatccttcggggtaaatagacccaccattagctgcatattcgattatgggaatagatatcacctacgctgttatatgtaccaggccagggatcttgccgctatggacaaagattccttcagcgacccttacgcgatcgtctcctttctccaccaaagccagaaaactgtcgtggtgaagaacacactgaaccctacctgggatcagaccctgattttctacgagattgaaatctttggggaaccggctaccgtggccgaacagccgccttccattgtcgtagagctgtacgaccatgatacctacggggctgatgagttcatggggaggtgcatttgccagccatccctggaacgaatgccgcgtctagcttggtttcctctgacacgcggaagccagccttccggcgagctcctcgcttctttcgagctgatccagcgtgaaaaaccagccatccaccatatccccggttttgaggtgcaggaaacttctcgcattcttgacgagagcgaagacacagacctgccatatccacctcctcagcgggaagccaacatttacatggttccgcagaacattaagccagctctccagcggaccgcaatcgaaatcctggcttggggactgagaaatatgaagtcgtatcagcttgccaacatctcttctccctcactggtggttgagtgcggaggccaaactgttcagtcctgcgtgattagaaacctccgaaagaacccgaacttcgacatttgcacccttttcatggaggtcatgttaccaagagaggagctgtattgtccacctatcaccgtgaaggtgattgataatcgccagtttggtcgccgaccggtggtgggtcagtgtacgataagatccctggagtcgttcctatgtgatccgtattctgccgagtcccccagtccacagggcggcccagacgacgttagtctattgagccccggtgaagatgtcttgatcgatattgatgacaaggagcccctgatacctatacaggaggaggaattcatcgactggtggtccaagttctttgctagcataggtgagcgggagaaatgtggctcttacctcgaaaaggactttgacactttgaaagtgtacgacactcagctagagaatgttgaagcttttgaaggcctgtccgatttctgcaatacgttcaagttgtaccgaggcaagacccaggaggagacagaagatccttccgtcatcggcgagttcaaggggctgttcaagatctaccccctcccagaggaccctgcgattcctatgccaccccgtcagttccaccaattagccgctcagggtccacaggagtgcctggtgcgcatctacattgtacgtgccttcggactgcagccaaaggatccaaacggaaagtgcgatccctacataaaaatcagcattggcaagaaatctgtgtccgatcaggataactatatcccttgcaccctggaacctgtttttggcaaaatgttcgagctcacatgcacactgccactggagaaagatcttaaaatcacattatatgattatgacctgctgtctaaggacgagaagatcggggaaaccgttgtagaccttgagaaccggctgctgtccaagtttggagctcggtgcggtcttccccaaacctattgcgtgtccggtcctaatcagtggagagaccagttgcggccttcacagctccttcatttgttttgtcagcagcatcgcgtaaaggcacctgtgtaccgaacagatcgtgttatgttccaggataaagaatactctattgaggaaatcgaggcagggcggatccccaaccctcacctcggtccagttgaagaacgactggctctccacgtcctgcagcagcagggcttggtacctgagcatgtggagagcaggccattgtattctccgctgcaaccagacatcgagcagggaaagctgcagatgtgggtcgatctcttccctaaggctctgggtagaccaggacccccattcaacatcaccccaaggcgggctcgccgcttttttcttcggtgcatcatctggaacactagagacgtgatcttagatgatctgagtctgaccggggaaaaaatgtcagatatctacgtgaagggatggatgattggctttgaggaacataagcagaagaccgatgttcactatcgttccctcggaggagaggggaacttcaactggcggtttatctttccatttgactatcttcctgccgagcaagtttgtaccatcgcaaaaaaagatgctttctggcgcctggacaagaccgagtctaagatccccgctcgtgttgtgtttcaaatttgggataacgacaagttctcctttgacgactttcttggatccctccaactggatcttaacaggatgcctaagcctgccaagactgctaagaagtgtagcctggaccagctggatgacgcatttcatcctgagtggttcgtgagcttattcgaacagaagacggttaagggctggtggccatgtgttgccgaggagggcgagaagaaaatcttggccgggaagttggagatgacactcgaaatagtggccgagtctgagcacgaagagaggccggcaggccaaggccgcgacgaacccaatatgaatcccaagctggaggacccaaggagacctgacacatcctttctgtggtttacctccccctataaaacaatgaaattcattttatggagaagattccggtgggccattatactgtttatcatcctgttcattttgctgctatttcttgcaatcttcatatacgcattcccaaactatgccgcaatgaaacttgtcaaacctttttct

SEQ ID NO: 10679 - DNA, 6243 bp, Artificial Sequence
  Description of Artificial Sequence: Synthetic coding sequence
atgctgtgttgcttgttagtgcgcgcaagcaacctgccatctgccaaaaaagacagacgctccgacccagtcgcaagcctgacgtttaggggcgtgaagaaacggacaaaggtaatcaagaatagtgtcaacccggtctggaatgagggatttgaatgggacctgaagggcatacccttggatcaaggaagcgagctgcatgtggtcgtgaaagaccatgagacaatgggtcgtaatcgcttccttggggaggccaaagtgcctctgagagaagtgctggcgacaccatctctgtcggcttctttcaatgcccctttattagataccaaaaaacagcccacgggagcttcgctcgtgcttcaggtctcttatacccctttgccaggtgctgtgccgctcttccccccccctacacctctggagccgtccccaacgctaccagatcttgatgtggtggccgacaccggcggcgaggaggataccgaggatcagggactgacgggtgatgaggctgagcctttccttgatcagtcaggaggccccggcgcaccgaccaccccacggaaactaccctcaagacccccaccccattatccagggatcaaacgcaagcggtctgccccgacatcaagaaaactgctgtctgataagccccaagacttccagatacgggtgcaggttattgaggggcggcagcttcctggcgtgaacattaagcccgttgtcaaggttacagccgctggccagacaaaaaggactcgtattcataagggcaacagtcctttgttcaatgagaccctcttcttcaaccttttcgatagccccggggagctgtttgatgagcccattttcataacggttgtggacagtcgctcattgaggactgacgcccttctcggggagtttcgaatggatgtgggaaccatttatagggagccacgccacgcttacttgagaaagtggctactcctctccgacccagacgatttcagtgctggagcccgcggctatctcaagacctcgctgtgcgtattaggcccgggtgatgaggcccctttggaacgtaaggaccccagcgaggacaaggaagacatagagtcaaacctgctgagacccactggggtcgccctgcgaggcgcccacttttgtttaaaggtatttcgcgcagaggacttgccccagatggacgatgctgtcatggacaatgtcaaacagatcttcgggtttgagagtaataagaagaatttagtcgatccttttgtggaagtgagctttgcaggcaagatgttgtgtagcaaaatactggagaagaccgccaacccacaatggaatcagaatatcacgctgcccgctatgtttccatccatgtgtgagaaaatgcggattaggattatcgactgggatcgactcactcacaatgacattgtggcaaccacatacctgtctatgtctaagattagcgctcctggcggagaaattgaggaggagccagcgggtgctgttaagccttccaaagcaagtgatctggacgactatctgggcttcctccccactttcgggccctgctatataaacttatatgggtctccgcgggaatttacaggctttcccgacccttatacagagctcaacaccgggaaaggggaaggggtggcctaccgtggcagactactgctaagcttggaaaccaagctcgtcgagcatagtgaacagaaggtggaggacctgccagctgatgatattcttcgcgtcgaaaaatacttacggcgacgcaagtactctctgtttgcagccttctattcagccactatgctgcaagacgttgacgacgcaatccaatttgaagtgtccatcgggaattatggtaacaagtttgacatgacctgcctgcctctcgccagcaccacacagtatagccgggccgtgtttgatggctgccattattattacctgccctgggggaatgtgaaacctgtggtggtgctgtctagctactgggaggatatctcacaccgcattgagactcaaaatcagctgctcggaatcgccgaccgccttgaagcaggcttggaacaggttcacctggcactcaaagcacagtgcagcacggaggacgtggactctctggtcgcacaactcacagatgaactgatagccggttgtagccagcctctcggcgatattcacgagacccctagcgcaacccatttggatcaatacctgtaccagctccggactcaccatctgagccagattactgaggccgctctcgcgttgaagcttggccacagcgaactcccagccgcacttgagcaggctgaggactggctacttcgcctgcgcgcgctagctgaagagccacagaattccctgcccgacattgtaatatggatgcttcaaggcgataagcgtgttgcttaccagcgggtccccgcacatcaagttctcttcagccgaagaggcgcgaactattgtggaaaaaactgtggcaaactccaaactatcttcctgaagtaccctatggagaaagtgcccggagctagaatgccagtgcagattagggtaaaattgtggttcggcttatctgtggatgagaaggagttcaaccagttcgctgaaggcaagctgagtgtgtttgccgagacatatgaaaatgagacaaagttggcactggttgggaactgggggaccactggcttgacataccccaagttctcggatgtgactggcaaaatcaaactccctaaggatagctttcggcctagcgctggttggacttgggcaggtgactggttcgtttgtcccgaaaagacactcctgcacgacatggacgccgggcatctcagctttgtggaagaagtgtttgaaaatcagactagactgcctggaggccagtggatttacatgagcgacaactatacggacgtcaatggggagaaggtgctcccgaaggatgatatcgagtgtccccttggctggaagtgggaggatgaagaatggagcaccgacctgaaccgggccgtagatgagcaggggtgggagtatagcatcacaattcctccagagaggaaacccaagcactgggttcctgcagagaaaatgtattacacccaccggcgcagacgctgggtccgattgcggcggcgagatctctcacaaatggaggccctcaagagacatagacaggctgaagcagagggagaggggtgggagtacgccagtctcttcggttggaaattccaccttgagtataggaaaactgatgctttccggcgccggaggtggcggcgccgaatggaacccctggagaagaccggacccgccgcagtattcgccctagaaggcgcactggggggcgtcatggatgataaatcagaggattcaatgagtgtctctactctgtctttcggcgttaaccgacccacaatttcttgtatttttgattatggaaaccgctaccatttacgctgctacatgtatcaggccagggatttggccgcgatggacaaggattcattcagcgacccttacgccatcgtgtctttccttcaccagtcccagaagaccgtagtcgtgaaaaatacactgaaccctacttgggatcagaccctcatcttttacgagattgaaatctttggagagccagctaccgtcgcagaacagcccccttcaatcgtggtggaactatatgaccacgacacctatggcgctgatgagttcatgggccggtgtatctgccagccatcccttgaacgcatgcccagactggcctggtttcctcttactcgcggtagtcaacctagcggcgaattgctagccagtttcgagctgatccaacgcgaaaagcctgccattcaccatatccctggcttcgaagtccaagagacatcccggatcctcgatgagagcgaggacaccgatctgccctacccacccccgcaaagagaggcaaatatctacatggtcccccagaacatcaaacctgccctacagcggactgcaatagagatcctggcttggggcctgcgaaacatgaagagctatcaactcgccaatatttcaagtcccagtttggtggttgagtgtggcggccagacagtgcagagctgcgtgatacgcaaccttcgaaaaaaccctaattttgatatttgcacactgttcatggaggtgatgctgccccgggaggaactgtattgccccccaattacagttaaagtcatagataaccgccagttcgggcggaggcccgtggttggacagtgtacaatccgatctctggaaagctttctatgcgacccttattctgcagagtccccatctccacaggggggaccggatgacgtaagtctgctaagtcccggagaagatgtcctaattgacattgacgacaaggaacccctaatcccaatacaagaagaggaattcattgactggtggtcaaagttttttgcctctattggcgagagagaaaaatgtggttcatacctggaaaaagatttcgacaccttgaaggtgtatgacacccagctggaaaacgtggaagcattcgagggactgagtgacttctgtaatacatttaagttgtaccgagggaagacccaggaagagacagaagatcccagcgttatcggcgaattcaaaggactgtttaagatttacccgctgcctgaagatcccgctatacctatgcctcctaggcaatttcatcagcttgcggcacagggaccccaggagtgcctggtgagaatctacattgttcgggcatttggccttcagcccaaagaccctaacggaaagtgtgatccatacattaaaatttctatcgggaaaaagagcgtctccgaccaagacaactatataccctgtaccctcgaacctgtcttcggtaaaatgtttgaactcacatgcactcttcccctcgaaaaagaccttaaaattactctatacgattatgacctcctgagtaaagatgagaaaatcggagagactgtggtcgacttagaaaacaggctgttgagcaaattcggcgcacgatgcggcttgcctcagacatattgcgttagtggcccaaaccagtggcgagatcagttgcgacctagccagcttttgcacctgttttgtcagcagcaccgcgtaaaggcccccgtctaccgaaccgaccgtgtgatgtttcaggacaaggagtactccattgaagaaatcgaagctggacgcatccctaaccctcacctggggccggtggaggaacggcttgctttacacgtgcttcagcaacagggattggtgccagagcatgtcgaaagtcggcctctgtactcgccactccaacccgacatcgagcaaggaaagctccagatgtgggtggacctgttccctaaggctctggggcgcccaggtcctccatttaatattacgccccggcgggcaagaagattttttctgcgatgcataatctggaacacgagagacgttatccttgacgacctatcgctaacaggcgagaaaatgtcggacatttatgtcaaaggttggatgatcgggttcgaggagcacaagcagaagaccgatgttcactatagaagcctggggggcgagggcaactttaactggcggtttatctttccattcgattacctgcccgcagaacaggtgtgcaccattgccaaaaaggatgccttttggaggttggataaaactgaatccaagattcccgcccgggtcgtattccagatttgggacaatgataagtttagtttcgacgattttctcggctccctgcagttggacctgaatcgcatgcccaagcctgccaaaacggcaaagaagtgctctcttgaccagctcgacgacgcctttcaccctgagtggtttgtttcactctttgaacaaaaaaccgtgaagggttggtggccgtgcgtggccgaggagggggagaaaaaaatactggccggcaagctcgaaatgacgttggagatcgtggccgagagcgaacatgaagagagaccagctggccaaggtcgggacgagccaaacatgaatcctaaactggaggatccacgacgacccgatacatcttttttgtggtttacgagcccgtacaaaacaatgaaattcatcctctggcgcaggtttaggtgggctattatcttgttcataatcctatttatattgctgcttttcttggcaatttttatctatgcgttccccaactacgcggccatgaagcttgtgaaacccttcagc

SEQ ID NO: 10680 - DNA, 6243 bp, Artificial Sequence
  Description of Artificial Sequence: Synthetic coding sequence
atgctgtgttgcctgctcgtgagggcctccaacttgccatccgccaaaaaagaccgccgcagcgacccagtcgcttctctaacattccggggcgtcaaaaagagaacaaaggtgatcaaaaacagtgtaaaccctgtgtggaatgaaggattcgaatgggatttgaaggggattcccctggaccagggctctgagctccacgtcgtcgtgaaggatcacgagacaatgggacgaaaccgcttcttaggggaagctaaagtcccattacgagaggtgcttgccacaccctcactaagcgctagcttcaacgctcccctgcttgacacaaaaaaacagcccaccggagcgtcattggttcttcaagtctcatatacccctcttcccggcgctgtgccgctgttcccccccccgactccacttgagccatcacctaccctcccagatctggacgttgtagctgacactgggggtgaggaagacacagaagaccaggggctgacgggcgacgaggctgagccttttctggatcagtcaggaggaccaggggcaccaacgacgccacggaagctgccctctagaccaccccctcattacccgggtatcaaaagaaagcggtcagcccctactagcagaaagctgttgagtgacaagcctcaggacttccagatcagggtacaggtgatagagggacgccagctgcctggtgtgaacatcaaacctgtcgtgaaggtgacggctgccggccaaaccaagcggaccagaattcacaagggcaactcccccctgtttaacgagacgctattcttcaacttattcgactctcctggggagctttttgatgagccgatcttcattaccgtggtcgattcccgaagcctaagaacagatgccttgctaggcgaatttcgcatggatgttggcactatttaccgggagccccgccacgcctatctgcgcaaatggctgttgctgagtgatcctgatgacttctctgctggcgccagggggtatctgaaaacatcactgtgcgtgctgggaccaggcgatgaagcgcccctggaacgtaaggatccctctgaggacaaggaagacattgaatccaacctactcagaccgaccggggtcgccctgagaggcgcacacttctgccttaaggttttcagagcagaagacctgccacaaatggacgatgcagttatggataatgtgaagcagatatttgggttcgagtcgaacaagaaaaatttggtggacccatttgtggaggtcagtttcgccgggaagatgctgtgcagtaagatcctcgagaagaccgcaaaccctcagtggaaccagaatattaccctgcccgctatgttcccaagcatgtgcgagaaaatgagaatccgtattattgattgggacagactcactcacaacgacattgtggccaccacatatcttagcatgagtaagatatccgcacccggtggagagatcgaggaagaacccgcgggcgccgtgaagccatcaaaggccagcgacctggacgactacctcggttttctccccacctttggtccttgttacattaatctgtacgggagcccccgggagttcaccggattccctgatccttatacagagctgaacactggtaagggcgaaggagtggcctatagaggcagactgcttctcagtctagagacgaaacttgttgagcactccgagcaaaaagtcgaggatttacccgcagatgacattcttcgcgtggaaaagtacttgcgaaggcggaagtatagtcttttcgcagccttttattccgccacaatgctgcaggacgtggatgacgctattcagtttgaagtatcaatcggaaattacggcaacaagttcgacatgacatgcctgccgttggcctcaacaacgcaatactccagagcggtgtttgacggatgccattactattacctgccatggggaaacgtaaagcccgtcgtcgtactcagtagttactgggaggatatttcacacaggattgagacacagaatcagctgctgggcatcgccgaccgactggaggccggattagaacaggttcatctggcactcaaggcccaatgcagcactgaagatgtcgattccctggtggcgcagctaaccgatgaattaatcgccggctgctctcagcctctcggggacattcacgagacccccagcgcaacccatctggatcagtatctgtatcagctgcgaacccaccacttgtcccagatcaccgaggccgccctggctcttaaacttggccattccgaactgccagctgcattagagcaggctgaggactggctgttacggctgcgagccctggcagaggagccacagaattccctacctgacatagttatatggatgctacagggggataagagagtagcataccaaagggtgcccgcacatcaagtcctgttttccagacgcggcgctaactactgcgggaagaattgcggcaaattacagacaatctttctcaaatacccaatggagaaagtccctggcgctcgtatgcctgtccagattcgggtgaaattgtggtttggactgagcgtggatgagaaggaatttaaccagtttgcagagggcaaactgtccgtcttcgcagagacttatgaaaatgagacgaaactcgctctggtagggaattggggtaccacaggtctcacttacccaaagttttcagacgtgacagggaagatcaagctccctaaggactcattcaggccgagcgcagggtggacttgggccggagactggtttgtgtgtcccgagaaaaccctgttgcacgacatggatgccggacacctgtcattcgtagaggaggtattcgaaaatcagaccagactgcccggcggccagtggatttatatgtccgacaattatactgacgtgaacggcgagaaggtactaccaaaggacgacatcgagtgccctctgggctggaaatgggaggacgaagagtggagcaccgacctgaacagagcggtcgatgagcaaggatgggagtattccataactatcccccctgagagaaaacccaaacactgggtgcctgctgagaagatgtactacacccaccgaagaagacgctgggtgaggctccggcggcgggatctgtcacagatggaggcccttaagagacataggcaggccgaggccgagggagaggggtgggaatacgcctctctttttgggtggaagtttcaccttgagtatcggaagaccgacgcattccgccggagaaggtggagacgccgcatggagcctctcgaaaagactggcccagccgcagtattcgctctcgagggtgcattaggaggggtgatggacgacaagagcgaggacagcatgtctgtttccactctctccttcggcgtgaatcggccaacaatcagttgcatttttgactacggaaacaggtatcatcttaggtgctacatgtatcaagctcgggacctggccgcgatggataaggactccttcagtgacccctacgcaattgtctcttttctgcatcagtcccagaagactgttgtggtgaaaaacacccttaaccctacatgggatcaaactctcatcttttacgagatcgagatcttcggtgagccagcaacggtcgcagagcagccacccagtatcgtggtggaattgtatgaccacgatacctatggggccgatgagttcatgggtcgatgtatctgccagccttctctggagcggatgcctcgcttggcctggttccccctgactcggggctcacagcctagcggggaattgttggctagcttcgagcttattcagagagaaaagcccgcaatccaccatatcccagggttcgaggtgcaggagacttcccgcatactagatgagagcgaggataccgacctgccataccctccaccacaacgagaggcgaacatctacatggtgccacagaatatcaagccagccctgcagcgaactgctatcgaaatcttggcatggggacttaggaacatgaaatcttaccagcttgctaatatatctagcccctccctcgtggtggaatgtggaggtcagacagtacagagctgcgttattaggaacttaaggaaaaaccctaattttgatatttgtacattgtttatggaagttatgttgcccagagaagaattatactgtcctcctatcacggtcaaagtgatagataataggcagttcggtcgccggcctgtggtcggccagtgtactatccgctctctggagagctttctttgtgatccttattctgccgaaagtccatccccccaaggtggacccgacgatgtctcactgctttctccaggagaagatgttctgatcgacattgacgacaaagagcccctgattcccattcaggaagaagagttcatcgactggtggagcaagttctttgctagtatcggggagcgtgagaagtgtgggtcatacctggagaaggatttcgacaccctgaaggtgtacgatacccagttagagaatgtcgaggctttcgaaggcctgagtgacttttgcaatactttcaaactttacagaggcaagacgcaggaggaaaccgaggacccatctgtcatcggcgagtttaaggggctgttcaaaatctatcctttacctgaagaccccgccatacctatgcctccccgccagttccatcagctggctgctcaaggcccacaggaatgcttggtccgaatctacatcgtcagggcattcgggttacagcctaaggaccccaatggaaagtgtgatccatacattaagatctctattggaaaaaagtcagtgagcgatcaggataattatatcccatgcaccctcgaaccagtctttgggaaaatgttcgaactgacttgtacactcccgttggagaaggatctgaagattacgctgtacgactacgacctgctttcaaaagatgaaaagattggcgagactgtggtggacttagagaatcggcttctgtctaagttcggcgcaaggtgtggtttgccccagacatactgtgtctctggtcccaaccagtggcgtgatcagctacgaccttcgcagcttctgcatctgttttgccagcagcatagagtgaaggcacccgtgtatcgtacggacagggtgatgttccaggataaagagtattccatcgaggagattgaggccgggcgtatccccaatccacatctggggcctgtggaagagcggttggcacttcacgtactgcagcagcaggggcttgtgcctgaacatgtagagtcacggccactgtacagtccgttacagccagatatcgaacaggggaagctccagatgtgggtagatctcttccccaaggcactggggaggccaggtcccccatttaacatcactcctcggagggcaaggcggtttttcttgcgctgtatcatctggaacacccgcgacgtcatcctggatgacctcagtctgaccggagagaagatgagcgatatttacgtaaaggggtggatgatcggctttgaagagcacaaacaaaaaaccgacgtgcattacaggtcccttggaggcgagggaaactttaattggcgattcatcttcccatttgattacttaccggctgagcaggtgtgtacgatcgcaaagaaagacgcattctggcggttggataaaactgaatctaagatccctgcaagagtggtgttccagatttgggataatgacaagttcagcttcgacgacttcttggggagtctgcagctggacctgaaccgaatgccaaagcccgccaaaaccgccaagaagtgttcactggaccagctggatgacgcctttcacccggagtggttcgtctccctgttcgagcagaagacagtgaaaggatggtggccgtgtgtggctgaggagggagaaaaaaaaatcttagccgggaaactcgaaatgacccttgaaattgtggccgaatccgagcatgaagagagacccgccgggcagggtagggatgagcctaatatgaatccaaagcttgaagacccccgtcgacccgacacaagtttcttatggttcacctcaccatataagaccatgaagtttatattgtggaggcgcttcagatgggccattatcctgttcatcatcttatttatcctccttctgtttttggcaatatttatctacgccttcccaaattatgcagccatgaaactcgtcaagcctttctcc

SEQ ID NO: 10681 - DNA, 6243 bp, Artificial Sequence
  Description of Artificial Sequence: Synthetic coding sequence
atgctgtgttgcctccttgttcgagcgtctaacctcccctccgccaagaaggatagacgaagcgatcctgttgcctcactgacctttcgcggcgtcaaaaagaggactaaggtcatcaagaactcggtgaacccggtgtggaatgagggattcgagtgggacctcaaaggtatcccattggaccagggttcagaactgcatgtcgttgttaaggaccacgaaaccatgggccgtaatcggttcctgggagaagcgaaggtcccgctgagggaagtcctcgccaccccgtccctgtccgcctccttcaatgcaccgctgctggacaccaagaagcaaccgactggtgccagtctcgtgctgcaagtctcctacacgccattgcctggcgcggtcccgctcttccccccgccgaccccccttgagccgtcgccgactctgccggatctggacgtcgtggcagatactggaggagaggaggacacggaggatcaggggctgaccggcgacgaagcagagccgttcctcgaccagtcgggcggaccaggcgccccaaccacgcctagaaaactcccatcgcgcccgcccccacattaccctggtatcaaaagaaagcgctccgcccccacgtcccggaagttgctgtcggataagcctcaggactttcaaattagggtccaggtcatcgaaggacgccaacttcccggagtgaacatcaaaccggtggtcaaagtgaccgcggcaggccaaacgaagcggactcggatccataagggaaattcccccctgttcaacgaaaccctgttctttaaccttttcgactcaccgggggaactgttcgatgaaccaatcttcataactgtggtggatagcagaagccttcgcactgacgctctcctgggagaattcagaatggatgtgggaaccatctacagggaaccccgccacgcctacctgcgaaaatggctcctcctcagcgaccccgatgatttctcggccggggctcgcggttacctcaagacttccctgtgcgtgctgggaccaggggatgaagccccgctcgaaagaaaagacccttcagaggacaaagaggatatcgagtccaacctgcttagaccaaccggagtggcactgcggggggctcatttctgtttgaaggtctttcgtgccgaggatttgccgcagatggatgacgccgtgatggataacgtgaaacagatctttggattcgaaagcaacaagaagaatttggtggacccgttcgtcgaagtgtcctttgccggaaaaatgttgtgctcgaagatcctcgaaaagaccgctaatccgcagtggaatcaaaacattaccctgcccgccatgtttcctagcatgtgtgagaagatgcgcatcagaatcatcgattgggatagattgacgcacaacgatatcgtggcgaccacttacctctccatgtcgaagatttccgcaccgggaggggaaattgaggaagagccggcaggcgccgtgaaaccttctaaggcatcagacctggatgattacctgggtttccttcctacctttggaccgtgttacatcaacctgtacggaagcccgcgggaattcaccggttttccagacccttataccgagctcaacaccggaaagggggaaggagtggcgtacagagggcggcttctcctgtccctcgaaacgaagctcgtcgaacacagcgaacagaaggtggaggacctcccggcggacgatatcctgcgggtcgaaaagtacctgcgacggcggaagtacagcctgttcgcggccttctactcggctacgatgctccaggatgtcgacgacgcaatccaattcgaggtcagcatcggcaattacgggaacaaattcgacatgacttgcctgcccctggccagcaccacccagtactcgcgggccgtgtttgatggatgccattactactacctgccttggggcaacgtaaaaccggtggtggtactgtcctcgtattgggaggacattagtcacagaatcgaaacccaaaaccagttgctcggcatcgcggaccggctggaggccggacttgagcaagtgcatctggcccttaaggcgcagtgctcgaccgaagatgttgattcattggtggcccaactcacggacgagctgatcgccgggtgtagccagccactgggtgacatccatgaaaccccgtcagccactcacctcgatcaatacctgtatcaactccgcactcaccaccttagccaaatcactgaagcagcgctggctctgaagttggggcacagcgagctgccagcggccctggagcaggccgaggactggctgctgcgtctcagagccctggcagaagaaccccagaacagcctgcccgacatcgtgatctggatgctgcagggtgacaaaagggtggcttaccaacgtgtgccggctcaccaggtgttgttctcgcgccgcggagcaaattactgtggcaagaattgcggaaagctccagaccatcttcttgaagtacccaatggagaaggttcctggagccagaatgccggtacagatccgggtgaagctctggtttggcctgagcgtggatgaaaaggagtttaatcagtttgctgaaggcaagctgtccgtgttcgctgaaacctacgaaaatgagacgaagctggccctcgtcgggaactggggaactactgggctgacctacccaaagttttcagacgtgaccgggaagattaagctcccaaaagactcattccggccctcggcgggatggacttgggcaggtgactggttcgtgtgccctgaaaaaactctgctgcacgacatggacgctggacatctctcgttcgtggaagaggtgttcgagaatcagacccgcttgccgggaggacagtggatttacatgagcgacaactacactgacgtgaatggagagaaggtgctgcctaaggatgatatcgaatgcccactcggatggaagtgggaagatgaagagtggtcgactgatctcaatcgggccgtggacgagcagggatgggaatactccatcaccatcccgccagagcggaagccaaaacattgggtgccggccgagaagatgtactacacccatcgccgccgcagatgggtccggctgcgcagacgcgacctgtcccaaatggaagcactgaaaagacaccggcaggccgaagccgaaggagaaggctgggaatacgcttccctgtttggatggaagttccacctggagtatcggaaaactgatgctttccggcggagacgctggcggcgtaggatggaaccactcgagaaaaccgggccggccgccgtgttcgcgctggaaggtgcattgggaggagtgatggacgacaaatccgaggactctatgtcggtgtcaaccctgagctttggggtgaaccgacccacgatttcctgcatcttcgactacggaaaccgctaccacctcaggtgctacatgtatcaggctcgggacctggcggcgatggacaaagactcgttctccgacccgtacgccattgtgtcgtttctgcaccaatcgcagaaaacggtcgtcgtgaagaatactttgaatccgacgtgggatcaaacgctcatcttctacgaaatcgaaatcttcggggaaccagccactgtggccgagcagcccccgtcgatcgtcgtggaactgtatgatcacgacacgtacggagcagacgagtttatgggtcgctgtatatgccagccgtcactcgaacgcatgcctcggctcgcctggttccctctgactcggggatcccaaccatccggggaactgcttgcttccttcgagctgattcagcgggagaagcctgcaatccatcacatccccggatttgaagtgcaggaaacctctcgaattctggatgagagcgaagatactgatctgccgtaccccccgccacagagggaagcgaacatctacatggtgcctcaaaacatcaagcccgccctgcaacgaaccgcaatcgaaatcctggcgtggggcctccgcaacatgaaatcataccagctcgcgaatatctcgtctccgtcattggtggtagaatgcggaggacagactgtgcagagctgcgtgatacgcaacttgcgcaagaaccctaacttcgatatttgcaccttgttcatggaggtcatgctccccagagaagagctgtactgcccccctattactgtgaaagtcattgataacagacagttcggcagacgtccggtcgtcggacagtgcactatccgctcgctcgaatcattcctgtgtgacccatacagcgcggagtcaccctcaccgcagggaggtcctgatgacgtgtccctgctcagcccgggggaggacgttctcattgatatcgatgacaaagagccgttgatccccatccaggaggaggagttcatcgattggtggtccaagttcttcgcttcaattggagagagagagaaatgcggatcctacctggaaaaggactttgacaccttgaaggtgtacgacactcagctggagaatgtcgaagcgttcgaaggactgtccgacttctgcaacaccttcaagctctaccggggaaagactcaggaggagactgaggacccgtcggtgatcggcgagtttaaaggactgttcaagatctaccccctcccggaagatccagccatccccatgccccctcgccaattccaccaactcgctgcccagggcccacaggagtgcctcgtgaggatctacattgtccgggcgtttggtctgcaaccaaaggacccaaatggaaaatgcgatccctacattaagatatcaatagggaagaagtcggtgtcggatcaggacaactacatcccatgtaccttggagcccgtgttcggaaagatgttcgaactgacttgcaccctgccgctcgagaaggatctgaaaatcactctctatgattacgacctgctttccaaggacgagaaaatcggggaaaccgtcgtggaccttgaaaataggctcctgtcgaagttcggcgctagatgcggactgccacaaacttactgcgtgtcaggaccaaatcagtggagagatcagctcaggccgagccaactcttgcacctcttctgccagcaacatcgggtgaaggctccagtctaccggaccgatagagttatgttccaggataaagaatattcaatcgaggaaatcgaggcaggcaggatcccaaatccgcatctcggaccggtggaggagagactggccctgcacgtcctccaacagcaaggattggtcccggaacatgtagaaagccggcctctgtattcgccgctgcaaccagatatcgagcaaggtaagctgcagatgtgggtggatctctttccgaaggcactgggacggccaggaccaccgtttaacatcactcctagacgcgcccgccgcttctttcttcgatgcatcatctggaacacccgggacgtaatcctggacgacctgagcctgactggagaaaagatgtccgacatctacgttaagggatggatgatcggattcgaggaacacaagcaaaagacggacgtgcactacaggtccctgggtggcgagggtaatttcaactggagatttatcttcccattcgactatctgccggctgaacaggtgtgtaccatcgccaaaaaggacgcattctggcgcctggataagactgaatcgaagatccctgcgcgggttgtgttccagatctgggacaacgacaagttctccttcgacgattttctgggctccctccagctggatcttaaccgcatgccaaagcctgccaagactgcaaaaaagtgttccctcgaccaattggacgatgcgtttcatcctgaatggttcgtgtcactgttcgagcagaaaactgtcaagggctggtggccctgcgtggcagaagaaggtgagaaaaagatcctcgcgggcaagctggagatgaccttggagatcgtggctgagtcagaacacgaagaacggccggccggtcagggacgggacgaaccgaacatgaacccaaagctggaggaccctaggcggccggataccagctttctttggttcacctcaccgtacaagactatgaagttcatcctttggagacggttccgctgggcgatcatcctgttcatcatcctcttcatccttctgctgtttctcgcgattttcatttacgcctttccaaactacgccgccatgaagctcgtgaagccattctca

SEQ ID NO: 10682 - DNA, 6243 bp, Artificial Sequence
  Description of Artificial Sequence: Synthetic coding sequence
atgctgtgctgcctcctggtgcgtgcgtctaatctgccatccgctaagaaggatcgccgtagcgatccagtcgcatcccttacgtttcgcggcgtcaagaaacgtaccaaggtgatcaaaaactcggtaaaccctgtgtggaacgaaggttttgaatgggatctgaaaggaatccctcttgaccagggatccgagctgcatgtggttgtcaaagatcatgaaactatgggcagaaatcgcttcctgggagaggctaaggtgcccctcagagaggtgctcgccacgccctcgttgtccgcttcgttcaacgcgccactgctcgataccaaaaagcagcccaccggcgcatcgcttgtgttgcaagtctcgtacacgccacttccaggagccgtgcctctgttccctccaccgactccacttgaaccgtcgccaacgctgccggatctcgatgtggtcgctgataccggtggagaagaagatacggaggatcaaggattgactggtgatgaggctgaaccttttcttgaccaatcgggaggtccgggagcaccgactaccccacggaagctcccatcgcgcccccctccacactacccgggcataaagcgcaagcggtccgccccaacttcgaggaagctcctgagcgataaaccacaagatttccaaattagagtccaggtgattgaaggacgccaactccccggagtgaacatcaagccagtggtgaaggtcactgccgcgggtcaaactaagcgtactcggattcacaagggaaattcgccactgtttaatgagactctgtttttcaacctttttgactcacccggggaactgtttgatgagccaattttcattactgtggtcgactccagatcccttcggaccgacgcgcttttgggagaatttcgcatggacgtgggcactatctatcgcgaaccccgtcatgcttacttgcgcaaatggcttctgctttcggatccagacgatttttccgccggagcaagaggttaccttaaaacttcactttgtgtcttgggacccggcgacgaagcaccgctggaaaggaaagatccttcagaagataaggaagatattgagtcgaatctgcttagaccaacgggagtggccctgcgcggtgctcacttttgtctgaaggtctttagagcagaagatcttccacaaatggatgatgcagtgatggataacgttaagcagattttcggatttgagtctaacaagaagaaccttgtcgatccatttgtcgaggtcagctttgctggaaaaatgctctgttccaagatccttgagaaaacggcaaatcctcaatggaaccagaacatcacgttgcctgccatgttcccctcgatgtgtgagaagatgcgcatccgcattatagactgggatcgtctcacccataatgacattgtggcgaccacgtacctctccatgtcgaaaatctcggcccccggaggagagatagaagaggaacctgcaggagcagtgaagccatccaaggccagcgatctcgatgattaccttgggttcctgccaacgtttggtccctgctacataaacctgtatggttcacctcgcgagtttactggtttccctgatccatatactgagctgaataccgggaagggtgaaggagtggcttaccgaggaaggcttcttctttcactcgaaaccaagttggtcgaacactcagagcagaaggtggaggatcttcccgcggacgatattctcagagtcgaaaagtacctgcgcaggcgtaagtactcgctttttgcagcattctactcagcaaccatgctccaggacgtggatgatgcaatacagttcgaggtatccattggcaattacggaaataagttcgacatgacttgcctgccactcgcgtcgaccacccagtacagccgggcagtgtttgacggatgtcattactactaccttccatggggaaacgtgaagcctgtcgtggtcctttcctcatactgggaagatattagccatcgtattgaaacccaaaaccaactgttggggatagcagaccggcttgaagctgggctcgaacaagtgcatctggcccttaaggcacaatgctctacggaggatgtggattccctggtcgcacaacttactgacgagctgatcgcaggctgttcccagcctttgggtgatatacatgaaaccccctccgccacccatcttgatcaatatctgtaccaactcagaactcatcacctgtcgcagattacggaagccgcccttgcccttaaactcggtcacagcgaattgcctgcagcactcgaacaggccgaggactggctcttgagactgagagcccttgcagaagaacctcaaaactcgcttccggacatcgttatctggatgctccaaggggataagcgagtcgcgtaccagcgcgtccccgcccatcaggttcttttttcaaggcggggggcaaactactgtggtaagaactgtggaaaacttcaaactatctttctcaaataccctatggaaaaggtcccaggagctcgaatgccagttcagatcagagtcaagctgtggtttggactgtccgtggacgagaaggagtttaatcaattcgcggaaggaaaattgtccgtgttcgcggaaacctacgaaaatgagactaaactggcacttgtggggaactggggaactaccggactgacctaccccaagtttagcgacgtgactggtaagatcaaactgccaaaggactcgtttcgcccatccgcggggtggacttgggcaggggactggtttgtgtgccctgagaaaaccttgttgcatgatatggacgcaggccacctctccttcgtggaagaggtgtttgaaaaccagaccagacttccaggaggtcagtggatctacatgagcgataactacactgacgtgaacggtgaaaaggttctgccgaaggatgatattgaatgtcctcttgggtggaaatgggaagatgaagagtggtccactgatctgaatcgggcagtcgatgagcagggctgggaatactcaattactatccctccagaacgcaaaccgaagcattgggtgccggctgagaaaatgtactatactcacagacgaaggaggtgggtgcggcttcgccgacgagatctttcacaaatggaagcacttaaacgtcatagacaggcagaagcggaaggagagggttgggaatacgcctccctctttggatggaaattccacctggagtaccggaaaacggatgcgtttcggagacgtagatggagacgcagaatggagccacttgaaaaaactggtccggcagcagtgttcgcactggagggagcattgggaggggtgatggatgataagtccgaggattcgatgtccgtgtcaactctgagcttcggtgtcaacaggcctacgatttcatgtatctttgactacggcaatagataccatctgaggtgttacatgtaccaagcacgggacctcgcagcaatggataaggattccttcagcgatccctacgccattgtgtcatttctgcatcagagccaaaagaccgtcgtcgtgaaaaacacccttaacccaacctgggatcagacgctgatcttctacgaaattgagatctttggtgaacctgcaaccgtggcagagcaacctccatcgatcgtggttgaactctacgatcatgacacttacggggccgacgaattcatgggaaggtgtatttgtcagccctcgctcgaacgaatgccacggttggcctggttcccacttactcgcggctcacaaccgtcgggtgagctcctcgcatcgtttgaacttatacagcgcgaaaagccagcaatccatcacatacctggtttcgaagttcaagaaacttcgaggatcctggacgagtccgaggataccgacctcccttacccgccaccccaacgtgaagctaacatttacatggttcctcagaacattaagcctgcacttcaaagaactgcaattgaaatcctcgcctgggggctcagaaacatgaagagctaccagcttgcaaacatcagcagcccaagccttgtggtggaatgcggcggtcagaccgtgcaatcatgcgttattcggaacctcagaaagaacccaaactttgatatttgtactctgtttatggaggtgatgcttcccagagaagagctctactgcccccctattactgtgaaggtgatagacaacaggcagtttggccgacgtcccgtggtgggtcaatgtacgatccggtccctcgaatcctttctgtgtgatccctactctgcagaatcaccttcccctcagggtgggccagatgacgtaagcctcttgtcccctggagaagatgtgctgattgatattgatgataaggaaccgctgattccgatacaagaagaagaattcattgattggtggtcgaagttttttgcaagcatcggagaaagagagaaatgtggctcctaccttgagaaggactttgatacccttaaagtctacgacacccagctcgaaaacgttgaagcatttgaaggactgtctgatttttgtaacacctttaaactttacagaggaaaaacccaggaggagactgaagatccttccgtgataggtgagttcaagggcctgtttaagatttatcctctgccggaagatcctgcaattccgatgccgcctagacaatttcaccaactcgcagcccagggaccgcaggaatgcctggtgcgcatatacatcgtgagagcctttggcttgcaacctaaagacccaaacgggaagtgcgatccttacatcaagatctcgatcggcaagaaaagcgtgtcggaccaagataactacatcccctgtaccctggagcctgtgttcggtaaaatgtttgagctcacctgcactctgcctctggaaaaggacctgaaaatcactctttacgactacgatctgctgtcaaaggatgaaaagattggagaaactgtggtggacctggaaaacagactgctgtcgaaatttggtgcaagatgtggcttgcctcagacctattgtgtgtcaggaccaaaccagtggagagatcaactgcgcccctctcagctgcttcacctcttttgtcagcagcatcgcgtgaaggcacctgtgtacaggaccgatcgcgtgatgtttcaagacaaggagtacagcatagaggagattgaagcaggtagaattccaaacccacacctgggacccgtggaggaaagacttgcactgcatgtgttgcagcaacaaggcctggtcccagaacatgtcgaatcgcgacctctgtactcgcccctgcaaccggatatcgaacaaggtaagctccagatgtgggtcgatctttttcctaaggcactcggtaggccaggacccccctttaacataactccaaggagagcaaggcgtttcttcctgagatgcataatctggaatactagagatgtgattctcgatgatctcagcctcactggagaaaagatgtccgacatatatgttaaaggatggatgatcggatttgaagaacataagcaaaagactgatgtgcattacaggtcgctggggggtgaaggaaactttaactggcgattcatttttccttttgactacctccccgcagaacaggtgtgtaccattgcgaagaaggatgcattctggagactggataagactgaatcaaagattcctgcaagagttgtgtttcagatctgggacaatgacaagtttagctttgatgatttcctcggttcgctgcaactcgaccttaaccgtatgcctaaaccagcgaaaactgccaagaaatgtagccttgaccaacttgatgatgcatttcacccggaatggtttgtgtccctttttgaacaaaaaactgtgaagggttggtggccctgcgtggcggaagaaggtgaaaagaagattttggccgggaaacttgaaatgactcttgagattgtggcagagtcagagcatgaagagcgtccagccggccaaggtcgcgacgaacctaacatgaatccaaagctcgaagatccccggcgacccgatactagcttcctctggtttacgagcccatacaaaacgatgaagttcattctgtggagacggtttcgatgggctatcattctgttcataattctgttcatcctcctgcttttcctggcgattttcatttacgccttccctaactacgccgcaatgaagctcgtgaagccgttttct

SEQ ID NO: 10683 - DNA, 6243 bp, Artificial Sequence
  Description of Artificial Sequence: Synthetic coding sequence
atgttatgttgcctcctggtcagggcctcaaacctcccctctgcaaaaaaggataggcggagtgatcctgtagcctctcttacatttaggggggtcaaaaaaagaacaaaagtgatcaaaaacagtgtgaaccccgtgtggaacgaaggatttgaatgggatttaaaagggatccctctggatcagggaagtgaactccatgtggtagtaaaagatcatgaaactatgggacgcaaccggtttctgggggaagctaaagtcccactacgagaagtgctggcaactccctcactgtctgcttcatttaacgcacctctgcttgatacaaaaaaacagcccacaggggcgtcactcgtactgcaggtgtcctatacaccactgcctggggctgtccctttattcccacctcctacacccctggaaccctctcccacacttcccgatctagatgtcgttgccgatacagggggagaagaagatactgaagatcaggggcttacaggagatgaagccgagcccttcctggatcagtctggagggcctggagccccaactactccacgcaaactcccctccagacctccacctcactatcctggaataaaacgaaaaaggtctgctcccacttccaggaaacttctctcagataaaccccaggattttcagatcagggtccaggtgatcgaagggagacaattaccaggggtgaatataaagcctgttgtaaaagtcactgccgccggacaaacaaaacggacacggatccacaaggggaattctccattatttaatgaaactctattcttcaacctctttgattcccctggagaactctttgatgaacctatcttcataacggttgtagattctcgctcgctccgcacggatgctctactgggagaatttcggatggatgttggaacgatctatagagaacccaggcacgcataccttagaaagtggcttctgctatcagatccagatgatttttccgcaggagcccggggatatctcaaaacatccctctgtgtactcggacccggggatgaagcacctttagaaagaaaagacccatccgaagataaagaggatattgaatctaacctactcagacctactggagttgcgctaaggggggcgcatttttgcctaaaagtgttccgggctgaagatctgcctcagatggatgatgctgtgatggataatgtaaaacagatttttgggtttgaatcaaataaaaaaaatttagtggatccatttgttgaggtatcttttgcaggaaaaatgttgtgttctaaaatcttagaaaagactgctaacccacagtggaatcagaacataactctgccagcaatgttccctagtatgtgtgagaaaatgagaatacgaatcatcgattgggatcggctcacacacaacgatatcgtggccacaacatatttgtcaatgtctaagatctccgctcccgggggggagatagaggaggaacccgcaggggcagtcaaaccctccaaagcctctgatctcgatgattatctggggttcttgccaacattcgggccttgttatataaatctctatgggtcccctagggagttcactgggttccccgatccctatacagaattgaatactgggaaaggggaaggagtggcataccgcggacgattgcttctatctctcgaaacaaaactagttgagcatagtgaacagaaggtggaggatttacccgccgatgatatcctacgcgtggagaaatacctgcggagaaggaaatattccctctttgcagctttttattctgctacaatgctccaagatgtagatgatgccatacagtttgaagtatctattgggaattatgggaacaaatttgacatgacatgtcttccactggcctctacaacacagtattctcgagccgtgttcgatgggtgtcactattattatctaccatggggaaacgtgaagcctgtcgtggtgctgagttcttattgggaagatattagtcatcggatagaaactcagaaccagctcctggggatagcagatcggcttgaagcaggactcgaacaggtgcatttagcactcaaagcccagtgctctacagaagacgtggattcactggtagctcagctaacagatgaacttatcgcaggatgtagtcagcctttaggagatatacatgaaactccatcagccacacacctggaccagtacttgtatcaattgcgcactcaccatctgtctcagattacagaagccgcactcgccctcaaactagggcactccgaattacccgctgccctggaacaggccgaagattggcttttgaggttgagggccctcgccgaagagccacagaactccttacccgatattgtgatttggatgctccagggggataaacgggtagcctatcagcgcgttcctgctcaccaggtgctgttttcgagaagaggggctaattactgtgggaagaattgcggaaaacttcagactatttttctaaaatacccaatggaaaaagttcctggagctagaatgcctgtacaaatccgggttaaactttggttcggactctctgtggatgaaaaagaattcaatcagttcgcagaggggaaactctcagtctttgctgagacatatgaaaatgagactaaattagcactagtgggaaactgggggacaactggactcacttaccctaaattctcagatgtaacaggaaagatcaagctgcccaaagatagtttcagaccttccgccgggtggacatgggctggagattggtttgtgtgccccgaaaaaacactcttacacgatatggatgcagggcatctctccttcgtggaagaggtttttgagaatcagactagacttcccggaggacagtggatatacatgtctgataactatactgatgtgaatggagaaaaggttctcccaaaggacgatatagagtgccctcttgggtggaaatgggaagatgaggaatggtcaacagatctcaatagagctgttgatgaacaggggtgggaatattccattacaatcccaccagagcgaaaaccaaaacactgggtccccgccgaaaaaatgtactacactcacaggcggcgcaggtgggtgcgattaagacggcgggatctgtcccagatggaagctctcaaacgacatagacaggctgaagccgaaggagaagggtgggaatatgcatccctgtttggatggaaatttcacttggaataccggaagacagatgccttcaggcggaggagatggcggcggagaatggaacccctagaaaagacagggcctgctgccgttttcgcactagagggagccctgggaggagtaatggatgataagtctgaagactctatgtcagtctccacgctctctttcggggtgaatcggcctactatttcctgtatcttcgattatggaaaccgatatcatctccggtgttatatgtaccaggctagggatcttgcagccatggataaagattcctttagtgatccatatgcgatagtctccttcctacaccagtcccagaagactgtagtcgtgaaaaatacactcaatcctacttgggatcagactctaatattttatgaaatagaaatattcggggaacctgctacagtggctgagcagcctccttcaatcgtagtggaactctatgatcatgacacatatggagctgatgaatttatggggcggtgtatatgtcaaccttcattagaacgaatgcctcgcctcgcatggtttcctctaactcgcggaagtcagcccagtggggaacttcttgcatctttcgaactcatacaacgagaaaaacccgcaattcaccacattcctggattcgaggtccaggagacttctaggatcctggatgaatctgaagatacagatctcccctatcccccaccccagagagaggctaatatatatatggtccctcagaatatcaagccagcactgcagagaactgctatcgaaatactagcatgggggctacggaatatgaaatcctatcagcttgccaacatatcatccccaagtctcgtggttgaatgtgggggacagacagtccagagttgtgtcatccgcaatctacggaagaatcctaactttgatatatgtacactttttatggaggtgatgctccccagagaagagttatattgcccccccatcacagtgaaagttatcgacaatcgtcagttcgggagacggccagttgtaggacaatgtactatacgtagtctggaatcctttctctgtgatccctacagtgcagaaagtccttctccccaaggaggacccgatgacgtgtcgctgctcagtcctggggaggacgtgctaatcgatatcgacgacaaagaacccctcatccctatccaggaagaagaattcatagactggtggtccaaattctttgccagtattggagaacgagaaaaatgtgggtcatatctcgaaaaagatttcgatacactcaaagtatatgatactcagctcgagaacgtggaagcttttgaaggactgagtgatttctgtaatactttcaaactctatcgggggaaaactcaggaggaaactgaggatccctccgtgataggggagttcaaagggctctttaaaatctacccactgcccgaagatcccgcaatcccaatgccaccaaggcagttccaccagctcgccgcacagggaccccaagaatgtctggtgcgaatctacatcgtgcgcgctttcggactccagccaaaagatcctaacggaaaatgcgatccttatatcaagatttctatcggaaagaaatcagtctccgaccaggataattatataccctgcacactggaacctgtcttcggaaaaatgtttgaactcacttgtacattgcctctcgaaaaagatcttaagatcacattatatgattacgatctcctaagtaaagatgagaaaataggagagacagtcgtcgatctcgaaaaccggctgttatccaaatttggagcaaggtgcgggcttccacagacatattgcgtctctggacccaaccagtggcgggaccaactcagaccttcccagctattacacttattttgccagcagcatcgggtcaaagcacccgtgtatcggactgatagagttatgttccaggacaaggaatattctattgaagaaatcgaagctgggagaatacccaatcctcacctagggcctgtcgaggagagactcgcattacatgtgcttcaacagcaggggctcgtgccagaacatgtcgaatctcggcccctatattctcctttgcagcccgatatcgaacagggaaaactgcagatgtgggtagatctattccccaaggccttgggaaggccagggcctccatttaacattactcctcgtcgggccagacgattctttctccggtgcattatctggaatactagggatgtgatcctggatgatcttagtctaactggggagaaaatgagtgatatctacgtaaaggggtggatgatagggttcgaagaacacaaacaaaaaacagatgttcattatcggtctctgggaggggaaggaaatttcaattggagattcatctttccattcgattatctaccagccgaacaagtgtgtacaatagcaaaaaaggatgcgttctggcggcttgataaaacagaatctaaaatccctgcccgcgtggtgtttcagatctgggataacgataagtttagtttcgatgattttctcgggtcacttcagttggatctgaatcgcatgcctaaacccgcaaaaacagcaaaaaagtgttcccttgatcagctggatgatgcctttcatcccgagtggtttgtgtccctgttcgaacagaaaacagttaaaggatggtggccctgtgtagcagaagagggggaaaaaaagatccttgctggaaaacttgaaatgacactcgaaatcgtggcagaatctgaacacgaggaaaggcccgctgggcagggaagagatgaacccaacatgaatccaaaattagaggatccaaggcgacccgatacaagttttttatggtttactagtccatataagactatgaaatttatcctatggcgaagatttaggtgggcaattatcctcttcataatactatttatccttctgcttttcctagccatcttcatatatgccttccccaattatgccgcaatgaaactcgtaaagccttttagt

SEQ ID NO: 10684 - DNA, 6243 bp, Artificial Sequence
  Description of Artificial Sequence: Synthetic coding sequence
atgctgtgctgtctgttggtccgcgcatctaacctgccttctgcaaagaaagaccgtcgttcagatccagtggcttcacttacctttcgcggcgtaaagaagcgtactaaggttattaagaacagtgttaacccagtatggaatgagggatttgaatgggatctcaaaggaatccccctggatcaaggttcagagttgcacgtagttgtgaaagaccacgagacaatgggccgcaaccgtttcctgggtgaggctaaggtgcctctccgtgaagtgctggcaacaccatcattgagcgcttcttttaatgcccccttgcttgatacaaaaaaacagcccacaggtgcaagtctcgtgctccaggttagttatacacctctccccggagcagtcccactgtttcccccccctacccctctggaaccatcccccaccttgcccgatcttgatgttgtcgcagacactggtggcgaagaggacaccgaagaccagggactgacaggtgacgaggctgagcctttcctggaccagagcggaggtcccggcgctcccaccacacccaggaagctgccttcccgtccccctccccactaccctggaattaaaagaaaacgttccgctccaacaagtcgcaaactgcttagtgataaaccacaggatttccagatcagagtgcaggtgatcgaaggccgccagttgcccggcgtgaatatcaagccagtggtgaaggtaacagccgctggacagacaaagaggacacgcattcataagggcaactcccctctctttaacgagacactgttttttaacctgtttgactctcccggagagcttttcgacgaaccaatcttcataaccgtcgtggattcacgttccctgagaactgatgcactgttgggcgagttccgtatggatgtgggcactatctacagagaaccccgccacgcctatctccgcaagtggctcctcctgagtgatcctgacgacttctccgcaggtgcccgcggatatcttaagacttcattgtgcgtgctcggccccggcgacgaggcccccctggagcgcaaggatcccagcgaggataaggaagacatcgagtctaacctgctgagaccaactggagtggccctgcgcggagcacacttctgcctcaaggtcttccgcgccgaggatttgccacagatggacgatgccgtgatggacaatgtcaagcagattttcggatttgagagcaacaaaaaaaaccttgttgacccttttgtcgaggtgtcattcgccggcaagatgctttgttccaaaatcctggaaaagacagccaaccctcagtggaaccagaacatcacactgcccgccatgtttccttctatgtgcgaaaagatgcgcatccgtattatcgattgggatagacttactcataatgatatagtggccacaacctatctgtctatgtctaaaatatcagccccaggaggagaaattgaagaggagcctgccggtgccgtgaaaccaagcaaggcaagcgacctcgacgactacctgggctttctccccaccttcggcccatgctacattaatctgtacggatcaccaagagaattcacaggatttccagacccctatacagagctgaacacaggcaagggtgagggagtggcataccgtggaaggctgctgctcagtctggaaaccaagctggtagaacattctgagcagaaggtggaggatctgccagccgatgatattttgagggtggagaagtacttgcgtagacgcaaatactctctgtttgctgccttctattccgctaccatgcttcaggacgttgacgatgctatccagttcgaggtgtctatcggaaattatggtaacaagttcgacatgacctgcttgcctctcgccagcaccacacagtatagtcgcgccgtgttcgacggttgccattactactatctgccttggggaaacgtgaagcccgtggtggtgttgtcttcctactgggaggatatttcacaccgcatcgagacccagaatcagctgctcggaatcgctgatcgtctcgaggccggtctcgaacaggtgcatcttgcactgaaggcccagtgttctaccgaagatgttgacagcttggtggctcaacttactgatgaattgatcgctggttgctcccagcctcttggagatatccatgagactccatccgctacccatttggaccagtacttgtaccagctgcgtacacaccacctgagtcagattaccgaagcagccctcgctcttaagctgggtcacagtgaactgcctgccgccctggagcaggctgaggattggctgctccgcctccgtgctctcgcagaagagccccagaattcactccctgatatcgtcatctggatgcttcaaggcgataaacgtgtcgcctatcagcgcgtgcctgctcatcaagtcctcttctcacgtaggggagcaaattactgcggtaagaattgtggtaaattgcaaactattttcctcaagtatcctatggaaaaggtgcctggagccaggatgcccgtccagatccgcgtgaaactctggttcggactgtccgttgacgaaaaggagttcaaccagtttgccgagggtaaactgtccgtttttgccgagacctatgaaaacgagacaaaactcgctctggttggcaactggggcaccactggactgacttaccctaagttcagcgacgtgactggtaagatcaagctcccaaaagacagctttaggccttcagccggctggacttgggccggtgactggttcgtatgccccgagaaaacactccttcatgacatggacgctggacacctgtctttcgttgaagaggtgttcgagaaccagactaggctgcctggcggccagtggatctatatgtccgacaattatactgatgtgaacggagagaaggtcctccccaaggatgacattgaatgccccctgggctggaagtgggaagacgaggagtggtctacagacctcaatagggctgtggatgagcagggatgggagtacagtatcaccatccctcccgaacgtaagcctaaacactgggttcccgccgagaagatgtattatactcaccgccgtagaaggtgggtgagacttcgtaggcgtgatttgagccagatggaagcactgaaaaggcaccgtcaggcagaggccgagggcgagggttgggagtatgcatccttgttcggctggaagttccacctggaataccgtaaaactgacgctttccgccgtagaaggtggagaaggcgtatggagccactggaaaagactggtccagccgctgttttcgcactcgaaggcgctctgggaggtgtgatggacgacaagagcgaagactcaatgtcagtgagcaccttgtctttcggcgtaaaccgcccaacaatttcttgtatctttgactacggcaacagatatcacctgcgctgctatatgtaccaggcaagggacctggccgccatggacaaagacagctttagtgatccttacgctatcgtgtcatttttgcaccaaagtcaaaagaccgttgtagttaaaaacacccttaaccccacttgggatcagaccctcattttctacgagatagagattttcggcgaacctgctaccgtcgctgagcagccccccagcatcgttgtcgagctgtacgaccacgacacctacggtgccgacgagttcatgggccgttgcatttgccaaccatccctcgagagaatgcccaggctggcatggttccccttgacaaggggaagtcagcctagcggcgagctgctcgccagtttcgaactcattcagagggaaaaacctgccatacatcacattcctggttttgaggtgcaggagacaagccgtatcctggacgaatcagaggatacagatctcccctatccacccccccagcgcgaggccaatatctatatggtgcctcaaaacattaagccagctctccaacgtaccgctattgaaattctcgcctggggcctgcgcaacatgaagagctaccaactggcaaacataagttcaccctcactcgtcgtggagtgtggaggccaaaccgttcagtcctgcgtcataagaaatctgagaaagaacccaaactttgacatctgtaccttgtttatggaggttatgctcccccgcgaggaactctattgtccccccatcaccgtcaaggttatcgataatcgtcagttcggcaggaggcccgtggtgggtcagtgcaccataaggtccctggagtcattcttgtgtgacccctactccgctgagtccccttctcctcagggtggtccagacgacgtgagtctcctttccccaggagaagacgttctgatcgatattgatgacaaagagcccctgatccctattcaggaggaagagttcattgactggtggtccaagttctttgcttcaatcggtgagcgtgaaaagtgtggatcctacctggagaaagacttcgacacattgaaggtatacgacacccagttggaaaatgttgaagcctttgaaggcttgtcagatttctgtaataccttcaagttgtacaggggcaagacccaggaggagacagaggacccctcagtgatcggagagttcaagggtctcttcaagatctatccacttcctgaggaccctgccatccctatgcctccacgccagttccaccagcttgctgcccagggtcctcaggaatgcctggtgaggatttacatcgtgcgtgcattcggcctgcaacccaaggaccctaacggaaaatgcgacccctacatcaaaatcagcatcggtaagaaatctgtctctgaccaagacaactacatcccctgcactctggaacccgtgttcggaaaaatgtttgagcttacttgcacacttcctttggagaaggatctgaagattaccctctacgattacgacttgctgagcaaggacgagaaaattggcgagacagtggttgacctggaaaacagactgcttagtaagtttggtgccagatgcggtctcccacaaacctactgcgtcagcggacccaaccagtggagagatcagctgcgtccctcacagttgctccacctgttctgtcagcagcacagagtcaaggcccctgtgtaccgcaccgatcgcgtaatgttccaagacaaggaatatagtatcgaggaaattgaggcaggaaggattcctaaccctcatcttggccccgtggaagagcgcctcgcactccacgtgctgcagcagcaaggcctggtgccagaacacgtagagtctaggccactttactctcctctccagcccgatatcgaacagggcaagctgcagatgtgggtggacctctttcctaaagccctgggcaggccaggacctccctttaacataaccccaagacgcgctagacgctttttcttgcgttgcatcatatggaacactcgcgatgttatcttggatgatctgagccttactggtgagaagatgtctgatatttacgtaaagggttggatgattggattcgaggagcacaagcaaaaaaccgatgtgcattataggtccttgggaggcgagggaaatttcaactggcgtttcatcttccccttcgactaccttccagccgaacaagtgtgcaccatcgctaaaaaggatgccttctggcgtctcgacaaaactgaatcaaagatacctgcccgcgtagtgtttcagatctgggacaatgacaagttttcttttgatgacttccttggcagcctgcaacttgatcttaaccgtatgccaaagcctgcaaagactgctaagaagtgctcactcgatcagttggatgacgcattccaccccgaatggttcgtttctcttttcgagcagaaaacagtcaagggttggtggccatgtgtggctgaggagggcgagaaaaagattctcgccggtaagctggagatgaccttggaaatcgtggccgagagcgaacacgaggaacgcccagccggccagggaagggacgagcctaacatgaacccaaagcttgaggacccaaggaggcccgacacatctttcctgtggtttacatccccatacaaaacaatgaagtttatactgtggagacgctttcgctgggccataatcctctttatcatcctcttcatcttgcttttgtttcttgctattttcatttacgctttccccaactatgcagccatgaagctggtgaagccttttagc

SEQ ID NO: 10685 - DNA, 6243 bp, Artificial Sequence
  Description of Artificial Sequence: Synthetic coding sequence
atgctttgctgtctccttgtgcgggcctcgaatcttccttccgccaagaaggatcgcagatcggatccagtggcatccctgactttcagaggtgtgaagaaacgcacgaaagtcatcaagaattccgtgaacccagtgtggaacgaaggatttgagtgggacctgaaaggaattccactcgatcagggttcagagttgcacgtcgtcgtgaaagatcatgaaacgatgggacgcaacagatttctcggtgaagccaaggtccctctccgggaagtgctggctactccgtcactctcggcctcctttaacgccccacttcttgatactaagaaacaacccacgggagcctccctggtgctgcaagtctcgtacacccccctcccaggtgcagtgcctctgtttcccccgcccactccactggaaccgtcaccgactctccccgatttggatgtggtggcagacaccggcggagaggaagataccgaagatcaaggacttactggtgatgaagcagaaccgttcctcgatcagtctggtggtcctggagcaccgactaccccccggaaactgcccagcaggcctccccctcattaccccggtattaagaggaagcggagcgcaccaacttcaaggaagctgctgtcagacaaaccacaagatttccaaattagagtccaggtgatagaggggcgccaactccctggtgtgaacataaagccagtggtgaaggtgactgccgccgggcaaactaaaagaactcgaatacataaaggtaactcgcccttgtttaacgagacgcttttcttcaacctgtttgattcccccggagaactctttgacgagcccatctttatcactgtggtggattcccgatccttgaggaccgacgcccttcttggtgaattccgaatggatgtggggaccatatatcgggaaccacgacacgcataccttcgaaaatggcttttgctctcggatcctgatgatttttcggccggtgccaggggataccttaagacctccctttgtgtcctcggtcctggagatgaagccccacttgagagaaaggatccttccgaggacaaagaggatatcgaatcgaacctgctgcggccaaccggggtggcacttcgcggagcacatttttgtctgaaagtgttcagagcagaagatttgccacaaatggatgatgcggtgatggataacgtgaagcagatcttcggttttgagtccaataagaaaaacctcgtcgatccatttgtcgaagtgtcctttgctgggaagatgctctgtagcaaaatccttgaaaagacggcaaacccacagtggaatcagaacattaccctcccagcaatgtttcctagcatgtgcgagaagatgagaatacgcataatcgattgggatagacttacccataatgatatcgtcgcaactacttacctctccatgtcgaagatttccgcaccaggtggagaaattgaagaagaacccgcgggagcagtgaaaccaagtaaggcttcggacctcgatgactacctcggatttctgcccacctttgggccctgttacataaacctttacggaagccctagagaatttactggattcccagatccatacaccgaacttaacactgggaaaggagaaggtgtggcatacaggggtaggctgctcttgtccctcgagactaagctggtggaacactccgaacagaaggtcgaggatcttccagcggatgatattcttcgtgtagaaaagtacctgagacggcggaaatactccttgttcgcagcattttactccgcaacgatgctgcaagatgtggacgatgccattcaatttgaagtctccatcgggaattatggcaacaagttcgatatgacttgcctgcccttggcatccactactcaatactcccgagcagtgtttgacggatgtcattactactatctgccatggggtaacgttaagccagttgtggtcttgagctcgtactgggaagatatttcgcataggattgaaactcaaaaccaactgcttggtattgcggataggcttgaagcggggcttgaacaggtacacctggcattgaaggcgcaatgctcgaccgaggatgtcgattccctcgtcgctcagctgaccgatgaacttatcgcaggttgttcgcagcctctgggcgatatacacgaaactccttcagcaactcatctggatcaatacctttaccagcttagaacccatcacctgagccagatcactgaagctgcacttgccctgaagctgggccacagcgaactgcctgccgctcttgaacaagccgaagattggctgctgcgacttcgggccctggcagaggaacctcaaaatagcttgcctgacatagtcatttggatgctgcagggagataagcgcgtggcgtaccaaagggtgccagcacatcaagtgctgttttcgagacgaggtgccaactattgcgggaagaattgcggtaagctgcaaacgatatttctgaaataccctatggagaaggtgccaggtgcgcgcatgcctgtgcagatccgcgtgaagctgtggtttggactgagcgtggacgaaaaggagtttaaccagttcgcagaaggtaagctgtccgtgttcgcagaaacctacgaaaacgaaaccaagctggcacttgtgggtaactgggggactaccggactcacctaccctaagttctccgacgtgaccggtaaaatcaaacttcccaaggattcgtttcgcccaagcgcaggctggacttgggctggagactggttcgtgtgtcctgaaaaaacgctccttcatgacatggatgccgggcacctgtcgtttgtggaggaggtgtttgagaaccagactaggctgcctggaggacagtggatttacatgtccgacaactacacggacgtgaacggagaaaaggtgctgcctaaagatgatattgagtgtccactgggctggaagtgggaagatgaagagtggtcgaccgaccttaacagagccgttgatgagcaaggttgggagtactcgatcactattccgccagaacgcaagccaaagcattgggtgcctgcagaaaagatgtactacacccatagaaggcggcggtgggtcagacttaggaggcgggatctgtctcaaatggaagcactcaaacgccatcggcaggccgaagcggaaggagagggttgggaatacgcgtccctttttggatggaagtttcatctggaatacagaaaaactgatgcctttagacgcaggcgatggcgtcgtcgaatggagcctctcgagaaaaccgggccggctgctgtatttgccttggaaggtgcccttggaggagtgatggatgataaatcagaagattcaatgagcgtgtcgactctgtcgttcggcgtgaacagacccactatctcatgtattttcgactatggaaatcggtaccatcttagatgttacatgtaccaggccagggacctggcagcgatggacaaagattcattttcagatccgtacgcaatcgtcagctttttgcatcagtcccagaaaactgtcgtggtcaaaaacaccctcaacccaacctgggatcaaaccctgatcttctatgagattgagatcttcggggaacctgctacggtggcagaacaacctccctcgatagtggtggaattgtacgatcatgatacctacggagccgatgagttcatggggcggtgcatctgccaaccctcgctcgaacgaatgcctagacttgcatggttcccactgaccagaggatctcagcctagcggagagctgcttgcctcgtttgaactcatccagagagaaaagcctgccatacatcacatacctggattcgaagtgcaagagacttccagaatcctggacgagtctgaagataccgaccttccctacccaccccctcaacgagaagcgaacatctacatggtcccacagaatatcaaaccagcactgcaacggactgcaattgagattctggcatggggtctgagaaacatgaagtcataccaattggcaaatatctcatcccctagcctggtcgtcgagtgtggtggccaaaccgtgcaatcctgtgttatccgaaatctcagaaagaatcccaacttcgatatctgtacgctctttatggaagtgatgctgccccgggaagagttgtactgcccaccaatcactgtgaaggtgatcgacaatcgccagtttggtcgtagaccagtggtcgggcaatgcacgataagatcactggaatcatttctttgcgacccttactccgccgaatctccatccccccaaggcggacctgatgacgtgtcgctgcttagcccgggagaggatgtcctgatcgatatagatgataaagaaccactgatcccgatccaggaggaagagttcatcgattggtggtcaaagttttttgcatccatcggagaacgagaaaagtgtgggtcctacctcgagaaagactttgatactctgaaggtgtacgatacgcagctggaaaatgttgaagcctttgaaggcctgagcgacttctgtaacaccttcaaactctatcgtggcaaaactcaagaagaaaccgaggacccaagcgtcattggagagtttaaaggccttttcaagatctacccacttcctgaagatcccgcaatcccaatgccccccagacagttccatcagcttgcagcccaggggcctcaggaatgccttgtccgtatttacatcgtgcgggcattcggactccagcctaaagatcccaatgggaagtgcgacccatacatcaagatatcaattggaaaaaagtcggtgagcgaccaagataactacatcccttgtactcttgagcctgtgtttggaaagatgtttgagcttacttgtacgctcccccttgaaaaagatctgaagattactctgtacgattacgatttgctgagcaaggatgagaagattggtgaaaccgtcgtggacttggaaaataggctcctgtcaaagtttggcgcaagatgtggcttgccgcagacttactgcgtgtcaggacctaatcaatggcgagatcaactgaggccgtcccaacttcttcatctcttctgtcagcaacaccgcgtgaaggccccagtctaccgcactgaccgtgtgatgtttcaggacaaggaatatagcattgaggagatcgaagcagggcgtattcctaacccgcatctgggacctgttgaggagcggctggctctccatgttctgcaacagcaggggcttgtgcccgaacatgtggaatcgcgccctctctattcccctcttcaacctgatatagaacaaggaaaacttcagatgtgggttgaccttttccccaaagcactcggaaggccaggaccaccttttaacattactcccagacgggcacgccgcttttttcttcgctgtatcatttggaataccagagatgttatactggatgacctctctcttaccggagaaaagatgagcgacatctacgtcaagggttggatgattgggtttgaggaacacaagcaaaagactgacgtgcactacaggagcctgggaggcgagggaaatttcaattggcgctttatctttccattcgactaccttccagctgagcaggtttgtactattgcaaaaaaggacgcgttttggagattggataagactgaaagcaagattcctgctagggtggtgtttcaaatttgggacaatgataagttctcctttgatgatttcctcggttcgcttcagctcgatcttaacaggatgccaaaaccagctaagactgcgaagaaatgttcccttgaccagctggatgacgcgttccatcccgagtggtttgtgtcgctttttgagcaaaaaactgtgaagggatggtggccttgtgtggcagaggaaggcgagaaaaagattcttgcgggtaagctggagatgactctggagattgtggcagaatcggagcatgaggaacggccagcaggccaaggaagagacgaacctaacatgaatcctaaacttgaggaccctcgacggccagacacctccttcctctggtttacttccccctacaagactatgaagtttatcctttggagacgttttcgatgggcgattattctctttatcatccttttcattctcctcctctttcttgccatctttatctacgcgtttcctaactacgcagcaatgaaacttgtgaagcctttttca

SEQ ID NO: 10686 - DNA, 6243 bp, Artificial Sequence
  Description of Artificial Sequence: Synthetic coding sequence
atgttgtgttgcttgctggtccgtgcctcgaacctgccctcggcaaagaaggataggaggtccgatcctgtggccagtcttaccttccggggggtgaaaaagcggacgaaggtgattaaaaatagcgtcaatcccgtatggaacgaagggttcgaatgggacttaaagggcatcccactggatcaaggttcagagttacacgtggtcgtgaaggatcacgaaactatgggacggaaccgattcttgggcgaagccaaagttccactccgggaagtacttgctacacccagcctcagcgcaagctttaatgctcccttgctcgatactaaaaagcagccgacaggcgccagccttgtcctgcaagttagctacactcccctacctggggctgtcccactatttcccccccccacgcctctcgagccgtcaccgacgttgccagacctagacgtagtggccgataccgggggagaggaggacactgaggaccagggcttgactggtgacgaagccgaacccttcctcgaccagtccgggggtccaggagcccctacaacacccagaaagctccccagccgacctccccctcattacccaggcatcaagcggaagcggagtgcccctacctcgagaaaactgctgtctgataaaccgcaggattttcagatacgtgttcaggtgattgaggggcgccagttacccggtgtgaatatcaaacctgtggttaaggtcacggccgccgggcaaactaagcgaaccaggatccataagggaaactcaccactgtttaacgagacactgttcttcaacctgttcgactcacctggcgagcttttcgacgagccaatttttatcaccgtggtcgatagcagatcactgcgcaccgacgctcttctgggcgaatttcgcatggacgtggggacgatttacagagagcctcggcatgcatatctacgaaagtggttgctgctgagcgatccggacgatttcagcgccggagcccggggttacctgaaaaccagtctttgtgtgttaggaccaggcgatgaggccccactggagaggaaagatccctcagaggataaggaagacatcgaatccaatctgctacgacccaccggcgtggcccttcgaggcgcccacttctgcctcaaagtgtttcgcgcggaagacttgcctcaaatggacgatgccgtcatggataacgtcaagcagatctttggcttcgaaagtaataaaaagaatctggtggatccttttgttgaagtctcatttgccgggaagatgctgtgctctaagatattggagaagaccgccaaccctcagtggaatcagaatattacgcttccagccatgttccctagcatgtgtgagaaaatgcgaatcagaatcattgactgggacagacttacccataacgatattgttgcaactacctacctgtcaatgagcaaaatatcagccccaggcggggaaatcgaggaggagccagctggggccgtcaaaccttccaaggcaagcgacctggatgactacctcggctttctgcctacttttggaccatgctacataaatctctacgggtccccaagggagtttactggatttcctgacccatatacggagctgaacaccggaaaaggcgagggagttgcataccgaggacgcttgttgctctctctcgagacaaaactcgtagaacactctgaacagaaggtagaggatctgccggccgatgatattctgagggttgaaaaatatctgcgccgccggaagtatagtctgttcgccgccttttacagtgctacaatgttgcaggatgtagatgatgcaattcaatttgaggtttccatagggaactacggcaataaatttgacatgacgtgcctccctctagcttctaccactcagtattctcgagctgtcttcgatgggtgccactattactatctgccctgggggaacgtcaaaccagttgtggttctgtcctcctactgggaagacattagccatagaattgaaacccaaaaccagctgcttgggatcgctgaccgactggaggccgggttggagcaagtgcacttagcccttaaagcacagtgttccacagaggatgtggactcactagtagcacagctgactgacgagttaatcgccggctgcagtcagccactgggcgatattcacgagacaccctcagctactcatctggatcagtacttataccaattgagaacccaccatctctcccagataacagaggctgccctggctcttaagttgggacacagtgagctgcccgccgcccttgagcaggcagaggactggttattgcgacttcgtgcccttgccgaggaacctcagaattctctgcctgatatcgttatttggatgctgcagggtgacaagcgtgtggcctatcagcgcgtacccgcacaccaggtcttgttttcacgacggggagctaattattgtgggaaaaactgcggtaagttgcaaactatttttcttaagtacccaatggagaaagtgccgggcgctaggatgcctgtccagattagagttaaactgtggtttggacttagtgtggatgagaaggagtttaatcagtttgcagaggggaagttatccgtgttcgccgagacatatgagaacgagaccaagttagctctggtggggaattgggggactacaggcctgacttaccccaaattctctgatgtgaccggaaagataaagcttcctaaggattcctttagaccatccgcgggctggacctgggcgggcgattggtttgtctgccctgagaaaactctgctccatgacatggacgccggacacctgtcattcgtcgaggaagtttttgagaaccagacacgactccctggaggccagtggatctatatgtcggacaactacacggacgtcaacggcgagaaagtgctgccaaaggatgacatagaatgtccgctggggtggaagtgggaagatgaagagtggtcgaccgacctgaatagagccgtagatgagcaggggtgggagtacagcattaccatcccacccgaacggaagccgaagcattgggtgccagcagaaaaaatgtattatacacaccggcggcggagatgggttaggctgcgtcgcagggacctgtcacagatggaggctctgaaacgccaccgccaggctgaagctgaaggtgagggctgggaatatgctagcctgtttggctggaaattccatctggaataccgcaaaaccgatgcattccggagacggcgctggcgcagaaggatggagcccctagaaaagaccgggcctgccgctgtgttcgctctggagggggctctgggcggcgtgatggatgataagtcggaggactccatgtccgtgagtacactgtctttcggcgtcaataggcccacaattagctgtatctttgattatggtaatcgctaccaccttagatgctacatgtaccaggccagggatctggccgctatggacaaagacagtttctctgacccatatgctattgtttcatttttacatcagtctcagaaaaccgtggtggtgaaaaatacgctcaaccccacctgggatcaaaccctgatcttttacgaaatagagattttcggtgaacccgccactgtggcagagcaaccacccagcattgtggttgaactgtacgaccatgacacatacggcgccgacgagttcatgggccgttgtatctgccagccctcattggaacggatgcctagactcgcttggtttcccttgacccggggatctcagcctagtggggaactcctcgcctcgttcgaactcatccagagggaaaagcctgctatccaccatatccccggttttgaagttcaggagacgagccgaattctggacgagtcagaggacactgatttaccctacccccccccccagcgcgaagctaatatctacatggtgcctcagaacattaaacctgctctacagagaacagctatcgaaattctggcatggggactacgaaacatgaagtcctatcagctcgctaacatttcaagccctagcctcgtagtggaatgcggtggccagacagtgcagtcctgcgtgattagaaacctgaggaagaatcccaacttcgatatctgtactctctttatggaggtcatgctacccagggaagagctctattgccccccaattacagttaaggtgattgacaaccggcagtttgggagaaggccagtggttggacagtgcactattcgcagtctcgaatcatttctgtgcgacccctatagcgccgagtccccctctcctcagggaggcccagatgacgtgagcctcctgtcccccggcgaggatgtacttatagatattgatgacaaggaacctcttatccctattcaggaagaggagttcattgattggtggtccaaattcttcgcatccattggtgagcgagagaaatgcgggtcatatctagagaaggatttcgacactctgaaagtgtatgatacgcaattggaaaatgtggaagcttttgagggtctcagcgatttttgtaacacatttaaactgtataggggaaagacacaggaagagacggaggacccctcagtcatcggagagttcaaggggctctttaagatatatcccctgcccgaggaccctgcaatacctatgcccccaagacaatttcaccaactggctgcccaggggccccaggaatgcctggtgaggatatatatagtgcgcgccttcggactgcaaccgaaggatcctaatggcaaatgcgatccgtacattaaaatttcaataggtaagaagagcgtgtcagaccaggataactacataccatgtaccctcgaacccgtgttcggaaagatgttcgagctgacctgtaccctgcccctggagaaagatctcaaaatcaccttatacgactacgaccttttaagtaaggatgaaaaaattggcgaaaccgttgtagacctggaaaataggctgttgagtaagttcggggccaggtgcggcctaccgcagacttactgcgtcagcggcccgaatcagtggagagatcagctcagaccatcgcagctgcttcacttattctgtcagcaacaccgggtcaaggctcctgtctacagaacggatagagtaatgtttcaggacaaagagtactctatcgaggagatcgaggcgggccgtattcctaacccacaccttggccctgtggaggaaaggctggctctgcatgttctgcaacagcagggcctcgtgcctgagcatgtggaatccaggcctctgtatagccccttgcaaccagatattgagcaaggtaagctacagatgtgggtcgacctgtttccaaaggctcttggtaggccagggccgccatttaatataacacccagacgagccaggagatttttcctgagatgcattatttggaacaccagagacgtgatactcgacgatctttccttgactggggagaaaatgtcggacatctacgtcaaggggtggatgatcggttttgaggagcataagcagaaaacagatgtgcactaccggtctctggggggagaagggaatttcaattggcggtttatatttcccttcgattatctacctgccgagcaagtgtgtaccatcgccaagaaagacgctttttggaggttggataagaccgagagcaaaatacccgctcgagtcgtcttccagatttgggataacgacaaattctcctttgatgactttctggggtccctgcagctggacctgaatcggatgcccaaacctgcaaaaacagctaagaagtgcagtttggatcaactggacgatgcctttcacccggagtggtttgtttccctgtttgaacagaaaacggtcaaagggtggtggccctgtgtagcagaggagggagaaaaaaagatactggctggaaagctcgagatgaccctggagattgttgcagagtctgagcacgaggagcgccctgccgggcagggacgcgatgagcccaacatgaatcccaaactcgaggatccccgccgccccgatacaagcttcctctggttcacaagtccttacaagacaatgaagtttatcctctggcgccgatttaggtgggcaattatcctgttcatcattctgtttatcctgctgctgttcctcgctatctttatatatgcatttccaaactatgccgcaatgaagttggtcaaacctttctca

SEQ ID NO: 10687 - DNA, 6243 bp, Artificial Sequence
  Description of Artificial Sequence: Synthetic coding sequence
atgctatgttgtcttctggtccgtgcatcaaatttgccgagcgcaaaaaaagatcgtagaagcgatcccgtcgcgagtctgactttccgcggggtcaaaaagcgaaccaaagttattaaaaactcagtgaatccagtctggaatgaaggattcgagtgggacctcaagggaatcccgctcgatcaaggttcggagttacacgttgttgttaaagatcacgagacaatgggacgtaataggtttttgggtgaagctaaggttccccttagagaggtcttggccacgccatcgctttcagcgtcgtttaacgcaccactgcttgatacaaagaaacaaccgacgggagcttcactcgtgttacaagtgagttatactcccctaccgggagccgtgcctttgtttccacctcctacaccactagagccttctccaacgctcccagatttggatgttgttgctgatactggaggagaggaggacacagaagaccaaggactaactggcgacgaagcagaaccttttctcgaccaaagtggaggaccaggagctcctacaactccgagaaagcttccatcacgaccaccgccacattatccaggaatcaagagaaaacgttccgccccgacatcccgaaagctcttgagcgataaacctcaagactttcagatccgtgttcaagtgatcgaaggccgtcaattgccgggtgtgaacattaaaccagtggtaaaagtgactgctgctggccagacaaaacggaccagaattcataaggggaacagcccgcttttcaatgaaaccctgttctttaatttgtttgattcaccgggtgaacttttcgatgaacctattttcattaccgtcgttgattcccgttctctgcgaactgacgcgctactgggcgaattcagaatggacgtcggaacaatatatagagaaccacgacacgcctatcttcgtaaatggctcctcttgtctgatccagacgatttctcagctggagcccgcggttacctcaaaacctctctgtgtgttttgggacctggtgacgaggcgccgctcgaacgcaaagatccatcagaggacaaggaggatattgaatcaaacttgcttaggccaacaggagtggcattgcgtggagctcatttttgtctaaaagtgtttcgtgctgaagatctaccacagatggacgatgctgtcatggataacgtaaagcaaatcttcggatttgagtccaacaagaaaaaccttgttgatcccttcgtcgaagtgtcatttgcgggaaagatgctttgctcgaaaatcctagagaagactgctaatccgcaatggaatcagaatataacacttccggcgatgtttccgagcatgtgtgagaagatgcgtatcagaattattgattgggaccgactcacccataatgatattgttgcaacgacttatctcagcatgtcaaaaatatcagcaccaggcggagaaattgaagaagagccggcaggtgcagttaagccttccaaggcctccgatctcgatgattatctgggattcttgcctacttttggaccatgttacattaatttgtatggatccccgcgtgaatttacaggattccccgacccatatacagagttaaacactggaaaaggggagggagtggcttaccgggggcgtttactgctcagcctggaaaccaaattggttgaacactctgaacaaaaagtagaggacctaccggcagatgacatcttgagagtggaaaagtacctccgtagaagaaaatactccctttttgccgctttctattcagctactatgttgcaggatgtggatgatgcaattcaattcgaagtgtcaattggaaattatgggaataaatttgatatgacttgcttacccctagcttcgactacccaatactcgcgggctgtgtttgatggttgccactattattacctgccatggggaaatgttaaaccggtcgtggttctgtcctcctattgggaagatatttctcaccggatcgagacgcaaaatcaacttttaggaatcgcagataggctggaggcaggattggaacaggtacatctagcattgaaagcgcaatgttctaccgaggatgtagattctcttgttgcgcagctcacagatgagctgattgcaggttgcagccagccattgggagatattcatgagactccgagtgccacacatctcgaccaatacctgtaccaactccgaacccaccatctgagtcaaattacggaggccgcgttggctctaaaactgggtcattccgagcttccagctgcactggaacaagcagaagactggcttctacgattacgggcgttggcagaagaacctcaaaacagtttaccggatatcgttatatggatgcttcaaggagataaaagagttgcttatcaacgggtgccagctcatcaggtgcttttttcaagacgcggagctaattattgtgggaaaaattgcggcaagctccagactattttcttgaaatatccaatggagaaggttccaggagctagaatgccggtgcaaatacgcgttaaattatggtttggattgtccgttgatgaaaaagaattcaatcagttcgcggaaggtaaattgtctgttttcgctgaaacttatgaaaatgaaacaaaactggctcttgtgggtaactggggaactactggactcacctacccaaagttttcagatgttacgggaaaaatcaaacttccaaaagatagtttcagaccaagtgctggatggacatgggcaggagattggtttgtctgtccagaaaagacgctgctgcacgatatggatgcaggccatctatcctttgtggaagaagtgttcgagaatcagactcgattgcccggtggacaatggatttatatgtctgacaattatacagatgttaacggagagaaggttttgccaaaggatgatattgaatgtccattgggatggaaatgggaagatgaggaatggtccactgacttgaatcgagctgtagatgaacaaggttgggaatacagtattactatcccaccagagagaaagccgaaacactgggttccggcagaaaaaatgtattacactcaccgacgtcgtagatgggttcgcctccgtcggcgtgacttaagccaaatggaggctttaaaacgacatagacaggctgaagccgagggagaagggtgggagtacgcaagtctctttggatggaaatttcacttagaataccgaaaaactgacgcttttcgacgcaggagatggagacgtcgtatggagcctttggaaaaaacgggccctgctgctgttttcgcccttgaaggagccctgggtggtgtgatggatgataagtctgaagattctatgtctgttagtaccctctctttcggtgtaaatcgaccaacaatttcgtgtattttcgattatggaaaccggtaccaccttcgctgctatatgtatcaggcacgtgatttagctgcaatggataaagattcgttctccgacccatacgccattgtatctttccttcatcaatcacaaaagactgtggttgtgaaaaacactttaaatccaacttgggaccagacactaattttctacgagatcgaaattttcggggaaccagctacggtcgcagagcaaccaccatcaatcgttgttgagctttacgatcatgacacttatggagcagacgaattcatgggacgctgcatatgtcaaccatccctagagcgtatgcctcgtctcgcttggtttccactcactaggggctcacaaccaagtggagaattgctggctagcttcgaattgatacagagagaaaagccagccatccatcacattccaggattcgaggtgcaagagaccagccgtatcctggacgaatctgaagacactgatcttccttacccgccgccacaacgggaagccaacatctatatggttcctcaaaatattaagccagctcttcagcgaactgccattgaaattctagcttggggactgcgtaatatgaagagctatcaacttgcgaatatttcatcaccaagccttgttgtggaatgcggaggtcagacagtccaatcctgcgttattaggaatctaagaaaaaatccaaattttgacatctgcaccttgttcatggaggtgatgcttccaagagaggaactttattgtccacccattactgttaaagttatagataacaggcagtttggccgaagacctgtagttggacaatgtacaatcagaagtctagaatctttcttgtgcgatccgtatagtgcagaaagtccatcgccacagggcggacctgatgatgtttccctactttcacctggtgaagatgtgttgattgatatcgatgacaaagagcctctcataccaatccaagaagaagaattcatagactggtggtcaaagttttttgcttcaattggagaacgagaaaaatgcggatcctatttggaaaaggatttcgatactttaaaagtgtacgacactcaactagagaacgtcgaagccttcgaagggctctctgatttctgcaatacttttaagctctataggggaaagacccaagaagaaactgaagatccaagcgtcatcggagaatttaaggggttgtttaaaatatatccactcccggaggatcccgcaattcctatgccgccacggcaattccaccaactcgctgcacaaggaccacaagaatgcttagttcgtatttacattgtccgggcatttggacttcaaccaaaggatccaaatggtaaatgtgatccatatatcaaaattagcattggaaagaaatccgtttcggaccaagataactatatcccatgcaccctcgaacctgtgttcggaaaaatgtttgaacttacatgtacattgccactcgagaaggatctgaagattactctctatgattatgatctcctttctaaagatgagaaaattggagagactgtggttgatttggagaatcgtcttctttcgaaatttggagctcggtgtggattacctcaaacatattgcgtaagcggacctaatcaatggcgtgatcaacttcgaccttcacagctactccaccttttctgtcaacaacatagagtcaaggccccagtatatcgtactgatcgagtgatgtttcaagataaagaatattcgattgaggaaattgaggctggacgaattcccaacccacatcttgggcctgttgaagagcggttagcattacatgttctccagcagcaaggtcttgtgccagaacacgttgaatccagaccactgtactcaccccttcagccagatattgaacagggtaaacttcagatgtgggttgatctcttccctaaagcactcggccgaccgggacctccattcaatatcacgccacgtcgtgctaggcgatttttcttgcgttgtatcatttggaacactcgtgacgtgatcttagatgacttatcactaactggagaaaagatgagcgatatctacgtgaagggttggatgataggatttgaagagcataaacaaaaaaccgatgttcattaccgatcactaggaggggagggtaattttaattggcggtttatcttcccgttcgattatctcccagctgagcaggtttgtactattgctaaaaaagatgctttttggcgacttgataagaccgaatcaaaaataccagcacgagtagtttttcaaatttgggacaacgataagttcagctttgatgattttcttggatctttgcaacttgatcttaaccggatgcctaagcccgctaagaccgctaaaaaatgttcactggatcagcttgatgacgcattccatcctgaatggtttgtttcactattcgaacaaaaaacagttaaaggatggtggccgtgcgttgcagaagaaggagaaaagaaaatacttgcaggaaaattggaaatgacgctcgaaattgttgctgagtcagaacacgaggagcgacctgccggacaaggacgagatgaaccgaatatgaaccctaaacttgaagatccacgtagaccagacacctcgtttctctggtttacttcgccatataaaactatgaaattcatcttgtggcgtcgattcagatgggcaattatattattcattatcttgttcatcttgttattgtttttagcgatttttatttatgcatttccgaactatgcggccatgaaattggttaagccattttcg

SEQ ID NO: 10688 - DNA, 6243 bp, Artificial Sequence
  Description of Artificial Sequence: Synthetic coding sequence
atgctgtgctgcctgctcgtgcgggcgtctaatctgccgtcagcgaagaaagacaggcgctccgacccggtcgcctcgctcaccttccgaggcgtgaagaagaggaccaaagtgattaagaactcggtcaacccagtgtggaatgagggcttcgagtgggacctcaagggaatcccactggatcaaggatcggaacttcatgtggtcgtgaaagaccatgaaactatgggacgtaaccgcttcctcggcgaggctaaggtcccccttcgtgaagttcttgccactccgtcactctcggcctccttcaacgcgccactgctggacactaaaaagcagcctaccggggcatccctggtgttgcaggtgagctacactccgctgccgggcgcggtaccacttttcccacctccaactccgctggaaccgagcccaaccctccccgacctggatgtggtcgctgacactggcggagaggaggataccgaggaccagggactcaccggggatgaagcggagccttttcttgaccagtcgggaggacctggagcccctacgactccgcgcaaactcccgtcgcggccgcccccgcactacccgggtatcaaaaggaagcgctccgctccaacgtcgcgcaaactgctctcggacaaaccgcaggactttcaaattagggttcaggtcatcgagggtcggcagctgcccggagtgaacatcaaaccggtggtcaaggtcaccgctgctggacaaaccaagagaaccagaatccacaagggtaattcaccattgtttaacgagactttgttcttcaacttgtttgattccccgggcgaactgtttgatgaaccgatcttcatcaccgtcgtggactcacggtccctccggacggatgcgctcctcggagagttccggatggacgtgggcacgatctaccgcgagccccgccacgcatacctccgaaagtggctcctgctgtccgacccggatgactttagcgcaggagcccgcggttacttgaaaacgtcgctgtgcgtgcttggtccaggtgatgaggctccactggaacgcaaggacccctctgaggacaaagaggacatcgagagtaacctcctgcggcccaccggcgtggcacttcggggggcgcatttctgcctcaaagtctttagagccgaagatctgccacaaatggacgatgccgtcatggacaacgtgaaacagatcttcgggttcgaatcaaataagaaaaaccttgtggatcctttcgtggaagtgtcgtttgcgggcaaaatgctgtgtagcaagattcttgaaaaaacggccaatccacagtggaatcagaatatcactcttcctgcgatgttcccttcgatgtgcgagaagatgcgcattaggataatcgattgggaccggttgacccacaacgatattgtcgcaaccacctacctctccatgagtaaaatctcagctccagggggagagatcgaagaggaaccggccggagcagtgaaaccttcgaaggcctctgatctggacgactaccttgggttcctccccacgttcggcccctgctacatcaacctctatggaagcccacgagaatttactggttttccggacccttacaccgagctgaacaccggaaaaggagaaggtgtggcgtatcgcggtcgcctcctcctctctttggaaaccaaactggtggagcattccgagcagaaggtggaggacctgccggcggatgatatcctgcgcgtggagaagtacctgcgcagacggaagtattcgctgttcgcggccttctactcagcgactatgctgcaggatgtggatgacgccatccaattcgaagtgtccattggtaattacggcaataagttcgacatgacctgccttccgttggcctcgaccactcagtactcccgagcagttttcgacggttgtcactactattaccttccctggggcaacgtgaagccagtcgtcgtcctcagcagctattgggaggacatctcccatcggatcgagactcaaaaccagctgctgggcatcgcagaccgcctggaagcgggactggaacaagtccatctggcactcaaggctcagtgttcgaccgaggacgtggattcattggtcgcccagctgaccgacgaactcatcgccggctgctcccaacctttgggtgatatccatgagactcctagcgccactcatctcgatcagtacctttaccagctgaggacgcaccatttgagccaaatcacggaagccgccctcgccctgaaactgggccactccgagttgcccgccgcgctggagcaagcggaggactggctgctgagactccgggcactcgctgaagagccacaaaattccttgccagacatcgtgatctggatgctgcagggagacaaacgcgtggcgtaccagcgggtcccggctcaccaagtgctgttctcccgcaggggagcgaactactgtggtaagaactgtggcaagctccaaactatcttccttaagtaccctatggagaaggtgccaggagccaggatgcccgtgcaaatcagagtgaagctgtggttcggactgtcagtggatgaaaaagaattcaaccagttcgccgagggtaaactgtcagtgtttgcggagacgtatgagaatgaaaccaagctcgcgcttgtgggcaattgggggaccaccggattgacttacccgaagttttctgacgtcactggcaagatcaaactgccgaaggatagcttcaggccttcggcaggatggacctgggcgggagactggttcgtgtgccctgaaaagaccctgctgcacgacatggatgccggtcacctgagcttcgtggaagaggtgtttgaaaaccagacccggctgcctggtggacagtggatctacatgtccgataactacactgacgtgaacggagaaaaggttctgcctaaggatgatatcgagtgtccgctgggatggaagtgggaagatgaagaatggtcgaccgacctcaaccgcgctgtcgacgaacagggttgggaatactcgattaccattccgcctgaacggaagccgaagcactgggtgccggccgaaaagatgtactacactcaccgacggcgacgctgggtccggctgcggcgccgggatctgtcgcagatggaggcccttaaacgccacaggcaggccgaagcagagggagaaggatgggagtatgctagcctgttcggctggaagttccatctggaatacagaaagactgacgcattccgccggcgccgctggcggcggcggatggagccactggaaaagaccggcccggccgcggtctttgcgctggaaggagctctgggcggcgtgatggacgataagtcagaagatagcatgtccgtgtccactctttcgtttggggtgaatcgcccaaccatctcctgcatcttcgattacggcaatcggtaccacctgcggtgctacatgtaccaggcacgcgacctcgccgccatggataaagactcattttcagacccatacgcaatcgtgagctttctccatcaatcgcaaaagactgtcgttgtgaaaaacactctcaatccgacctgggaccagaccctgatcttctacgagatcgaaatcttcggagaaccagctaccgtcgcagaacaacccccgtctatcgtggtcgagctgtacgatcacgatacctacggagccgatgaattcatggggagatgcatatgccagccaagcctcgaacggatgccgaggctggcctggttccctctgacccggggaagccagccgtctggcgagctcctggcctcattcgagctgatccagcgggagaagccggcaatacatcacatcccaggatttgaagtgcaggagacttcaaggatcctggacgagagcgaagatactgacctcccatacccaccaccgcaacgggaggccaacatctatatggtgcctcagaacattaagccagctctccaacgaacggcaattgagatccttgcctgggggctcaggaacatgaagagctaccagctcgcaaacatttcaagcccctctctggtggtcgaatgtggtggccagactgtgcagtcgtgcgtcattagaaatctgcggaaaaacccgaactttgacatctgcaccctcttcatggaagtcatgctcccacgggaggaactctactgtccaccgatcactgtgaaggtcatcgataatagacaattcggccggcgccctgtggtcggccagtgcactatccggtcgcttgaatcgttcctgtgtgacccctattcagccgaatcaccgtcacctcaaggcggacccgatgacgtctctctgttgtcgcctggggaggacgtcctgatcgatatcgacgataaggagccgctcattcccatccaagaggaagaattcattgattggtggtcgaaattcttcgcatccatcggagagcgggagaaatgcggaagctacctggagaaagatttcgataccctgaaggtctacgatacgcagctggaaaacgtggaggcttttgaggggctgtccgacttttgcaacacgttcaagctgtaccggggcaagactcaggaggaaaccgaagatcccagcgtgatcggagaattcaagggcctgttcaagatctacccgttgcccgaggacccggcgattccaatgcctccacggcagttccatcagctggcggcccaaggtccgcaggagtgtctcgtcaggatctacatagtccgggcattcggattgcagcctaaggacccaaatggaaaatgtgacccgtacatcaagatctcgatcgggaagaaatcggtcagtgaccaggacaactacatcccgtgcactctcgaacctgtgttcggaaagatgttcgagttgacctgcaccctgccgctggagaaggacctcaagatcactctttacgactacgacctcctgtcgaaggatgagaagattggtgaaactgtggtggatctcgagaacagacttctctccaagttcggggcacgttgtgggctgccgcaaacctactgcgtgtccggacccaatcagtggcgggaccaactcagaccatcccaactcttgcatctgttctgtcagcagcatcgcgtgaaggcaccggtgtaccgcactgatcgggtgatgttccaagacaaggaatactctatcgaggaaatcgaagcagggagaatcccgaatccgcacctggggcctgtcgaggagcgcctggcgctgcacgtcctgcaacagcaaggcctggtcccggaacacgtcgaaagcaggcccctgtacagcccgcttcagccggatattgagcagggtaagctgcagatgtgggtcgatctgttcccgaaggcattgggtagaccgggaccaccattcaatatcaccccacggcgcgcccgcagatttttcctgcgatgcattatctggaacactagggacgtcatcctggacgacctttccctcactggagaaaagatgtcagatatctatgtgaaaggatggatgattggcttcgaagaacacaagcaaaaaacggatgtgcactaccgctctctcggaggagaaggcaatttcaactggagatttatcttcccttttgattacttgcccgcggaacaggtctgcactatcgctaaaaaggacgctttttggagactggataagactgagtccaaaatccccgcacgcgtggtgtttcagatatgggacaacgacaaattctcctttgatgattttctcgggagcctccaactggacttgaataggatgccgaagccagccaagaccgccaaaaagtgtagcctcgaccaattggacgacgcctttcacccggaatggttcgtgagcttgttcgagcaaaagaccgtcaagggatggtggccttgcgtggcggaggagggcgaaaagaagatcctggccggaaagttggagatgactctggaaatcgtcgccgaatcagaacacgaagaacgaccggcgggccaaggacgggatgagcctaacatgaatcctaaactggaggacccgcggcgcccggacacctcgttcctctggttcacttccccctacaaaaccatgaagttcatcctgtggcggcgcttcagatgggcgatcatcctcttcatcatcctgttcatcctgctgctcttcctcgccatcttcatctacgccttccctaactacgcggcaatgaagttggtgaaaccgttctcc

SEQ ID NO: 10689 - DNA, 6243 bp, Artificial Sequence
  Description of Artificial Sequence: Synthetic coding sequence
atgctctgttgtctactagttagggcctctaacctgcccagtgctaagaaggatcgtcgcagcgaccccgtcgcttccttgaccttccggggagttaagaagcgtaccaaggttatcaaaaattcagtaaatcctgtctggaacgagggcttcgagtgggatctaaagggaattccgctggaccaaggcagcgagctccacgtagtagtcaaggatcacgaaactatgggaagaaaccgtttccttggagaagccaaggtgccactgagggaggttcttgccacaccctcactgagtgcttcattcaacgctcccctgctggacaccaaaaagcagcccacaggagcctccttagtgctgcaggtgtcgtacacgcccctgcctggcgctgtgcccctgttcccccctcctactccactcgagccatcacctactctgcctgatctggatgtggtggctgatacggggggcgaggaggacaccgaggaccagggcctgaccggtgacgaggcagagccatttcttgatcagagtggaggcccaggtgcccctaccacccccagaaaattaccctcacggccaccaccacactacccggggattaaaagaaaaaggtcggccccaactagcagaaagctgttgtctgataagccgcaggattttcaaattcgggtccaggtgatcgagggcagacagctccccggggttaatatcaagccggtggtgaaagtgactgcagcaggtcagactaaacgcaccagaattcacaaaggaaattcccctttgttcaatgagacactgttctttaatttatttgacagccccggagagctattcgatgagcccattttcatcacagtcgtggacagccgctctctcaggacggatgctcttttaggggaatttcgcatggatgtcgggactatatatcgagaaccgcggcatgcctatctgagaaagtggctgctgttaagtgatcctgacgacttttctgccggggcgagaggctacctcaaaacatccctgtgcgttctcggcccgggcgatgaagctcccttggaaagaaaggacccgagcgaggacaaagaggacattgagtccaatcttctgcgacctacgggagttgccctgcgtggcgcacatttttgtctcaaagtgttcagggctgaggatttgcctcaaatggatgatgctgtgatggacaacgttaaacaaatattcggttttgagtctaacaagaaaaatcttgtggatcccttcgtagaagtcagctttgctggtaagatgttgtgttcgaagatcctcgaaaagacggccaacccccagtggaatcagaacatcacattgcccgccatgttcccgagcatgtgcgaaaagatgcggattcgtatcatagattgggataggcttacccacaatgacatagtggcgacaacttatctcagcatgtccaagatcagtgcacccgggggcgagattgaggaagagccagccggcgctgtgaaaccctctaaagcttctgacctggatgattacttgggcttcttgcctactttcggaccttgctatattaacctgtatgggtcccccagagagtttaccggtttccctgacccctacacagagctgaacactggaaagggggaaggtgtggcttaccggggccggctgctgctgtcacttgaaacgaaactggtagaacacagcgagcaaaaagtcgaagatttgcctgcagacgacatccttcgcgtcgaaaaatacttgcgtcgccgaaaatattctttgtttgccgcattttattccgccacaatgctccaggatgtggatgacgccatccagtttgaagtgtctatcggcaattacgggaacaagttcgatatgacctgcctgcccctcgcttccaccacccagtactctagggccgtattcgatgggtgtcattactactatctgccatggggaaacgttaagccggtggttgtactgagttcatactgggaggatattagccaccgcattgagacccagaaccaactgctgggcattgccgaccgacttgaggctggactcgaacaggtgcacctggcattgaaagctcagtgctccactgaagacgtcgacagcctggttgcccagttgacagatgaactcatcgccggctgcagccagcccctaggtgacatccatgagacaccttcggcaacgcacctggatcagtatctctatcaacttcgcacgcaccatttatcccaaatcacagaagcagctcttgctctcaagctgggacacagcgagctgcccgccgccctggaacaggctgaggattggttattgcggctgagggccctggctgaggagccccagaactccctgcctgacatcgtgatctggatgctacagggggacaagagggtggcatatcagcgcgtacccgctcaccaggtgctattcagtcggagaggcgcaaactactgcggaaagaattgtggcaagctccagacgatctttttgaagtacccaatggaaaaggtcccaggcgctcgaatgccggtgcagatccgcgttaagttgtggttcggcctctccgtcgatgaaaaggaatttaaccagtttgccgaaggaaagctctctgtgttcgccgagacgtacgaaaacgagactaagctcgcgctagtgggaaactggggaacaaccggattgacttacccaaagttctctgacgtgacaggtaagattaaacttcccaaagactccttccgtcctagcgcaggctggacatgggctggggattggttcgtgtgtccagagaagactctcctccatgacatggatgctggccacttgtccttcgtggaggaagtgtttgaaaatcagaccagactgccagggggccagtggatttatatgtccgacaattacaccgacgtgaacggcgagaaggttctgcccaaggacgacatagagtgtcctttgggatggaaatgggaggacgaggagtggtccacagacctcaatagggcggttgatgagcaaggctgggaatattctatcactattccgcctgagcggaaacccaagcattgggttcccgccgagaaaatgtactatacgcatcggcgtaggcgttgggtacgcttacggcggagagatttatcccagatggaggctctgaaacgccatcgccaggccgaagccgagggcgaaggatgggagtacgcgagtctgttcggctggaaattccacttagaatatcgtaaaacggacgcttttcgtcgtcgtaggtggcgacggaggatggaaccacttgagaagacaggtccagcagccgtattcgccctagaaggggcccttggaggggtgatggacgataaatccgaggattctatgagcgtgtcaaccctgagtttcggtgtgaaccgcccaacaatatcctgtatcttcgactacgggaatagataccatctacgttgttacatgtatcaggctcgcgatctggccgccatggacaaggacagctttagcgacccttacgctatcgttagcttcttgcaccagagccagaaaacagttgtggtgaaaaacacccttaatcccacctgggaccagactctcattttttatgagatagaaatatttggggagcctgcaactgtagccgaacagcctccttccatcgtagtcgaactgtatgaccacgatacctatggggcagatgaattcatggggcgatgtatttgtcagccctccctcgagaggatgccaaggctcgcttggtttcctctcactcgaggctctcagccaagcggcgagctcttggcctctttcgagctgatccagcgagagaagcccgcaatccaccatataccaggttttgaggttcaggaaacgtctagaatcctcgatgaaagtgaagacacagacctaccatatccgcccccgcagcgtgaggcaaatatctatatggtgcctcagaacatcaagccggcactgcagaggacggctatcgaaatcctggcctggggtctgcggaatatgaaaagttaccagttggccaatatatcttccccgtccctcgtggtagagtgcgggggtcagacagtgcaatcatgcgttatacggaatttgaggaaaaaccctaacttcgatatctgcactcttttcatggaggtcatgttgcctcgcgaagaactttattgcccacccattacagttaaggtgattgataatcgccaattcgggagacggcccgttgttggccagtgtacgatacgaagcctcgagagcttcctgtgcgatccatactctgcggagagcccttcccctcagggcggtccggatgatgtgtcacttctgtccccgggagaggacgtcttgatagacatcgatgacaaagagcctctcatcccaattcaggaagaggagttcattgattggtggagtaaatttttcgcgtcaatcggtgaacgcgaaaagtgcggaagttatctcgagaaggactttgacactctgaaagtgtatgatacccaactggaaaatgtggaggcatttgaaggtctgtctgatttttgtaatactttcaagctctatcggggcaagacccaggaggagaccgaagacccctccgtgattggagagttcaagggcttattcaagatttatcctctccccgaagatcctgcaatcccaatgccccccagacaattccatcagcttgccgcacagggaccgcaggaatgccttgtgcgcatctacatcgtgcgtgcttttggtttgcaacctaaggatcccaatggcaaatgtgatccctacatcaaaatatccattgggaagaagagtgtgagtgatcaagacaactacatcccatgcacactggagccagtcttcggtaaaatgttcgaacttacatgcacactgccactggagaaagatctgaaaatcaccttgtacgattacgatctgctgtctaaagatgagaagattggagagaccgtcgtcgatctcgaaaatcggctgcttagcaagtttggcgccaggtgtggcttaccgcaaacctattgtgtgtccggccctaaccagtggagagaccagctccgacccagccagctcctgcatctattctgtcaacagcatcgcgttaaagctcctgtgtacaggactgacagggtgatgttccaggataaagagtattccattgaagaaatcgaggccggccgcattccaaaccctcatctaggtccagttgaggaaagactggccctgcacgtactgcagcagcagggattagtccccgaacatgtggagagccgccccttgtatagtcctttgcagcccgatatcgagcaaggaaagttgcagatgtgggtggacttatttccaaaagccctcggaaggcctggacctcctttcaatataactccgagaagggcccggcggttcttccttcgttgtataatttggaacacccgcgacgtgattttagatgacctcagcctcacaggcgagaagatgtctgatatctatgttaagggatggatgattggtttcgaagaacacaagcagaagacagatgtccactaccgaagcctcgggggcgagggcaacttcaattggcggtttatctttccctttgattatcttcctgcggaacaggtgtgtactatcgcgaagaaggacgccttttggagactagataagactgagtccaaaattcccgctagagtggtgtttcagatttgggataacgacaaattctcgtttgacgattttctaggctcactgcagctggatcttaatcgcatgcctaaacccgccaaaactgctaagaagtgttctctggaccagcttgacgatgctttccacccggaatggtttgtgagtctgtttgaacaaaaaacggtgaagggctggtggccttgtgtggcggaggaaggcgaaaagaagattctcgctggtaaacttgaaatgaccctggagatcgtggcagaaagcgagcatgaagaaagacccgcagggcagggtagggacgaacctaacatgaaccctaagcttgaggatcctcggcgtccagacacctcattcctgtggttcacgtcaccgtacaagaccatgaaattcattctgtggcgaagattccgctgggctatcatcctgtttataattctgtttatactgcttctgtttcttgctatctttatttatgcctttccaaattacgccgctatgaagctggtgaagccattcagt

SEQ ID NO: 10690 - DNA, 6243 bp, Artificial Sequence
  Description of Artificial Sequence: Synthetic coding sequence
atgctctgttgccttctcgttagagcgtctaatctgcccagtgccaagaaggaccggcggtctgatccggtagcatcgttgacattcaggggtgtcaaaaagcgaactaaagtgattaagaacagtgttaatcctgtctggaatgagggattcgaatgggatctgaaagggatacctctcgatcaaggcagtgagctgcacgtcgtggtgaaggatcacgaaacgatgggacggaatcgctttttgggcgaagccaaggttcctctgagggaggtgctggccaccccaagcctcagcgcatccttcaatgcccctcttcttgacaccaagaaacagcccacaggcgccagcctggtgctccaggtgtcttatacgccgctgccaggtgccgttccactgttcccgccaccaacacctcttgagccatccccaactctccccgatctggacgtcgtggccgatactggtggggaggaggataccgaggatcaggggctgaccggtgatgaggctgagccttttctcgatcagagtggtggccccggcgcccccactacccctaggaaactgccctctcgaccacccccacactaccccgggatcaaacggaagaggtctgccccgacctcccgcaaattgttgagcgataaaccacaggattttcagatccgggtgcaggtcatagaagggcgccaactgcctggcgttaatattaagcctgttgtgaaggttaccgccgctggccaaaccaagcgcacccgaatccataaagggaacagcccactgttcaacgaaacgctgttcttcaaccttttcgatagccccggcgagctattcgacgaacccattttcattacagtcgtcgactcacgcagtctgaggactgacgcgcttctgggagaattccgtatggacgtcggcacaatataccgagaaccgaggcatgcttatcttcggaaatggttgctcctcagtgatcctgacgacttctcagcaggcgccagaggctaccttaaaactagcctctgtgtgctaggaccaggagatgaagctccgcttgagcggaaggatccttctgaggataaggaagacattgagtctaatctcctacggcctacgggggtcgccctgcgtggagcccacttctgcctcaaagtgttccgggcagaagacttgccgcagatggacgacgccgtaatggataatgttaagcagattttcggttttgagagtaacaagaagaatttggtcgacccatttgtcgaagtttcgttcgctgggaagatgttgtgctcaaagatcctcgagaagaccgcaaatcctcagtggaaccagaatattactctgcccgcaatgttcccaagcatgtgtgaaaagatgagaatccgaatcatcgactgggatcgtctaactcacaacgatatcgtcgcaactacctacctgtccatgtccaagatttcagctccaggtggggagatagaggaggagcctgccggagcagttaaaccctcgaaggcgagtgatctggacgactacctaggatttctgcctacgttcggaccatgttatattaacctctacggcagccctcgcgaatttactggttttcccgatccgtataccgaattgaacacagggaagggagaaggcgtggcttaccgcggacggctactgctgtcccttgaaactaagctagtggaacacagcgagcaaaaggtagaggacttgcccgccgatgacatactacgggtcgagaagtatctgaggcgtagaaaatatagcctctttgccgcgttctattcagctactatgctccaggatgtggacgacgctattcagtttgaggtgagcattggtaactatggtaacaaatttgacatgacctgtctcccactcgccagtacaacacagtattctagagctgtgttcgacgggtgccattattattacttgccctggggcaacgtgaagccagtggtggtgctttcctcttactgggaggatatcagtcatcgcatagagacccagaatcagctcctcgggatagccgaccgcctggaggcaggtttggaacaagttcatctggctctgaaggcacagtgcagcacagaggacgtcgacagtttggtcgcccagttgacagacgagcttatcgcagggtgtagtcagccgctgggagacatccacgagacgccttccgcgactcatttagatcagtatctataccaattgaggacacatcaccttagccaaattacagaggctgccctggccctcaaactcggacacagtgagctcccagccgctttggagcaggcggaagattggttgctgaggctgagagccctggcagaagagccgcaaaattccttgcccgacatagtgatttggatgctgcagggggacaaaagggtggcatatcagagggttcctgcccaccaggttctcttctccaggcgcggcgcaaactattgcggcaagaactgtggtaagctacagacgatctttctgaaataccccatggaaaaggttcccggagctaggatgcctgttcagatacgggtgaaactgtggttcggattgtcagtggacgagaaggagtttaatcagtttgcggagggcaagttgagcgtgtttgcggagacatacgaaaatgagactaagcttgctctggtaggaaactggggcacaactggtctcacgtacccaaaattctctgatgtgacaggtaagataaaactccctaaggacagctttcgaccaagcgcagggtggacgtgggccggcgattggttcgtatgtcccgaaaagacacttctgcatgacatggatgccggacatctgtccttcgtcgaggaggtgttcgaaaatcagacccgccttccaggtggccaatggatctatatgagtgacaattacacagatgtgaatggagaaaaggtgctgcccaaggacgacatcgaatgcccacttgggtggaagtgggaggatgaggagtggtccacagatcttaatagagcagtggatgagcagggctgggaatatagcatcaccataccccctgaacgaaaaccaaaacattgggtacctgccgaaaaaatgtattatacccaccggcgcaggaggtgggtgcgcctgcggaggagggacctatctcagatggaggcgctgaagagacaccgacaggctgaggcagagggcgaaggttgggaatacgccagcctgttcggatggaaattccatctggagtatcgcaaaacagatgcctttcgccgcaggcggtggcgaagacggatggagcccctggagaagaccgggcccgcagccgtctttgccctggagggggccctcggaggtgtgatggatgacaaatctgaggacagcatgagtgtcagcaccttgagctttggagtcaatagaccaactatctcatgtatcttcgactacggcaatagataccacctgaggtgctacatgtaccaggcaagggatctggcggcgatggacaaggatagttttagcgacccgtatgccattgtttcatttcttcatcagtcacagaaaaccgtggtagtcaaaaataccttgaacccaacatgggaccagactctcatcttttacgagatcgaaatttttggcgaacccgcgaccgtagcagagcagccccccagcattgtcgtggaactctacgaccacgacacgtacggggccgacgagtttatgggccgatgtatctgccagccatcattagaaaggatgcctaggcttgcttggtttcctttaactcggggctcccagccctctggcgaactcctggccagcttcgaactcatccagcgggagaagcctgcgatccaccacattcccggatttgaagtacaggagacgagcaggattctggatgagagcgaggatactgacctaccctacccaccaccgcaacgggaagccaacatctacatggtgccacagaatattaagccagctctgcagcgcacagcgattgagatccttgcttggggtctgcgaaatatgaaatcctaccaactggcaaacataagctccccttctttggtagttgagtgcggcggccagaccgttcagtcttgcgtcatccgaaatctccgtaagaatcccaacttcgatatttgcacactttttatggaggtgatgctacctcgggaggagctctattgtcctcctattacagtgaaggtcatcgacaataggcagtttggtagaaggccagtggtcggacagtgtacaatccggagcctggaatctttcctatgtgacccctactccgcggagtctccatcaccacagggaggtccagatgacgtttcgctgctgtcaccaggagaagacgtgctcattgacatcgacgataaagagcccctgattcctatccaggaagaagagttcatcgattggtggagtaagtttttcgcaagtattggcgaacgagagaaatgcggctcttatctcgaaaaggatttcgatacactgaaagtgtacgatactcaactcgagaacgtcgaagcatttgaggggctaagcgacttctgtaatacttttaagctgtacaggggcaagactcaagaggagaccgaggatccttcggtcataggtgagtttaaaggactttttaaaatttacccactgcctgaggaccccgccatccctatgccccccaggcaattccatcagctggccgctcaggggccgcaggaatgtctggtccgcatctatattgtcagagctttcggcctccagccaaaagatcctaatgggaagtgcgatccatacatcaagatttccatcgggaagaaatctgtgtctgatcaggacaactatatcccatgcacactggagccagtatttggcaagatgttcgagctgacctgtaccctgcctctggagaaagacctgaaaataacactctatgactatgacctgctgagcaaggatgaaaagatcggagagacggttgtagacctggagaatcggctgctctccaagttcggcgctaggtgcgggttaccacagacctattgcgtaagtggccccaaccagtggcgggaccagctgagaccatcccaattactgcatttgttctgtcagcagcacagggtcaaagctcctgtgtaccgcaccgatcgcgttatgttccaggacaaagagtattcaatcgaagaaatcgaggctggccgcattcctaatccccatcttggccctgtggaagagcggctcgccttgcatgtgctccagcagcaggggctggtgcccgaacatgtggaaagccggcccctctacagccccctccagcccgacatagagcaggggaagctgcaaatgtgggttgacctgttcccaaaagctctgggccgtcctggcccaccgtttaacattaccccccgacgcgctcgccggttcttcctccggtgtatcatctggaatacacgtgacgtgatcttggatgatttatccctgaccggagagaagatgtccgatatctatgtgaaagggtggatgatcggattcgaggaacataagcagaagactgacgtccattatcgaagtttagggggggaaggaaattttaattggcggttcatatttcccttcgactatttgccggctgaacaggtgtgtacaattgcaaagaaggacgctttttggcgtttggacaaaaccgaatcgaagattcccgcacgtgtagtctttcaaatctgggataatgataagttctccttcgacgatttccttggctcactgcagctggacctcaaccgcatgccaaagcccgccaaaactgccaaaaagtgttccctggatcagttggacgacgctttccaccctgaatggttcgtatccttattcgaacagaagactgttaaaggctggtggccttgtgttgccgaggagggcgagaaaaagattctggctgggaagttggaaatgacattggagattgtagctgaatcagagcacgaggagcgccccgcaggacagggtcgggacgaacccaacatgaatcccaaactggaggaccctaggcgccccgatacatcgttcctctggttcactagtccctacaagactatgaaatttattctgtggcggaggtttcggtgggcgatcatactgtttatcattttgttcattctcctgctatttctggctattttcatctacgcatttccaaattatgccgctatgaagctggtgaagcccttttcc

SEQ ID NO: 10691 - DNA, 6243 bp, Artificial Sequence
  Description of Artificial Sequence: Synthetic coding sequence
atgctctgctgcctcctggttcgggctagtaatctcccctccgctaagaaagaccgaaggagtgatccagttgccagtctcacctttcgaggcgtgaagaaacggacgaaggtgattaagaattccgtgaatcccgtgtggaatgagggatttgagtgggatctcaagggcattcccctggatcaaggaagtgaactccatgtcgtggtgaaggatcatgagaccatgggcagaaacaggttcttgggagaagccaaggtgccactgagggaagtgctggcaacaccctctctgagcgccagctttaatgcccctctccttgacactaagaagcagcccacaggcgcgtctctggtactccaggtgagttatactcctctccctggcgcagtccccttgttcccacccccaacccccctggagccctctcctacactgcctgacctggatgtagttgccgatactggaggcgaggaagacactgaggaccagggattgaccggggacgaggcggagccttttcttgaccagagcggcgggcccggggctcccacaacccccaggaagcttccctcaaggcctcccccccactaccccggcattaagcgaaagcggtctgccccaacttcaaggaagcttctcagtgacaagccacaggattttcagataagggtacaggtcatcgagggccggcagctgcctggcgtgaacatcaagcctgtcgtcaaggttaccgctgccggccagacaaagcgcactcgcattcataagggcaactctcccctgttcaacgagaccttgttcttcaaccttttcgattctcctggcgaactgttcgacgaaccgatattcataacagtggttgattcccggtccctccgaacagatgccctcctgggcgaatttaggatggacgtaggaactatttatcgggagcctcgccacgcctatcttcggaagtggctgctcctgtctgaccccgacgacttctccgccggggctcggggctacctgaagacatcactctgcgtgctcggccccggcgacgaagccccgctcgagcggaaggacccatcagaggacaaggaggatatagaaagtaaccttctcaggcctacaggggtggccctgaggggggcccatttctgtttgaaggtgtttagagctgaagatctgccgcagatggacgacgcggtgatggacaatgtgaaacaaatttttggtttcgaatcaaacaagaaaaatctggtggatcctttcgttgaggtcagttttgcgggcaagatgctgtgtagtaagatcctcgaaaagacagctaatccacagtggaatcaaaatattacgttgccagccatgttcccatccatgtgtgagaaaatgagaattcgcataattgattgggatcgcctcactcacaatgacattgttgctactacctatctgagcatgtccaagatctctgcaccaggaggggagatcgaagaggaacccgcgggcgccgtgaaaccatcaaaagcaagcgaccttgacgattatctgggctttttgcccactttcggaccttgttacatcaacttgtatgggtcccctcgggagttcaccggattccctgatccatacactgagttgaacactgggaaaggggaaggagtggcatataggggtcggctgctcctgtctctggaaacaaagctggtggaacactccgaacaaaaagtagaggacctccccgcagacgacattctgagagtggaaaagtacctcaggagaagaaagtacagcttgtttgccgccttctactcagctaccatgctgcaggacgttgacgatgctatccaattcgaggtgtcaataggaaactatggaaacaagtttgacatgacatgcctgccgcttgccagtacaactcaatactcccgagctgttttcgatggctgtcattactactatctcccctggggtaacgtaaagccagtggtagtccttagctcatactgggaggacatctctcacagaatcgagactcaaaaccagctcctggggatagccgacaggctggaggctgggttggagcaggtccacctggctctgaaggcacaatgtagcactgaagacgtggacagcttggtagcacaactgacggatgagctgattgccgggtgttctcagcccctgggcgacattcatgaaaccccctccgcaactcacttggaccaatacctgtatcagctccgcacgcatcacctttcccagatcaccgaggcagctctggctttgaaactgggccacagcgaattgcccgccgccctcgagcaggcagaggactggctgctgaggctgagagccctcgccgaggaacctcagaactcactccccgatatagtgatatggatgctccagggcgataaaagggtcgcttatcagagagtccccgctcaccaggtgctgttttccaggcgcggcgcaaactactgcgggaagaattgcggcaaactccagacaatcttcctcaaatatcctatggagaaggtgccgggagccaggatgccagtgcagattagggtgaagctttggttcggactgtccgtggacgagaaagagtttaatcagttcgcggaaggtaaactctccgtctttgccgaaacctacgagaatgagacaaagttggcactggttggtaactggggaactacaggcttgacctatcccaagttttcagacgtgacgggaaagatcaagctgccaaaagattcattcagacccagtgccggttggacatgggcaggtgactggtttgtatgcccggaaaagacgttgttgcacgatatggatgcgggtcaccttagctttgtggaggaagtctttgagaaccagacaagactgcctggcggccaatggatttatatgagcgacaactacacagacgtgaacggagaaaaagtactgcctaaggacgacatcgagtgtcccttgggctggaaatgggaagacgaggagtggtctactgatcttaacagggcagttgacgaacaagggtgggaatactctataaccatcccacccgagcggaagcctaagcactgggtgcctgccgagaagatgtattatacgcacaggagacgccgctgggtccgattgagacggagagacctgagtcagatggaggctctgaagcggcacaggcaggctgaggccgaaggtgagggatgggagtacgcgagtctgtttggatggaaatttcacctggagtacaggaagaccgacgcgtttcgaaggcgccgctggaggcgccggatggagcccttggaaaaaacaggacccgccgctgtcttcgcgctggaaggtgcgctgggaggagtgatggacgataagagtgaagactccatgtctgttagtaccctgagcttcggcgtaaacaggccaacaatttcctgcatcttcgactacggcaataggtatcatctgaggtgttacatgtaccaggcacgggatctggctgctatggacaaggactctttcagtgacccttacgcaatcgttagctttcttcatcagtctcagaagacagtcgtcgtgaaaaacacgctcaaccccacttgggatcaaacattgattttttatgaaattgagatctttggagagccagccactgtcgcagaacagcctccttctatcgtagtggaattgtatgaccatgacacctatggggccgacgaatttatgggccgctgcatctgtcagccatcactggagcggatgcctagattggcctggtttccgcttacacgcggttcccagccttccggcgagcttctggcctccttcgaactgatccaaagggagaagccggcaattcaccacatcccgggcttcgaagtgcaagaaacgtctaggattctggacgaaagcgaggatacagaccttccatatcccccccctcagcgagaggccaacatctacatggtgccccagaatataaagcctgcactccagcggactgcaatcgagattctcgcttgggggctgaggaatatgaaatcttaccagttggcaaatatctcttcccccagcttggtcgtcgaatgcggaggtcagaccgttcagagttgtgtaattagaaatcttaggaaaaacccgaacttcgacatctgcactctttttatggaggtgatgttgcctagagaagagttgtattgtccaccaataacggttaaagtaattgacaacagacagtttggtaggaggcccgtggtgggccagtgtactatacgcagtcttgaatctttcctctgtgacccctacagtgccgagagtccatctccacagggcggcccggatgacgtcagtttgctgtccccgggggaggatgtgctgatcgacattgatgataaggagccactgatacccattcaggaagaggagttcattgattggtggtctaaattcttcgcttctattggagagagagaaaaatgcggttcttacctggagaaagactttgatacattgaaggtctacgacacacagctcgagaacgttgaggcttttgaaggccttagtgacttctgcaacactttcaaactgtaccgggggaagacacaagaagaaaccgaagatcctagtgtcataggcgagtttaaaggcttgttcaagatctacccacttcctgaggacccggccatccctatgcctcctagacagtttcaccaactcgccgcccagggcccacaagagtgtctggttcggatttacatcgtcagggcctttggattgcagcccaaggaccccaatggtaagtgcgatccgtacattaaaatatctataggaaagaaatcagtgagcgatcaggacaactacataccctgcacgttggagccagtcttcgggaagatgttcgaactgacttgcaccctgccactggaaaaagaccttaaaatcactctctacgattacgacctgctctcaaaagacgagaagattggcgagaccgtggtcgatcttgaaaatcgccttctctccaagtttggcgctagatgcggtctgccgcaaacgtactgcgtgtccgggcccaatcagtggagagaccagctgagaccatcacagctgttgcacctgttttgccagcagcatcgcgtgaaagctcccgtataccgcaccgacagagtaatgttccaggataaagaatacagcatcgaggaaatcgaggcaggacggattcccaacccacatctgggtccagtagaggagagattggctcttcatgtcctgcagcagcagggactcgtgccggaacacgtggaatccaggccgctgtacagcccgttgcagcctgatatagaacaaggaaaattgcaaatgtgggtggacctgttccccaaagccttgggacggcccggacctcctttcaacatcacaccacggcgagctcggaggttttttctgcggtgcatcatctggaatacacgagatgtgatcctcgacgacctgagtttgactggcgaaaagatgagcgacatctatgtaaagggatggatgattggttttgaggaacacaagcagaagacagacgtgcactatagaagtcttggtggcgaaggaaacttcaattggcgattcatatttccattcgattacttgccagccgaacaggtatgtacaatagccaaaaaggatgcattctggcggctggataaaacagagagtaaaatccctgcacgggtcgtattccagatttgggacaacgacaaattcagttttgacgatttccttggcagtctgcagctcgatttgaaccgaatgcctaagcctgctaagacagcaaaaaagtgttctttggatcagttggatgatgcctttcaccccgagtggttcgtgagcctttttgagcagaagaccgtgaagggttggtggccttgtgtcgcagaagaaggcgagaagaagatcctcgctggcaaattggagatgactttggaaatcgtggccgagtcagagcacgaggagcgacccgccggtcaagggcgcgatgaacctaatatgaatccaaaactggaagaccccaggcgacctgatacaagcttcctgtggttcacttccccctacaagaccatgaaattcattctctggcgccgattccggtgggcaatcatcctgtttatcatcctgttcatcctgcttttgttcctggccatcttcatctacgccttcccgaactacgccgccatgaaactcgtgaagcccttttcc

SEQ ID NO: 10692 - DNA, 6243 bp, Artificial Sequence
  Description of Artificial Sequence: Synthetic coding sequence
atgttatgctgcctgctcgtgcgggcaagcaatctgccgtctgccaagaaggatcgccggtcggacccagttgccagcttgaccttccggggcgttaagaagcgaacgaaagtaataaagaacagtgtgaacccggtgtggaatgaaggattcgaatgggatcttaagggaattcccctggatcagggatcggagctccacgtggtggtgaaagatcacgagactatggggaggaaccgattcttaggcgaagccaaggtccccctacgcgaggtcctagcgactcccagcctctctgctagcttcaatgcgcctctcctcgataccaagaagcagccaactggtgccagccttgttttgcaggtgtcttatactccccttcccggtgcagtccctctgttccccccgcctacgccactggaaccttcccctaccctacctgatctggatgtcgtggctgataccggaggggaggaagacactgaagaccagggactgacaggagacgaggcagaaccttttctggaccagtccgggggacccggagcccctacgacccctaggaagctcccatcccggccccccccccactaccctggcatcaaacgaaaacggagcgcaccaacaagccgcaagctgctgtccgataaaccacaggacttccagattcgggttcaggtgatagagggtcgtcagcttcctggagtaaatatcaaacccgttgtcaaagtgaccgccgcggggcaaactaagagaacacgtatccacaagggcaattctcctttatttaatgaaacccttttctttaacctgttcgattccccaggggagctgtttgacgaaccgatctttattactgttgtcgatagccggtcactgcggacagacgcattactgggggagtttcgcatggacgtgggcaccatctaccgcgagccgcggcacgcctatctgcgaaaatggctcctcttgagtgatcctgacgacttcagcgccggtgctaggggttacttaaagacttctttgtgcgttctgggcccaggagatgaggctcccctggagcggaaggaccccagcgaagacaaggaagacattgagagtaacctcctgcgacctacaggggtcgcattgagaggtgctcacttttgcctgaaagtttttagagccgaggaccttccccagatggatgacgcggtgatggacaacgttaagcagatcttcggattcgagagtaataaaaagaacctcgtcgatccattcgttgaggtttcctttgccggcaagatgttatgctccaaaatattggaaaagaccgctaatccccagtggaaccagaacataaccctcccagctatgtttccctctatgtgcgaaaaaatgcgcatcaggattatagattgggaccggctgacgcacaatgacatcgttgccacaacttatctgtcaatgtccaaaatcagcgcccctggaggcgagatcgaagaggaacctgcgggcgcagtgaaaccatcaaaagcttccgacctagacgactacttagggttcctacctacatttggaccttgctacatcaacctgtacggctcgccacgagaattcacgggattcccagacccgtacacagaacttaatacgggcaagggagaaggagttgcttatcgaggccggctgctgctatctcttgaaaccaagcttgtggagcattcggaacagaaagttgaagacctgcctgcggacgatattctgagggtggagaaatacttgagacgccggaagtactctttgttcgccgcgttttattctgcgacaatgctgcaagacgttgacgatgccatccagtttgaagtttctatagggaactatggcaataaattcgatatgacttgtttgcccctcgcttcaactactcagtattctcgggctgtattcgatggttgccattactactacttgccatggggaaacgtgaaacctgtggtggtgttgtcaagctactgggaggatatctctcacagaattgagacccagaatcaactgctgggcatcgccgaccgactggaggcaggtctggagcaggtgcatttagctttgaaagcgcagtgctcaactgaagatgtggattcactggtggctcagttgacggatgaattaattgccgggtgcagccagccactcggagatattcatgagacaccaagcgccacccacttggaccaatacctgtatcagctgcgaacccatcacctcagccagatcaccgaggccgcacttgctttgaagctgggacacagcgaacttcccgcagcactggaacaggccgaggattggctgctgcggctccgagccctcgcagaagagccccagaattctctgccagacattgtgatctggatgttgcagggtgataaaagagtggcatatcagcgcgtgcccgctcaccaggtcctcttctccagaagaggtgcgaactactgtgggaagaattgtggtaaactccagaccatatttctgaagtaccctatggagaaagtgcctggggcccgtatgccagttcagatccgcgtcaagctctggttcgggctctccgtggatgaaaaggaattcaatcagttcgcagaggggaagttgtccgtcttcgccgagacctacgaaaacgaaactaagctcgcactggtggggaattggggcacaacaggcctgacctatcccaagttcagcgacgttactggtaagatcaaactcccgaaggattcttttcggcctagtgccggttggacatgggccggggactggttcgtttgccccgagaaaacattactgcatgatatggatgcgggccacttatcattcgtggaagaagtattcgagaaccagactcggctgcccggaggtcaatggatatatatgtccgacaattataccgacgtaaatggtgaaaaggtgttgcctaaggacgacatagagtgtcctctgggctggaagtgggaggatgaggagtggagcacagacctcaatagagccgtggacgaacaaggctgggagtactctatcaccataccacctgaaaggaaacccaagcattgggtgcctgcagagaagatgtactacactcatagacggcgtagatgggtgagacttcggagaagggatctatcacagatggaagcgctgaagaggcatcgacaggcagaagctgagggtgagggctgggagtatgcctccctattcggttggaagttccatctggagtaccggaagactgacgcttttcgaagacggcggtggcggcgccggatggaaccacttgaaaaaactgggccagccgctgtcttcgctttggagggagccctgggtggggttatggatgacaagtcagaagacagcatgagcgtctcaaccttgagtttcggggtgaataggccgactattagctgcatttttgactatggaaaccgataccatctgaggtgttacatgtatcaagctagagatttggcagccatggataaggattcttttagtgacccatatgcaatcgtgtcattcctgcaccaatcccaaaagaccgtggtggtgaaaaatacccttaatccaacctgggatcaaaccctgattttctacgagatcgaaatcttcggtgaacctgccaccgtggccgagcagcctccttcaattgttgtggagctgtatgatcacgacacttatggcgcagacgaatttatgggccggtgcatctgccagccatctcttgagcgtatgccacgtctggcgtggttccccctgactaggggatcccagcccagcggagagctgctggcctctttcgagctgatccaaagagagaaaccagcgatccaccacattcctggcttcgaggtccaagaaacttctcgaatcctggacgagagcgaggatacagacctgccatatccacccccacaaagagaggccaatatctatatggttccacagaatatcaagcctgctctacagaggaccgcgatcgaaattctcgcctggggactgcggaacatgaagtcttatcagctggccaatatcagcagtccaagtttggtggttgagtgtggcggccaaaccgtgcagagctgcgtgatccgaaacctcaggaagaaccccaactttgatatctgcacccttttcatggaggtgatgttaccaagggaggagctgtactgtcccccaatcacagtcaaggtcatcgacaaccgacagtttggaagaaggccggtcgtgggccagtgtactatcaggtcactggaaagcttcttgtgtgatccttacagcgcagagtcacctagccctcagggcggtcccgatgatgtttcactgctctctcccggggaagacgtcctaattgatattgatgacaaagagcccctcattcctatccaagaggaggagttcatcgattggtggagcaaattcttcgcctccattggtgagcgggaaaagtgcggtagctatctcgagaaggattttgacaccctgaaggtatacgatacacagttagagaacgttgaagcctttgagggtctctccgacttttgcaatacgttcaagctgtatcggggcaagacccaggaggaaaccgaggacccttcggtgataggggaatttaaaggtctatttaagatttacccgctgccagaggaccccgcaatccctatgccaccaagacagttccatcagctggcggcccagggacctcaggagtgcctggtgaggatatatattgtgcgggctttcggactgcagccgaaggatcctaatggtaagtgtgatccctatatcaagatctccattggaaaaaaatccgtcagtgaccaagataactatatcccgtgcaccctagagcccgtgtttggcaagatgttcgagctcacctgcacactgccgctggaaaaagaccttaaaattactttgtatgattacgacttgctgtctaaagatgaaaagataggagagaccgtggtggacctggaaaatcgccttctgtctaagttcggagcccgctgtggactcccacaaacatattgtgtgtccggccctaaccaatggagagaccagttgaggcccagtcaactcctgcacctgttttgtcagcagcaccgtgtcaaggctccggtgtatcggacagatagagttatgttccaggacaaagagtactccattgaagagattgaagccggcagaatcccaaatcctcacctgggcccggtagaagagcggcttgctttacatgtactgcagcagcagggactcgttccagaacacgtggagagcagacccctgtacagccctctgcaacccgacattgaacaggggaagctccagatgtgggtagatttatttccaaaagcactcggaaggccaggaccaccctttaacatcactccacgtcgggcccgccgtttcttcctgcgctgtatcatatggaacacgagagacgtgatcctagacgacctctccttaaccggagagaagatgtccgatatctacgttaaaggatggatgatcggcttcgaagaacacaagcagaagactgacgtgcactatcgctctctggggggcgaaggcaattttaactggcgcttcatctttcccttcgattacctaccggccgagcaggtgtgcacaattgcgaaaaaagacgctttttggagactggacaaaacggaaagcaagattcccgcgcgagtcgttttccagatctgggataacgacaaattcagcttcgatgatttccttgggtccctgcagctggatctgaatcgtatgccgaaaccggccaagacagctaagaaatgtagcctggatcaactggacgacgcctttcatccggaatggttcgtttcgttgttcgaacagaaaaccgtgaagggctggtggccctgtgtggcagaggaaggcgaaaagaaaatactggctgggaagctggaaatgacgctggagattgtggctgaatcagagcacgaggaacgacccgcaggccaaggtcgagacgagccaaacatgaacccaaaactcgaggaccctcggaggcccgacacaagcttcctgtggtttacaagcccctataaaaccatgaaatttatcctgtggcgccgattcagatgggccataatcctgttcatcattctcttcatcctgctactgtttttggccatcttcatctacgcgtttccaaactacgctgcgatgaagcttgtcaaaccctttagc

SEQ ID NO: 10693 - DNA, 6243 bp, Artificial Sequence
  Description of Artificial Sequence: Synthetic coding sequence
atgctctgctgcctgctggtgcgggcctcaaatctcccttctgcaaagaaggatcggcggtcagaccctgtggcctccctcaccttccgcggtgtcaagaagcgcaccaaggtgatcaaaaactcagtgaaccccgtttggaatgaaggctttgagtgggacctgaaaggcatcccgctggatcagggctcggaattgcacgtggtggtcaaggaccacgagacgatgggacggaacagatttctgggcgaagcgaaagtgccactgcgcgaggtgctcgccactccatccctgtcagcatccttcaacgcgcctctgctggacactaagaagcagccgactggagcttcgctggtgctccaggtgtcctacacgccattgcctggagcagtcccactctttcccccgcctacccctctggaaccatcgccaaccctgccggatctggatgttgtggccgataccggtggagaggaagataccgaggaccagggcctgaccggagatgaagccgagccgttcctcgatcagtccggcgggccaggcgccccgactactccgcgcaagctccctagccggcctccgccgcactacccgggaataaagcgcaagagatcagccccgacctcccgcaagctcctctcggacaaaccgcaggacttccaaatccgcgtgcaggtgatagaaggtcgacaactcccaggagtgaatatcaagccagtagtgaaggtcacggctgccggacaaaccaaacgcactagaatccacaagggtaactccccgctcttcaacgaaaccctgtttttcaatctgtttgacagcccgggggaattgttcgacgagccgattttcataactgtcgtcgactcgcggtccctgcgcactgacgccctgctcggagaatttcggatggatgtaggaaccatctaccgggaaccgcgccacgcctacctccggaaatggctcctgctgtccgatcctgatgacttctccgcgggagccagagggtatcttaagacctctctctgcgtgctgggacccggcgacgaggcgccactggaaaggaaagatccatcggaagataaggaagatatcgaatcaaatctgcttcggccgaccggcgtggcgctcagaggagcccacttctgcctgaaggtgtttagggccgaggacctcccacagatggacgacgccgtcatggacaatgtgaaacagatttttgggttcgagtctaacaagaagaatctggtggatcctttcgtggaagtgagcttcgccggaaagatgctgtgctcgaagattctggaaaagacggccaacccgcagtggaaccagaacatcaccctgccggcaatgttcccttcgatgtgtgagaagatgcgcatccgcatcattgattgggaccggctgactcataacgacatcgtggcgaccacgtacctgtccatgtcgaagatctcagctccgggaggagaaatcgaggaggagccggcaggagctgtcaagccttcaaaagcctcggacctcgatgattacttgggttttctgccgacttttgggccttgttacatcaatctgtacgggagcccgcgggaatttaccgggttccccgacccgtacaccgaactcaatactgggaagggggagggagtcgcgtacaggggtcgcctgctgctgtcacttgagactaagctggtggagcattcggagcagaaggtcgaagatcttccggcagatgacatcttgcgtgtcgagaagtacctgagacggcgcaagtactcgctgttcgcagccttttactcggccactatgctgcaggacgtcgacgacgcgatccagttcgaagtgtcaatcggaaactacggaaacaagttcgacatgacctgcctcccactcgcatccaccacccagtactcccgcgccgtgttcgacggatgccattactactatctgccctggggaaatgtcaagccggtggtggtgctgtcatcatactgggaggatatctcacatcggatcgaaacccagaaccagctgctgggaatcgccgatcgcttggaagccggcctggagcaagtgcacctggcgctgaaagctcagtgttcaactgaagatgtggacagcttggtcgcgcagctcaccgatgaacttatagcagggtgttcgcagccgctgggagacatccacgagactccatcggccactcatctggaccaatatctctatcagcttcgcacccaccatctctcccagattaccgaagccgcgctcgcgctgaaactgggacactcggagctgcccgcagcgctcgagcaagccgaggattggctgttgcgcctgagggccctcgccgaagaaccacaaaattcgctgccggatatcgtcatctggatgctgcaaggtgataagcgtgtcgcgtaccagcgggtcccagcccatcaggtgctgttttcaagacgaggggcaaattactgtggcaagaactgcggaaaattgcagaccatcttcctgaagtacccgatggaaaaggtccccggcgcacggatgccggtgcagatccgggtcaagctgtggttcggcctgtccgtggacgagaaggaattcaatcagttcgctgaagggaaactgtcagtctttgcggaaacttacgaaaatgagacgaaactggcgctggttggcaactggggtactaccggactcacgtaccctaagttctcagacgttactggaaaaatcaaactgcccaaggactccttccggccctcggccggttggacttgggcaggggactggtttgtctgcccagagaaaaccctgttgcatgatatggatgcaggacacttgtcgttcgtggaagaagtctttgagaaccagaccaggcttccgggcggacagtggatctacatgtctgacaactacaccgacgtgaatggcgagaaggtcctgcccaaggatgacattgaatgcccgctcggctggaaatgggaggacgaagaatggtcaactgacctgaaccgggctgtcgacgagcagggatgggaatatagtattaccattccaccggaacgcaaaccgaaacactgggtgccagccgagaagatgtactacactcatcggcggcgccggtgggtgcgcctcagacggagggacctgagccagatggaagcacttaagcggcatcggcaggcggaggccgagggagagggttgggaatacgcgtcgctgttcggatggaagttccacctggaataccgcaagactgacgcgttcagacgccgccggtggcgcagacggatggaacccctcgaaaagaccggccccgctgccgtctttgccttggagggtgccctgggaggagtgatggatgacaaatcggaggactcgatgtccgtctctaccctgtcgttcggcgtgaacagaccaaccatctcatgcatctttgactacggtaaccggtaccaccttcggtgctacatgtaccaggcacgcgatctcgccgcgatggataaggatagcttcagcgatccgtacgcaatcgtgtccttcttgcatcagtcacagaaaactgtcgtggtcaagaacactctgaatccaacgtgggaccagactctgatcttttacgagatcgaaatctttggtgaacccgccactgtggcggaacaaccaccaagcatcgtcgtcgaactctatgaccacgacacctacggtgcggatgagtttatgggcagatgtatctgccaaccgtcgctcgaacgaatgccgagattggcctggttcccgctgacccggggatcacaaccgtcgggcgaattgctcgcctcgttcgaattgatccaacgggaaaagccagcgattcaccacatcccgggattcgaggtgcaagaaacttcgagaatcctcgatgaatccgaagataccgacctcccgtaccctccaccgcagcgggaggctaacatctatatggttccgcagaacatcaaaccagcgctccaaaggactgccatcgaaatcctggcttggggcctccggaatatgaagagctaccaactcgcaaacatctcctcgccttctctcgtggtggagtgcggaggccagaccgtgcaatcgtgcgtgatcaggaacctgcggaaaaatcctaacttcgacatctgcaccctgttcatggaagtcatgcttcctagggaggagctctactgccccccgatcacggtgaaggtgatcgacaacaggcaattcgggcggcggccggtggtgggtcaatgcacgatcagatccctggagtccttcctgtgcgacccatactccgccgagtccccgtccccacaaggcggccctgacgacgtgtcactgctgtcccccggggaggatgtgctgattgacatcgatgacaaagagccactgatcccgatccaggaagaagaattcatagattggtggtccaaattcttcgcgagcatcggagaaagagagaagtgcggatcgtatctggaaaaagactttgacaccctgaaggtgtacgatacccagctggagaacgtggaagcattcgagggcctgtcggatttctgcaatacctttaagctgtaccgcggaaagactcaagaggaaaccgaagatccgtccgtcatcggagaattcaaggggcttttcaagatttacccactccctgaggacccagccatcccgatgccaccaaggcagttccatcaactggccgcgcaaggaccgcaggagtgtctggtgagaatctacatcgtgagggccttcggactgcagccaaaggacccaaacggaaaatgtgacccctacattaagatctcaattggcaagaagagtgtttcagaccaggacaactacatcccatgcactctggagccggtgttcggcaagatgttcgaactgacttgcaccctgcccctggaaaaagatttgaagatcaccttgtacgactatgatctgctgtcaaaggatgagaaaatcggagagactgtggtggaccttgagaacagactcctgtcgaagtttggagcgagatgcggcctgccgcagacgtactgcgtgagcggaccaaaccagtggcgcgatcaactcagaccatcgcaactgcttcatctcttttgtcaacagcacagagtgaaggcgcccgtgtaccgcaccgatcgggtgatgtttcaggacaaggagtactcaatagaggaaatcgaagccgggagaattcctaacccccacctcggaccggttgaagaacggcttgcgcttcatgtgctgcaacagcaaggactcgtgccggaacacgtggagtcacgtccgctgtacagcccgctgcaaccagatatcgaacaaggcaagctgcaaatgtgggtggacctctttccaaaggcgctgggtcgcccaggcccacctttcaacatcactccgcggagggcgagaagattctttctcaggtgcatcatctggaatacccgggatgtcatcctcgacgatctttcactgacgggagagaaaatgtccgacatctacgtcaaaggatggatgattgggtttgaggagcacaaacaaaaaactgacgtgcactacagatcgttgggaggagaaggtaatttcaactggagattcatctttccattcgactacctgcctgcggaacaggtgtgcaccatcgcaaaaaaggatgcgttctggagactcgacaagactgaaagcaaaatcccggcacgcgtcgtgttccagatttgggacaatgacaagttctccttcgatgacttccttggttcgctgcaactggaccttaaccggatgccgaagccagccaagactgctaagaaatgctcgttggaccagcttgatgatgcattccatcctgaatggttcgtctccctcttcgaacagaaaacggtcaaggggtggtggccttgtgtcgccgaagaaggagaaaagaagatcctcgcgggaaagctcgagatgactctggaaatagtcgccgaatcggaacatgaggagcgacccgccggtcagggccgggatgagcctaacatgaacccgaaactggaagatccgcgtcgcccggacacctccttcctctggttcacttccccgtacaagactatgaagttcatcctgtggcggcggtttcggtgggcgattatcctcttcattatcctgttcatcctccttctcttcctcgccatcttcatctacgccttcccgaactacgccgccatgaaactggtgaagcctttctct

SEQ ID NO: 10694 - DNA, 6243 bp, Artificial Sequence
  Description of Artificial Sequence: Synthetic coding sequence
atgctgtgctgcctactggtgcgcgctagtaatctgcccagcgcaaagaaagaccgacggagtgacccagtggccagcctgacattccgtggggtgaagaagagaaccaaagttataaagaacagcgtcaaccccgtgtggaatgagggtttcgagtgggatctcaaagggatcccgctagaccaagggtccgaacttcacgtggtggtgaaagaccatgaaactatgggcagaaaccggttcctgggagaagcaaaggtcccacttcgcgaggtgctggccaccccatccctctcagcatcttttaatgcccctctgttggacaccaaaaaacagccaaccggggcatctctggtcctgcaagtgtcttacactccactccccggcgcagtgcccctcttccctccacctacccccctcgaacccagccccacgctaccagacttggacgtagtggccgacaccgggggcgaggaagacaccgaggatcagggcttgaccggcgacgaagccgagccctttctagatcagagcggaggccccggagccccaactacgcccaggaaactcccgtcacggccgcccccccactatccaggcatcaaaagaaagcggagtgcccccaccagccgcaagctgttgtccgataagccccaggatttccagattagggtgcaggtcattgaaggcaggcaactcccaggagtgaacatcaaaccagtggttaaggtgacagcagccgggcagaccaaaaggacgagaatacataagggaaattcaccgctctttaatgaaacactcttctttaacctgttcgacagtccgggggaattgttcgacgagcccatctttatcaccgtcgtcgatagcaggtcacttcgaactgatgcgctgttaggagaatttcggatggacgtgggcacgatctatagagagccccgccatgcatatctcaggaagtggcttctcctctctgaccccgacgattttagtgcaggtgcacgggggtacctaaaaacctctttgtgcgttctgggccctggagacgaagcccccctggagcgcaaggaccctagtgaggacaaggaggacattgaatccaatctcttgagacccactggtgtcgccctacgcggggcacacttctgcctaaaggtctttagagcggaagatctgccccagatggatgacgcagtcatggacaatgtcaaacagatcttcgggtttgaatccaataagaaaaatttagtggatccctttgtggaagtctccttcgctgggaagatgctctgtagcaagattctagagaagacagccaatccacagtggaaccaaaatattaccttgccggcaatgttcccttccatgtgcgaaaaaatgcggattcgaataatcgactgggacagactgacccataacgatatcgtcgcgaccacttacctgtctatgtccaaaatatctgcccctggcggcgagatcgaggaggagccggccggcgcggtgaagcctagtaaggctagtgatttagatgactacttgggctttctgcccacgttcgggccctgctacatcaatctttacggttctcctagggagttcacgggatttccagacccgtacacagaactgaacaccgggaaaggggaaggcgtggcctatcgagggagattgctgttgtctctggagaccaaattagtggaacatagcgagcaaaaggtcgaagatttaccagcagatgacatcctgagggtagagaaatacctgagacgaagaaaatattcactgttcgcagcgttctactcggcaacaatgctacaggacgtcgatgatgcaattcagtttgaggttagcattggaaattacggtaataagttcgacatgacatgcctgcccctggcctcaacgacacagtatagcagggccgtatttgatggctgtcactactactatctgccatgggggaatgttaagcccgtggtggtgctgtctagttattgggaagatataagtcatcggatagagacacagaatcagctcctggggatcgccgatcgactggaagccggcctggaacaagtccacctcgcgttaaaggctcagtgctcaactgaggacgtggactccctggttgcacagctgactgatgagttgatagccggctgcagccagcccttaggcgatatccacgaaactccatctgctacccacctggaccagtatctgtatcagctgaggactcatcacctgtcccagatcacggaggcagccttagctctaaagttgggtcattctgaactcccggccgccctggaacaggccgaggattggctgctaagactgcgcgctctagctgaagagcctcagaactcgctgcccgatattgtcatctggatgctgcagggggataaaagggttgcataccagcgcgtgcctgcccaccaggtgctgtttagtagacgtggagctaattactgtggaaaaaactgcgggaagctgcagaccatcttcctgaaataccctatggaaaaagtcccgggtgcacgcatgcccgtgcagatccgcgtaaagctttggttcgggctgagtgttgatgagaaggagtttaaccagttcgcagaggggaagctgagcgtctttgccgagacatatgagaacgaaacaaaactggccttggtcggaaattggggaaccaccggcctaacatatcctaaattctccgacgtgacgggaaagatcaagctgcctaaagactcctttcggccctctgccggctggacatgggccggcgactggtttgtttgcccagaaaagaccctgctgcacgatatggacgcaggccacctttcctttgtggaagaggtctttgaaaatcaaactagactgcccggcgggcagtggatttacatgagtgataactacacagacgtcaacggcgagaaggtactaccaaaagatgatattgagtgtcccttgggatggaagtgggaggatgaagaatggtcaaccgacctgaaccgggcggttgatgagcaaggctgggaatatagtattaccatccccccggaacggaagcctaagcactgggtacccgctgagaagatgtactacacacacaggcgacgccgatgggtgaggctgaggaggagggatctctcccaaatggaggctctcaaacggcacaggcaggccgaggccgagggagagggctgggagtatgcaagcctgttcggctggaaattccacctggaataccgtaaaacagacgcattcaggagaaggcgctggaggcgtcgcatggaacctttagagaagacagggcccgcagccgtgtttgcactggagggagccctgggcggagtcatggatgataaatcagaggattctatgagtgtctcaaccctgtcatttggcgtaaaccgccccactatcagctgcatcttcgactatggtaaccgttaccatctgcgatgttacatgtaccaggctagagatctcgctgcaatggataaagatagcttctccgacccctacgcaatcgtgagttttctgcaccaatcccagaagacggtggtcgtgaagaatacactcaacccaacctgggaccaaactctcatattttacgaaatcgagattttcggagagcccgcgacagttgccgagcagccgccatccatcgtagtggagttgtatgaccatgacacctatggagccgatgagttcatgggccggtgcatctgccaaccatcattagaacgaatgccacgactggcttggttccccctcactcggggttcacagccttccggcgagctgctcgcctcttttgagctaatccagcgggagaaaccagccatccaccatattccgggattcgaagtgcaggaaaccagtcgaatcctggacgagtccgaagataccgatctgccttaccccccccctcagagagaggctaacatctatatggtgccgcagaacataaaaccagcgctacagcgtaccgcaattgagatactggcctggggtctgagaaatatgaagtcctatcaattggccaacatcagttccccaagtctggtggtggagtgtggggggcagacagttcaatcctgtgttattcggaacctgcgtaaaaacccaaatttcgatatatgtacactcttcatggaggtcatgctgcctcgagaggaactttattgtcccccaatcacggtcaaagtgattgataatcgccagtttggacgcagacccgtggtgggccagtgcacaatccggtcactagaatcattcctgtgcgacccttattccgcagaatcaccctcaccacaagggggtcctgacgacgtttctctgctctcccctggcgaagacgtgctgattgacattgacgacaaggaaccattgattcctattcaggaggaggaatttattgattggtggtccaagttcttcgcgtccatcggcgagagagagaagtgtgggagttatctggagaaagactttgataccctaaaggtgtacgatacacagcttgagaacgtggaagctttcgagggactgagtgatttctgtaatacattcaaattgtatcgaggcaaaacccaggaagagacagaggatcctagtgtgattggggaattcaaaggcctgttcaagatctaccctctacctgaggatcctgctattcccatgccccctcgccagtttcatcagctggccgcccagggtcctcaggagtgtctcgtccggatctacattgtacgggcattcgggctgcagccaaaggacccgaatgggaaatgcgacccctatatcaagattagtatcgggaaaaaaagcgtgtccgaccaggacaactatatcccatgcaccttggaaccagtgttcggcaaaatgttcgaactgacctgcacactcccccttgaaaaagatcttaaaatcacactttatgactacgacctgctctctaaggacgagaagataggcgagaccgtagtcgatctggaaaaccggcttttatctaagtttggtgctaggtgtggtttaccccagacctactgcgtttccgggccaaatcagtggcgcgatcaactcagaccctcccaactcctccacctgttctgccagcagcaccgagtgaaagcccccgtctacagaactgaccgcgtcatgttccaggataaggaatacagcatcgaggagatcgaagctggaagaatccctaacccccacctcggtcccgtggaggagcgcctcgctcttcacgtgctacagcagcagggcctggtgcccgaacacgtggagagcagaccactatactcaccactacaacccgatatagagcagggcaagttgcagatgtgggtggacttgttccccaaggctctggggaggcctggtcccccatttaatataacgcctcgtagagctagacggttcttccttcgttgtatcatctggaacaccagggacgtgatcctggatgatcttagcctgaccggggagaagatgagcgatatctatgtaaagggctggatgatcggattcgaagagcacaaacagaagaccgatgttcattaccgctctcttggtggggagggaaacttcaactggcgttttatttttccgttcgattatcttcccgcagaacaggtgtgtactattgccaaaaaagacgccttctggaggctcgataaaaccgaaagcaaaatccctgcccgggtggtgttccagatctgggacaacgataagtttagtttcgacgattttttgggcagcttgcagctggatctgaacagaatgcccaagccagcaaaaaccgcaaaaaaatgtagccttgaccagctggacgacgcattccatccagagtggtttgtgtcgctgttcgagcagaagaccgtgaagggatggtggccttgcgttgccgaggaaggtgaaaaaaagatactggccggaaaactggagatgacactggagatagtggctgaaagtgagcacgaagagcggcctgctggacagggacgggatgaacccaatatgaatccaaagttggaagatcctaggagaccggacactagtttcctgtggtttacgtcgccttacaagaccatgaagttcatcctgtggaggagattcaggtgggctattattctattcataattcttttcatcctcctgcttttcctggccattttcatttatgcctttccaaactacgcagcgatgaagctggtgaagcctttctcc

SEQ ID NO: 10695 - DNA, 6243 bp, Artificial Sequence
  Description of Artificial Sequence: Synthetic coding sequence
atgctgtgctgcctgctggtccgggcttcaaacttgccatccgcgaaaaaggaccggagatccgaccccgtggcgagcctgactttccggggggtgaagaaacggaccaaggtgatcaagaactccgtgaatccggtgtggaacgaaggattcgagtgggacctcaaaggaattccgctcgatcaaggctcagagctgcacgtggtggtcaaggaccatgaaaccatgggacgcaaccggtttctgggagaagccaaggtgcctctgagggaagtacttgcgaccccctccctgtcggcctctttcaacgccccgctcctggataccaagaagcaaccaacgggggcatcgctggttctgcaggtgtcatacacccccctgccgggggctgtcccgctctttccgcccccgaccccacttgaaccctcgccgacgcttccggacctggatgtggtggctgacactggaggtgaggaggacaccgaagatcagggcctgaccggagatgaggcagaaccctttttggaccagtccggtggaccgggcgctccgaccaccccgcggaagctgccgtcgaggccaccaccccactacccaggtatcaaaaggaagagatcggcacctacgtcacgcaaactcctgtccgataagccgcaagattttcagatccgcgtgcaggtcatcgagggacgacagctgccgggcgtgaacatcaagccagtggtgaaggtcaccgccgcagggcagaccaaacgcactcggatccacaagggaaatagccccctgttcaatgaaaccctgttcttcaatctcttcgattcacctggagaactgttcgacgaacccatcttcatcactgtcgttgattcccgttccctgcgcactgacgcactgctcggagaatttcgcatggatgtgggaaccatctacagagagccgaggcacgcatacctccgcaaatggcttctgctttcggacccagatgatttctccgcaggagcccgtggatacctgaaaacttcgctgtgcgtgctgggccctggagatgaagccccattggaacggaaagatccttcagaggacaaggaggacatcgaatccaacctcctcaggcctactggagtggcgctgagaggagctcacttttgtctcaaggttttcagagcggaagatctcccacaaatggacgacgccgtgatggataacgttaaacaaatcttcggattcgaatcaaacaaaaagaacctggtggacccgttcgtggaggtgtcgttcgcgggaaagatgctctgctctaaaatcttggagaaaaccgccaatccgcagtggaatcagaacatcactctgcctgccatgtttccttctatgtgcgaaaagatgagaatcagaatcatcgactgggatcgcctgactcacaacgatattgtggcgaccacctacctgtcaatgagcaagatttcggcgcctggaggcgaaatcgaggaggaaccagccggcgctgtcaagccgtcaaaggcctcagatctcgacgattacctgggcttcttgcctactttcggcccgtgctacatcaacctgtacggatctccgcgggaattcaccggctttccagacccgtacactgagctgaataccggcaaaggagagggggtcgcttaccgcggccggctgctcctctcgctcgaaactaaactggtcgagcatagcgagcaaaaggtcgaggacctgccagccgatgacatcctccgggtcgaaaagtacctgcggcggcggaagtactccctgtttgcggctttctactccgcgaccatgctgcaggacgtggacgatgctatccagtttgaagtatcgatcgggaattacggcaacaaattcgacatgacttgtttgcccctggcctccactactcaatatagccgagccgtgttcgacggttgccactactactacctgccttggggtaatgtcaaacctgtggtggtcctgtcgagctactgggaagatatctcacataggattgagactcaaaatcagctgctgggaatcgcggatcgcctggaggccgggctggaacaagtccatctggccttgaaggcccaatgctcgaccgaggacgtggactccctcgtcgcgcagcttactgacgaactcatcgctggatgctcccaaccgctgggtgatattcatgagacgccgagcgccacgcatctcgaccagtacctttaccagctccggactcaccatctttctcaaatcaccgaagctgccctcgccctcaagctcggacactctgaactccctgccgcactggaacaggcggaggactggctgcttcgcctccgcgcacttgcggaagagccgcagaatagcctcccagacatcgtgatctggatgctgcagggcgacaagcgcgtggcctaccagcgcgtcccagctcatcaggtgctgttctccagaaggggcgcgaactactgtggcaagaattgtggcaagctgcaaaccattttcctgaagtaccccatggaaaaggtccctggcgcgagaatgccggtgcagatcagggtgaaactttggttcggactgagcgtggatgagaaggaattcaatcaattcgcggagggaaaactgtccgtgtttgcggaaacctacgagaacgaaaccaagttggccctcgtagggaactggggaactactggcctcacctacccgaagttctccgatgtgaccggcaaaatcaaacttcccaaggactcattccgccccagtgcaggatggacttgggccggcgactggttcgtgtgccccgaaaagaccctgctgcacgacatggacgccggacatctgagctttgtcgaagaggtatttgaaaaccagacccgcctgccaggcggacagtggatatacatgtcagataactacactgacgtcaatggagaaaaggtgctgcctaaggatgacattgagtgcccgctcggatggaaatgggaagatgaggagtggtccactgacctcaatagggccgtggacgaacaaggttgggagtacagcatcaccatcccgccagagagaaagccgaaacactgggtcccagcggaaaagatgtactatacccaccgtcggcgccgctgggtgaggctcaggcgcagggatctcagccaaatggaggcactgaagcgccatagacaagccgaggccgagggtgaggggtgggaatacgcatcgctttttggttggaagttccacctggaataccgtaaaaccgacgcttttcgtcgcaggagatggcggagacgcatggaaccgctggaaaaaacgggcccagccgctgtctttgccctcgagggggccttgggaggcgtcatggatgataaatccgaggactccatgtccgtcagtacgctctccttcggcgttaaccgtccgactatctcgtgcattttcgactatggcaaccgctatcacttgcggtgctacatgtaccaggctcgcgatctcgccgcaatggacaaggactccttttcggacccgtacgccatcgtgtccttcctccatcaaagccaaaagacggtcgtggtgaaaaacaccctcaacccaacctgggaccagaccctcatcttctacgaaatcgaaatcttcggagaaccggcaacggttgctgaacagccaccctcgatcgtcgtggaactgtacgatcacgacacttacggagccgacgaattcatgggacgatgcatctgccagccttcgctggagcgcatgcctaggctcgcctggttcccgctgactagaggctcgcagccctcaggagagctcctggcttcttttgagctgatccagcgggaaaagcctgcaatccaccacatcccaggcttcgaggtccaagaaacctcccggatcctcgatgaaagcgaagatactgacctgccataccctccgccgcaacgggaggccaatatctacatggtcccgcaaaacatcaagcccgcgctgcaacgaactgcaatcgaaattcttgcttggggactgagaaacatgaagagctaccagctggcaaacatcagcagcccgtccctggttgtcgaatgcggaggccagactgtgcagtcgtgcgtcatccgcaacctgcgcaagaacccgaatttcgatatctgcaccttgtttatggaagttatgctgcctcgggaggaactttactgtccaccgatcactgtgaaggttattgataacagacagttcggacggcggcctgtcgtgggacagtgtaccatccgcagcctggaatcattcctgtgcgacccttacagcgccgaatccccttccccgcaaggaggaccggatgatgtgagcctcctttcacccggagaggacgtgctgatcgacatcgacgacaaggaaccactcataccgatccaggaagaagaattcattgactggtggtccaaattcttcgcatcgatcggagaacgggagaagtgcggatcatacctcgagaaggacttcgataccctgaaggtttacgatacccagctggagaatgtcgaggctttcgaaggcttgtcagacttctgtaacactttcaaactttatcgggggaaaacccaggaggagactgaagatccgtcagtgattggggaattcaagggactcttcaagatatatccgctgccagaagatccggccatccctatgccgccgagacagttccaccaactggccgcacagggaccccaagaatgcctggtgcgtatctatatcgtgcgcgcctttggacttcaacccaaagatccaaacggaaagtgtgacccttacattaagatcagcataggaaagaagtcggtgtcggaccaagacaactacatcccgtgcaccctggagccagtgtttgggaagatgttcgagcttacctgcactttgccccttgaaaaggatttgaaaatcaccctctatgactatgacctgctgtccaaggatgagaagataggcgaaaccgtcgttgacttggagaatcggctgctcagcaagtttggtgcacgctgcggactcccacagacttactgcgtgtccggaccaaaccagtggcgcgaccagctccgccctagccagcttctgcacttgttttgccagcaacaccgcgtcaaggctccggtctaccggactgatcgagtgatgttccaggataaagaatactcgatcgaggaaatcgaagcaggccgcattcctaacccgcacctggggccggtcgaggaacgcctggctctgcatgtgctccaacagcagggactggtccccgaacacgtggagtcccggccattgtactcgccgctgcagccggatatcgaacagggcaagttgcaaatgtgggtggacctgtttccgaaagccttgggacgaccaggtccgcccttcaacatcacccctagacgggctcggcggttcttcctcagatgtatcatttggaacactcgggacgtgattctggatgatttgtcactgacgggagagaaaatgtcagatatctacgtgaagggatggatgatcgggttcgaagagcataagcaaaaaaccgacgtgcattacagatcgctgggtggagagggtaatttcaactggagatttatcttcccgttcgattaccttcctgctgagcaggtgtgtaccatcgctaaaaaggacgccttttggcggctggacaagactgagtctaagataccagcccgggtggtgttccagatctgggacaatgacaagttttcgttcgacgactttctgggttcccttcaactcgacctgaatagaatgccaaagccagcaaaaacggccaagaaatgcagccttgatcagctcgacgacgctttccaccctgagtggttcgtgtctctgtttgagcagaaaactgtgaagggttggtggccgtgtgtggctgaagaaggcgagaagaagatcttggccgggaagctggagatgactctggaaatcgtggcagagtccgagcatgaggagcggcccgcggggcagggacgggacgaacccaacatgaaccctaaattggaagatccgcggcggcctgacacttcgttcttgtggttcacttcgccgtacaagaccatgaagtttatactctggagaaggttcagatgggccatcatcctcttcatcatcctgttcatcctgctccttttcttggcgattttcatctacgccttcccgaattacgccgcgatgaagttggtgaaaccgttttcc

SEQ ID NO: 10696 - DNA, 6243 bp, Artificial Sequence
  Description of Artificial Sequence: Synthetic coding sequence
atgctttgctgcctgcttgtgcgggccagcaatcttcctagcgctaaaaaggataggaggtcggacccagtcgcgtcgcttacttttaggggtgtgaagaagaggactaaagtcataaagaactcggtgaatcctgtgtggaatgaagggttcgaatgggatctgaagggtattcctctggatcaaggttccgaacttcatgtggtcgtgaaggaccatgaaactatgggaagaaaccgcttcctcggtgaagcaaaggtgcctctcagagaagtgttggcgaccccttcactgtcggcctcttttaacgcgcctctgctggacaccaagaagcagccaaccggagcatcactggtcctccaggtgtcgtatactcctttgccgggagcggtgccattgtttccgccccctacccctctcgagccctcgcccactcttcctgatctcgatgtggtcgcagacaccggcggagaggaggatactgaggatcagggcctgactggagacgaagccgagccttttttggatcaatcgggcggaccgggcgcacctaccaccccacgaaagctgccatcgcgccctccaccccattacccaggaatcaagaggaaaagatcggcgcctacgtcgcgtaagttgctctcggataagccacaggacttccagattagagtgcaggtgattgagggacgccaactcccgggtgtgaacataaagcctgtggtcaaagtgacggccgcagggcaaaccaaaagaactcggattcataaagggaacagcccacttttcaacgaaacgttgtttttcaacctttttgatagcccaggagaactttttgacgaaccaattttcatcactgtcgtagacagcagaagccttcgcaccgatgcccttcttggggaatttagaatggatgtcggtaccatataccgcgagccacgacatgcgtacctgagaaagtggcttcttctctcggatccagatgacttttcggcaggcgcaagagggtacctcaagacgtccctttgtgtgctgggtcctggtgacgaggcaccgctggagaggaaagatccctccgaagataaagaggatattgagtccaatctgcttcgtccaacgggggtggcacttcgaggcgcacacttctgtctgaaggtctttcgcgcagaggatctgcctcagatggatgacgcggtgatggataacgtcaagcagatttttggattcgaaagcaataagaagaaccttgtggatccgtttgtggaagtgagcttcgctggaaaaatgctttgtagcaaaattctcgagaaaactgccaatccccagtggaaccaaaacattactcttccagcaatgttcccttccatgtgcgaaaagatgcgtattcgcatcatagactgggaccggcttacgcacaatgacatagtcgcaactacttatctttcgatgtcgaaaatctcggcaccaggtggggaaatagaagaagaaccagcaggtgccgttaagccctccaaggcgtctgaccttgacgattaccttggatttctccctacttttggaccttgctatatcaatttgtacggctcgcctcgtgagtttaccggattcccagatccgtacacggagttgaatactggcaaaggagaaggggtcgcatatcgggggcggttgcttcttagccttgagactaaactggtggaacactccgaacaaaaggtggaggacctccctgcagatgatatcctgagagtggagaagtacctccgcaggagaaagtactcactcttcgcagccttttactcagcaaccatgctgcaggacgtcgatgatgcgatccagtttgaagtgagcattggtaactatggtaataagttcgacatgacgtgtctccccctggcaagcaccacccaatactcgagagccgtgtttgacggttgccattactactacctcccatggggaaatgtcaagccagttgtggtgctgtccagctactgggaagatatctctcatagaattgaaactcagaaccaactgttgggtatcgctgaccggctcgaagcaggactggagcaggtccatctggcccttaaggcgcagtgttcgactgaagatgtggatagcctcgtggcacagttgaccgatgaactgattgcaggttgttcgcaaccactgggcgacattcatgagactccttcagcgacccacctggatcaatacttgtaccaactgagaacccaccatctgtcccaaattactgaggcagcattggcactgaaattgggacactccgaacttccagcagctctggagcaggctgaagattggcttcttcggctgagagcactggcagaagagcctcaaaactccctgcctgacatcgtcatttggatgcttcaaggagataagagggtggcttaccagcgggttcctgcgcaccaagtgcttttttcgcgccggggagcaaattactgtggtaagaactgtggtaaactgcaaaccatattcctgaagtaccccatggagaaggtccctggtgcaagaatgcctgtgcagatccgagtgaagctctggtttggactgtcggtggatgagaaggagtttaatcaattcgccgagggtaagctctccgtgtttgccgaaacttacgaaaatgaaaccaaacttgcgctggtcggaaattgggggaccacggggcttacttatcctaagttttccgatgtgactgggaagattaagctgccaaaggactctttccgaccttctgcaggctggacctgggctggggattggtttgtgtgtccagagaaaacgcttctgcacgacatggacgccggccatctttcctttgttgaggaggtgtttgagaatcagaccaggcttcctggaggccagtggatttacatgtcagataactacaccgatgtgaacggtgaaaaggtgcttcctaaggacgacattgagtgccccctcggatggaagtgggaagatgaagaatggtctacggatcttaacagagcagtggacgaacagggatgggaatactcaattaccatcccacctgaacgtaaaccaaagcactgggtgccagctgaaaagatgtactacacccatagacgacgacggtgggtccggttgcgccgtagggacctgtcgcaaatggaggcactgaagcggcatagacaagctgaagctgagggtgaagggtgggaatatgcttcgctcttcggttggaaattccacctggaatacagaaagactgacgcattccgccgccgtagatggcgccgacggatggaaccgcttgaaaaaacgggtcctgcggcggtgtttgccctggagggcgcactgggtggagtcatggatgataagagtgaggactctatgtccgtgtcgaccctctcgtttggcgtgaacaggcctactatctcgtgtatctttgactacggtaatagataccatcttcgctgttatatgtaccaagccagagatctggctgctatggataaggattcgttctcagacccctacgccatcgtgtcgtttcttcaccaatcccaaaagactgtagtcgttaagaacactctgaaccctacttgggaccaaactctgattttctacgagatagagatctttggtgaacctgcaacggtggcagaacaacccccttccatcgtggtggaactttacgatcatgatacctacggagcggacgagtttatgggccgctgtatctgtcaaccctcgctggaacggatgcctcgtctggcatggtttcctctcacccggggtagccagccgtcaggagagttgctggcatcatttgaacttattcaaagagagaaacccgccattcatcatatccctggatttgaggtccaggagacttcgcggattctggacgagtccgaggataccgacttgccatacccacccccacaacgcgaagcaaacatttacatggtgcctcaaaacataaaaccggcactgcaacggactgcaattgagattctggcatgggggctcagaaatatgaaatcataccagctcgcaaatatcagctccccttctctcgtcgtggaatgtggagggcaaaccgtgcagtcatgcgtgatccgcaatcttaggaaaaacccaaactttgacatctgtactcttttcatggaagtgatgctgcctcgagaagaactttactgtccacccattactgtgaaggtgattgataaccgacaattcggacgccgcccagtcgtgggtcagtgcaccatcaggagccttgagtccttcctctgtgacccgtactccgcagagagcccaagcccccaaggtggaccagatgatgtcagcctgttgtccccgggagaagatgtgctgattgatatcgatgataaggagcctcttatcccaattcaagaggaagagtttattgattggtggtcgaagttctttgcaagcatcggggagagagaaaagtgtggatcctacctggagaaggatttcgatacccttaaggtttatgatactcaacttgaaaatgtggaggcatttgagggcttgtccgatttttgcaacacctttaagctctaccgagggaaaacgcaagaagaaactgaagatccttcagtgatcggtgagtttaagggactgtttaagatatacccccttcctgaagatcctgccattcccatgccacccagacaattccatcaacttgccgctcagggaccacaggaatgccttgtcagaatttacattgtgagagcgttcggactccagcccaaagatcctaatggaaagtgcgatccatacatcaaaatctcgattgggaagaagtcggtgagcgaccaggacaactacattccatgcaccctggaacctgtctttgggaagatgttcgagcttacctgcacgctgcccctggaaaaggatctcaagattactctgtacgattacgatctcctttcgaaagacgagaagatcggagaaaccgtagtcgatctggagaatcggcttctctccaagtttggagcccgatgtggtctgccacagacttactgtgtgagcggaccaaaccagtggcgcgaccaattgcgaccgtcacaactcttgcacctgttctgtcaacaacatagggtcaaggcacctgtgtaccggactgaccgtgtgatgtttcaggacaaagaatacagcattgaagagatcgaggcgggccgtattccaaacccgcatcttggccctgtcgaagaaaggctggccttgcatgtccttcagcagcagggccttgtgcctgaacacgtggaaagcaggcctttgtactcgccactgcaacctgatattgagcaggggaaactccagatgtgggtggacctttttccgaaagcgctgggtcgaccaggacctccttttaacatcacccctagacgtgcaaggcgctttttcctccgttgcatcatttggaacactcgcgatgtgatcctcgatgacctgagcctgaccggtgaaaagatgtcggacatctacgtgaaaggttggatgatcgggtttgaagaacacaagcaaaaaaccgatgtgcattaccgttcgttgggtggcgaaggcaatttcaattggcggttcatctttccatttgactacctgccagcagaacaagtgtgtactatagcaaaaaaggatgcgttttggcgtctggacaagaccgaatccaagatccccgcacgcgtggtgtttcaaatctgggataacgacaagttcagcttcgatgattttcttggcagcctccaacttgatctgaaccggatgcccaagcctgccaagactgcaaaaaagtgcagccttgatcagctggatgacgcatttcatcctgagtggtttgtcagccttttcgaacaaaagaccgtcaagggttggtggccttgtgtggcagaagaaggtgaaaagaagatcctggctggaaaattggaaatgaccctggagatcgttgccgaatccgaacacgaagagcgtccggcaggacagggtagagacgagcctaacatgaaccctaagctcgaagatccgcgtcgccctgacacgtcctttctctggtttacctctccctacaagaccatgaaattcattttgtggaggcgcttcaggtgggcgatcattctgttcattatcctgtttatcctgcttctgttcctcgcgatctttatctacgccttccctaattacgcagcgatgaagctggtgaagcctttcagc

SEQ ID NO: 10697 - DNA, 6243 bp, Artificial Sequence; identical to SEQ ID NO: 10692
  Description of Artificial Sequence: Synthetic coding sequence

SEQ ID NO: 10698 - DNA, 6243 bp, Artificial Sequence
  Description of Artificial Sequence: Synthetic coding sequence
atgttatgctgcctgttagtacgtgcgagcaatttaccgtctgcgaaaaaagaccgtaggagcgatccggtagcctctttaacgtttagaggagtcaagaagcgcaccaaagtgatcaaaaattcggttaatcctgtgtggaacgagggctttgaatgggatcttaagggaatccccttagaccaaggatctgagcttcatgtggtagttaaggatcatgaaactatggggagaaaccgctttttaggtgaggcaaaagtgccgttacgcgaggtattggcgactccgtctctatctgcaagctttaacgcgcctctacttgacactaaaaaacagccgacgggagcttctctagtacttcaggtgtcttatacaccactgcccggagctgtacctttgtttccgcctccgactccactcgaaccgagccccactcttccggatttagacgtagttgcggacaccggtggtgaggaagatactgaggaccaaggacttacaggggatgaagctgagccttttttggatcagagcggcgggccgggcgctccgactacccctcgaaaactgccttcccgtccgccgccgcactatcccggcattaaaagaaaacgctccgccccaacttcacggaaacttctgtctgataagccgcaagatttccaaattcgtgtacaagttatagaaggcagacagcttcccggtgttaatattaaaccagtcgttaaggtaacagccgctggccagacgaagcgtacgcggatccacaagggtaatagcccactgtttaatgaaacgctctttttcaatctgttcgattctcccggagaactctttgatgaaccgatttttattacagtggtggattcgcgatctttaaggaccgacgcactgctcggcgaatttagaatggatgtcggcaccatttacagagaaccgcggcatgcctaccttcgaaagtggctgctgctcagtgatcctgatgatttctcagctggcgcgagaggctacttaaagacttcgctttgcgtgctcggcccgggtgacgaagctcctcttgaaagaaaggacccgtcagaggataaggaggatatcgagagcaaccttttgcgcccaacaggtgtagccttacgtggggcccatttttgccttaaagttttcagagctgaggatttgcctcaaatggacgacgccgttatggataacgtcaaacaaatttttggctttgaatctaacaagaagaacctcgtagacccatttgtagaggtctcttttgcgggtaagatgctgtgctccaaaatattagagaaaactgccaatccccagtggaatcagaacatcacactccctgcgatgtttcctagtatgtgtgaaaagatgcggatacgtattatcgattgggacagacttacacataacgatattgtcgctactacttacctctcaatgagcaagatttcagcgcccgggggtgaaatcgaagaggaaccggctggcgcggtgaaaccatcaaaagcatcggatcttgatgactacctgggctttcttccgacatttggtccttgctatattaatctgtacggtagccctagagagtttacgggatttcctgatccatatacagaactcaataccggcaaaggggaaggcgttgcctatagaggccgtctcttgctgtcattggaaactaaactggtcgaacacagcgaacagaaagtcgaagacttgccggctgacgatatcttacgcgttgagaaatatcttcggagaaggaaatacagcttattcgcggctttttactcggctacaatgttacaagacgtcgatgatgccatacagttcgaagttagcattggtaattatgggaataaattcgacatgacttgtctgccgttggcctccacaacccagtattcacgggcggtatttgatggttgtcattattactatttgccttggggcaacgttaaaccggtagtcgtcctttcttcatattgggaggatatttcacaccgcattgagacacaaaatcagctcctgggcatcgccgatcggttagaagccggcttggaacaggttcatctggcacttaaagcccaatgtagtacagaagacgtagactcactggtggcacagttaacggacgaactcattgctggttgcagtcagccgctaggtgacatccacgaaacaccatctgcaacacatcttgatcaatatttgtaccaattacgcactcatcacctcagccagattacagaagcagctttagctctgaagctggggcactcagaattgccggcagccctggaacaagctgaggattggttattgcgcttgcgagctcttgccgaagaaccgcaaaattcccttccagatatcgtcatttggatgttacaaggggataaacgggttgcttatcaacgtgtcccggcgcatcaggtcctgttctcacgtagaggtgccaattattgtggtaaaaactgcggaaaattacagacaatatttcttaagtatccgatggaaaaggttcccggagccaggatgcctgtacagatccgggtaaagctgtggtttggcctgtcagtggatgaaaaagaattcaaccaatttgcagagggaaaactttcagtatttgcagaaacttacgaaaacgagaccaaacttgctcttgttggcaattggggtacaaccggtttgacatatcctaaatttagcgatgtaactgggaaaataaagttaccaaaagactcctttcgtccatcagccggctggacatgggcaggtgattggtttgtgtgccctgagaaaacccttttgcatgacatggatgcaggtcatctttcttttgtggaagaggtcttcgaaaaccagactagacttccggggggtcagtggatctatatgagtgacaactatacagatgttaatggagaaaaggtcttgcctaaagatgatattgaatgtccattaggttggaaatgggaagacgaagaatggagcacagacttaaatagagctgtggatgagcaaggctgggagtatagcataactattccgccggaaaggaagccgaaacactgggtgccggcagagaaaatgtattatacccataggagacgtcgctgggtacggttacgtagacgagacctgagccagatggaggctcttaaaagacatcgccaggcggaagcagaaggagaaggctgggaatatgcttccttgtttggctggaagtttcatctggagtatcgcaaaaccgatgcatttcgaaggcgcagatggcgccgcagaatggaaccgctggaaaaaacaggcccagcagctgtcttcgcgcttgaaggggcactgggaggggttatggacgataaatcagaagattcaatgagcgtcagcacattatcttttggcgttaatcgtccgaccattagctgtattttcgattacggaaatagatatcatctacgctgttacatgtatcaagcgcgggacttggccgccatggacaaggattcattttccgacccttatgcgattgtgtcgtttcttcaccaatctcaaaaaacggtagtggtcaaaaacaccttgaacccgacatgggatcagacgctgattttttacgaaattgaaatatttggagaaccagctacggtggcagaacaacctccatccattgtcgtggaattgtatgatcatgatacatatggcgccgatgagtttatgggaagatgcatttgccaaccttcattagagcgcatgcctagattggcttggtttccacttactagaggttcacaaccgtctggggagttattggcaagctttgaattaattcaacgagaaaagcctgccattcatcatatacctggattcgaagtacaagagacaagccgaattctggacgaaagtgaggatacggacttaccgtatccgcccccacagcgagaagcaaatatatatatggttcctcagaacataaagccagctcttcaacgcacggccatagaaatcctggcttggggattacgcaacatgaaatcttatcagctggcgaatattagcagtccatcattggtggttgagtgcggcgggcaaacagttcaatcgtgcgtcatcagaaacttgcgcaaaaaccctaattttgatatttgtacgctgtttatggaagtgatgcttccaagagaagaactctattgtcctcctatcaccgtcaaagtaattgataataggcaatttggtcgccgcccggtagtggggcagtgtacaatccgttcgttggaatcttttttatgtgatccgtattcggcagaatcaccatcaccgcaaggcggccctgatgatgtatcacttctgagcccgggtgaggacgtacttattgatattgatgataaggaacctctgattccaatccaggaagaagaattcatcgattggtggtctaaatttttcgcgtccatcggagagcgcgagaagtgcgggtcttatctagaaaaggattttgatacgctaaaagtgtacgatactcaactcgagaatgttgaagcatttgaaggtcttagcgatttttgcaatacgttcaagttatacagagggaaaacacaggaagaaacagaagatccgtccgtaattggcgaattcaaaggactgtttaagatctacccgctccctgaagatcctgctattcctatgccgcccagacaatttcatcagcttgctgcccaaggaccgcaggaatgccttgttcgtatctatattgttcgtgctttcggactccaacctaaagatccgaacggtaaatgcgatccatatattaagatttcgatcggcaagaaatccgtttcagatcaagataattatatcccttgtactttagaacccgtttttggcaaaatgtttgagctgacttgcactcttccgcttgagaaagacctgaaaattacactctatgattacgatctactgtcaaaggatgaaaaaatcggagaaacagtggtggatttagagaatcgcttgctctcgaaatttggagcacggtgcggactgcctcaaacgtactgcgtgtctgggccaaaccaatggagagatcagcttagaccgtctcagttattgcacctgttttgtcagcaacatagagtgaaggcgcctgtttatcggacagatcgcgttatgtttcaagataaagaatactcgattgaggaaatcgaggcgggtcggatccccaatccgcacttgggaccggttgaagaacgtttagctctccacgtgttacagcaacagggtcttgtcccggaacacgttgaatcacgccccctgtacagcccgctgcagcctgatatagagcagggcaaattgcagatgtgggtcgatctgtttccgaaagccttggggagaccgggacctccgtttaatattacaccgcggcgtgcccgacgcttttttctccggtgcattatctggaacacacgggatgtcattcttgatgatttgagcctaacaggagaaaagatgtcagatatttatgtcaaaggatggatgattggctttgaagagcataagcagaagacagatgtgcattaccgttcattaggcggcgaagggaactttaattggagattcatattcccctttgattatcttcctgctgagcaggtctgtacaatcgccaaaaaagatgccttttggcgcctagataaaacagaatctaagatccctgctcgcgttgtctttcagatttgggataacgataagtttagctttgatgactttttaggttctctccaacttgacctaaatagaatgcctaaaccggcgaaaaccgcaaaaaaatgcagtcttgaccagcttgacgatgcttttcatccagaatggttcgtgtccctctttgaacaaaaaacagtcaaaggctggtggccttgcgtagccgaagaaggagaaaagaaaattctcgccggaaaactagaaatgacgctggaaatagtcgcagaatccgagcatgaagagcgtccggcaggacaaggacgggatgaacctaacatgaatccaaaactggaggatccacgccgtccggacacaagttttctgtggtttacgagcccttacaagactatgaaatttatcctttggcgcagatttagatgggccattatcctgtttattatattatttatcttacttctgtttctggccatttttatctatgcttttccgaactacgcggctatgaaactggtgaagccgttttct

SEQ ID NO: 10699 - DNA, 6243 bp, Artificial Sequence
  Description of Artificial Sequence: Synthetic coding sequence
atgctttgctgcctcctagtcagagccagcaaccttccctccgccaaaaaagaccgccgttccgaccctgtggcctcgctgacctttcgcggagtgaaaaagcgcacaaaagtgatcaagaactccgttaaccccgtatggaatgaaggcttcgaatgggatctgaaggggatccctttggaccagggctctgaacttcacgtggtggtcaaagaccacgagacgatgggccggaataggtttctgggtgaggccaaagtgcccctgcgcgaggtgctggcaaccccgtccctatctgccagctttaatgcaccgctgcttgacacaaagaaacagcccactggtgcaagtctggtgctgcaggtctcttacacccccctccccggtgcagttcccctcttcccaccacctacgcccctcgagcctagcccaacacttcctgaccttgatgtggtggctgatacaggtggtgaggaggataccgaggatcagggcctaacgggggatgaggctgagccctttctagaccagtctggagggcccggcgcacctaccacacccagaaaattgccatcacgcccgcctccccactaccccgggatcaagcgcaaacggtctgctccgaccagccggaagcttctcagcgataagccccaggatttccagattagagtacaggttattgaaggcagacaactccccggagtcaatattaaacctgtggttaaggtgacagcagcgggccagaccaagcggacccgcattcacaaagggaactcgcccctcttcaatgagactctcttcttcaacttgttcgattcaccaggtgaactcttcgacgaacctatttttataaccgtggtcgattccagatcactccgcactgatgcattactgggcgagttcaggatggatgtgggaacaatttaccgcgaaccacgacacgcatatctgaggaaatggctgctgctgagtgacccagacgacttctcagctggcgctcggggctatctgaagacaagcctctgtgtcctagggcctggggacgaggcgcccctagagaggaaggatccctcagaggacaaggaagacatcgagagtaacctgctgcggcccaccggagttgcacttcggggtgcccacttctgtctgaaggtgttccgggcagaggatctgccccagatggatgacgccgtgatggacaatgttaaacagatttttggatttgaaagcaacaaaaagaatcttgttgatcccttcgtagaagtctctttcgcaggcaaaatgctgtgcagtaagattctcgagaagacagcaaatccgcaatggaaccagaacatcaccctgccagctatgttcccatccatgtgcgagaaaatgcgaatccgaattatcgattgggaccgcctgacgcataatgacatagtagctactacatatctgagcatgtcaaaaatttccgcccccggcggcgaaatcgaagaagagccagccggggcagtgaaaccctccaaagcctccgatttggatgattatctgggcttcctccccacattcggcccttgttacattaacctgtatggctcgccacgggagttcactggtttccccgatccatacacggagctgaataccggaaaaggagagggcgttgcgtacagaggccggctgctgctctccctcgaaactaaactcgtcgaacactcggaacagaaggtggaagatctcccagccgatgatatcttacgtgtggagaaatacctccgcaggcgaaaatattccctgtttgccgctttctacagcgctaccatgctgcaagacgtagacgatgctatccagtttgaagtgagcattgggaattacgggaacaagttcgatatgacatgtctgcctcttgcttctacaacacagtattcaagggctgtgtttgacggctgtcattactattatctgccctggggcaacgttaagccagtggtcgtgttgagctcatattgggaagacatcagtcaccgcatagaaacacagaaccagctgctggggattgctgacaggttagaggccggactagaacaggtgcatctggctttgaaagcccagtgttctacggaggatgtggacagcttggttgctcagctgacagacgaattgattgctggatgctcacagcccctgggtgatattcacgagaccccctcagccacacatttggaccagtacctgtatcagctgcgtactcatcacctgtctcagatcacggaagccgcactcgccctgaaactaggccatagtgagttgcccgccgccctggagcaggctgaggattggcttctgaggctccgcgctctggccgaggagccacagaattccctgcccgacatcgtgatatggatgctacagggtgataaaagagtggcctatcagagggtacctgcacatcaggtcctgttctcccggcgtggggccaattactgtgggaagaattgtggcaagctccagacaattttcctcaagtacccaatggaaaaagtgccaggagcaaggatgcccgtgcagatccgggtcaagctgtggtttggattaagcgtcgacgaaaaagaatttaatcaatttgctgagggcaagctgtcagttttcgccgaaacctatgagaacgagactaagctggcactggtgggcaactggggcacaaccgggctgacatatcccaagtttagcgatgtgactggcaagattaagctgcctaaggattccttccgtccttccgccggatggacctgggccggcgactggttcgtgtgccctgaaaagactttgctgcatgatatggacgcaggtcacttgagcttcgtggaagaggtctttgaaaaccagacacggttgcccggcggccagtggatttacatgagtgataattacaccgatgtcaatggcgagaaagtgttgcccaaggacgacatagaatgtccccttggttggaagtgggaagacgaggagtggtctacagaccttaatcgcgccgtggatgagcagggctgggagtattcaattaccatccctccagaacgcaagcctaagcactgggtccccgccgagaagatgtattacactcaccgtaggagacgctgggtccgcctgaggaggcgcgatctctctcagatggaagccctgaagcggcatcgacaagccgaagccgaaggggagggatgggagtacgcgagcctattcggttggaagttccacttggaatataggaagactgacgctttccgtcggcgccggtggagacgaaggatggagcccttagagaaaaccggaccagccgctgttttcgctctcgagggagccctgggtggagtaatggacgataaaagcgaggactccatgagtgtgtctacactgtccttcggcgttaacaggcctaccatttcatgtatctttgattacggaaataggtaccacttgagatgctacatgtatcaagcccgggatctcgcagccatggacaaggacagcttctcagacccgtatgccatcgtttctttcttacatcagtcccagaagacggtggtcgtgaagaatacactgaatccaacatgggatcagactttaattttttatgagattgaaatatttggagagcctgccactgtcgcagagcagcctccgtccatcgtggtggagttgtacgatcacgatacctacggtgcggacgaatttatgggcagatgcatttgccagccaagcttagaaaggatgcccaggctggcatggttccctttgacgcgggggtctcaaccatcaggcgagttgctggcttcgttcgaattgatccagagggagaagcccgctattcaccatattcccgggtttgaggtccaggaaacgtctcggatcctggatgaaagcgaggacacggatctgccttaccctcctccacaacgggaggccaacatctacatggtgcctcagaacatcaaaccagccctgcagaggactgccattgagattctggcatgggggttaaggaatatgaaatcataccagcttgccaatatttcgtctccctctctcgttgtcgagtgtgggggccagacagtgcagtcttgtgtgattcggaatctgcggaaaaacccaaactttgatatctgtactctgttcatggaagtgatgctcccacgcgaggagctctattgccctccaatcacagtgaaagtcatcgacaaccgccaattcggtaggcgtcctgtggtgggacagtgtaccattagatccttagagtcatttctgtgcgatccgtacagcgcagaatccccgagcccccagggcgggccggacgatgtcagcttattatcgcccggagaggatgtgttaatcgacattgacgacaaggaacccctaattcctattcaggaagaagaatttatcgactggtggagcaagttcttcgcgtcgatcggggaacgcgagaaatgcggcagctacctggagaaagactttgataccctgaaggtgtacgatacccagctcgaaaacgtggaggcctttgaaggccttagcgatttctgcaatacattcaaactgtatcgtggaaaaacccaggaagaaacagaggatccttccgttatcggcgagttcaagggtttattcaaaatttatccacttcccgaagaccctgctatccctatgcctcctcgtcaattccatcaattggcagcccaagggccacaggagtgcctggtccggatttatatcgtcagggcctttggcttgcagcccaaggatcccaacggtaaatgcgatccgtacatcaagatatccattggcaaaaaaagcgtttcagaccaagacaattatatcccttgtaccttggaacccgtcttcgggaaaatgtttgaattaacttgcacattgcccctggagaaggacctgaaaatcaccctgtacgactatgacctgctttctaaggatgagaaaataggagagaccgtcgtggacctcgagaatcgcttactctcaaaattcggcgcccgctgcggactgccgcagacgtactgtgtttccggtcccaaccagtggcgtgatcagctgcggccctcgcagctactacacctgttctgccagcaacaccgcgttaaggcgccagtatacaggacggatcgcgtgatgtttcaggacaaggaatactctatcgaggaaatagaagcaggccgaatcccaaatcctcacctggggcctgtggaagaaagacttgctttacacgttcttcagcagcagggtttagtcccagaacatgtggaatctaggcccttatatagcccactgcaacccgacattgagcagggcaagctccaaatgtgggtcgatctctttcctaaggcgctgggacggcctggacctccgttcaacatcacaccaaggagggctcggagatttttcttacgctgtatcatctggaacacgcgggatgtgatcttggacgacctgtctctcaccggagaaaaaatgagcgacatctacgtgaagggttggatgatcggttttgaagaacacaagcagaagacggatgtacattacaggtccctcggtggagaaggcaactttaactggagatttatatttcctttcgattacttaccagctgaacaggtgtgtacaatcgccaaaaaggatgccttctggcgtttggataaaacagaaagcaagattcctgccagagtagtgtttcaaatatgggacaacgataagttttccttcgacgacttcttgggcagcctgcagctggacctgaacaggatgcccaaacccgccaaaaccgccaagaagtgttctcttgaccagctggatgatgcgtttcacccagagtggtttgtgagtcttttcgagcagaagaccgtgaaaggttggtggccgtgcgtggctgaagaaggggagaaaaagattctggccggcaagctagaaatgactctggaaattgtagccgaaagtgaacatgaggagagaccggccggacaggggcgcgacgaacctaacatgaaccctaaactggaggaccctcgcagacctgacacttccttcctatggtttacatccccctataaaacgatgaaatttatcctgtggcggcgcttcagatgggccattatcttattcattatcttgttcatcctcctgctgttcctcgctatattcatttacgctttcccaaactacgctgcaatgaagcttgtcaagccattctcc

SEQ ID NO: 10700 - DNA, 6243 bp, Artificial Sequence
  Description of Artificial Sequence: Synthetic coding sequence
atgctgtgttgtctgcttgttcgtgcctccaacctcccatcagcaaagaaagaccgaaggtcagaccctgtagccagcctgacattcagaggggtgaaaaagaggaccaaagtcataaagaacagcgtcaaccctgtttggaatgaaggcttcgagtgggacctgaaaggcattccgctcgatcaggggagtgaacttcatgtagtggtgaaggatcacgagacaatgggacgaaatcggtttctcggggaagctaaagttccactgcgtgaagtactcgctaccccctcactctcagcatcatttaatgccccactcctggacactaagaaacaacctacaggcgcctccctggttcttcaggtcagctacacccccctgcctggggctgtcccattgtttcccccccctacacccttagagccaagcccaacactgcccgaccttgatgtggtggccgatacggggggtgaggaagatacggaggatcagggtttaaccggcgatgaggctgagccgttcctagatcagagcggggggccgggggctcccactacaccccgcaagctgccaagtaggcctccgccacattaccctggcatcaaacgaaagagatccgccccaacatcaagaaagttgctatcagataagccccaggatttccagattcgagtgcaggtcatcgaaggaaggcaattgccaggcgtgaacattaagcctgtggtcaaggtaaccgccgcaggacaaactaagcggacccgtattcataaggggaactctccgttgtttaacgagacactcttctttaatctttttgattcccctggagaactcttcgatgagccaattttcatcactgtggtcgacagccgcagtctgcggactgacgccctgcttggtgaattcaggatggacgttggcaccatttacagggagccaagacatgcctacctgcgtaagtggctcctgctttccgatccggatgacttctctgcaggcgccaggggctatctcaagaccagtctctgcgtgcttggcccaggggatgaggcaccactggagcgaaaagacccaagtgaggacaaggaggatattgagtctaatctgttgcgcccgactggagttgcactaagaggagctcatttttgtctgaaagtcttccgcgccgaagatctgccgcaaatggatgacgccgtgatggacaacgtgaagcagatctttggctttgaaagcaataagaagaacttagttgaccctttcgtggaagtgtcctttgccggtaagatgctctgctctaaaatactcgagaaaaccgcaaatccccagtggaatcaaaatatcaccctacccgccatgtttccatccatgtgcgagaagatgaggattagaattattgattgggaccgattgacacataatgacatcgttgcaactacgtacctgagtatgagtaagatttctgctcccggaggggaaattgaagaggagcctgcaggcgctgtgaagccttccaaagcttcagacttggacgactatctgggcttcctccctaccttcggtccttgttatatcaatctgtatggaagcccccgcgaatttacaggctttcctgatccttacacggagctgaatacaggaaagggtgaaggtgtggcctaccggggcagactgctgctgtcacttgagactaaactggttgagcactccgagcagaaagtagaagatttgcctgccgatgacatactgcgcgttgagaaatatttacgccgcaggaagtacagcctctttgcagccttctactccgcgacaatgctgcaagacgtggacgacgcaatccagttcgaagtctcaatcgggaactacggaaataagtttgacatgacatgcctgcctctggcgtctacaacccaatactcacgcgcggtgtttgacgggtgtcattactattatttgccatggggcaacgttaaacctgtggtggtgctctctagctactgggaagacatttcccacagaattgagactcagaatcagctattgggcatcgccgatagactggaagcagggctggagcaggttcacctggccctgaaagcacagtgcagtacggaagacgtcgactcgttggtcgcccagctgactgacgaactcatcgcagggtgtagccagccactgggcgatatccatgagacccctagcgccacgcaccttgatcagtacctctatcagcttaggacccatcatttgtcccagataacagaggctgcactcgccctgaagctggggcatagcgaactgcccgcagctctggagcaggcagaagattggctgttgaggctgcgtgctctcgctgaggagcctcagaatagcctcccagatattgtgatctggatgctccagggggacaaaagggtggcttatcaaagagtccccgctcaccaggtgctgttctcacggagaggcgccaactactgtgggaaaaactgtggtaagctgcagacaatcttcctaaagtacccaatggagaaggttcctggcgccaggatgcccgtccagataagggtgaagctttggttcggcctgtccgtagatgaaaaggagttcaaccagttcgccgagggaaaattgagtgtgttcgcagaaacatacgagaatgagactaagctcgctctcgtcggcaattgggggactacaggcctgacctatccaaaattctccgatgttactggaaaaattaaactgcctaaagatagcttcaggccatccgcagggtggacatgggctggcgattggttcgtatgtcccgagaagaccctcctgcacgatatggacgccggccatctatctttcgtggaggaagttttcgaaaatcaaaccagattacccggcgggcagtggatttacatgtccgataactatacagatgttaacggcgagaaggtcctgccaaaggatgacatagagtgtccccttgggtggaaatgggaagacgaggaatggagcacagatctgaatcgcgcagtggatgagcagggctgggaatactccattaccataccgccagaaagaaagccaaagcactgggttcccgcagagaaaatgtactatacccatcggcgaagaagatgggtgcgcctgaggaggcgagacctgtcccagatggaggcccttaagcgccatagacaggccgaagccgagggtgagggatgggaatacgcatctctttttggatggaaattccacttggagtaccgtaaaaccgacgccttccgtagacgcagatggaggcgcaggatggaacccctggagaaaacagggcccgccgccgtgtttgcgctggagggcgcactgggtggggtgatggatgataagtcagaagatagcatgagcgtgagtacgctcagtttcggcgtgaacaggccaacgattagctgcatatttgactacggaaatagataccatctgcgctgctatatgtatcaggcccgcgacctggccgctatggataaagacagcttttccgacccctacgcgatcgtgtcattccttcatcagtctcagaaaaccgtagttgtgaaaaatacccttaatcctacatgggaccagactttgatcttctacgagatcgagatattcggagagccagccactgtggccgagcagccaccttctattgttgtcgaactctacgaccacgatacttacggtgcggacgaatttatgggaagatgtatatgtcaaccttccctcgagaggatgcctcgcctagcctggtttcccctcacacggggaagccagccatctggtgagctgctagccagcttcgagctgattcaacgcgaaaaacccgcaatccatcacatcccgggtttcgaggtgcaggagacctcaagaatacttgacgagagtgaagataccgacctgccttatcctcctccgcagagggaggctaacatctacatggtcccccagaatatcaaaccggccctacaacgcactgcaattgagatcctcgcttggggtctacgcaacatgaagtcgtaccagctcgccaatatctccagccctagcctagttgtagagtgtgggggacagacagttcaaagttgtgtgatcagaaatttgcgcaagaatcccaatttcgatatatgtactctctttatggaagtgatgctacctagagaggaactgtactgtccgccaatcaccgtgaaggtaatagataatagacagttcggtcggaggccagtcgtgggtcaatgcactattagatccttagagtcttttctctgcgatccctactctgcagagtcaccttcgccgcaaggtggaccagatgacgtctcgctgttgtccccaggcgaagatgtgcttatagacatcgatgacaaagaacccttgatacctattcaggaggaggagtttatagactggtggagcaagttttttgcaagcatcggagagcgagagaagtgcggcagttatttggagaaggatttcgatactctcaaggtgtacgacacccagttggaaaatgtagaagcattcgaagggcttagcgacttttgcaacacctttaagctctatagaggcaagacccaagaggagaccgaagatccgtcagttatcggtgagtttaaaggactgttcaagatttatcccctgcccgaggacccggctatccccatgccacctcggcagtttcatcagttggcggctcaaggccctcaggagtgtctagtgagaatttatatcgtgagggctttcggactgcagcccaaggatcctaatggcaaatgtgacccttacatcaagatcagcattggaaaaaaatcagtgtctgatcaggacaactacattccatgcactctagaaccggttttcgggaagatgttcgagctgacttgtaccctccctttggagaaggatctgaaaattaccctgtatgactacgatctgctctcgaaagatgagaaaataggggaaaccgtcgtggatctcgaaaacaggttactcagtaagttcggagcccgctgcgggctccctcagacttactgcgtgagcggcccgaaccagtggcgtgatcagctcagacccagccaacttctccatcttttctgccagcaacacagagtgaaagcacctgtgtaccggacagatcgtgtgatgtttcaagacaaggagtactcaattgaggaaatcgaagccgggcgcatcccaaacccacacctgggacctgtcgaagagagattagctttgcatgtgctgcagcaacagggtctggtgcccgagcacgttgagagccgacccttgtacagtcctctccaaccagatatcgaacagggcaaattgcaaatgtgggttgacctctttccgaaggcgctgggtcgaccaggaccccctttcaacattacccccaggcgggcaagaaggttcttcctgcgctgcatcatttggaatacgcgcgacgtaatcttggacgacctgtcactcaccggagaaaaaatgtccgacatctacgtaaaagggtggatgattggttttgaagagcataagcagaagacagacgtacactaccgttcactgggtggggagggaaactttaattggaggtttatattccccttcgactatctcccggctgagcaggtttgtaccatcgcgaagaaagacgccttctggagactggacaaaacggaaagcaaaatccccgctcgcgtggtgttccaaatctgggataacgacaagttctcctttgatgacttcttgggcagtctccagctggatttaaatagaatgcccaagcctgctaaaacggctaaaaagtgcagtctcgatcagctcgacgacgcttttcaccctgaatggttcgtgtcgctcttcgagcagaaaactgttaaggggtggtggccttgcgtggcagaggagggcgagaaaaaaattcttgcgggcaagctggagatgacgctggagattgtcgcggaatcagagcacgaggagcgtcctgccgggcaaggccgtgatgagcccaatatgaacccgaagctggaggatccccgtagaccggacacgagctttctgtggtttacatccccatacaaaaccatgaaatttatactttggaggaggttccgctgggctatcatcctgttcattatactttttatcctgcttctgttcctcgccatctttatctacgcttttcctaactatgctgcgatgaagctggttaaaccattctct

SEQ ID NO: 10701 - DNA, 6243 bp, Artificial Sequence
  Description of Artificial Sequence: Synthetic coding sequence
atgctgtgctgtctcctcgtgcgcgcgtcgaatctgccgagcgcgaagaaagatcggaggtcggatccggtggcaagtctgaccttccggggggtcaaaaagcggactaaggtgatcaagaattcggtcaaccctgtgtggaacgaaggtttcgaatgggacctcaaggggattcccctggaccaaggatcggaattgcacgtcgtggtcaaagatcacgagacgatgggccggaatcggtttctgggagaagccaaggtcccgctgcgggaagtgctggccaccccttccctgagcgcctcttttaacgcccctctgcttgacaccaagaagcaaccgactggtgcctcgctggtgcttcaggtcagctacaccccattgcctggagcagtgccgctgttcccaccgccaactccgctggagccttcgcctactctgcccgacctggacgtggtcgcggacactggaggagaagaagataccgaagatcaaggcctgactggcgatgaagccgaaccgttccttgatcaatcgggcggaccgggagcacctaccactcctcggaagctcccgtcgcgcccgccgccgcactatccagggatcaagcgcaaaagatccgcgccaacctccagaaagctgctgtcggataaaccccaagacttccaaatccgcgttcaggtgattgaaggacgccagctgccaggtgttaacatcaaaccagtggtgaaagtgaccgcggccggacagaccaagcgcacccggatccataagggcaattcgcccctcttcaatgaaactcttttcttcaatttgttcgactcgccgggagagctcttcgacgagcccatctttatcactgtggtggactcgcgttccctgcgcaccgatgctctgctcggagagttccgcatggacgtgggcaccatctaccgtgagccccgccacgcatacctccggaaatggctcctcttgtccgacccagatgacttctccgctggcgctcgaggatacctgaaaacttccttgtgcgtgctgggacccggagacgaagcaccactcgagcggaaggacccttcagaagataaggaggatatcgagtccaacctgttgcggcccactggcgtggcgctccgcggggcgcatttctgtctgaaagtgttccgggctgaggatttgccccagatggatgatgccgtgatggataacgtgaagcagattttcggattcgagtcgaataagaaaaaccttgttgatccgttcgtggaagtctcgttcgccgggaaaatgctgtgctcaaagatcttggaaaagactgccaatccccagtggaaccaaaacataactttgccggcgatgtttccctccatgtgtgagaagatgcgcatcagaatcatcgactgggacaggcttacccacaacgacatcgtcgccaccacctatctgagcatgagcaaaatctcagctccgggcggagagatcgaggaagagcccgcgggggcggtgaaaccgtcgaaggcttccgacctcgacgattacctcggcttcctgccgactttcggaccatgttacattaacctgtacgggtccccacgggaattcactggattcccggatccgtacactgaactcaacactggaaagggtgagggagttgcttaccgagggcgccttctgttgtcgttggagacgaagctcgtggaacactccgaacaaaaggtcgaggacctccctgctgatgatattctccgggtggaaaagtacctcaggcgccggaagtatagccttttcgccgcgttctactcagcaactatgctgcaggatgtggatgacgcgatccagttcgaagtctccatcggaaattacggcaataagttcgatatgacttgccttccgctggcttccaccacgcagtacagccgcgcagtgttcgatggctgccattactactaccttccctggggaaatgtgaagcccgtggtcgtcctttcgtcgtactgggaggacatttcccaccgcatcgaaactcagaatcaactgctcgggatcgccgaccgcctggaagccggcctggagcaggtccatctcgccctcaaagcccaatgtagcactgaagatgtcgattcgctggtggcccagctgactgacgagcttatcgccggttgcagccagccgctcggagatatccacgaaactccctcggcgacccacttggaccagtacctgtaccaactgcgcactcatcacctgtcgcagatcaccgaggcagccctggccctcaaactgggccattccgaacttccagcggctcttgaacaagccgaggactggctgcttcgcctgcgggcgcttgccgaagaaccacagaacagcctgccggacatagtgatctggatgctgcagggagacaagcgggtggcgtaccagcgggtccccgcccaccaagtgctgttttcgagacgcggcgcaaactactgcggaaagaattgcggcaagttgcaaaccattttcctgaaatacccgatggaaaaggtcccaggagcacggatgccggtgcagatccgggtcaagctgtggtttggcctgtcggtggacgagaaggaattcaaccagtttgccgaggggaagctctcagtgttcgccgaaacctacgaaaatgagactaagctggcgctcgttggtaactggggtaccactggccttacgtacccaaagttctcagatgtgactggaaagatcaagctcccgaaagactcctttcgcccttcggcaggatggacttgggccggagactggttcgtgtgcccggaaaagactcttctccacgacatggacgctggtcacctgtccttcgtcgaagaagtgttcgaaaaccagaccaggctgccaggaggccagtggatctacatgagcgacaattacactgacgtcaacggagaaaaagtgcttcctaaagacgatatcgagtgtccgctgggatggaagtgggaggacgaggagtggagcactgacctcaacagggccgtggacgaacagggttgggaatactccattacgatcccaccagagcgcaaacccaagcattgggtccccgcagaaaagatgtactacactcatcggcgccggagatgggtgcgtctccgccgcagggatctgagccaaatggaggccctgaagcgccacagacaggcagaagctgagggcgagggatgggagtatgcgtcactgttcgggtggaagttccatctggaatatagaaaaactgatgcgttccggcggcgccggtggcgccggagaatggaaccactggaaaaaaccggaccggcagccgtgttcgcgctggagggagctctcggaggggtgatggatgacaagtccgaggactccatgtcagtctcaaccctcagcttcggtgtgaaccgcccaactatttcttgtatcttcgattacggcaacagataccatctgaggtgctacatgtaccaggcccgcgacctcgccgctatggacaaggattcattctcggatccttacgcgatcgtgtcgttcttgcatcagagccaaaagaccgtggtggtgaagaatactctgaacccaacctgggatcaaactctgatcttctacgaaatcgagatcttcggggagccggcgaccgtggccgagcagccacctagcatcgtcgtggagctgtacgaccacgacacctacggagccgatgagtttatgggccgctgcatctgccagccaagcctggaaagaatgccgaggctcgcgtggttcccactgactagaggaagccagccatcgggggagctcctcgcgtcgttcgagttgatccagagggagaagccggcgatccatcacatcccgggcttcgaagtgcaggagacttcgcgcatcctggatgaatccgaagatactgatcttccataccccccgccccaacgggaagccaacatctacatggtgccgcaaaacatcaaaccggctctccagcgaactgccatcgagatcctcgcgtgggggctgcgcaatatgaagtcataccagctggctaacatctcgtccccgtccctggtggtggagtgcggcgggcaaactgtgcaatcgtgcgtgatccgcaatctgcggaagaacccgaattttgatatatgcacgcttttcatggaggtcatgctgccacgcgaagaactctactgcccgcccatcactgtgaaagtgatcgacaaccgccagttcgggagacgcccggtcgtgggacaatgcaccatccgcagcctcgaatctttcctgtgtgacccgtacagcgcagagagcccatcgccacagggaggaccggacgacgtgtcgcttctgagcccaggcgaagatgtgctcattgacattgatgataaggagcccctgatcccgatccaagaagaggagttcattgactggtggtcaaagttttttgcgtccattggagagcgggagaagtgtggatcatacctcgaaaaagacttcgacactctcaaggtgtacgatacccagctcgaaaatgtggaggcttttgaaggactcagcgatttctgcaacacttttaagttgtatagaggaaagacgcaagaagaaaccgaggacccatcggtcattggagaattcaaaggcctgtttaagatatacccgcttccggaggatcctgccatcccgatgccgccaagacagttccatcaactggccgcacaaggaccacaggagtgcctcgtccggatctacatcgtgcgcgccttcggcctccagccgaaggaccccaatggcaagtgcgatccgtacatcaagatctccataggcaagaagtccgttagcgaccaggataactacatcccgtgcacccttgaaccggtctttggaaagatgtttgagctgacctgcaccctgcctctggagaaggacttgaagattaccctgtatgactacgacctgctgagcaaggacgaaaagatcggagaaaccgtggtggacctggagaaccgcctgctttcaaagttcggcgccagatgtgggctcccacaaacttactgtgtgagcggacctaatcagtggagagatcaactgaggccgtcgcagttgctgcaccttttctgccagcagcatagagtgaaagcgcccgtctacagaactgaccgtgttatgtttcaagataaagaatatagtatcgaggaaattgaagccggacgaatcccgaatcctcatctggggccggtcgaagaaagactcgccctgcacgtgctgcagcagcaaggactcgtgccagaacatgtggagtcccgccctctgtactcgccactgcaaccggacatcgaacaaggcaaacttcaaatgtgggttgacctgttcccgaaggccctggggcgcccgggaccgccattcaacatcactccgagacgggcgcggcggttcttcttgagatgcattatctggaacacccgcgacgtcatcctggacgatctgtcgctgaccggagaaaagatgtccgatatctacgtgaagggttggatgatcggattcgaggagcataaacagaaaactgatgtccactataggtccttgggaggtgaggggaactttaactggcggttcatcttccccttcgactacctcccagcggagcaggtctgcactatcgccaagaaggacgccttttggagactggacaaaaccgaatcgaaaatcccggctcgggtggtctttcagatctgggataacgataagttctcctttgacgacttccttggatcactgcaactggacctcaatcggatgccaaaacctgctaagaccgccaagaagtgttcactcgaccagctggacgatgccttccatcccgagtggtttgtgagcctgttcgaacaaaaaaccgtgaagggatggtggccgtgcgtggccgaggagggcgagaagaagatcctggcaggcaagctggagatgaccctggaaatcgtggcagagtccgaacacgaagaacgcccggcagggcaaggacgcgatgagccgaacatgaacccgaagctggaagatccgcggcgaccagacacctcgttcctgtggttcacgtccccgtacaagactatgaaattcatcctgtggcggcgctttagatgggccatcatcctgttcatcattctgttcatcctgctcttgttcctggcgatctttatctacgcgttcccgaactacgccgcgatgaagctcgtaaaaccgttcagc

SEQ ID NO: 10702 - DNA, 6243 bp, Artificial Sequence
  Description of Artificial Sequence: Synthetic coding sequence
atgttgtgctgcctgctggtgagagcctcgaatcttccatcagccaagaaagatcggagatccgacccagtggcctcgttgacctttcgcggcgtgaagaagagaactaaggtcatcaagaatagcgtgaacccggtctggaacgaaggctttgagtgggacctcaaaggaatcccgctcgaccaaggatctgagttgcatgtggtggtgaaggaccacgaaactatgggacggaaccgcttcctgggagaagcgaaagtcccactccgcgaagtgcttgccactccctccctctcggcgtccttcaatgcgccattgttggacacgaagaagcagcctactggcgcgtcgctcgtgctccaagtgtcctatactccactgccgggagccgtgcccctttttccgccaccgactccactcgagccctcgccaaccttgcccgacctggacgtggtggcggataccggcggagaagaagacaccgaagaccagggtcttaccggcgatgaagcagaaccgttcctcgaccagagtggcggccctggggctcctaccaccccccgcaagctcccttcacgccctcctccgcattacccagggatcaaaagaaagagatcggctcccacctcccggaagctcctgtccgataaaccgcaggatttccagattcgcgtgcaggtcatcgagggaagacagctcccgggagtcaacatcaaaccagttgtgaaagtgaccgctgccgggcagactaagagaacgcggatccacaagggaaactccccgctcttcaacgagacgctgttcttcaacctcttcgacagcccgggggagctgttcgatgagccgatcttcatcactgtggtggattcacgctccctcagaaccgacgcactcctgggcgagtttagaatggacgttgggaccatctacagagagccccggcacgcatacctccggaagtggcttctgctgtcagatccggatgatttctcggccggagctcgcgggtacctcaagacttcgctgtgcgtactgggtccaggagatgaggcgccccttgagcgcaaggacccgtcagaagataaggaagatattgagtctaacctgcttagaccaacgggggtcgcactgcggggagcccatttctgcctgaaggtgttcagagcggaagatctgccgcagatggacgacgctgtgatggacaacgtgaaacagatttttggcttcgagtcaaataagaagaacctggtggacccattcgtggaggtttcgttcgctggaaagatgctttgtagcaagatcctggaaaagaccgctaacccacagtggaaccagaacatcaccctgccggccatgtttccatccatgtgcgagaaaatgcgcatccgcatcatcgactgggatcgcctcacgcacaatgacatcgtggctactacgtacctctcaatgtccaagatctcagcaccgggaggcgagatcgaagaggaaccggccggagccgtcaagccgagcaaggcctcggatctggatgactacctcgggttccttcctaccttcggaccgtgctacatcaacctctatggttcaccgagagaatttaccggcttcccggacccgtacaccgaactgaatactggaaagggagaaggcgttgcttacagagggcgactcctgctgagcctggaaaccaagctggtcgagcactccgaacagaaggtcgaggacctgccggcagatgacatcctgagagtggagaagtacctgaggaggcgcaagtactccctgtttgcggccttctactctgcgactatgcttcaagatgtcgatgatgccattcaattcgaagtgtcaatcggaaattacgggaataagttcgacatgacctgccttccgttggcaagcactactcagtactcgagggcggtcttcgatggatgccactactactacctgccgtggggcaacgtgaagcctgtggtggttctttcttcatactgggaagacatctcgcaccggatcgaaacccaaaaccagctcctcggaattgcggacaggctggaggctggactcgagcaggtgcaccttgccttgaaggcacaatgctcgactgaggacgtggactcactcgtggctcagctgaccgacgaactcatcgctggatgctcgcaacctctgggggacatccatgagactccctcggcgacccatctggaccagtacttgtatcaactccgcacccaccatctgtcgcagatcaccgaagcggcgctggcactcaagctggggcactcggaactgccagccgcattggaacaagccgaagactggctgctgcgactccgggccctcgcagaagaacctcagaattcgttgcctgacatagtgatctggatgctccagggtgataaacgcgtcgcgtaccagcgcgtgccggctcatcaggtgctgttctccagacgcggcgcgaactactgcggcaagaattgcggcaaacttcagactatctttcttaagtaccccatggaaaaagtgccgggtgcccggatgccggtgcagatccgggttaagctgtggttcggactgtcggtggacgaaaaagaattcaatcaatttgcagagggcaaacttagtgtgttcgccgagacttacgagaatgaaaccaaacttgcacttgtcggaaactgggggactacgggcctgacctacccgaaattctcggacgtgactggaaaaatcaagctgcctaaagacagcttccggccgtcagcgggatggacttgggcgggagactggtttgtatgcccggagaagaccctcctccacgacatggatgcaggccacctgtcgttcgtggaggaagtctttgaaaatcagactcggctccctggtggtcaatggatatacatgtcagacaactacaccgacgtcaatggagaaaaagtgctcccgaaggacgatatcgagtgtcctctcggatggaaatgggaagacgaagagtggagcaccgacctgaacagagcagtcgacgaacagggatgggaatacagcatcactatcccaccggaaagaaagccgaagcactgggtccctgctgaaaagatgtactacactcaccggcgccggagatgggtgcggttgcggcgtcgggatctgagccaaatggaggcactcaagcgccaccgccaagcagaggccgaaggcgagggatgggagtacgcaagcctttttggatggaagttccacctggagtacaggaagactgatgctttccgcagacggcggtggagacggcgtatggagccgctcgagaagactggtccggcggccgtgttcgcgctggagggtgctctgggtggagtgatggacgacaagtcagaggatagcatgtcagtgtccaccctcagcttcggggttaatagaccaaccatcagctgcatcttcgactacggcaaccgctaccatcttcggtgctacatgtaccaggctcgggacctcgctgctatggataaagactcattttccgatccgtacgcaatcgtgtccttcctgcaccagtcccagaagacggtggtcgtcaaaaacaccctgaatccgacctgggatcaaaccctcattttctacgagatcgaaatcttcggggagcccgccaccgtggccgaacagccgccgtcaatcgtggtggaactgtatgatcatgatacctacggagccgacgagttcatggggcgttgcatctgtcaaccatcgctggagcgcatgccgcggctggcctggttcccgctgacccgtggaagccagccttcgggtgagctccttgcctcgttcgagctcatccaaagagaaaaaccggccatccatcacatcccgggattcgaagtgcaagaaacttcgcggatacttgacgagtccgaagacacggacctgccctacccgccgccgcagcgcgaagcgaacatctacatggtgccgcaaaatatcaagcccgcgcttcagcgcaccgcaatcgagattctggcctggggcttgcgcaatatgaagtcatatcagctggccaacatctcttcgccatcactcgtagtggagtgcgggggacaaactgtgcagagctgtgtgatccgcaacctgagaaaaaacccaaattttgatatctgcactctctttatggaagtcatgcttcccagagaagaactctactgcccgccgatcaccgtcaaggtgatcgataataggcagttcgggcgccgccccgtggtcggacagtgtacgatcaggagcctggagtcctttctgtgcgacccttactcggccgaaagcccgtcacctcagggaggaccggacgatgtgtcgctgctgtcaccgggagaggatgtgctcatcgacatagacgataaggaacccctgatccccattcaggaagaagagttcatcgattggtggtccaaattcttcgcctccatcggagaacgggaaaaatgcggaagctacctggagaaggatttcgacaccctgaaggtgtacgatacccagctcgagaacgtggaggcttttgagggactctccgacttctgcaacactttcaagttgtacagaggcaagacgcaagaggaaactgaggatccgagcgtgattggagagttcaagggcctcttcaaaatctacccgctgcccgaagatccggcgatccctatgccccctcgccagttccaccaactcgccgctcagggaccgcaggaatgtcttgtgcgcatctacatcgtgagggcattcggtctgcagccgaaggacccgaacggaaagtgtgacccgtacatcaaaatttcaatcggaaagaagtcagtgtcagaccaggataactacatcccttgcactctcgaaccagtgtttggcaagatgttcgaactgacctgtaccctgccgctcgaaaaagacctgaagattactttgtacgattacgatttgctttctaaggacgagaagatcggggaaacggtcgtcgatttggaaaatagactcttgagcaaattcggcgctcgctgcggacttccacagacgtactgcgtgtcgggacctaaccagtggcgggaccaacttcgcccctcgcagctgcttcatctgttttgccaacagcacagggtcaaggcacctgtctacagaactgaccgcgtgatgttccaggacaaggaatactccatcgaagaaatcgaggcaggcagaattccaaatccgcacctgggacctgtcgaagaacggctcgctctccacgtgctccagcaacagggactcgtgcctgagcacgtggaatcaaggccgctctacagcccactgcagccggatatcgaacagggaaagctgcagatgtgggtggacctgtttccaaaggcgttgggacggcccggacctcccttcaacatcactccgcggcgcgccaggcgcttctttctccggtgcattatctggaatacccgcgacgtgatccttgacgacctgagcttgaccggcgagaaaatgtccgatatctacgtcaagggatggatgattgggttcgaggagcataagcaaaagactgacgtgcattacaggtccctgggaggagaaggtaacttcaattggagattcattttcccatttgattacctgccggccgagcaggtgtgcaccatcgctaaaaaagacgcgttttggcgtctggataagactgaatcgaagattcccgcgcgcgtcgtgttccagatctgggacaatgacaaattctcgttcgacgactttctgggatcgctgcagctggacctcaacagaatgccaaaaccagccaaaaccgctaagaagtgctcgttggaccagctcgacgacgccttccatcctgaatggtttgtttcgcttttcgagcagaagactgtgaagggatggtggccatgcgtggccgaggaaggtgagaaaaagatcctcgcaggcaagctggaaatgaccctggaaattgtggccgaaagcgaacatgaggaaagacccgccggtcagggtagagacgaaccaaacatgaaccctaaactggaggatccgaggcggcctgataccagcttcctgtggtttacctcaccttataagaccatgaagttcatcctgtggcgtaggttccgctgggcgatcatcttgtttatcatccttttcattctgctgctcttccttgcgatctttatctacgcattcccgaactacgcggcaatgaagctggtgaaaccgttctcc

SEQ ID NO: 10703 - DNA, 6243 bp, Artificial Sequence
  Description of Artificial Sequence: Synthetic coding sequence
atgctttgctgccttcttgtgagagcatccaaccttccatccgcgaagaaggatagacggtcagatcctgtcgcatccctcacttttcgtggagtgaagaaaagaaccaaagtgatcaagaactcggttaacccagtgtggaatgaggggttcgagtgggatcttaagggcattccgctggatcagggttcagagctgcatgttgtggttaaggatcacgagactatgggtcgaaaccgatttcttggtgaagcaaaggtgccacttcgggaagtgcttgcgaccccgtcgctgtccgctagcttcaacgcaccacttcttgacaccaagaagcaacctactggcgcaagccttgtcttgcaggtgtcctacactccactgcccggcgcagtcccactgttcccacctcccacccctcttgaaccttcccctacccttcctgatcttgacgtcgtggcagacactggtggtgaggaggatacggaagatcaagggctcaccggcgacgaagctgaaccttttcttgatcaatcggggggacccggtgcacctaccactcctaggaaactgccgtcacgtccaccgccacactacccaggtattaagcggaagcgatcagctccaacctccagaaagctgctctctgataagccacaggatttccagattcgggtgcaagtgatagaaggacgacaactcccaggagtgaatatcaagcctgtggtgaaagtgaccgcggcaggacagactaagcggaccagaattcataagggaaactcgccgctcttcaacgagactctgttctttaacctgtttgattcccccggagagctgttcgatgagcctattttcattactgtggtcgattcgcgatcccttagaaccgacgcccttcttggagagtttagaatggacgtcggtaccatctaccgggagcctcggcatgcctacctccgaaaatggctcctcctttccgatcccgatgacttcagcgcaggggcccggggctacctcaaaaccagcctgtgcgtcctgggtcctggtgacgaggcacccctggagcgcaaggacccctccgaagataaagaagatatcgaatcgaatctcctgcgcccgaccggagtggcccttcgcggagcccacttctgccttaaggtgtttagggcagaggatctgccacagatggatgacgcagtcatggataacgtgaagcagatttttggtttcgaaagcaacaagaaaaatctcgtggacccttttgtggaagtgtcctttgcaggtaagatgctgtgttctaaaatcctcgaaaagaccgccaacccacaatggaaccagaacattaccctccccgcgatgtttccaagcatgtgtgagaaaatgcggataagaatcatcgattgggataggctgacccacaatgatattgtcgcaaccacttacctctcgatgagcaagatttccgcccccggaggggaaatcgaagaagaaccagcaggggccgtgaagccatcgaaagcatccgatcttgacgactatctcggtttccttcccacctttggtccctgctacataaacctttacggatcgcctagagaatttaccggtttcccagatccttacaccgaattgaacactgggaaaggcgaaggtgtggcctaccggggacggttgctcttgtctctggaaaccaaacttgtggagcactcagaacaaaaggtggaggaccttccagcggatgatattctgagagtcgagaaatatcttagacgcagaaagtactccctttttgccgcgttttacagcgccaccatgctccaggatgtggacgatgcaattcaattcgaagtgtcgatcggcaactacggtaataagtttgatatgacttgtctgcctttggcatccaccacccaatacagcagggcggtctttgatggatgtcactattactacctgccttggggaaacgtgaagcccgtggtggtgctgagctcgtactgggaagatatctcgcatcggattgaaacccagaaccaactcctgggtatagcagatagactggaagcaggactggagcaagtgcacctcgcgctgaaagcgcaatgctccactgaggatgtcgattccctggtcgcgcagctgactgatgagcttattgccggatgttcgcagccgctgggggacattcatgagactccatcggccactcacttggaccagtacctctaccaacttcggactcatcatctttcccagataaccgaagcggcacttgcacttaagctcggacattctgaacttcctgctgcccttgagcaagctgaagattggttgctgagacttcgggcactcgcagaagagcctcagaattcgctgccagacatagtgatttggatgctgcagggagataagcgggttgcctaccaacgcgtgcctgcccatcaggttcttttttcccgtcgcggggcaaattactgcggtaagaattgtggtaagttgcaaacgatttttctgaagtaccccatggagaaggtgcctggtgccagaatgccagtgcagatacgtgtgaagctgtggttcggtctgtccgtggatgagaaagagtttaatcaatttgcagaaggaaagctgtccgtctttgcggaaacttacgaaaatgaaacgaaacttgccctggttggaaactggggaaccactggacttacctaccctaaattctcggacgttaccggaaagatcaaactgcctaaggattcatttagacccagcgcaggatggacgtgggcaggggattggttcgtgtgcccggaaaagactcttcttcacgatatggatgcaggccatctgagcttcgtggaagaggtctttgagaatcagactagactgccaggaggacaatggatctacatgagcgacaattacacggatgtgaacggggaaaaagtgctgcccaaggatgatattgaatgcccacttggatggaaatgggaagatgaggagtggtccaccgacctgaatcgtgccgtggatgaacagggatgggaatattccatcaccattccacctgagcggaagccaaagcattgggtgcctgctgaaaagatgtactacactcatagacgcaggagatgggtgagactgcggagaagagatctctcacagatggaggcgctcaagagacatagacaggcagaagccgagggcgaaggctgggaatacgcctcactgttcggttggaagtttcatttggaataccgcaagactgatgcatttcggaggagaagatggcgacgaagaatggaacctcttgaaaaaactggtcccgcagcagtctttgccctcgagggggcccttggtggtgtgatggacgataaatcggaggattcaatgtcggtgtccaccctttcattcggcgtcaatcgtcctaccatctcgtgcatttttgactacggcaaccgataccatctcagatgttacatgtaccaggcccgagatctggcggccatggataaagactcctttagcgacccttacgcaatcgtgtcctttctgcatcaatcccaaaagacggttgttgtgaagaacactcttaaccctacctgggatcaaacccttatcttctacgagatcgagatcttcggcgaacctgcaaccgtggcggaacaaccaccaagcattgtcgtggaactttacgatcatgacacgtacggtgccgatgagtttatgggaaggtgtatctgtcagccaagccttgaacgtatgcctcgcttggcttggtttcctttgacgaggggttcacaacctagcggggaacttttggcgagctttgaacttattcaacgggagaaacctgccattcaccatattcctggttttgaagtccaagagacttcgcgaattctggacgaatcggaggacaccgatctgccatatcctccaccacagcgtgaggcaaatatctacatggtgccccaaaacatcaagccagcactgcagagaacggctatcgaaatcctggcatggggattgagaaacatgaagtcataccaactcgcaaatatcagctcgccttcgctggtggtcgaatgtgggggtcaaaccgtgcagtcgtgcgtgattagaaatctgagaaagaacccaaacttcgatatttgtacccttttcatggaagtcatgctccctcgggaagagttgtactgccccccgattactgtcaaggtcattgacaacagacagttcggaagaaggccagtggtgggacaatgcactatcaggagccttgaatcatttctctgcgacccttactcggcagagagccctagcccccagggtggaccagatgatgtgagccttctttcacctggagaagatgtgcttattgatatagacgataaagaaccactcattccaatacaggaagaggagtttattgattggtggagcaagttttttgcctccattggcgaacgagaaaagtgtggaagctatcttgagaaggattttgataccttgaaggtctacgatacccagctcgaaaatgtcgaagcgtttgagggactgtcggatttttgcaacacgttcaaactctaccgcggtaagactcaagaggagacggaagatccatcggtgataggggaattcaaaggactgtttaagatctacccgctgccggaagatccagcaatccctatgccgcctcggcaatttcatcaacttgctgcacaagggcctcaagaatgcctggtccgtatttacatcgtgagagcatttggccttcaacctaaagaccccaatggcaagtgtgatccttacattaagatctcgattggtaagaagtcagttagcgatcaggacaactacattccatgtacgctggaaccggtctttgggaaaatgttcgaactgacctgcacgctgccacttgaaaaggatttgaagattacgctctacgactatgatctccttagtaaagatgaaaagattggcgaaaccgtcgtggacctggaaaaccggcttctttcgaaattcggagcaaggtgtggactcccgcaaacctactgcgtgagcgggccaaaccaatggcgggaccaacttaggccttcccagctgctgcaccttttctgtcagcagcatagagtgaaagcgcctgtgtacagaaccgatagagtcatgtttcaagataaggaatatagtattgaggagatcgaagctggtcgtatacctaatcctcatcttggcccagtggaagaacgtctggcccttcacgtgctgcagcagcaagggctggtgcctgagcacgtcgaatcaagacctctgtacagccctttgcagcctgacatagagcaaggtaaattgcaaatgtgggtggacctgtttcccaaagcgcttggacgcccgggaccaccttttaacattacccccagaagagcccggcgcttttttcttaggtgtatcatatggaacactcgtgatgtgattctcgacgacctgtcgctgaccggagagaagatgtcagacatttacgtgaagggatggatgataggattcgaagagcataagcaaaagaccgatgtgcactacaggagcctgggtggagaaggcaactttaactggcgtttcatctttccctttgattaccttccagccgaacaggtgtgtactattgctaagaaggacgcattctggagacttgacaagaccgaatcaaagattccagcaagggtggtgtttcagatctgggataatgacaagttctcgttcgatgactttcttggatcacttcaacttgaccttaatcgcatgcctaagcctgcaaaaactgcaaagaaatgttcgctggatcagctggacgacgcattccacccggagtggtttgtgtccctgtttgagcagaaaactgtgaaaggatggtggccttgcgtggccgaggagggagaaaagaaaattctcgcggggaaactcgaaatgaccctggaaattgtcgcagaatccgagcacgaagagaggccagcaggacagggaagagatgaacctaacatgaacccaaaacttgaggaccctagacgtccagatacttcctttctctggtttacgagcccatacaaaaccatgaagtttattctttggaggagattccgttgggccatcatcctctttatcattctgttcatattgctcctgttcctcgccatcttcatttatgccttcccaaattacgcagcgatgaaacttgtcaagccattctcg

SEQ ID NO: 10704 - DNA, 1167 bp, Artificial Sequence
  Description of Artificial Sequence: Synthetic coding sequence
atgggctaccctgaagtggaaagaagagagctcctccctgcagctgccccccgggaaagaggttcccagggatgtggatgtggtggtgcacctgcacgggcgggggaaggtaacagctgtctgctttttctgggattctttgggctttcccttgcactgcacctgctgactctttgttgttaccttgaactgcgcagcgagctccgcagagaaagaggggcagagtcgagactcggaggttcgggtacccctgggacctcgggaacgcttagcagtctcggaggacttgaccctgattcacctatcacctcccatttgggccaaccttcaccaaaacagcaacccctggaacccggagaagcagcactccattccgattcgcaggatggacatcaaatggccctccttaacttctttttcccagatgagaagccctactcagaagaagaatccagaagagtcagaagaaacaaacgctcgaagtcgaatgaaggggcagatgggccagtgaagaacaagaaaaagggtaagaaggcgggtccaccaggacctaacgggcctcccggcccaccgggtccacccgggccacaaggcccccctggaataccaggtatcccaggtatccctgggactactgtaatggggcccccaggacctcctgggccaccgggacctcaaggccctcccgggctccaaggtcctagcggagccgcagacaaggcaggtactcgagagaaccaaccagcagtcgtgcacctgcagggtcagggctccgctattcaggtgaagaacgacctttcgggtggagtcctgaacgactggtcgagaatcactatgaatccaaaggtctttaagctccacccccgtagcggggaactggaggtgcttgtcgatggaacttacttcatttactcgcaagtgtactacatcaacttcacggattttgcttcatacgaagtggtggtggatgaaaagcctttcctgcaatgcactcgttccattgaaactgggaaaactaactataacacctgttacaccgcgggggtgtgccttttgaaggcgcgccagaaaattgcagtgaagatggtgcatgcagatatcagcatcaatatgtcaaagcacaccacctttttcggcgccattaggcttggcgaagcacctgcatcc

SEQ ID NO: 10705 - DNA, 1167 bp, Artificial Sequence
  Description of Artificial Sequence: Synthetic coding sequence
atggggtatcctgaggtggagcgaagagagctcctccccgctgccgcaccccgggagagagggagccagggctgtggttgtggcggggcgccggcacgagccggggaaggtaacagctgcttgctgtttcttggttttttcggcctgagtctggcactgcatctgctaactttgtgttgctacctagagctgagatccgagctgcggagagaacggggagcagagagtaggctgggcggaagcggaactccggggacatctgggactctgagctcactagggggtctcgatccagactcgcccataaccagtcatctgggccaaccttcacccaagcagcagccactggagcctggcgaggccgccctccattccgatagccaagatgggcatcagatggccctgctgaacttctttttccccgacgagaagccttattctgaagaagaatcccggagggtacgacgaaacaaaagatctaaaagcaatgagggtgccgatggtcctgtgaagaacaagaagaaaggaaagaaagctggaccccctggccctaacggcccgcccggtccgcctggaccaccagggccacagggtcctccaggaattcccgggatacccggcatccccggaaccacggtgatggggccaccaggtccacccggccctcccgggccacagggtccaccaggcctccaggggcctagcggcgccgccgacaaggccgggacacgcgagaaccagccagctgtggtccatctgcaaggtcagggaagcgccatccaggtcaagaacgatctctccggcggcgtgctgaatgattggtctcgcattactatgaaccccaaggtatttaagttgcaccctcggtctggcgaactggaggttttagtggacggcacctactttatctacagccaggtatattacatcaatttcacggattttgcttcttacgaagtcgtagtcgacgagaaacctttcttgcagtgtacacgctcgattgagactggtaaaaccaactacaacacatgttacactgcgggcgtgtgtcttctgaaagctcgccagaagatcgctgtgaaaatggtccacgcagatattagcatcaatatgtcaaaacatacaacatttttcggagcaattagactgggcgaggcaccagcctcc

SEQ ID NO: 10706 - DNA, 1167 bp, Artificial Sequence
  Description of Artificial Sequence: Synthetic coding sequence
atgggctatcccgaagtggagcgccgcgagcttcttcctgccgccgcacccagagagcgaggctcacaggggtgtggctgcggcggcgcgcctgctagggctggagagggtaatagttgcctgctgttcctgggcttcttcgggcttagcttggctctgcatctgctgaccctttgctgctacctagaattgagaagtgaactgagacgtgagaggggcgccgaaagcagactcggaggctcagggactcccggtacaagcggaacactgtcaagtctgggaggcctcgatccagactcccctattacttcccacctaggacagccctcccccaaacagcaaccactcgagcctggggaagcggccttacattccgattctcaggacggccaccagatggcactcctgaacttctttttccctgatgaaaagccgtacagcgaggaggaatccagacgcgtccgccggaataagcggagcaagagcaatgagggcgccgacgggcctgtcaagaacaaaaagaagggcaagaaggctggccctccggggcctaacgggccgcctgggcctccagggccgccaggcccccagggcccccccggaatacccgggatcccaggcatcccaggtaccactgtaatggggccaccaggcccaccagggcctccaggaccacaggggccccctggcttacaaggcccttccggggcggccgataaggccggaacccgtgagaaccaacccgcagtagttcacctccaggggcaggggtctgcaatccaagtcaagaatgacctcagtggtggtgtcctgaacgattggtcgagaatcacaatgaaccccaaagtttttaaactgcacccgcgctcaggtgagctggaagtgcttgtggatggcacttacttcatttatagccaagtgtactatataaatttcaccgacttcgctagctacgaggtcgttgtggacgagaaaccatttctccagtgcacccgatcgatcgaaactggcaagaccaattataatacatgctataccgctggggtctgcctgctgaaagcgcgacaaaaaatagcagtgaagatggtgcacgcagatatctctatcaatatgagtaaacacacaactttcttcggagccattcgcctcggggaggcccctgcctca

SEQ ID NO: 10707 - DNA, 1167 bp, Artificial Sequence
  Description of Artificial Sequence: Synthetic coding sequence
atgggataccctgaagtggaacgccgcgaactcttgcctgcggccgccccgagagaacggggaagccaaggatgcggatgtggaggagcccccgcgcgcgctggtgaaggaaactcgtgcctgctgttcttgggattcttcggtctgtcgctggccctgcatttgctcaccctgtgttgctacctggaattgagatcagagctgcgccgcgagcgcggcgccgagtccagactggggggatccgggacgcctgggaccagcggaacgttgtcgtccctcggagggctggatccggattcccccatcacttctcacctcggtcagccctcgccgaagcaacagcccctggaaccgggagaagcagctttgcactcggattctcaagatggacaccagatggcgctcctgaacttcttctttccggatgaaaagccttattccgaagaagagagtcggcgcgtgagaagaaacaaacgcagcaagagcaacgaaggcgccgacggcccggttaagaataagaagaaaggcaagaaggccggtcctccaggaccaaacggacccccaggaccgcccggcccgccaggaccacaagggccgccgggtatccccggtatccctggaattcctggtactacggtgatgggcccgccggggccgcctggaccaccagggccgcagggaccgccgggcctccaaggaccgtccggcgccgcagataaggctggtactcgggagaatcagcctgcggtcgtccatctgcagggacagggaagcgcaatccaggtgaaaaacgacctttccggcggagtcctcaacgattggtcccggatcaccatgaacccaaaggtgttcaagctccatccacggagcggagaactggaagtccttgtggacggcacctactttatctactcccaagtttactacatcaatttcactgacttcgcttcatacgaagtcgtggtggacgaaaagccgtttctgcagtgtactcggtccatcgagactggaaagaccaactacaatacctgctacacggcgggagtgtgccttctgaaagctcggcagaagatcgccgtgaagatggttcacgcggacatctccatcaacatgtcgaagcacaccaccttctttggagcgatccggctgggggaggccccggccagc

SEQ ID NO: 10708 - DNA, 1167 bp, Artificial Sequence
  Description of Artificial Sequence: Synthetic coding sequence
atgggctaccccgaggttgagaggagagagctgcttcccgccgctgctccaagggagaggggtagccagggttgcggttgtggcggcgcacccgcacgcgccggtgagggaaatagctgtctcttgttcctgggatttttcggcctgtctttggccctccacctcttgactttgtgttgttacctggaactgaggagcgagctgcgccgcgaaaggggagcagaatcacgcctcggcggtagcggcacacccggaacatcaggcacgctgagttcactgggtggccttgacccagacagccccattacttcacatctgggccaaccatcccctaaacagcaacctctggagcccggagaagctgctctccattccgattcccaggatggacatcagatggctctccttaatttcttctttccagacgaaaagccttactccgaggaagaatcccgccgcgtgaggagaaacaaaaggagtaaaagtaatgagggtgccgatggaccagtgaagaacaagaaaaagggcaagaaagctggccctcctggcccgaacggaccccctggcccacccggacccccgggcccacagggtccaccaggtattcccggcattcccggcatccccggcactaccgtaatgggcccccctggcccacccggaccaccgggtccgcagggacctcccggtctccaaggaccctccggtgctgctgacaaagcgggtacgagggaaaaccaacccgctgtagtacacctgcagggacaaggtagcgccattcaagtaaagaatgacctctccggcggcgtactcaatgactggtcccgcatcactatgaaccccaaagtgtttaagcttcatccccgcagcggtgaactggaggtgctggtcgacggaacttatttcatctacagccaagtttactacatcaacttcacggacttcgcttcctacgaggttgtagtggatgagaaaccctttctgcagtgtacaagatctatcgaaacaggaaagaccaattacaatacctgttataccgccggcgtgtgcttgcttaaggccaggcaaaagatcgctgtgaagatggtgcacgccgacatctctatcaacatgtctaagcataccaccttctttggagctatcaggcttggtgaagcgccagcgagc

SEQ ID NO: 10709 - DNA, 1167 bp, Artificial Sequence
  Description of Artificial Sequence: Synthetic coding sequence
atgggatatcctgaagtggaacggcgggaattactaccagctgcggcaccccgcgagcggggcagtcagggttgtggatgcggcggcgcacctgctagagcaggcgagggcaactcctgcctgctgttcctggggttcttcgggttgtcacttgccctgcacctcctaaccctttgctgctacttggaactgcggagcgagctacgccgggagcgaggggcagagagtcgccttgggggttctggaacacccggcacatccggcaccctatcatcactgggagggctcgaccctgatagccccataacgagccatttgggacagcccagccctaagcagcagccactcgaacctggggaggcagctctccacagtgacagtcaagacgggcaccagatggctttgctgaattttttttttcctgatgaaaagccctactcggaggaggaaagtcggagagttcgacgcaacaaaaggtcaaaatcaaatgagggcgccgatggacctgttaagaataagaagaagggaaagaaggcaggccctcccggacccaatgggcctcctgggcctcctggcccaccaggcccacagggcccaccaggtatcccaggtatccccgggattccaggaaccaccgtgatgggacctcctggccctccaggaccacccggtccccagggcccccctgggctccaaggcccatctggggcagctgataaggccggaacacgagagaatcagccagccgtggtacatctgcaggggcaagggtccgccatccaggtcaagaacgacttgagtggaggagtcctaaacgactggtctcgaataaccatgaatcccaaggtgtttaagctccatccccgaagcggtgagcttgaggtacttgtcgacggcacctattttatctattcacaggtgtattatatcaatttcacagatttcgcttcatatgaggtggtggtggacgagaagccgtttcttcagtgcactcggagcatagagacaggcaaaacaaattataatacttgttacacggccggcgtctgtctcctgaaggcaagacagaagatcgccgtgaaaatggtccatgctgacatatcaatcaacatgtccaaacatactacgtttttcggcgcgattagacttggcgaagcacccgcatct

SEQ ID NO: 10710 - DNA, 1167 bp, Artificial Sequence
  Description of Artificial Sequence: Synthetic coding sequence
atggggtatcctgaggttgaaaggcgagagctgctgcccgccgctgctccgagagagcgcgggtctcaagggtgcgggtgcgggggagccccagcccgggccggggagggcaacagctgtctgttgttcctcggctttttcggattgtctctggccctgcacctgctaactctttgttgttatcttgaactgcggtcggaactgcggagagagcgcggagccgagagccgccttggcggctccggcactcccggtacttccggcaccttgagctccttgggtggtctggatcccgattcccccatcacatcacacctggggcagccctctcccaagcagcagccactggagccgggagaagcagctttgcacagcgactcccaggacggacaccagatggccttgcttaacttcttctttcccgacgagaagccgtattcagaggaagaatccaggcgcgttaggaggaacaagagaagcaaatccaacgaaggcgcggatggccccgttaaaaacaagaagaaggggaagaaggctggccctccgggacccaatgggccccctggcccgcctgggcctccaggaccgcaagggccacctgggattcctgggatccccggcattccggggacaacggtgatgggtccccctggtcctcctgggccccccgggccccagggcccccctgggctgcagggcccctccggcgcggcagataaagctggtacgcgcgagaaccagccagccgtggtgcacctccagggtcagggttctgccatccaagtgaaaaatgacctgtcaggcggcgtgctgaacgactggtctcggatcaccatgaatcctaaagtgtttaaactgcacccaagaagcggggagctcgaggtgctggtcgacggcacatacttcatctacagccaggtgtactacattaactttaccgacttcgcgtcctatgaagttgtggtggacgaaaagccgttcctgcagtgtacgaggtccatcgagaccgggaagactaattataatacctgctataccgccggcgtgtgcctattgaaagcccggcagaaaatcgctgtgaagatggttcacgcagacatctccattaacatgtccaagcatactaccttctttggcgccataagactgggagaggccccagcaagc

SEQ ID NO: 10711 - DNA, 1167 bp, Artificial Sequence
  Description of Artificial Sequence: Synthetic coding sequence
atggggtaccccgaagttgagagacgggaacttctgcctgcagcggccccacgggagcgggggagccaggggtgcggctgtggaggcgccccggcacgcgccggcgagggtaactcgtgcctgctgttcctggggtttttcggcctctccctggcactgcacctgttgaccctgtgctgctacttggagcttcggtcagaattgcgacgcgagcgcggcgccgaatcgcggctgggaggatcgggaacccctgggacttccggaaccctgtcctccctgggaggactggatcctgattctccaatcaccagccacctgggtcaaccatccccgaaacagcagccgctcgaaccgggcgaagccgcgctgcacagcgactcgcaggacggccatcagatggcgctgctcaatttcttctttcccgatgaaaaaccatactcggaagaggaatcgcgcagagtccgccgcaacaagcggtcaaagtcgaacgagggggcagacggccccgtcaaaaacaagaaaaagggtaagaaggctggtccgccaggccccaacgggccaccgggaccccccgggcctcctggaccgcaaggcccaccggggatcccgggcatcccgggaatcccggggacgactgtcatggggcctccgggaccgcctggtccgcctggtccccaggggccaccagggttgcagggaccgtccggcgctgccgataaggccggaacgcgcgagaaccaaccggccgtggtgcacctgcagggacagggatccgctatccaggtgaagaatgacctgagcggaggtgtcctcaacgactggtcgaggatcaccatgaaccctaaggtgttcaagttgcatccgcggagcggcgagctcgaagtgctggtcgatgggacctatttcatctactcgcaagtgtactacatcaatttcaccgacttcgccagctacgaagtcgtggttgacgaaaaaccgtttctccagtgcacccggtcaatcgaaaccggaaagactaactacaacacctgttacactgccggagtgtgcctgctgaaggcccgccaaaagatcgcggtgaagatggtgcacgccgatatctcaatcaacatgtctaagcacaccacgttttttggagcgatccgacttggagaagcgccggcttcg

SEQ ID NO: 10712 - DNA, 1167 bp, Artificial Sequence
  Description of Artificial Sequence: Synthetic coding sequence
atgggctatcctgaggtggagcgccgggagttgctcccagcggccgcaccccgggaacgtggatcccagggatgcggctgtggcggcgcaccggcccgcgccggggaggggaacagctgtctgctgtttctgggctttttcggactgtcgctcgccctgcaccttctgacattgtgttgttacctcgagctaaggagcgaattgaggcgagagcggggggcggagagcagacttgggggcagtggaacacccgggacttccggaacactttctagtcttggaggtcttgatcctgattcacctatcacaagtcatcttggccaaccaagtcctaaacagcagccacttgagcccggcgaagcagcacttcattctgactcccaggatggacaccagatggcgctcctcaactttttcttcccagacgaaaagccctattcagaggaagaatctaggagggtgcggagaaataaaagaagtaaatccaatgagggagccgatggtccagtgaaaaacaagaagaagggaaagaaagctgggcctcccggacctaatgggccacccggcccacctggaccaccagggccacaaggtcctcctggcattccgggcatccccggcatacctggcacaaccgtcatgggcccccctggcccccccggacccccaggccctcagggaccacccggcttgcagggcccctctggagcagctgataaggcaggaacccgagaaaaccaacccgccgtggttcatcttcagggccagggctccgccatccaggtgaaaaatgacctgtccggaggcgtactgaatgattggagtcgtatcacaatgaatcctaaggtttttaagctccaccctcggagcggggagctcgaggtgttagtggacgggacctactttatctattctcaagtgtactatatcaatttcacggattttgcttcatacgaggttgtggtcgacgagaaaccatttttgcaatgcacacgcagcatcgaaacggggaagactaactacaacacttgttacacagctggcgtttgcctcctcaaagcacggcagaagatcgctgtgaagatggtacacgctgatatcagcatcaatatgtccaagcataccacatttttcggggccattcggctgggcgaggcccccgcgagc

SEQ ID NO: 10713 - DNA, 1167 bp, Artificial Sequence
  Description of Artificial Sequence: Synthetic coding sequence
atggggtaccctgaagttgaaagaagagaacttctgcctgcagcagcgccccgagagagaggaagccaaggttgtggctgtggcggggctcccgctcgcgcgggcgaaggaaattcttgtctgctgttcctgggctttttcggattgtcccttgcactgcatcttctcaccctgtgttgttacttggaattgcggtcggagctgcgcagagagcgaggtgcagagtcgaggttgggtggatccggaacccctggcacctccggtactctgtcctcactgggcggacttgacccagactcgccaattacttcccatttgggtcagccgagtccaaaacaacagccgctggaaccgggagaagcggcattgcactccgattcgcaggatggacatcaaatggcactcctgaatttcttttttcccgatgaaaagccatatagcgaggaggaatcgcgtcgcgtccggcggaataagcgttcaaaatcgaacgagggcgcagatgggcccgtgaaaaacaagaagaaagggaagaaggcaggtccccctggcccaaatggtcctccaggtccacctggtcccccgggtcctcaggggccgcccggaatccctgggatccctggcatacctggaactactgtcatgggacctcccggaccaccaggccctcccggtccacaggggcccccgggtctgcaagggccttcgggagcggccgataaggcgggcacccgcgagaaccagcccgcagtggtgcacctgcaaggacagggctccgccattcaagtgaagaatgacctttcaggaggggtgctgaacgattggtcccgaattaccatgaacccaaaggtgtttaaactgcatcctcggagcggagaactcgaggttctcgtggacggaacctatttcatttactcccaagtatactacatcaacttcactgactttgcatcttacgaagttgtggtggatgaaaaaccttttctccaatgcacgaggtcaatcgaaaccggtaagactaactacaacacgtgctacacggcaggtgtgtgcctcctgaaggccagacaaaagattgctgtcaagatggtccacgctgatattagcatcaatatgtctaaacatactaccttctttggggcaataaggttgggcgaggcccctgccagc

SEQ ID NO: 10714 - DNA, 1167 bp, Artificial Sequence
  Description of Artificial Sequence: Synthetic coding sequence
atgggctaccctgaggtggaacggcgcgagcttttgccagcagccgcaccaagagagagaggctcacaaggatgcggctgtggcggcgctcctgcaagagcgggtgaggggaatagctgtctgctttttcttggctttttcgggctcagtctggctctgcaccttcttaccctgtgctgctaccttgagctgaggagcgaactgcgccgagagcggggggccgagtcacgtctgggcgggtctggaactcctggcacgtcggggactctgagctcactgggaggactcgatccagactcacccatcacttcccacctggggcaaccttctccgaaacagcaaccactggaaccaggtgaggcagcacttcattccgatagccaagatggacatcaaatggcactgctcaatttcttcttcccggacgaaaaaccatactcggaagaggaatcgcggagagtgcgcaggaataaacgctccaagtcgaacgagggcgccgatggacctgtaaagaataagaaaaagggaaagaaagcaggcccaccaggccctaacggtcctcctgggcctccaggacctcctggccctcaggggccacccggtattcccggtatccctggtattcctggaaccaccgtgatgggtcctcctggaccaccaggtccaccaggaccgcagggccctcctggtttgcaggggccttcgggagctgcagacaaggcaggaacccgagagaatcaacccgcagtggtacatctgcaaggacaaggttcggcaattcaggtgaagaatgatctgtcgggaggtgtgcttaacgattggtcgagaattaccatgaaccccaaggtctttaaactccatccgcgatctggcgaacttgaggtgctggtggacggaacgtactttatctactcgcaggtgtactacataaacttcaccgactttgcatcctacgaagtggtcgtcgacgaaaagccatttcttcagtgtaccagatccatcgagacgggtaagactaactacaacacctgttatactgcaggggtctgcctgttgaaggcgaggcaaaagatcgcagtcaagatggtgcatgcagacatttccatcaacatgtcgaagcatacgacctttttcggagcaataaggctgggagaggctccagcgtca

SEQ ID NO: 10715 - DNA, 1167 bp, Artificial Sequence
  Description of Artificial Sequence: Synthetic coding sequence
atgggatatccagaagtcgaaaggagggaattgctcccagctgccgcacccagggagagaggcagtcagggatgcggatgcggaggggcaccggccagggctggtgagggcaactcttgtcttctgttccttggtttcttcgggctgtcactggctctgcacctgctgaccctctgctgctacttagaactcagaagcgaactgaggcgtgaacgcggagcggaaagtcggcttggcggcagcggaacacctggcacatccggtactctgagttcccttggcggactggacccagattctcccattactagccaccttggacagccttctcctaaacaacagccattagaacccggagaggctgcccttcactctgacagccaggatggccatcagatggcgttgctgaattttttttttcccgatgaaaaaccttacagcgaagaggaatcccgcagagttcggcgcaacaaacggtccaaatccaacgagggggcagacgggcctgtgaaaaacaaaaagaagggcaagaaggcgggaccgccaggcccaaacgggcctcctggaccacctggaccgccagggcctcagggaccacccggaatccctggaatcccaggaatcccaggaaccacggttatgggcccccctggcccccctggtccccccggcccacagggtcccccagggctgcaagggccgagcggagccgcagataaggccgggacacgagagaaccagcccgcagttgttcatctgcagggacagggaagcgctatccaagtgaaaaatgatctgagcggcggtgttcttaacgattggagccgcatcaccatgaatcctaaagtgttcaaactgcatccccggagtggtgagctggaggttctagtcgacggcacatattttatctatagtcaagtatactatattaactttaccgatttcgcttcctacgaagtagtagtcgatgagaaaccttttttgcagtgcacccggtctattgaaactggaaaaacaaattataacacctgctatactgccggtgtctgcttgctcaaagcaaggcagaagatagcagttaagatggtgcatgctgatatatccatcaacatgagtaaacacacaaccttttttggtgcaatcaggcttggagaagcccccgcttct

SEQ ID NO: 10716 - DNA, 1167 bp, Artificial Sequence
  Description of Artificial Sequence: Synthetic coding sequence
atgggataccccgaggtcgagcgccgggagctgctccctgccgcagccccgcgggaacgcggttcgcaaggttgtgggtgcggcggcgcgccggcacgcgccggagaaggaaactcgtgtctgctcttcttgggattcttcggcctctcgcttgcgctccatctgttgactctgtgttgctacttggagctccggagcgagctcagaagagagcgcggagctgaatcccggctgggaggctcaggaaccccaggaacttccgggactttgtcgagcttgggcggactggaccctgactcgccaatcacctcgcatctgggacagccgagcccaaaacagcaaccgctggagcctggagaggccgcgctccactcagactcgcaagatggacaccagatggccctgctgaacttcttctttccagacgagaagccgtactcggaggaggaatcgagaagagtccgccgcaacaagagatcaaagtcaaatgaaggcgcggatggcccagtgaagaataagaagaagggcaaaaaagccgggccgccgggcccgaatggtccaccgggcccacctgggccaccgggaccccagggtcccccaggaatcccgggaatccctggcatcccaggcacgactgtcatgggcccaccaggaccgccgggacccccgggaccgcaagggccgcccggcttgcaaggaccatcaggcgccgcagacaaggcggggacccgggaaaaccaaccagcagttgttcacctccagggacagggttccgccattcaagtcaagaacgacctgtcaggtggtgtgctgaacgactggtcgcgcataaccatgaacccgaaggtgttcaaactgcatccgcgctcgggagaattggaggtgctcgtggatggaacttactttatctatagccaggtgtactacatcaatttcacggacttcgcttcgtacgaggtggtcgtggacgagaagccttttctccagtgcactagatccatcgagactggcaagactaactacaatacctgttacactgctggggtgtgccttcttaaagcgcgccagaagatcgcggtgaaaatggtgcacgccgacatctcaatcaacatgtccaagcataccactttctttggagcaatccgactcggagaagcacctgcatcg

SEQ ID NO: 10717 - DNA, 1167 bp, Artificial Sequence
  Description of Artificial Sequence: Synthetic coding sequence
atgggttatcctgaggttgagagaagggagctcttgccagccgctgcaccaagagagagaggctcgcaggggtgcggctgcggtggcgcccctgcccgcgccggggaaggaaactcgtgcctgctgtttctgggtttctttggcctgtcattagccctgcacctcctaacactgtgttgctatctagaattgaggtcagagctgcggcgcgagcggggagctgagtcccgtctcgggggatccggcacccccggcacatccggaactctctcttctctcggcggtctggatcccgactcccctatcacaagtcacctggggcagccctctccaaaacagcaaccactcgagcccggcgaggctgctctgcattccgactcacaggatggacaccaaatggctctgctgaattttttttttcctgacgagaagccatattcagaggaggagtcccggagagtgcgtcgcaataagcgtagtaaaagtaacgagggagcagatggcccagtgaagaacaaaaaaaaggggaaaaaggctggtcctccgggtccaaatgggcctccgggcccccctggcccacccggtccccaaggcccccctggcatccctggaattcctgggattccggggactaccgtcatgggtccaccaggcccgcccgggcccccgggaccccagggccccccgggcctgcagggccccagtggggctgcagacaaagccggcacgcgcgagaatcagcctgccgtggtgcatctgcagggtcagggctccgcaattcaggtaaaaaacgacctctccggtggggttctcaacgattggtctcggattactatgaatccaaaagtcttcaaattacatccaagatctggggagttagaagtgctcgtcgatggtacctatttcatatactctcaggtgtattatatcaatttcacagattttgcttcttacgaagtggtggtggatgaaaagccttttctgcaatgtacccggtcaatcgagacgggaaagactaactacaacacatgttatacagccggcgtctgtctactaaaggccagacagaagatagctgtgaaaatggtacacgctgacataagtattaatatgtctaagcacactacctttttcggggccatcagactgggggaagcacccgcctcc

SEQ ID NO: 10718 - DNA, 1167 bp, Artificial Sequence
  Description of Artificial Sequence: Synthetic coding sequence
atgggctaccctgaagttgaaaggcgggagctgctccctgccgcggcgcctagggagcgcgggagccagggatgtggctgcggcggcgcccctgccagagccggcgaggggaacagttgcctgctatttctcgggtttttcgggctcagtcttgccttgcacctccttacactttgctgctatctggagctgcggagtgaactgcggagggaaagaggggccgaatcccgcctgggcgggtctggcacaccggggaccagcgggaccctttcctctctcggcggtctggatcccgattctcccattacaagtcaccttgggcaaccgtctccaaagcaacaacctctggagccgggcgaagctgctctgcactccgattctcaggacggtcatcagatggcactattgaatttctttttccccgacgagaaaccttatagcgaagaggagagcaggcgagttcgtcgcaataagaggtccaaatccaatgagggagctgacggacccgtcaagaacaagaaaaaagggaaaaaggcaggtccccccgggcccaacggcccgcccggccctcctggtccccccggccctcaaggccctcccggaattcctgggatacccggaattccgggaacaaccgtcatgggcccccctgggcccccagggcctcctggccctcaaggcccacccggcctccagggacccagcggcgcagctgacaaagccggcacccgggagaatcaaccggctgttgtgcatctgcagggccaaggcagcgctatccaagtaaagaatgatctttccggcggcgtcctgaatgattggagtcggatcaccatgaatccaaaggtcttcaagctccatcctcggagcggggaactcgaagtgttggtcgatggaacttatttcatttacagtcaggtctactacataaattttacagattttgccagctacgaagtggtggtggacgaaaagcccttcctgcagtgcacccgcagtatagagaccgggaaaactaactacaacacatgctacacagctggggtttgcttgctgaaagcaaggcagaagatcgccgtcaaaatggtacacgccgacatttccattaacatgtcaaaacacacaacttttttcggggctatccggctgggtgaagctcctgcaagc

SEQ ID NO: 10719 - DNA, 1167 bp, Artificial Sequence
  Description of Artificial Sequence: Synthetic coding sequence
atgggatatccagaggttgaaagaagagaacttttgccggcggctgctccacgagagcggggttcgcaaggatgcggctgtggtggagcgccagcacgggctggggaaggaaattcttgtttgctgttccttggattctttggactctccttagccctacatctgttaaccctttgttgctacttggagctccgtagtgagttacgtagggagcgtggagctgagagccggcttggaggttccggaacaccaggaacttctggcacgctatcctccctgggaggtttagatccagattcacctattacatctcatcttggacaaccatcaccaaagcaacaaccgttggagccaggagaggctgcactgcactcggattcacaagatggtcaccagatggctcttctcaatttcttttttcccgacgaaaaaccatattccgaggaggaatctcggcgggtcagacgtaataaacgctcgaagtctaacgagggggccgatggtcctgtgaaaaataaaaagaagggcaagaaagctggacctccaggtccgaatggaccaccaggaccaccaggtccaccaggaccgcagggacctccgggaataccaggtattccaggaattccggggacaaccgttatgggacctccaggaccacctggtccacctggaccacaaggaccacccggcttgcaaggaccgtcgggtgctgctgacaaagcaggaacacgtgaaaaccagcctgccgtggtccatttacaagggcaaggttcagcaattcaagtcaaaaacgacctttcaggcggtgtcttaaatgattggtccaggattacaatgaatcctaaagtgttcaagttgcacccaagatctggtgaacttgaagttctcgtggacggaacgtattttatctattcacaagtctattatattaactttacagattttgcaagttatgaagttgtggtagacgaaaagccctttcttcaatgtacacgcagtattgagacaggaaaaactaattataacacatgttacacagctggggtctgtctacttaaagcacgacagaagattgctgttaagatggtacacgcagatatctctatcaacatgagtaagcacactacattcttcggcgctattcgtctcggagaagctccagcttct

SEQ ID NO: 10720 - DNA, 1167 bp, Artificial Sequence
  Description of Artificial Sequence: Synthetic coding sequence
atggggtacccggaagtcgaaagacgggaattgctcccggctgctgctccccgggagcgtggaagccaggggtgtggttgcggcggggctcccgctcgagctggggaaggaaactcctgtctgctgtttttaggcttttttggactcagcctggccctgcacctgctaaccctttgctgctatctggagctccggagcgagctgcgacgggagcggggagcggagagcaggctgggcggcagtggcacgcctggcacctcaggcacactctctagcctcggtggactcgaccctgactcacctatcactagccatcttggccagccttccccaaagcagcaacccctggagccaggagaagctgcgttacactccgacagccaagatggacatcagatggccttgctaaattttttcttccccgacgagaagccctactctgaggaggagtcccggcgcgtgaggcggaacaaaaggtcgaagtcaaatgaaggtgccgatgggcccgtcaaaaataagaagaaaggcaaaaaggctggtccccctggcccaaatggaccccctggaccacccgggccccctggcccccaagggcctccaggaattcctgggatccctgggataccagggacaaccgtgatgggccctcccggccctccagggcctccaggtcctcagggccctcccggattacagggaccctccggcgcagcggataaagccgggaccagggagaaccagccagccgtcgtccatctccaaggacagggctccgcaatacaggtgaagaacgatcttagtggcggggttctaaacgactggagcagaatcaccatgaaccctaaggtatttaagctccaccctaggagcggggagctggaggttcttgtggacggcacgtatttcatatattcacaggtctactacattaattttacagactttgccagttacgaagtggttgtggacgaaaaaccctttctccagtgcactcgaagtattgaaaccgggaaaacaaactataacacgtgctacacggccggcgtctgtctgctgaaagcccggcagaagatcgcagtcaaaatggtgcatgcggacatctcaatcaacatgtccaagcacacaactttctttggtgccataagactcggcgaggcaccggcatct

SEQ ID NO: 10721 - DNA, 1167 bp, Artificial Sequence
  Description of Artificial Sequence: Synthetic coding sequence
atgggatatccagaagtggaaagacgcgagcttcttccagccgcagcaccaagagaacgaggctcgcaaggttgtggatgcgggggagcacctgcccgtgcaggtgaaggaaattcgtgtctgttgtttctcgggttctttggactttcactcgcgctccacctcctgaccctgtgctgttacctcgaacttagatcagaactgagacgggagagaggtgcagagagtagactcggcgggtcgggtactcctggaacttcaggtaccctcagctccttgggtggtcttgaccccgactcgccaattacttcgcatttgggccaaccttcacccaagcaacaacctctggaaccaggagaggctgccctgcattcggattcccaagacgggcaccagatggcactcctgaactttttctttcctgacgaaaagccctactccgaagaggagtcccgtagagtgcgaagaaacaagagatcgaagtctaatgaaggtgcggacggacctgtgaagaataagaaaaaaggtaagaaggcaggtcctcccggcccaaacggtcctccaggccccccagggccccctggtccccagggcccacctgggatacctggtatacctggaatcccaggtaccaccgtgatgggccctccaggaccgccggggcctccaggtccacagggtccccctggattgcagggtccttccggagcagcagacaaagccggcaccagggaaaaccagccagcagtggtgcatcttcaaggtcagggctcggccattcaagtcaagaatgatctgtcgggtggagtgctcaacgattggagcagaattaccatgaaccctaaggtgttcaaactgcatcctcgctcgggtgagttggaagttcttgtggatgggacttacttcatctactcccaagtgtactacatcaactttactgactttgccagctacgaagtcgtggtggatgaaaagccttttctccaatgtacgcgttcgatagagactggtaagactaattacaatacttgttacaccgcaggagtgtgcctgctgaaggcacggcaaaagattgcagtgaagatggtgcatgcagatatatccattaacatgtccaagcacactacgtttttcggggcgattagacttggcgaagcgccagcatcc

SEQ ID NO: 10722 - DNA, 1167 bp, Artificial Sequence
  Description of Artificial Sequence: Synthetic coding sequence
atgggatatcctgaggttgagaggcgggagctactccctgcagccgcacccagggaaaggggaagccagggctgcgggtgcggtggcgcccccgcgcgcgctggggagggtaacagttgcctgctgttcctcgggttcttcgggctatcactggcactccatcttctcaccttgtgttgttacctcgaactgcgcagtgagctccgaagggagaggggcgctgaatctaggctgggagggagcggcacccctgggacttccgggacactgtcttcactaggtgggctcgacccagactccccaattaccagccatttgggtcagccgtcccccaaacagcagcccctcgagccaggagaagccgcgctgcattctgacagccaggacggccaccaaatggcccttctgaattttttcttccctgatgagaaaccgtactccgaggaagagtccagacgggtccgacgcaataaacggtctaagagcaacgagggcgcagacggccccgtaaagaataagaagaagggaaaaaaagcaggccctccagggccgaatggcccccctggtcccccaggccctccagggcctcaggggcctccaggcatccccggaattccaggaattcccggcaccacggtgatggggcctcctgggccacctgggccgccaggacctcaaggcccacccggcctgcagggtcctagtggggcagctgacaaagctggaacccgagaaaaccagccggcagttgtgcatctacagggacagggtagcgctattcaggtaaagaacgatctgagtggaggagttcttaacgattggtcccgaattaccatgaatcctaaggtgttcaaactacatccgcgctcaggcgaattagaagtgttggtggacggaacttacttcatatattcgcaggtctattatattaattttaccgatttcgccagttacgaagtggttgtggacgagaagccttttctccagtgtacaaggtcaatcgagaccggcaagaccaactacaatacttgctatacggctggggtgtgtctgttaaaagcccgtcagaagatcgctgtcaagatggtccatgcagacatatctatcaacatgtctaagcataccacttttttcggggccattcggctcggagaggctccggccagc

SEQ ID NO: 10723 - DNA, 1167 bp, Artificial Sequence
  Description of Artificial Sequence: Synthetic coding sequence
atggggtacccagaagtggagaggagggaactgttacccgccgcggccccgcgcgaaagaggctcacaaggttgcggttgtggaggggcgcccgcccgcgccggggagggcaattcatgtctcctctttctggggttctttgggttgtctttggcccttcatttactcacattatgctgttatctggaattgaggagcgagctgagaagagaaaggggagcagagagtagacttgggggctccggaacccctgggacttctggtacattgtcgtccctcggaggattagatcccgattcccctatcacatcccacctgggacagccttcccccaaacaacagcctctcgagccgggcgaagcagctctgcacagtgatagccaagatgggcatcagatggccctcttgaatttcttcttcccagacgaaaagccatatagcgaagaggaaagccggcgagtgagacgcaacaaacgcagcaaatctaatgagggcgcggacggacccgtcaagaacaaaaagaaagggaagaaggcggggcctcctggcccaaatggcccccctggtcctccgggtcccccagggcctcagggaccacccggcattccaggcattcccggaataccaggaactaccgttatgggacccccaggccctcctggacccccgggcccacaggggcctccaggcctccagggtccatcgggcgctgccgataaggcaggaaccagagagaatcagcccgccgtggtacacctgcaaggacaggggtcagctattcaagttaaaaacgacctcagtggtggtgtgctgaacgattggtcaagaattaccatgaatcccaaagtttttaaactgcacccccggtccggtgagcttgaggtgctggtggatgggacctacttcatctacagccaggtgtactatataaacttcacagactttgcctcatatgaggttgtggtggatgagaagcctttcttgcaatgtacacggtcaatcgagactggtaagactaattataacacttgctataccgccggggtgtgcctcttaaaagcgaggcagaagattgccgtgaagatggttcacgccgatatctcgatcaacatgtcgaagcacactactttttttggggcaataaggttaggagaagctcccgcttcc

SEQ ID NO: 10724 - DNA, 1167 bp, Artificial Sequence
  Description of Artificial Sequence: Synthetic coding sequence
atgggatatcccgaggttgagcggagagaactgctccctgctgccgcaccccgggagcggggatcccaaggctgcggatgcggcggggcaccggcacgagcaggcgaagggaactcctgtctcttatttctggggttcttcgggctttcgttggccctgcatctgttgacgctatgctgttaccttgagctgagatccgaactgagacgggaacggggtgccgaaagcaggctgggcggctccgggacaccaggcacgtctggcactctttcaagtttgggcggcctggaccctgattcacccataacaagccatttaggccagccttctcccaaacagcaaccacttgagccaggcgaggcggctctccacagcgatagtcaggacgggcaccagatggccctcctaaacttcttctttccggacgaaaaaccgtactccgaggaagaatcacgaagggtgaggaggaacaagcggagtaagtcaaatgagggtgccgacggcccggttaaaaacaagaaaaaaggtaagaaagccggtcccccaggccctaacggacctccagggccccctggacctccgggccctcagggcccgccagggatacccgggatccctgggattcctggcacaactgttatgggtcctcccggtccccccggtccgcctggaccgcagggaccccccggcctacaaggcccctcgggcgcagccgacaaggctggaaccagagagaatcagcccgccgtcgtgcacttgcagggacagggatctgcgattcaagtgaaaaatgacctaagcgggggagttctcaatgactggtcacgcatcacaatgaatcccaaagtgtttaagttgcatcctaggtccggcgaactcgaggtgctggtggatgggacatattttatatactctcaggtgtactacattaacttcactgactttgcatcatacgaggtggtcgtagatgaaaagccctttttgcagtgcacccggtcgattgaaactggtaagacaaattataacacctgttacactgctggcgtgtgcttactgaaagctagacagaaaatcgccgttaagatggtgcacgctgatatctcgatcaatatgagcaaacataccaccttttttggggcaatccgactgggcgaggcacccgcatcc

SEQ ID NO: 10725 - DNA, 1167 bp, Artificial Sequence
  Description of Artificial Sequence: Synthetic coding sequence
atgggttaccctgaagtcgaacgcagggagctcctgcctgctgccgccccgagagagagaggctcccagggatgcggctgcggcggagcccctgcccgcgccggagaaggcaacagctgtctgctgtttctggggttctttgggctgtcgctggcgctgcatctgttgaccctgtgctgttacctcgagctcaggagcgaactgcggcgggagcgcggagccgaatcgagattgggcggctcgggcactccagggaccagcggaaccctgagttcgctggggggtctggacccggactcaccgatcacctcgcacttgggacagccgtcccccaagcaacaaccactggagccaggggaagccgcacttcattcggactctcaggatggacatcagatggctcttctcaatttcttcttcccagatgaaaagccgtacagcgaagaagaaagcagacgggtgcggagaaacaagcggtccaagtcaaacgagggagctgacggacccgtcaagaataagaagaagggaaagaaggcgggaccacccggaccgaacggccctcctggaccacctggaccgccgggaccacagggcccaccggggatcccaggaatccctgggatcccgggtaccactgtgatgggaccccccgggccacctggcccgcctggacctcagggcccgccggggctccagggaccgtcgggagccgcggacaaggctggcacgcgcgaaaaccagcccgccgtggtccacctccaaggacagggatcagccatccaggtgaagaacgacctgagcggcggagtgctcaacgattggtcccgcataaccatgaacccaaaggtgtttaaactgcatcctcgctctggcgagttggaagtgctcgtcgatggaacttacttcatctactcgcaggtgtattacattaacttcaccgactttgcgtcgtacgaagttgtggtcgatgaaaagccatttcttcaatgcacccggtcgatcgaaaccggaaagacgaactacaatacctgctacactgccggagtttgcctgcttaaagcaagacagaagatcgccgtcaaaatggtgcatgccgacatcagcatcaacatgagcaagcatactaccttctttggagcgatccggctcggtgaagcccccgcctca

SEQ ID NO: 10726 - DNA, 1167 bp, Artificial Sequence
  Description of Artificial Sequence: Synthetic coding sequence
atgggataccccgaagtggagagaagggagctgctgccagctgccgccccccgggagagaggatcccagggatgcgggtgcggaggagctccagcaagggccggagagggaaactcttgtctcctgttcctcggattcttcggactctcactggcactgcacctgctgaccctgtgttgttacctggaactccggtccgagctgaggcgggagaggggagctgagtccagactgggtggctccgggacgccgggaaccagtggcaccctttcttcactgggcggtttagatcctgactctccaattactagtcacctcggccaaccgagtccgaagcaacagcctctggagcctggggaagctgccctccactctgacagccaggatggccaccaaatggccctgctcaacttcttcttcccagacgagaagccttatagtgaggaggaaagtagacgggtgagacgaaataagcggagtaaatccaatgagggggctgatggtccagtgaagaacaagaagaagggcaagaaggccggtccaccgggcccaaatggtccacctggcccccccgggcctccaggccctcagggacctccagggattcccggaatcccgggaatccccggtacaacagtgatggggcctcctggccccccaggaccacctggacctcaggggccacccggattgcagggtccaagcggcgccgcagacaaggccggcacacgggaaaaccagccggcggtcgttcacttgcagggccagggtagtgccatccaagtgaagaacgacctctctggtggcgtgttaaatgattggagtcgcattactatgaatcccaaagtcttcaagctgcatccccggtcaggagagctggaggtgctggtcgacgggacatattttatatacagtcaggtgtactatatcaattttacagattttgccagctatgaggtggtggttgatgagaagcctttcctgcagtgcacgaggagcatcgaaacgggcaagactaactataatacttgctacacagcgggagtgtgccttctgaaggcgcggcaaaagattgccgtcaagatggtgcacgccgacatcagtatcaacatgagtaaacacactacctttttcggagccataagactcggggaggccccagcttct

SEQ ID NO: 10727 - DNA, 1167 bp, Artificial Sequence
  Description of Artificial Sequence: Synthetic coding sequence
atgggctaccctgaggtcgagcggcgggaacttctcccagcggccgccccacgcgaacgcggctcccaaggctgcggctgcggcggcgccccagcacgcgccggcgagggtaattcgtgcctgctttttctgggattctttggactgtccctggcgctgcatctgctcaccctgtgttgttacctcgaactgagatcggagctcagacgagagcggggcgctgaaagcagattgggcggatcgggaaccccggggacttcggggactctgtcctcactcggaggacttgacccagattcacccatcaccagccatcttgggcagcctagccctaagcaacagccgttggagcccggggaggccgctctgcattcggattctcaagacggacaccagatggctctgctgaacttcttctttcccgatgaaaagccgtactcggaagaggaatccaggcgagtgcggcgcaacaaacgctccaagtccaacgaaggagccgacggacctgtcaagaataagaagaagggaaagaaggcaggaccgcctggtccaaacggtcctcctggtccacctggacccccgggaccccagggtccgccaggaataccggggattccgggaattcctggtaccaccgtgatgggaccaccaggaccgccgggtccaccaggaccacaaggcccgccgggactccaggggccatccggggcagccgataaagccggcacccgcgagaatcagccggcagtggtgcacctccaaggtcagggttccgcaattcaggtcaagaacgatctttcgggaggggtgctcaacgattggtcccgcatcaccatgaacccgaaggtgttcaaactccacccaagaagcggagaactcgaagtcctcgtggacggtacttacttcatctactcacaagtctactacatcaatttcaccgatttcgcgtcatacgaagtcgtcgtggacgaaaagccattcctgcagtgtactcggagcatcgaaaccggaaagaccaactataacacttgttacaccgcaggagtgtgcctgttgaaagcgaggcagaaaatcgcagtgaaaatggtgcacgcagacatctccatcaatatgagcaagcacaccacttttttcggagcaatccggctgggagaggcaccggcctcg

SEQ ID NO: 10728 - DNA, 1167 bp, Artificial Sequence
  Description of Artificial Sequence: Synthetic coding sequence
atgggttacccggaagtggagagacgggaacttctgcctgccgccgctccccgcgagaggggatcccaaggctgcggctgtggtggagccccggcccgggcaggagaaggcaactcctgcctgctgttccttggcttcttcggactctcgctggctctgcacctgcttaccttgtgttgttacctggaactgagatccgagctgagacgcgaacggggcgccgaatccagactgggcggatccggaaccccgggcacctcgggaactttgtccagcctcggaggtctggaccccgattccccgatcacctcgcacctcggacagccctctccgaagcagcaaccactggaaccgggcgaggccgcactgcactccgattcgcaagacgggcaccaaatggctctgttgaatttctttttccccgacgaaaagccatactcggaagaggagtcgagaagagtgcgccgcaacaaacgctcgaagtctaatgaaggggcagacggaccggtcaagaacaagaagaaagggaagaaggctggacccccaggccctaacggacctcctggcccgccaggtcctccaggcccccaaggcccgccgggaatccctggcatccccggcattccgggtactaccgtcatgggccccccaggtccgcctggaccgccgggacctcagggtccccccggacttcagggcccgtcaggtgcggcggacaaagccggtaccagagagaatcaaccagcagtcgtgcacctccaaggtcagggatccgcgattcaggtgaaaaacgacctcagcggaggggtgctgaacgattggtcacggatcaccatgaacccgaaggtgttcaaactgcatccacgcagcggagagctggaggtgctggtggacggaacctactttatctactctcaggtgtactacatcaactttaccgatttcgcgtcgtatgaggtggtggtggatgagaagcctttcctccaatgtactcggtcgatcgaaactggaaaaacgaactataacacttgctacaccgcgggagtatgcctgctgaaggcccggcagaagatagccgtcaaaatggtccatgcggacatctcgatcaacatgagcaagcatacgactttctttggtgcgatccgcctgggggaagcgcccgccagc

SEQ ID NO: 10729 - DNA, 1167 bp, Artificial Sequence
  Description of Artificial Sequence: Synthetic coding sequence
atggggtaccccgaggtcgagaggagggaattgttacctgctgcagctccaagagaacgtggtagccaaggatgtgggtgcggaggggccccagcaagagcaggagagggtaattcctgcctactttttcttggattttttggtctcagtttggctcttcatcttttgactctttgttgttatctagagcttcgaagcgagttgcgtagagaacgtggagcagagtcaaggctaggggggtccggtacccctgggacatctggtaccctcagttccttaggtggtttggatcccgatagtccaataacatctcatctaggacaaccttcgcctaaacaacagccactcgaacccggtgaagccgcacttcattcagattcgcaggatggtcatcaaatggctttgctcaacttcttcttccctgacgaaaagccctactccgaggaagaaagtcgtagagtcaggagaaacaagcgatctaagtccaatgaaggagctgatggcccagtgaagaataagaaaaaggggaaaaaggcgggtccacccggtccaaacggtcctcccgggccgccaggaccaccagggccacagggaccccctgggattcctggaattccgggaattccgggaactacagtgatgggtccaccgggtccgccgggccctccaggccctcaaggccctcccggtctccaggggccaagtggagccgcggataaagccggtacccgggaaaaccaaccggctgttgtccatttgcagggccagggttccgctattcaagtgaagaacgatttgagcggaggcgtccttaatgattggagtcgtatcaccatgaacccaaaggtgtttaagctccacccacgttccggggaactcgaagtattggtagatgggacatactttatatacagccaagtctactacattaacttcactgatttcgcatcttacgaagtggtggttgatgaaaagccatttcttcagtgcacaagaagcattgaaactggcaagacaaactataatacctgctacactgcaggtgtgtgtttactcaaagcccgacagaaaattgctgttaagatggtgcatgctgatatcagcattaacatgtcaaagcatactaccttctttggagctattcgtctcggagaggccccagcctca

SEQ ID NO: 10730 - DNA, 1167 bp, Artificial Sequence
  Description of Artificial Sequence: Synthetic coding sequence
atggggtaccctgaagttgagcggcgcgaactgttacccgccgctgccccaagggagaggggatcacagggatgtggatgcggcggcgcaccagcgagagcaggcgaaggaaattcttgtctcctgtttttgggcttcttcgggctgagcctggcactgcatctgctcacactgtgctgctacttggagttaagaagcgagctgcgccgcgaacgcggtgccgaaagccgcctgggcggcagcggcacccctggcacctcaggaaccctgtctagtttgggaggcctcgatccagactcgcccatcacatctcacctcggtcaaccaagccctaagcagcagcccctcgaacctggcgaagccgctctacacagcgacagccaagatggtcaccagatggccctcctcaactttttttttccagacgaaaaaccttatagcgaggaggagagccgcagggtgagaaggaacaaaagatcaaagtcgaatgaaggtgctgatgggccagtgaaaaacaagaagaaaggaaagaaagccggaccacccgggccaaacggcccacctggcccccccggtccacctggcccacagggaccaccaggaatccctggaatccctggaattccagggaccactgtgatgggcccacccggcccgcctggccctccaggccctcaggggccaccgggactgcaaggtccaagcggtgccgccgataaagcaggaaccagagagaatcagccagcagtagtgcatctgcaaggccaagggtccgctatccaggtgaagaacgatctgtccggaggcgttctgaacgattggtctagaataaccatgaacccaaaagtgttcaaattacaccccaggagcggagagctggaagtgctggtcgatggtacgtactttatttactcccaggtctactacatcaacttcaccgattttgcatcctacgaggtggtcgtggatgagaaaccattcctgcagtgcacacgatctattgagaccggaaagaccaattacaacacttgctacacagccggcgtgtgtctcctcaaagctagacaaaaaatcgcagtgaagatggtccacgctgacatctccatcaatatgtcaaagcacacaaccttctttggcgctatccgtttaggtgaagcaccggcaagc

SEQ ID NO: 10731 - DNA, 1167 bp, Artificial Sequence
  Description of Artificial Sequence: Synthetic coding sequence
atgggataccccgaggtggagcgcagagaactgttgcctgctgctgccccaagggaaaggggatcacaaggatgcgggtgtggtggtgcccccgctcgagctggggagggtaactcttgtctgctgtttctgggatttttcggactgagtctggcccttcacctgctcacactgtgctgttacctcgagctgcgttccgagttgcgaagggaaagaggcgctgagtcaaggctggggggctcaggtacgcccggcacctctgggactctatcttctctagggggactggatcccgactcacctatcaccagccacctaggtcagccctcccccaaacagcagccccttgaaccaggtgaggccgcactgcattcggactctcaagacgggcaccaaatggccctgctgaattttttttttccggacgaaaaaccttactcagaagaggaatcgaggagagttcggaggaacaagcgttcgaagtccaatgagggagccgacggtcccgtcaaaaacaagaagaagggcaaaaaggctggccctccaggcccaaacggcccgccaggacctccaggacctcctggaccccaggggccccccggaatccccggaatccctggcatccctgggacaacggtgatggggcctcccgggcctcccggacctccgggcccacagggccccccgggcctgcaagggccaagtggagccgctgacaaggccggcacccgggagaatcagccggccgttgtgcatctgcagggacaggggtcagcaattcaggtgaagaacgatctgtctgggggcgttctgaacgattggtcccggataacgatgaaccccaaggtcttcaaattgcatccccggtcgggtgaacttgaggtcctggtggacgggacctattttatctacagtcaggtatactatattaacttcacagacttcgctagttatgaggtcgtcgtggatgaaaagcccttccttcaatgcacgcggagcattgaaactggcaaaaccaattataatacatgctacaccgccggcgtgtgcttactgaaggctagacagaagatcgctgtgaagatggttcatgcagatatcagcatcaacatgagtaagcataccacattctttggtgcaatacgcctcggcgaggcccccgctagc

SEQ ID NO: 10732 - DNA, 1167 bp, Artificial Sequence
  Description of Artificial Sequence: Synthetic coding sequence
atggggtacccagaggtcgaacggagggaactgcttcccgccgccgcaccccgagaacgggggtctcaggggtgtggatgtggaggggcccccgcgcgagcgggagaggggaattcttgtttactgttccttgggttctttgggctcagtcttgctctgcatctgctcacactctgttgctaccttgaactccgatctgaacttagacgcgagcgcggggccgaatctcggcttggagggtctggaacacctggaacatctgggacactgtctagtctcggagggctcgatcctgatagtccaataacatcccatcttgggcagccctcacctaaacagcagccactcgaaccaggggaggccgccctccattccgattcacaggatgggcaccagatggcattactcaactttttctttcctgacgaaaagccatattctgaagaagaatctcggcgcgtgcgaagaaataaaaggtctaaatctaacgagggagccgatgggcctgtgaaaaataaaaagaaagggaaaaaagccgggcctccagggccaaatggaccacctggaccccctggacccccaggaccccaggggcctcctgggatccctgggatccccgggatcccaggaactactgtaatgggacctcccgggcccccaggaccccctgggcctcagggaccaccagggctccaggggccctccggggccgccgataaagcaggaactcgagagaaccagcccgcagttgtacatctccaaggacagggatcagccatccaggtgaaaaacgatctctccgggggagtactcaacgattggagtcgcatcactatgaaccctaaagtttttaaactccatcctcgatctggagagctggaagtactggtggatggaacatatttcatatattcacaggtttattatataaattttacagattttgcttcttatgaagtagtggtcgacgaaaaaccatttctacagtgcacacgctctatcgagacagggaaaacaaactataatacatgctatacagcaggagtgtgtctcttgaaggctaggcagaagattgccgtcaaaatggttcatgctgatatcagtataaatatgagtaaacatactacattctttggggctatcagacttggggaagcacctgcatca

SEQ ID NO: 10733 - DNA, 1167 bp, Artificial Sequence
  Description of Artificial Sequence: Synthetic coding sequence
atgggctatcctgaagtcgaacgccgcgaactgctgcccgcagctgccccacgcgagcggggcagccagggttgtggatgtggaggtgctcccgcaagagccggtgaaggcaacagctgcctgctgttcctgggatttttcggactgagccttgcactgcatcttctcactctgtgttgttacctcgagctgagatccgagctgaggagagagcgtggcgcagagtcacgcctgggaggatcaggaactcctggtacttcaggaactctctcctcccttggaggcttggacccagactcgcctattacgtcccatttggggcaaccatccccgaagcagcaacctctcgaacctggtgaggcagcacttcactcagattcccaagatggacaccaaatggcactgctgaacttcttttttcctgacgagaagccctactcagaagaggagtcgaggcgcgtccgacgtaataagagatccaagtcgaatgagggagcagacgggcctgtcaaaaacaaaaagaagggtaagaaggcaggaccaccggggcccaacgggccaccaggtcctccaggtcctcctggccctcaaggacctccgggcatacccggtattcccggcattcccggtaccaccgtcatgggtcctcccggacctcccggtccacccggtcctcagggaccacctggacttcagggcccctccggtgcagcagataaggcaggaaccagggaaaatcaaccagcagtggtgcatctccagggtcagggttcggcaatccaagtcaagaacgatctgtccggaggagtgctgaacgattggtcaagaataactatgaatcccaaggtgtttaaacttcatcctcgctccggggagctcgaggtacttgtcgacggtacctactttatctactcacaggtgtactacatcaactttactgattttgccagctacgaagtggtggtcgacgagaagccattcctgcagtgcactaggtccattgaaactggaaaaaccaattacaatacttgttacactgcgggggtgtgtctcttgaaggcacggcagaagatcgccgtgaaaatggtgcatgcagatatctcgatcaatatgtccaaacacaccaccttctttggagccatccggctcggggaagccccagctagc

SEQ ID NO: 10734 - DNA, 1167 bp, Artificial Sequence
  Description of Artificial Sequence: Synthetic coding sequence
atgggataccctgaggtggagcgccgggaattgctgccggctgccgcccctagggagaggggttcacagggatgcggttgtggtggcgccccggcccgcgccggagagggcaatagctgcctcctgttcctgggcttcttcggactctctcttgctctgcaccttctgacactctgttgctacctggagctgcgctctgaattgcggagggagagaggggctgagtcacggctggggggctccggaactccaggaacaagtggtacactgagttccctcggcgggctcgatcctgactcacctatcacaagtcatctcggacagccgtcccctaagcagcagcctcttgaacctggggaggcggcgttgcactccgactctcaggacggccatcagatggctctgctcaacttttttttccccgatgagaagccatatagcgaggaggagtctcggcgggtgcggaggaacaagagatccaagtctaacgagggcgcagatggtccagtgaaaaacaaaaaaaagggtaagaaggcaggcccaccaggccctaatggtccccctgggcctcctggcccccccgggcctcaaggtccccccgggattcccggcatcccaggcatccctggcactacggtaatgggaccgcctgggccccctggcccgccggggccacaaggtccacccgggcttcagggcccctcaggggctgctgacaaggccggcaccagggaaaatcaacccgctgtggtccacctgcaaggtcagggcagtgcgatccaggtgaagaacgatttgtccggaggggtgctgaacgattggtccaggattaccatgaatcccaaagtgtttaagctccacccacggtccggagagctcgaagtgcttgtggatgggacctatttcatctattcccaggtgtactatatcaacttcactgactttgcgagctacgaggtggtcgtggacgaaaagccgttcctgcagtgtaccagatcaattgaaacaggaaaaactaattacaacacctgttacacagcaggcgtgtgcctgctgaaagcccggcagaagatcgcggtgaagatggtgcacgccgatatcagcattaatatgtctaagcatacaacttttttcggcgccatccgactgggcgaagcaccagcctct

SEQ ID NO: 10735 - DNA, 1167 bp, Artificial Sequence
  Description of Artificial Sequence: Synthetic coding sequence
atgggttaccctgaggtagaaaggagagagcttctacccgctgccgcgcctagagagcggggctcacaaggttgcggttgcgggggggctcctgcgcgggcaggagaggggaatagctgcctactgttccttggcttcttcggtttgtcactcgccctgcacctgcttacgctctgctgttatttggaattacggagtgaactaagacgggagagaggagctgagtctcgcttggggggatcaggaacccccggcactagtggtaccttgtctagcctgggtggcctggatcctgactctcctatcacatcccatttaggtcaaccatccccaaagcagcagcccctagaacccggcgaggcggcgctgcatagtgactcccaagacggccatcaaatggccctcctgaatttctttttccccgatgagaagccatactccgaggaagagagccggcgggtgcgtcgcaacaagagaagtaaatcaaatgagggcgcagatggacctgtcaagaataaaaagaaaggtaaaaaggctggcccaccgggccccaatggtccacccggaccacccggaccccctggaccacaggggccccccggtatccccgggatccccggcatacctggcacgaccgtcatgggcccccccggacccccgggaccaccaggtccgcagggtccccccgggctacaggggcccagcggggccgctgataaggccggaaccagagaaaaccaacctgcagttgttcacctccaaggccagggaagcgcaattcaagttaaaaatgacctgtcgggtggggtgctgaatgactggtcccggatcaccatgaacccgaaagtgttcaagcttcatccgcggagcggcgagctggaagttctcgtggatggcacttattttatttattcccaggtttactacatcaatttcaccgacttcgcctcctatgaggttgtggttgacgaaaagccattccttcagtgcacgaggagcatcgagactgggaagaccaactataatacatgttatactgctggcgtatgtctcctgaaggctcggcaaaaaatcgccgtcaagatggtccatgccgatataagtattaatatgtctaaacacacaacatttttcggagctatcagactcggagaggctccagcttcc

SEQ ID NO: 10736 - DNA, 1167 bp, Artificial Sequence
  Description of Artificial Sequence: Synthetic coding sequence
atgggatatcccgaagtggagcgtagggaactgctacctgctgctgccccaagggaacgcggctcacaggggtgcggctgcggcggtgccccggcacgggcgggggaggggaactcttgtctcttgtttttaggctttttcggcctgagtttggccctacacctgttgacgctatgctgctacctcgaacttcgcagtgagctgcggcgtgagcggggtgccgaaagtagactcggtgggagtggaacaccaggtacctctggaacacttagttccttgggggggctggaccctgacagcccaatcacatcccatctgggccagccctcaccaaaacagcagcccctggaacctggcgaggcagccttgcactcagacagccaggacgggcatcagatggcgctactcaacttttttttcccagacgagaagccatattccgaggaagagagtaggcgcgtccgcagaaacaaacgttccaaatctaatgaaggtgcagatggtcctgtcaaaaacaaaaaaaaggggaaaaaggcaggccctcccggccccaatggtccccccgggccccctgggcctcctggacctcaggggcctccaggtatccccggaattccaggcattcctgggaccaccgtaatggggccaccaggacctcctggaccgccgggccctcagggacctcctggcctacagggcccttccggggcagctgacaaggctggcacgcgggagaatcagcctgctgtagttcaccttcagggacaagggtccgccatccaggtcaagaatgacctgtccggaggagtgctcaacgactggtcccgcattaccatgaatcccaaggtcttcaaacttcacccacggtcgggggagttggaggtgttggttgacgggacctacttcatttattcccaggtttactacatcaacttcactgattttgcttcatacgaggtcgtcgttgacgaaaagccatttttgcagtgtactagaagcattgagactggcaagaccaattataatacctgctacacagccggtgtttgcctgctgaaagctagacaaaaaattgccgttaagatggtgcatgcggatatctccatcaatatgagtaaacatactacattttttggagccatcagactcggggaggcccccgctagc

SEQ ID NO: 10737 - DNA, 1167 bp, Artificial Sequence
  Description of Artificial Sequence: Synthetic coding sequence
atggggtaccccgaggtagagagacgggagctcttgccagcggccgcccctagggagagaggtagccagggctgtggctgcggcggcgcccctgcacgggccggagaaggcaactcctgcctcctgttcctcggattttttggactgtctctcgcccttcatctgctgactctgtgctgttacttggaactcagaagcgagctgcggcgcgagaggggcgcagaaagccggcttggcggcagcggcactccaggaacctccgggacattgtcctcactcggtggattggatcctgactctccgattacctctcaccttggtcagccgtctccaaagcagcagccgctggagccgggtgaggccgctctgcactccgatagccaagacggacatcaaatggccttgctgaacttttttttccccgacgaaaagccatactccgaggaggaaagccgccgagtgcggcggaataaacggagtaaatccaacgaaggcgcggatgggccagttaaaaacaagaagaagggtaagaaggctggaccaccggggccgaacggacctcccggacctcccggccccccaggccctcaaggcccacccggcatcccaggtatccccggcatcccaggaacgacggtgatgggccctcccggcccacctgggccacctggacctcagggaccccccggactgcagggtcccagcggagccgctgataaggcaggtacgcgcgaaaatcagccagctgtggtccacctccagggacaaggcagtgccatccaagtcaaaaacgacctcagcggtggggtattgaatgactggagtcggataaccatgaatcctaaggtctttaaactgcatccacgcagcggcgaactggaagtgctggttgacggtacttactttatttattcccaggtgtactacattaattttacggactttgcctcatatgaagtggtcgtggatgagaaacccttcttgcagtgtactcgcagtattgagaccggaaaaacaaattataatacctgctacaccgccggcgtgtgtctgcttaaggccagacagaagatcgcagttaaaatggtgcatgctgacattagcattaacatgagtaaacacactaccttctttggtgccataagactgggtgaagcccctgcttcc

SEQ ID NO: 10738 - DNA, 1167 bp, Artificial Sequence
  Description of Artificial Sequence: Synthetic coding sequence
atggggtatcctgaggttgagagaagggaattgctgcctgctgcagctccccgggaaagaggcagtcaggggtgtggctgtggtggggccccagcccgcgctggggaagggaacagctgccttttgttcctcggcttctttggcctgtctctcgctctccacctgctgaccctgtgctgctacttggaactaaggagcgagctgcggagggagcgcggtgccgagagtcggctcggaggttccggaacgccaggcacctccgggactctgtcctcactgggagggttggatcccgactcgcccatcacaagccatctgggccagccctcgcccaaacagcagcctctagagccaggcgaagctgccctacactcagattctcaggacggccaccagatggcattattgaacttcttcttccctgacgagaaaccctactctgaggaggagagcaggagagtgagacgtaataaaagatccaagtccaatgagggggctgacggcccagtaaagaataagaagaaaggcaaaaaggctggcccacccggcccaaatggccccccaggtccacccgggcctcctggaccacagggccctcctggcatccccgggatcccgggcattcccgggaccactgtcatgggacctccaggtcctcccgggcccccgggcccgcagggcccccctggactgcagggtccaagcggagcagccgacaaggccggaaccagggagaatcagcctgctgtggttcatctgcaagggcaagggtctgccatacaggtgaaaaatgacctgagcgggggcgtgttgaacgattggtcacgcatcacaatgaatcctaaggtgtttaagctgcatcctaggagtggagaactcgaagtattggtcgacggtacttactttatttacagccaggtgtactatattaattttaccgattttgcaagttacgaggttgtcgttgatgagaaacctttcctccagtgtacccgttctattgaaacgggaaagaccaactacaacacatgttacaccgctggagtgtgtctgctgaaggcacgacagaagattgctgttaaaatggttcacgctgatatctcaataaatatgtccaagcacactacttttttcggagcgattagactaggagaggctcctgcatct

SEQ ID NO: 10739 - DNA, 1167 bp, Artificial Sequence
  Description of Artificial Sequence: Synthetic coding sequence
atgggttatcctgaggtcgaaagacgagagcttctgccagcagcagctccacgggagcgcgggtctcagggttgcggctgtggcggggcaccagccagggccggagaaggcaatagctgcctgctctttctgggctttttcgggctctcactggcactgcacctgctgacactgtgttgctacctggagctccgaagcgagttaaggcgtgagaggggtgccgagtctcgactgggggggtctgggactccaggaaccagcggtaccctgagtagcctaggggggctggaccccgattcccctataacatctcatttaggacagccctctcctaaacagcagccactggagcccggggaggctgccctgcactcagacagtcaagacggccatcagatggctctactgaatttcttctttcccgacgagaagccttactccgaagaggagagccggcgcgttcggcgtaacaagagaagtaagagcaacgagggagctgatggcccagttaaaaataagaagaaggggaagaaagccgggccaccaggtcctaacggaccacctggcccaccagggcctccgggcccgcaaggaccacccggaattccaggtattccagggatccccgggaccacagttatgggccctccaggccctcccggccctccaggacctcagggcccccccggcctgcaaggcccatccggtgcagccgacaaagccggcacaagggagaaccagccagcagttgtgcatctgcagggacagggcagtgctatacaagtgaaaaacgatctgagtgggggcgttctgaatgactggagcagaatcaccatgaaccccaaggtgttcaagctgcacccaaggtctggcgagcttgaggttctggtagacggaacctacttcatctactcccaggtctactatataaacttcactgattttgcttcttacgaggtagtggtggacgagaagccttttctccagtgtactcgaagcattgaaaccgggaagaccaattacaatacctgctatacagctggggtgtgcctgctgaaagctcgccaaaagattgccgtgaaaatggtgcacgccgatatctctattaatatgtccaaacacacaacattctttggcgccatacgattgggcgaggctcccgccagt

SEQ ID NO: 10740 - DNA, 1167 bp, Artificial Sequence
  Description of Artificial Sequence: Synthetic coding sequence
atgggatatccagaagtggagagacgggaactgctgccggcggctgcaccaagagagagaggctcccaaggatgtgggtgcggcggtgcaccagcaagagcaggagaaggtaatagctgccttctttttcttggattctttggtctttcgcttgcactccatctccttactctgtgttgttacttggaacttcgctcagagcttcgcagagaacggggggcagaatcccggctgggtggatccggtactcccgggacctctggaaccctgagctcgctgggcggactcgatcccgattccccaattacctcccaccttggtcaaccgtcccctaagcaacagccacttgaacctggagaagcagccctgcactccgactcgcaagatgggcaccagatggcgctgttgaacttcttttttcctgacgaaaaaccatactccgaagaagaatcccgaagggtccgtcggaataagcggtcaaagtcaaacgaaggagcagatggaccggtgaagaataagaagaaaggcaagaaagcgggaccacctggaccaaatgggcctcccgggcctcctggtcccccaggaccacaaggaccccccggtatccctggaatcccaggcatcccgggaaccaccgtgatgggaccaccaggaccacccggacctcctgggccacagggtccacctggcctccaaggaccaagtggggccgcagataaggcaggtactcgcgaaaaccaacctgcggtggtgcatctgcaaggacagggttcggcgattcaggtgaagaatgacctttcgggcggagtgttgaacgattggagcaggatcaccatgaatccaaaggtctttaagctgcatccccgctccggagaacttgaggtgctggtggatggtacttacttcatttactcgcaagtttactacattaactttaccgactttgcatcttacgaagtggtggtggacgaaaaaccctttctccagtgcactagatcaatcgaaactggtaagaccaactacaatacttgttacactgctggtgtgtgccttctgaaggccagacagaagatagcagtgaagatggtgcatgcggatatcagcatcaatatgtccaagcataccacgtttttcggagcaattaggctgggagaagcacctgcaagc

SEQ ID NO: 10741 - DNA, 1167 bp, Artificial Sequence
  Description of Artificial Sequence: Synthetic coding sequence
atgggttaccctgaggtagagagacgcgaactcctgcccgccgctgccccaagagaacgcggctcccaaggttgtggttgtggtggagcccctgctagagccggtgaaggcaactcctgtctgctgtttttgggattcttcggtctgtcccttgcactgcaccttctgaccctctgctgttatttggagctccgcagtgagctcaggcgtgagcgtggcgccgagagtaggcttggaggcagcggtacacctggtacatccggaaccctctcaagtttgggaggtctggacccagacagtcctattacctctcacttgggccagccttctcccaaacaacaaccactcgagccaggcgaggccgctctccattcagatagccaggacggccaccaaatggctctcctcaacttcttcttcccagacgagaagccatattctgaagaggagtcccgtcgtgtaaggcgcaacaagagaagcaaatctaatgaaggtgctgatggccccgtgaaaaacaaaaaaaagggtaagaaggcaggaccccccggtcccaacggaccacccggccctcccggccctcccggacctcagggaccacccggcatccctggcatcccaggcatcccaggaaccacagttatgggacctccaggcccccctggtcctccaggtccacaaggcccacccggcttgcaaggtccttcaggtgctgccgacaaagccggcacacgcgaaaatcagccagccgtggtgcacctccagggccaaggctccgctatccaggttaaaaacgatctctccggcggtgtgctgaatgattggtctaggatcacaatgaacccaaaggttttcaagctccaccctcgttcaggtgaacttgaggttctcgtcgacggcacctatttcatctattctcaggtgtactacattaacttcaccgatttcgcctcatacgaagtggttgtagatgaaaagcctttccttcaatgtacccgcagtatcgaaactggcaagactaactacaatacctgttacactgccggcgtttgcttgctgaaggccagacagaagatcgccgtcaagatggtccacgccgatatttccatcaacatgtccaaacatacaaccttcttcggcgccataaggttgggagaagctcctgctagc

SEQ ID NO: 10742 - DNA, 1167 bp, Artificial Sequence
  Description of Artificial Sequence: Synthetic coding sequence
atgggatacccagaggtggaaagacgcgagctcctgcccgcagccgccccgagggaaagggggtcacaaggctgtggctgtggaggtgcccctgcgagagcaggagaaggaaacagctgcctgctgtttctggggttcttcggactgagcttggccctccacctgttgaccctgtgctgttacctcgaactcaggtctgagcttaggagggaaagaggagccgaatctcgcctgggcgggagcgggacaccaggtacctcagggactcttagctcactgggcggccttgaccccgacagtcccatcacaagccacttgggccagcccagccccaaacagcaacccctggaaccaggcgaggccgccctgcactccgattcacaggacggccatcaaatggctctcctgaacttttttttccctgatgagaagccttatagcgaggaggagtcaaggcgcgttcgcagaaacaagcgatccaagagcaacgagggagcggacggccctgttaagaataagaaaaagggaaaaaaggccgggccccccggccccaacggtcctcctggacccccaggacctcccggcccacagggccctcctggaatacctggcattcctggcatacctgggacaaccgtgatgggcccaccgggccccccagggcctcccggacctcagggccctcccggtctgcaagggcccagcggagctgctgacaaagccgggactcgagaaaaccagcccgctgtggtgcatctgcagggccagggcagtgctatccaggtgaagaatgaccttagtggcggtgtactgaacgattggagcaggattaccatgaatcccaaagtttttaaactgcacccacggtccggagagctcgaagtgttggtggacgggacttattttatctacagtcaagtctactacataaacttcaccgatttcgcttcctacgaagtggtcgtcgatgaaaagcctttcctgcagtgtacgagatctatcgagacaggcaaaacgaattataatacatgctataccgccggcgtatgcctgctgaaagctcgacagaaaattgcagtgaagatggtgcacgctgacatctctataaatatgagcaagcatacaacattctttggggccattaggctgggagaagcgcccgcctca

SEQ ID NO: 10743 - DNA, 1167 bp, Artificial Sequence
  Description of Artificial Sequence: Synthetic coding sequence
atgggatacccggaagtggaacgcagagagttgctgccggccgcggctccgcgggagagaggaagccaaggatgcggatgcgggggtgcgccggcccgagcaggcgagggaaactcctgcctgctcttcttgggatttttcggactcagcttggcgctccacctccttactctgtgctgctacctggagctgagaagcgaactgcggcgcgaacgcggcgctgagtcgcggcttggtggatccggaacgccgggaacctccggaaccctgtcgtccctcggaggcctcgatccggactcacctatcacctcgcacctgggacagccttccccgaagcagcagccgctggaaccgggagaggcagccttgcattctgactcacaagacggccaccagatggctctgctgaatttctttttcccggatgaaaagccctactccgaagaggaatcacgccgcgtccgtagaaacaaacgcagcaaaagtaatgaaggagccgatggaccggtcaaaaacaagaagaagggcaaaaaggcgggccctccaggaccaaacggcccgccaggacctccgggcccaccagggccgcagggacctccagggatcccgggcattccgggaatcccaggtactaccgtgatgggcccccctggtccccccgggccgcccgggcctcaagggccacccgggctgcaaggaccatcgggggccgccgacaaggctggcactcgggagaaccagccagcagtggtccacctgcaaggccagggtagcgcaatccaggtcaagaatgacctctcgggaggagttctgaacgactggtcacgcattacgatgaacccgaaggtgttcaaactgcaccctaggtccggtgaacttgaagtgctcgtggacggcacctacttcatttacagccaggtgtactatatcaactttactgactttgcctcgtacgaagtggtcgtggatgagaaacctttcctgcaatgcaccaggtccatcgaaactggaaagactaattacaatacctgttacactgccggtgtgtgtctgctcaaggcccggcagaagatcgccgtaaagatggtgcatgcagatatctcgatcaacatgtcaaagcataccaccttcttcggggctatccggctcggagaggcgccagcgtcg

SEQ ID NO: 10744 - DNA, 1167 bp, Artificial Sequence
  Description of Artificial Sequence: Synthetic coding sequence
atgggctatcctgaggtcgagagaagagagctcctgccggcagcagctccgcgggaaagaggaagtcaaggttgcgggtgcgggggcgccccagcaagagcgggcgaaggtaactcttgtctcctttttctcggttttttcggattatcactcgccctccacctgcttacgttatgctgctatctcgaattgcgatccgaactaaggagagaaaggggcgccgagtctaggctgggaggttccgggacccccggcacttccggcactctgagttcgctgggtggcctcgatccggactcccctattacttcccatctcggccaaccatctcccaaacaacagcccctggaacctggggaggccgcattgcattccgactctcaggacgggcatcaaatggccctactgaatttttttttccccgatgagaaaccatactctgaagaggagtcacggcgtgtacgtcggaacaagagaagtaagagcaatgagggcgcggacgggccagtgaaaaacaagaagaaggggaagaaagccgggccgcctggaccaaatggaccccccggccctccaggaccccccggaccccaaggcccccctgggatccccgggattccagggatacctggcacaacggtgatgggaccacctggccccccggggccacccggaccacaagggccccccggcttgcagggaccctctggggcagcagataaggcaggaactagggagaatcaacccgccgtagttcatctccagggccaggggagcgccatccaggttaagaatgatctctccggcggggtcctgaatgactggagtaggatcacgatgaacccaaaggtctttaagctgcaccctcgctcaggcgaattggaggtgctagtcgatggtacatatttcatttacagtcaggtgtactacattaatttcacagacttcgcctcatacgaagttgtcgttgacgagaagccattcctccagtgcacaagatcaatcgaaaccgggaaaacaaattataatacgtgctataccgctggcgtctgcctccttaaggcgagacagaagatcgccgtgaagatggtgcatgcagacatttctatcaatatgtccaagcatactacgttctttggcgcaattcggctgggcgaggctcctgcatcc

SEQ ID NO: 10745 - DNA, 1167 bp, Artificial Sequence
  Description of Artificial Sequence: Synthetic coding sequence
atgggctatccagaggtcgagcgcagagagctcttgcctgctgcggctccaagagagagaggatctcaaggctgcggatgcggtggtgcccccgcgcgggctggcgagggcaacagctgcctgctttttttaggcttcttcgggctgtcactggcgctgcatctgctaaccctgtgttgctatctcgagctgcggagtgagcttcgaagagagaggggcgctgaatcaagacttggtgggtccgggaccccaggaacgtccgggacgcttagtagtctgggcggcctggacccagactctcctataacttctcatctcgggcagccatcacccaagcagcagcctctagaaccgggcgaggccgccctgcattcagactctcaggatggacaccagatggctctgctaaatttctttttcccagacgagaaaccgtattcagaagaagagagccgccgggtccgcaggaataagaggagcaagagcaacgagggagcagatggcccagtaaagaataagaagaagggcaaaaaggccggtcccccgggaccaaacggacctccagggccccctggaccccctggaccccagggcccccccgggattccaggaatacctgggattccaggtactactgtgatgggcccgccaggacctcccggacctcctggtcctcaaggaccacctggccttcagggtcctagcggagctgctgataaggctggcacaagagaaaaccagcctgccgtggttcatctgcaggggcagggtagtgctatccaagttaaaaacgacttgtctggcggggtgctgaatgactggagtcgcataactatgaacccaaaggtcttcaagctgcatccgcgatctggggaacttgaggtactggttgacgggacctacttcatttatagccaggtatattacatcaattttaccgattttgcgtcatacgaggtggtcgtagacgaaaaaccatttctgcaatgtactaggagcatcgagaccggtaaaactaattataacacttgctacactgctggagtgtgcctgctgaaggcacggcagaagatcgccgtcaaaatggtgcacgctgacattagtattaatatgtccaaacacacaacatttttcggggcaatccgactgggcgaggctccagcctcc

SEQ ID NO: 10746 - DNA, 1167 bp, Artificial Sequence
  Description of Artificial Sequence: Synthetic coding sequence
atggggtatcccgaggttgaacgtcgtgaactgcttccggccgccgcgccccgagagagaggatctcagggctgtggctgtggaggcgcacctgcgagagccggtgagggcaattcctgcttgttgtttctgggcttcttcggcctttctctcgctctgcacctgctgactctctgttgctatttggagctgaggagcgaactcaggcgtgagagaggcgccgagagccgactgggagggagcggaactccagggacatccggcacactctcgtccctcggcggcctggaccccgacagccccatcacatcacatctgggtcagccctcccccaaacagcagccattggagccaggcgaggccgccctgcactcagactcccaggatggccaccagatggcgctactgaactttttttttccggacgagaagccatattccgaggaagagagtcgacgtgtgcgacgcaacaaacggagcaaatcaaacgaaggcgctgatggcccagtcaaaaacaagaagaagggcaagaaagcaggtcctcccggacctaacggcccacccggaccccccgggcctccaggcccccaaggtccccccggcattcccggaatacctgggattccagggaccacagtgatgggccctccggggccccccgggccacctggacctcaaggcccacctggcctccaggggccatctggcgctgccgataaagctgggactcgagagaaccagcccgcggtggtacatctccagggtcagggaagcgccatccaggtcaaaaatgatctctccggcggcgtccttaacgattggtcacgaattaccatgaacccaaaagtgttcaagctgcatccccgttccggcgaattagaagtcttggtggacggcacctactttatctacagtcaggtgtattatatcaatttcacggattttgcttcctacgaagtcgtagtagatgaaaaacccttcttgcagtgtactagatcaatagagactggaaagactaattataacacttgctatacggccggcgtgtgtctccttaaagctagacagaagatcgccgtaaagatggtgcatgccgatatctcaatcaacatgagcaagcacacaaccttcttcggtgcgataagattgggggaggcccccgccagt

SEQ ID NO: 10747 - DNA, 1167 bp, Artificial Sequence
  Description of Artificial Sequence: Synthetic coding sequence
atgggataccccgaggtagagcgaagggaacttctgcctgccgccgctccaagagagagaggctcacagggttgtgggtgcgggggcgcgcccgctagggccggagaaggtaattcatgcttactgtttcttgggttctttggcctgagtctcgccctgcacctccttacactctgctgttatctggagctgcggtctgaactccgtcgtgaacggggtgcggagtctcggctaggaggcagtggcacacctgggacttccgggacactttcttcccttggcgggttagaccctgattcgcctatcaccagccacctggggcagccttcgcctaaacaacagcctctggaaccaggagaggccgcccttcattccgacagtcaggatggccatcagatggccctgctcaacttctttttccccgatgagaagccatactctgaagaggaaagccggcgtgtgagacgtaataaaaggtctaaaagcaacgaaggagctgacggcccagtaaagaacaaaaaaaaagggaagaaagccggaccaccgggtccgaacgggcccccagggcctccagggccaccagggcctcagggtccccccgggatcccggggattcccggaattccaggaaccacggtaatggggcccccaggtccacctgggcctcccggtccacagggcccacctggcctccagggaccttcaggagctgccgacaaagctggcaccagggagaatcagcccgcggtggtgcacctgcagggacagggctcagctatccaggtaaaaaacgatctgagcggcggggtgctgaacgattggtctcgcattactatgaaccccaaagtcttcaagctgcaccctcgctctggggaattagaggtgcttgttgatggaacctacttcatctatagtcaggtgtattatatcaactttacagattttgcttcatatgaagtagtggtagacgaaaagccattcttgcagtgtactcgtagtattgagacagggaagaccaactataacacatgttatactgctggagtctgcttgcttaaggccaggcagaaaattgccgtcaagatggtgcacgccgacatctccatcaacatgtcgaagcataccacctttttcggtgctattagactcggggaggcccccgcatca

SEQ ID NO: 10748 - DNA, 1167 bp, Artificial Sequence
  Description of Artificial Sequence: Synthetic coding sequence
atgggctacccagaggtagagagaagagagcttctcccggctgctgcaccgcgtgagagaggatcacaaggatgcggttgtggaggagcccctgcacgtgctggagaaggtaactcgtgccttctttttctgggttttttcggcctttcgctggcactgcatctcctgaccttgtgttgttacctcgaacttcgttccgagcttcgcagggaacgtggtgcagagtcccgcctcggaggatcgggcactcccggaacttcaggaaccctttcatccctgggtggactcgatccagattcaccgattaccagtcatctgggccagccttcgcccaaacagcaaccgctggagcctggtgaggccgcgcttcatagcgatagccaagacggtcatcaaatggcacttcttaacttctttttccccgatgagaaaccatatagcgaagaagagtccagaagagtacgtcggaacaagcgtagcaagagcaacgaaggcgcagacggaccagtgaagaataagaagaagggtaaaaaggcagggccccctggaccgaacggtccgcctggaccccccggcccgccaggaccacaagggccgcccggcattccggggataccaggtatccctggtactactgtgatggggcctccaggtcctccagggcctcctggcccgcaaggacccccagggctgcaggggccttcgggagccgcggacaaggcggggactcgggaaaaccaacctgccgtggtgcatctccaaggacagggatcggcaattcaggtcaaaaatgatctgtcgggcggagttttgaatgactggtcacgaatcactatgaatccaaaggtgttcaaacttcacccacggtccggagaacttgaagtcctggtcgacggaacctactttatctacagccaggtctactacattaactttaccgattttgcttcctacgaagtggttgtcgatgaaaagccatttctccaatgcaccaggtctatagaaaccggcaagaccaattacaacacctgttacaccgcaggtgtgtgtctgttgaaggcacgccagaagattgcagtcaaaatggtgcatgcagatatttcgatcaacatgagcaaacacacgacttttttcggcgcaattagacttggagaagccccagcgtca

SEQ ID NO: 10749 - DNA, 1167 bp, Artificial Sequence
  Description of Artificial Sequence: Synthetic coding sequence
atgggttacccggaagtcgaacgtagagagctgctgcccgctgccgcgccacgcgaacgaggtagccagggatgtggatgtggcggagcacctgcccgcgctggcgagggaaatagctgccttctctttcttggattcttcggactttccctggcactgcatctgctgactctctgttgttacctcgagcttaggtctgaactccgcagagagcggggagctgagtcgaggctcggtggctccggaacgcctggaactagcggaactctgtctagtctcggaggtctggaccccgattccccaatcactagccatctgggccaaccatcgcccaaacaacaaccactggaacccggtgaggcagcacttcattcggattcgcaggatgggcatcaaatggctctgctcaatttctttttccctgatgaaaagccttactccgaagaggaaagtcgtagagtgcgccgtaataagaggagcaaatccaacgagggtgcagacggacctgtcaaaaacaagaaaaagggtaagaaggcagggccaccaggtcctaacggccctccgggacctccagggccacccggacctcagggacccccagggatacccggtattcccggaattccaggaactactgtcatgggccccccagggccccctggacccccgggtccacaaggtccaccaggccttcagggaccttccggcgcagcggacaaggccggaactagggaaaaccagcccgcagttgtgcacctgcagggacagggttcagcaatacaagtcaaaaacgatctttcgggcggcgtgctgaacgactggtcacgcatcaccatgaacccaaaagtgttcaaattgcaccccaggtccggtgaactggaggtcttggtggatggaacctatttcatatacagccaagtgtactacatcaatttcaccgattttgcgagctacgaagtggtggtggatgagaagccctttcttcagtgtaccagatcaatcgaaaccggaaagaccaactacaatacctgctacactgctggagtgtgccttctgaaagctagacagaagatcgccgtgaagatggttcacgccgatatttcaatcaatatgtcgaagcatactaccttttttggggccattaggcttggagaggcacctgcgtcg

SEQ ID NO: 10750 - DNA, 1167 bp, Artificial Sequence
  Description of Artificial Sequence: Synthetic coding sequence
atgggctatcctgaggtagaaagacgcgaacttctcccggcagcggctccgcgtgagaggggaagccagggatgcggatgcggcggggcaccggcaagagcgggcgagggtaactcgtgccttttgtttctggggttttttggtctcagccttgctcttcatcttctaacattgtgctgttatttggaattgcggtcagagcttcgaagagaacgtggagcggaatcgcgtcttggcggatctggtacaccgggtactagcggtaccctatccagcttaggaggtttggatccagactctccaattacttctcatttgggacaaccatcaccaaaacagcaaccgttagaacccggggaagcagcactgcattcggatagccaagatgggcaccagatggcattattgaacttttttttccccgacgagaaaccatattccgaagaggaatcacgcagggtgcgccgtaacaaacgttccaaaagtaacgaaggagcggatggaccggtcaaaaataaaaagaaaggcaaaaaagccggccctccaggacccaatggaccgccaggtccaccaggaccccccggcccgcagggcccaccaggcatccctggcattccgggtatccctgggacaacagtcatgggtccgccgggccctcccggaccaccaggtcctcaggggccgccaggtttacagggaccttcaggtgcggctgataaagcaggcacaagagaaaaccagccagccgtcgtgcaccttcagggccaaggaagcgcaatacaagttaaaaacgatctttcaggtggcgttttgaatgattggagtaggataacaatgaaccccaaagtctttaagcttcatccgcgcagtggagagcttgaagtgctggtggatggcacctactttatttactctcaagtctattatatcaactttaccgattttgctagctatgaagtagtcgtagatgagaagccttttttgcaatgcacccgatccattgagacgggaaaaaccaattacaatacttgctatacggctggcgtttgcctgctgaaggcccgccaaaaaattgccgtgaaaatggtacatgctgatattagcatcaatatgtctaaacatacgaccttttttggcgcaatcagattaggtgaagcgcctgcatct

SEQ ID NO: 10751 - DNA, 1167 bp, Artificial Sequence; identical to SEQ ID NO: 10720
  Description of Artificial Sequence: Synthetic coding sequence

SEQ ID NO: 10752 - DNA, 1167 bp, Artificial Sequence
  Description of Artificial Sequence: Synthetic coding sequence
atgggttacccggaggtggaaagacgcgagctgcttccggctgccgcacctcgggaacgtggatcccaaggatgcggttgtggaggcgcccccgcacgcgctggagaaggcaattcatgcctcctcttcctgggtttctttggcctgagcctcgccctgcacctgttgaccctgtgctgctacctggaattgcggtcggagctcaggcgggagaggggagcggagtcaagactgggaggaagcgggaccccaggaacctcgggaaccctgagcagcctgggaggtctggacccagattcgcctattacctcgcatctgggacagccgtctccgaagcaacaacctctggaaccgggagaagccgcccttcatagcgactcccaggacggtcatcagatggcactcctcaatttctttttcccagatgagaagccttacagcgaagaggaatcaagacgggtgcggcgcaacaaacgcagcaagtcgaatgagggagccgatgggccggtgaagaacaagaagaaggggaagaaggccgggccacctgggccgaatggaccacctggacctcctggaccgccaggaccgcagggaccacccggcatcccgggtattccgggcattcctggaaccacggtgatgggacctccgggcccgccgggcccccctggcccgcaagggccacctggactccagggaccatccggtgccgctgacaaagctgggacccgcgagaatcagccggcagtggtgcacctccagggccagggatcggccattcaagtgaagaatgacctgagcggaggcgtgttgaatgattggagcagaatcaccatgaacccgaaggtctttaaactccatccacggtcaggagaacttgaagtcctggtggacggaacttactttatctactcccaggtctactacatcaactttactgacttcgcgtcatacgaggtggtggtggatgaaaagcctttcctgcagtgcacccggagcattgaaacgggaaagactaactacaacacgtgttacactgcgggagtgtgcctgctgaaggcacggcaaaaaatcgcggtgaagatggttcacgccgacatctccatcaacatgtccaagcataccactttcttcggggccattaggctcggggaagcgcccgcgtca

SEQ ID NO: 10753 - DNA, 1167 bp, Artificial Sequence
  Description of Artificial Sequence: Synthetic coding sequence
atgggctacccggaagtagaacgccgagagctccttcccgctgccgccccacgtgagaggggttcccaaggttgtgggtgcgggggcgcaccagccagggccggagagggaaatagctgtctcctgtttctcggtttttttggtctgagtctggcccttcacctgctcaccctctgttgctacctcgaactgcggtctgaacttaggagggaacgaggcgcggagtctcggctcgggggatctggcacgcctggcacaagtgggactctgagttcactaggcggactcgaccccgatagtcctatcactagccatctcggtcagccatctcccaaacagcagccacttgaaccaggtgaagcggctttgcacagcgatagccaagacgggcaccagatggctttgctgaatttttttttccccgacgagaagccttactctgaggaagaatcacgtagagtgagaaggaacaagcgtagcaagagtaacgaaggggcagacggcccagtcaagaataagaagaaagggaagaaagccgggccgcccggccccaacggtcccccgggaccccctggccctccaggccctcaagggccgcctgggataccagggatcccaggcattcccgggaccactgttatgggccctcccggcccccccggcccccctggtccacaaggcccacctggacttcagggccctagcggagcggctgacaaagcaggtacccgggagaatcagccggccgtcgtgcacttgcaggggcagggaagtgcgatccaggtgaaaaatgatctgagcggtggcgttctgaacgattggtccagaataactatgaacccaaaggtgtttaaactgcacccccgatccggagaactggaagtcttggtggatggcacctactttatttactcccaggtctactacataaacttcactgatttcgcttcctatgaggtagtggtggacgaaaagccttttctgcaatgcacacgatccatagagaccggaaaaacaaactataacacatgctacacagccggcgtttgcctactgaaggctcggcaaaagattgccgtgaagatggtccacgcagatattagcatcaacatgtccaagcatacaactttttttggtgccataagactcggggaggctcccgcctcc

SEQ ID NO: 10754 - DNA, 1167 bp, Artificial Sequence
  Description of Artificial Sequence: Synthetic coding sequence
atgggttaccctgaggtggaaagaagggagctgctgcctgctgctgctcctagagagcgcggcagccaaggatgtgggtgcggtggagcccccgctcgagctggtgaggggaacagttgccttcttttcttgggcttctttggactatcccttgcacttcatctgttaactctgtgctgctatctagagttgcggagcgagctccgacgggagagaggcgccgagagtaggcttggagggtctggcacaccggggacatccggtaccctgtcttctctaggaggcctcgatccagactcacccatcacttcacacctgggccagccatccccaaagcagcaaccactggagcccggtgaagctgccttgcacagtgacagccaggacgggcaccagatggcactgttgaactttttcttccccgacgagaaaccttactcggaggaggagtcccgccgggtccgccgcaataagaggtctaagtccaatgagggagcagatggtccagtgaaaaataaaaagaaaggtaaaaaagcgggcccacctgggcctaacggtcctccgggaccacccggcccacccggaccacagggtccccccggcatccccggtattcccggaattccagggaccacagtcatggggccccctggtccccccggacctccaggccctcagggtcccccgggtcttcagggcccttccggtgctgccgataaagcgggaacacgcgagaaccagccggcggtggtccatctacaaggccagggcagcgcgatccaggtcaagaacgatctcagcggaggtgtgctaaacgactggtccagaattactatgaatcccaaggtgttcaagttgcacccacgctcaggcgagctcgaggtcctggtggacgggacctacttcatatattcccaggtttattacatcaacttcacggactttgcatcctacgaggtggtcgtagatgagaagccttttctgcagtgcaccagaagcatcgaaacagggaaaacaaattacaatacctgctacaccgcgggagtctgcctacttaaggcccgacagaaaattgctgtaaagatggtccatgctgatataagcatcaatatgagcaaacacacaaccttttttggagctatccggctaggagaagcccccgcttca

SEQ ID NO: 10755 - DNA, 1167 bp, Artificial Sequence
  Description of Artificial Sequence: Synthetic coding sequence
atgggatacccggaggtcgagcgacgcgagctgttgccggccgcggctccgcgggaaagggggtcgcagggatgtggatgcggaggagccccggcccgcgcgggggaaggaaattcctgtctcctgttcctgggatttttcggactgtcactggccttgcacttgttgactctgtgctgctacctggagctgcgtagcgaacttcggcgggaaagaggagctgagagccggctcggaggctcaggcactccgggaacctcgggaactttgtcgtccttgggtggactggatcccgactccccgatcaccagccatttgggtcagccctcccctaagcagcagccgctcgagccgggagaggccgccctccatagcgactcacaagatggccatcagatggcacttctgaacttcttctttccggacgagaagccgtactcagaggaagaatcgaggagagtgcgccggaacaaacggtcgaagtcgaacgaaggagcggatggaccggtcaagaataagaagaaaggaaagaaagctggcccgcccggtccgaatggacctcccggcccacccgggccaccgggcccgcagggcccgccaggcatcccaggaatccctggaatcccgggaactaccgtgatggggccaccagggccccccggacccccgggtccacagggacctccaggcctccagggcccctcgggggccgcagacaaggcaggcacgagagaaaatcaaccagcagtggtgcacttgcagggacaaggatccgccatccaggtcaagaatgatctgagcggaggcgtgctgaacgactggtcgcgcatcactatgaatccaaaggtctttaagctccacccacgctcgggcgaattggaagtcctggtcgacggtacctacttcatctattcgcaggtctactacattaacttcactgattttgcgtcatacgaggtggtggtggacgaaaagccatttctgcagtgtacccgctccatcgaaaccggaaagactaattacaacacctgctacaccgcaggcgtgtgcctcctgaaggcccgccagaagatcgcagtgaagatggttcacgctgacatcagcatcaacatgtccaaacataccactttctttggggccatccgtctgggggaggcccctgcatcc

SEQ ID NO: 10756 - DNA, 1167 bp, Artificial Sequence
  Description of Artificial Sequence: Synthetic coding sequence
atgggttacccggaagtagagcgccgcgaactgctgcctgctgccgcgccgcgcgagcggggtagtcagggttgtggttgtggaggcgctccggctcgggctggcgaaggaaacagttgcttgttgttcttgggctttttcggtttgtccctggcactgcacctgttgaccctgtgctgctacttggagctgcgcagcgagctgcgccgtgagcgcggtgccgagagccgcctcggcggctccggtaccccaggcaccagcggcacgctgtctagcctcggtggactggacccagacagcccgattacctctcacttgggacagccgagccctaagcaacagccgctagagccaggagaagctgcccttcattctgactcacaagacggccaccagatggctctgctaaactttttcttccccgacgaaaaaccatactccgaggaagagagccggcgcgtccgtcgtaacaaacgctctaagtctaatgagggcgccgatggccctgtgaagaataaaaaaaaaggcaaaaaagcgggtcctccaggtccaaatgggccaccaggtccacctggcccccctggtccgcaaggtccgccagggatcccgggaattcctggcattcctggcacgactgtgatgggtccaccgggacctccggggccgcctggccctcaggggcccccgggactgcagggtccatcgggagcggccgacaaggcgggcacacgcgaaaaccagccggccgtcgtccatctgcaagggcaggggtcggctattcaggtaaaaaacgacctgagtggtggagtcctgaacgactggtctcgcattaccatgaatccgaaagttttcaaactgcacccacggagcggcgagctagaggtcttggtagacggtacctatttcatctatagccaggtgtattacataaatttcaccgatttcgctagctatgaggttgtcgtggatgaaaaaccgttcctgcaatgtacgcgcagcatcgagaccgggaaaacaaactataatacctgctataccgccggcgtgtgtttactgaaggcgcgccagaagatcgcagttaaaatggtgcatgccgacatctcgattaatatgagcaaacacacgacgtttttcggcgccattcgcctgggtgaagctccggctagc

SEQ ID NO: 10757 - DNA, 1167 bp, Artificial Sequence
  Description of Artificial Sequence: Synthetic coding sequence
atgggctaccctgaagtggaaaggagagagctgcttcctgctgccgccccgcgtgaacgcggcagccaaggttgtggatgcggaggtgcacctgccagggcaggagaaggtaactcatgcctccttttcctgggtttctttgggctgtcgctcgcgctgcatcttctgactctgtgttgttacctcgaactgcggtccgaactgagacgtgagaggggagccgaatcccggttgggagggagcggaactccaggcacttcgggcaccctgtcctcactgggaggactcgacccagactccccaattacctcccatctcgggcaaccttccccaaaacagcaaccacttgagcctggggaagcagccctgcattcggattcgcaggatggacatcaaatggcactccttaacttctttttcccagatgagaagccctactccgaggaagaaagcagacgtgtgagacgcaacaaaagaagcaagtcgaacgaaggtgctgatggcccagtcaagaacaagaaaaaaggtaagaaggccggacctcccggcccaaacggcccaccgggccccccagggccaccagggccacaaggtccaccaggaatcccaggaatccccggaataccaggcaccacggtaatgggaccacctggccctcctgggccccctggtccgcagggcccacctggtttgcagggtccaagcggagccgccgataaggcagggactagggaaaatcaaccggctgtggtgcacctccagggacagggtagcgcaatacaggtcaagaacgacctctcagggggagtgcttaacgattggtcccgtatcactatgaatcccaaggtgttcaagctgcatcctcggtccggcgagcttgaagtccttgttgatggtacctactttatctactcgcaagtgtactacattaactttactgattttgcctcatacgaggtggtcgtcgatgagaagcctttcctgcaatgtactcggtcaattgaaactggcaaaactaactacaacacctgttacactgcgggggtgtgcctgcttaaggcacgccaaaagattgcagtcaagatggtgcacgccgatatctccatcaatatgtccaagcataccacgttctttggtgcaattcgtcttggagaggcccctgcttct

SEQ ID NO: 10758 - DNA, 1167 bp, Artificial Sequence
  Description of Artificial Sequence: Synthetic coding sequence
atgggttaccctgaggtggagcggcgagagctgcttccggcggctgcacctcgcgagcgcggatcgcaaggatgtggatgtgggggagccccggcccgcgcaggcgagggaaatagctgtctcctttttctcggattcttcggactgtcgctggccctgcatctgctgaccctgtgttgttatttggagttgagatcagagctcaggagggagcgcggggcagaatccaggttgggaggtagcggaaccccggggacttccggaaccctgtcgtcgctgggaggactggacccagattcgccgatcacctcgcacctgggacagccaagcccgaaacagcagcccctcgaaccgggcgaagccgcactgcatagcgacagccaggatggacaccagatggccctgttgaatttcttcttcccggacgaaaaaccgtacagcgaagaagagtcgcgccgggtgcggcggaataagaggtccaaaagcaacgaaggggcggatggaccggtcaaaaacaagaagaagggaaagaaggccggcccacctggtcctaacggtccgccgggaccgccgggcccacccggtccacaaggacccccaggaatcccaggcattccgggaatccctggaactaccgtgatgggcccgccagggccaccagggcccccgggaccccagggaccaccagggcttcaggggccgtcgggcgcggccgataaggcaggaaccagagagaatcagcccgcagtggtgcatctgcaagggcaaggaagcgccatccaagtgaagaacgatttgagcggcggagtgctgaatgactggagcaggatcacgatgaaccctaaagtgttcaagctgcacccgcggtctggcgaactggaggtgctggtggatggcacttacttcatctactcgcaggtctactacatcaacttcaccgacttcgcgtcatatgaagttgtggttgacgaaaagccgtttctgcagtgtacccgctcgattgaaaccggtaagaccaactacaatacttgctacactgccggtgtgtgcctgctcaaggcgcgccagaaaatcgcagtcaagatggtccacgccgatatcagcattaacatgtcaaaacacactactttcttcggagccatacgcctgggagaagcgccagcctcc

SEQ ID NO: 10759 - DNA, 1167 bp, Artificial Sequence
  Description of Artificial Sequence: Synthetic coding sequence
atgggttacccggaagttgaaagaagggagctgctccccgcggccgctcctagggagcggggcagtcagggttgcgggtgcggaggtgcacctgcccgcgccggagagggtaactcttgccttctgttcctgggtttcttcggcctctctctcgcgttgcacctacttacgctgtgttgttaccttgaactcagaagcgaacttagacgagaacggggcgccgagagtaggctgggcgggagcggcaccccagggacgagtggaacgctctcgtctctggggggcctggaccctgacagccctataacaagccacttagggcagccctctcccaagcagcagcccttagagcccggcgaagctgcattacactcagactcccaagacggtcaccagatggccctgcttaatttcttctttcccgacgaaaaaccttatagcgaagaagaatcacggcgagtgcggagaaacaaacgatctaaaagtaacgaaggtgctgatggaccggtgaagaataagaagaaaggcaaaaaggcagggcccccgggcccgaatgggcctccaggcccccccggacctccaggaccccaaggccccccaggcatccctggcatacctggcattcctggcacaactgttatgggaccacccgggccgcctggaccaccagggccacagggtccccctggtctgcaggggccgagcggcgccgctgataaagctggcactagggagaaccaacccgccgtcgtgcacctgcaggggcagggctctgcgatccaggtgaagaacgatctgtccggcggagtactgaatgattggtctcgcatcactatgaacccaaaagtcttcaaacttcacccacgaagtggtgagctggaggttttggtagatggcacgtacttcatatatagtcaggtgtattatattaactttaccgatttcgcatcctacgaagtcgtggtggatgagaagccattccttcagtgtactcggagtattgaaactggtaaaaccaattacaatacgtgttataccgctggtgtctgccttctgaaagctaggcagaaaatcgctgtgaagatggtccacgcagatataagtatcaatatgagtaaacatactacattttttggtgctatccggctcggtgaggcacctgcctca

SEQ ID NO: 10760 - DNA, 1167 bp, Artificial Sequence
  Description of Artificial Sequence: Synthetic coding sequence
atgggatacccagaagtcgaaaggcgagagctgctcccggctgccgcaccccgggagagggggagtcaaggctgtggctgtggaggggcaccggctcgcgcaggtgaaggaaactcctgtctgctgtttctgggatttttcggcctatctctggctcttcaccttctcactttgtgttgttacttggagttaagatccgagttgcgcagagaaagaggtgccgagagccggctggggggatctgggacaccaggtacttctgggactctttcctcactggggggtctggatccagatagtccaattacgtcacacttaggacaaccgtcaccaaagcagcagcctctggagcctggggaagcagccctccacagtgactctcaagatgggcaccagatggcccttctgaattttttctttccagatgagaagccgtactccgaagaggagtcacggagggtgcggcgcaataagcgcagtaagtcgaacgaaggggcagacggtcctgtcaaaaacaaaaaaaagggtaagaaagctggtcccccaggccccaacggccctcctggaccaccaggacctccaggtcctcaggggccccctgggatcccaggtattccaggaatccccggcaccacagtgatgggacctccaggacctcccggacctcccggaccccaaggaccacctggcctgcagggtccaagcggagccgccgataaagctggcacacgggaaaatcaaccagcagttgtgcatcttcagggccagggctctgccatacaggtaaaaaacgatctgtctggaggcgtgctgaatgactggtctcggatcacaatgaaccccaaggtctttaagctccacccccgcagcggcgagcttgaagtgctcgtcgatggcacatatttcatttactcgcaggtgtattatattaacttcactgacttcgcctcctacgaggtggtggttgacgagaagccattcttgcagtgcacccgctctattgagactgggaagactaattataatacatgttacacggctggggtctgtctcctgaaggcgcgacagaagatcgccgtcaaaatggtgcatgccgatatttcaatcaacatgtctaagcataccactttctttggtgctatccgattgggtgaggcccccgcctcc

SEQ ID NO: 10761 - DNA, 1167 bp, Artificial Sequence
  Description of Artificial Sequence: Synthetic coding sequence
atgggctaccctgaagtagaaaggcgggagttgcttccagctgctgcacctcgggagcgcggcagccaaggctgcggctgcggtggcgcgccagctagagccggcgagggcaatagctgccttctgtttcttgggttcttcggattgtcactggcgctccacctgctcacgctttgttgctatctggaactgcgttctgagctcagaagagagcgaggcgcagaatctcggcttggcggatccgggacccctggtactagcggtacccttagtagcctcggtggcttggatcctgactcccctattacctctcatctgggccagcctagccccaaacagcagccactggagcccggcgaagccgccctgcactcagattcgcaggatggccatcagatggccctgttaaacttctttttcccggacgagaaaccttacagtgaagaggaatctcggagagttcggagaaataagcgatccaagagcaacgaaggcgccgacggtcccgtgaaaaacaagaaaaaggggaagaaggcgggcccacccggtccaaacggccctccaggcccacccggccctcctggccctcaggggcctccagggatcccaggcattcctgggatcccaggtactactgtgatggggccccccggcccccccggccctcctggcccacagggacccccaggactgcaggggccaagcggtgcagctgataaggcagggactagggaaaaccaacctgctgtagtacaccttcaggggcagggatcagcaatccaggtgaaaaatgacttgtcaggaggagtactcaacgattggagcaggattacaatgaatcccaaagtattcaagcttcatccccgctccggggaactggaggtgctggtggatgggacctactttatttattcccaggtatattatataaattttacagacttcgcctcctatgaggtggttgtggatgaaaagccatttttacagtgtacaagatctatcgaaacaggcaagactaactacaatacttgctacacggctggtgtatgcctgctgaaggctcgacagaaaatcgccgtgaagatggtgcacgctgacatcagcattaatatgagcaaacataccacattcttcggggctatcagactgggcgaggcacccgcatcc

SEQ ID NO: 10762 - DNA, 1167 bp, Artificial Sequence
  Description of Artificial Sequence: Synthetic coding sequence
atgggttacccggaggtcgagcggagagagttgctgccagcagcggctccgcgcgaacgcggctctcagggctgtggttgcggcggcgcacctgccagagcaggagagggtaatagctgtttgctgttcctgggtttcttcggactgagtctggccctgcatctcctgacactgtgctgttaccttgagctgcgtagcgaactgaggcgtgagagaggagcggaatcccgcctgggtggatccggcacaccgggcacaagtggtaccttgtcctcgctgggtggacttgatcccgactcgccgataacgtctcacctgggccaaccgagcccgaagcagcagccactcgagccaggcgaggctgctctgcacagtgactcccaggatggacatcaaatggccctgctgaactttttcttcccggacgaaaagccatactcggaggaggaatctcgcagagtgcgccgtaataaacgaagcaagtcgaacgagggcgccgatggaccagtgaagaacaagaaaaagggcaagaaagcgggacccccgggcccaaatggtccgcccggaccacctggcccgcccggcccccagggtcccccaggaatccccggcatacccggtattcctggcacgactgtcatgggtccacccggtcccccgggtccgcccggaccccagggccctcccggccttcagggaccttccggagcagccgataaggctggcacacgagagaaccaacccgccgtggttcatctgcagggccaaggatccgccattcaagtgaagaacgatctgagtggcggtgtgctcaatgactggtctcgtataactatgaatcccaaggtgttcaagttgcacccgcgcagcggtgagttggaggtgcttgttgacgggacatatttcatctattctcaggtatactacattaactttacagatttcgctagttacgaggtggttgttgacgagaaaccgtttttgcagtgcacgcgcagcatcgaaactggtaagactaactataatacgtgctacacagccggggtgtgtttgcttaaagcgcggcagaagatcgccgtaaagatggtgcatgcggacatatccataaatatgagcaaacatactaccttttttggcgccatccgcctaggcgaggctccggcttcg

SEQ ID NO: 10763 - DNA, 1167 bp, Artificial Sequence
  Description of Artificial Sequence: Synthetic coding sequence
atgggctaccctgaggtcgagcggagagagctgctgcctgcagcagccccacgtgagcggggatcgcaggggtgcggatgcggcggcgcccctgctcgcgccggagagggcaattcctgcctcctcttcctgggcttcttcggtctgagcctggcgttgcatttgctgactctgtgttgctacctggagctcagatccgaattgcgcagggagcgcggagcggaatcacgcctgggaggatccggtactccgggtacctcgggaaccctcagctccctgggcggacttgacccagattcccctattactagccacctcggacagccatccccgaagcagcagccgctggaacccggtgaagcggccctccacagcgattcgcaagacggccaccagatggcactgctgaacttcttctttcccgatgagaagccgtactcggaagaagaatcgagacgggtgcgccggaacaagaggtccaaaagcaatgaaggcgctgacgggccagtgaagaacaagaaaaagggtaagaaggccggaccgccgggccctaatggaccgccaggacctccgggtccgccaggtcctcagggaccgcccggaatccccggaattccaggaatcccaggaaccaccgtgatgggcccgcctggacccccgggtccccctggtccacagggaccgcctggtctgcagggaccatccggagccgcagacaaggcgggaactcgggaaaaccaacccgcggtggtgcatcttcaaggccagggatccgccatccaggtcaagaacgatctttccgggggcgtgttgaacgactggtcgcgcatcactatgaaccctaaggtattcaagctgcatcctcggtcaggcgagttggaggtcctcgtcgacggaacctacttcatttactctcaggtgtactacatcaacttcactgactttgccagctacgaagtggtcgtcgacgagaagccttttctgcagtgcaccagatcgatcgagactggtaaaaccaattacaacacgtgctacactgcgggggtctgcctccttaaagcgcggcagaagatcgctgtgaagatggtgcacgccgatatctcgatcaatatgtcgaagcacaccacttttttcggtgcaatccggctgggagaagcgccggcctcc

SEQ ID NO: 10764 - DNA, 1167 bp, Artificial Sequence
  Description of Artificial Sequence: Synthetic coding sequence
atgggttacccagaagtggagaggcgggaactcctgcccgcagcagcaccccgagagcgtggctcgcagggatgcggatgtggaggagcacctgcacgggcaggggaaggaaacagctgcctgctgtttttgggttttttcggactttccctggccctgcacctcctgaccctttgttgttacctggaacttagatcagagctgcgccgcgaaagaggagcggaaagccggctcggcggttcgggaacccctggcacctcgggaacgttgtcatcacttggaggcctcgaccctgattcgcccattacttctcatcttggccagccctcccctaaacaacagccactggagcccggtgaagcggcccttcattcagactcccaggatggtcaccaaatggcactgcttaacttcttcttccctgatgaaaagccttacagtgaggaggagagcaggagagtgaggagaaacaagcgttcgaaatccaatgagggcgcagatgggccggtcaagaacaaaaagaagggcaagaaggcgggccctccaggtccaaatggtcctccaggcccacctggaccacctggacctcaaggaccgcctgggattccaggcattccaggaattccgggtaccactgtgatgggtcctccaggacctcccgggccccccggacctcagggtccacccggactgcaaggaccctcgggagccgcagacaaggcagggaccagagagaaccagccagctgttgtgcatctgcagggtcagggatcagcaatccaagtgaagaacgacctttctggtggtgtgctgaatgattggtctaggattacgatgaacccgaaagtattcaaattgcatccccgatcgggtgaacttgaagtgctcgtggacggcacctatttcatatactcgcaagtgtactacattaacttcaccgattttgccagctacgaagtcgtcgtggatgaaaaaccttttcttcagtgtactcgatcaatcgaaactggaaagaccaattacaacacctgttacactgcaggagtgtgccttctgaaggcacgccaaaagatcgccgtgaagatggtgcatgcggatatttcgattaacatgtctaagcacactaccttctttggtgctatacggcttggtgaagcacccgcctcg

SEQ ID NO: 10765 - DNA, 1167 bp, Artificial Sequence
  Description of Artificial Sequence: Synthetic coding sequence
atgggctaccctgaagtggagcgtagagaattgctgcctgccgcagcaccacgagaaagaggaagccaggggtgcggctgcgggggagctcctgctcgagccggagagggtaacagttgtctcctcttcctgggattctttggactgtcccttgctttacacctgctgaccctgtgttgttaccttgaactgaggagcgaactaaggcgagaacgaggagcggaatcccgactgggcggaagcggaaccccggggacctccggaactcttagttctctgggcggcctagatcctgattcacccatcacctcacatctcggccagccgagcccaaaacagcagcctctggaaccaggggaagccgcgttgcactcagactcacaggacgggcaccaaatggcattgctgaatttctttttccccgatgagaagccatattcggaagaggaatctcgtcgcgtacgtcggaataagcgatccaagagcaatgagggcgccgatgggccggtgaagaataagaaaaaaggaaaaaaggcgggccctccaggacctaacgggcctcccggacctcccggcccgccgggccctcaggggccccccggcatccctggcatccccgggatcccgggtaccactgtgatggggccgccaggtccccccgggccaccggggccccaggggccccctggccttcaggggccctctggtgcggcggacaaagctggcactagagaaaatcaacccgccgtagtgcacttgcagggccagggatccgcaattcaggtcaaaaatgatttgtccggcggggtccttaacgactggagtcggattaccatgaaccccaaggtttttaaattacacccccgaagtggggagctcgaggtgctggtcgatgggacatatttcatttactcccaggtctattacattaactttaccgatttcgcatcctatgaagtggtggtggatgaaaaacccttcctgcagtgtaccaggtctatagaaacaggaaagacgaactataacacatgctatacagccggagtctgtctccttaaggcgagacaaaagatagctgtcaagatggtgcatgccgatatttcaattaatatgagcaagcacacaacatttttcggtgccatccgcctcggagaggcccctgctagt

SEQ ID NO: 10766 - DNA, 1167 bp, Artificial Sequence
  Description of Artificial Sequence: Synthetic coding sequence
atgggctacccggaggtggagcggcgggaactgctgccagccgcggctcctagggagagaggatcccaaggatgcggctgcggcggcgccccagctagagcaggagagggcaactcatgcttgctctttctgggattctttggcctctctctcgccttgcacctgctgactctctgttgctacctcgaactccgctcagagctgcggcgcgaaaggggcgcggagtctcggttgggaggttccggcaccccgggaacttcaggaaccctgtcaagcctgggaggactcgaccctgactccccgattacgtcccatttggggcagccgagccctaaacagcagccgctcgaaccaggagaagctgccctgcactccgactcgcaagatggccatcagatggcccttctcaacttcttttttccagacgaaaagccgtactccgaagaagaatcacgccgcgtccgaaggaataaacggtcgaagtcgaacgaaggagctgatggaccagtcaagaataagaaaaaaggcaaaaaggccgggccacctggacccaatggaccgcctgggcctcctggaccgccgggcccgcaaggcccacctggaatcccaggcatccccggtatcccagggaccaccgttatgggcccgcctggaccaccagggcccccagggccgcaaggacccccagggctgcaagggccttcaggggcagcggataaagccgggacccgcgaaaaccaaccggcagtggtgcacttgcaagggcagggaagcgccatccaggtgaagaatgacttgtcaggaggtgtcctgaacgattggtcccggattactatgaacccaaaggtgtttaagctccatccacggtcaggcgagctggaggtgctcgtggacggcacttacttcatctactcgcaggtctactacatcaacttcactgattttgcgagctacgaggtggtggtggatgagaaaccgtttctgcaatgcacccgatcgatcgaaaccggaaagacgaattacaacacctgctatactgccggagtctgcctcctgaaagcacggcaaaagatcgcagtcaagatggttcacgccgacatctcgatcaatatgtccaagcacaccactttctttggcgctattagactgggtgaggccccagcctca

SEQ ID NO: 10767 - DNA, 1167 bp, Artificial Sequence
  Description of Artificial Sequence: Synthetic coding sequence
atggggtatcccgaggtcgagcggcgagaactacttcccgccgcagcaccacgggaacggggatcccagggatgtggatgtgggggggcccctgctagggccggggaaggaaacagttgtctcttgttcctgggattttttggattgtccctagccctgcatttgttaactttatgctgttatttggaactgcgctctgaattgagaagagaaaggggagcagaatctcggctcggaggatccggaactcctgggacttccgggacactgtcctctctcggagggctagatccagattcacccataacatcacacttaggacagccctcacctaaacaacagcccctagaacccggggaagccgccttacactcagattcacaggatggacaccagatggcacttctcaacttttttttccccgatgaaaaaccctatagtgaagaagaatcccgacgggtcagacgcaacaaaagatctaaaagtaacgagggggctgatggacctgtcaaaaataaaaaaaaaggaaaaaaagcggggccccctgggcccaacgggccccctgggccacccggacctcctgggccccagggacctcctgggatacccggaataccagggatcccagggacaacagtgatgggacctccaggacctcccggacctcccggaccccaggggcctcccgggcttcagggaccctctggggccgccgataaagcagggactcgagaaaatcagcccgctgtagttcatctgcagggacagggatcagccatccaagtcaaaaacgatttatctgggggagttctcaacgactggtctaggataactatgaatcctaaagtgttcaaattacacccgcggtcaggagagcttgaagtgctcgtggatgggacatacttcatatattctcaagtttactatataaattttacagattttgcctcctatgaagtcgtcgtggacgaaaagcccttcttacagtgtacacgaagtatagaaacaggaaaaacaaattataatacttgttatactgctggagtctgtcttcttaaggcccgacagaaaatagctgtcaagatggtgcacgcggacatcagtattaacatgtcaaagcatactactttttttggggctattaggctgggggaagcacctgcttcc

SEQ ID NO: 10768 - DNA, 1167 bp, Artificial Sequence
  Description of Artificial Sequence: Synthetic coding sequence
atgggttaccctgaggtcgaacgccgcgagctgctgccagccgctgcgccccgggaacgcggatcgcagggttgcgggtgtggaggcgcccctgcacgcgctggtgaaggcaactcgtgcctcttgttcttgggtttctttggactgtccctggcgctgcacctcctcacgctgtgctgctaccttgagcttcggtctgagctgcggcgagagagaggcgctgaatcaaggctcggcggttccggcaccccgggcacctcggggactctgagctcactgggcgggctggacccagattcacctataacttcacacttggggcaacccagccccaagcagcaacctctcgagccaggagaggccgccctgcactcggactcacaagacggacatcagatggcactgctcaactttttcttccccgacgagaagccgtactcagaggaggagtctcgccgcgtgcggcgcaataaacggtccaagtccaacgaaggagcggacggccctgtcaaaaacaagaagaaggggaagaaggctgggccgcccggaccgaacggaccaccgggtcctccggggccacccggaccgcagggaccaccgggaattccgggaatcccaggcatccctggcaccaccgtgatgggaccaccagggccgccagggccgccggggccccagggaccgccgggcttgcaaggaccgtccggagccgctgataaggctggtacccgggagaaccagccggcagtggtgcacctgcagggacagggatcggcaatccaggtgaaaaacgacctttccgggggtgtcctcaacgactggtcccggatcactatgaatccgaaggttttcaaacttcacccgaggtcgggcgaactcgaggtgctggtggatggaacttacttcatctactctcaggtctactatatcaacttcactgacttcgccagctacgaagtggtcgtggatgagaagccgttcctgcagtgcactcgctcgatcgaaactggcaagactaactacaatacctgttacaccgccggcgtgtgtctcctcaaggcacggcaaaagatcgccgtcaagatggtgcacgcagatatatcaatcaacatgtccaagcataccaccttctttggcgcaattcggctcggagaagcgccggccagc

SEQ ID NO: 10769 - DNA, 1167 bp, Artificial Sequence
  Description of Artificial Sequence: Synthetic coding sequence
atgggctatcccgaagtcgagcggcgtgaactactcccagcggcggccccccgagagaggggttcccaggggtgtgggtgcgggggtgcccctgctcgggcaggcgaaggaaacagctgtctgttatttttggggtttttcggcctctcactcgctctccacctgctcactctgtgttgctatctggaacttcgttcagagctcagacgtgaacgaggtgctgagtcccgcctcggggggtcagggactccggggacctccggcactctgagtagcctaggcgggctagaccctgacagtcctatcacaagccacctgggccagccaagtccgaagcagcagccactggaaccgggggaggctgcactgcacagcgacagccaggatgggcatcaaatggcgctactgaacttcttttttcccgacgaaaagccctactccgaggaagaatccaggagggtgaggcgaaacaaacgatccaaatctaacgaaggggctgacggcccagtgaaaaacaaaaaaaaaggtaagaaagctggacctccaggaccaaacgggccacctggccccccaggccccccaggaccccagggtcccccaggtatcccaggaattcctggcataccaggcactacggttatgggcccacccggtccccccgggcctcccggcccacaaggcccccctgggttgcagggaccgagtggggccgccgataaagccggaactagggaaaaccagccggcagtagttcatctgcaaggacaaggctctgcgatccaggttaaaaacgatcttagtggcggtgtgctgaatgattggtctcgtattacgatgaaccctaaggtgtttaagttgcacccacgctctggagaactcgaggtgcttgtggacggtacatacttcatctatagtcaggtttattatatcaactttaccgacttcgcttcttatgaggtggtggtagatgagaagcccttcttgcagtgtacacgttccatagaaaccgggaagaccaactacaacacctgttatacagcaggggtgtgtctgctgaaggcacggcagaaaattgctgtgaagatggtccatgctgatatctccattaacatgtcaaaacacacaacctttttcggggcaattcggctgggtgaggcacccgctagt

SEQ ID NO: 10770 - DNA, 1167 bp, Artificial Sequence
  Description of Artificial Sequence: Synthetic coding sequence
atgggatacccagaggtggaacggcgcgagctcctgccggctgcggccccgcgcgaacgcggcagccagggttgcggatgcggcggagcccccgcgagagccggcgaaggaaatagctgcctgctgttcctgggtttcttcggattgtccctggccctgcacttgcttaccctctgctgttacctggaactccggtcggagctgcgtcgcgagcgcggagctgagtcaaggttgggtgggagcggaaccccggggacctcaggaactctctcgtcgctgggaggcctggacccagactcccctatcaccagtcatcttgggcagccgtccccaaagcagcagccactcgaaccgggcgaagccgctcttcactccgattcgcaggacgggcaccaaatggctcttctcaactttttctttccggatgaaaaaccctacagcgaagaggagtcgcggagagtgcgccgcaacaagcggtcaaagtcaaatgaaggcgctgacgggcccgtgaagaacaaaaagaaaggcaagaaagcgggcccgccgggacccaacggaccccctggaccgcccgggcctccgggccctcaaggaccgcctggcatccctggaatacccggcatcccggggaccaccgtcatgggaccgccgggaccaccggggccccccggaccgcagggaccaccagggttgcaaggaccgtcaggtgccgccgataaggccggcaccagagagaaccaaccagccgtcgttcatctccaaggccagggatcggcgatccaggtgaagaacgacctgagtggaggggtgctgaacgactggtcgaggattacgatgaaccctaaggtgttcaaactccatccacggtcgggggagctcgaagtgctggtcgacggaacctacttcatctactcacaagtgtactacatcaatttcaccgattttgcatcttacgaggtggtggtcgacgagaagccgttcctgcagtgcaccagatccatcgaaacgggaaagactaattacaacacttgctatactgcgggagtctgtctcttgaaggcgcgccagaagatcgccgtgaagatggtccacgcggacatatccatcaatatgagcaaacacaccactttcttcggggctatcagactgggcgaagccccggcctcg

SEQ ID NO: 10771 - DNA, 1167 bp, Artificial Sequence
  Description of Artificial Sequence: Synthetic coding sequence
atgggttatccggaagttgaacgtcgtgaattactaccggcggcggcgccgcgagaacgtggttcgcaaggttgtggttgtggtggtgcgccggcgcgagcgggtgaaggtaattcgtgtctactatttctaggtttttttggtctatcgttagcgctacatttattaacgctatgttgttatctagaattacgatcggaactacgtcgtgaacgaggtgcggaatcgcgtttaggtggttcgggtacgccgggtacgtcgggtacgctatcgtcgctaggtggtttagatccggattcgccgataacgtcgcatttaggtcaaccgtcgccgaaacaacaaccgctagaaccgggtgaagcggcgttacattcggattcgcaagatggtcatcaaatggcgctattaaattttttttttccggatgaaaaaccgtattcggaagaagaatcgcgacgtgtacgtcgtaataaacgatcgaaatcgaatgaaggtgcggatggtccggttaaaaataaaaaaaaaggtaaaaaagcgggtccgccgggtccgaatggtccgccgggtccgccgggtccgccgggtccgcaaggtccgccgggtataccgggtataccgggtataccgggtacgacggtaatgggtccgccgggtccgccgggtccgccgggtccgcaaggtccgccgggtttacaaggtccgtcgggtgcggcggataaagcgggtacgcgagaaaatcaaccggcggttgtacatttacaaggtcaaggttcggcgatacaagtaaaaaatgatttatcgggtggtgtattaaatgattggtcgcgaataacgatgaatccgaaagtatttaaattacatccgcgttcgggtgaactagaagttttagttgatggtacgtattttatatattcgcaagtttattatataaattttacggattttgcgtcgtatgaagtagtagtagatgaaaaaccgtttctacaatgtacgcgttcgatagaaacgggtaaaacgaattataatacgtgttatacggcgggtgtttgtttattaaaagcgcgtcaaaaaatagcggttaaaatggtacatgcggatatatcgataaatatgtcgaaacatacgacgttttttggtgcgatacgtttaggtgaagcgccggcgtcg

SEQ ID NO: 10772 - DNA, 1167 bp, Artificial Sequence
  Description of Artificial Sequence: Synthetic coding sequence
atgggatatccggaagtcgaacgaagagaactcctcccggccgcagctccgagggagagaggcagccaagggtgtggatgtggaggcgcccctgcccgggctggagagggcaattcatgcttgctttttctggggttttttggactgtcgctcgccttgcacctcctgactttgtgctgctatctcgaactgcggagcgagcttagaagagagcgcggcgccgaatcacgcctgggcggaagcggaaccccgggaacctcaggtacgctgtcatccctgggtggactggaccctgacagcccgattacgagccacttgggccaaccctcgccaaaacagcagccattggaaccaggagaggccgcactgcattcggattcgcaggacggacatcagatggctctgctgaatttctttttcccggatgaaaagccatactcggaagaggaatcacggcgcgtgcggcggaataagcgttcgaagtccaatgagggcgcagatggacccgtgaagaacaagaagaaggggaagaaagcaggtccgcctggtccaaacggccccccgggcccaccaggaccgccgggtcctcagggaccaccgggcatccctggcatcccggggatcccaggcaccaccgtcatgggccccccaggaccccccggtcctccagggccccagggcccgccggggctccaaggaccatccggcgcggcggacaaggccgggactagggaaaaccaacccgccgtcgtccacctgcagggacaaggctccgcaatccaagtcaaaaatgatctgagcggaggggtgctgaacgactggtcccggatcactatgaatccaaaggtgttcaagctgcatccccgctcaggagaactcgaagtgctggtggacggtacttactttatctacagccaggtgtactacatcaacttcactgactttgcatcgtacgaggtcgtggtggacgagaagccttttctccaatgtactcgaagcatagagacgggaaagaccaattacaacacttgttacactgccggggtgtgcctgcttaaggctcgccaaaagatcgcagtgaagatggtccatgcggatatctctatcaacatgtccaagcacactacttttttcggagctatcagactgggcgaggctccggccagc

SEQ ID NO: 10773 - DNA, 1167 bp, Artificial Sequence
  Description of Artificial Sequence: Synthetic coding sequence
atgggatacccggaggtcgagaggcgggagcttttgccagctgcagcacctagagaaagaggaagccagggttgtgggtgtggcggtgcccccgccagagcaggagaaggaaattcgtgtctcctcttcctgggcttttttggacttagccttgcactgcatcttctgacgctttgttgttacctggaacttcgatcggagctgagaagggagcgaggagcggagtcacggcttggtggttccggtacccctggtacttcgggtaccctcagctcgcttggtggactggatcctgattcgccgattacgtcccatctgggccagccatcaccaaaacagcaaccacttgaaccgggggaggcggcgcttcatagcgatagccaggacgggcatcagatggcacttcttaacttcttctttccggatgaaaaaccttacagcgaagaagaatcgaggcgcgttcggcgcaataagcggtctaagagcaatgagggtgcagacggtcctgttaagaacaaaaagaaggggaagaaggcaggccctcctggacccaacgggccacctggcccaccaggacctcctggacctcagggacctcctggtattcccggtattccaggaataccaggcaccaccgtgatgggtccccctggtcctcctggaccacccggacctcaaggtcctcccgggcttcagggtccatcgggagccgcagataaggcaggaacccgcgaaaaccaacccgcagtcgtccaccttcaaggccagggaagcgcaatccaggtgaagaacgatttgtccggaggtgtgctgaatgattggagccggataaccatgaaccctaaggtgttcaagttgcatccccgatccggagaactggaagtgcttgtggatgggacctacttcatctattcccaagtgtactacatcaactttacggattttgcctcatacgaagtggtggtcgacgagaaaccttttctccagtgtacccgctcgatcgaaaccggtaagactaactacaacacttgttacaccgccggggtgtgccttcttaaggctagacaaaagattgcagtcaaaatggtgcacgcagacatttctatcaatatgtccaaacacaccaccttttttggcgcaattagactgggggaagcacctgcctca

SEQ ID NO: 10774 - DNA, 1167 bp, Artificial Sequence
  Description of Artificial Sequence: Synthetic coding sequence
atgggctatcctgaggttgaacgccgcgaactcctcccggccgccgcacccagagaacgtggtagccagggatgcgggtgtggaggggctcctgcacgcgccggggaagggaattcgtgcctactttttctaggttttttcggtctttccctcgctctccaccttctgacactgtgctgttacctggaactccgttcagagctacggcgtgagcggggtgctgaaagtcgcttaggaggctcgggaacccccggaacttcgggcactcttagttccctcggtggtctggatcctgattctccgatcacatcccatctaggacagccctctcctaagcaacagccactcgaacccggtgaagcagccctgcatagcgactctcaggacggacaccaaatggctctgttgaatttcttctttcctgacgaaaagccatattcagaggaggaatctcgtcgcgtccgtcgcaacaagcgatcgaaatccaacgaaggagccgatgggcccgtgaagaataagaagaagggaaagaaagctggccctccaggacctaatggacctcccggcccgccaggccctccaggacctcagggtccccctggcatcccaggtatcccaggaatcccgggaactacggtcatgggaccgccgggtcccccaggcccgccgggcccccaagggccacccggactccaggggccatcaggtgcagcagataaggctggtacacgagagaaccaacctgctgtggtccatctgcaaggacaaggctccgcaatccaggtaaagaacgacttatctgggggggtgctgaacgattggagtcgtattacgatgaatccaaaagtattcaagctgcatccgagatccggggagctcgaggtattggtggacggcacatatttcatttattcccaggtttactacattaactttactgacttcgcatcttacgaagtggtcgtggacgagaagcctttcctccaatgcaccagatctattgaaacagggaagactaactacaacacctgctacacggctggagtctgtttgctgaaggcccgccagaagatcgccgtcaagatggtacatgccgatatttctatcaatatgagtaagcacacaacatttttcggtgcgattcggcttggtgaagcgccagcttcc

SEQ ID NO: 10775 - DNA, 1167 bp, Artificial Sequence
  Description of Artificial Sequence: Synthetic coding sequence
atgggctaccctgaggtcgagcggcgggagctccttcccgccgccgctcctagggagcgtggctcgcagggttgtggctgcggtggcgcacctgcgcgggcaggagagggtaattcctgcttgctgttcctcggtttctttggtctcagtctggccctccatcttctcactctatgctgctatttggagttgcggagcgagttgcgccgcgagcgtggcgctgagtctcgcctgggtggctcggggacgccgggcactagcggtaccctgtcaagcctgggcggattggatccggattcccccatcaccagccacctaggccagccctcccctaaacagcagcccctcgagcccggcgaggccgcccttcacagcgactcgcaggatggacaccaaatggcccttctgaacttttttttccctgatgagaagccctacagtgaagaggagtcccgcagagtccgccgcaataagcgtagtaagtcaaacgagggcgcggatggcccggttaagaacaagaaaaagggcaagaaggccggtcctcctgggcccaacggcccccccggtccccccggcccccccggcccacaaggtcctcccggcatcccaggcatccccggaatccccggtacaaccgtcatgggacctcctggtccccccggtccacctggcccccagggtcccccaggtttgcagggaccatccggagccgccgacaaggctggcaccagggagaaccagccggctgttgttcaccttcaaggtcaaggctctgctatccaggttaagaacgacctctcgggcggcgtgctaaatgactggtcgagaatcacgatgaatcccaaggtttttaagcttcaccctcgctctggtgagctcgaggtcttggtcgatggaacctattttatctatagccaagtgtactacatcaatttcaccgacttcgcttcttacgaggtcgtcgttgacgaaaagcccttcttgcagtgcacccgctccatagagacaggtaagaccaactacaacacgtgctacaccgccggtgtctgtttgcttaaggcgcgccagaagattgccgttaagatggttcacgctgatatcagcatcaatatgtccaagcacaccacattcttcggcgcaatccgactgggtgaggctccggcgtcc

SEQ ID NO: 10776 - DNA, 1167 bp, Artificial Sequence
  Description of Artificial Sequence: Synthetic coding sequence
atgggataccctgaagtcgaacgaagagaactcttgccagctgctgccccgcgggagcggggatcacaaggatgcgggtgtggaggggcgccagctcgggctggagagggcaatagctgcctccttttccttggattcttcggtctgagcctggctctgcatctgctgaccttgtgctgctacctggagctgcgctcagaactcaggcgcgaacgtggcgcagaatccagattgggagggtccgggactccgggaactagcgggactctctcgtccctgggcggactcgacccggactcccctatcacctcgcatctgggacagccatcgccaaagcagcaaccgcttgagccgggtgaagccgcgttgcactcagactcacaagatggacaccagatggcgctcctgaacttctttttcccggacgaaaagccgtattcggaggaggaatcccggcgcgtcagaagaaacaagaggtccaagagcaacgaaggggcagacggcccggtcaagaataagaagaagggcaagaaagccggaccgcctggccctaacgggccacctggcccgcctggaccgccaggccctcaaggacccccgggaatcccgggtatccctgggatcccgggcactactgtgatgggaccgccaggtccaccgggaccaccaggaccccaaggtccacctggactgcaggggccgtcgggagcagcggataaggccggcacccgggaaaatcagccggccgtggtgcacctccaagggcaaggatcagcgatccaggtgaagaacgacctgtcgggtggagtgctcaatgactggtcgaggatcacgatgaatccgaaggtctttaagttgcaccctcgctcgggcgagctggaggtgctcgtggacggtacctactttatctactcccaagtttactacatcaacttcacggactttgcatcctacgaagtggtcgtcgatgaaaaacctttcctgcagtgtaccaggtccatcgaaacggggaaaaccaactacaacacttgctacaccgcgggagtctgtttgcttaaggcccgacagaagatcgccgtgaagatggtgcacgctgatatctcaatcaacatgtcgaaacatactactttctttggagccattcgcctgggtgaagccccagcgtca

SEQ ID NO: 10777 - DNA, 1167 bp, Artificial Sequence
  Description of Artificial Sequence: Synthetic coding sequence
atgggttatcccgaggtagagcgtagagagctccttcctgcagccgctcccagagagagaggcagccagggttgtgggtgcggtggagcaccagcaagagctggtgaaggcaattcctgtttgctctttctcggctttttcgggctttctctggctcttcacctgctaaccctttgctgttatctggaacttcgctctgagctccgtagggaaagaggggccgaatcaaggctgggaggatccggtacgcccgggaccagcggcacgctttcctcgctcggaggcctggacccagattccccaatcaccagccacctggggcagccaagcccaaaacaacagcccttagaacccggggaggcagcgttgcacagcgatagtcaggacggtcatcagatggctttgttgaattttttctttcccgacgaaaaaccctacagcgaggaagaaagtcggagagtccggcggaataaaagatcaaaaagtaacgagggagcagacgggcctgtgaagaacaaaaaaaagggcaaaaaggccggccctcccggccctaatggcccccctgggccgcctggtccccccggtccccaggggccgcctggcattcctggcatacctggtatcccgggcaccaccgtcatgggtccaccagggccacccggtccacctgggccccagggacctccggggctccagggacccagcggagcagccgataaagctggaacccgggagaaccaacccgcagtggtgcacctacagggccagggcagcgctatccaggtgaaaaatgatctgtccggaggagttctaaatgattggtcaaggattacaatgaaccccaaggtgtttaagctgcatccccgctcgggagagctagaggtgcttgtggatgggacatactttatctacagccaggtgtactatatcaatttcaccgactttgcctcatacgaagtggtagtagatgagaaacctttcctacagtgtacgaggagcatcgaaactggcaaaacaaattataacacttgctacactgcgggggtttgtcttctgaaggcccggcagaagatcgcggtgaaaatggtccatgctgacatctctattaacatgtcgaaacatactacgttctttggagcaataagactgggtgaggcacccgcaagc

SEQ ID NO: 10778 - DNA, 1167 bp, Artificial Sequence
  Description of Artificial Sequence: Synthetic coding sequence
atgggctaccccgaggtggaacgtcgcgaactgcttcccgcagctgcgccccgagaaagaggaagccagggatgtggttgtggtggggcacctgcgcgggcaggagaagggaactcctgccttctgttcctgggatttttcgggctttcgctggccctgcatctcctgaccctgtgctgttaccttgaactgcggtccgagctccgtcgcgaaagaggagctgaatccagattgggaggaagcggtactcctggtacctccggtactctttcgtcccttggtggactggaccctgatagcccgataaccagccaccttggtcagccgtcacctaagcaacagcctctggaaccaggtgaggcagcactgcacagcgacagccaagacggtcatcaaatggcactcttgaacttctttttcccagatgagaagccttacagcgaagaagaatcccggagggtccgtagaaacaaaagatctaagtccaacgagggtgcagatggtccagtgaagaacaagaaaaagggcaagaaagcaggacctcctggtcccaatggacccccaggcccacctggtcctcctggccctcaaggccctcccggtatccccggcattcctggcattccaggcactactgtgatgggtccccctggaccccccggtccccccggtccgcaaggccctccagggctccagggtccatccggtgccgcggacaaggctggtaccagggagaaccagcctgccgtggtgcatcttcagggacaaggctcagcaatccaggtcaagaacgatctctccgggggagtccttaatgattggtcacgtatcacgatgaatcctaaggtgttcaaactgcaccccagatccggagagctcgaagtgctggtggacggaacctacttcatctattcacaagtgtactacatcaatttcacggattttgcttcgtacgaggtggtcgtcgatgaaaaacccttccttcagtgtactagatcgatcgagactggcaagaccaactacaacacctgctatactgcaggagtttgtctcctcaaagcgagacagaagatagcagtcaagatggtccatgctgatatctccattaacatgtcaaagcatactacttttttcggagccattagacttggtgaagctccagcgtct

SEQ ID NO: 10779 - DNA, 1167 bp, Artificial Sequence
  Description of Artificial Sequence: Synthetic coding sequence
atgggatacccggaggttgagaggcgcgaactgctgccagctgcggcgcctcgcgagagggggtcgcagggatgcggctgcggcggcgccccagcgagggccggcgaggggaactcatgtctgctgttcctggggttcttcggactcagcctggccctgcacttgctgactctctgctgttacttggaactgcgctcggaactgagacgcgagcggggagcggaaagccggctgggaggttcaggcaccccaggaacctcaggtaccctgtcgagccttggaggcctggacccggacagcccgataacctctcatctgggtcagccgtccccgaagcagcagccgctcgagccgggagaagctgccttgcactcggactcccaggatggacatcaaatggctctcctgaacttctttttcccggacgagaagccgtactcggaggaagaatcacgccgcgtgcgtcgcaacaaaagaagcaaaagcaacgaaggggccgacggaccggtcaagaataagaagaagggaaagaaagcaggcccgccgggaccgaacggaccgcctggtcctccaggacctccaggcccgcaaggcccgccaggaatcccgggaatccctggaatcccagggacgaccgtgatggggcctcctggacccccaggaccaccgggacctcagggaccgcctggattgcagggaccgtcgggcgcagcagataaggccggaactcgcgagaaccagcctgctgtcgtgcacctccaaggccaaggatcagcaatccaggtgaagaacgacctgtcaggtggagtgttgaacgattggtcccggatcaccatgaaccctaaagtctttaaactgcatccgcggtcaggcgaactggaggtgctggtggacggcacctactttatctattcgcaagtgtattacattaacttcacggacttcgcctcgtatgaggttgtcgtggacgaaaagccattcctccagtgtactcggagcatcgaaactggaaaaaccaactacaacacttgctacactgccggggtctgcctcctgaaggcccggcagaaaattgccgtgaagatggtgcacgccgatatctccatcaatatgtccaaacacactactttctttggggccatcaggctcggtgaggccccagcgtca

SEQ ID NO: 10780 - DNA, 1167 bp, Artificial Sequence
  Description of Artificial Sequence: Synthetic coding sequence
atgggataccctgaagtcgagcgcagagagctcctgcctgcagccgcaccccgggagcgtgggagccagggctgtggctgcggtggagctcccgcacgagcaggtgaaggaaacagctgccttctgtttctgggatttttcggactttcccttgctctgcaccttctgaccctttgttgttacttggaattgaggagcgagctgagacgcgaacggggtgcagaatctcgactggggggatcagggacccctgggacctcgggaaccctgtcgtcgctgggaggacttgatccagactccccgattacttcgcatcttgggcaaccttccccaaagcaacagcctctggaaccaggtgaagccgcactgcattcggattcacaagatggacatcaaatggccctgctcaacttcttctttccagatgaaaagccctactcggaggaagagtcgaggcgggtccgccgtaacaaaagatcgaaatcgaacgaaggtgcagatggtccagtcaagaataagaagaagggaaagaaggcaggcccgcccggaccaaacgggcctcctgggccccccggacctcctggtccacaaggaccaccaggtatccctgggattcctgggatccccggtactactgtcatgggccctcctggaccacccggaccccccgggccgcagggaccgcctggtctgcaaggtccttcgggcgccgctgataaggcagggactagggagaaccagcccgccgtggtccatctccaaggtcagggatcggcgattcaggtgaagaacgatctttcgggtggcgttttgaacgattggagccgaataactatgaatcctaaggtgttcaaacttcacccaaggtcaggcgaactggaagtgctcgtggacggcacgtacttcatatacagccaggtctactacatcaatttcaccgatttcgccagctatgaagtcgtggtggatgaaaagcctttcctccaatgtactcggtcgatcgaaaccggaaaaactaactacaatacttgttacacggcaggtgtgtgcctgcttaaagcgagacagaaaattgctgtcaagatggttcatgcagacatttcaattaacatgtccaagcacaccaccttctttggcgcaatcagactgggagaagcacccgcaagc

SEQ ID NO: 10781 - DNA, 1167 bp, Artificial Sequence
  Description of Artificial Sequence: Synthetic coding sequence
atggggtaccctgaagtcgaaagaagagagctgctgccagcagcagcaccaagggaacgcggatcccaaggttgtggttgcggaggcgcccctgcacgagcaggagaggggaattcctgcctgctgttcctgggttttttcgggctttcgctcgccctccatcttttgaccctgtgctgttaccttgaactgcgatcggagctgagacgtgagcggggagcagagtccagactgggaggttccggtacccctggtacctccggtaccctctcctcgctcggcggactggatcctgacagcccgattacctcacacctgggtcaaccttcacctaagcagcaaccgctggaacctggagaagccgccctccattcagatagccaggatggtcatcaaatggcccttttgaactttttctttccggacgaaaaaccttatagcgaagaagaatcgcgccgcgtgaggcgcaacaagcggtccaaaagcaacgagggagcggatggtccggtcaagaacaagaaaaagggaaagaaggccggtccccccggacctaatgggcctcctggacctcctggccctcccggccctcaaggcccaccaggtattccaggaatccctggaattcccggaactaccgtcatgggccctccgggaccgccaggaccaccgggtcctcaaggacctcctgggctccaaggcccttccggcgccgccgacaaggctggtacccgcgaaaaccaacctgcagtcgtgcatcttcaaggccagggttcagccattcaagtcaagaacgatctcagcggaggagtgcttaacgattggtcccgcatcacgatgaatccaaaagtgtttaaactccatccccgttcgggtgagctcgaagtcctggtcgatggcacgtactttatctactcccaagtgtactacattaactttactgactttgcatcatacgaggtggtggtggacgaaaagcctttccttcagtgtactaggagcattgaaactggaaagaccaactacaacacttgttacaccgctggagtgtgtctcctgaaggcaaggcaaaagatcgcagtgaaaatggtccacgcggacatcagcatcaatatgagcaagcataccaccttctttggagcaattaggctcggcgaagcacctgcctct

SEQ ID NO: 10782 - DNA, 1167 bp, Artificial Sequence
  Description of Artificial Sequence: Synthetic coding sequence
atgggataccccgaggtggaaaggcgggaactgctgccggccgccgcgccacgcgagcgcggctcccaaggctgtggatgtggcggggctcccgcacgggccggtgagggaaattcctgcctgctcttcctgggcttcttcggattgtcactcgcgctgcacctcctgactttgtgctgctacctggagctccgctcggagcttagacgcgagagaggagccgaaagccgcctcggaggatcaggaacgccgggaacctcgggaactctctcctcgctcggagggttggatcctgactcacctatcacctcccacctcggacagccttcgccgaagcagcaaccgttggaaccaggcgaagccgctcttcattcagactctcaagacggacaccaaatggccctgttgaacttcttcttcccggacgaaaagccgtactccgaagaggagagccggcgcgtgagaagaaacaagcggagcaagtcgaatgaaggcgcggacggaccggtgaagaacaaaaagaagggaaagaaagcaggcccgccaggcccaaatgggcctcccggtccccccggaccgccgggtcctcagggaccgccgggaattccgggcatcccaggcatccctggcaccaccgtcatgggacccccgggaccacctggtccgccggggccgcaaggacctccgggcctgcaaggaccatcgggggcagcagacaaagcgggcactcgcgaaaaccagccagccgtcgtgcacctccagggccagggctcggccatccaggtgaagaacgatctgtccggaggtgtgctgaacgattggtcgcggattactatgaatccaaaagttttcaagctccatccgcggtcgggagaactggaggtcctggtcgacggcacgtacttcatctactcccaggtgtactacatcaacttcaccgatttcgcatcgtacgaagtggtggtggacgaaaaacctttcctgcagtgcacccgctcaatcgagactggaaagaccaactacaacacctgctacactgccggtgtgtgcctgctgaaggcccggcagaagattgccgtgaagatggtgcacgccgatatctcgatcaatatgtctaagcacactactttcttcggcgcgatccggctcggagaagcacccgcctct

SEQ ID NO: 10783 - DNA, 1167 bp, Artificial Sequence
  Description of Artificial Sequence: Synthetic coding sequence
atgggatatccagaagtagaaagaagagaattgttgccagcagcagcacctagagaacgtggatcacaaggatgcggttgtggtggagctcctgcaagagctggtgaaggaaattcttgtttactttttcttggattttttggtctttcacttgctttacatcttttgacattatgttgttatctcgaattacgttctgaattaagaagagaaagaggagctgaaagtagacttggaggatcaggaactccaggaacatctggaacactttcatcattaggaggattagatccagattcaccaattactagtcatttaggtcaaccatctccaaagcaacaaccattagaaccaggagaagcagcattacattcagactcacaagatggtcatcaaatggcattgttaaattttttttttcctgatgaaaagccatattctgaagaagaatcaagaagagttcgaagaaacaaaagaagtaaaagtaatgagggagctgatggaccagttaaaaataagaaaaaaggaaaaaaggctggtcctccagggccaaatggacctccaggaccacctgggccaccaggaccacaaggacctccaggaattccaggtattcctggaattccaggaacaacagttatgggaccaccaggacctccaggaccaccaggtccacaaggtccaccaggtttacaaggaccatcaggagctgctgataaagcaggtactagagaaaatcaaccagcagtagttcatttacaaggacaaggaagtgcaattcaagtaaaaaatgatttatcaggaggtgttttaaatgattggagtcgtataacaatgaacccaaaagtttttaaacttcatccaagatcaggagaattagaagttcttgttgatggaacttatttcatttattcccaagtttattatattaatttcacagatttcgcttcatatgaagtggtcgtagatgaaaaaccatttttacaatgtactcgtagtatagaaacaggaaagacaaactataatacttgttatacagctggagtatgtttacttaaagctagacaaaaaattgcagttaaaatggtccatgctgatattagtattaatatgtcaaaacatacaactttcttcggtgctataagattaggagaagcaccagcatcg

SEQ ID NO: 10784 - DNA, 1167 bp, Artificial Sequence
  Description of Artificial Sequence: Synthetic coding sequence
atggggtatcccgaagtcgaacggcgagaactactaccagccgcagctccccgggaaaggggttcacaaggatgtggatgcgggggagcaccagcccgcgcgggcgaggggaacagctgtctgctgtttcttggattcttcggcctaagcctggctttgcaccttcttacgctgtgttgttaccttgaacttagatcagagctgcggcgggaacgtggcgctgaatctcgtctgggaggctccgggaccccagggacaagcggcactctcagctctctgggaggactggacccagatagccccatcacctcccatctgggccagccgtcacccaagcaacagcccctggagccaggcgaggccgccttacacagcgatagccaggacggccatcaaatggcactgttgaattttttcttccctgatgaaaaaccatactccgaggaagaatccagaagagtccgacgaaacaaacgctctaaatccaacgaaggcgcagatggcccagtgaaaaacaagaagaagggaaaaaaggcggggccccctggcccaaacggaccaccagggccaccgggccctccgggaccacagggccctcctggcattcccgggatccccggaatccccgggactacagtgatggggcctcccggcccccccggccctcccggccctcagggtccaccggggttacagggcccatctggagccgccgacaaagctggaacccgcgaaaaccagcctgctgtcgtgcatttgcagggtcagggaagcgccatccaggtgaagaacgatctgtccggcggggtccttaatgactggtcgaggattacgatgaaccccaaagtgtttaagttgcaccctcggagtggcgaactggaggtgcttgtagacgggacctactttatctactcacaagtgtattatattaattttactgactttgcctcatacgaggtggttgtggatgagaaaccatttctgcagtgtacgcgttcaattgaaactggaaagactaattataatacatgttatacagctggggtctgcttactcaaagctcgacagaaaattgctgtcaaaatggtgcatgccgatatctctatcaatatgtccaagcacacgacattcttcggcgccatccggcttggtgaggcccctgcctca

SEQ ID NO: 10785 - DNA, 1167 bp, Artificial Sequence
  Description of Artificial Sequence: Synthetic coding sequence
atgggttaccctgaagtggagagaagagaactgcttccggcagcggcacctagagaaagagggagccaaggttgtggttgcggcggtgccccagcacgtgcaggcgaaggcaactcctgtcttttgtttctcgggtttttcggtttgtcgctggcacttcacctgttgacgctttgttgctaccttgagctgcgctccgaactgcgcagagagcggggagcagaaagccgcctgggaggatcaggaacccccggcactagcggtactttgtcctccctggggggactggatccagactcgcctatcacctcgcatcttggacaaccgagccccaaacagcaacctcttgagccaggcgaagccgctttgcattcagatagccaagacgggcaccagatggcattgttgaacttctttttccccgatgaaaagccttactcggaagaggaatcgcggcgggtgagaaggaataagcgatcaaaatcgaacgagggtgctgatggacccgtgaagaacaaaaagaagggaaaaaaggcaggacctcccggtcccaacggcccccctggccctcctgggccacctgggcctcaaggaccacctggaatcccagggattccaggaatacccggaaccactgtcatgggaccaccaggtccacctggccctccaggtccacaaggaccaccgggactgcaggggccatcaggtgcagcggacaaagctggtacccgtgaaaaccaaccagcagtcgtgcaccttcaaggccagggatcagctatccaagtcaaaaatgacttgtctggcggcgtgctgaatgattggtcacgaatcaccatgaaccccaaggtctttaagctccatccccggtcaggcgaactggaggtgctggtggatgggacttacttcatctacagccaggtgtactacattaactttaccgactttgcgtcgtacgaagtggtggtagacgagaagccgttcctccaatgtactaggagcatcgaaactggaaagactaactacaacacgtgctatactgctggagtctgtctgctgaaggcccgtcagaaaatcgcagtcaagatggtgcatgccgacatctcgattaacatgagcaaacataccaccttttttggtgccattagactgggagaggcaccagcatca

SEQ ID NO: 10786 - DNA, 1167 bp, Artificial Sequence
  Description of Artificial Sequence: Synthetic coding sequence
atgggctacccggaggtggagagaagggaactcctgcctgcagccgcgccgcgggaacgcgggagtcaggggtgcggttgtggtggcgctccggctcgcgccggcgaggggaacagttgcctgttgttcctagggtttttcgggctgtctctggctctgcacctgctaactctatgctgctaccttgaactccgttctgaacttaggagagagaggggagcagaatctagactgggggggagtggaactcccggcacttccggaacccttagttccctgggaggtctggatccagactccccaataaccagccacctcggacaaccgtcccccaagcagcagccattggagccaggagaggctgcactccacagcgatagccaagatggacatcagatggctctgttaaattttttctttcctgacgagaaaccctactccgaagaagagtctaggcgcgtcagacggaataagcggagtaaatccaatgagggggccgacgggcctgtaaaaaacaagaagaaaggtaagaaagccgggcctcccggtcccaatggcccccccggcccgcctgggcctcctggtccccagggccctccggggatacccggaattcctggtattccaggcacaactgtcatgggccctccgggaccaccaggtccgcctggccctcaggggccaccagggctgcagggcccttctggggcagcagataaagccgggacgcgggagaaccagccagcagttgtccacctgcagggccagggttctgctatccaagtgaaaaacgacctgtccgggggcgtcctcaacgactggtcccggattacaatgaatccaaaagtgttcaaactgcatcctagatccggggaactcgaggtcttggtggacgggacttattttatttattcacaggtgtattacattaactttacagattttgccagttacgaggtggttgtggacgagaagccttttctgcagtgcaccaggtcaatcgaaaccggaaaaaccaactacaatacctgctacacggctggggtatgtctgttgaaagcacgccagaaaatagcggtcaaaatggtgcatgctgatatctccattaacatgtccaaacacactaccttcttcggcgctattcgcctgggcgaggcacctgctagc

SEQ ID NO: 10787 - DNA, 1167 bp, Artificial Sequence
  Description of Artificial Sequence: Synthetic coding sequence
atgggatatcctgaagtggagcggagggagctgctacctgccgcagcccctcgagaacgtggatctcagggttgcgggtgtggaggggctcccgcccgggccggcgaaggaaactcgtgcttgctgtttctcggcttcttcggtttgtccctagccctgcacctcctgaccctgtgttgctacctggagttgcggagtgagctccgtagggagcgtggggcggagtcgaggttgggtggttccggtacccctggaacctctggaacgcttagctcactggggggtctcgatccggatagtcccataacttcccatcttggccagccttcaccaaaacaacagccgctggagcctggcgaggctgcactacacagtgacagtcaggacggccatcagatggccctgctcaacttctttttcccagatgaaaaaccctactccgaggaagaatctcgcagggtaagacgcaacaagagatctaaaagcaatgagggcgctgacgggcccgttaagaacaagaagaaaggcaaaaaggctggcccgcccggcccaaacggtccccctggacccccaggaccgcccggcccccaggggccccctgggattcccggcatccctggaatcccaggaacaacagtcatgggacctcctgggccccccgggccccctggaccacaggggccaccaggactgcagggacccagtggcgccgcagacaaggcggggacaagggagaatcagccagcggtggtgcacctccagggccagggcagcgccattcaggtgaagaatgatttaagcggcggagtgttgaatgattggagcaggatcactatgaatccgaaagtgtttaaactgcaccctagatctggcgaactcgaggtcctggttgacggcacgtattttatctacagtcaggtgtattatattaatttcaccgatttcgctagctacgaagtggtggtggatgagaagcccttcctccagtgcactcgatctatcgagaccggcaagactaattataacacatgttataccgccggggtctgccttcttaaggcccgccagaagattgcagtcaagatggttcatgccgatatctcaattaacatgagtaaacatacaaccttctttggcgcaatcaggcttggtgaggccccagccagc

SEQ ID NO: 10788 - DNA, 1167 bp, Artificial Sequence
  Description of Artificial Sequence: Synthetic coding sequence
atgggataccctgaggtggaaaggcgggagcttcttcctgcggcagcacctagggaacgagggagccaaggttgtggatgcggaggcgcaccagcacgcgccggggaaggaaactcatgcctgctctttctgggcttttttggcctctcacttgcgctgcatctccttaccctgtgttgttaccttgaacttcgatcagagctgcgtagagaacgtggagccgagtcccgcctgggtgggagcggtacccccggaacgtccggaactctctcatcgcttggaggacttgatcctgattcacctattactagccacctcgggcaaccttctccaaaacagcaacctttggaacccggagaagcagcactgcactccgatagccaggacggacaccagatggcgctcctgaacttctttttcccagatgagaagccatactcggaggaagaaagcagaagagtgagaagaaataagagatcgaagtcaaatgaaggtgcagatggcccagtgaagaacaagaaaaagggcaagaaagcgggacccccggggccaaacggaccacctggcccccctggccccccaggtccacaaggaccacctgggattccgggaatcccggggattccagggaccactgtcatgggcccacctggtccgcctggaccgccaggacctcaaggccctcctggattgcaaggcccaagcggagcggccgataaggccggaacccgcgaaaaccaaccagcagtcgtgcatctgcaaggtcagggctcggcgattcaagtaaagaacgacctttccggaggcgtgcttaacgattggtcccggattactatgaaccctaaggtgttcaagctgcatccccgctcgggtgagctcgaggttctggtcgatggtacttactttatctattcacaagtgtactacattaactttaccgatttcgctagctacgaggtggtggtcgatgaaaaaccatttttgcagtgcaccaggtccattgaaaccggtaagactaactacaatacttgttacaccgctggcgtctgcctgcttaaggccaggcaaaagattgcggtcaagatggtgcatgcagacatttcgataaacatgtccaagcacaccacctttttcggtgcaatcaggcttggagaggcgcccgcttcc

SEQ ID NO: 10789 - DNA, 1167 bp, Artificial Sequence
  Description of Artificial Sequence: Synthetic coding sequence
atggggtacccagaagttgaacgtcgggagctgttgcctgcagccgcgcctagagaacggggcagccagggttgcggctgtggtggagcgccagcacgcgctggagaaggtaactcatgccttctttttctcggattctttggcctgtcgcttgctctccaccttctgaccctttgttgttatcttgaacttagatcggaattgcgcagagaaagaggcgctgaatcaaggcttggggggtccggaacccctggaacgtccggaacgctcagctccctgggaggacttgaccccgattccccaattacttctcacctcggtcagccaagccccaagcaacagcctctcgaacccggcgaggcagcgctgcactctgattcccaggacggccaccaaatggcccttctgaacttcttttttcctgacgaaaaaccatactcagaagaagaaagccgccgcgttaggagaaacaaaagatcgaagagcaacgagggagcagatgggcctgtgaagaataagaagaagggaaagaaggccggcccacctggccctaacggtccccccggtccaccgggtccgccaggaccacaagggccacccgggatccctgggattcctggcattccaggtaccacggtgatgggtccccctgggccaccaggtcctcctggacctcaaggccctccaggcctccaaggtccttctggggcagcggataaggctggtacccgtgaaaatcaaccggccgtggtccatctccagggccagggaagcgccatacaagtgaagaacgacctgtcagggggagtcttgaatgattggtcacgtataacgatgaaccccaaggtgtttaaactgcatccccggtcgggagagctggaagtgctcgtggacggcacctacttcatttactcgcaggtgtactatatcaactttactgatttcgcatcatatgaggtggtggtcgatgagaagccatttctgcagtgcactcgatcaattgagactggcaagaccaactacaacacttgttacaccgcaggagtctgccttctgaaggcacgtcagaagatcgcagtcaaaatggtgcatgccgacatttcaataaacatgtcgaagcatactaccttctttggggcaatacgcctcggcgaagcacctgcgtca

SEQ ID NO: 10790 - DNA, 1167 bp, Artificial Sequence
  Description of Artificial Sequence: Synthetic coding sequence
atgggatacccagaagtggagcgaagggagctgctgccagccgccgcccctcgcgaaaggggctcccagggatgcggctgcggaggagcaccggcgcgggcaggcgagggcaattcctgcctgttgttcctgggattcttcggtctttcactggccctgcacctcctcactctctgttgctacctggaacttcgcagcgagttgcgacgagagcggggagccgaatctcgcctgggaggaagcggcactccggggacttccgggactctgtcgtcactgggaggacttgatcctgactcaccgattacttcgcatctgggccagccatccccgaagcagcaacccctcgagccgggagaagccgccttgcattccgatagccaggacggacaccagatggccctcctgaacttcttctttccagacgagaaaccctactcggaagaagaatccagacgcgtgagacgcaacaagcggagcaaatccaatgaaggggccgacggaccagtcaagaacaagaagaaaggcaagaaggctggtccgccgggaccaaatgggccgccgggcccgccaggccctccgggcccacaaggcccaccaggtataccgggcattcccggcattcccggtaccaccgtcatggggcctccagggccgcccggtcccccgggaccgcaaggaccacctgggctccaaggcccgtcgggcgcggccgacaaagctggaacccgggagaaccagccggcagtagtgcatctccagggacaggggagcgcaatccaggtgaagaacgatctctctggaggggtccttaacgactggtctaggatcaccatgaatccgaaggtctttaagctccacccgcggtcaggagagttggaggtcctggttgatggaacctatttcatctacagtcaagtgtactacatcaacttcaccgatttcgcgagttacgaagtggtggtggacgaaaaacctttcctgcaatgcactagatcaatcgagactggcaagacgaactacaacacctgctataccgctggtgtgtgtttgctcaaggcacggcagaagatcgctgtgaaaatggtgcacgctgacatttcgatcaatatgagcaagcacaccaccttttttggcgcgatccgactgggggaggcgcctgcgtcc

SEQ ID NO: 10791 - DNA, 579 bp, Artificial Sequence
  Description of Artificial Sequence: Synthetic coding sequence
atgggggtccacgaatgtcctgcttggttgtggctgttattgagtctgctgagtttgcctttggggctccccgtattgggtgcgcccccccggctgatctgcgactcacgtgtacttgagaggtacctactggaggcgaaggaagctgaaaacatcaccacagggtgcgccgagcactgcagcctcaacgagaacatcactgtgccagataccaaagtgaatttttacgcctggaaaagaatggaagtgggtcagcaagccgtcgaagtgtggcagggattagcactattgagtgaagcagtgctcaggggccaagctttgctggttaattcctctcagccatgggagcccctgcagctgcacgtggataaagccgtgtccgggcttcgttccctgacaaccttgctgagagcgctaggagcacaaaaagaagccatcagcccccctgacgcagcgagcgccgcacccctccgtacgatcactgcagacacctttcgtaagctcttcagggtttactccaattttctaagaggaaaactgaaactttacacaggcgaggcgtgtagaaccggcgaccgg

SEQ ID NO: 10792 - DNA, 579 bp, Artificial Sequence
  Description of Artificial Sequence: Synthetic coding sequence
atgggtgtgcacgagtgtccagcttggctctggctgctcctgtccctgctgagcttgccgcttggcctcccggtgctcggggctccgcctaggctgatctgcgacagccgcgtcctggagcgctacttgctggaggcaaaggaggcggagaacatcacgaccggatgtgcggagcactgctccctgaacgaaaacatcactgtgccggatactaaagtgaacttctacgcttggaagcggatggaggtcggacagcaggcagtggaagtctggcaaggactggccctgctctcggaagcggtgctgcgcggccaggcgctccttgtgaattcttcccagccgtgggaacccctgcagctccacgtcgacaaggccgtctcgggactccggtcgctcactactctgctgcgggccctcggagctcaaaaggaagccatttccccgcctgatgccgcctcagccgctcccctccgaactatcacggcggacacgtttcgcaagctgttccgcgtgtacagcaactttcttagaggcaaactgaagctgtacaccggtgaggcttgccgcacgggagataga

SEQ ID NO: 10793 - DNA, 579 bp, Artificial Sequence
  Description of Artificial Sequence: Synthetic coding sequence
atgggcgttcacgagtgcccggcatggctttggctgctgctcagcctcctgagcctgccgctgggcctgccggtgctcggagccccgcctcggttgatttgcgattcgagagtgctggaacgctatttgctggaggctaaagaagcggagaacatcaccactggatgtgcggagcattgctcgctgaacgaaaacatcactgtgccagacactaaggtgaacttctacgcttggaagcgaatggaagtgggacaacaggcggtggaggtgtggcagggtctggccctcttgtcagaagcagtgttgcggggtcaggcactcctggtcaattccagccagccttgggagccgctgcaactccacgttgacaaagccgtcagcggattgaggagccttaccaccttgctcagggccctcggggcgcagaaggaggcgatctcacctccagatgcagcgtccgctgcaccgcttcggaccatcactgcggacacctttcggaagctctttagggtgtactcgaatttcctccgcggtaaactgaagctctacacgggcgaggcgtgccgcacgggagataga

SEQ ID NO: 10794 - DNA, 579 bp, Artificial Sequence
  Description of Artificial Sequence: Synthetic coding sequence
atgggggtgcatgaatgccctgcgtggctgtggttgctgttgtcgttactgtcccttcctctaggcctccccgtactcggtgcacctccccgcctgatttgcgattccagagtgctagagcgctacctgttggaggcgaaggaagcggagaacattacaacaggatgcgcagagcattgcagtctgaacgagaacataacagtgcctgacacaaaggtaaacttttatgcttggaagaggatggaagtggggcaacaggcagtggaggtatggcaaggcttggctctcctatcggaggctgttctgcgcgggcaggccctgcttgtaaactctagccaaccatgggagccactccagttacatgtggataaagctgtgtcagggctgcgctcgctgacaactctcctcagggctctgggggctcaaaaagaggcgatttccccaccagacgcagcatccgctgctccactgagaacaatcaccgccgatacgtttcgaaaactctttcgtgtgtacagcaatttcctcagagggaagctgaagctgtataccggcgaggcgtgtagaaccggggaccgt

SEQ ID NO: 10795 - DNA, 579 bp, Artificial Sequence
  Description of Artificial Sequence: Synthetic coding sequence
atgggggtgcacgaatgccctgcttggctgtggctactcctgagcctactgtctctgcccctgggcctacccgttctgggggctccaccccgtttgatttgtgattcacgggttctggagagataccttctggaagctaaggaggcagagaacattacgacagggtgcgctgagcattgctcattgaacgaaaatattactgtgcccgacacaaaagtaaacttctacgcttggaagcggatggaagtcggccagcaggcggtggaggtgtggcaggggcttgccttactttcagaagccgtgctgagggggcaggcactgcttgtcaatagtagtcaaccatgggagcccctgcaacttcacgtggacaaagccgtgtctggcttgcgatctctgacaacacttttgagggctctaggggctcagaaagaagcaatctcccctcctgatgccgcttccgccgcccctcttaggactatcaccgccgatactttccggaaacttttccgggtgtactctaatttcctgcgtggaaaactgaagctgtacactggggaagcctgtagaactggtgatcga

SEQ ID NO: 10796 - DNA, 579 bp, Artificial Sequence
  Description of Artificial Sequence: Synthetic coding sequence
atgggcgtgcatgagtgtcctgcatggctttggctgcttctttccctgctgtcgctcccattggggctgccagtgcttggagcgccgccccggctgatctgtgattcaagagtcctggagaggtacttgctcgaagctaaggaggcggaaaacataaccaccggatgcgctgaacattgcagccttaacgagaatatcactgtgcctgataccaaggtgaacttttacgcatggaagaggatggaagtcggacaacaggcagtggaagtctggcagggactggcactcctctctgaagctgtgctgagaggtcaagccttgcttgtgaactcatcacagccctgggagcctcttcaacttcatgtggacaaagcagtctcgggtctgagaagccttaccaccctgctccgggcactgggagcgcaaaaagaggcaatttcccctcctgatgctgcatccgcggcaccactgcggaccattactgcagacacgtttaggaagttgttccgggtgtattccaattttcttagaggaaaacttaaactgtatactggtgaggcatgtagaaccggtgatcgg

SEQ ID NO: 10797 - DNA, 579 bp, Artificial Sequence
  Description of Artificial Sequence: Synthetic coding sequence
atgggtgttcatgaatgtcccgcctggctttggctactcctctccctgttgtcgcttccgttaggcctgccagttctgggtgctccccctcgccttatctgtgattcgcgagtgctcgaaagatatttgctggaagcaaaggaggccgagaatatcacgaccggctgtgctgagcattgcagtctcaatgaaaacatcaccgttcctgacacaaaggtcaatttttacgcatggaagcgtatggaagtgggtcagcaggcggtcgaagtctggcagggccttgcactcctgagtgaagctgtccttcgcgggcaagctctgttggtcaactcgtcgcagccgtgggagcccctgcagttgcatgtggacaaagcggtgtcgggcttacgtagtctgacgacccttctgagggcacttggagcccagaaggaggcgatttcgccaccagacgccgcctcggcagcgccacttagaaccatcacagccgacacttttcgaaagctattcagagtgtactccaatttcctgcgtggtaagctgaagctttatacaggcgaggcctgccgtaccggagatcga

SEQ ID NO: 10798 - DNA, 579 bp, Artificial Sequence
  Description of Artificial Sequence: Synthetic coding sequence
atgggcgtccatgagtgccccgcctggctgtggctgctcctgagtctcctgagtctgccactgggtctccccgtgttaggcgcgcccccgagactcatttgtgattcccgggttctggagcggtatctgctggaggccaaggaggcggagaacatcacgacaggctgtgctgaacactgctcgctaaacgagaatattacggtacccgataccaaggtgaatttttatgcctggaagcgcatggaggttggtcagcaagccgtggaagtgtggcagggactggcattactctccgaggctgtgttgagaggtcaggcactgctggttaactcctcccagccttgggagcctttgcagttgcacgtggataaggctgtttctggacttcgatcgttaactacgctcctgcgcgctctaggcgcgcagaaagaggccatttccccacccgacgccgccagcgctgccccgttgcgtacgatcacggccgataccttccgcaaactcttccgggtttacagtaacttcctgaggggcaagcttaagctctacaccggagaggcctgtaggaccggtgatcgg

SEQ ID NO: 10799 - DNA, 579 bp, Artificial Sequence
  Description of Artificial Sequence: Synthetic coding sequence
atgggcgtgcacgaatgccccgcatggctgtggctgctgctgtcactgctctccttgcctctgggactgccggtccttggtgccccaccacgccttatctgtgacagccgcgtgctggaaaggtacctcctggaggccaaggaagccgaaaatatcaccactggatgcgcagaacactgctcccttaacgagaacattactgtgccagacactaaggtgaatttttacgcctggaagcgaatggaagtggggcaacaggcggtcgaggtttggcagggactcgcactccttagcgaagccgtcttgagaggacaggccctgctggtcaactcgtctcagccgtgggagccgttgcaactccatgtggataaggctgtgtccgggctccgcagcctgactactctcttgcgggcgctcggagctcaaaaagaggcgatctcacctccggacgcggcctcggcagccccgctgcggaccatcacggcggacaccttcagaaagctgttccgggtgtactcgaacttcctgaggggcaagctgaaactctacaccggcgaggcttgccgcaccggagatcgg

SEQ ID NO: 10800 - DNA, 579 bp, Artificial Sequence
  Description of Artificial Sequence: Synthetic coding sequence
atgggagtgcacgagtgtccagcatggctgtggctgctcctctccctcctgtccttgcccctgggtctccctgtgctcggcgcgcccccccgcctgatctgcgacagtagggtcttggagcgctatttgcttgaagccaaagaggcggaaaatatcaccacgggatgcgctgagcactgctctcttaatgaaaacatcactgtcccggataccaaagtaaatttctacgcctggaagagaatggaggtgggacaacaggctgtggaggtttggcaaggcctggccctccttagcgaagccgttctgagaggacaagccctgctggttaacagctcacagccgtgggagcctctgcagcttcacgtcgataaagctgtgagtggccttcgctctcttaccacactcttgagagcgctcggtgcccagaaagaagccatctccccgccagatgctgcctccgccgctcctctgagaaccatcacggccgacacctttaggaagctgtttagggtctactcaaactttctgagaggaaagctcaagctctacactggagaggcctgtaggaccggtgatcgc

SEQ ID NO: 10801 - DNA, 579 bp, Artificial Sequence
  Description of Artificial Sequence: Synthetic coding sequence
atgggggtccacgagtgccccgcttggctctggctcctcctttccttgctttcgctcccactgggactgccggtcctgggggctccgccccgcctgatctgtgacagccgggtcctggaacggtaccttctggaggctaaagaggctgagaacattacgaccggatgcgcagagcactgttccttgaatgagaatatcactgtgccggatactaaagtgaacttctacgcgtggaaaagaatggaagtgggacagcaagcagtggaggtttggcagggactggcgcttctgagcgaagcagtcctgcggggccaagccctgctggtgaactcgtcccagccatgggaaccgcttcagctccacgtcgacaaggcggtgtccggactccggtcactgactaccctcctgagggctctcggtgcgcagaaggaggcgatttccccaccggatgccgcgtccgcagccccgcttaggactatcactgctgatactttcagaaagctgttcagggtgtacagcaatttcttgcgaggaaagctcaagttgtatactggagaagcgtgccggaccggcgaccgt

SEQ ID NO: 10802 - DNA, 579 bp, Artificial Sequence
  Description of Artificial Sequence: Synthetic coding sequence
atgggcgtgcatgaatgccccgcctggctctggctcttgctgagtttgttgtctctgccgctcggacttcccgtcctcggggctccgcccaggctgatttgtgatagccgcgtcctcgagcggtatctcttggaggccaaggaggctgagaatatcactacggggtgtgccgagcattgttccctgaacgagaacatcacggtcccagacactaaggtcaacttctacgcatggaaaaggatggaagtgggccagcaagccgtggaagtctggcaaggtctcgccctcctgagtgaggccgtactgcgcggacaggcacttttggtgaactcaagccagccatgggagcccctgcagctccacgtggacaaagctgtcagcggactgcgaagcctgaccacgctgttgcgagcactcggggctcaaaaggaggccatatccccgcctgacgctgcgtccgctgccccacttagaacaataacagcggacacgtttcgaaagttgttcagagtgtactcaaacttcctgcgcggaaagctcaagctctatactggcgaagcttgcaggaccggagaccgc

SEQ ID NO: 10803 - DNA, 579 bp, Artificial Sequence
  Description of Artificial Sequence: Synthetic coding sequence
atgggagtgcatgagtgtcctgcttggctctggctcctcctgagtcttttgtcgctgccactggggctgccagtgctgggtgcgccccctcggctcatctgtgatagcagagtgctcgagcgttatctgctcgaggcaaaggaagcagaaaacatcactacgggatgcgccgaacactgtagcctgaatgagaacattactgtgccagacactaaggttaacttctacgcctggaagcgtatggaggtgggtcaacaggctgtcgaagtgtggcaaggactcgcccttctctccgaagcagtgctgcggggacaagcacttctcgtcaattcgtcacaaccctgggaacctcttcagctgcatgtggacaaagcggtatcggggctcaggagcttgactacccttctcagagcgcttggggcccagaaggaggctatttcaccacctgacgcggcttcggcagccccactcagaaccatcaccgcagatacctttcgcaaattgtttcgcgtctacagcaacttcttgcggggcaaattgaaactgtacaccggcgaggcctgccggacgggagatcga

SEQ ID NO: 10804 - DNA, 579 bp, Artificial Sequence
  Description of Artificial Sequence: Synthetic coding sequence
atgggcgtgcacgagtgcccggcatggctgtggcttcttctctccctgctgagcctgcctcttgggctgccagtgctgggagcaccaccaagactcatttgtgattccagagtcctcgaacgatacctccttgaagctaaagaagcggaaaacatcacgaccggctgcgcagagcactgctctctgaatgaaaacattaccgtgcccgatacgaaggtcaacttttacgcatggaagagaatggaagtcgggcaacaagccgtggaagtctggcaaggactggcactcctgtcagaagccgtcctccggggacaggcccttttggttaactcgtcacagccttgggagccgctgcagctgcacgtcgataaagcagtctccggactccgctcactgaccaccctgcttagggcgcttggcgcacaaaaggaggcaatctccccacccgacgccgcatccgctgcaccacttcggactattactgcagataccttccgcaagctcttccgcgtctactcaaactttcttcggggtaagctgaaactttacaccggagaagcatgtagaaccggggataga

SEQ ID NO: 10805 - DNA, 579 bp, Artificial Sequence
  Description of Artificial Sequence: Synthetic coding sequence
atgggagtgcatgagtgtccggcctggttgtggttattactttccctgctttctcttccgcttggcctccccgtcctgggtgctccgccgcgtttaatatgtgacagtcgggtcctggaacgttatctcttggaagccaaggaagctgagaatatcacaacgggctgcgctgagcactgctctcttaacgagaacatcacggtcccggatactaaagtgaacttttacgcttggaaacggatggaagtcggacaacaggctgtcgaagtatggcaaggactcgctctgttgtcagaagcggttctccggggacaggcactgcttgttaattcatcacaaccttgggaaccgttacaacttcatgtggataaggccgtttctggtcttaggtcactgactactcttctgcgtgcgcttggagcacagaaagaagccattagtccaccagatgctgcaagcgccgctccccttagaaccattacagcagacacctttcgcaaactgtttcgggtatattcaaacttcctccggggtaaactcaagctatataccggagaagcgtgtcgtactggggatcgc

SEQ ID NO: 10806 - DNA, 579 bp, Artificial Sequence
  Description of Artificial Sequence: Synthetic coding sequence
atgggggtccacgagtgcccagcatggctttggcttctactgtctctgctgagcctgcccctgggcctgcccgtgctgggcgctcctccgagactgatttgtgactcccgagtgctcgagcgttatctgctggaagccaaggaagcggaaaacattacaacaggatgcgccgagcactgctcgctgaacgagaacatcacagtgccggatacgaaggtcaacttttacgcctggaaacggatggaggtggggcaacaggctgttgaggtttggcaagggttggctctcttatcagaggccgtgttgcgggggcaggcacttcttgttaactcttcccagccctgggagccccttcagctgcacgtggataaggctgtgagcgggttgaggtcactgacgactcttctacgcgctctcggcgctcaaaaggaggcgatctcgccccccgatgccgctagcgcggcaccattaaggactattaccgccgatacattcagaaagctgttcagggtctactctaatttcctcaggggcaagctcaaattatataccggggaagcctgcagaacgggagatcgt

SEQ ID NO: 10807 - DNA, 579 bp, Artificial Sequence
  Description of Artificial Sequence: Synthetic coding sequence
atgggagtgcatgaatgtccagcctggctctggctcctgctgagtctattgagcctacccttgggtcttcccgtccttggcgctccgccccgcctcatttgtgattcacgggttttggaacgatatctcctggaagccaaagaggccgaaaacattacgacgggatgcgcggagcattgctctcttaacgagaacatcaccgtcccagatacgaaagtaaacttttatgcatggaaaagaatggaggtgggccagcaggcagtggaggtctggcagggcttggctctgctgtctgaggcagtgctgcggggacaggcactgttggtgaattcgtcacagccgtgggagccactacaattgcacgtggacaaggccgtttctggcctccgcagtttgaccactcttcttcgggcactcggggcacagaaggaagccatttctccccctgacgcggctagtgcagctccactacgaaccattaccgcagacacgttcagaaagctgttccgagtctattcaaattttctcagaggtaagttaaaactgtacaccggcgaagcctgcaggacaggcgatcgc

SEQ ID NO: 10808 - DNA, 579 bp, Artificial Sequence
  Description of Artificial Sequence: Synthetic coding sequence
atgggagtacacgaatgccccgcatggctgtggctgctcttgagtctgctgtccctaccactcggactgcctgtgctcggagccccaccacgcctgatttgcgactcgagggtcctggagcgttacctgctggaggccaaggaggctgagaatataaccaccggttgtgcggaacactgtagtctcaacgaaaatatcactgtacccgacacaaaagtaaatttttacgcctggaagagaatggaggttggtcaacaggccgtggaagtgtggcagggacttgccctgctctcggaagcagtgcttcgtgggcaggcactcctagttaatagctcacagccgtgggagccccttcaactacatgtcgacaaggccgtctccggactacgctctctgacaacgctgctccgggccctgggtgcccagaaggaagctatttcccccccagacgccgcaagtgccgccccattgaggacgataacagccgatactttcaggaaactcttccgtgtgtattccaatttccttcgggggaaactgaagctttatacaggtgaggcatgtaggaccggggaccgg

SEQ ID NO: 10809 - DNA, 579 bp, Artificial Sequence
  Description of Artificial Sequence: Synthetic coding sequence
atgggagtgcacgaatgtccagcatggctgtggctcctgctgagcctcctgtctctcccactcggcctgcccgttctcggcgccccgccgcgtttaatttgcgattctagagtactggagaggtacttgcttgaggccaaagaagcggaaaatataactacgggatgcgcggaacactgcagtctcaacgaaaatatcacagtgcccgacacgaaggtcaatttttacgcatggaaaaggatggaggttgggcagcaagctgtagaggtttggcaagggttggccctgctgtcggaggcagtgctgcggggccaagccctcctcgtgaactccagccagccatgggagccactacaactccacgtcgataaagctgtgagcggactacgcagtctgacaacactgctacgtgcactgggggcgcagaaggaggcaatcagccctccggacgcagcttcggctgcacctctcagaactatcacagccgacacctttaggaagctctttagggtgtacagcaactttctgcgcgggaaactgaaactttatacaggggaagcatgtaggaccggagacaga

SEQ ID NO: 10810 - DNA, 579 bp, Artificial Sequence
  Description of Artificial Sequence: Synthetic coding sequence
atgggagtgcacgaatgcccggcgtggctgtggctgcttctgtcactgctttcactgcctctgggactccctgtcctgggtgcgccaccgaggctgatctgtgactcaagggtgctggaacgctatctgctggaagccaaagaggcagaaaacattaccactggatgcgccgagcattgctcgctcaacgagaatatcaccgtccccgacactaaggtgaacttctacgcctggaagcggatggaagtcggacagcaggccgtggaagtgtggcaagggttggcgctcctctccgaggccgtgcttcgtggccaggcccttctcgtgaactcgtcacaaccatgggagcctcttcaactgcatgtggataaggcggtgtccgggctccggtcgctgacgactctccttcgggccttgggagcccagaaggaggcgatctcgccgccggacgctgcatcagccgcgccgctgagaaccatcactgcagatacgttcaggaaactgtttcgcgtgtactcaaatttccttcggggaaagttgaaactgtacactggtgaagcctgcagaactggggatagg

SEQ ID NO: 10811 - DNA, 579 bp, Artificial Sequence
  Description of Artificial Sequence: Synthetic coding sequence
atgggcgtccacgaatgcccagcttggctctggctattgttatccttattgtctctcccactgggcctgcctgtattgggcgccccccccagactgatttgtgactccagagtgctcgagagatatctgctggaagcaaaggaagccgagaatataacaactggctgtgctgagcactgcagtctcaatgaaaacattacggtgccggacacaaaagttaacttctatgcctggaaacggatggaagtcggccaacaagccgtggaggtgtggcaaggccttgcattgctgtcagaagcagtgcttagaggacaggcgctccttgtgaattcatctcagccctgggagcccttacagttacacgtggataaggccgtctcgggcttacgcagtttaactaccctgttaagagccctgggcgctcaaaaggaagctatttccccccccgatgctgccagtgctgctcccctcagaacgatcaccgcagatacctttcgtaagctgttccgtgtgtattccaattttctcagagggaagctgaaactctacactggtgaggcatgtcgaaccggcgataga

SEQ ID NO: 10812 - DNA, 579 bp, Artificial Sequence
  Description of Artificial Sequence: Synthetic coding sequence
atgggagtccacgaatgtcctgcatggctctggcttctgctgtcgctgctgagcctgccacttggactgccggtgcttggtgcacccccaagactgatctgtgattcacgggtcctggaacggtaccttttggaagcaaaggaagccgagaatatcaccaccggttgcgcggaacattgttcactgaatgagaacataaccgtgccagatactaaagtcaatttctacgcatggaaaaggatggaagtcggtcagcaggccgtggaggtgtggcaaggtctggcactcctgtccgaagcagtgctcagagggcaggccctgctcgtcaactcctcgcaaccgtgggaacccctgcaactccatgtggataaggcagtgtcggggctgaggtccttgactaccctgctgcgtgctctcggagcacagaaggaagctatttcgccccctgacgcagcatcggccgcaccactgagaactattaccgcggacacctttagaaaactttttagggtctactcgaactttctccggggtaagctcaagctctacaccggggaagcctgccgcaccggagatagg

SEQ ID NO: 10813 - DNA, 579 bp, Artificial Sequence
  Description of Artificial Sequence: Synthetic coding sequence
atgggagtgcacgagtgcccagcttggctgtggctgcttctgtctctcctttcacttcccctcgggctacccgtgctcggggctcccccccggctgatatgcgactcgcgcgtgttagaaaggtaccttctcgaagccaaggaagcagagaacattactacaggatgcgctgaacactgctcccttaatgaaaacattacagtcccggacacaaaggtgaatttttacgcttggaaacggatggaagtgggacagcaggccgttgaggtgtggcagggactcgccctcttgtcggaggcagtcttgaggggccaggcgctgctggtgaattcatcacagccatgggaaccactgcagcttcacgtggataaagctgtatctggtcttaggtccttgacaactttgttacgggcgttaggagcacagaaagaggctatctcacctccagacgccgcctctgccgctcccctaagaaccataacggccgacacgtttcgtaaattgttccgtgtgtactcaaacttcctgcggggaaaattaaaactgtacaccggcgaggcatgccgcacgggggataga

SEQ ID NO: 10814 - DNA, 579 bp, Artificial Sequence
  Description of Artificial Sequence: Synthetic coding sequence
atgggagtccatgagtgccccgcatggctgtggctgctgctcagcctgctttcgctgccgctcggactccccgtgctcggagcaccaccacgcctgatttgcgacagtcgggtgctggaacggtacctcttggaagcgaaggaagctgagaacatcaccactggctgcgcggaacattgttcgctcaacgaaaacatcactgtccccgatactaaggtgaacttttacgcctggaagcgcatggaggtgggacaacaggccgtggaagtgtggcagggtctggccctgctgtccgaggcagttctgaggggacaggccctcttggtgaactcgagccaaccatgggaaccgctgcagctccacgtggataaagcggtgtccggattgagatccctcacgaccctgctgcgagctctgggagcgcagaaggaggcgattagcccgccagatgcggcctcggcggccccattgcgcaccatcaccgccgacacctttcggaagctgtttagagtctacagcaacttcctccggggtaagctcaaactgtacaccggggaagcatgccgcaccggcgataga

SEQ ID NO: 10815 - DNA, 579 bp, Artificial Sequence
  Description of Artificial Sequence: Synthetic coding sequence
atgggcgtgcacgagtgcccagcctggctctggctgttgctgtccctcttgtccctgccactgggattgcctgtgcttggcgctcctcctcgcctgatttgcgactccagggtcttggagcgatacctgctggaagccaaagaagcggaaaatataaccaccggctgcgccgagcactgctcattgaacgagaacatcaccgtgcccgacaccaaggtgaatttttacgcatggaagaggatggaagtaggccagcaggcagtcgaggtgtggcaggggctggctctcctgagcgaagccgttcttagggggcaggcgctgcttgtgaattcaagtcagccgtgggaaccactgcagctgcacgtggataaggccgtaagcggcctcaggagtctcacaactctcctccgagcgctgggagcccagaaggaggctattagtccccccgacgccgcctctgctgccccgctcaggactatcaccgccgatacattccgaaagctctttagagtctatagtaactttctgcgcggaaagcttaagctgtacacaggtgaggcctgtcggacaggggatcgg

SEQ ID NO: 10816 - DNA, 579 bp, Artificial Sequence
  Description of Artificial Sequence: Synthetic coding sequence
atgggggtgcatgaatgcccagcgtggctgtggttgcttctgtccctgctgtctctgcctctgggcctgcctgtgttaggtgcccctccccggttgatctgtgacagtcgggtgctagaacgctatctgcttgaagccaaggaagcagaaaacatcaccaccggctgcgccgagcattgctctttaaacgagaacatcacagtccctgacacaaaagtgaatttttacgcttggaagcgaatggaagtaggtcagcaagcagtggaagtttggcaagggctggcacttctgtccgaagccgttttgcgcggccaagcactcctggtcaactcttcccagccctgggaacccctgcaactgcatgtcgataaggccgtctccggcctgaggtccctgaccacactgctcagggcactgggtgcgcaaaaggaggccatcagtccaccagatgccgccagtgctgcgccactccgcaccataactgcagacacgttccgaaagctttttcgcgtgtatagtaattttttacgcgggaaattgaaactatataccggagaggcctgtcggacgggagacaga

SEQ ID NO: 10817 - DNA, 579 bp, Artificial Sequence
  Description of Artificial Sequence: Synthetic coding sequence
atgggcgtgcatgagtgtcccgcatggctctggctgcttctgtcccttctttctcttcctctgggactcccagtcctcggtgcacctccaaggctgatttgtgattcacgagtcctggaaagatacctgcttgaagcaaaggaagctgaaaacattaccactggatgcgctgagcactgtagcctgaacgaaaacataactgtgccagataccaaggtgaacttttacgcctggaagcgaatggaagtggggcagcaggccgtggaagtttggcaaggtctggcccttttgagcgaagcagtgcttagggggcaagcacttcttgtcaactcaagccagccgtgggaaccactccaactccacgtggataaggctgtcagtggactgagatcgctgaccactcttctgcgggcactcggagcccagaaagaagcaatatcgccccccgacgccgcatcggccgctccccttcggactatcacggcggatacctttcggaagctgtttcgggtgtactcaaacttcttgcgcggtaagttgaagctgtacactggagaggcgtgccgcacgggagataga

SEQ ID NO: 10818 - DNA, 579 bp, Artificial Sequence
  Description of Artificial Sequence: Synthetic coding sequence
atgggagtacacgaatgtcctgcctggctgtggctgctgttaagcctgctttcactcccgctggggctgccagttttaggtgccccgcctcggttgatatgcgatagccgcgttttggaacgctatcttcttgaagcgaaagaggccgagaatatcaccaccggctgcgctgaacactgttctctcaatgaaaatattaccgtgccggacactaaagtcaatttctacgcttggaagcgaatggaggtcggccagcaggcggtggaagtgtggcagggtctggccctgctgagcgaggcagttttgcgcggccaggctctgctggttaactcaagccaaccgtgggagccgctgcagctgcacgttgataaagccgtctccggcctccgctccctgactactctgctgcgcgctctcggcgctcagaaagaagcaatcagccctccggacgcggccagcgcagcaccactgagaaccatcaccgcggacacatttcgcaagctgtttcgcgtttacagcaatttcctgcgtggcaagctaaagctctacacgggtgaggcctgtcgcaccggggaccga

SEQ ID NO: 10819 - DNA, 579 bp, Artificial Sequence
  Description of Artificial Sequence: Synthetic coding sequence
atgggcgtccacgaatgtccagcatggctgtggctgttgctctccctcttgagcctgccgcttggcttgcctgtgttgggtgcgcctcctcggctgatctgcgactcccgggtcctcgaaagatacctgctcgaagccaaggaagctgaaaacatcaccaccggatgcgcagaacattgctccctgaatgaaaacattaccgtgccggacaccaaggtgaatttctatgcctggaagcggatggaggtgggccagcaggcggtcgaggtctggcagggtctggccctgttgtccgaggccgtcctgcgcgggcaggccctgctggtgaactcgtcgcagccgtgggagccactgcagctgcatgttgataaagcagtgtctgggctcaggtccctgaccaccctgttgcgcgcgcttggagcccaaaaggaggctatctcacccccagacgctgcgtccgccgcaccgcttaggaccatcactgccgataccttcaggaaattgtttcgggtgtactccaacttcctgcggggtaagctgaagctgtacaccggcgaggcgtgccgcactggcgatcgt

SEQ ID NO: 10820 - DNA, 579 bp, Artificial Sequence
  Description of Artificial Sequence: Synthetic coding sequence
atgggtgtgcacgagtgccctgcatggctctggctattgctgtctttactgtccctgcccctaggtctgcctgtgttgggggcccccccgaggctcatttgtgattcaagagtcctagagcggtacctcctggaggctaaggaggccgagaatattactacagggtgcgccgaacattgctccctgaacgaaaacattacggtgccagacacaaaagtgaacttctacgcatggaagcgaatggaagtgggccagcaggcggtggaggtctggcagggcttagcgttgctgtccgaggccgtactgcgcggacaggctctcctcgttaattctagccagccatgggaaccgctgcaactccacgtagacaaagccgtatcggggctgagaagtctgaccaccctgctgcgggcactgggagctcagaaagaagctatttcaccccctgatgcggccagcgcggcacccctgcggacgattaccgccgacactttccgcaaactgttccgagtttatagtaactttctccgaggaaagctgaagctgtataccggtgaagcctgcagaaccggtgatcgg

SEQ ID NO: 10821 - DNA, 579 bp, Artificial Sequence
  Description of Artificial Sequence: Synthetic coding sequence
atgggagtccacgaatgtccagcttggctgtggctcctgctctccctactctctcttccattagggctccccgtattaggggctccacccaggctgatatgtgattccagggttttggaaagatatctgctggaagctaaagaagctgaaaacataactactggatgtgccgagcattgctctctcaatgaaaatatcacagtaccagatacaaaggtaaacttttatgcatggaaacggatggaagtggggcagcaagctgtggaagtatggcaggggcttgcccttctctctgaagccgtccttcgggggcaggccctactcgttaactctagtcagccatgggaacccctacagctccacgtcgataaagcagtatccgggctccgtagtcttacaacattattaagagctcttggggcacaaaaggaagccatcagtccacccgatgctgcgagtgccgcacccctccgaactattactgcagatacattcagaaagctttttcgggtgtattccaatttcctgaggggaaaacttaagttgtatactggagaagcttgccggactggagatcgg

SEQ ID NO: 10822 - DNA, 579 bp, Artificial Sequence
  Description of Artificial Sequence: Synthetic coding sequence
atgggcgtccatgagtgccccgcatggctctggctcctgctttctctgctgagtctaccgctcggcctgcccgtcctgggcgcccctcctcgcttgatatgcgattcccgcgtgttggaaagatacctgcttgaagccaaggaggccgagaacattaccactggctgcgccgagcactgctccctcaacgagaacatcaccgtcccagacactaaggtgaatttctacgcctggaagcgcatggaggtggggcagcaagccgtcgaagtttggcagggtctggcattgctgagtgaggcggtcctgcggggacaggcccttctggtgaactcatcccagccctgggagccgctgcaacttcacgtggataaagcggtgtccggccttagaagcctgaccaccctactccgagcattgggagcccagaaggaggccatttccccgccggacgccgcttcagcggcccccctacgaacaataactgcggatacttttcgcaagctcttccgggtgtattccaactttctgagagggaagctaaaactttacaccggggaagcatgcagaactggagatagg

SEQ ID NO: 10823 - DNA, 579 bp, Artificial Sequence
  Description of Artificial Sequence: Synthetic coding sequence
atgggtgtgcacgaatgtcctgcatggctgtggttgttactgtcactgctgagcctccccctcggactccccgtgctgggggcgcctcccaggctgatctgcgactctagagttttagagaggtacctgctagaagctaaggaggctgagaacatcaccacaggttgtgcggaacactgcagccttaatgagaatataactgtccccgataccaaggttaacttttatgcctggaagcggatggaagtaggacagcaagccgtggaagtgtggcaaggcctggctctgctaagcgaggcagtgcttcgagggcaggccctcctggtcaactcttcccagccttgggaacctctacagttgcatgtggacaaagcagtgagcggcttgaggtctctgacaaccctgttgcgggccctgggggctcagaaggaagccatttcaccccccgatgcggcgagtgctgctccactgaggaccatcacagcagatacgttcaggaaactttttagggtgtacagcaacttccttcgtggaaagctgaaactgtatacgggcgaggcctgtagaaccggggatcgt

SEQ ID NO: 10824 - DNA, 579 bp, Artificial Sequence
  Description of Artificial Sequence: Synthetic coding sequence
atgggtgtgcatgaatgccctgcttggctgtggctgctgttgtctctgttatccctgccacttggcctgcccgtgttgggggctccccccaggttaatctgcgattcacgtgtgcttgagcggtatctgctggaggctaaagaggcggagaacattaccaccggatgcgccgagcattgtagtctgaatgaaaatatcactgtgcctgacactaaagtgaatttctacgcctggaagagaatggaggtgggacagcaggcagtagaggtatggcagggcctggccttattgtcagaagccgtgctgagaggacaagcactgctggtgaactctagccagccttgggagcccttgcagctgcacgttgacaaagcagtgagcggtctgaggtccttgaccactcttctccgagctctgggagcccaaaaggaggctattagtcctccagacgccgccagcgccgcaccactgcgaacaattactgcagacacatttcgtaagctctttcgggtctacagcaactttctccgtggtaagttgaagttatatacaggggaagcatgccgtaccggagatcgg

SEQ ID NO: 10825 - DNA, 579 bp, Artificial Sequence
  Description of Artificial Sequence: Synthetic coding sequence
atgggtgtacatgaatgtccggcgtggctatggctactattatcgctactatcgctaccgctaggtctaccggtattaggtgcgccgccgcgattaatatgtgattcgcgagttttagaacgatatttattagaagcgaaagaagcggaaaatataacgacgggttgtgcggaacattgttcgttaaatgaaaatataacggttccggatacgaaagttaatttttatgcgtggaaacgtatggaagttggtcaacaagcggtagaagtatggcaaggtttagcgctattatcggaagcggttctacgaggtcaagcgctattagttaattcgtcgcaaccgtgggaaccgctacaattacatgtagataaagcggtttcgggtttacgatcgttaacgacgctactacgagcgttaggtgcgcaaaaagaagcgatatcgccgccggatgcggcgtcggcggcgccgctacgtacgataacggcggatacgtttcgtaaattatttcgtgtttattcgaattttctacgaggtaaattaaaactatatacgggtgaagcgtgtcgtacgggtgatcga

SEQ ID NO: 10826 - DNA, 579 bp, Artificial Sequence
  Description of Artificial Sequence: Synthetic coding sequence
atgggtgtgcacgaatgccctgcatggctgtggctgctgctgtcactgctgtctcttccgctcggactgccggtcttgggtgctccaccaaggctgatttgcgattcgcgggtgctggaacggtacctgttggaagctaaggaggctgaaaacataaccaccggatgcgccgaacattgttcgcttaatgaaaacattaccgtgccagacaccaaagtcaacttttatgcctggaaaagaatggaggtggggcagcaagcagtggaggtgtggcagggcttggccctcctctctgaggcggtcctccgcggacaggccctcctggtcaattcgagccagccgtgggaaccgctccaacttcacgtggacaaggcggtaagcggactccgcagtttgacgaccttgctgcgggcactgggcgcacagaaagaggctatctccccgcctgacgccgcctcggccgcacctctccgaactatcactgctgacactttcagaaagctgttccgcgtgtattccaatttcttgcgcggcaagctgaagctgtacactggggaagcctgccggacgggagatcgg

SEQ ID NO: 10827 - DNA, 579 bp, Artificial Sequence
  Description of Artificial Sequence: Synthetic coding sequence
atgggagttcacgaatgtccagcgtggttatggctcctgctcagtctgttatccctgcctctcgggctaccagtgcttggcgcgcccccaagattgatttgcgattcacgggtgctcgaacgatatcttcttgaggcgaaggaggccgagaatatcactacgggctgtgcagaacactgtagccttaacgaaaacattacagttccagacactaaagtgaatttctacgcttggaagaggatggaagtgggccagcaggcagtggaggtgtggcagggactggcgctgctatccgaggctgtgcttcggggacaagccctattagtgaattcaagccagccatgggagcccctccagctgcatgtggacaaagccgtctctggtctcagatctctgaccacccttctaagagctctgggagcacaaaaagaggcgatctctccacccgatgctgcctctgcagcgcctctcagaaccattacagcggacacatttcggaaactatttagggtgtattctaactttctgagaggcaagctgaaactgtacacaggcgaggcttgtagaaccggggacagg

SEQ ID NO: 10828 - DNA, 579 bp, Artificial Sequence
  Description of Artificial Sequence: Synthetic coding sequence
atgggcgtgcatgaatgtccagcttggctgtggttgctcttgtcccttctatctttacctctgggtctcccggtgctgggagcgccccctcgactgatctgcgattcaagggtcctcgaacgttatttactggaagctaaggaagcggagaacatcactactgggtgtgctgaacactgcagtcttaacgaaaacatcacagtcccggacactaaagtgaatttctacgcctggaagcgcatggaagtggggcagcaggcagtggaggtctggcaggggcttgctctactcagtgaggccgtcctcagaggtcaggcactgttggtcaactctagtcagccttgggagcccttacagttgcacgttgataaagctgtgagcggcttgaggagtctgacgactctgctccgcgcactcggcgcccaaaaggaagcaatctcccctccggatgcagcttccgccgccccgctgaggaccattactgctgatacatttcggaaattattccgagtgtattccaactttctgcggggcaaacttaagttgtacactggggaagcctgccgcacaggggatcgg

SEQ ID NO: 10829 - DNA, 579 bp, Artificial Sequence
  Description of Artificial Sequence: Synthetic coding sequence
atgggagtccacgaatgcccggcgtggctctggttgttgctctcactgctcagccttccactgggactgcctgtgttgggagctccaccgcgcctgatttgtgattcacgcgtcctcgagaggtacctgttggaagccaaggaggcggagaatatcaccacgggatgtgcggaacattgctccctgaatgagaacatcaccgtcccggacaccaaggtgaacttttacgcctggaaaagaatggaagtgggacaacaggcggtggaagtgtggcaagggctcgccttgctgtccgaggcagtgctgaggggacaggcgctgctggtgaattccagccagccgtgggagcccctgcaactgcacgtggataaggccgtgagcggtctgcgatcactgactaccctgcttcgcgccctgggtgcccaaaaggaggccatctcgcccccagacgcggcatcagccgcccctctccgcaccatcaccgctgatactttccggaagctcttcagagtctactcgaatttcctgcgcggaaagctcaagctgtacactggtgaagcgtgccgcaccggtgaccgc

SEQ ID NO: 10830 - DNA, 579 bp, Artificial Sequence
  Description of Artificial Sequence: Synthetic coding sequence
atgggcgtgcatgagtgtcccgcatggctgtggcttttattgtccctcctgagcctcccacttggcctgcccgtgctgggtgcacctccgagactgatatgcgattctcgagtgctggagcgatacctactcgaagccaaggaggccgaaaacataacaacagggtgcgccgaacactgctcactgaacgagaatattacagtgccggataccaaggtgaacttctacgcatggaaaagaatggaagtgggacagcaagcagtcgaagtttggcagggtctcgctctgttatctgaggctgttctgcgagggcaggctcttctcgtcaattcatcccagccgtgggaacccctgcagctacacgttgacaaagcagtgtctggcctgcgctcacttactaccttgttgagggcccttggggctcaaaaagaagccatctcgccccctgatgctgcgtcagccgcgccgttaaggaccatcactgcagatacattccgcaaactgtttcgcgtgtactcaaactttctgagaggaaagctgaagctgtatacaggggaggcatgccggaccggagaccgg

SEQ ID NO: 10831 - DNA, 579 bp, Artificial Sequence
  Description of Artificial Sequence: Synthetic coding sequence
atgggcgttcacgagtgccctgcttggctttggctgctgctctcgctcctcagcctgccgctcggcttgcctgtgctgggagccccgccacgtctcatctgcgattctcgggttcttgagcggtatcttcttgaagccaaggaagccgaaaacatcacgactggatgcgcggaacactgcagcttgaacgagaatatcaccgtgcccgacaccaaggtgaacttttacgcgtggaagagaatggaagtcggccagcaggccgtggaggtctggcaggggctggccctgctgtcagaggcagtgctgcgcggacaagccctgctcgtcaattccagccaaccctgggagccgctgcaattgcatgtggataaagcggtttcgggactccgttcacttaccacccttctccgtgcactcggtgctcagaaagaagctatttccccaccagacgctgcttctgcggcgccgctgcgcactatcaccgcagacactttccggaaactcttccgggtgtactcgaacttcctgcgaggcaagttgaagttgtacacgggagaagcatgtcgcactggcgacagg

SEQ ID NO: 10832 - DNA, 579 bp, Artificial Sequence
  Description of Artificial Sequence: Synthetic coding sequence
atgggggttcatgaatgcccggcttggctttggctgctgttgtccctcctgtccctgccgctcggactgcctgtgctgggagcacccccgagactgatctgcgattcaagggtgctcgagcggtacctgctcgaggcaaaagaagccgagaacatcaccactggctgcgcggaacattgtagcctcaacgagaatatcacggtcccagacaccaaagtgaatttctacgcctggaagagaatggaggtgggacagcaggccgtggaggtgtggcagggactcgcgcttctgtccgaagccgtgctgcggggacaagcgctgctggtgaattcatcccagccttgggagccgctgcagctgcatgtggacaaggctgtgtcgggactgagaagcctgacgaccctcctgcgcgcgctgggagcacagaaggaagcgatctcgccaccagacgccgcctcagccgctccactcagaaccatcactgccgataccttccggaagttgttccgggtgtactctaacttcttgcgcggaaaactgaagctctacaccggcgaagcctgccgcactggtgatcgc

SEQ ID NO: 10833 - DNA, 579 bp, Artificial Sequence
  Description of Artificial Sequence: Synthetic coding sequence
atgggcgtgcacgaatgtccggcatggctctggctgcttctttctctcctgtctctgccgctgggactgcctgttctcggcgcaccacccagattaatttgtgacagtcgagtgctggaacgatatctgctggaagccaaggaggctgagaacattacaaccgggtgcgcagaacactgttcgttgaatgaaaacataacggtacctgacactaaggtcaacttttacgcctggaagcgaatggaagtcgggcagcaggccgtcgaggtgtggcaggggctggctctcttgtctgaggctgtcctgaggggacaggccctgctagtcaatagctcacagccttgggagcccctccagctgcacgtggataaagcagtgtccggtttgcgatcccttacgactctcctgagagccctgggggctcagaaggaggctatttctccaccagacgccgcatcagccgcaccactgagaacaattacagctgatactttcaggaaactgttcagagtctattcaaatttcctgaggggaaagctgaaactgtatacaggagaggcttgcagaacaggcgaccga

SEQ ID NO: 10834 - DNA, 579 bp, Artificial Sequence
  Description of Artificial Sequence: Synthetic coding sequence
atgggtgtgcatgaatgtcctgcctggctctggctgctgcttagtctgctgtcactgccactggggttgccagtgctcggcgcacctcctagactgatatgcgattctagggtactggaacgctacctgctagaagcaaaggaagccgagaatataaccaccgggtgcgctgaacactgctctctgaacgaaaatatcactgtgcccgacactaaagtgaatttctatgcttggaaacgaatggaggtaggccagcaggctgttgaagtgtggcaggggctggccctactgagcgaggcagttctgaggggccaggccttactggtgaacagcagccagccatgggaacccctgcagctgcatgtggataaggctgtgtccggcctgcgctctctgacaaccctgctcagggctctgggcgctcagaaggaggcaatcagcccccctgacgccgcctccgccgcccccctgcggacaattacagctgatacatttcggaagctttttcgggtgtacagcaactttctgaggggtaagctcaagctgtatactggggaggcctgtcgcactggtgaccga

SEQ ID NO: 10835 - DNA, 579 bp, Artificial Sequence
  Description of Artificial Sequence: Synthetic coding sequence
atgggtgtgcatgaatgtcctgcttggctctggttgcttctctctctcttgagcctcccgttgggactacctgttcttggggctccccctcgattgatttgcgatagtcgtgtgctggagaggtatcttttagaagccaaggaagccgaaaatattaccaccggatgcgccgaacattgcagtttaaacgaaaacataaccgttcccgatacaaaggtaaatttctatgcatggaaaaggatggaagtcggtcaacaggctgttgaagtttggcagggacttgccctcttaagtgaagcagtcttaaggggacaggcattacttgttaattcgtcacaaccttgggaaccactccaacttcatgtcgacaaggcagttagtggtctgcgatcattgacaacactacttagggccttgggcgcacaaaaggaggctatctcacctcccgatgcagcgtctgcggccccgctcagaactattaccgctgatacattccgaaagttgtttagagtttattccaatttcctccgtggaaaactcaagttgtatacaggagaggcttgtcgtaccggtgataga

SEQ ID NO: 10836 - DNA, 579 bp, Artificial Sequence
  Description of Artificial Sequence: Synthetic coding sequence
atgggcgtgcatgagtgtcctgcatggttgtggctgctgcttagccttctctcacttccacttggactgcctgtgttgggagcacctcctcgtcttatttgtgattcccgagtcctcgaaaggtacttgctcgaagcgaaggaagcagagaacatcactactggttgtgcagagcattgctcgctgaatgagaacattacggtcccggacactaaggttaacttttacgcatggaaaagaatggaagtgggtcaacaggcagtcgaagtgtggcagggattggcgcttctgtccgaggcagttctgagaggacaagcgcttttggtgaatagctcgcagccgtgggaaccactgcaacttcacgtggataaagctgtgtcagggctccgatctctgacgacccttctgcgggcgcttggtgcgcaaaaggaagctatatcgcccccggatgctgcatccgcagcaccactgagaaccatcaccgcagatactttccggaagctctttcgtgtgtacagcaacttccttcgcggtaaactgaagctctacaccggagaagcgtgcagaaccggggaccgg

SEQ ID NO: 10837 - DNA, 579 bp, Artificial Sequence
  Description of Artificial Sequence: Synthetic coding sequence
atgggcgttcacgaatgccccgcgtggctctggctcttgctgtctttactcagcctgccactgggcctcccagtcctgggagccccaccaaggctcatctgtgactcccgagtgcttgagaggtatctgctggaggctaaagaggccgaaaacatcactacgggatgcgctgaacattgctccctgaacgagaacataacggtgcccgacaccaaggtaaatttctatgcctggaagagaatggaggtaggccagcaagcagttgaggtgtggcaagggttagccctcctgtctgaggcagttttaagagggcaggctctgctggttaatagcagtcagccgtgggaaccgcttcagttacatgtggacaaggccgttagcggcctaaggtccctgaccaccctcctgcgggcactgggagcgcagaaagaggcgatcagcccacctgatgccgcctcagccgcacccctcaggaccataacagctgataccttccgaaagctttttcgcgtgtactccaacttccttcgaggaaagctcaagctgtatacaggggaagcctgcaggactggcgacaga

SEQ ID NO: 10838 - DNA, 579 bp, Artificial Sequence
  Description of Artificial Sequence: Synthetic coding sequence
atgggtgttcatgaatgccccgcatggctgtggctccttctcagcctgctgtcattacccctgggcctacctgtactgggcgccccccccaggttgatctgcgattctcgggtgcttgagaggtatcttctcgaagctaaagaggccgagaatataacaacgggctgcgcagaacactgtagcctgaacgaaaacatcacagtcccagatactaaagtcaacttctatgcctggaagagaatggaagtaggccaacaagcagttgaggtgtggcagggactggctctcctgtcagaggccgtcctccgggggcaagcgctgctagttaacagttctcaaccatgggagcccctgcagctgcacgtcgataaggcagtgagtggactgcgaagtctgaccaccttgttaagagccctgggtgctcagaaagaagccataagcccccccgacgctgcctctgcggctcctcttaggaccataacagcggacacatttcgcaaactattcagggtttacagtaattttttacgggggaaactgaagctttacactggcgaagcctgccggactggagataga

SEQ ID NO: 10839 - DNA, 579 bp, Artificial Sequence
  Description of Artificial Sequence: Synthetic coding sequence
atgggagtgcatgaatgtcccgcatggctttggctccttctctcgctgttgtcgcttccacttgggctgccggtgcttggtgcccctccgcggctgatctgtgattctcgagtgctggaaagatatctccttgaagccaaggaagccgaaaacattactaccgggtgtgccgagcattgctctctcaatgaaaacattaccgtgcctgacaccaaggtcaacttttatgcttggaagcgtatggaagtgggacagcaagcagtggaggtttggcaaggactcgccctcctttccgaggctgtgctccggggtcaggccctgctggtgaattccagccaaccttgggagcctcttcaactccacgtggataaagcggtgtccggtctgagatcgcttactacgctcctgcgcgcgttgggggcacaaaaagaggcgatttccccacctgacgcagcaagcgccgccccactgcgcactatcactgctgatacgtttcgcaagctgtttagagtttactcaaactttcttagaggtaaacttaagctctacaccggcgaagcgtgtcggactggtgaccgg

SEQ ID NO: 10840 - DNA, 579 bp, Artificial Sequence
  Description of Artificial Sequence: Synthetic coding sequence
atgggcgtgcacgagtgtccagcatggctctggctgctcctctccctccttagcctgcccctgggactgcccgtcctcggagccccgccccggcttatatgtgatagtagggttttagagagatatctgctcgaagccaaggaggccgagaatatcaccaccggctgcgccgagcactgttcccttaatgaaaacataactgtgcctgacacaaaagtgaatttctacgcctggaaaaggatggaggtgggccagcaggccgtggaggtttggcagggcttggcactgctctcggaggctgtccttcgagggcaggctctcctggtgaatagtagtcagccttgggagcccctgcagctgcacgtggataaggctgtaagtgggctgagaagtctcactacattactgagggctctaggcgcacagaaggaggctatctcacccccagatgctgcctctgcagccccgttgaggaccatcacagctgacacttttaggaagttgtttagagtgtacagtaatttcctgcgggggaagcttaaactgtacactggagaagcttgtcgcaccggcgacagg

SEQ ID NO: 10841 - DNA, 579 bp, Artificial Sequence
  Description of Artificial Sequence: Synthetic coding sequence
atgggcgttcacgagtgtcccgcctggctttggctcctgctttcccttctgtcattgccactcggcctcccagtactcggtgcaccaccccgtctgatctgcgacagcagggtgcttgaacgctacttattagaagccaaagaggctgaaaatataaccaccggatgtgctgaacattgttcattgaacgaaaacatcacagttcccgacacaaaagtgaatttctatgcctggaaaagaatggaggtcggacagcaagccgtggaagtttggcagggcctggccctgctgagcgaagcagtgctgcgaggccaggccctcttggtaaattcaagccaaccatgggaacccctccaactgcacgtcgataaagccgtgagcgggctgcggtctttgaccacccttcttagggcactaggagcccaaaaggaggcaatcagtccacctgatgctgccagcgccgcgcctctgagaacaattacagcggacacttttcggaaattattccgcgtgtatagcaacttcctcagagggaaattgaagctgtacaccggcgaagcttgtagaactggggacagg

SEQ ID NO: 10842 - DNA, 579 bp, Artificial Sequence
  Description of Artificial Sequence: Synthetic coding sequence
atgggcgtgcatgagtgtcctgcgtggctctggcttctgctttccctcctgtccctgccactggggctgcccgtcctcggagccccaccacgtcttatctgcgactcccgcgttcttgaacggtatcttctggaagcaaaggaagcagagaacataaccactggctgcgccgaacattgttcactcaacgaaaacatcactgtgcctgacacgaaggtcaacttttacgcgtggaagagaatggaagtgggtcaacaggcagtggaagtctggcaaggtcttgctcttctgagcgaagcagtgctgcggggtcaggccctgctcgtgaactcctctcagccgtgggagcccttgcagctgcacgtggacaaggctgtctccggactcagaagcctcactactctccttcgagcccttggagcccaaaaggaggcaatttcgcctcccgatgccgcatcggccgcgccactgaggacgattactgcagacaccttccgcaagctgtttcgcgtgtattctaatttcctccgcgggaaacttaaactgtacactggagaggcgtgtaggaccggggatagg

SEQ ID NO: 10843 - DNA, 579 bp, Artificial Sequence
  Description of Artificial Sequence: Synthetic coding sequence
atgggagtgcatgagtgccccgcgtggctgtggctcctgctctcactcctgtccctgccactgggtctcccagtgctcggtgccccaccacgtctcatttgcgattctcgggtactggagcgctatctgctggaagccaaagaagccgaaaacataaccaccggctgcgctgaacactgcagcctcaacgagaacattaccgttcccgacaccaaggtaaacttctacgcctggaagcgcatggaggtgggacagcaggctgtggaggtttggcagggcttggcccttttgagtgaggctgtcttaaggggccaggctcttctggttaattcatcacagccatgggagcccttacagcttcacgttgacaaggctgtgtccggtctgcgttccctgacaactcttctccgggcattaggcgctcaaaaggaggcgatctcgccccccgacgcggcctccgccgcccccctacgcacgataactgcagatacattccggaagctattcagagtgtatagcaactttctccgggggaagctgaaattgtatacaggagaggcttgccgcaccggcgaccga

SEQ ID NO: 10844 - DNA, 579 bp, Artificial Sequence
  Description of Artificial Sequence: Synthetic coding sequence
atgggcgtccatgagtgccccgcgtggttgtggctcctgctttcgctgctttcactgcctctcggcctgccagtgctcggagccccgcctcggttgatctgcgattcgagagtactggaacggtacctccttgaggcgaaggaagctgaaaacattactactggatgtgcagagcactgcagcctcaacgagaacatcaccgttcctgataccaaggtgaacttttacgcatggaagcgcatggaagtcggacagcaggctgtggaggtgtggcagggactggccctgctctcagaggcagtcctgcgcggacaggccctgctggtgaacagctcccagccctgggagccactgcagttgcacgtcgataaggccgtctcgggcctgagatcgctgacgactcttctcagagcgctgggagcccaaaaggaggccatctcgccgcctgacgctgcctccgctgctccactgcgaactatcacggccgacactttccggaaactgttccgcgtgtattctaacttcctgcggggcaaactcaaactctacaccggagaagcctgccgcaccggagatcga

SEQ ID NO: 10845 - DNA, 579 bp, Artificial Sequence
  Description of Artificial Sequence: Synthetic coding sequence
atgggagtgcatgagtgcccagcctggctctggctgcttctctcgctgctttccctgccccttggccttcctgtgttgggggcaccgcccagactgatctgcgactcacgtgtcttggagaggtacctgttggaagcaaaagaggcggagaatatcaccaccggttgcgccgagcactgcagccttaacgaaaacattacggtgccggacactaaggtcaacttctacgcgtggaagcggatggaagtgggccaacaggcggttgaagtatggcaggggctggctctgctttccgaagccgtgctcagaggacaagctctcttggtcaactcgtcgcagccttgggaaccgctgcagctgcacgtggataaggccgtgtcaggcttgcgatccctgaccaccctgctgcgggccctgggagcacaaaaagaagcaatctcaccgccagacgcagcttctgcggcgccgctgcgcaccatcaccgccgacacttttcgcaagttgttccgtgtctacagtaatttcctccgcggaaagctgaaattgtacacgggagaggcatgtcgcactggtgatcgg

SEQ ID NO: 10846 - DNA, 579 bp, Artificial Sequence
  Description of Artificial Sequence: Synthetic coding sequence
atgggcgtgcacgagtgtcccgcctggctttggttgcttctgtcgctccttagccttcctctcggcctgccggtgttgggtgcacctccacgtcttatctgcgattcacgggtgctcgaacgatacctgttggaagcaaaagaggccgagaacattaccactgggtgtgcagaacattgttcgctgaatgagaatatcaccgtgcctgacaccaaagtcaacttttacgcatggaagcgaatggaagtgggccagcaagctgtggaggtgtggcaaggtttggccctcctgtccgaggcagtgcttaggggacaggcactgcttgtgaactcctcgcaaccttgggaacctctgcagctccacgtcgataaggcagtctccggcctgcggtcgctcacgaccctgctgagagccctcggcgcccaaaaggaagcaattagccctccggatgccgcctcggctgccccgcttcggactatcaccgcagatacgttccggaagctgtttcgagtgtacagcaactttctcagaggtaaattgaagctgtacacgggagaagcctgcagaactggtgacaga

SEQ ID NO: 10847 - DNA, 579 bp, Artificial Sequence
  Description of Artificial Sequence: Synthetic coding sequence
atgggcgtccacgaatgtcctgcctggttgtggctcctcctgtctctacttagcctacctctcggcttacctgtcctgggcgcaccacctcgcctgatttgtgacagccgcgtgctcgagcggtatctactagaggcaaaggaggccgagaacattaccaccggatgcgccgagcactgttccctaaacgaaaacattacagtgccggataccaaggtgaacttctatgcctggaagaggatggaagtggggcaacaggccgtggaggtgtggcagggactcgctctcctgtcagaagcagtgctccgaggtcaggcactacttgttaacagctctcagccatgggagccactccagctgcatgtggacaaggctgtgtcgggcctccgctccctcacgacgttactgagggcgcttggcgcccagaaggaagctataagcccacctgacgcagcctctgcggcccctctcagaactatcactgccgacactttcaggaagctctttcgcgtgtattcaaattttttgcgaggtaagttaaaactatatacaggcgaagcctgccggaccggcgaccgg

SEQ ID NO: 10848 - DNA, 579 bp, Artificial Sequence
  Description of Artificial Sequence: Synthetic coding sequence
atgggcgtgcacgagtgccctgcatggctctggctgctcctttccctgctttccctgcctctgggcctccctgtgcttggagccccgccccgcctcatttgcgattccagagtgcttgaacgataccttcttgaggcaaaggaggcggaaaacatcaccaccgggtgtgcagaacactgttctctgaatgaaaacatcactgtgcccgatacgaaggtgaatttctacgcttggaagcgaatggaagtgggacaacaggcagtcgaagtgtggcaaggacttgccctgctctccgaagcggtgcttagaggccaggcactcctggtcaactcatcgcagccctgggaacctcttcagctgcatgtggataaggccgtgtcaggcctgcgctcgctgactaccctgctcagagcattgggcgcacagaaggaggcaatatcgccaccggacgcagcaagcgcagcccccttgagaacgatcactgccgacacctttagaaaactctttagagtgtatagcaacttcttgagggggaagctcaagctgtacacgggtgaagcctgccgcaccggagataga

SEQ ID NO: 10849 - DNA, 579 bp, Artificial Sequence
  Description of Artificial Sequence: Synthetic coding sequence
atgggtgttcatgaatgtcctgcatggctttggttgttgttaagtttattatctttacctttaggtttacctgtattaggtgctcctcctagattaatatgtgattcaagagttcttgaaagataccttttagaagcaaaagaggctgaaaatattacaactggatgcgctgaacattgttcattaaatgaaaatattacagttccagatactaaagtaaatttttatgcttggaaaagaatggaagttgggcaacaagcagttgaagtttggcaaggacttgcattactttcagaagctgttttaagaggacaagctttacttgttaattcttctcaaccatgggaacctctacagttgcatgtagataaagctgtttctggacttcgaagtcttacaactcttcttagagctttaggagcacaaaaagaagctatttcaccaccagatgccgcttcagcagctccattaagaacaattacggctgatacatttagaaagttatttagagtttatagtaattttcttagaggtaaattaaaattatatactggggaagcatgtcgaacaggtgacaga

SEQ ID NO: 10850 - DNA, 579 bp, Artificial Sequence
  Description of Artificial Sequence: Synthetic coding sequence
atgggcgtgcacgagtgtcctgcatggttgtggctactgttgagcctgctgtccctccctctgggccttcctgtgctgggcgccccccctcgattaatctgtgattctagggtactcgagaggtaccttttagaagctaaggaagctgagaacattaccacagggtgcgctgagcactgcagcttaaatgagaacattacagtccccgataccaaggtgaacttctatgcctggaagagaatggaggtgggccagcaggccgttgaagtctggcagggattggcgctgctctctgaagctgtgctgcgcgggcaggctcttctagtaaacagcagtcagccttgggaacctctccaattacatgtcgacaaggcagtctcagggttgaggagtctgactacattgctcagggccctcggggcacaaaaagaggctatttcgccgcccgatgctgcctccgccgcacctctgcggacgatcactgcggatacattccgcaaactgtttcgcgtctatagtaacttcttgcggggcaaattaaaactgtataccggagaggcctgccggaccggcgatcgt

SEQ ID NO: 10851 - DNA, 579 bp, Artificial Sequence
  Description of Artificial Sequence: Synthetic coding sequence
atgggagtgcatgaatgcccagcgtggctgtggctcctcttgagcctcctgtcgctgccgctcggcctgcctgtgctgggcgcaccgccacgccttatctgcgactcccgggtcctggaacgctacctgctggaggccaaggaggcagaaaacattactaccggatgcgccgaacactgcagcctgaatgaaaacatcactgtgccggacaccaaggtcaacttttacgcttggaaaaggatggaagtcggtcagcaagcagtggaggtctggcagggactcgccctgctgtccgaagcagttcttcggggtcaagcactgctcgtgaacagctcccagccgtgggagccgcttcaactgcatgtcgacaaggctgtctccggcctgagatccctcactaccctgctgcgcgctttgggagcacagaaggaggcaatctcacctccggatgccgcgagcgccgcgccgctgaggactattacggcggacaccttccggaagctgtttcgggtgtacagcaactttctgcgcggaaaactgaagctgtacactggagaagcatgccggactggagatcgc

SEQ ID NO: 10852 - DNA, 579 bp, Artificial Sequence
  Description of Artificial Sequence: Synthetic coding sequence
atgggggtgcatgagtgtcctgcctggctgtggctcctgttgagtttgctcagtctgcctttgggtctcccagtcctcggggcccctcctaggctcatctgcgactccagagtcctggaacggtacctgctggaggccaaggaagcggaaaacattacaaccggatgtgcagagcactgctctctcaatgaaaacatcactgtgcccgacacaaaagtgaatttttacgcgtggaagagaatggaagtgggccagcaagccgtggaggtctggcaggggttggcgctgttgtcagaagctgtcctgagaggtcaggcattgctagtgaactcttctcagccctgggaacctttgcagctgcacgtggacaaggccgtctctgggctgagatccctgaccacactgttgagagcattgggggcccagaaagaggcgatctctccacccgacgccgcctctgccgcgccattaaggaccatcaccgccgatacttttaggaagctgtttcgcgtctactcaaattttctgagaggaaagttgaagctatacacgggggaagcctgccgcacaggcgacaga

SEQ ID NO: 10853 - DNA, 579 bp, Artificial Sequence
  Description of Artificial Sequence: Synthetic coding sequence
atgggggtgcacgagtgtcccgcttggttgtggcttctgctctcccttttgtctctgccgctgggcctgccggttcttggtgcccccccccggctgatatgcgactctagagtcctagaacgctatctcctggaggctaaggaggcagagaacattacgactggctgcgctgaacattgtagtctgaacgaaaatatcaccgttccagatacgaaggtgaacttctacgcgtggaagaggatggaggtggggcaacaagccgttgaagtgtggcaagggctggctttgctctccgaagccgtccttaggggacaagcactgttggtcaactcatctcagccatgggagcccctccagcttcatgtcgataaggccgtgagtggcttgaggtcactcacaacgttgttgagggccctgggtgcgcagaaggaggcaatcagtccacctgatgccgcctctgcagccccactgcgaaccattaccgcagatacatttaggaagctcttcagggtctactctaactttttgagagggaagctaaagttatataccggtgaagcctgcagaaccggcgatagg

SEQ ID NO: 10854 - DNA, 579 bp, Artificial Sequence
  Description of Artificial Sequence: Synthetic coding sequence
atgggcgtgcacgaatgccccgcttggctttggctcctgctatctctgttgtcgctgcccctaggactgcctgtgctcggagcaccacccagacttatctgcgattctcgagtgcttgaaaggtatctgctcgaggctaaggaagctgagaatatcacaaccggctgcgccgagcactgcagcctcaacgagaacatcactgtgcctgacactaaagtgaacttctacgcatggaaacgcatggaggtggggcaacaggctgtcgaagtctggcagggtctggcgctgctgtccgaagccgtgctcagaggacaagctctgctcgttaacagctcccaaccgtgggagcctttgcaattgcacgtcgacaaagctgtctccggattacgctctctcactactctcctgcgggctctcggcgcccagaaagaagctatatcccctccagatgctgcttcagcagcccccctcaggaccattacagccgacacatttagaaaactttttagggtgtacagcaacttcctgcggggaaaacttaagctctatacaggagaagcttgtaggacaggcgaccgg

SEQ ID NO: 10855 - DNA, 579 bp, Artificial Sequence; identical to SEQ ID NO: 10811
  Description of Artificial Sequence: Synthetic coding sequence

SEQ ID NO: 10856 - DNA, 579 bp, Artificial Sequence
  Description of Artificial Sequence: Synthetic coding sequence
atgggcgtgcacgagtgtcctgcatggctgtggttgttgttgagcctgctgtcattgccactgggcctccctgtgctgggtgctccacctcgtttgatttgtgacagccgcgtgctggagcgctatctcttggaagccaaggaagccgagaacatcacaacaggatgtgccgaacactgctcactcaacgagaatattaccgtaccagacaccaaggtgaatttttacgcctggaagaggatggaagtgggtcagcaggccgtcgaagtttggcagggtctggctttgctcagcgaggcagtactgagaggtcaggccctcctggtaaatagctcccaaccctgggagcctctccagttgcacgtcgacaaggctgtgtctggtctcagatccttgacaacccttcttagggctctgggcgctcagaaagaagctatcagcccccccgacgctgcttccgctgctccactccgcactatcaccgctgacacttttaggaaactctttcgtgtttactctaacttccttcgcggtaagcttaagctgtatacaggtgaggcctgcagaaccggtgacagg

SEQ ID NO: 10857 - DNA, 579 bp, Artificial Sequence
  Description of Artificial Sequence: Synthetic coding sequence
atgggggtccacgagtgcccggcgtggttatggctgttgctgtcactcctgagccttcctctcggtctgcctgtcctcggcgctccccctcgcctgatttgtgatagcagggtgctggaaagatatctcttggaagctaaggaagccgagaacatcactactggttgcgcagagcactgtagcctgaatgagaacatcacggttcccgataccaaggtaaatttttatgcatggaagcgaatggaagtcggccaacaagccgtcgaggtgtggcagggtctggcattattatcggaggccgtgttgagaggtcaggcactgctggttaatagcagccaaccatgggagcctctgcaactgcacgttgacaaagctgtgtctggcctgcgttccctgaccactctgctccgggcactcggcgcacaaaaggaagcaatcagccctcctgatgctgcctctgccgcccccctgcgtactataaccgccgacacattccgcaagctttttcgggtttacagtaacttcctacgcgggaaactgaagctctatacgggcgaagcttgccggacaggcgataga

SEQ ID NO: 10858 - DNA, 579 bp, Artificial Sequence
  Description of Artificial Sequence: Synthetic coding sequence
atgggagtccacgagtgcccagcctggctgtggctgctgctgtccctcctgtccttgccgttgggactgccggtcctgggcgcaccgcctagactcatctgcgattcacgcgtgctggaacggtaccttttggaagcgaaggaagccgaaaacatcaccactggatgcgccgaacattgcagcctgaatgaaaacattactgtgcctgacactaaggtgaacttttacgcctggaagcggatggaggtgggacaacaggccgttgaggtctggcaggggctggctctcctgagcgaggcggtccttcgcggccaggccctgctggtaaacagcagccagccgtgggagccgcttcagctccatgtggacaaggccgtctcaggattgcgatcactgacgaccctgctccgggctctgggagcccaaaaggaagccatttctccaccggatgccgcctcggcagcgcctctccgcactatcactgccgacacgtttaggaaactttttcgggtgtactcgaatttcctgcggggaaagctgaaactttacaccggcgaagcgtgtagaaccggcgatagg

SEQ ID NO: 10859 - DNA, 579 bp, Artificial Sequence
  Description of Artificial Sequence: Synthetic coding sequence
atgggtgtgcatgaatgccccgcctggctgtggctgttgctgtcccttttgtccctgccacttggactccccgtgcttggggccccacctcgtttgatttgtgactctcgtgtgcttgaacgttacctgctcgaagcaaaggaggcagaaaacattaccaccggatgtgctgaacactgctcgcttaatgaaaacattacggtccccgatactaaggtgaatttctatgcatggaagagaatggaagtgggtcaacaggccgtggaagtttggcaaggcctggcccttctgtcggaggccgtcctccggggacaagcacttcttgtgaactcgagccagccgtgggagccacttcaactgcacgtggataaagcagtgtccgggttgagatcccttaccaccctccttagggcactgggggcacaaaaagaagcaatctccccacctgatgcagctagcgcggcaccacttcgaactattaccgcagatacgtttagaaaactttttcgcgtgtactccaacttccttcggggaaaacttaaactttacactggtgaagcatgtcggactggcgacaga

SEQ ID NO: 10860 - DNA, 579 bp, Artificial Sequence
  Description of Artificial Sequence: Synthetic coding sequence
atgggagtccatgaatgtcccgcttggctctggcttctcctttcgctgctttcattgccgctcggactgccggtgctgggcgcaccgcctcgactgatttgcgactcgcgggtgcttgaaagatacctgctggaagcaaaggaggcagaaaacatcacgaccgggtgcgctgagcattgtagccttaacgaaaacatcactgtgccagatactaaggtgaatttctacgcatggaagaggatggaggtcggtcagcaggcagtggaagtctggcaaggactcgcacttctgtccgaagcagtcttgcgtggccaagccctgcttgtgaatagctcgcaaccttgggaacccctgcaacttcacgtcgataaagctgtgtcaggtctgaggtccctcactactcttctcagagctttgggcgcacagaaagaggcgatttcgccacctgacgccgcatcggccgccccccttcgcaccatcaccgccgatacgttccgtaaacttttccgggtgtacagcaacttcctgcggggtaaacttaagctgtacactggagaggcatgccggaccggagatagg

SEQ ID NO: 10861 - DNA, 579 bp, Artificial Sequence
  Description of Artificial Sequence: Synthetic coding sequence
atgggtgtccacgaatgtcctgcgtggctttggcttttgctttcgctgctgagcctgccactcggccttcccgtgttgggagctccaccaaggctgatatgcgattcacgcgtccttgaaaggtatcttcttgaggcaaaagaagccgaaaacatcactaccgggtgtgcagaacactgtagcttgaatgaaaacattactgtgccggacaccaaggtgaatttctatgcgtggaagcgaatggaggtcggtcagcaagcagtggaggtgtggcaaggactggcactgcttagcgaggcagtgctgagaggacaggcactgttggtcaactcctcgcagccttgggaaccacttcaactccacgtagacaaagctgtctcaggtttgagatcgctgacgaccctgctgagagcacttggggcacaaaaggaggcgatttcaccccccgacgcagcatcggcagcgcctctgcggaccattaccgccgatacttttcgcaagttgtttagagtgtactccaactttctgcgaggaaagctgaaattgtacactggagaggcatgccgtacgggcgatagg

SEQ ID NO: 10862 - DNA, 579 bp, Artificial Sequence
  Description of Artificial Sequence: Synthetic coding sequence
atgggggtgcatgagtgcccagcttggctttggctgttgctctcgctgctgtccctgcctctgggccttcccgtgcttggcgcccctccaaggcttatttgcgattccagagtgttggaacgataccttctggaagcgaaggaggcagagaacattactacggggtgcgcagagcattgttcgctgaacgaaaacattaccgtgccagataccaaggtcaacttctacgcatggaagagaatggaagtgggacaacaagccgtcgaagtgtggcagggcctggctttgctcagcgaagcggtcttgcgcggccaagcactgctcgtgaattcttcccagccctgggaaccactgcaactgcatgtcgacaaggccgtgtcaggcttgcgaagccttaccactcttcttcgcgcccttggagcccaaaaagaggccatttccccgcctgatgcagcctccgccgcacctctccgcactatcaccgcagacacctttaggaagctgtttcgcgtgtacagcaattttctccgcggtaagctcaagctctatacgggcgaggcatgcagaaccggagatcgg

SEQ ID NO: 10863 - DNA, 579 bp, Artificial Sequence
  Description of Artificial Sequence: Synthetic coding sequence
atgggagtccacgagtgtcccgcttggctgtggctgttgctttccctcctctcccttcctcttggtctgccggtgctcggtgcgccaccgagactgatttgtgacagcagagtgttggaaaggtacctgttggaagctaaggaggcagagaacatcaccaccggttgtgccgaacattgctccctgaacgaaaacatcactgtgccagataccaaggtcaatttctacgcctggaagaggatggaagtcggccagcaagctgtggaagtgtggcagggcctggcgctcctgagcgaagccgtgctgcggggacaagccctcctcgttaactcaagccagccctgggaaccgctgcagctgcatgtggataaggcagtgtcgggactccgctcgctgaccactctcctgagggcacttggagcgcagaaagaggccatctcgccacccgacgccgcctctgcagccccactccggaccattaccgcggacactttcaggaaactcttccgggtgtacagcaactttctgaggggtaagttgaagctctacactggcgaggcctgtcgaactggggaccgc

SEQ ID NO: 10864 - DNA, 579 bp, Artificial Sequence
  Description of Artificial Sequence: Synthetic coding sequence
atgggagtgcatgagtgtccagcatggttgtggctgcttttgtctcttctgtcactcccgcttggcctgcccgtgctgggggcacctcctagactgatttgtgattcacgggtcctggaacgataccttctggaagcaaaggaggcagaaaacattacgacgggttgcgcggaacattgttcgctgaacgagaacatcactgtgccagacaccaaggtgaacttctacgcatggaagcgtatggaagtgggacagcaagcagtcgaagtgtggcagggtcttgcattgctttccgaggcagtccttagagggcaagccctgctggtcaactcgtcgcaaccatgggaaccccttcagctgcatgttgacaaggcagtttccggactgcgcagccttaccactcttcttagagcactcggtgcacagaaggaagcaattagccctcccgacgccgcatcagcagcacccctccggaccatcaccgcggataccttcaggaagctcttcagagtgtattcgaactttttgagagggaaactcaagctgtacactggggaagcctgtcggacgggagatcga

SEQ ID NO: 10865 - DNA, 579 bp, Artificial Sequence
  Description of Artificial Sequence: Synthetic coding sequence
atgggagttcatgaatgtccagcttggctatggctcttgctctctttgttgtcattaccacttggcttaccagttctgggagcacctccaagacttatttgcgactctcgtgtgttggaacgttatcttcttgaggctaaagaggcggaaaatataacaactggatgtgcagaacattgttcgcttaacgaaaacattacagtgccagatacaaaggttaatttttatgcttggaaacggatggaagttggacaacaagctgtggaggtttggcaaggccttgcgctcctttcagaagcagtattaagaggccaggcactacttgttaatagttctcagccatgggagccacttcaactccatgtggataaagccgtcagtggattacgttcgcttactacacttcttcgcgctctcggagcccagaaagaggccatttcacctcctgatgcagcctcagccgctccgttgagaacaattacagcagataccttccggaagttattccgtgtctattcaaattttttgcgtggaaaactgaagctctatacaggagaagcttgtcgcactggagaccgt

SEQ ID NO: 10866 - DNA, 579 bp, Artificial Sequence
  Description of Artificial Sequence: Synthetic coding sequence
atgggcgtgcatgaatgtcctgcctggctatggcttctcctcagcctgctgagtctccccctgggcttaccagtgttgggcgccccccctcgcctgatatgtgatagtcgggtcctagaacgataccttctcgaggccaaggaagcggaaaacatcaccacagggtgtgcagagcattgctctttgaacgaaaatataaccgtgcctgatacaaaggttaatttctatgcatggaagcggatggaggtcggacagcaggccgtagaggtgtggcaggggctagccttgcttagtgaggcagtgctgcgcggacaggctctgctggtgaacagctcgcagccatgggagcccttgcagctgcatgtggacaaggccgtatccggcctgcgttccttgaccacccttctcagagccctgggcgctcagaaggaggcaatctctcccccagatgccgcctccgccgctcctttgcggactatcacagcagatacgtttcggaagcttttcagagtgtactcaaactttctgaggggaaagcttaagctctacacaggggaggcgtgtcgcacaggggatcga

SEQ ID NO: 10867 - DNA, 579 bp, Artificial Sequence
  Description of Artificial Sequence: Synthetic coding sequence
atgggggttcatgaatgtcccgcgtggctgtggttgctcctgagcctcctctctctgccactagggttgcccgttctgggggctcctccaaggttgatatgcgactcccgggtgcttgagcggtacttgctagaggctaaggaggctgaaaatattacgaccggctgcgcagagcattgtagcctcaatgaaaacataacagtaccagatactaaggtgaatttttatgcatggaagcgtatggaggttggccaacaggcggtcgaagtctggcaggggcttgcacttttatccgaggcggtgctcaggggtcaggctctgctcgtgaattcaagccagccgtgggagcctctgcagttgcatgtggacaaggccgtgtccggacttcgctctttgacaaccctgctccgggccctaggagctcagaaggaggctatttctcctcctgatgcagctagcgccgctcctctcaggacaattaccgcagatacattcagaaagttgttcagagtgtattcaaacttccttcgtgggaagctgaaactgtatacaggagaggcatgtagaacgggtgataga

SEQ ID NO: 10868 - DNA, 579 bp, Artificial Sequence
  Description of Artificial Sequence: Synthetic coding sequence
atgggtgtgcatgagtgcccggcttggctctggttgctgctgagtctgctgagtctcccactgggtctgcccgttcttggtgctccgccacgcctcatttgcgactcccgcgtcttggaacgttacctcctggaggccaaggaggccgaaaacatcaccaccggctgtgctgagcattgttctctcaatgagaacattacagtcccggataccaaggtcaacttctacgcgtggaagcgcatggaggtcggccagcaggccgtcgaggtctggcagggtctggccctgctgtctgaggcggtcctccgtggccaagccctcttggttaactcctcccaaccgtgggagcctttgcagctgcacgtagataaggcggtcagtggcctgcggtcgctgaccaccctgttgcgtgctctgggcgctcagaaagaggccattagcccgcccgatgctgcctccgccgccccactccgtactatcactgccgacacgtttcgcaagctcttcagggtctatagcaacttcctgcgtggcaaacttaagttgtacacaggtgaggcgtgtcgcaccggagaccga

SEQ ID NO: 10869 - DNA, 579 bp, Artificial Sequence
  Description of Artificial Sequence: Synthetic coding sequence
atgggtgtgcatgagtgtccggcatggctctggctcctcctctcactgctgagcttgccactgggactgcccgtgctgggggcgccgcctcgcttgatctgcgacagcagagtgctcgagagataccttcttgaggcgaaagaagccgagaacatcactaccggttgcgccgaacactgctcccttaacgagaacataaccgtgccggatactaaggttaacttctacgcatggaagcgcatggaggtcggacaacaggccgtggaggtgtggcagggactggcgctgttgtcggaagccgtgctgagaggacaagcactgctggtgaattcatcgcagccctgggaaccactccagcttcacgtggataaggcggtcagcggcctgagatcgctgacgactctgctgcgcgctttgggagcccaaaaagaagctatctcgccgcccgacgccgcctctgcggcccccctcagaaccatcactgcagataccttccggaagctgtttcgggtgtactcgaacttcctgagaggaaagctgaagctgtacacgggcgaggcgtgcaggacgggcgatcgg

SEQ ID NO: 10870 - DNA, 579 bp, Artificial Sequence
  Description of Artificial Sequence: Synthetic coding sequence
atgggtgtccatgagtgtcccgcttggctctggcttttactgtctcttctctctttacccctggggctgccagtgcttggtgcaccgccaaggctaatatgtgactctcgggtgctggaaaggtacctgttagaagctaaagaagccgagaacatcacaactggatgtgctgaacattgctccttgaacgagaacatcacagttccagatacaaaagtgaacttctatgcttggaagaggatggaggttggacagcaggccgtcgaggtttggcaggggctcgcactgctcagtgaggcggtgctacgcggtcaggccctgttagtcaactcctcccagccctgggagccactgcaattgcacgtggacaaggcagtgagcggattaaggagccttaccacgctactgcgcgctctgggggctcagaaagaggcgatctctcctcctgacgctgcaagcgctgcccccctgagaaccatcacagcggacacattcaggaagttgttccgcgtgtatagtaattttcttcgggggaagctcaaactgtacaccggcgaggcctgtaggactggagaccgg

SEQ ID NO: 10871 - DNA, 579 bp, Artificial Sequence
  Description of Artificial Sequence: Synthetic coding sequence
atgggtgtccacgagtgtccggcctggctgtggctgctcttgtcgctcctctcactgccactgggcctgccggtcctcggagccccacctagactgatttgtgactcccgggttctggaaaggtaccttctcgaagcgaaggaggccgagaacattactaccggatgcgccgagcactgctccctgaacgagaatatcaccgtcccagataccaaggtgaacttttacgcctggaagagaatggaagttggacagcaggcggtggaggtgtggcagggactggcattgctctcggaggccgtgctgcgggggcaggcgttgctggtcaactcatcacagccgtgggagccactgcagcttcatgttgacaaagcagtgtccggacttcgatcgctgactactttgctgcgggctctgggcgcgcagaaagaagcaatctccccgcccgacgcagcgtccgctgccccgctccgcactatcactgcggacacttttagaaagttgttcagagtgtactcgaacttcctgcgaggtaaacttaagctgtacaccggagaagcgtgccggactggcgatcgc

SEQ ID NO: 10872 - DNA, 579 bp, Artificial Sequence
  Description of Artificial Sequence: Synthetic coding sequence
atgggagtgcatgagtgtccagcctggctgtggctgctgcttagtcttctgagcctgccgctcggcctgccggtgttgggggccccccctcgactcatatgtgattctagagttctggagaggtacctcctggaggccaaagaggcggaaaatatcactacaggttgtgctgagcattgctccctgaacgagaacataacagtgcctgacacaaaggtaaacttttacgcgtggaaaaggatggaggtggggcagcaggctgtggaggtgtggcagggattggcgctgcttagtgaggcggttctccgcggacaggccctccttgtgaatagctcccaaccatgggaaccacttcagcttcacgtggacaaggccgtatctggactgcgctccctcaccacgctgcttcgggcactgggggcccagaaggaggccatcagccctccagacgcagcatctgccgccccgctgcgaaccattaccgctgatacttttcgaaaactttttagagtctattccaacttcttgaggggtaagctgaaactttacactggggaagcctgtcgaaccggggaccgc

SEQ ID NO: 10873 - DNA, 579 bp, Artificial Sequence
  Description of Artificial Sequence: Synthetic coding sequence
atgggagtgcacgaatgcccggcctggctctggcttctgctgtcccttttgtccctgccgctgggattgcccgtgctgggagctccgcctcgcctgatctgcgactcacgcgtgcttgagcgctacctgctggaggccaaagaggcggagaacatcaccactggatgcgcggagcactgtagcctgaatgaaaatatcactgtcccggacactaaggtcaatttctacgcatggaagaggatggaagtgggtcaacaagcagtggaggtctggcaaggactcgccctcttgtcagaagccgtgctgcgggggcaggcccttctcgtcaattcgtcccagccgtgggagccactgcaactgcacgtggacaaggcggtcagtggcctgcgctcgctgaccaccctcctgagggcactcggtgcgcagaaggaggcaatttcaccccctgacgccgcctcggccgctccgctgcggactatcactgctgacactttccggaagctgttccgcgtgtacagcaatttcctgagaggaaagttgaaactgtacactggcgaggcctgtagaaccggcgaccgg

SEQ ID NO: 10874 - DNA, 579 bp, Artificial Sequence
  Description of Artificial Sequence: Synthetic coding sequence
atgggggtacatgaatgccccgcctggctgtggctacttctttcacttctgagtctcccactggggctaccagttctgggggcacccccacgcctcatatgtgactccagggttctggaacgatatcttctagaggccaaagaggccgagaacataacaactggatgtgcagaacattgttcacttaacgaaaatatcacagtgccagatacaaaggtgaacttctatgcctggaagaggatggaagttgggcagcaggctgttgaggtttggcagggactggccttactgtctgaagctgttctgagggggcaggccttacttgttaattcatcacagccttgggagccactgcagctccatgtagataaagcagtgagtggattacggagtctgactacactccttcgcgctttaggggcccagaaagaagccatctccccccctgatgccgcctctgccgcgcccctccggacaataacagcagatactttcaggaaactgttccgcgtttattcaaacttcctgagaggaaaactgaaactttatacaggggaggcctgccggacaggggatagg

SEQ ID NO: 10875 - DNA, 579 bp, Artificial Sequence
  Description of Artificial Sequence: Synthetic coding sequence
atgggagtccatgaatgtccagcctggctctggctcttgctctcccttctctcactgccacttggactgccggtgctcggtgcaccgccccggcttatctgcgattcgcgtgtcctggagagatacctgctcgaagccaaggaagctgagaacataaccaccggttgcgcagagcactgctcccttaacgaaaacatcaccgtccccgatactaaagtgaacttctatgcatggaaacgaatggaagtgggacaacaagcagtcgaggtgtggcagggacttgcacttcttagcgaagcagtgctcagaggtcaggcactgctggtgaatagctcacagccttgggagccactccaactgcatgtggacaaggcggtgtccgggctgaggtccctcacgactcttcttcgcgcccttggagctcagaaagaagcgatctcgcctcccgacgcagcctcagccgcaccgctcagaaccataacggcagacacgtttaggaagctgtttagagtgtactctaatttcctccgaggtaaacttaagctgtacactggagaagcatgtaggaccggagatagg

SEQ ID NO: 10876 - DNA, 579 bp, Artificial Sequence
  Description of Artificial Sequence: Synthetic coding sequence
atgggcgtccatgagtgcccagcctggctgtggctgcttctttcgcttctttccctgcccttgggactgcccgttctgggagcaccaccccggcttatatgtgattcgagagtgctcgagcgttacctgctggaggcaaaggaagctgaaaacattactactgggtgcgcagaacactgtagcctcaacgaaaacatcaccgtcccagatactaaagtgaacttctacgcgtggaagcgaatggaagtgggacagcaggcagtggaagtgtggcaagggctcgcccttctttcagaagcagtgctcagaggtcaagcccttcttgtcaactcttcgcagccatgggagcccctgcagctgcacgtggataaggcagtgtctggtctgagatccctgactactctgctgagggccctgggagcacaaaaggaagcaatttccccgcctgatgctgcatctgctgcaccccttcgtacgattaccgcagatacctttagaaagctcttccgcgtctattcgaattttctccggggcaaactcaaactgtacaccggagaggcctgtcgcactggggaccga

SEQ ID NO: 10877 - DNA, 579 bp, Artificial Sequence
  Description of Artificial Sequence: Synthetic coding sequence
atgggcgtgcacgaatgccccgcttggttgtggctcctgttatccctgctgagcttaccactggggctccccgtcctgggcgcccctccaagactgatctgcgattcaagggtacttgagcgatacctgctcgaggccaaggaagccgagaacattactaccggctgcgctgaacactgttccctgaacgagaatattacggtgcccgatacgaaggtgaacttctatgcctggaagcgtatggaggtcgggcagcaagcagtggaggtttggcagggccttgcattactttctgaggcggtcctgcgaggacaggccctccttgtcaacagctctcagccatgggaaccccttcagctgcacgtggacaaagctgtgtctggccttcggtctctcactacattgttacgggcactgggagctcagaaagaggcaattagtccaccagatgccgcctccgccgcaccactgcgcaccatcaccgccgatactttcagaaaactgtttcgcgtatatagcaacttcctacgaggcaagttgaagctttatactggtgaagcttgcaggacgggagatcga

SEQ ID NO: 10878 - DNA, 618 bp, Artificial Sequence
  Description of Artificial Sequence: Synthetic coding sequence
atgtgtgagcctgctccccctaagcccacacaatctgcttggcatagcttcccagagtgcccagccctgctgctcttgctgtctctcttgcttcttcccctggggctcccagtgctgggagccccaccacggcttatatgtgactccagggtcctggaaaggtatattctcgaggcaagagaagctgaaaacgtgaccatgggctgtgcccaaggctgcagcttctccgaaaacatcaccgtgcccgatacaaaggtgaatttctacacctggaaaaggatggatgttggacagcaggcgctggaggtatggcaggggttagcactccttagcgaagctatcctcagggggcaagctctcctcgcaaatgccagccagccaagcgaaacaccacaactccatgtggacaaggccgtgtcaagcctgagatcgttgacgtctttgttgagagctctgggagcacagaaagaagccatgagcctgccggaagaggcctctccagccccactccggacttttacggtggataccctgtgtaaactttttcggatctattcaaactttctgcgtggaaagcttactctgtacacaggcgaagcgtgcaggcgcggagatagg

SEQ ID NO: 10879 - DNA, 618 bp, Artificial Sequence
  Description of Artificial Sequence: Synthetic coding sequence
atgtgtgagcctgcgccacccaagcctacgcaaagcgcatggcactccttccccgagtgtccggcacttcttctgctgctctctctgctcctccttccactgggccttcctgtcctcggtgcccctccaagattgatctgtgacagccgtgtcttggagcggtacatcctggaagccagagaagcagaaaacgtgactatgggatgcgcacaggggtgcagtttttctgagaacattaccgtgcctgacaccaaagtgaacttttacacctggaaacgtatggatgtggggcagcaagccttggaagtttggcaaggacttgcacttctttcagaggcaattctgcgcggtcaggctcttctggcaaacgcctcgcaaccatccgagactccccagcttcatgtagacaaggcggtgtcgtcgctccggtcgcttacgtcccttcttcgcgcactcggtgcacaaaaggaagccatgagcttgcctgaagaagcatctcccgcgccactgcgaacttttactgtggataccctctgtaagctgttcagaatttactccaacttcctgcgtggaaagctgactctctacaccggagaagcgtgtcggcgtggcgataga

SEQ ID NO: 10880 - DNA, 618 bp, Artificial Sequence
  Description of Artificial Sequence: Synthetic coding sequence
atgtgtgaaccagcccccccgaagccaacacagagtgcttggcactcctttccagaatgccccgctctgttgctgttgctctcccttctgttgctgcccctgggcctgcccgtgttgggcgccccccctcgcttgatctgtgattctcgcgtattggaacggtatattctggaagcgcgagaagctgagaacgttacgatgggatgcgcccaaggctgtagtttttctgagaacattaccgtccccgacactaaagtgaatttctacacctggaagcgaatggacgtaggacagcaggcgttggaggtgtggcagggacttgcactcctgtctgaagccatcctgcgggggcaggccctcctggctaacgcctctcagccctccgagacaccccagctccacgtggacaaggctgtctctagcctgaggtcactgacttctctgctcagggcactcggggcccagaaggaggctatgagcctccccgaagaagcaagtccggccccattgcggactttcaccgttgatactctttgcaagctctttcgcatttattctaactttctgcgggggaaactgacattgtataccggggaggcctgcaggaggggagataga

SEQ ID NO: 10881 - DNA, 618 bp, Artificial Sequence
  Description of Artificial Sequence: Synthetic coding sequence
atgtgtgagccagcccctccgaaacctacgcaatcggcctggcattcctttcccgaatgtccagcgctgctgcttctcctctcactgctccttcttccgttgggactgccagtgctgggagcgcctcccagattgatttgtgactcgcgggtgctcgaaagatacattcttgaggccagggaagcagaaaacgtgacgatgggttgcgcacaaggttgttcattcagcgagaacatcactgtccccgacaccaaggtcaacttctatacctggaagaggatggatgtggggcaacaggccctggaggtgtggcaggggcttgctctgctttcggaagcgattctccgcggccaagcactgctggcaaacgcctcccagccaagtgaaaccccacagctccatgtggataaggcagtctcctcactccgctccctgacgtcactccttcgggcgcttggggcgcaaaaggaggcaatgtcgcttccagaagaagcatcacctgcaccacttagaacctttactgttgacaccctgtgtaaactgttcaggatctactcaaatttcctgagaggtaaactgactctttacaccggggaggcatgccgcagaggtgacagg

SEQ ID NO: 10882 - DNA, 618 bp, Artificial Sequence
  Description of Artificial Sequence: Synthetic coding sequence
atgtgtgaaccagcaccccctaagccgacccagtcagcatggcatagcttcccagagtgcccagctctcctgctcctgctttccctgctcctcctgccactgggactgccagtgctcggagctccgccgcgcctgatctgcgattccagagttctggaaagatacatcctggaggcacgcgaagcagaaaacgtcaccatgggatgcgcccaaggatgcagcttctcggagaacattactgtgccggataccaaggtgaacttctacacttggaagcggatggatgttggtcagcaggctctggaggtgtggcagggcctcgctctgctctccgaggcgattctgcgcggacaagccttgctcgcgaatgcttcccagccatccgagactccgcagctgcacgtggacaaggccgtgtcgtcgctgcgctcgctgactagcctcctgcgcgcgctgggagcgcagaaagaggccatgtcgctgcctgaggaagcctcgccagcgcctctgcgcacttttaccgttgatactctctgcaagctgttccggatctactcaaacttcctgcgcggaaaactcaccctgtacaccggcgaagcctgtcggagaggagacagg

SEQ ID NO: 10883 - DNA, 618 bp, Artificial Sequence
  Description of Artificial Sequence: Synthetic coding sequence
atgtgtgagcctgctcccccgaagcctactcaatccgcttggcacagcttccccgagtgtccagctctgctgctgttactgtcactgctccttctccctctcggtctgcccgtgctgggcgctccacctaggttgatctgcgattcgcgagtgctcgaacgctatatcctggaggcacgcgaggccgaaaatgtgactatgggttgcgctcagggctgctccttcagtgagaacatcactgtgcctgacacgaaagtgaacttctacacctggaaaagaatggacgtgggtcaacaggcgctggaagtctggcaggggctggccctcctctccgaggctattctaagaggccaagccctgctggccaacgcgagccaacctagcgaaacccctcagctccatgtagataaagctgtctcctctctgagatccctgactagtctattgagggctcttggagcacagaaggaggctatgtctctgccagaggaagcttcaccagcgcccctccgtaccttcaccgtcgatacactctgtaagttattccgaatttattctaacttcctgaggggaaagctcaccctgtataccggggaggcttgtcggcggggggacagg

SEQ ID NO: 10884 - DNA, 618 bp, Artificial Sequence
  Description of Artificial Sequence: Synthetic coding sequence
atgtgtgagccagcgccgccgaagcccacccaatcagcctggcactcattcccggagtgcccggcacttctgctgcttctgtccctgctgctgctcccactcggtttgccagtcctcggtgcgccacctaggcttatctgcgacagccgcgttctggagcggtacatcctcgaagcgagggaggccgaaaatgttaccatgggatgtgcccagggctgctcgttctcggaaaacatcaccgtgcccgacaccaaagtgaatttctacacctggaagcgaatggacgtgggacaacaggcccttgaggtgtggcaaggactggccctcctctcggaagcaatcctgcgagggcaggccctgctggccaacgccagccaaccgtcggaaaccccccaattgcacgtggacaaggccgtgtcgtctttgcgcagcctgacttcactcttgagagcactcggagcacagaaggaagccatgtcgctgccggaagaggcgagtcctgctccgctgcgcactttcactgtggacactctgtgcaagctgtttaggatctactccaatttcctgcgcggcaaactgactctgtacactggagaagcctgtcgccgcggtgaccgg

SEQ ID NO: 10885 - DNA, 618 bp, Artificial Sequence
  Description of Artificial Sequence: Synthetic coding sequence
atgtgcgagccggccccgcccaaaccgactcagtccgcatggcacagcttccctgaatgcccggcactcctgctcctgctttctctgttgctgctgccactgggcctgccagtcctcggagctccgccgcgcctcatctgcgactcgcgtgtgttggaacgctacatcctcgaggctagggaagcggagaacgtgaccatgggatgcgcacagggatgtagcttttcggagaatatcaccgtgccggataccaaagttaacttctacacgtggaaaagaatggatgtcggacagcaggccctggaagtgtggcagggactggccctcctctccgaagcgattctgcgcggccaagctcttctcgcgaacgcctcacagccctcggagactccccagctccacgtggacaaagccgtgagctcgctcagaagcctgaccagcctgctgcgggcactgggggcacaaaaagaagccatgtcgctgccagaagaggcgtctccggcgccattgagaacgttcaccgtggataccctctgcaagctgtttcggatctactcgaatttcctgcggggcaagctgaccctgtacaccggagaggcgtgccgccgcggggaccgc

SEQ ID NO: 10886 - DNA, 618 bp, Artificial Sequence
  Description of Artificial Sequence: Synthetic coding sequence
atgtgtgagccagcaccacctaagcctacgcaaagcgcatggcactcctttccagagtgtccagctctcctgttgttgctcagcttgctgctgctgcccctgggcctgcctgtactgggagcacctcctaggctcatttgtgactcacgcgtactcgaacgctatattctggaagcacgcgaggctgagaacgtgaccatgggatgtgctcaggggtgctctttctccgagaacataactgtcccagatactaaggtgaatttttatacctggaagagaatggatgtagggcagcaggcactggaagtgtggcagggcttggccttgttgagtgaggcaattctgagggggcaggctctgctggctaacgcgtcccagccctcagagacaccgcagctgcacgtggataaggctgtaagttctctgaggtctcttaccagcctgcttagagcactgggagcacagaaggaggccatgtcactgccagaagaggcgagccccgcacccctgcgcactttcactgtggacaccttgtgtaagctgttcaggatttactctaactttctgaggggtaagcttactctttataccggagaggcctgccgacgcggggaccgc

SEQ ID NO: 10887 - DNA, 618 bp, Artificial Sequence
  Description of Artificial Sequence: Synthetic coding sequence
atgtgtgaaccagcaccaccaaagccgactcagtcagcctggcattcatttcctgagtgtccagctctactcctgcttctttccttgttactgctgcccctcggactgccagtactcggcgcacctccccgactgatctgcgattcaagggtcctggaaagatacatcctcgaggcgagagaagctgagaacgtgaccatggggtgcgcacagggctgttcatttagcgaaaacatcaccgtgccagacactaaggtaaatttttatacgtggaagcggatggacgtgggacagcaggccctcgaggtgtggcaaggcctggctctgttgagcgaagctatccttcgaggtcaggcgctgttggcaaatgcgagtcagccgtctgaaactcctcagctccatgtggataaggcggtgagttcgctccggtctttgacgtctctcctgagggccctgggggctcagaaggaagctatgtctctgcctgaggaggccagcccagctcctcttcgcacctttaccgtcgacaccttgtgcaaactcttcaggatctattcaaacttcctgaggggcaagctcactctgtacactggagaggcttgcaggcgaggtgatagg

SEQ ID NO: 10888 - DNA, 618 bp, Artificial Sequence
  Description of Artificial Sequence: Synthetic coding sequence
atgtgtgaacctgccccccctaagccgacacagtccgcctggcatagctttcctgagtgtcccgcgcttttattgttgctatcgttgctgttactccccttgggcctgcccgtgttgggcgctcccccgcgcctgatttgcgattcccgcgtacttgagagatatatcctggaagcaagagaagccgaaaacgtcaccatgggctgcgcacagggctgctccttcagcgagaacatcacagtccccgacaccaaggtaaacttttacacctggaagaggatggacgttggacagcaggcattggaagtctggcaaggcctggctttgctcagtgaggcgatactgaggggtcaagcccttctcgccaacgcttcacaaccctccgaaaccccccagttgcatgtggacaaagctgtgtcatccctgcgaagcctgacgagcttgctgcgggccctaggggcccagaaagaagcaatgagcctgcccgaagaggcgtctccagctcctctgcgaaccttcaccgtggacacactttgtaagctcttccggatttattccaactttctgaggggaaagctgacgctgtacaccggcgaagcgtgtaggagaggagaccgc

SEQ ID NO: 10889 - DNA, 618 bp, Artificial Sequence
  Description of Artificial Sequence: Synthetic coding sequence
atgtgcgaacctgcccctcctaaacctacccaaagcgcgtggcacagctttccggaatgcccggcgcttctgctcctgctgagcctcctgctcctaccactgggactgccagtgttgggtgcgccgcctcggctgatttgtgacagccgagtactggagcggtatatcctggaggctcgcgaagctgaaaatgtcaccatgggctgtgcacagggatgcagcttctccgagaacattaccgtcccggacaccaaagtcaatttctacacttggaaacggatggatgttggtcagcaggcactggaagtgtggcaaggactcgcccttctgagcgaggcgatcctgcgcggccaggcattgctggcaaatgcttcacaacctagcgagactccgcagctgcatgtggataaagccgtgagctcactgcgtagcctgaccagcctgttgcgtgcgctgggcgcccagaaggaggcaatgagcctgccggaagaagccagtcccgcgcctctgcgcacctttacagttgacacactctgtaaactgttccggatctattctaacttcttacgcggtaaactgaccctgtacaccggcgaagcctgccggcgcggcgacagg

SEQ ID NO: 10890 - DNA, 618 bp, Artificial Sequence
  Description of Artificial Sequence: Synthetic coding sequence
atgtgtgagcctgcgccccccaagcccacccaatcggcgtggcacagcttccctgaatgccccgctctccttctgttgctgtcacttctgctgctccccctcggcctcccggttttgggcgcccccccacggttaatttgcgattcccgcgttttagagcgctatatcttggaggcccgggaggctgagaatgtcactatgggttgtgcgcagggttgctcctttagcgagaacattaccgtacccgacacaaaggtaaacttctacacatggaagcgcatggatgtgggacagcaagcgctggaggtctggcaggggttagctctgctctccgaggctatcctgcggggccaagctctgttggctaacgcttcgcaaccgtctgagaccccccaactgcacgtggacaaggctgtgtcgtcactacgctcccttacaagtcttctccgcgcactcggagcccaaaaggaggctatgtccctcccagaagaagcctcccccgcccctctccgcaccttcaccgttgataccctttgcaaactgttcaggatctacagcaactttctccggggcaagttgactctctacaccggtgaggcttgcagacggggtgaccgg

SEQ ID NO: 10891 - DNA, 618 bp, Artificial Sequence
  Description of Artificial Sequence: Synthetic coding sequence
atgtgtgagcctgctccccctaaaccaactcaatctgcatggcactctttcccagaatgccctgctctgctgctgctcctgtcactcctcttactgcccctgggcctgccggtgcttggggcaccaccgcgcctgatttgcgattctagagtgctggagaggtatatactagaagctcgggaagccgagaacgtaaccatgggttgtgcccaaggatgtagtttctccgagaacattaccgtgcctgatacgaaggtaaatttctatacatggaagcggatggacgtcggacagcaggcactggaggtttggcaaggccttgctttgctgagtgaagcgatcctgaggggacaggcgttgctggccaatgcaagccaaccttcagagactcctcagctgcatgtggataaagcagtcagcagtctgagatcactgactagcctgctacgcgccctcggagcccagaaagaagcgatgagccttcctgaagaggcatctcccgcacccctgcgcacctttacagtcgataccctctgtaaacttttccggatttactctaatttcctgagaggcaagctgaccctgtatacaggtgaggcgtgtcgtcgaggcgatcga

SEQ ID NO: 10892 - DNA, 618 bp, Artificial Sequence
  Description of Artificial Sequence: Synthetic coding sequence
atgtgtgaaccggcgccgccgaaaccgacgcaatcggcgtggcattcgtttccggaatgtccggcgttactattactattatcgctactattactaccgttaggtttaccggtattaggtgcgccgccgcgattaatatgtgattcgcgtgttctagaacgatatatattagaagcgcgtgaagcggaaaatgtaacgatgggttgtgcgcaaggttgttcgttttcggaaaatataacggttccggatacgaaagtaaatttttatacgtggaaacgaatggatgttggtcaacaagcgctagaagtttggcaaggtctagcgctattatcggaagcgatactacgaggtcaagcgctattagcgaatgcgtcgcaaccgtcggaaacgccgcaactacatgttgataaagcggtatcgtcgttacgttcgttaacgtcgctactacgtgcgttaggtgcgcaaaaagaagcgatgtcgctaccggaagaagcgtcgccggcgccgttacgaacgtttacggtagatacgctatgtaaattatttcgtatatattcgaattttctacgaggtaaattaacgctatatacgggtgaagcgtgtcgtcgtggtgatcgt

SEQ ID NO: 10893 - DNA, 618 bp, Artificial Sequence
  Description of Artificial Sequence: Synthetic coding sequence
atgtgtgaacccgctcctccgaagccaactcagagcgcctggcacagtttcccagaatgccccgcacttttgctgctgctctctcttctgctcctgcccctgggccttcctgtgctcggagcccccccccggctgatttgtgactctagagttcttgagcgatatattcttgaagcccgggaggcggagaatgtgaccatgggctgcgcacaaggctgttctttcagcgagaacatcaccgtcccggacacaaaggtaaacttttatacttggaagaggatggatgttggacagcaggccctcgaggtgtggcagggcctcgccctgttaagcgaagccattctgcgggggcaagcacttctggctaatgcctcccaacctagcgagactcctcagttgcacgtcgacaaggcggtaagcagtttgcgcagtctgacaagcctgttgagggcactgggcgctcagaaagaagcgatgtccttgccagaggaggcaagccccgccccgctgcgaaccttcacggttgacaccctctgcaagctttttcgaatctactcgaactttcttcgaggcaaattgactctatatacaggcgaagcgtgcaggcggggtgaccgc

SEQ ID NO: 10894 - DNA, 618 bp, Artificial Sequence
  Description of Artificial Sequence: Synthetic coding sequence
atgtgcgaaccagcacctcctaagccaacccaatccgcatggcatagctttccagaatgtcctgcactcctgcttttgctttcgctccttttgcttccactgggccttcctgtgctgggcgctccgcctcgcctgatttgtgattcccgtgtgctggagagatacatactggaagcgcgtgaagccgagaacgtcaccatgggatgcgcacagggatgtagcttttcggaaaacatcactgtgcctgacactaaggtcaacttttacacttggaagaggatggatgtgggacagcaagcactggaagtgtggcagggacttgcgctcctttcggaggcaattctgagaggccaggctctgctggcaaacgcgtcccaaccatccgagactcctcaactccacgtggacaaggcagtctcctctcttcgctcacttacctccctgctgcgggcactgggtgcacaaaaagaggccatgtctctgcctgaggaagcctcccctgcacctctccgcacttttactgtggacaccctgtgcaaactttttagaatctactccaactttcttcgcggaaagttgaccctgtacaccggagaagcctgcagacggggtgacagg

SEQ ID NO: 10895 - DNA, 618 bp, Artificial Sequence
  Description of Artificial Sequence: Synthetic coding sequence
atgtgtgaacctgcgcctccaaagcccactcagtcggcatggcattcctttccagaatgtcctgcactgctcctccttctgtccctgcttctcctcccgttgggattgccagtccttggtgcgccaccaagactcatctgtgattcaagagtccttgagaggtatattcttgaagcacgggaagcagaaaacgttactatggggtgtgcacaaggttgcagcttcagcgaaaacatcaccgtgcctgacaccaaggtgaacttttacacgtggaagcgcatggatgtgggacaacaggccctcgaggtgtggcagggactggcattgttgtcggaagccattcttagaggccaagccttgctcgcaaacgcatcgcaacctagtgaaacgcctcaactccacgtcgataaagcagtctcatccctccgctccctcacttcgcttttgcgggcacttggtgctcaaaaggaggcgatgtcccttccagaagaggcctcccctgcaccactgaggactttcaccgtggataccctctgtaagctctttaggatctacagcaattttcttcgggggaaactcacgctgtacactggagaagcgtgccgaaggggagatagg

SEQ ID NO: 10896 - DNA, 618 bp, Artificial Sequence
  Description of Artificial Sequence: Synthetic coding sequence
atgtgtgagcccgcgccacctaaaccaacccagagcgcatggcattctttcccggagtgccccgctcttttgctgctcctctcactcctgctgcttcccctgggcttgccagtgctgggtgcccctccgcgacttatttgcgactcgagagtgctggaacgctacatcctggaagctcgcgaggcggaaaacgttaccatgggctgcgctcagggatgctccttctccgaaaacattactgtgccggacactaaagtgaacttttacacttggaaacgtatggatgtcggacaacaagccctcgaagtgtggcagggcctggcgctcctctcggaggccatcctccgcgggcaagcactgcttgccaatgcgtcgcaaccatccgaaactccacagctgcacgttgataaggccgtctccagcttgcggagcctcacctcgctgctcagggcactcggtgcccagaaagaagctatgagtctgccggaagaggcctcaccggctcctctgcgtaccttcaccgtagacactttgtgcaagctgtttaggatctattccaatttccttagaggaaagctgacgctttacaccggagaggcgtgtcggaggggggatcgg

SEQ ID NO: 10897 - DNA, 618 bp, Artificial Sequence
  Description of Artificial Sequence: Synthetic coding sequence
atgtgcgaacccgcaccgccaaagcctacccagtcagcctggcattcgtttcctgagtgccctgcacttctgttgcttctcagccttctgctgcttccactgggactgccagtgcttggggctccccccagactgatctgtgactccagagttttggaaagatacatactggaagcgagggaggcagaaaacgtcacgatgggttgtgcgcagggatgctcattctccgagaatatcacggtcccggatacgaaggtgaacttttacacttggaaaagaatggatgtcgggcaacaggcactcgaagtgtggcaagggctcgcactgcttagcgaggcaatactgcggggccaagcgctccttgccaatgcaagccagccgtccgagactccgcagctccatgtggataaggcggtgtcctcgctcagatccctcacttccctccttagagcactgggtgcccagaaagaggcgatgtccctgcctgaagaagcatccccagcacccctgcgcacgtttaccgtcgataccctttgtaagttgttcaggatctactcaaactttctgcgcggcaaattgaccctttacaccggagaagcatgtcgacggggggaccgt

SEQ ID NO: 10898 - DNA, 618 bp, Artificial Sequence
  Description of Artificial Sequence: Synthetic coding sequence
atgtgtgagccagctcctccaaagccaacccagtcagcctggcacagctttcccgagtgccctgctctcctcctgcttctgtctttgctgctcctgcccctgggactgcccgtccttggcgctccccctcggcttatttgcgacagcagagtccttgaaagatacatcctcgaggccagggaagcggagaacgtcaccatgggatgcgcacaggggtgtagctttagtgaaaacatcaccgtgcctgataccaaggtgaacttctacacatggaagagaatggacgtggggcagcaggctcttgaggtgtggcagggcttggctttgctgtcagaggctatactcagggggcaggctctgctcgctaatgccagtcagcccagcgagacgcctcagctgcacgtggataaggccgtcagttcccttaggagcctcactagtcttctcagagctcttggggctcagaaggaggcgatgtccctgccagaagaggcctccccagcccccctgcgcacgttcactgtcgatacactgtgcaaactgtttaggatatattccaattttcttagaggaaaattgacattgtatacaggagaggcttgcaggcgaggcgatcgc

SEQ ID NO: 10899 - DNA, 618 bp, Artificial Sequence
  Description of Artificial Sequence: Synthetic coding sequence
atgtgtgaaccagcgcccccaaaaccgacacagagtgcatggcattcgttcccagaatgtcctgcactccttcttttgttaagtctgcttctccttcccttgggactgcccgtccttggcgcccccccacgcctgatttgcgattcgagagttctggaaagatatatcctcgaggcgcgtgaagctgaaaatgttaccatgggctgcgcacagggatgttcattttccgagaacataaccgtgccagacaccaaggtgaacttctatacgtggaagcggatggatgtgggccagcaggctcttgaagtatggcagggtcttgcgctactgagtgaagccatcctgcgtggtcaggccctactggccaatgctagtcagccctccgagactccgcagttgcatgtggataaggcagtgtcttctctgcgctccctgacttcccttttgagagccctgggtgcccagaaagaggctatgtcgctgcctgaagaagcaagccccgctcctctgagaacctttactgttgatacgctgtgcaagctgttcaggatctatagcaactttctgcgggggaagctgacgctctacaccggcgaagcctgtcggcgtggggatcgt

SEQ ID NO: 10900 - DNA, 618 bp, Artificial Sequence
  Description of Artificial Sequence: Synthetic coding sequence
atgtgcgaacctgcaccgccaaagccaacccagtcagcttggcacagcttccctgagtgtcccgcactgctgctgctccttagcctgttgctgctcccccttggactgccagtcctgggagctccgccacgacttatctgtgacagccgggtgctcgagcggtacatccttgaggcacgcgaggccgaaaatgtgaccatgggttgtgctcagggatgttcattttccgaaaacattaccgttccagataccaaagtgaacttctatacctggaagcgaatggatgtgggacaacaggcactcgaagtgtggcagggcctcgctctgttgtctgaagcaattctccggggacaggccctgctggcaaacgcgtctcaaccaagtgaaactcctcaactccatgtggataaggccgtgagctcgcttcgttcgctgacctcgctgcttcgtgcgctgggtgcacaaaaggaggcaatgtcgctgccagaagaagcatcccctgccccacttcggacgtttaccgtggatacgttgtgcaagttgtttagaatttactcgaattttctcagaggtaaacttaccctttacactggggaagcgtgtagacggggtgatcgg

SEQ ID NO: 10901 - DNA, 618 bp, Artificial Sequence
  Description of Artificial Sequence: Synthetic coding sequence
atgtgtgagcccgcacctccaaagccgacacaatccgcatggcacagctttccagaatgccctgcactgctgctgctgcttagcctgctgctgctcccactcggtctccccgtgctcggtgcccccccgcggctgatctgcgattcccgcgtgcttgaacgctatatacttgaagcacgagaggccgagaacgtcaccatggggtgcgcacaggggtgctcctttagcgaaaacataactgtacctgataccaaggtgaacttctacacatggaagcgcatggacgtgggacagcaggctctggaggtgtggcagggtcttgcactcttatctgaagctattctgagggggcaggcgctgctggccaacgcgtcccagccaagcgagacaccccagctgcacgttgataaagcggttagctctctgcggtcactcactagcctgctgcgagctctgggtgcgcaaaaagaggcaatgtctctgcctgaggaggcatctcccgccccgctgcgcacgttcactgtggataccctgtgcaagctgttcaggatctacagcaactttcttagaggaaagttaacactgtacaccggtgaggcttgcagaagaggcgatcgt

SEQ ID NO: 10902 - DNA, 618 bp, Artificial Sequence
  Description of Artificial Sequence: Synthetic coding sequence
atgtgtgagcctgctccaccgaagcccacgcagtctgcctggcacagttttcctgagtgtcccgccttgctgctcctcctgagcctgttgctcttgccactaggtctcccagtgttgggagcccctcctcgtctgatttgtgattctcgcgtcctggagagatacattcttgaggctcgcgaggcagagaacgtgactatgggatgtgctcagggctgttcattttccgaaaacatcacagttcccgacacaaaggtgaatttttatacctggaaaagaatggacgttgggcagcaagcgcttgaagtatggcagggactcgcgctgctttccgaggcgatactgagaggacaggctctcctggcaaacgcttcacagcccagtgagactccccaactacatgtcgataaggctgtctcttcactgagatcactgacctcgctgctcagagcactcggagcccagaaggaagctatgtcgctgccggaggaggcgagtcctgctccccttagaacatttaccgtggacaccctgtgtaagcttttccggatatactccaacttcctgcgtgggaagctcactctgtataccggcgaggcgtgcagaagaggcgatcgt

SEQ ID NO: 10903 - DNA, 618 bp, Artificial Sequence
  Description of Artificial Sequence: Synthetic coding sequence
atgtgcgaacctgcgccaccaaaacctacacagtccgcctggcattccttccccgaatgccccgccttgctccttcttctgtccttgttgcttctgcccttgggcctccctgtgctaggcgccccccctaggctaatttgcgactccagggtgctggaacgatatatcctggaagctcgagaagccgagaacgtgactatggggtgcgcacagggttgcagcttctccgagaacataactgtgcctgatacaaaggtaaatttttatacgtggaaacgcatggacgttggacagcaggcacttgaggtgtggcaggggttggcccttttatctgaagccattttgcgcggtcaggctctgctcgcaaatgcgtctcagcctagtgagacacctcagttacacgttgataaagccgtaagtagcttaagaagcctcacttccctgttgcgagcactgggtgctcaaaaggaagctatgagtctcccagaagaagctagtccagctcccctgaggacttttacagtagatactttatgcaagctgtttcgaatctatagcaacttccttagaggtaagctgacactgtacaccggtgaggcttgcagacgcggcgacaga

SEQ ID NO: 10904 - DNA, 618 bp, Artificial Sequence
  Description of Artificial Sequence: Synthetic coding sequence
atgtgtgaacccgcccctcctaagcccactcaatctgcatggcacagttttcccgaatgcccagcactgctactcttgctttcactgctattgctgccactggggcttcccgtgctgggggccccaccacgcctaatctgtgattcgcgggttctagagaggtatattttggaggcgcgggaggcagaaaacgtgactatgggttgtgcccaggggtgtagcttttcagagaacataacggtcccggacactaaagtgaatttctatacctggaagagaatggacgtagggcagcaggccctcgaggtgtggcagggactcgctctgctgagcgaagcgatcttgcgcgggcaggctctgctcgcgaatgcaagccaacccagcgaaacacctcagctgcacgtggataaggccgtgtctagtctcaggtccttaacttcattgctgcgagccctaggggcacaaaaggaagccatgtcactgcccgaggaggcatcgccagcacccctcaggacatttaccgttgatacactgtgtaaactattcaggatctacagtaattttcttcggggtaagctgaccttgtacacaggcgaggcctgtcggaggggcgaccgt

SEQ ID NO: 10905 - DNA, 618 bp, Artificial Sequence
  Description of Artificial Sequence: Synthetic coding sequence
atgtgtgaaccggcaccaccaaagcctacccaatccgcctggcattcctttcctgagtgcccggccctgctgcttctgctctcgctcctgctgctcccgctgggactccctgtgcttggtgcacctccaaggttgatttgtgattcgagagtcctggaacggtatattctcgaggcgcgggaagcagaaaatgtgactatgggatgtgctcagggatgttcatttagcgaaaacattactgtgcccgacacgaaggtcaatttctacacgtggaagcgaatggacgtcggacaacaggcactcgaagtgtggcaggggctcgcacttctttctgaggcgattttgcggggccaagcccttcttgcaaacgcatcacaaccctctgagactcctcagcttcacgtggacaaggcggtgtcgtcacttagatcgctgacctccctgctcagagcactgggagcacaaaaggaggcaatgtcgcttccagaggaagcgtcaccggcaccactcagaacgttcaccgtggacactctttgcaaactttttcgcatttactccaactttctccgtgggaaacttactctttacactggcgaggcatgccgtcgaggtgaccgg

SEQ ID NO: 10906 - DNA, 618 bp, Artificial Sequence
  Description of Artificial Sequence: Synthetic coding sequence
atgtgcgaaccagcacccccaaaacctacccaatcggcctggcattcgtttcccgagtgccccgcactgcttcttctgctgagcttgctgctgctgccactcgggctccccgtccttggcgcgccacctagactgatatgcgactcccgtgtgcttgaacgttacatactggaagcacgggaggctgaaaacgtgactatgggatgtgcacaaggttgttcgttctcggaaaacataaccgtccctgatactaaagtgaacttttacacgtggaaacgcatggacgtgggtcaacaagcacttgaagtgtggcagggcctcgcacttctctcggaggccatccttcgggggcaggccttgctggccaatgcctcacagccatcggaaacccctcagctccatgtcgataaggcagtgtcaagccttcgctcacttacttcgttgctgagagcacttggagcacaaaaggaggctatgtccctccctgaggaggcctccccggccccgctgcgaacgttcaccgtcgatactctgtgcaagttgtttcggatttactcgaactttctccggggcaagctgactctgtacactggggaagcatgcagacggggtgataga

SEQ ID NO: 10907 - DNA, 618 bp, Artificial Sequence
  Description of Artificial Sequence: Synthetic coding sequence
atgtgtgagcctgcaccgccgaaacccacccagtcggcgtggcacagctttccagagtgcccagcactgcttcttcttctcagccttctgctgctgcctctgggtttgccggtgttgggagcacctccacgcctgatctgcgattccagagtgctggagagatatatccttgaagcacgtgaagccgagaatgtgaccatgggctgtgcccaaggttgttccttcagcgagaacattacggtgccggatactaaggtcaacttctacacctggaaaagaatggatgtgggacagcaagcgttggaagtgtggcagggactggccctgctgagcgaggcaattctccggggacaggcactgcttgctaacgcaagccagccatcggaaactcctcagcttcatgtcgataaggcggtgtcaagccttcgatccctcacctccctgctgcgggcactgggggcccagaaggaagcaatgagcctgcccgaagaagcatccccggcccctttgcggacttttaccgtcgatactctttgtaagctctttaggatttactccaactttctccgaggaaagctcaccctgtacaccggggaagcatgcagaaggggcgaccga

SEQ ID NO: 10908 - DNA, 618 bp, Artificial Sequence
  Description of Artificial Sequence: Synthetic coding sequence
atgtgtgagccagccccaccaaagccgacccaaagcgcatggcattctttccctgaatgtccagcgctcctcctgcttctctcgcttctgcttctgccactcggacttcctgtcttgggtgctcctccccggctcatatgcgatagcagagtgcttgagcgctacatccttgaagcacgagaggcagaaaacgtgactatgggatgtgcacagggttgctcgttttccgagaacataactgtgccagataccaaagtgaacttttacacctggaagcgtatggatgtcggtcagcaagcattggaagtgtggcagggactggcactgctcagcgaagcaatcctgaggggtcaagcactgttggccaatgcatcccaaccgagcgaaacccctcaactgcatgtggataaggccgtgagctcacttcggtcgctgacgtcgttgcttagggcgcttggcgctcaaaaggaagcgatgagcttgccagaagaggcatcacccgcgccacttaggacctttaccgtggataccctgtgcaagctgtttagaatctattcgaactttctccgcggaaaacttaccctgtacaccggagaagcctgccgcaggggcgataga

SEQ ID NO: 10909 - DNA, 618 bp, Artificial Sequence
  Description of Artificial Sequence: Synthetic coding sequence
atgtgcgaacccgccccacctaagccaacacagtccgcatggcattcttttccagaatgtccagccctcttgttgctgctgtccctcctcctgctccctctcggacttcctgtcctgggcgcaccccctaggctcatctgcgactccagagttctcgagaggtacattctggaagcaagggaggctgagaacgtcaccatgggatgtgcccagggatgctcatttagcgaaaatattacagtgcccgacactaaggtcaacttctacacctggaagcgcatggatgtcggtcagcaggccctggaggtctggcaaggcctggctctgctctccgaggccattctccgcggacaggctttgcttgcaaacgcttcacagccttctgagacccctcaattgcatgtcgataaggcagtcagctcactcaggagtttgacctctctgctccgcgctctcggtgctcagaaagaagcaatgtcccttccagaagaagcttcacccgcaccactgagaacctttactgtggataccctgtgtaagcttttcaggatctattctaacttcttgagaggcaagctcaccctgtacaccggcgaggcctgccgtagaggtgatcgc

SEQ ID NO: 10910 - DNA, 618 bp, Artificial Sequence
  Description of Artificial Sequence: Synthetic coding sequence
atgtgcgagccagctccccctaagccaacccaaagcgcatggcatagcttcccagaatgcccagcactgctccttctgctttcattactgctactgccacttggcttgccagttctgggagccccaccaaggctcatctgcgatagtagagtgctggagaggtacatcctggaggctagggaggcagaaaacgtgacaatgggctgcgcacaaggttgcagcttcagtgaaaatattacagttcccgacacaaaagtgaatttctacacttggaagcgcatggacgtgggccagcaggccctggaggtgtggcagggactggctctgttgagtgaggccattttgagagggcaggccttactggccaacgctagccaaccctctgagacaccacagctccacgtcgataaagcagtatcatccctaaggtctctgacaagtctgctgagggcgctgggcgcgcagaaggaggccatgtcactccctgaagaggcctcccccgcacctctacgtacttttaccgtagacaccctctgcaaactttttaggatctattcaaattttctgcgggggaaactaactctctacactggagaggcttgtcgtcgtggagatcgt

SEQ ID NO: 10911 - DNA, 618 bp, Artificial Sequence
  Description of Artificial Sequence: Synthetic coding sequence
atgtgcgaacccgctcccccgaagccaacacagagcgcgtggcactcatttccggagtgtcccgcccttctgctgttgctgagtctgctccttctgccgcttggcctgccagttctgggagctccaccgcgcctcatctgcgactctagagtcttggaaagatacatcctggaagctagagaggctgagaatgttacaatgggatgcgctcaggggtgtagcttcagcgaaaacattactgtgcccgatactaaggtgaacttctatacctggaagaggatggacgtgggacagcaggcattggaggtgtggcaaggtctggcactgctgtctgaagcaatcctgaggggacaagctctgctggcaaacgcctcacaaccttccgaaaccccccagcttcacgtcgataaagccgtgtcatcgttgcggtcactgacgagcttgctgagagcgctcggagcccagaaggaggcgatgagcctcccggaagaggccagccctgcccctcttcgtacattcaccgtcgatacactgtgcaagttgttccgcatctattcaaactttcttagagggaaactcacactctacacaggggaagcttgtcggcgcggagaccgc

SEQ ID NO: 10912 - DNA, 618 bp, Artificial Sequence
  Description of Artificial Sequence: Synthetic coding sequence
atgtgtgagcctgccccaccaaagccaacccagagcgcttggcattcgttccctgagtgtcctgccctgctgctactgctatcattgcttctcttgccattgggactgcccgtacttggggcccctccacggctgatctgtgacagccgggtgctggagcgctatatactcgaagcccgggaggccgaaaatgtgactatgggatgcgcccagggctgctctttcagcgagaacatcaccgtgccagacaccaaggtaaatttctatacgtggaagcggatggacgtcgggcagcaggcgcttgaagtttggcagggcttggcccttttgtctgaagccatcctgcgggggcaggctctgctagcaaacgcctcccagccatcagaaaccccacagctacacgttgataaagccgtctcttctttgcgatcactaaccagtctgctgagagctctgggagcccagaaggaggctatgagccttcctgaagaagcctcaccggcgccactcagaaccttcacagtggacaccttgtgtaagctatttaggatctattcaaatttcctgcgaggcaagctcaccctttataccggagaagcttgtaggcggggggaccgt

SEQ ID NO: 10913 - DNA, 618 bp, Artificial Sequence
  Description of Artificial Sequence: Synthetic coding sequence
atgtgtgaacccgcaccccctaagccaacccagtcagcttggcattcgttccccgagtgcccagcattgctgctgctcctgagcctgctgcttcttcctctgggtttgcctgtgcttggagcaccccctcgtttgatttgtgacagccgcgtgcttgagaggtatattctggaagcacgcgaagcggaaaacgtgactatggggtgtgcacaaggctgctcattttccgagaacattaccgtgccagataccaaggtcaatttctacacttggaaacgaatggatgtgggtcagcaggcactggaagtgtggcaggggcttgcactgctctccgaagcgatacttagaggccaggcacttctcgcaaatgcatcgcaaccatccgaaacccctcaactccacgtcgataaagcggtgtcctcgctgagatcgctgaccagccttctcagagctcttggagctcaaaaggaagctatgtcactgccggaggaagcatcacctgccccactgaggactttcaccgtcgacactctttgtaagttgtttaggatttactctaactttctccgcggaaagctgacgctttatactggagaggcatgtaggcgcggtgaccga

SEQ ID NO: 10914 - DNA, 618 bp, Artificial Sequence
  Description of Artificial Sequence: Synthetic coding sequence
atgtgtgaacctgctcccccaaaacccacgcaaagtgcctggcactcatttcctgaatgtcccgccctcctcctcctgctgtctctgttgctgctgccgctgggattgcccgtgctcggagccccccctagactgatctgtgactctagagttttggaacgctatattctggaggcccgggaggctgagaatgttacaatgggctgtgcacagggatgttccttctccgagaatattactgtgccggacactaaggtgaacttttacacatggaaacgcatggacgtagggcagcaagccctggaggtatggcaaggtttagcattgctgtcagaggcaattcttcgcggccaagcacttctggctaacgcgtcgcagcccagcgaaactccccaactccacgtcgacaaggccgtgtcatccctaagatccctgacttctcttcttcgggctctgggtgcccagaaagaagcgatgtctctgcccgaggaagcctctccggcgccactaagaacgtttactgtggataccctgtgcaaacttttccgcatctattccaactttctgcgcggcaaactaacactgtacaccggcgaagcatgcagacggggagaccgg

SEQ ID NO: 10915 - DNA, 618 bp, Artificial Sequence
  Description of Artificial Sequence: Synthetic coding sequence
atgtgcgaaccagcccctccgaaacctacccagtctgcatggcacagcttcccagaatgtccggccctgctgctgctcctgtcgctgctcctcctcccgcttgggcttccggtgcttggcgcaccaccaaggcttatctgcgactcgcgggtccttgaaagatacatactcgaagctcgagaggccgagaacgtgactatgggatgcgctcaaggctgtagcttctcagagaacatcacggtcccagacactaaggtgaatttctacacttggaagcgtatggacgttggtcagcaggcattggaggtctggcaaggactggccctgctttccgaagcgatcctccggggccaggccttgttggctaacgcgtcacagccttccgaaaccccgcagttgcatgtggataaggcggtgtcctccctgcggtccctcacctcattgctgcgggctctgggagcccaaaaggaagcaatgagcctgcccgaggaggcttcgccggcgcctctgcgcactttcacggtggataccctgtgcaagctctttcgcatctactcgaattttctgcgcggcaaattgacgctctacaccggggaagcatgccgacgcggagacaga

SEQ ID NO: 10916 - DNA, 618 bp, Artificial Sequence
  Description of Artificial Sequence: Synthetic coding sequence
atgtgtgaaccagctccccctaaaccaacccagtcggcatggcactcgttcccggaatgtcccgccttactgctgctgcttagtctgctgctgctgccactaggcctgccggtgttaggcgcccccccgagactgatctgcgacagccgggttttggagaggtatattcttgaagctagggaggccgagaatgtgactatgggttgcgctcagggctgctcttttagcgagaacataaccgtgcccgacaccaaggtgaacttttacacatggaaacgaatggacgtcggacagcaggctcttgaggtttggcaagggctcgccctactgagcgaagctatcctgcgcggtcaggccttgctcgcaaacgccagtcagcctagtgaaacaccccagctacatgtcgataaggctgtcagctctcttagatctctaacctccctcttgcgagctctaggggcccagaaagaggccatgtctctcccagaggaggcgtctcccgccccattgagaacttttaccgttgacactctgtgcaaattatttcggatatactcgaatttcctacgaggaaaattaacactctatacgggtgaggcgtgccgccggggggaccgc

SEQ ID NO: 10917 - DNA, 618 bp, Artificial Sequence
  Description of Artificial Sequence: Synthetic coding sequence
atgtgtgagcctgcgcccccaaagccgacccagtccgcatggcactctttccccgaatgcccagcactcctcctgctcttgagtctgctccttctgccgctgggactgccagtcttgggcgcaccaccaaggttgatttgcgacagcagggtcctcgaaaggtatatcctggaagccagggaagccgagaacgtgactatgggttgcgcccagggttgttccttttctgagaacatcacggtgcccgatacaaaggtgaacttttacacctggaagagaatggacgtcggccaacaggccctcgaagtgtggcagggtctcgctctgctgtccgaggccatcctcaggggacaagcgcttttggccaatgctagccagccctcagagactccccagctgcacgttgacaaagcggtctctagtctccgcagtctcaccagtctgttgagggcactgggagcccaaaaagaagctatgagtcttccagaagaggcctctcccgcccccctgagaaccttcacagttgacaccctctgtaaactcttcaggatctattctaattttctgagaggaaaattgacactctacaccggtgaagcttgtagacgcggtgacagg

SEQ ID NO: 10918 - DNA, 618 bp, Artificial Sequence
  Description of Artificial Sequence: Synthetic coding sequence
atgtgtgaaccagcaccaccaaaaccaactcaatctgcttggcattcttttcctgaatgcccagcactccttttacttcttagtcttcttcttttacctttaggacttcctgtcttaggtgcaccaccacgtcttatttgtgattcaagagtattagagagatatatattagaagcaagagaagctgaaaatgtgactatgggatgtgcacaaggttgttctttttcagaaaatattactgttcctgatactaaagttaatttttacacatggaaacgtatggatgtaggacaacaagcccttgaagtttggcaaggtttagcattattaagtgaagctattttaagaggacaagctttattagcaaatgcaagtcaaccaagcgaaacaccacaactacatgttgataaggcagtttcatctttaagatcattaacaagtttacttcgtgctttaggagcccaaaaagaagcaatgtcacttccagaggaagcatcaccagcaccacttagaacattcactgtcgatacactttgtaaattattccgaatttattcaaattttttaagaggtaagttaactctttatactggtgaagcttgtagaagaggtgataga

SEQ ID NO: 10919 - DNA, 618 bp, Artificial Sequence
  Description of Artificial Sequence: Synthetic coding sequence
atgtgcgagccagcgccgcctaagcctactcagtcggcttggcattccttccctgagtgcccggccctgcttctgctgctgtcactgttgctgctgccgctggggctccccgtgctgggggccccacccagattgatctgcgactcccgggtgctcgaacgctatatcctcgaggccagagaagccgaaaacgtgaccatgggctgtgctcagggatgctccttttccgagaacatcactgtgcccgacaccaaggtgaacttttacacctggaagcggatggatgtgggacagcaggcccttgaagtgtggcaaggacttgcgctgctcagcgaagcgatcctgcggggacaagccctgctggctaatgccagccagccctcggaaactccccagcttcacgtcgacaaggccgtgtcctctctgcgctccctgacgtcgctgctccgcgctctgggagcacagaaagaggcaatgtcgctccctgaagaggcctcgcctgctcccttgaggaccttcaccgttgacaccctgtgcaaactgttccgcatctacagcaacttcctcagaggcaagctcacgctgtataccggagaggcctgtcgcagaggagatcgg

SEQ ID NO: 10920 - DNA, 618 bp, Artificial Sequence
  Description of Artificial Sequence: Synthetic coding sequence
atgtgcgaacccgctccccctaagccaacccagagtgcatggcactctttcccagagtgcccggccctgttgctcctactatcgctcctgcttctgcctctcggtctaccagtcttaggcgctcccccaaggctcatctgtgactcaagggtgctggaacgatacatcttggaagcgcgagaggccgaaaacgtaactatgggatgcgcacaggggtgtagcttcagcgagaacatcactgtccctgacaccaaggtcaatttctatacctggaaacgaatggacgtcggccagcaggccttggaagtatggcagggactcgcactgctgagtgaggctatcctccggggccaggcgttgctggcaaacgctagtcagccttccgagactccccagcttcatgtggataaagccgtcagttcccttagaagtttaacgtcattactgcgtgccctgggcgctcagaaggaggcaatgtccttgccagaagaagcttcacccgcccctctcaggaccttcaccgtggacactttatgcaagctttttcgcatctatagcaacttcttgcgaggaaaattaaccctgtatacgggcgaggcttgtaggcgaggtgataga

SEQ ID NO: 10921 - DNA, 618 bp, Artificial Sequence
  Description of Artificial Sequence: Synthetic coding sequence
atgtgcgagccggctcctcctaagccaactcagagcgcttggcattcttttcctgagtgcccagcactcttgctgctgctgagcctactgttactgcccttagggctgcctgtcctcggagcaccccccagattaatctgtgacagccgagttttggagcgatacattcttgaggcacgcgaggcggagaatgtaactatgggttgtgctcaggggtgttctttttccgagaacattaccgtgcccgataccaaggtcaatttctatacttggaagcgaatggacgtcggccagcaggcgctggaagtgtggcaaggtctggcactcctgagcgaggccatcctgcggggtcaagccttactggctaatgcctctcagcccagcgagacgcctcagctgcacgtggacaaagctgtgtcttcattacggtcattgacctcgttgcttagagctctcggagcgcagaaagaagccatgtctcttccagaagaagctagccctgcccctctccgtaccttcaccgtggacaccctatgcaaattatttcgtatctacagcaatttcttgcgggggaaactgacactgtataccggcgaggcttgcagacgcggtgaccgc

SEQ ID NO: 10922 - DNA, 618 bp, Artificial Sequence
  Description of Artificial Sequence: Synthetic coding sequence
atgtgtgagccggcaccaccaaaaccaacacagtctgcctggcactcattccctgaatgtccggcgcttcttttgctgctttcactgctgctgctgcctctgggcctgcccgttctcggcgcgccccctcggttgatctgtgacagccgggtgctcgagcggtacattctagaagcaagggaggcagagaatgttacgatgggttgcgctcaaggatgctccttcagtgagaacatcacagtgcctgatactaaagtgaacttttacacatggaagcgtatggatgtcgggcagcaagccctcgaggtctggcagggtttggctctgctttctgaggccatcttgcggggccaggccctgttggctaatgccagtcagccctcggagacccctcagctccacgtggacaaggcggtgtcttctctgcgttccctaacttctctactgcgggctctcggagctcagaaggaagccatgtcacttcctgaggaagccagccccgcacctcttcgtactttcacggtggacaccctttgtaaactgttcaggatctattctaattttttgagaggaaagttaactctctacacaggggaggcttgcagaaggggcgataga

SEQ ID NO: 10923 - DNA, 618 bp, Artificial Sequence
  Description of Artificial Sequence: Synthetic coding sequence
atgtgcgaacccgcccccccaaaacctacacagagcgcgtggcacagtttcccagaatgtcccgccctcctgcttttactctctctgctgctgctgcctttggggctgcccgttctaggtgccccaccccgtctgatctgcgactctcgcgttttggagcgctatattctggaggccagggaggccgagaatgtaaccatggggtgtgcacaagggtgctcttttagtgagaacattacagtgcctgacacaaaagtaaacttttacacatggaaacggatggatgtaggacaacaggccctggaggtgtggcaggggctggcacttctctcggaggctattctcaggggacaagctctcctggccaacgccagccagccatcagagacacctcagctgcacgtcgataaggccgtgtcttcccttagaagcctaacttctttgctgcgcgcactaggagcacagaaggaggccatgtccttgccagaggaggccagccctgccccgctgcgcacattcaccgtcgacaccctctgtaagttatttagaatttactcgaatttcctgcgtggtaagctgaccctgtacaccggagaggcctgccgaaggggagatcgg

SEQ ID NO: 10924 - DNA, 618 bp, Artificial Sequence
  Description of Artificial Sequence: Synthetic coding sequence
atgtgcgaaccggccccccccaagccaacccagtcagcctggcactcatttccagagtgcccggctcttttgcttctcctgtccctgctcctgctgccactgggcttgcctgtgctgggagcacccccccggctaatctgtgacagtcgcgttcttgaacggtatatacttgaagcccgcgaagctgagaacgttaccatgggatgtgcgcaaggttgcagtttttccgagaacatcacagttccagatactaaggtgaacttctacacttggaagcgaatggacgtgggacaacaggctcttgaagtctggcagggcctagcacttctgagcgaggctattttgcgcggtcaggccttgttagctaatgcgagtcagccctctgaaacgccccaactacatgtcgacaaggcagtcagtagcctacggtcgcttacttccttgctgcgggccctgggtgcacaaaaagaggctatgtctcttcctgaagaggcctccccagcgcccctcagaacgttcactgtggacactctctgcaagctgtttcgcatttatagcaactttctgagggggaagttgacgctgtacacgggcgaggcgtgtaggcgtggcgatcgc

SEQ ID NO: 10925 - DNA, 618 bp, Artificial Sequence
  Description of Artificial Sequence: Synthetic coding sequence
atgtgtgaacccgcaccgcctaagccgactcaaagcgcgtggcattcgttccccgaatgtccagcactccttttgctgttgtcattgttgcttctgcctctgggccttcccgtccttggtgcacctcctcgcctcatctgcgatagcagagtgttggaaaggtacattcttgaagcacgcgaagcggaaaacgtgactatgggatgcgcccaaggatgttcgttctcagagaacataaccgtcccagataccaaggtgaacttttacacttggaaaagaatggatgttgggcaacaggcgctcgaagtgtggcaggggctggctctgctgtccgaggcaattcttcggggacaggcactgttggcaaatgcatctcaaccatcggagacgccacaactgcacgtggacaaggcagtgtcgagccttagaagcctgacttcactgctccgtgcgctcggtgctcagaaggaagccatgtccttgccggaggaagcctcgcctgcgcctcttcgcacgttcaccgtcgacaccctctgtaagctgtttaggatctactcgaattttctgcgtggcaaacttactctgtacactggtgaggcgtgccgtcggggggaccgg

SEQ ID NO: 10926 - DNA, 618 bp, Artificial Sequence
  Description of Artificial Sequence: Synthetic coding sequence
atgtgcgagcctgccccccctaagcccacgcaatccgcctggcacagttttccagagtgcccagccctgctcctcctacttagtcttctgctgctccccctggggttgccggtgctgggcgcaccacctagacttatttgcgactccagggtgctagaacgctacattttggaagcacgggaagccgaaaacgtgactatggggtgcgcgcagggctgtagtttttcagagaacatcaccgtacctgacacgaaggtgaatttctacacatggaagaggatggatgttgggcaacaggctctagaggtatggcagggcttggcactgctttctgaggctatcctcaggggacaggcactcctggctaacgccagccaacctagtgaaacaccacagttgcatgtggacaaggccgtgagctctttgcgaagcctgactagtttgttacgtgcattgggggctcaaaaggaggcaatgtctctgcctgaggaggcttcccctgccccacttcggacctttaccgttgataccttatgcaaactgtttcgtatctacagcaacttcctaagagggaagttaactctctatactggtgaggcatgcaggcgtggcgataga

SEQ ID NO: 10927 - DNA, 618 bp, Artificial Sequence
  Description of Artificial Sequence: Synthetic coding sequence
atgtgcgagcccgctcccccaaaaccaacgcagtctgcatggcattcgttccctgaatgtcccgccctccttttattgctgtccctcctgctcctgccactgggcctcccggtactcggcgccccacctcgcttgatctgcgactcacgtgtcctggaacggtacatcctcgaagctcgagaagccgagaatgtaactatgggttgcgcccagggttgcagcttcagtgagaacataacggtgcctgacactaaagtgaatttctacacctggaagaggatggatgtcgggcagcaggcactggaggtctggcaagggctggccctgctatccgaagcgattctgagaggtcaggccttactggcgaatgcaagtcagccgagtgagacccctcaattacatgtcgataaagccgtgtcaagcctccgcagcctgacctccctgttgagagccttgggggcacagaaggaggccatgtcactccccgaagaggcgtctcccgccccactccgaaccttcacagttgataccctgtgtaagctgttcagaatttattcgaattttctgaggggaaaactcacactgtatactggagaggcgtgccgacggggggaccgg

SEQ ID NO: 10928 - DNA, 618 bp, Artificial Sequence
  Description of Artificial Sequence: Synthetic coding sequence
atgtgcgaaccagcccctccgaagcctactcaaagcgcttggcatagcttccccgagtgcccggccctgctcctgctcctgtccctgctgctgctgcccctggggcttccggtgttgggagctcccccgcgattgatctgcgactcgcgggtcctggaaagatatatcctcgaggccagggaagccgaaaatgtcactatggggtgcgcgcaggggtgttccttttcagagaacattaccgtgccagacaccaaagtgaacttctacacttggaagaggatggacgtcggacagcaagccctcgaagtgtggcagggactggccctgctgtccgaggcgatcctcaggggtcaagccctgttggcgaacgcctcacaaccgtcggagactccgcaactccatgtggacaaggcagtctcgagcttgcgctccctgacttccctcctgagagcgctgggagcgcagaaggaggcgatgtcgctgccggaagaagcctcgcccgcgccactgcggaccttcaccgtcgataccctgtgcaagctcttccgtatctacagcaatttcctgcggggaaaactgactctgtacactggagaagcatgcaggcgcggagacaga

SEQ ID NO: 10929 - DNA, 618 bp, Artificial Sequence
  Description of Artificial Sequence: Synthetic coding sequence
atgtgtgagccagcaccccccaagcctacacaatcggcctggcactcatttccagagtgtccagcactgctgttgctcctgagtctactgctgctgccgctcgggctgcccgttctgggcgctccacccaggttgatctgcgattcacgcgtgttggagaggtatatcttggaggccagggaagcagagaacgtgaccatgggctgtgcgcaggggtgcagcttctctgaaaatatcactgtgccagacactaaggtgaacttttacacttggaaaaggatggatgtaggacagcaggcactcgaagtttggcagggcttagcactactgagcgaggctattctgcgagggcaggcactgctggcaaatgcatctcagccttccgagaccccgcagttgcatgtcgataaggccgtgtccagcctgcggtccctgacatcactactgcgggctctcggggctcaaaaagaggcaatgagcctgcctgaggaggcgtctccggctccactgaggacctttactgtagacactctctgcaagctttttcgcatttatagcaattttctcagaggaaaactaacactgtacaccggagaggcgtgccggcggggtgatagg

SEQ ID NO: 10930 - DNA, 618 bp, Artificial Sequence
  Description of Artificial Sequence: Synthetic coding sequence
atgtgtgagccagccccaccaaagcctacgcaatcggcctggcattcattccccgaatgtccggcacttctcctcctcctttcactgttgcttctgccactcgggctccccgtcttgggtgctccgcctagacttatttgtgattcgcgcgtgctcgaacgttacattctggaggccagggaagcagagaatgtcactatgggttgtgctcaaggatgttcgttttcggagaacatcaccgtgcctgacaccaaggtcaacttttacacctggaagcggatggatgtgggacaacaagccctcgaggtctggcagggacttgcactcctgagcgaagcaattctgaggggacaggcgctcctcgcaaacgcctcgcaaccctccgaaacgccacaacttcatgtggataaggcagtctcgtcccttagaagcctcacctcgcttctgcgggcacttggagctcagaaagaagcaatgtctcttcctgaagaggcttcgcctgcaccgttgagaacttttactgtggataccctttgtaagctgttccggatttactccaacttcctgaggggtaagttgactctttacactggtgaagcatgtcgccggggtgaccgt

SEQ ID NO: 10931 - DNA, 618 bp, Artificial Sequence
  Description of Artificial Sequence: Synthetic coding sequence
atgtgcgagccagcacccccaaagccgactcagtccgcatggcactcctttccggagtgcccggccctcctgctgctcctctcgttgcttcttctgccactgggtctgccggtgctcggtgccccgccgcgcttgatctgtgacagtcgggtgttggaaaggtatatcctggaagctagagaggccgaaaacgtgaccatgggttgtgcacagggatgtagcttctcggagaatatcaccgtgccagacaccaaggtgaacttctacacgtggaagagaatggacgtcggccagcaggccctggaggtgtggcaggggctcgccctgctgagcgaagcgatactcagaggccaggccctgctggcaaatgcatcccagccttcggaaactccacagctgcatgtcgataaagcagtgtcaagcctgcgcagcctgaccagcctgttgcgcgcgctgggagcccaaaaggaagccatgtcgctgccggaggaggcctcacccgcacctttgcggacgttcactgttgacaccctgtgcaaactcttccggatctacagcaacttcctgcggggaaaactgaccctgtacaccggagaggcttgccggcggggggaccgc

SEQ ID NO: 10932 - DNA, 618 bp, Artificial Sequence
  Description of Artificial Sequence: Synthetic coding sequence
atgtgcgaaccggccccaccgaagcctactcagtccgcctggcattcattccccgaatgcccggccctgctgcttcttctgtccttgctgctcctcccgctgggtctgcctgttttgggagcgccaccacggctcatctgcgatagccgcgtgctcgaacgctacattcttgaagccagggaggcggaaaacgtgaccatgggatgtgcacagggctgctccttctcggaaaacatcaccgtgcccgacaccaaggttaacttctacacttggaaaagaatggacgtcggccagcaggcgctggaagtgtggcaaggactggctctcctttcagaggcgatcttgcgcggccaggccctgttggcaaatgccagccagccgtccgaaacgccgcagctgcatgtggacaaagcagtctcctcgctccgctccctcacttcgctcctccgagccctgggagcacagaaggaggcgatgtcgctgcctgaagaggcttcaccggcccccctgcgcaccttcactgttgataccttgtgtaagctgtttcggatctactcaaatttccttcggggaaagctcactctgtacaccggcgaggcctgtcgacgaggagataga

SEQ ID NO: 10933 - DNA, 618 bp, Artificial Sequence
  Description of Artificial Sequence: Synthetic coding sequence
atgtgcgaaccagctcctcctaaacccacacagagtgcttggcattcttttcccgagtgtcccgccttactattacttttatcgctgctcctgctacctctcggactgccagtgctcggggcccccccccggttaatctgtgattctagggttctggaacgttacatactcgaagcgcgagaggccgaaaatgttacaatgggatgtgcacaggggtgttcattctcagagaacatcacggtgcccgacacaaaggtcaacttttacacttggaaacgtatggatgtggggcaacaggctctggaagtctggcaggggctagccctcctatctgaagccatccttcgcggacaggctctgcttgcaaatgcctctcagccatcagagacacctcagcttcacgttgataaagcagtgtcttccctaagatctctgacttctcttcttagggcactgggggcgcagaaagaggcaatgtcactgcccgaagaagcctcccctgcccctcttcgcacattcactgttgatacactatgtaaactatttagaatctattcaaatttcctacgcgggaaactcacactgtatacaggagaagcctgtcggcggggagatagg

SEQ ID NO: 10934 - DNA, 618 bp, Artificial Sequence
  Description of Artificial Sequence: Synthetic coding sequence
atgtgtgagccagcacctccaaagcctacccagtcagcttggcacagcttccccgagtgtcctgccctgttactgctcctgtcactgctgctgctgcctctcggtctaccagtgctgggtgctcccccccgtctcatatgcgactcaagggtcctagaacgatacatactggaagccagagaagctgagaacgtgactatgggatgcgcccagggctgctcattttctgaaaacataaccgttcctgatacaaaagttaacttctacacatggaaaagaatggacgttgggcagcaggccctggaagtctggcagggcctcgcactgctgagcgaggccatactgcggggccaggcattgttagctaatgcatcccagcctagtgagaccccccaactacatgtcgataaggccgtgtcttcactgcgctccctgaccagtctgctgcgcgctctgggagcccagaaggaggccatgagcctgcccgaggaggcatcccccgctcctctgcgaaccttcactgtggacacactgtgcaagctattcaggatctacagcaactttctccgaggcaagctgactctgtatactggcgaggcttgcaggaggggggatagg

SEQ ID NO: 10935 - DNA, 618 bp, Artificial Sequence
  Description of Artificial Sequence: Synthetic coding sequence
atgtgcgaacctgcgccgcctaagccaactcagtcagcgtggcatagcttcccagagtgcccggcactcctcctgctgttgtcactcctgcttcttccattgggcctgccagtgctgggagctccgcctcgcctgatttgcgatagcagggtgctggaacgctatatcctggaagcgcgcgaagcggagaacgtgaccatggggtgcgcacaggggtgcagcttctccgaaaacattacggtgccagataccaaagtcaatttctacacgtggaaacgcatggatgtgggccaacaagctctggaggtgtggcagggactggcactgttgtccgaggccatcctgcggggacaggcactgctggcgaacgcctcacagccatcggaaactccgcagttgcacgtggataaggccgtcagctccttgcggtcacttaccagtcttctccgcgccctgggtgcgcaaaaggaagcaatgagcttgcccgaggaggcgtcccccgccccgctcagaacctttactgtggacaccctctgcaagctctttcggatctattcaaacttcctgcggggcaaactgaccctgtacactggagaggcatgccgcagaggggaccgt

SEQ ID NO: 10936 - DNA, 618 bp, Artificial Sequence
  Description of Artificial Sequence: Synthetic coding sequence
atgtgcgaacccgcgccaccaaaacccacacagtcagcgtggcattccttcccagaatgccccgcattgctcctgctcctgtcacttcttttacttcccttgggcctccctgtcctaggggcccctccccgtctaatctgcgattcgcgcgtgttggagcgatacatcctcgaagcacgtgaggcggagaatgtcacaatgggctgcgctcaaggctgttctttctcagaaaacatcacggtcccggacactaaagtgaatttctatacctggaaacgtatggatgtcggacagcaggctcttgaagtctggcaaggccttgcattactatctgaagctatcctcagaggccaagcgctccttgccaatgcatcgcagcccagcgagacccctcaacttcatgtcgataaggccgttagctctcttcgatcgctgacttcattacttcgcgctctcggcgcccaaaaggaggcgatgagcctccctgaagaagcctccccagctcctttaaggacgttcacagtggatactctgtgtaaactgtttcggatctattcaaatttcctacgtggcaagttgacactgtataccggagaggcatgtagacgaggtgatcgg

SEQ ID NO: 10937 - DNA, 618 bp, Artificial Sequence
  Description of Artificial Sequence: Synthetic coding sequence
atgtgtgagccggcacctcctaaaccaactcaatctgcttggcatagttttcctgagtgtcctgcgctgctgcttcttttatccctgctgctgttacccctcggactgcctgtgctgggtgcacctccgcgattgatttgtgactctagggtgctggagagatacatcctcgaggcacgggaggcagagaatgtgaccatgggatgtgcacaggggtgcagtttctctgagaacattactgtcccagacacgaaggtgaacttctacacctggaagagaatggacgtgggtcagcaggctctcgaggtttggcagggtctggctctcctgtcagaggccatcctccgcggccaggccctgctggccaatgcctcacagccgtcggagaccccccagctacatgtggataaggcagtatcctctctccggagcttgacctcactgctgagggccttgggagctcaaaaggaagctatgagcctcccagaagaggcctctccagcgcctctgcggacgtttaccgtcgacaccctgtgcaagttattccggatttacagcaactttctcaggggcaaactcaccctgtataccggcgaagcctgtaggcggggcgacagg

SEQ ID NO: 10938 - DNA, 618 bp, Artificial Sequence
  Description of Artificial Sequence: Synthetic coding sequence
atgtgcgagccggccccccccaaaccaacacagtccgcctggcacagctttcccgagtgtccggccttgcttctccttctatctctgcttctgcttcccctggggctgccggtgctgggagctcccccacgactcatatgtgactcccgggttctggagagatatatcctggaggctcgcgaagccgagaatgtaaccatgggctgcgcccagggatgctcctttagtgagaacattaccgtccctgacacgaaggtgaatttttatacttggaagcgaatggatgttgggcaacaggctctggaggtttggcagggtctggccctgctatccgaggcgatattgcgtggacaagcactcctcgccaacgcctctcagccatccgagacccctcagcttcatgtggacaaagcagtgtcgtccctgcgcagtctaacaagcctgctcagagcactgggagcccaaaaagaagctatgagtctgccagaagaggccagtcccgcccctctgcgaactttcacagtggacactctgtgtaaactatttaggatctactcgaatttcctacgcggaaagctgacgctatatacaggcgaggcatgtcgccgcggcgaccgc

SEQ ID NO: 10939 - DNA, 618 bp, Artificial Sequence
  Description of Artificial Sequence: Synthetic coding sequence
atgtgtgaaccggcaccaccgaagcctacgcaatcggcttggcacagcttcccagagtgtccggcactcctgctgttgctgtccctgctgctcttgcctctgggcctcccagtgcttggcgctcctccgagactgatctgcgattcgcgcgtcctggaaagatacatcctcgaagcgagggaagcagaaaacgtcaccatgggatgcgctcaggggtgttcatttagcgaaaacatcactgtccctgacaccaaggtgaacttctacacctggaagagaatggacgtcggccaacaggcacttgaggtctggcagggcctcgcccttctcagcgaagctattctgagaggccaagcactgttggccaacgccagccagccatccgagactccacaactccacgtggacaaggcagtgtcctccctgcgcagccttacctccctccttcgagcgttgggggcgcagaaagaggccatgtcactgccagaagaggcctcgccggccccgctccggacctttactgtcgacactctgtgcaagctgttccggatctacagcaacttcctgcggggaaagctcactctgtacaccggagaggcctgccgtaggggcgaccgc

SEQ ID NO: 10940 - DNA, 618 bp, Artificial Sequence
  Description of Artificial Sequence: Synthetic coding sequence
atgtgcgagccggccccacccaagcccacccagagcgcatggcactccttccccgagtgtcccgcgctgctgctgcttttgtcactgctcctgttaccgctgggattgcccgtcctgggtgctccccctagactgatctgtgattctagagtgctagaacggtacatcttggaggcgagagaggccgagaacgtcaccatgggttgtgcgcagggatgctcattttcggaaaatatcaccgtgcctgacactaaggtgaacttttatacttggaagcgaatggacgtaggacagcaagctctcgaggtctggcagggtctagccctcctttccgaggcgatcctccgaggccaggctctcctggctaatgccagccagcccagtgaaaccccacagctacatgtggataaggccgtgtcaagcctgagatctcttacctctctcctgagggcactgggagcacagaaagaggctatgtcactgcccgaggaagctagtcccgctccgctaaggacttttactgttgatactctctgtaaattgttcaggatctattcaaactttctgcgcgggaagctgacgctctataccggcgaagcctgtagacgaggggaccgc

SEQ ID NO: 10941 - DNA, 618 bp, Artificial Sequence
  Description of Artificial Sequence: Synthetic coding sequence
atgtgtgagcctgcaccgcccaagcctactcagtcagcatggcattcctttcccgaatgtccggccctcctcctcctgttgagccttcttctgttgccgcttggtttgccagtgctgggagcaccacctcggctgatttgtgactcgagagtgctggaacgatacatcctcgaagcacgagaggcagagaacgtgacgatgggctgtgcccaaggatgctccttctctgaaaacatcactgtgcccgataccaaggtgaacttctacacctggaagagaatggatgtcggacaacaagcacttgaggtctggcaaggactggcactgcttagcgaagcaattctgagaggacaggccctgcttgcgaatgcgtcacaaccttcggaaacccctcaacttcacgttgataaggccgtgagttcgcttcgctcacttacgtcgctgcttcgagctctgggcgcacaaaaggaagcaatgtcactgccagaagaagcatcacctgcgccactgaggacctttactgtcgatactctttgtaagctgtttagaatctacagcaacttcctccgaggtaagctcactctttacactggggaagcatgtagacgtggagatagg

SEQ ID NO: 10942 - DNA, 618 bp, Artificial Sequence
  Description of Artificial Sequence: Synthetic coding sequence
atgtgtgagcctgcacccccaaagcctacgcaaagtgcttggcattcatttccggaatgtcccgcattgctcctcttactttcattgcttctgttgcctttaggacttcctgtcctaggcgctccaccacgactcatttgcgattcacgtgttctggaacggtacattcttgaggctagagaggcagaaaatgttacgatgggttgcgctcagggatgttcctttagcgagaatatcacggttcctgatactaaagtaaatttttatacctggaaaaggatggacgtgggacaacaggccttggaagtttggcaaggactagccttgctctccgaggccattcttagaggtcaggcacttttggctaacgctagtcaacctagtgagacaccacagctgcacgttgataaggccgtttctagtttgagatcactcacttccctcttgcgagccttgggtgcccagaaggaggccatgtcacttcctgaagaagctagtcctgctccccttcgtacgttcactgttgatacactttgcaagctattcagaatctatagtaacttccttaggggtaaacttactttgtataccggggaggcttgtaggcgaggtgaccga

SEQ ID NO: 10943 - DNA, 618 bp, Artificial Sequence
  Description of Artificial Sequence: Synthetic coding sequence
atgtgcgagcccgctccaccaaagccaacgcagtccgcatggcatagctttcctgagtgtcccgcactgttgctgttgctgtcgttgttgctgctcccattaggcctcccagttctcggtgctcccccacgactgatttgcgatagcagggtgttggagaggtacatcctggaagctcgcgaagctgagaatgtgacaatgggatgtgcccaaggctgcagtttttccgaaaatattactgtaccagacaccaaagtgaacttctacacttggaaacggatggatgtcgggcagcaggcccttgaagtctggcaaggcctcgctctgctcagcgaggctatcctgaggggtcaggcgcttctcgctaatgcctcacagccctcagagacgccccagcttcacgtggacaaggccgtgtcttccctgcggtccctgacttcactgttgcgtgcacttggcgcccagaaagaagcaatgagtctccctgaggaggccagtccagccccactcaggacattcaccgtagacacattgtgtaagctatttaggatatattctaattttctgcgcggaaagttgaccctgtacacaggagaagcctgtagaaggggagatcgt

SEQ ID NO: 10944 - DNA, 618 bp, Artificial Sequence
  Description of Artificial Sequence: Synthetic coding sequence
atgtgcgaaccggcacctcccaagccaactcagagtgcttggcattcatttccagaatgtcctgcgctcctgctgcttcttagcctactgctgttgcctcttggtctgccagtgctgggagcaccaccacgcctcatctgcgactcaagggtgttggaaaggtatatccttgaggcaagagaggccgagaacgttaccatgggatgtgcgcagggctgcagcttttccgagaatataacagtgccggacacaaaagtgaacttttacacctggaaaagaatggatgtcggccagcaagcactggaagtgtggcagggccttgcgctgctttcagaggctattctcagaggccaggcattgcttgcaaatgcttcccagccatctgagactccacagttacacgtcgacaaagccgtatcttcccttcggagcctaacgtctctgctgagggcacttggagcacaaaaagaggcgatgtccttgcctgaagaggcgtctcccgcccccctgcgtacattcaccgtggacacattgtgtaaacttttcaggatctacagcaacttcttacggggaaagctcactctgtatactggagaagcctgccggaggggagaccgc

SEQ ID NO: 10945 - DNA, 618 bp, Artificial Sequence; identical to SEQ ID NO: 10937
  Description of Artificial Sequence: Synthetic coding sequence

SEQ ID NO: 10946 - DNA, 618 bp, Artificial Sequence
  Description of Artificial Sequence: Synthetic coding sequence
atgtgcgaacctgctcctccgaagccaactcagagcgcgtggcactcgtttcctgaatgccccgcgctgcttctgctgctctctctgctgctcctgccgctcggcctgccagtgctgggagccccaccacgcttgatctgcgattcaagagtgctcgagcgctacattctggaagctcgggaagccgagaacgtcactatgggatgtgcacagggatgctccttttcggaaaacatcacggtcccagacaccaaagtgaacttctacacttggaagagaatggacgtggggcagcaggccttggaggtgtggcaaggtctggcactgctcagcgaggctatcctgcggggccaggcgctgctggctaatgcatcgcagccctcagagactccgcagctgcacgtggacaaggctgtctcgtcccttcggtcacttacctccttgctgcgggccttgggagctcagaaggaagcaatgtcgttgccagaggaagcctccccggccccgttgcgcactttcacggtggacaccctgtgcaaactcttccgcatctacagcaacttcctgcggggaaaactgaccctctacaccggtgaggcctgccgacgcggagacaga

SEQ ID NO: 10947 - DNA, 618 bp, Artificial Sequence
  Description of Artificial Sequence: Synthetic coding sequence
atgtgcgagccggccccgcctaagccgacgcaatccgcgtggcactcgttcccggaatgcccagcactcctgctgctcctctcgctgcttctgctgcctctcggccttccagtgctgggcgctccgccaaggctgatctgcgacagcagagtgctggaacggtacatccttgaggcacgcgaagctgaaaatgtcactatggggtgcgcacagggatgttctttctcggagaacatcaccgtgccagatactaaagtgaatttctatacgtggaagcggatggacgtcggacaacaggcgctcgaggtgtggcagggactcgcgctgctgtcggaggctatactccggggtcaagcactgctggcgaacgcctcccaaccaagcgaaactccccagctgcatgtggacaaggccgtgtcatcccttcggagcttgacgtccctgttgagagcgctgggagcccagaaggaagcaatgtccctgccagaagaagcgtcacctgctccgctgcgcacctttaccgtcgatactctgtgtaagttgttccggatctactcaaactttcttagaggcaaattgaccctgtacactggtgaggcttgccgcaggggagacagg

SEQ ID NO: 10948 - DNA, 618 bp, Artificial Sequence
  Description of Artificial Sequence: Synthetic coding sequence
atgtgtgagcctgccccgccaaaacccacccaatccgcttggcactcgtttcctgaatgcccagcactgctgctcctgctctcactgcttctccttcctctgggccttccagtgttgggcgcgccgcctcgcttgatctgcgattcccgagttctcgagagatacattctggaggctagggaggcggaaaacgtgaccatgggatgtgcgcagggatgctcgttcagcgagaatatcaccgtgccggatacgaaggtgaacttctacacttggaaacgcatggacgtcgggcagcaagcgctcgaggtgtggcaaggattggctctcctgtcggaggcgatccttcgcggacaggcactgttggccaacgcaagccagccctccgaaaccccgcaactgcatgtagacaaggcggtgtcctctctcaggtcactgacctccctgttgcgagccttgggagcccaaaaagaggcaatgtcgctgccggaagaggcctcccccgccccgctccgtacctttactgtggacactctctgcaagttgttcagaatctactccaatttcctgagaggcaagctgaccctgtacacgggagaagcctgcaggagaggtgacaga

SEQ ID NO: 10949 - DNA, 618 bp, Artificial Sequence
  Description of Artificial Sequence: Synthetic coding sequence
atgtgtgagcctgcgcctccaaagccaacccaatccgcatggcatagcttccccgaatgcccagcgctccttcttcttctgtcccttctcctccttccacttggactcccagtgctcggcgcaccacccagactcatttgcgactccagagtgcttgagcgctacatccttgaagcgagagaggccgaaaacgtgaccatgggctgtgcgcaaggatgctcgttctctgaaaacatcactgtcccagatacgaaagtcaacttctatacttggaagaggatggatgtgggacaacaggctttggaagtatggcaaggactggccctgctctccgaggcaattctgcgcggccaagcacttctggcaaacgcgtcgcagccttcagaaacccctcagttgcatgtggacaaagcagttagctcgctgcgaagcctgactagcctccttcgcgcactcggagcccaaaaggaagcaatgtcccttcctgaagaagcatcgccagcgcccttgcggacctttactgtggacaccttgtgtaagctgtttaggatttactcgaattttctccgagggaagttgactctgtacaccggtgaggcatgtagacgcggtgatagg

SEQ ID NO: 10950 - DNA, 618 bp, Artificial Sequence
  Description of Artificial Sequence: Synthetic coding sequence
atgtgtgagccagcaccgcccaagccaactcaaagcgcctggcacagcttccccgagtgccccgcgctgctgctgcttctctcactcctgttgctgccgctggggctcccggtgctgggtgcaccgccgcggctgatttgcgattcgcgggtcctcgaacgctacatcctcgaagccagagaggccgaaaacgtcaccatgggatgcgcgcagggctgtagtttcagcgaaaacatcaccgtaccagatactaaggtgaacttctacacctggaagcggatggacgtcggacaacaggctcttgaagtgtggcagggactcgccttgctgtccgaggcgatcctccggggacaggcactgctcgcaaacgcgtctcaaccgtcggaaacccctcaactgcatgtggataaagccgtgtcctcactccgaagcctgacttccctcctccgcgcgctcggagcgcagaaagaggccatgtcactcccggaggaggcatctccggcgccactgagaacgttcactgtcgacactctgtgcaaattgttccggatctactcaaatttcctgaggggtaaactgacgctgtacaccggtgaggcgtgccggcgcggtgatcgc

SEQ ID NO: 10951 - DNA, 618 bp, Artificial Sequence
  Description of Artificial Sequence: Synthetic coding sequence
atgtgcgagccagccccccctaaacctacgcagagtgcctggcacagttttcctgagtgtcccgcactcctgctgctgctgagtcttctactgctaccgctgggcctgccggtcttgggagcccccccccgtttgatttgtgattcccgagtgctggagcggtacatcttagaggcccgtgaagctgagaacgtgacaatgggctgtgcccaggggtgctcgttcagtgaaaacattaccgtgcccgatacaaaagtgaacttttacacttggaagcgcatggatgtcggtcagcaagcactggaagtgtggcagggtctagctctgttgtcggaagccatactgcgaggacaagcattgctcgctaacgccagtcagccctcagagacgccgcagttgcatgtcgataaagctgtgagttcgctgcgctctcttacctccctgctcagggctctgggagcccaaaaagaagctatgagtctgccggaggaggcatcaccggcgcctctgagaacgtttacagtagatacattatgtaaactgtttaggatctattcaaatttcctccggggcaagctgactctgtacacaggcgaggcatgtcgcaggggagaccgt

SEQ ID NO: 10952 - DNA, 618 bp, Artificial Sequence
  Description of Artificial Sequence: Synthetic coding sequence
atgtgcgaacccgcaccccccaagcctacccagtctgcctggcattcctttccagaatgcccggccctgctactgctcctgagtctcctgctgctgcccctcggtttaccggtattgggggctcctcctcggcttatttgtgacagtcgcgtcctcgaacgctatatcttggaggctagagaagcagagaacgtgacaatggggtgcgctcagggctgcagtttttccgaaaatattactgtacctgacactaaagtgaacttttacacgtggaaacgcatggacgtgggacagcaggccctggaggtgtggcaaggattggcattgctcagcgaagccattctgagaggccaagcccttctggccaatgcctcccagccgtccgaaacaccccagctccatgtggataaggctgtgagttctctgagatctttgacatcgctgttgcgggccctcggcgctcaaaaggaggccatgagtctccccgaggaagccagccctgccccactgagaacctttactgttgatacactgtgcaagctgttccgtatctacagcaactttctacggggtaaactgacactctatacgggcgaggcgtgtaggagaggggacaga

SEQ ID NO: 10953 - DNA, 618 bp, Artificial Sequence
  Description of Artificial Sequence: Synthetic coding sequence
atgtgtgaacctgcgccacctaagccaacccaatctgcatggcacagctttcccgaatgccctgccctgctcctgctcctcagcctgctgttgctgccattgggactccccgtccttggtgccccgccacggctcatttgcgactcaagggtacttgaacgatacattctcgaagcgcgcgaagctgaaaatgtcaccatggggtgtgcgcaaggctgttcattctcggagaacataactgtcccggatacgaaggtgaacttctacacttggaagcgaatggacgttggtcaacaagcgttggaagtgtggcagggtcttgccctgctgtccgaagcaatccttcgcggccaagcactcctggcgaacgcaagtcagccatccgagactccccaacttcacgtggacaaggcagtgagctcgctgaggtcccttactagcctgcttagagcactcggggcacagaaagaggccatgtcgctcccagaggaagcctccccagccccacttcgcacgttcaccgtggataccctctgtaaactctttagaatctatagcaatttcctgcggggaaaactcaccctgtacactggtgaggcctgtagaaggggagatcgt

SEQ ID NO: 10954 - DNA, 618 bp, Artificial Sequence
  Description of Artificial Sequence: Synthetic coding sequence
atgtgtgaacccgcaccgccgaagccaacgcaatccgcatggcactctttccctgagtgcccggctttgctgctgctgctgtccctcctgctcctgccgctgggactgccagtgctcggagctcctccgcgccttatctgcgactcacgagtgttggagcgctacatcctggaagcgagggaagccgagaatgtcactatggggtgtgctcaaggatgctccttctcggagaatatcaccgtgccggatactaaagtcaacttctacacttggaagagaatggatgtgggacaacaagcgttggaagtctggcaaggactggcgcttttgtccgaggccatcctccgcggccaggcgctcctggccaatgcgtcgcagccatccgaaacccctcagcttcacgtggataaggccgtgagctccctccggtcgctcacctcgctgttgcgcgctctgggcgctcagaaggaagccatgtccctgcctgaggaagcctctccagctccactccgtactttcactgtggacactctgtgtaagctcttccggatctacagcaacttcctgcgcggaaagctgacgctgtacactggcgaagcatgtagacgcggcgaccgc

SEQ ID NO: 10955 - DNA, 618 bp, Artificial Sequence
  Description of Artificial Sequence: Synthetic coding sequence
atgtgcgagcctgccccgcccaagcccacacagtcggcctggcattcgttcccagaatgtcctgccttgctgctgctcctctccctgctgctactaccgctgggattgccagtccttggagcacctccgcgccttatttgtgattcccgggtcttagagcggtacatcctggaggcccgggaggctgaaaacgtaactatggggtgcgcacagggctgttcattcagtgagaacatcactgttcccgatacaaaagtgaatttctacacttggaaacgtatggacgttggtcagcaggccctggaggtgtggcaaggcctcgccctgctctccgaggcgatactgcgaggtcaggcactgctggcaaatgcctcccagccctcagagacgcctcagttgcatgtggacaaggccgtatctagtctgagatcgctgacatccctcttaagagctctaggagcccagaaagaggcaatgtccctccctgaggaagccagcccggccccattgcgaaccttcactgtggacacactgtgcaagctatttcggatttattcgaacttcttgcgtggaaaattgacactatacacgggagaggcctgccgacgaggagacagg

SEQ ID NO: 10956 - DNA, 618 bp, Artificial Sequence
  Description of Artificial Sequence: Synthetic coding sequence
atgtgcgaaccagcaccgccaaagccaactcaatctgcctggcattccttcccagaatgcccggctctgctcctattgctttcactcctcttgctgccgttgggccttccagttttgggagctcctccacgactaatttgtgattccagagtcttagaacggtacatccttgaagcaagagaggcagagaacgtcacaatgggatgcgcacaaggttgttccttctcggaaaacattaccgtcccggatacaaaggtcaacttttacacctggaaaaggatggacgttgggcagcaggcactcgaagtgtggcagggactcgctttgctcagtgaagctatcttgcgaggacaggctcttctggctaatgcgagccaaccatcggagacgccacaactccatgtagataaagccgtttcatcgcttagaagtttgactagtctgttacgcgctttgggtgcccaaaaagaagccatgtcgcttcctgaagaggcgtcaccagcaccattgaggacctttacagtggacacgctttgtaaattgttccgtatttattccaattttttgcgaggaaaacttacattgtacacaggtgaagcatgtcgtagaggagatcgt

SEQ ID NO: 10957 - DNA, 618 bp, Artificial Sequence
  Description of Artificial Sequence: Synthetic coding sequence
atgtgcgagcccgctcctccgaagccgacgcaaagcgcttggcacagctttcctgaatgccccgcacttttattgctgctgtcacttcttcttctcccgcttgggttacctgtacttggggctcctccgagacttatatgtgatagccgcgttctggaaagatatatcctggaagccagagaagccgaaaacgtgaccatgggctgtgcccaaggttgcagtttcagtgaaaacataacagtcccggatactaaggttaatttctatacttggaaacgcatggacgttggacagcaggcgctggaagtttggcagggtctcgctcttctgagcgaagccattcttcggggtcaggcattgcttgcgaatgcttcacagcctagtgagacgccacagttgcatgtcgataaagcagtttcctcactgagatcccttacttctctgcttagagctttaggtgcacaaaaggaagcgatgagtctgccggaagaggcaagccctgcgccgttacgcacctttacggttgataccctttgtaaactgtttcgtatttactctaattttttaagaggcaaacttacactttacaccggagaagcgtgtcgacgaggggatcgt

SEQ ID NO: 10958 - DNA, 618 bp, Artificial Sequence
  Description of Artificial Sequence: Synthetic coding sequence
atgtgcgagccggcacctccaaagcccacgcagagtgcttggcactctttccccgaatgccctgctctgcttctcttattaagtttgcttctcctacctctgggacttcccgtattgggagcccctccacgtttgatatgtgattctagggtgttagaacgctacatactcgaagcgcgggaagccgagaacgtgactatggggtgcgcccaggggtgttctttttccgaaaacataacagtccccgatactaaggtaaacttttatacttggaaaaggatggacgtggggcaacaggccctcgaagtctggcaggggctcgctcttctgtccgaagccatactaagagggcaggcacttcttgctaatgccagtcagccatcagaaactccccagctccatgttgacaaagccgtgtctagtcttcggagtctgacttctcttctgcgggctctcggagcccagaaagaggctatgtcactccctgaagaagctagtcccgcacctttgcgcacatttacagttgatacattgtgtaaattatttagaatatattctaactttctaagaggaaaattgactctctacacaggggaggcctgcagaaggggagatagg

SEQ ID NO: 10959 - DNA, 618 bp, Artificial Sequence
  Description of Artificial Sequence: Synthetic coding sequence
atgtgcgagcccgccccgccgaagccaacgcagtcggcctggcactcctttcccgaatgccctgccctgctgctcctgctgtccctgctcctcctgccgctgggactgcctgtgctcggagccccgccgcgtttgatctgcgattcacgcgttctggagaggtacattcttgaagcccgagaagcggagaacgtgaccatgggatgtgcccaaggatgttccttctcggagaatatcaccgtgccggacactaaagtcaacttctatacttggaagcgcatggatgtgggtcaacaggcacttgaagtgtggcaagggctggccctgctgtccgaagccatcttgcgcgggcaggcgctgctcgctaacgcgtcccagccgagcgagactcctcagttgcatgtggataaggcggtgtcctcgctgcgcagcctgacctctctgctgcgggcactcggagctcaaaaagaggctatgtcgctgccagaagaagcctctccagcgcccctccgcacgttcactgtggatactctgtgcaagctgttccggatttactctaatttccttcgcggaaagctgactctgtacaccggcgaagcatgtagacggggggatagg

SEQ ID NO: 10960 - DNA, 618 bp, Artificial Sequence
  Description of Artificial Sequence: Synthetic coding sequence
atgtgtgaaccggcacctccaaagcccacccagtcagcctggcactcatttcctgagtgtccagccctcctcctgttgttgtctctgctcctcctccccctcggtttgcctgtgctgggagctcctcccagacttatctgtgattcccgcgtgttggaacggtacattttggaagcaagggaggcggaaaatgtgaccatgggctgcgcacaagggtgctcgttcagcgagaacataaccgtgccggacactaaggtcaacttttacacctggaaacggatggatgtcggacagcaagcactggaagtgtggcaaggattggcgcttctgtccgaggccattctcagaggtcaagctctgttggcaaacgcaagccagccaagcgaaactccacaactgcacgtggacaaggcagtttcgtcactccgatcgcttacgagcctccttagagcactcggagcccagaaggaagccatgtcgcttcccgaagaagcatctcctgccccgcttcggactttcactgtcgatacgctttgtaaactgtttcggatctactcgaattttctccgcggaaagctgacgctttacacgggagaagcatgtcggcgaggggatcga

SEQ ID NO: 10961 - DNA, 618 bp, Artificial Sequence
  Description of Artificial Sequence: Synthetic coding sequence
atgtgtgagccagcgccaccaaaacccacacagtctgcttggcacagtttccctgaatgccccgctctgctactgctcctttcactcctgctgctcccattagggctgccagttctgggggctcccccgagactcatctgcgactcacgcgttctcgagagatacattctcgaggccagagaagccgagaatgtgactatggggtgtgctcagggatgctctttcagtgaaaacatcaccgtgcccgatacgaaggtgaatttctatacctggaagcggatggatgttggacagcaggctctcgaagtctggcaaggcctggccctcctgtcagaagcaattctgagaggccaagcattgctggccaacgccagtcagccttctgaaacaccccagttgcacgtggacaaagcggtgtcatcccttagatctctcacaagcctgcttagggctcttggtgctcagaaagaggcgatgagcctccctgaggaggcttcccctgcgcctctacggactttcacagtcgatacattgtgtaaattgttcaggatctatagcaatttcctaaggggcaaattgaccctgtatacaggagaagcatgtagacggggagatagg

SEQ ID NO: 10962 - DNA, 618 bp, Artificial Sequence
  Description of Artificial Sequence: Synthetic coding sequence
atgtgcgaacctgcccccccaaagcctactcagtctgcttggcactcttttccggagtgcccagcattgctactgctgctgagcttacttctgttgccgttgggactgcctgtacttggagcaccaccccggttgatttgtgacagtcgggtgctcgaacgatatatcctggaggcccgcgaggccgaaaacgtgacaatgggatgtgcacaagggtgttcgttttctgagaatataaccgtgcctgacactaaggtgaacttttatacgtggaaaaggatggatgtgggacagcaggctctcgaagtttggcagggcttggccttgctgtccgaggcaatcctgagaggccaggctttactggccaatgccagccaaccaagcgaaacccctcagctgcacgtggataaagccgtctcctcactgcgttctttgacatctttgttgagagctctaggggcccagaaagaagccatgtccctcccagaggaagcctccccagctccattgcggactttcaccgtggacactctctgtaaactgtttcggatttactccaatttccttcggggcaaattaacgctgtataccggtgaggcttgccggcggggagacaga

SEQ ID NO: 10963 - DNA, 618 bp, Artificial Sequence
  Description of Artificial Sequence: Synthetic coding sequence
atgtgcgagccagccccgccgaagccgacgcaatcggcctggcattcattcccggaatgcccggccctgctgttgttgctgtccctgctcctgctcccactgggattgcctgtcctcggagctccgccgcgcctgatctgcgattcgagagtgctggaacggtacatcctggaagccagggaggccgaaaacgtcactatgggatgtgcacaagggtgctcattctctgagaatatcacggtgcctgatactaaggtgaacttctacacctggaagcgcatggacgtggggcagcaggctctcgaagtgtggcagggacttgcacttctgagcgaggcaattctccgcggacaggccctcctggccaacgcttcgcaaccatcggaaactccacagctccatgtcgataaggccgtttcatcgctgcggtcccttaccagcctgttgcgcgccttgggagcgcagaaggaagcaatgtctctcccggaggaagcgtccccagcccccctgcgcacttttacggtggacaccctgtgcaagctctttcgcatctactcaaactttctcaggggtaaattgaccctctacactggagaagcgtgtcggaggggagataga

SEQ ID NO: 10964 - DNA, 618 bp, Artificial Sequence
  Description of Artificial Sequence: Synthetic coding sequence
atgtgcgaaccagccccgcccaagccgacccagtcggcatggcattcattcccggagtgcccggccctgctcctgttgctgtcgctgctcctcctcccacttggtctgccagtcttgggcgcgccacctcgccttatttgtgactcaagagtgctcgaacgctacatcctggaagcccgggaagccgagaatgtgactatgggatgcgcgcaaggatgcagctttagcgaaaacatcaccgtgcctgataccaaagtgaacttctacacttggaagaggatggacgtcggacaacaggccctggaagtttggcagggcctggcgctgctgtcggaggcaatccttcggggacaagctctgctcgcaaatgcttcccagccctccgagactccgcagttgcacgtggacaaggccgtctcatcccttcgctctctcacttcgctgttgcgggccctcggagcacagaaagaggctatgtccctcccggaagaggcgagcccggcgcctctgagaaccttcactgtggatacgctgtgcaagctgtttcgaatctacagcaacttcctcagagggaagctgaccctgtacaccggcgaagcctgtcgccggggggaccgc

SEQ ID NO: 10965 - DNA, 576 bp, Artificial Sequence
  Description of Artificial Sequence: Synthetic coding sequence
atgggctcctgtgaatgtcctgcacttctgcttcttctgtcccttctcctcctgccactgggcttgcctgtgctgggggcacccccaagactgatctgtgattccagagtgcttgaacgctatattcttggagcgcgagaggccgaaaatgtgaccatgggatgtgcagaaggatgctcgttttccgaaaacatcaccgtgccggacactaaagtgaacttctacacgtggaagagaatggacgtgggacagcaggccgtcgaagtgtggcaaggactggcccttctttccgaagccattcttcgggggcaggcgctgctggcaaattcctcgcaaccctcggaaacccttcaactgcatgtggataaggcagtgtcctcccttagatcactgacctccttgcttcgagcactcggtgcacagaaagaagcaacttcgctgcccgaagccaccagcgccgcacctttgcgcaccttcactgtggatactctctgtaagctgttcagaatctactcgaacttccttcgcggtaagctgactctgtacactggagaggcttgccgtaggggggatcgg

SEQ ID NO: 10966 - DNA, 576 bp, Artificial Sequence
  Description of Artificial Sequence: Synthetic coding sequence
atggggagctgtgaatgcccggctctccttcttctcctgtcgttgctccttctgccgctaggtctcccagttctgggagcacccccccggttaatctgcgatagcagagtccttgagcggtatattctgggagccagagaggccgagaacgtaaccatggggtgcgctgagggatgtagcttctcagagaacattactgtgcctgacaccaaggtaaacttttatacatggaagagaatggatgttggccagcaggctgtggaggtatggcagggcctcgccctactgtctgaggcaatacttcgcgggcaagcgctcctggccaacagcagtcagccttccgagaccctgcagctccatgtagacaaagccgtgagctccttacgctccctaacaagtctgcttagagcacttggagcccagaaggaggccacttctctcccagaggcgaccagtgccgctcccttgaggacttttaccgttgacaccctttgtaaactattccggatatacagtaacttcttgaggggtaaattaacgttgtataccggcgaggcttgcaggaggggggataga

SEQ ID NO: 10967 - DNA, 576 bp, Artificial Sequence
  Description of Artificial Sequence: Synthetic coding sequence
atgggctcttgtgaatgtccagcactcctactcttgctaagcttgctgctcctacccttagggctccccgttttgggcgcccctcccagactcatatgtgattctagagttcttgagcggtacatactgggcgcacgcgaggccgaaaacgtcacaatgggatgtgctgagggttgttccttctcggaaaatataacggttccggacaccaaggttaatttttatacttggaagcgaatggacgtgggtcagcaggcggttgaagtctggcaaggactcgccctgcttagcgaggcgatcctgcgaggccaggcccttttggccaactcatcacaaccatcggaaaccttgcaattgcatgttgataaggcagtatcttccctccgatcattgacatccctactacgggcattgggcgctcaaaaagaagcgactagcctcccggaagccacctccgcggcgccgttgcgtactttcacggtcgatacactgtgcaaactgttcaggatctactccaactttttgcgagggaaactgaccctttatactggtgaagcttgccggaggggtgaccgt

SEQ ID NO: 10968 - DNA, 576 bp, Artificial Sequence
  Description of Artificial Sequence: Synthetic coding sequence
atgggctcatgcgaatgtcccgcactgttgctgttactcagtttgctgctccttccgctgggactacctgtgctgggtgctcctccgcgcctgatatgtgatagccgcgtgctggaacgctatatcctgggggccagggaggccgagaatgtgaccatgggatgtgcagaaggttgctcgttctccgagaacattaccgtgccagacaccaaagtaaacttctacacatggaaaaggatggacgtcggacaacaggccgtcgaggtttggcagggcttggcgttgctaagtgaagctatcttgcgcggtcaggcgctgctggctaacagttcccagccttcggaaactctccagctccacgtagataaagccgtttctagcctgagaagtcttacctcgctccttagggcacttggtgcacagaaggaagccacatcccttccagaggcaactagtgcagccccactcagaacattcaccgtggatactctgtgcaagttgtttcgcatctactctaatttcctgagaggcaagctaacactgtacactggagaggcctgcaggcgtggggataga

SEQ ID NO: 10969 - DNA, 576 bp, Artificial Sequence
  Description of Artificial Sequence: Synthetic coding sequence
atgggatcgtgcgaatgcccggccctgctcctgctcctgtcactcctgctgctcccactcggactgccagtcctcggcgcgccgccgaggctgatctgtgactcgagagtcctcgaacggtatatcctgggggcgagggaggcggagaacgtgactatggggtgcgctgaggggtgctccttctccgagaacattactgtcccggacaccaaggtgaatttctatacctggaagcggatggatgtcggccagcaggctgttgaagtttggcagggattggcactgttgagcgaggccatccttcggggccaggccctgctcgctaattcctcacagccgagcgaaactttgcaactccacgtcgataaggccgtctccagcctgaggtcactcacttcgctgctgcgcgcgctgggggcgcaaaaggaggcgactagcctcccggaagctacgtccgccgccccactgcggacttttaccgtggacaccctgtgcaagctcttcagaatctacagcaatttcctgcgaggaaaactgaccctctacactggagaagcctgcagacgcggtgaccgc

SEQ ID NO: 10970 - DNA, 576 bp, Artificial Sequence
  Description of Artificial Sequence: Synthetic coding sequence
atggggagttgcgaatgtcctgcactgcttctgctcctttccctgctcctcctgccactggggcttcccgtactaggagcccccccaaggctaatctgtgattcaagggtcctggagcgatatatactaggagcccgggaggctgagaatgtgacaatgggatgcgccgaggggtgcagtttctctgagaatatcacagtacccgatacaaaagttaatttttatacatggaaacggatggatgtgggacagcaggcagtggaggtttggcaaggactggccctgctcagtgaagctattctaagggggcaggcactgctggccaattcttcacaaccaagtgaaactctccagctgcacgtcgataaagctgtatcttccctccggtcattgacttctctgctcagggccctcggggctcaaaaagaggccacatctctgcccgaagctacttccgctgcccctctcaggacatttactgtcgatacactctgcaaactgtttagaatctattcgaacttcctgcgtggaaaactcacactttatactggagaagcttgtcggcggggggatcgc

SEQ ID NO: 10971 - DNA, 576 bp, Artificial Sequence
  Description of Artificial Sequence: Synthetic coding sequence
atggggagctgtgagtgccccgccctcttgcttctgctgtctcttctcctcctgcccctgggtctgccggtgctgggcgcccccccgcggctgatctgtgactccagagtgctcgaaagatacattttgggtgccagggaagccgaaaacgtgactatggggtgtgcggaagggtgcagcttctcagagaatattaccgtgccagacacaaaagtcaatttttatacctggaaacggatggacgtcggacagcaggccgtggaggtgtggcaaggactcgcccttctctctgaagctattctccgaggccaggcactgctcgcaaattcctcccagccatccgaaaccttgcagctccacgttgataaagcggtgtcatccttgaggtcactgacctcactgcttcgcgctctcggagctcagaaggaagccacaagcctgcctgaagcaacctccgccgctccactgagaacttttaccgtggacaccctgtgtaaattgtttaggatttactctaattttctgaggggaaaactgacactgtatacaggagaggcctgcaggcggggtgatcgg

SEQ ID NO: 10972 - DNA, 576 bp, Artificial Sequence
  Description of Artificial Sequence: Synthetic coding sequence
atgggtagctgcgaatgtccagcattgctcttgttgttgtctttgttgttgctgccactcggactaccagttttgggcgcacctcctagacttatctgtgattctagagtcttggaaagatacatattgggtgccagagaggccgagaacgtcaccatggggtgcgccgaaggatgctctttttctgagaatatcacagttcctgacaccaaggtcaatttctacacgtggaagaggatggacgttggacagcaagccgttgaagtatggcaaggtcttgcactcctcagtgaggcgatcttgcggggccaggcactactcgccaattcttcgcagccgagcgaaactttgcagctacatgttgacaaggctgtctcttcactcagatcgttgacttccctgttgagagcccttggagctcagaaggaagctacctcactaccggaagccacctcagctgctccactacgaaccttcaccgtagatactctctgtaaattgttcaggatttattccaacttcctcagagggaaactcacactatacactggtgaggcctgcaggcgtggagatcgt

SEQ ID NO: 10973 - DNA, 576 bp, Artificial Sequence
  Description of Artificial Sequence: Synthetic coding sequence
atgggcagctgcgaatgccctgcgctgcttcttctactgagcctgctccttttacctttggggctgcctgtactcggcgccccgccgaggctcatctgcgattcaagagtgctcgagaggtatatactgggggccagagaggccgaaaatgtaacgatgggctgtgccgaaggatgcagcttctcagaaaacattacagtgccagatactaaagtgaacttctatacctggaagagaatggatgttggacagcaggctgtcgaagtctggcagggattggctctcttatctgaagccatcctgcgcgggcaggccttgctggcgaatagctcccagccaagtgaaacattacagctgcatgttgacaaggctgtgtcatctctgcgcagtctcacaagcctgttacgtgcccttggagctcaaaaagaggcaactagcctacccgaggcaactagtgctgcaccattgcgcactttcactgtggatacactgtgcaaactgttccgtatttactctaacttccttcgcgggaagttaacactgtataccggcgaggcgtgtcggcggggagatcgg

SEQ ID NO: 10974 - DNA, 576 bp, Artificial Sequence
  Description of Artificial Sequence: Synthetic coding sequence
atgggtagctgcgaatgcccagccctgcttctactgctctcgcttctgctgcttcccctgggactcccagtgttgggcgcacccccacgtcttatctgtgatagcagagtgctggaaagatacattctcggtgcgagggaagccgagaacgtgaccatgggatgcgctgagggctgcagtttcagtgaaaacatcaccgtcccagacacaaaagtcaacttctacacttggaaacgcatggatgtgggccagcaggcagttgaggtgtggcaagggctggccctgctgagcgaggcaatccttagggggcaggcactgttggcaaacagctctcagcccagtgaaacactacaattacatgtggacaaagcagtgtcatcactgcgctctctgactagcctccttagggcattgggtgctcaaaaagaagctacctcactgcctgaggcaacgtcagcggcaccgttgcgcacctttacagtggacacactgtgcaaactcttccgcatctattcaaactttcttaggggcaagttgacactttacacaggagaagcatgccgcagaggagacaga

SEQ ID NO: 10975 - DNA, 576 bp, Artificial Sequence
  Description of Artificial Sequence: Synthetic coding sequence
atgggatcctgcgaatgcccagcgctgcttttgttattaagtcttcttctgctcccactcgggctcccagtgttaggagcccccccaagattaatctgtgattcacgcgttctggaaagatatattcttggggcgagagaagccgagaacgtgacaatggggtgtgctgaagggtgctctttttccgaaaatatcactgttcccgacacaaaagtcaatttttatacttggaaaaggatggatgtcgggcagcaggctgtcgaagtttggcaaggactagccctgttatcagaggctatcctacgaggacaggcactgctagcaaactcttcccagccctcagaaactcttcagctccatgtagataaagcagtgtcctctctccgaagtctaacgtctttactgcgagcccttggggcacagaaggaagctacttcgctcccagaagccacatccgcagctcccctcagaacatttacagtcgacacattgtgcaaactttttagaatttactccaatttcctccggggaaaactaactctatacactggagaagcgtgtagaaggggggataga

SEQ ID NO: 10976 - DNA, 576 bp, Artificial Sequence
  Description of Artificial Sequence: Synthetic coding sequence
atgggctcgtgcgaatgccccgctctgctactgttactttctctgcttcttttacctctgggattacccgtgctgggcgctcccccgaggttgatctgtgattccagggtacttgagcggtatatcttgggagcgagagaagccgagaatgttaccatgggatgcgccgaggggtgttccttcagtgaaaacatcacagttcctgacaccaaagtgaatttctatacttggaaaagaatggacgtggggcaacaggccgtggaagtgtggcaaggtctggctctgctctcagaggcgatcctgcggggtcaggccctcctggctaatagttcccagccaagcgaaacattacagctacacgtggacaaggccgtttcctctttgaggagtctgacatcgctgctccgcgccctcggggcccagaaggaagccacatcattgcctgaagctacctcagccgctccccttcgtacgttcactgtggacacactgtgtaaactgttcaggatttatagtaattttttgcgtggaaaactgacgctttatactggcgaggcctgccggaggggggaccgg

SEQ ID NO: 10977 - DNA, 576 bp, Artificial Sequence
  Description of Artificial Sequence: Synthetic coding sequence
atggggtcttgtgagtgtccagctctgctgctcttactgagcttgctgctcctgccattgggactgccagtgctgggcgctcctccccggctgatttgcgattctcgggtcctggagaggtacatactgggggcaagggaagccgagaatgttacaatgggttgtgcagaggggtgctcctttagcgagaatattacagtgccagacactaaagttaacttctacacctggaagcgtatggatgttggccagcaggctgtggaggtctggcaaggcctagctctgctgtcagaggccatactaagaggacaggctctcttagctaacagtagccagccatctgaaaccctacagctacacgttgacaaggccgtgtctagccttaggtctctgacatctctcctgcgcgctttgggggcccagaaagaggccacaagcctgcctgaagccacctcagccgccccactgcgaacatttaccgttgatactttgtgtaagctgttccgcatctatagcaattttttgaggggaaagctgaccctgtacacaggcgaggcttgcaggaggggcgatcgg

SEQ ID NO: 10978 - DNA, 576 bp, Artificial Sequence
  Description of Artificial Sequence: Synthetic coding sequence
atgggcagctgcgaatgcccggccttattattactattaagcctattactcctgcccttgggtttaccagtattgggcgcacccccgcgcctgatttgcgattcccgcgttctcgaacgctacatcctgggagcgagagaggccgagaacgtgacaatgggctgtgcagaaggctgttccttctccgaaaacataacggttccagatacaaaagtaaacttttacacgtggaaaaggatggatgtggggcagcaagcggttgaagtctggcaaggtcttgcacttctctccgaagcgatccttcgtggccaggcgctgctggcaaactcgtctcagccatccgaaaccttacaattgcatgtcgataaagcggttagcagccttagaagcttaacaagcttacttcgagcgctgggtgcacaaaaagaagcgacgtcgttaccggaagctacgtccgcggcaccgcttcggacattcactgtagatacactgtgcaaattgtttcggatctatagtaactttttacgaggaaagttaacattgtatacaggcgaagcgtgtagaagaggggatagg

SEQ ID NO: 10979 - DNA, 576 bp, Artificial Sequence
  Description of Artificial Sequence: Synthetic coding sequence
atgggaagctgtgagtgtccagccctgttgctgctattgtcactgctgttgctccccctgggccttcccgtgcttggggccccgccccgcctcatttgcgactctcgggtgctcgaaagatacattctaggagcaagggaggccgaaaacgtgaccatgggctgcgctgaaggttgttcattctccgagaacataactgtccccgatacaaaagtgaacttctatacctggaagcgcatggacgtgggccagcaggcagtggaggtgtggcaagggctagcccttctgagcgaagctattctccgcgggcaggctctgctcgcgaatagcagccagccctcagagaccctccagttgcatgtggataaggctgtaagcagtctcaggtcgctcacgtccttgctacgagctctgggggcgcaaaaagaggccacttctctcccggaggctacatctgccgcgccacttcgtacatttacggtggacaccctgtgcaaactgttccggatttactccaactttctgcgcggcaaattgactctatacaccggggaagcatgtaggagaggcgaccga

SEQ ID NO: 10980 - DNA, 576 bp, Artificial Sequence
  Description of Artificial Sequence: Synthetic coding sequence
atggggtcatgtgagtgcccagcccttctgcttctgctgtcgctcctgcttcttcctctgggactgcccgttctcggagctcctcccagacttatatgtgattccagagtgctggaacggtacattcttggagcccgcgaagcagaaaacgtcacgatgggatgtgcagaaggatgttccttctcagagaacattaccgtgcccgacactaaagtgaatttctacacctggaagagaatggatgtaggacagcaggcagtggaggtgtggcagggtctggcactcctttcagaggccattctgcgaggacaagcactcctggctaatagcagccagccttccgaaacgctccaactgcatgtggataaggccgtctcatcgcttcgttcactgacttccctgctccgggcacttggagctcaaaaggaggcgacttcactgcctgaagccacttccgctgcaccactccggacctttactgtcgataccctctgtaaactctttagaatctactccaactttctccgcggtaagctcaccctgtatacgggtgaggcatgcagaaggggcgatcgt

SEQ ID NO: 10981 - DNA, 576 bp, Artificial Sequence
  Description of Artificial Sequence: Synthetic coding sequence
atgggatcatgcgagtgtcctgcacttcttctccttctctcccttctcttgcttcctctcgggctgcctgtgcttggtgcacctccacggcttatatgtgacagcagggtgctggaacgttatatccttggcgccagagaagccgagaatgttaccatgggatgtgccgaaggctgctcattttcagagaatatcaccgttccagacactaaagtgaacttctatacttggaagcggatggatgtgggccagcaggcagtggaagtgtggcaaggactggcgcttctgagcgaggcaattttgaggggccaggcactgctcgctaacagttctcaaccaagcgaaactcttcaacttcatgtggataaagccgtaagctcgctgcgctccctgacttcgctgctgcgcgcactcggagcgcagaaagaagcaacctcgctcccggaagcgacctcggctgcaccccttagaacttttacggtggacaccttgtgcaaactgttcagaatctactccaactttttgcggggcaagctcacgctgtacactggcgaggcttgtagacgcggagatcgg

SEQ ID NO: 10982 - DNA, 576 bp, Artificial Sequence
  Description of Artificial Sequence: Synthetic coding sequence
atgggatcatgtgaatgtccggcgcttcttctgctgctgagcctgctgctcttgccactggggttgcctgtgctgggagcgccgccgcgactcatctgtgactcgagggtgcttgagaggtacatcctgggtgcacgcgaggccgaaaacgttaccatggggtgcgccgagggatgctcattctctgagaatatcaccgtccctgacacgaaggtcaatttctatacttggaagaggatggacgtaggacagcaagctgtggaagtgtggcaaggcctcgccctgctctccgaggcgattctgaggggccaggccttgcttgccaacagctcgcagccgtcggaaaccctccaactgcatgtggataaagccgtgagctcgctccgatcactgacgtcgctgctgcgggctctgggggcgcagaaggaagcgacctccctcccagaggccacctcggctgcgcccctgcggacgttcaccgtcgacactctctgcaagctctttagaatctactcaaacttcctgcgcgggaaactcactttgtacactggagaagcctgccggcgaggagataga

SEQ ID NO: 10983 - DNA, 576 bp, Artificial Sequence
  Description of Artificial Sequence: Synthetic coding sequence
atgggaagttgcgaatgtccagccttgttgctgctgctgagcttgctccttttgcctctgggattgccggtgctcggagcaccacccaggctcatctgcgatagcagagtgttggagagatacattttgggcgccagagaggcggagaacgtcacgatgggctgcgccgaaggctgcagttttagtgaaaacataacagtgccagataccaaagtaaacttctacacttggaaaaggatggatgtgggacagcaggcagtggaggtctggcaaggcctggccttgctctcagaggccatcctgagaggccaggcgctgcttgcaaactcatctcaacctagcgaaactttacagcttcatgtggataaggctgttagctcactgaggagcctgactagcctgctgagggcactgggagcccaaaaagaggccactagtttacctgaggcgactagcgcagccccactgagaacatttactgttgataccctctgcaagctgttcaggatttacagcaatttcctcagaggtaagctgacattgtacaccggcgaggcgtgccggagaggggacagg

SEQ ID NO: 10984 - DNA, 576 bp, Artificial Sequence
  Description of Artificial Sequence: Synthetic coding sequence
atggggtcatgcgagtgcccggctttgctcctgcttctgtccctgcttctgctgcccctagggctgcctgtcctgggggccccgcctcgcttgatatgtgactcacgtgtgctggagcgatatatcttgggcgcccgcgaggctgagaatgttacaatgggctgtgctgagggatgcagcttttccgagaacattacagttcctgatactaaagtgaacttctacacctggaagagaatggatgtggggcaacaggccgttgaagtgtggcagggcttagcgctgctctccgaggccatcctgcgcggacaggccctgctggctaacagctcccagcccagcgagacattgcaactccatgtggacaaggctgttagttctttgaggtccctgacgtccctgcttcgggcccttggcgcccagaaagaggctacatccctaccggaggcaacctccgccgctccactgaggaccttcactgtggacaccttgtgcaaattgtttcgtatttactcgaactttctgcgcgggaaacttacattgtacaccggggaggcatgtaggcgaggcgatagg

SEQ ID NO: 10985 - DNA, 576 bp, Artificial Sequence
  Description of Artificial Sequence: Synthetic coding sequence
atgggatcgtgtgagtgtcctgcccttctgttgctcctgtccttgttgctcctgccactgggactcccggtcttgggggcaccgcccaggctgatttgcgatagtcgcgttctggagcgctacatcctcggcgcgcgggaagcggaaaacgttaccatgggatgcgccgagggatgctccttctccgagaacatcactgtgcctgacactaaggtgaatttctacacttggaaaaggatggacgtgggtcaacaagcagtggaagtatggcagggccttgcgctgctgtctgaggcgatactgaggggacaggctctcctggccaattcgtcacagccatctgaaacgcttcagctgcacgtcgacaaagctgtctcgagcctgcgcagcctgacgtcactgttgcgggcacttggtgcacaaaaggaggccacctcgctcccggaagcgaccagcgctgccccgctccggacctttactgtggacaccttgtgcaagttgttccgcatctactcaaacttcctgcgaggaaagctgactctctacaccggcgaagcctgcagaagaggggatcgc

SEQ ID NO: 10986 - DNA, 576 bp, Artificial Sequence
  Description of Artificial Sequence: Synthetic coding sequence
atgggatcctgtgaatgcccggctctgctgctgctgctctccctgctgctgcttccgctgggccttccagtcctgggagccccaccgcggctgatctgtgatagcagggtcctcgagagatacatcttgggggcacgcgaagccgaaaatgtcaccatgggatgtgccgagggatgtagcttctcggagaacatcaccgttcctgatactaaagtcaatttctatacctggaagcggatggacgtgggacaacaagccgtcgaagtgtggcaaggcctggcgctcctgtcagaagctatcttgcgcggtcaggccctgctcgctaacagctcgcagccatccgaaaccctgcagctgcatgtggataaggccgtgtcgtcactgagaagcctgactagcctcctccgggccctcggcgcacaaaaggaggcaacttcgctcccagaggctacctcagccgcgcccctccgcaccttcactgtggacacgctgtgcaaactgttccgcatttactcaaactttctgaggggcaagctgaccctgtacaccggggaggcttgccggcgcggagatcgg

SEQ ID NO: 10987 - DNA, 576 bp, Artificial Sequence
  Description of Artificial Sequence: Synthetic coding sequence
atgggatcatgcgaatgcccggcgttgctgctactgctcagtctgctgctgctcccactaggcctcccggtgcttggcgcccccccaagacttatctgtgatagccgcgtcctcgaaagatatatcctgggggcccgcgaggccgaaaacgtgacgatgggctgtgctgagggatgtagcttcagcgaaaatatcaccgtcccggatacgaaggttaacttctacacctggaaacgtatggatgtgggtcagcaagcggtcgaggtgtggcaaggactggccctgttgagcgaggctattcttcgcggacaggccctgttggccaattccagccagccttccgagacccttcagctgcacgtggataaggccgtgagctctctgaggagtctgacatctctgctgcgggccctgggtgctcagaaggaggcgacgagcctgcccgaggcgacgagtgcggctccactacgcacgtttaccgtggacacgctgtgcaagctattccgcatctattccaacttcctgcgtggcaagctgactctctacaccggagaggcttgccgtcgcggcgataga

SEQ ID NO: 10988 - DNA, 576 bp, Artificial Sequence
  Description of Artificial Sequence: Synthetic coding sequence
atgggatcatgcgaatgcccagctctgctgttgttgttgtccctgctccttctgccactgggcctgccagtgctcggcgccccgcctcgcctcatctgcgacagcagggtccttgaacgctacatcctgggagcccgcgaggctgaaaacgtcactatgggatgcgccgaaggttgcagcttttcggagaacatcactgtgccggataccaaggtcaatttctacacctggaagcggatggacgtcggacagcaggcggtcgaagtctggcaaggactggccctcctgtcagaagcgatcctgcgcggccaggccttgctcgcaaatagctcgcagcctagcgaaactcttcaactgcacgtggacaaggcggtgagctccctgcgctcgttgacgtccctgttgcgggctctcggcgcacaaaaagaagcaaccagcctgcccgaggcgacctccgcggccccactccggaccttcactgtggacaccctctgcaagctcttcaggatctattcgaatttccttcggggaaaactgactttgtacactggcgaggcctgcagacgcggcgaccgg

SEQ ID NO: 10989 - DNA, 576 bp, Artificial Sequence
  Description of Artificial Sequence: Synthetic coding sequence
atgggttcatgtgagtgcccggcgctgctgctcctgctctcattgctcctccttccacttggcctgccggtcctgggagccccgccccgactcatctgcgactcaagagttctcgaacgctacattttgggagcccgcgaggccgaaaatgtgaccatgggatgtgccgaaggctgctcattctccgagaacatcactgtgccggatactaaagtgaacttctacacctggaagcggatggatgtgggacagcaggccgtggaggtgtggcagggacttgccctgcttagcgaggctattctgcgcggacaggccctgctggcgaactcaagccagccttcggagactctgcagctgcacgtcgataaggcggtatcctcactgcgcagcctcactagcctgttgagggccttgggcgctcagaaggaggcaacttcgctgcctgaggcgacgtccgcggcgccgctgcgcacttttaccgtggacaccctttgcaagttgttccggatctactcgaacttcctcagaggaaagctcaccctctacactggggaagcgtgccgccgcggagacaga

SEQ ID NO: 10990 - DNA, 576 bp, Artificial Sequence
  Description of Artificial Sequence: Synthetic coding sequence
atggggagctgtgaatgcccggccctgctgcttcttcttagcctcttgcttctgccactcgggctgccggtgctcggagccccaccgcggctgatttgcgactcgcgggtcctggaaaggtacatcctgggtgcgagggaggccgaaaacgtgactatgggatgcgcggagggctgttccttttcggagaatatcacggtcccggacaccaaggtgaatttctacacctggaaacgcatggatgtcggacagcaggcagtcgaagtgtggcaaggactggctctcctgtccgaagccatcctcagggggcaagcgttgctcgccaactcatcgcagccgtcagaaaccctccagctgcacgtggacaaagcggtgagctcgctgcgttccctcacctcacttctgagagcattgggagcccaaaaggaggccacctccctgccggaagctacctctgcagccccgcttaggactttcaccgtggacaccctgtgcaagctgttcaggatctacagcaactttcttagaggaaagctgaccctctacactggagaggcttgccggcggggagatagg

SEQ ID NO: 10991 - DNA, 576 bp, Artificial Sequence
  Description of Artificial Sequence: Synthetic coding sequence
atgggttcgtgcgagtgtccggccttgttgctccttttgtcacttctgttactcccgctcggtttaccagtgctcggagctccaccaaggctcatctgtgatagtagagtgctcgaacgttatatcttaggagcaagggaagctgaaaacgtgacaatgggatgtgctgaaggatgttcattttccgagaacattacagtaccggatactaaggttaacttctatacttggaaacgtatggatgtgggtcaacaagccgttgaggtttggcaaggacttgcattgctgtccgaagctatcctgcggggacaggcgcttcttgcgaattcctcacagccctccgagactcttcaattgcacgttgacaaagctgtttcttccctccgatcacttacttcgttgcttcgggctcttggagcgcaaaaggaagcaacttctctaccagaggctacttcagccgcacccttaagaacgttcacggtagatactctttgtaaattgtttcgtatatatagtaattttctcagaggaaaattgaccctttataccggagaggcgtgtcgtcgtggagacaga

SEQ ID NO: 10992 - DNA, 576 bp, Artificial Sequence
  Description of Artificial Sequence: Synthetic coding sequence
atgggcagttgcgaatgtccagcactcctcctgctgctgagccttcttctgctgcccctgggactgccagtgttgggcgccccgccaagactgatttgcgattcccgtgttctggagaggtacattctgggcgcacgagaggcagagaacgtcacaatggggtgcgccgaaggatgctcattcagtgagaatataactgtgccagatactaaggttaatttttacacttggaagcgcatggatgtgggccagcaggcagtggaagtgtggcagggcctcgctttgttgagcgaagccatcctgagaggacaagccctgttagccaatagcagccagccttcggagaccctgcagctccatgtggataaagctgtgagcagcctgaggagcctgacctcgctgctgcgggccctgggcgcccagaaggaagccaccagcctccctgaggccacaagtgctgcgccactaagaacctttactgtcgacactctgtgcaaattgttcaggatttactctaactttctgcgggggaagttgacattatatactggcgaagcgtgccggcgcggcgacagg

SEQ ID NO: 10993 - DNA, 576 bp, Artificial Sequence
  Description of Artificial Sequence: Synthetic coding sequence
atggggagctgtgagtgtcccgcgcttcttctcctcttgtccctgcttctcttgcccctgggccttcctgtgcttggggcacctccgaggctgatatgtgactcacgcgtcctggagcgctatatcttgggcgcacgagaagccgaaaatgtgactatggggtgtgcggagggttgttctttttccgagaacattaccgtgcccgataccaaggtgaatttctacacctggaaacggatggacgtggggcagcaagcggtggaagtgtggcagggattggcgctgctttcggaagccatcctcagaggacaagccctgcttgccaactcgtcacaaccctcagaaaccctgcagctgcatgtggacaaggcagtgtcgtcattgcggagcctcacctcactgcttcgcgcactgggagcccaaaaggaggcgaccagcttgcctgaggcaacctcggcagcgcctcttcgaacctttactgtcgacactctctgcaaactttttagaatttacagcaacttcctgagaggtaagctcacgctgtacactggcgaagcatgccgccgtggtgaccgg

SEQ ID NO: 10994 - DNA, 576 bp, Artificial Sequence
  Description of Artificial Sequence: Synthetic coding sequence
atgggatcttgcgaatgtcctgccctactacttttgttgtccctacttttacttcctcttggtctccccgtgctgggcgctccaccacgtcttatctgcgacagccgcgtgctagagcgatacatacttggagctcgagaggcggagaacgtcacgatgggttgtgccgagggctgctcattctcagagaatattaccgtgcctgacaccaaagtcaacttttatacctggaaacgtatggacgtgggccagcaggccgtggaggtgtggcagggcctggccctgctgtctgaggctattctgcgcggccaggccctgcttgccaactcttcacagccatcggagaccttgcagctgcacgtggacaaggcagtctcctctcttaggtccctaacgtcgctactccgtgccctgggcgctcaaaaggaagccactagtctgccggaggccactagcgcagcaccgttgagaacctttacagtggacaccctatgcaagctgttccgtatctattcaaacttccttagaggaaaactgacactatatactggcgaggcttgccgacgcggcgacagg

SEQ ID NO: 10995 - DNA, 576 bp, Artificial Sequence
  Description of Artificial Sequence: Synthetic coding sequence
atgggaagctgcgaatgcccagcgctgctgttgctcctttccctgctccttctgccgttgggccttcccgtgctgggtgcccctccgcggctgatctgcgattcgagggtcctggagaggtacatcctgggagcccgcgaagcggaaaacgtcactatggggtgtgccgaaggatgctcgtttagcgaaaacatcactgtgcctgacaccaaggtgaatttctacacttggaaaagaatggacgtgggacagcaggcagttgaggtgtggcagggactcgccctcctcagcgaggcgatcctgagaggccaagctctcctggcaaattcctcacagccgtcagaaaccctgcaactgcacgtcgataaagcggtgtccagtctcagatctctgacctccttgctgagagcgcttggcgcccaaaaggaagcaacctcgcttccagaggccacttctgcagctccactcaggacctttactgtggacaccctctgcaaacttttccggatatactcaaacttcctccgtggtaagctgacgctgtatacgggtgaggcttgtcggaggggcgaccgc

SEQ ID NO: 10996 - DNA, 576 bp, Artificial Sequence
  Description of Artificial Sequence: Synthetic coding sequence
atgggatcctgtgaatgtccagctctgctgctgctccttagcctgcttcttctcccgctgggattgccagtactgggggcccctcccagattgatttgcgactctcgggtgcttgaacggtacatcttgggagcgagggaggcggaaaatgtgaccatgggttgtgccgagggctgcagcttctcggaaaacattaccgtcccggataccaaggtgaacttctacacttggaaacgcatggacgtcggccaacaggctgtggaagtgtggcagggactcgccctcctctcagaggcgatcctgcgcggacaagccctgctggcaaattcctcacagccatcggaaaccctgcagctccacgtcgataaggcggtgtcaagcctccgctccctgacttccttgcttcgggccctcggagcccaaaaagaagcgacctcgcttccggaggctactagcgcagctccgctccggacgttcacggtagataccctctgcaagctctttagaatctacagcaacttcctcaggggaaagctgactctgtacaccggagaggcctgtaggcgcggcgaccgc

SEQ ID NO: 10997 - DNA, 576 bp, Artificial Sequence
  Description of Artificial Sequence: Synthetic coding sequence
atggggagctgtgagtgtcctgccctgctgctgctgctctctctcctcctgcttccacttgggctcccggtgctgggagccccgcctcgtctgatttgcgactcacgagtcctagaaagatatattctaggagccagggaggccgaaaacgttacaatgggctgtgctgaggggtgcagcttctcagaaaatattacagtgcccgacactaaagtgaatttctatacatggaagcgtatggacgtcggtcagcaggctgtggaggtgtggcagggcttggctctgttatcagaagccatcttgcggggacaggctttgctggccaactcctcgcagcctagcgagacgctgcagctgcacgtcgataaggccgtgagctcacttcggtccctgacttccttattgagggcgctcggggcgcagaaggaggcaacaagtctgcctgaggcaacatctgcagccccactgcgaactttcacagtcgacacactgtgcaaacttttcaggatatattctaacttccttcgaggtaagctgacattgtataccggcgaggcgtgtagaaggggcgacagg

SEQ ID NO: 10998 - DNA, 576 bp, Artificial Sequence
  Description of Artificial Sequence: Synthetic coding sequence
atgggatcttgcgaatgccctgccctgctgttacttttgtccctattattacttcccttgggacttccagtgctgggcgcaccccctaggctcatctgcgactcacgagtattggagagatatatcttgggggcccgtgaggctgaaaacgttacaatgggctgcgccgaaggctgtagcttttcagagaatataacagttccggataccaaagtgaacttttacacgtggaagcgtatggatgttgggcagcaagctgtcgaagtgtggcagggcctcgcactcctgtcagaggcaatcctcaggggccaggcgctccttgcgaacagtagtcagccatccgagactctgcagcttcacgtggacaaggcagtttctagcctacgcagtcttaccagtctgctgcgggctctcggggcgcaaaaggaagcgacatcacttcccgaggcaactagtgcagctcctcttaggacattcacagtcgacacactctgcaaactgtttcgaatttactctaatttcctgcgcggcaagttaacactctataccggcgaggcctgcaggagaggtgacaga

SEQ ID NO: 10999 - DNA, 576 bp, Artificial Sequence
  Description of Artificial Sequence: Synthetic coding sequence
atgggatcgtgtgaatgcccggctctgcttctgctgctttcccttctcctgttgcccctgggcctgccagtccttggggctcctccacgcctgatctgcgacagtagagttctcgaaagatacatccttggcgcacgggaggctgaaaacgtgaccatgggttgcgcggaagggtgcagctttagcgagaacattaccgtgcctgacactaaggtcaatttctatacttggaagcgcatggacgtcggccagcaagctgtggaagtttggcaagggctcgccctcctttcagaggccatcctccgcggtcaggctctgctcgccaactcatcacagccctcagagactcttcagctgcatgtggataaagcggtgtcgtcgttgcggagcctcacctccctgttgcgcgcgctgggagcgcaaaaagaggcgacttccctcccagaagcaacctccgccgctccgctgcggacgtttaccgtggacaccctctgcaagctgttccgcatctactcgaatttcctgcgtggaaaactcacgctctacactggagaggcctgtcggagaggagatcgg

SEQ ID NO: 11000 - DNA, 576 bp, Artificial Sequence
  Description of Artificial Sequence: Synthetic coding sequence
atgggttcttgtgagtgtccagccctgctcttactgctgtccctcctgttactgcctctcggactgcctgtcctgggcgcacccccacgtcttatctgcgacagcagagtgctggagaggtatatcctcggcgcacgggaagccgaaaacgtgaccatgggatgtgctgagggctgcagcttctcagagaacattacggtccctgacacaaaggtcaacttttatacgtggaagcgaatggatgttggacaacaagcggtcgaggtttggcaggggcttgctcttctgtcagaggccattctgcggggacaagcactcttagcgaattcaagccaacccagtgagactctgcagcttcacgtggacaaagccgtctcgtctctcaggagcttgacctcactgctccgcgccctcggcgcccagaaagaagcaactagtctgcccgaggcgacttctgccgcacccttgaggaccttcacggtggatacactgtgtaaactgttccggatttattcaaacttcctaagggggaagcttaccctctacacaggtgaagcttgtcggaggggcgatcgc

SEQ ID NO: 11001 - DNA, 576 bp, Artificial Sequence
  Description of Artificial Sequence: Synthetic coding sequence
atgggcagctgtgaatgccctgcactgctgctgctcttgagcctactgctgctgcctcttggactacctgtgcttggagcccctccccgcctcatttgtgatagcagggtactggagcgctacattcttggagctcgggaggcagagaacgtgactatgggctgtgcggagggctgttccttttccgaaaatatcaccgtacccgatacgaaggttaacttctatacctggaaaagaatggacgtgggccagcaggctgtcgaggtctggcagggacttgcactgcttagcgaggcgatcctcagaggccaggctttgctggccaactcatctcagccctcagagacccttcagctgcacgtggacaaagctgtgtcttcattgcggtccttgactagcttgctgagggccttgggagcacagaaggaagccactagtctccccgaagccacaagcgccgcacccctccggacgtttaccgtggatacactatgcaagctgtttagaatctactcaaatttcctgagaggtaaactcaccttatacaccggagaagcttgccggcgcggcgacaga

SEQ ID NO: 11002 - DNA, 576 bp, Artificial Sequence
  Description of Artificial Sequence: Synthetic coding sequence
atgggatcgtgcgaatgccctgcactccttttgcttttgtcgctcctcctgctccctctgggccttcctgtgctgggagcacccccgcgtctgatttgcgacagccgcgtgctggagcgctacattcttggcgctagggaggcagaaaacgtgaccatgggatgtgccgagggttgttccttctccgagaacataaccgtgccagatacgaaggtgaacttctacacttggaagcggatggatgtcggccaacaggcggttgaggtctggcagggacttgcactgttgtcagaggcaatactgagagggcaagcactgctggccaatagctctcaaccatcggaaactctgcaactccatgtcgataaggctgtgtcctccctgcgctcgctgacttcactcctgcgcgcgctgggggcgcagaaggaagcaacttcccttcctgaagctacctcggccgcaccactccgaactttcaccgtggatactctgtgtaaactctttcggatttactctaactttcttagaggcaaacttacgctgtacaccggagaggcttgtcgtcgtggagatcga

SEQ ID NO: 11003 - DNA, 576 bp, Artificial Sequence
  Description of Artificial Sequence: Synthetic coding sequence
atgggtagctgtgagtgcccagctcttctccttctcctttcgcttcttctgctgccgctgggactgcccgtgcttggagcacctccccggctgatttgcgatagcagagtgcttgaacgctacatacttggagcacgcgaggccgaaaatgtcaccatgggatgtgccgaagggtgcagcttttcggaaaacatcactgtgcctgataccaaggtcaacttttacacgtggaaacgcatggacgtgggtcagcaagcagtcgaggtgtggcagggactcgccctgctttccgaagcaattctccgagggcaagcacttttggccaattccagccagccctcggagactctccagctccacgtggacaaagcagtcagcagcttgaggtccctgacttccctgttgagggcattgggtgcacaaaaggaagcgacctcactgccagaggccactagcgcagcacctctgagaacgttcaccgtggatacgctctgcaagttgtttcgcatttactctaactttcttcgtggaaaacttactctgtacactggtgaagcatgtaggcgcggtgaccgg

SEQ ID NO: 11004 - DNA, 576 bp, Artificial Sequence
  Description of Artificial Sequence: Synthetic coding sequence
atgggttcctgcgaatgccctgccctgctgttgctgctgagcctcttgctgctgccgctgggtctcccggtcctgggcgccccacctcggcttatatgtgactctagggtcctggaaagatatatcttgggtgcgagggaggcggagaatgtcaccatgggttgcgcggaagggtgtagctttagcgaaaacattacagtgccagacaccaaggtcaacttctacacttggaagcgcatggacgtgggccagcaggctgtcgaagtgtggcagggtctggctctactgtctgaggcgatactgcgaggtcaggctctgctggcgaacagttctcaaccgagcgagaccctccaactccatgttgacaaggccgtctcttccttgcgatcgctgaccagcctgctcagggccctgggtgcgcagaaggaggccacgtctctgccagaggctacgtctgccgctccgcttcgcacgttcaccgtggacaccctgtgcaaactattccgcatctactccaactttctccgtggcaaacttaccctgtataccggtgaggcgtgccgccgcggtgataga

SEQ ID NO: 11005 - DNA, 576 bp, Artificial Sequence
  Description of Artificial Sequence: Synthetic coding sequence
atggggtcctgcgagtgcccagcgcttctgcttctgttgtctcttttgctgctgccgctcggattgcctgtccttggcgctccgccccggttgatttgtgacagccgcgtactcgagcggtatatcctcggagcccgagaggctgaaaacgtcaccatggggtgcgcagagggatgctcgttctctgagaacattactgtgcccgacactaaggtgaacttctacacctggaagcgaatggatgttggacagcaggcggtggaggtctggcagggattggccctcctgtctgaggcaatcctgcgcggacaggcgctgttggccaacagttcccagccttctgaaaccctgcagcttcatgtggataaggccgtgagctcgttacgttctctgacttccctgctgcgcgcgctcggtgcccagaaggaggcgaccagcctgccagaagctactagtgctgcacccttgcgtactttcaccgtcgataccttgtgtaaactcttccggatttactccaacttcctgcgcggaaagctgacgctgtatactggagaggcttgtcgtcgtggtgatcgc

SEQ ID NO: 11006 - DNA, 576 bp, Artificial Sequence
  Description of Artificial Sequence: Synthetic coding sequence
atgggtagctgcgaatgtccagctctgctgctcctgcttagcctgcttctccttcctcttggactgcctgtgctcggggcacctccccgtttgatttgcgacagccgcgtgctggaaaggtacatccttggggcccgagaggcggagaatgtgactatgggttgtgctgagggatgttcgtttagcgagaacatcaccgtgcctgataccaaagtcaatttctacacctggaagaggatggatgtcggccaacaggctgttgaagtgtggcaagggctggcgctgctgtcggaggcaatactcagaggccaagcacttcttgcaaatagctcccagccctccgaaactcttcagctccacgtcgataaagcagtgtcgtcgcttagatcgctcacttcactgctgcgggctcttggagcacaaaaggaagcaacttcgcttcctgaagcaacgtccgcagcaccacttcggacttttaccgtcgataccctgtgcaaactgtttaggatctactccaatttcctcagggggaagctgactctgtacactggtgaggcgtgcagacgtggcgatcga

SEQ ID NO: 11007 - DNA, 576 bp, Artificial Sequence
  Description of Artificial Sequence: Synthetic coding sequence
atgggctcatgtgaatgtcccgctctgctcttattgctgtccctgctcctgctgcccctgggtctgcctgtgctgggcgccccccctaggctgatatgtgattctcgagtactggagaggtatatactgggagctcgagaggcagagaatgtgaccatggggtgcgccgaaggatgctccttttcagaaaacattaccgtgcctgatacgaaagtgaatttctacacctggaagcgtatggatgtgggacagcaagctgtcgaggtgtggcaaggcttagctctgctgtcggaggccatcctaagggggcaggcactgcttgcgaatagtagccaaccctccgaaactctgcagctccatgtagacaaggccgttagttcgctccggtctctgacttccctgctccgagctcttggggctcagaaggaagcaacatcactgcctgaagcaactagcgcagctcctttacgaaccttcacggtcgatacactctgcaaactctttcgtatctacagcaatttcctgagggggaagcttactttgtatacgggtgaggcttgtcgaaggggcgataga

SEQ ID NO: 11008 - DNA, 576 bp, Artificial Sequence; identical to SEQ ID NO: 10992
  Description of Artificial Sequence: Synthetic coding sequence

SEQ ID NO: 11009 - DNA, 576 bp, Artificial Sequence
  Description of Artificial Sequence: Synthetic coding sequence
atgggatcgtgtgagtgtccagctttgcttcttctccttagcttgctgcttttgccacttgggctgcctgtgctcggagcaccgcctcgactcatttgcgattcccgtgtgctggagcggtacatacttggggccagagaagccgaaaatgtgactatgggatgtgcagagggatgttcgttctctgaaaacatcactgtccctgacactaaggtgaacttttacacttggaagcgaatggatgtcggtcagcaagcggtggaagtgtggcaaggtctggccctcctctcagaagcaattctgcgaggccaagcgctgctggcaaacagctctcagcctagcgaaacccttcagctgcacgtcgacaaggctgtgtcatcacttagatccctgacctcgctgttgagagccctcggggcgcaaaaggaagcaacttccctgcccgaggcaacctcggcagctcctttgagaactttcaccgttgatactctctgcaagctgtttaggatctacagcaactttttgaggggaaaacttactctttacaccggcgaggcatgtagaaggggagatcgc

SEQ ID NO: 11010 - DNA, 576 bp, Artificial Sequence
  Description of Artificial Sequence: Synthetic coding sequence
atgggaagctgcgaatgcccggcactgttgctcctgctgtcgctgctccttctgccgctcgggctccctgtgctgggagcaccgcctagattgatctgtgactcacgtgtgctggaacggtatatactcggagcccgcgaggctgagaacgtcactatggggtgcgccgagggttgctcgttttcagagaatatcaccgtgcccgatactaaggtgaatttctacacttggaaacggatggatgtgggacagcaggcggttgaagtctggcagggactggctctcctgtccgaggcaatcctgcgaggtcaggcgctgctggccaactccagtcaaccatccgagactctgcagttgcacgttgacaaggcagtgtctagcctccggtccctgacctcgctgctcagagcgcttggagcccagaaggaagccaccagcttgccagaagcgacttcggcggccccgctgcggaccttcaccgtggatacgctctgcaagttgttccggatttacagcaactttctgcgcggcaaactgaccctctacactggagaggcttgtcgccgcggagacaga

SEQ ID NO: 11011 - DNA, 576 bp, Artificial Sequence
  Description of Artificial Sequence: Synthetic coding sequence
atgggaagctgcgaatgccccgccctgctgctgttgttgtccctcttgctcttgccacttggcctccctgtgctgggggcccccccaagactgatctgcgactctcgggtgcttgagaggtacattctgggggcccgggaggctgaaaatgttaccatggggtgtgctgaggggtgttctttttccgaaaacatcaccgtaccagatacaaaggtaaatttctacacctggaagaggatggatgtggggcagcaggccgtagaggtttggcagggtctggcgttgctgagcgaagcgatcttgcgcggtcaggctttgcttgctaactctagccaaccttccgaaacattgcagctgcatgtggacaaggcggtcagttcactgcggtctctgacatctctgctgcgggccttgggggcacaaaaagaggctacttctttgcccgaagcaaccagcgccgccccactgcggactttcaccgtagataccttgtgcaaattgttcaggatctactctaactttcttagaggtaagctgacgctctatactggggaggcttgcagaaggggggatagg

SEQ ID NO: 11012 - DNA, 576 bp, Artificial Sequence
  Description of Artificial Sequence: Synthetic coding sequence
atgggaagctgtgaatgccctgcactgcttctgcttctcagcttactcctattaccgctgggccttccagtgttaggggcccccccaagactcatctgcgatagccgagttttggaacggtacatattaggcgcgagggaggctgaaaacgtgacaatgggttgcgctgaaggctgctccttctcagagaacattactgttccagatacgaaggttaacttttatacttggaaacggatggacgtcgggcagcaggccgttgaggtgtggcagggcctagccctactgtcggaggcgatcttacgtggccaggcgctgctcgccaactcatctcagccatctgaaacgttacaactgcacgtcgacaaagccgtctcttccctgcgtagcctaacatcactccttagggccctgggagcacagaaagaagccacttcacttccggaagcaaccagcgctgcccccctgcggacgttcaccgttgacaccttatgtaagctcttcaggatctatagcaacttcttgcgaggcaagctgacactgtataccggggaggcttgtcgtcgcggcgacagg

SEQ ID NO: 11013 - DNA, 576 bp, Artificial Sequence
  Description of Artificial Sequence: Synthetic coding sequence
atgggctcctgcgagtgtccagcccttttgctactgctctccttgctgctcctgcccctgggtcttcccgtgctgggcgccccccccaggcttatctgcgattctcgtgtgctggaacgctacatcctgggcgctcgggaagcagagaacgtgacgatgggctgcgcggaagggtgtagcttctcagagaacataaccgtaccagacacaaaggtgaatttctacacttggaaacgaatggacgtcggtcagcaggccgtcgaggtgtggcaggggctggccctcctcagcgaggcgatcctacgtggacaggccctgctggctaactcctcccagcctagcgaaacccttcagttgcacgtggacaaggccgtgagttctcttcgcagccttaccagccttctgcgagccctaggggcccagaaagaagcaacatcactgccagaagctacgtctgccgcaccactcaggacattcacagtggacaccctgtgtaagctgtttcgcatatattccaacttcctgaggggtaagctgaccctttacacgggcgaggcgtgccgacgcggcgaccgg

SEQ ID NO: 11014 - DNA, 576 bp, Artificial Sequence
  Description of Artificial Sequence: Synthetic coding sequence
atgggttcatgcgaatgccccgccctccttctgctgctgtccctgctgttgcttcccttgggcctccccgtgctgggtgctcccccacggctaatctgcgactccagagtgttggagagatacatactcggggccagagaggccgaaaacgtgaccatgggttgcgccgagggttgtagctttagcgagaatatcactgtgccagatacgaaggtgaacttttatacttggaaacgcatggatgtagggcagcaggccgttgaagtgtggcagggcctcgcactgctcagcgaggcaatcctgcgcggtcaggctcttctcgccaactctagtcaaccgtccgagaccttgcagctgcatgtcgacaaagcggtgtcttctctccggtcccttacctctcttctaagggcactgggggctcagaaggaggctaccagtttgccggaagcgaccagtgctgccccgctgaggacgtttaccgtggacaccctgtgcaagctgttccgcatctacagtaatttcctccgaggtaaattaaccctgtatacaggagaggcgtgtagacggggagacagg

SEQ ID NO: 11015 - DNA, 576 bp, Artificial Sequence
  Description of Artificial Sequence: Synthetic coding sequence
atggggagctgcgagtgcccagctctactgcttctgttgagtctcttgctcctcccgctcggactgcccgtcctaggggctccgccacgcctcatctgcgattcccgcgtgctggagcgctacatcctcggggctcgggaggccgaaaacgtaactatgggatgtgcagagggttgcagcttttcagaaaacattacagtgcccgacaccaaggtgaacttttacacatggaaaagaatggacgttggtcaacaggccgtcgaggtctggcagggcctagctctcctgagcgaagccatcctgagaggtcaagcgcttctggcgaatagcagccagccttctgaaacacttcaattgcacgtcgacaaggccgtgtccagcctgcgctccttgacctctctccttcgtgccctcggcgcccaaaaggaggccacctctttacccgaggccacatctgcagcaccattacgtacctttaccgtggacaccctttgtaagttgttcaggatttactctaattttctgcgcgggaagctaaccctgtacacaggcgaagcatgccgccggggcgacagg

SEQ ID NO: 11016 - DNA, 576 bp, Artificial Sequence
  Description of Artificial Sequence: Synthetic coding sequence
atgggatcgtgtgaatgcccagcactgttgctccttctgtccctgctgctcctccccctcggcctcccagtgctgggagccccgccccgcttgatctgcgactcaagagtgctggagcgctatatcctcggagctagagaggcagaaaatgtcacgatgggttgcgctgagggctgttccttcagcgagaacatcactgtgccggatactaaggtgaatttctacacgtggaaacgtatggatgtcggacagcaagccgtggaagtttggcaagggcttgcactgctctcagaagccattctcagaggacaggctctgctggctaactcttcccaaccgtcggaaacccttcagctgcacgtcgacaaagctgtgagctcactccgcagcttgacctcgctgctccgcgctctgggagcacagaaagaagcaactagcctcccggaggccacctcggctgcgccacttaggacgtttaccgtggataccctgtgtaagctgtttcgcatctactccaacttccttcgggggaagttgaccttgtacactggtgaggcatgccggcggggagacagg

SEQ ID NO: 11017 - DNA, 576 bp, Artificial Sequence
  Description of Artificial Sequence: Synthetic coding sequence
atgggttcgtgcgaatgtccggccctgctgcttctcctgtcactgctcttgctgccgctggggttgcccgtgttgggagcacctccaagattgatctgcgactccagagtgttggagcggtacatcctgggagcaagggaggcagaaaacgtgactatgggatgcgcggagggatgctccttttcagagaatatcaccgtgcctgacaccaaggtgaacttctacacttggaagagaatggacgtgggacaacaagcagtcgaggtctggcaaggcctggctctgctgagcgaagcgatcctccggggccaagctctcctggccaactcctcccaacctagcgaaaccctgcagctgcatgtcgataaggcggtgtcgtcgctccgctcacttacctcactgctcagagccctcggcgcgcaaaaagaggccacttcgctgccggaggccacgtcggcggcccctctccggaccttcactgtggacaccctctgtaagctgtttcggatctattccaatttcctgagaggaaagctcactctctacactggcgaagcctgcagacggggcgataga

SEQ ID NO: 11018 - DNA, 576 bp, Artificial Sequence
  Description of Artificial Sequence: Synthetic coding sequence
atggggtcctgcgaatgccccgccctcctcctcctcctttccctgctgttgctcccactgggcttgccagttctgggcgccccacctcggctcatttgtgactcccgcgtgcttgagcgctacattttgggtgcacgcgaggcagaaaatgtgaccatgggatgtgccgaaggctgcagcttctccgaaaacatcacagtgcccgacaccaaggtgaatttctacacatggaaaagaatggacgtggggcagcaggcggtggaggtctggcaaggcctcgcactgttgtccgaagcaatattgagaggccaggccttgcttgccaattccagccagccttccgaaactttgcagctccatgtggataaggctgtgagttccttgaggtcacttacgagccttctgagggcacttggagcccagaaggaggctacatctttgcccgaggcaacaagcgctgcacctctgcggacattcaccgtcgatactctgtgcaaactgtttcgcatctacagcaattttctgcgggggaagttgactttgtacaccggagaggcatgtcgccgcggcgacaga

SEQ ID NO: 11019 - DNA, 576 bp, Artificial Sequence
  Description of Artificial Sequence: Synthetic coding sequence
atggggtcctgtgaatgtccagctctgctccttttattgtcactccttctgttgcctctgggcctgccggtgctcggagcgcccccacggctaatctgtgactctcgagtgctggaacgttacatccttggagctcgggaggcggagaatgtcacaatgggctgtgctgagggctgcagctttagtgagaatatcacggtgccagacactaaggttaatttttatacatggaagaggatggacgtcgggcagcaggccgttgaggtgtggcagggactggcactgctttctgaagctattttgcgcggacaggcattacttgccaactccagtcagccctctgaaacacttcagctgcacgtggataaagctgttagtagtctgcgctccctaacctcactgctccgcgcactgggagctcaaaaggaggccacctcattgccagaggccacgtcagccgcgcccctgaggacattcacagtggacacgctgtgcaaactcttcagaatctactctaatttcctgcgtggtaagctgactctgtacactggggaggcttgccgaagaggagaccga

SEQ ID NO: 11020 - DNA, 576 bp, Artificial Sequence
  Description of Artificial Sequence: Synthetic coding sequence
atgggttcatgcgaatgtcccgcactgctgctccttctgtcacttcttctcctgccactgggacttcctgtgctgggtgcacctcctcgacttatttgcgattcgcgggtgcttgagcgatacatacttggtgcgcgtgaagctgagaacgtcactatgggatgtgcggaaggatgtagcttttcagaaaacatcaccgttcctgacaccaaggtgaacttttacacctggaaacgaatggatgtcggacagcaagccgtggaagtctggcaaggactggcacttctgtcggaggcgatccttcgggggcaggcacttctggcaaactcgagccagccttcggaaaccctccaacttcacgttgataaagccgtcagctctttgagaagcctcacctcactgcttcgcgcactgggggcccaaaaggaggccaccagcttgcccgaggccacctcagcagcgcccctccggacgtttactgtggacaccctttgtaaactgttccgcatttactcaaactttctcagaggaaagctcaccctgtacaccggtgaagcatgtcgcagaggcgacaga

SEQ ID NO: 11021 - DNA, 576 bp, Artificial Sequence
  Description of Artificial Sequence: Synthetic coding sequence
atgggctcctgtgagtgtccagcgttgttgctcctgctctccctgttgttgctgccgctgggcctcccagtgctgggagccccgccgcgcctgatctgcgatagtagagttctggaacgctacatcctcggagcgcgcgaagcggagaacgtgaccatggggtgcgctgaggggtgcagcttctccgaaaacatcacggtcccagatactaaggtcaatttctacacctggaagcgcatggacgtgggtcagcaggccgtggaagtctggcaaggcctggcactgctgagcgaggcaatcctccgcggtcaggccctccttgcaaattcatcgcagccgagcgaaaccctgcagctgcacgtcgacaaggccgtctcatcgttgcggagtcttactagcctcctgcgggccctgggcgcacaaaaagaggccacttcactccctgaggctacttccgccgcgcctctgcggactttcacggtagataccctgtgtaagctcttcagaatctactcgaactttctgagaggaaaattgactctgtacaccggtgaagcgtgtcggcgcggagatcgc

SEQ ID NO: 11022 - DNA, 576 bp, Artificial Sequence
  Description of Artificial Sequence: Synthetic coding sequence
atgggcagctgtgaatgccctgccctgctactgctcctctccctcctactgctgccattgggtctacccgtgctcggagccccacccagactaatttgcgattccagggtgttggagcgctatatcctaggagctcgggaggctgagaacgtgactatggggtgcgctgaaggttgttccttctcagagaatattacagtgcccgacaccaaggtaaacttttacacctggaagcgcatggacgttggccagcaagctgtggaagtgtggcagggtctggcattgctgtccgaggccattttgcgcggccaagcactcctggcaaattcgagtcagccaagcgagacactgcagttgcacgttgataaagcagttagctccctgcgtagcttgacatcattgctgcgcgctttgggcgcccagaaggaggcaacctccctgcccgaagcgacatccgctgctccactgcgcaccttcaccgttgataccctttgtaagttgttcaggatctacagtaattttttgaggggaaaactgactttatacactggggaagcctgccggcgaggcgatcgc

SEQ ID NO: 11023 - DNA, 576 bp, Artificial Sequence
  Description of Artificial Sequence: Synthetic coding sequence
atgggatcgtgcgaatgcccggcgctcctcctcctgctgtccctgcttctgctgccactgggcctgccagtgcttggagccccgccgcgactcatctgcgactcccgggttctcgaacggtacatcctgggtgcgagagaggccgagaacgtcactatgggatgcgcagaaggctgttccttttcggaaaatattaccgtgcctgacaccaaggtgaatttctacacctggaaacgcatggatgtgggacaacaggctgtggaggtctggcaaggtcttgccctgctgtcggaagctatcctgcgcggccaggctttgctggcgaactcttcccagccttcagagactctccaactgcacgtggataaggcagtgtcgtcattgcgtagcctgaccagcctcttgagggcactcggagcccagaaggaggcaacttcactccccgaagccactagcgcggccccgctgcgcacgttcaccgtcgacacgctgtgcaagttgttccggatctacagcaacttcctgagagggaaactcactctgtacaccggagaagcctgtcggcgcggggacaga

SEQ ID NO: 11024 - DNA, 576 bp, Artificial Sequence
  Description of Artificial Sequence: Synthetic coding sequence
atgggctcttgtgagtgccctgcactgctgctgctgctgtcgttgctcctgctcccacttgggctccccgtgctgggtgcacccccaaggctgatctgcgattccagggttcttgaaagatatattctgggggcaagagaagccgagaacgttacaatggggtgtgcggagggctgcagcttctccgagaatatcaccgtcccagacaccaaagtgaatttctatacttggaaacggatggacgttggccaacaagctgtggaggtgtggcagggactggcattgctgtccgaggctatactgcgaggacaagctttattagccaattcgagccagccctcagagacactccagctgcacgtggacaaagccgtgagctccctgagaagcctgacatccttgcttcgggccttgggtgcgcagaaagaagccaccagccttccagaagcaaccagtgccgctcctctgcggaccttcacggtcgatactctgtgcaaactgtttcggatctactcgaacttccttagggggaaacttactctgtataccggtgaggcatgtagacggggcgacaga

SEQ ID NO: 11025 - DNA, 576 bp, Artificial Sequence
  Description of Artificial Sequence: Synthetic coding sequence
atgggttcctgcgaatgccctgccctgcttttgttgctgtctttgctgctgctgcctctcggcctcccagtgctgggagcgccgccgcgactcatctgtgactcgcgcgtgcttgaaagatatatcctcggagcccgggaagccgaaaatgtcaccatggggtgtgccgaaggttgttccttctctgagaacattacggtgcctgatacgaaagtgaacttttacacatggaagagaatggacgtcggccagcaagctgtggaggtgtggcaggggctggccctgttgtctgaagccattttgcgcgggcaggcattgcttgcaaacagcagccagccttccgagacattacaacttcacgtagataaagccgtgagcagcctccggtcactgacgagtttgttgagagccctgggcgcccagaaggaggctacttcacttcctgaggcaacatcggccgcccccctacgcacctttacggtggacacactttgcaagctgttccgcatttactctaacttcctgcgcggcaaactcacactctataccggagaggcctgcaggcgcggagataga

SEQ ID NO: 11026 - DNA, 576 bp, Artificial Sequence
  Description of Artificial Sequence: Synthetic coding sequence
atgggaagctgtgaatgtcctgcattgctcctgctactgtcactactcctgctgccgctgggcttgcccgtgctgggagctccaccacgcctaatctgtgacagtagagttctggaacggtacattctgggagctcgggaggcggaaaatgtcaccatggggtgcgccgaggggtgtagcttctctgagaatattaccgtgcccgacacgaaggttaatttttacacctggaagagaatggacgtgggacaacaggctgtcgaagtttggcagggtctggcgctgcttagcgaggccatacttcgtggtcaggctctcctggccaacagcagccagccttctgagactcttcagttacatgtggacaaagctgtttctagtttacgaagcctgacaagcttgttgagagcactgggcgcccagaaagaagcaacgtcgcttcctgaggcaactagtgctgcaccgttgcgcaccttcacagttgacaccctgtgtaaactgttccgcatctattctaatttcctgcgggggaagctcacactatatactggagaggcttgtcggaggggcgataga

SEQ ID NO: 11027 - DNA, 576 bp, Artificial Sequence
  Description of Artificial Sequence: Synthetic coding sequence
atgggcagctgtgagtgccccgctctcctccttctactgagtctgcttctcttaccactaggtctgcctgtactcggtgctccccccagactgatatgcgactcacgcgtcttggaaagatacattctaggggccagggaggccgagaacgttacgatgggatgcgcagagggatgttcctttagcgagaacattactgtgccagacactaaggtgaatttttacacctggaaaaggatggatgtggggcaacaggcagttgaggtgtggcagggccttgcgttgctcagcgaagccatcttgcgagggcaggccctgctggccaatagcagccagccaagtgaaacactacagttgcatgtagataaggcggtctcctcccttcggtcgcttacttctctgctcagagcgcttggcgcacagaaggaggcgaccagcctgcccgaggctacgagcgccgcccctctccgcaccttcacggtggacaccctgtgtaagctgttccgcatctatagcaactttctgaggggcaaacttaccctgtataccggggaggcctgtcgccggggcgaccgg

SEQ ID NO: 11028 - DNA, 576 bp, Artificial Sequence
  Description of Artificial Sequence: Synthetic coding sequence
atgggtagctgcgaatgccctgctcttctgttgctgcttagtctgttactactgcccctgggactgcccgtgctgggtgctcctccccggttaatctgcgatagccgtgtgctggagaggtacattctgggcgcgcgagaggccgaaaatgtgaccatggggtgcgccgaaggctgctctttcagtgagaacatcacagttccggacaccaaggtaaacttttacacttggaagcggatggacgtcggccagcaggcagttgaggtgtggcaaggccttgccctgctgtccgaagctatattgagaggacaggccctcttggctaattcaagtcaaccttcggagacccttcagctgcatgtcgacaaagcagtctcctcactgcgctcattaacctccctgttacgggcccttggagcccagaaagaggctaccagcctgccagaagctacctccgccgcaccattgagaacctttaccgttgacaccctgtgcaagctgttcagaatttactccaatttcctgcggggtaagctgaccttgtacacaggagaggcttgccggcggggtgacagg

SEQ ID NO: 11029 - DNA, 576 bp, Artificial Sequence
  Description of Artificial Sequence: Synthetic coding sequence
atgggatcttgtgagtgtccagcactgttgctgttactaagcctcctcctcctccccttaggccttccggtcttgggggcccctccaaggcttatttgcgactctcgcgtgctggagcggtacattttaggggctcgcgaggcagagaacgtcactatgggttgcgccgaggggtgtagcttttccgagaacatcaccgttcccgacactaaggtgaatttttatacctggaagcgaatggatgtgggacagcaggcggtggaggtgtggcaggggctggccctcctttctgaggccattctgcgtggccaggcgttgcttgctaattctagtcagcccagtgaaaccctccaactgcacgtggataaagcggtctccagcctgcggagtctgacctcactcctcagggccttaggagcccaaaaggaagcaacatccttacctgaagccacatcggccgctcccctgagaacatttaccgtcgacactctctgcaagctctttagaatctattccaactttctgcggggcaaactcacactgtacacaggcgaggcctgtagacgcggtgacagg

SEQ ID NO: 11030 - DNA, 576 bp, Artificial Sequence
  Description of Artificial Sequence: Synthetic coding sequence
atgggttcctgcgagtgtccagctttgctcctgcttctgtcactcctgctgctgcccttgggtctccccgtactgggcgccccaccccgcctgatctgcgactcccgcgtgttggagcgctacatcctgggtgccagagaagccgagaacgtcacaatgggctgcgccgaaggttgttccttctcagagaacatcaccgttcccgataccaaggtcaacttctacacctggaaacgcatggacgtgggacagcaagcggttgaggtatggcaaggtctggccctgttgtctgaggccatcctgagaggccaggccctccttgccaactcaagtcagcccagtgagacacttcagctccacgtcgacaaggctgtgtcatccctgagatcattgacatccctccttagagccttgggagcccagaaggaggcgacatcactgcctgaagcaacatccgccgcacctctgaggaccttcacagtggataccctctgcaagctcttccgcatctactcaaacttcctccgcggcaagttgactttgtacaccggcgaagcatgcaggagaggagacagg

SEQ ID NO: 11031 - DNA, 576 bp, Artificial Sequence
  Description of Artificial Sequence: Synthetic coding sequence
atgggttcgtgtgaatgtcctgcacttttgctgctgctttctcttctcctgctgcctctggggttgccagtgcttggtgcaccgcctcgccttatatgcgattcacgagtccttgaaagatacattctcggtgcaagagaagcagaaaacgtgaccatgggatgcgcagagggatgtagtttcagcgaaaacattactgtgccggacactaaggtgaacttttacacttggaagcggatggacgttggacaacaagccgtggaagtgtggcaaggactggcgctgctttccgaagctatcctgagaggccaggcccttctggcaaattccagccaaccatcggagactcttcagcttcatgtggacaaggccgtgtcctcacttagaagcctcaccagcctgcttagggcccttggagcacagaaagaagccacgagcttgcccgaggccactagcgcagcaccccttcgaacgtttactgttgacactctgtgtaaactgtttagaatttactcgaatttcctcagaggtaagctgaccctgtacactggagaggcctgcagaaggggcgatcgg

SEQ ID NO: 11032 - DNA, 576 bp, Artificial Sequence
  Description of Artificial Sequence: Synthetic coding sequence
atgggatcgtgtgaatgtcctgcccttctcctcttgctttccttgctgctgcttccactcggactgccagtgttgggtgcacctcctcgcctcatttgtgactcaagagtgcttgagcgttacattcttggtgcacgggaagcagaaaatgtgaccatgggctgcgcagaaggttgttcgttctccgaaaacattaccgtgcctgacaccaaggtgaacttttacacttggaaacggatggacgtgggtcaacaagccgtagaggtgtggcaggggcttgccctcctctccgaagctatccttcgcggacaagcacttctggccaactcatcccaaccttcggagactttgcaactgcacgtcgataaggcagtgtcgtcacttcgttcccttacctcactgctgagagctctcggtgcccagaaagaggcaaccagcttgcctgaagccacctcggccgcgcccctgaggacgttcaccgtcgatactctctgcaagctcttcagaatatactccaactttttgcgcggaaaactcaccctttacactggcgaagcatgtcgcaggggggacagg

SEQ ID NO: 11033 - DNA, 576 bp, Artificial Sequence
  Description of Artificial Sequence: Synthetic coding sequence
atgggatcgtgtgaatgtccagccctcctactcctactgtctttgcttttgctgcctttggggctcccggtccttggagcaccccccagactaatttgcgattcccgtgtgcttgaaagatacatcctcggcgccagggaagcggaaaatgtgacaatgggctgcgctgaaggctgttcatttagtgagaatataaccgtgcctgatacgaaggttaatttctacacttggaaaaggatggacgtgggccagcaagcggtggaggtgtggcagggattagctctgttatccgaggcgatacttcgcggccaggccctcttagccaattcatctcagccctccgagacgctccagcttcatgttgataaggctgtgtcttcactccggtcccttacttcactcttaagagcacttggcgcccagaaggaagccacaagcttaccagaggccaccagtgccgctccactccggactttcacagtggacacactttgtaagctgttccggatctatagcaattttctccgcggtaaactgaccttgtacacaggggaggcttgcaggcggggggataga

SEQ ID NO: 11034 - DNA, 576 bp, Artificial Sequence
  Description of Artificial Sequence: Synthetic coding sequence
atgggttcgtgtgaatgtccggcgttattattactactatcgctactattattaccgttaggtctaccggtattaggtgcgccgccgcgtttaatatgtgattcgcgtgttttagaacgttatatattaggtgcgcgtgaagcggaaaatgttacgatgggttgtgcggaaggttgttcgttttcggaaaatataacggtaccggatacgaaagttaatttttatacgtggaaacgtatggatgtaggtcaacaagcggtagaagtatggcaaggtttagcgctactatcggaagcgatactacgaggtcaagcgttactagcgaattcgtcgcaaccgtcggaaacgctacaactacatgttgataaagcggtatcgtcgttacgttcgttaacgtcgttattacgagcgttaggtgcgcaaaaagaagcgacgtcgctaccggaagcgacgtcggcggcgccgctacgaacgtttacggttgatacgctatgtaaactatttcgtatatattcgaattttttacgtggtaaactaacgctatatacgggtgaagcgtgtcgtcgtggtgatcgt

SEQ ID NO: 11035 - DNA, 576 bp, Artificial Sequence
  Description of Artificial Sequence: Synthetic coding sequence
atgggcagctgtgagtgcccagccttgttgctgctgcttagccttttgctactgccccttggattacctgtgttgggcgccccaccccgcctgatctgcgattcacgtgtgctcgaacgatatattcttggagcgcgtgaagctgagaatgtgacaatgggatgcgctgagggctgttcctttagtgaaaacattaccgtgcctgatactaaggtaaacttctacacttggaaacgcatggatgttggacaacaggcggtggaggtatggcagggtctggccctcctgagtgaggcaatcttacgcgggcaagccctcctggctaacagcagccaaccctctgagaccctgcagcttcatgtggataaagccgtatcttccttgcggagcttgaccagcctccttcgcgcactgggcgcccaaaaggaagccactagcctgcctgaagccacctccgctgccccgttgcgcacctttacagtggataccttatgcaagctgtttaggatttattccaatttcttaaggggaaagctgacactgtataccggggaggcatgtaggcgcggcgatcgc

SEQ ID NO: 11036 - DNA, 576 bp, Artificial Sequence
  Description of Artificial Sequence: Synthetic coding sequence
atgggttcgtgtgaatgtccggctcttctcctgctgctgtcgctgctccttctgcctcttggccttccggtcctcggcgcgccacctcggctcatttgtgactcccgcgtgttggaacgctatatcttgggtgctcgggaagccgagaacgtgaccatgggatgtgctgagggctgttcgtttagcgagaacattacggtgccagataccaaagtcaacttttacacttggaagcggatggatgtgggtcaacaagcagtggaggtgtggcagggcctcgcactgctctcggaagccattctgagggggcaagcactcttggcaaactcatcccaacccagcgaaaccctccaacttcatgtggacaaggcagtctcctccctgcgcagcctgacttcacttctgcgtgcacttggcgcacagaaagaagcaacctccctgcctgaagccacctcagcagcgccactccgcacctttacggtggatactctctgcaagctcttccggatttactcaaactttctgagaggaaagttgactctgtacactggggaagcctgtcgccgaggtgataga

SEQ ID NO: 11037 - DNA, 576 bp, Artificial Sequence
  Description of Artificial Sequence: Synthetic coding sequence
atggggtcgtgcgaatgcccggccctcctgctcctcctgtcgttgctcctgctgccgctcggactgcctgtgttgggagcaccacctaggctcatctgtgattcgagagtcctggaaaggtacatcttgggcgcgagagaagccgagaatgtaaccatgggatgcgcggaaggatgttccttttcagagaacattactgtgcctgatacgaaggtcaatttctacacctggaagcggatggacgtgggccaacaggccgtcgaagtttggcagggactggcgcttctgtcagaagccatcctgagaggacaagccctgctggccaactcgtcccagccgagcgaaaccttgcaactgcatgtcgataaagccgtcagctcactgcgctcactgacgtcgctgctgagagcccttggcgcacaaaaggaagccacctccctcccggaagccacttccgctgctccactgcgcaccttcaccgtcgataccttgtgcaaactcttccggatctactccaacttcctgcgcggaaagttgaccctctacaccggagaggcctgccggcgtggagatcgg

SEQ ID NO: 11038 - DNA, 576 bp, Artificial Sequence
  Description of Artificial Sequence: Synthetic coding sequence
atgggatcttgcgagtgtccagcactactcctgcttctgtccctcttgcttttgccactgggcctgcctgtcttgggcgcaccaccaaggctgatctgtgacagccgggtgttagaacggtatatcctgggagcaagagaggcagagaatgtcacaatggggtgtgccgaggggtgcagcttcagtgagaatatcactgttccagataccaaagtcaacttctatacttggaagcggatggatgttgggcaacaagctgtggaggtttggcagggcctcgccctgctcagcgaggccatcctacggggacaggcactgctagcaaactcttcccagccatctgagaccctacagcttcatgtggacaaggcagtctctagtctgcggtcgctgacttctctgctgagggcactgggcgcacagaaggaggccacatctctaccggaggccacgagcgcggccccccttaggacgtttacagtagacactttgtgcaagctctttcggatttacagcaattttctcaggggtaaactaaccctttacaccggtgaagcgtgccgcaggggagaccgg

SEQ ID NO: 11039 - DNA, 576 bp, Artificial Sequence
  Description of Artificial Sequence: Synthetic coding sequence
atggggagctgcgagtgccccgccctcctgctgttgctgtctctgctgctgttgccactgggtctccctgtcctgggtgccccgccacgactgatctgcgatagccgggttctcgaacggtatatcctcggggcacgcgaggccgagaacgtcacaatgggctgtgccgaagggtgctcttttagcgaaaacattacagtgcctgacactaaagtgaacttctatacctggaagcgcatggatgtcgggcagcaggccgttgaagtgtggcagggtctagcgcttctatccgaagctattctccgtgggcaggccctgctggcgaattcctcacaaccctccgaaacccttcagctacatgtggataaggcagtgagctcactgcggtctctgacgtctctactgagggccctgggggcccagaaggaggcaacatctctcccggaagcaacttctgcggctccccttaggacttttaccgtggacaccctctgcaaactttttaggatctattcgaacttcctccgcggtaaattgacattatacactggcgaggcgtgtcgtaggggagaccgt

SEQ ID NO: 11040 - DNA, 576 bp, Artificial Sequence
  Description of Artificial Sequence: Synthetic coding sequence
atgggttcatgcgagtgccccgcacttctgcttctcctgtcactgctcctgctcccacttggactcccagtgctcggggcaccacctagactgatatgtgacagcagagtccttgaacgttacattctcggcgccagagaagctgagaatgtgactatggggtgcgctgaaggatgtagcttttccgagaacataacggtgcctgacaccaaggtgaacttttacacctggaagagaatggatgtcggtcagcaggcagtggaagtttggcagggactcgcccttctttcggaagcaattcttcgtggtcaagcgctgttggcaaattcctcacagccttcggaaacccttcaactgcacgtggacaaggctgtctcttcgcttcggagcctgacctccctcctccgagcacttggtgcacagaaggaagcaacgagcctgccggaggcaacctcggcagcaccgctgcgcacctttactgtcgatacgctgtgcaaattgtttcgcatttactcaaactttcttcgcggcaagctgactctttacactggagaagcatgtcgtcgaggcgatcgc

SEQ ID NO: 11041 - DNA, 576 bp, Artificial Sequence
  Description of Artificial Sequence: Synthetic coding sequence
atgggatcttgtgaatgtccagcattgttactcctattgtctttgctattacttccacttggattaccagttttaggagcaccaccacgattaatttgtgactcaagagttcttgaaagatatatattaggagcacgtgaagcagaaaatgtaactatgggatgtgcagaaggttgttcattctctgaaaatattacagttcctgatacaaaggtcaatttctatacatggaaaagaatggatgtaggacaacaagctgtagaagtatggcaaggacttgctcttttatcagaggctattttaagaggacaagcattacttgcaaattcttctcaaccaagtgaaacattacagttacatgttgacaaagcagtttcttcattaagaagtcttacttctcttcttagagctttaggagcccaaaaagaagccacatcattaccagaagctacatcagctgctcctctccgaacttttactgtcgatactctttgtaaattattcagaatttattctaattttttaagaggaaagttaacactttatacaggagaagcttgtagaagaggagataga

SEQ ID NO: 11042 - DNA, 576 bp, Artificial Sequence
  Description of Artificial Sequence: Synthetic coding sequence
atggggtcatgtgaatgcccagcactactcttactcttaagcctgttattgctacctttaggacttccggtattaggcgcccctccccgtctaatatgtgacagccgcgtcctggagcggtacatactgggtgcccgagaagccgagaatgtaaccatgggctgcgctgagggttgcagcttttcagagaacatcactgtaccggataccaaggtgaatttttacacctggaaaagaatggacgtaggccagcaagccgtggaagtatggcagggcttagcactgctctctgaggccattctgcggggccaagctctgctggccaactctagccagcctagcgaaacgctgcagctccatgtcgacaaagctgtctcctcccttaggtcacttacaagtctgctgagggcgctgggggcccagaaagaagcgacttctctgccagaggccacatcagcagctcccctccggactttcactgtggacaccctttgcaaattgtttcgcatttactctaacttcctgagaggcaagcttactctgtacaccggagaagcctgcagacggggagacagg

SEQ ID NO: 11043 - DNA, 576 bp, Artificial Sequence
  Description of Artificial Sequence: Synthetic coding sequence
atgggttcctgtgaatgtccagctctgctcctgctgctcagtctgcttctgctgcctctggggctgcccgtgctcggtgcgccgccaagattgatctgcgatagccgtgtcctcgagcgctacattctcggcgcccgggaggcagaaaacgtgacgatgggatgcgctgaagggtgctcgttttccgaaaacatcactgttcctgacacgaaggtgaacttctatacctggaagaggatggatgtcgggcaacaagcggtggaggtgtggcagggacttgcgctgctgtccgaagccattcttagaggtcaagcactgttggccaactcgtcacagcctagcgaaacccttcagctgcatgttgataaagcagtgtcatctcttagaagtcttacttccttgttgcgagccctgggagcacaaaaagaagcaaccagcctcccagaggcaacctccgccgcaccgcttcgaacctttactgtcgataccctttgtaagctcttcaggatatacagcaattttctgaggggtaagttgactctttatactggagaagcctgtagacgcggcgaccgc

SEQ ID NO: 11044 - DNA, 576 bp, Artificial Sequence
  Description of Artificial Sequence: Synthetic coding sequence
atgggatcgtgtgagtgcccggccctgctgctgctcttgtctctcctcctcctcccactgggactgccggtcctgggcgcaccgccaagactcatctgcgactcacgggttctcgaacggtacatcctcggcgccagagaagcggagaacgtcactatgggatgcgcagaaggatgttcgttctccgagaatatcaccgtcccggataccaaggtcaatttctatacttggaaaaggatggacgtcggccagcaagcggtggaagtgtggcagggtctggccctgctttcggaagctatcctgcgcggacaggcactgctggccaattcgtcccagccgtccgaaaccctgcagctgcacgtcgacaaggccgtctcatcgttgcggtccctcacttccctccttcgggcgttgggagcacagaaagaagcgaccagcctgcctgaggccacctccgcagccccgctcagaactttcactgtggatactctgtgcaagctgttcagaatctactcaaatttccttcgcggaaagctgaccctgtacaccggcgaggcgtgccgcagaggagatcgc

SEQ ID NO: 11045 - DNA, 576 bp, Artificial Sequence
  Description of Artificial Sequence: Synthetic coding sequence
atgggatcctgcgaatgtccggccctgctgctgctgctttccctcctgctgttgccgcttggacttccagtgctgggagcgccgccgcggctgatctgtgattcccgggtcctcgagcgctacatcctcggagcaagagaggcagaaaacgtcaccatggggtgcgctgaaggatgctcgttttcagaaaacatcactgtgccagatactaaggtgaatttctacacttggaagcgcatggacgtgggccagcaagcggtggaagtgtggcaggggctggcgttgctgtcggaagccatcctgcgaggacaggccctcctcgcgaacagcagccaaccgtcggagactctgcagcttcacgtcgacaaagccgtttcaagcctccggtccctgactagcctgctccgcgcccttggagcacaaaaggaagccacctccctccccgaagcaacttccgccgcgcctctgagaacctttaccgtggacaccctctgcaaactgttccggatctactcaaactttctgaggggaaagctcactctttacactggggaagcatgccgcaggggggacaga

SEQ ID NO: 11046 - DNA, 576 bp, Artificial Sequence
  Description of Artificial Sequence: Synthetic coding sequence
atgggaagctgtgaatgtccggctcttctcctgctgctgtcactgctgctcctccccctgggactgcccgttcttggagccccgccacgcctcatctgcgacagccgcgtcctggagcgctacattcttggggcacgggaagccgagaacgtcactatggggtgcgctgaaggatgctccttcagcgagaatatcaccgtgccggatactaaagtcaatttctacacgtggaagcggatggacgtgggccaacaggccgtggaagtgtggcagggcctggcactcctgtcggaagccatcttgcgcgggcaggcgctcttggccaactcttcgcaaccaagcgagactctgcagttgcacgtggataaggcggtgagctccctccgctccctgactagcctccttcgcgcccttggagcacaaaaagaagctacctccctcccggaggccacgtccgcagctccgctgagaactttcaccgtggacacgctgtgtaagctgttccggatctactccaacttccttcggggaaagctgacgctgtacactggtgaagcgtgcagaaggggtgacaga

SEQ ID NO: 11047 - DNA, 576 bp, Artificial Sequence
  Description of Artificial Sequence: Synthetic coding sequence
atgggaagctgtgagtgtcctgcacttctccttctgctgtcccttctccttctcccacttggccttcctgtgttgggggctcctccacgtctgatttgtgactcgagagtcctcgaacgctacattctcggtgcacgcgaggccgaaaatgtgactatgggatgcgcagaagggtgtagcttttccgaaaacattaccgtgccagataccaaggtgaacttttacacctggaaaagaatggacgtgggacaacaagctgtggaggtgtggcagggtctggcattgcttagcgaagcaatcctgagaggtcaagcactgcttgcgaattcgtcgcagccgtcggaaactctgcagcttcatgtggataaggcggtgtcgtcgctgcgaagcctcacctcactgctgagggccctcggagcacagaaagaagcgacctcgctgccagaagcgaccagcgcagccccgctgcgcaccttcactgtggatactctttgcaaactctttcgaatctacagcaactttctgagaggaaaactgaccctttacaccggggaagcctgtcggcgcggagataga

SEQ ID NO: 11048 - DNA, 576 bp, Artificial Sequence
  Description of Artificial Sequence: Synthetic coding sequence
atggggtcgtgcgagtgtcctgcgctcttgcttctcctgtcactgctcctgctgccactgggactccctgtgcttggagcaccacctagactcatatgtgattctcgggtgctggaacggtatattctgggagctagagaggcagaaaacgttactatgggatgcgcagagggttgttcattctcggagaacattacggtgcccgataccaaggtgaatttctatacgtggaagaggatggatgtgggtcagcaggcagttgaggtgtggcaaggcctggcactgctgtccgaggcaatacttcgaggtcaagcgcttcttgccaactcatcccaacccagcgaaaccttgcaactgcatgtcgataaggcagtcagctcgctccgtagcctgacttcgctgctgcgggctctgggcgcacagaaggaggcaactagcctgcccgaggcaacctcggcagcaccactccgcacttttactgtggatacgctttgcaaattgtttagaatctactccaatttcctgagaggtaagctgaccctttacactggagaagcatgtcggcgaggcgacaga

SEQ ID NO: 11049 - DNA, 576 bp, Artificial Sequence
  Description of Artificial Sequence: Synthetic coding sequence
atgggatcatgtgaatgcccagcgctgctgcttctcctgtcactactgcttctgcctctcggtctccccgttctcggcgcaccacctaggttgatctgtgacagcagagtgctcgagaggtatatcctaggcgcgagggaggcagagaatgtgactatgggatgtgcggaaggttgctctttcagcgagaacattacagtccccgacactaaggtgaatttctatacctggaaacggatggatgtcggccaacaagcagtggaagtgtggcaaggcctcgccttgctatccgaggccatcttgagggggcaggctctgttagctaatagctcgcagcccagtgagactcttcaactccacgttgataaagccgtttcctccttgagatcgctgaccagtctcctcagagccctcggtgcccagaaggaggcaacctctttaccggaggccactagcgctgcgcccctgcgaacattcaccgtggacaccctgtgcaaactcttccgaatttactccaactttctgcgtggcaagctgaccctgtacactggggaagcatgtcgccgcggtgatagg

SEQ ID NO: 11050 - DNA, 576 bp, Artificial Sequence
  Description of Artificial Sequence: Synthetic coding sequence
atgggctcctgtgaatgccccgccctgctgttgctgctttctcttttgctcctcccactgggccttcctgtcctcggtgctcctcctcgcctgatctgtgatagccgcgtactggaacgttacattctcggagcccgcgaggccgagaacgtgaccatgggctgcgcagaaggttgctccttctcagaaaacataaccgtccctgatactaaagttaacttttatacatggaaaaggatggatgtcggccagcaagctgtcgaagtgtggcagggccttgctctgctttccgaggcaattctccgcggccaggctcttctggctaactccagccagccatcagagacccttcagttgcacgttgataaagccgtgagctccttgcgctctttgacctctctgctgagagctttgggtgcccaaaaggaagctacttctctgcctgaggctacttcagctgctccactccgtacattcactgttgatacactgtgtaagcttttcaggatctatagcaatttcctgcgcggtaagctgaccctttacaccggtgaagcatgccgtcgtggagataga

SEQ ID NO: 11051 - DNA, 576 bp, Artificial Sequence
  Description of Artificial Sequence: Synthetic coding sequence
atgggaagctgtgaatgtcctgcacttcttcttctgctgtcgctgcttcttctgcctcttggacttcctgtgcttggtgcgcccccgagactgatatgtgattcgagagtgctcgagcgatacattctcggcgcacgggaagcagaaaacgtgactatgggctgtgccgagggttgctccttctccgagaatatcaccgtgcctgatacgaaagtcaacttttacacgtggaaaaggatggatgtggggcagcaagcagtggaggtctggcagggtctggctttgctgtctgaagcaattctgcgcggacaagcgctcctcgcaaattcgagccagccgtcagaaaccctgcaacttcatgtcgacaaggctgtctcctctcttcgcagccttactagcctgttgcgggccctcggagcacaaaaggaagcgacgtccctgccagaggccacctctgcagccccactgagaacctttactgtggatactctctgcaagctgtttcggatctactccaacttcttgcgcggtaagctcaccttgtatacgggggaagcatgtcgccggggagacaga

SEQ ID NO: 11052 - DNA, 2598 bp, Artificial Sequence
  Description of Artificial Sequence: Synthetic coding sequence
atgtttagcatgagaattgtgtgtttggtcctgtccgtggttggtacggcatggacggcagattcaggcgaaggcgattttcttgcagagggaggcggagtccggggcccaagagtggtggaacgacatcaaagcgcatgtaaagattcggactggcctttctgctcggatgaagattggaactacaaatgtccatccggttgtagaatgaagggtttgattgatgaggtgaaccaagatttcactaaccgtatcaataaactgaagaattcattgtttgaataccaaaagaacaataaggatagccactcattgactactaacataatggaaattctgcgaggtgatttttcaagtgccaacaaccgggacaatacttacaatcgagtgagcgaggacctgcgatcccgtattgaagtcttgaaacgcaaagtcattgaaaaggtgcaacatatccagctccttcagaaaaatgttagggcgcaacttgtcgatatgaagcggcttgaggtcgatattgacataaagatcagatcgtgccggggatcctgttctcgcgctcttgcgcgggaggtcgatcttaaggattacgaggaccagcaaaagcaattggagcaggtcatcgccaaggatctgcttccatccagagatcgccaacatctgcctttgataaagatgaagcccgtgccagacctggtgcccggcaactttaagtcacagttgcaaaaggtccctcctgaatggaaagccctgactgatatgccacagatgcgcatggagctggaacgccccggcggcaacgaaattacccgtgggggctccacctcgtacggcactggatcggaaaccgaaagccctaggaacccctcgtcggccggttcctggaacagcggttcgagcggtcctggatccaccggaaatagaaacccagggagctccggaactggaggtactgcgacttggaaacctggtagctcgggaccgggatcgactggctcctggaactccggttcgtccggaacgggaagcaccggcaatcaaaatcctggttcgccacgccctgggagcaccggaacttggaacccaggatcgtccgagcggggttccgcaggacattggacttcagagagctccgtttcgggttccaccggacaatggcactccgaaagcggatcattccgtccagattctcctggttcgggaaacgctcgtcctaacaacccggactggggtaccttcgaggaggtgtcgggtaacgtgagcccaggtaccaggagagaataccatactgaaaagctggtgacgtcgaagggggataaggaacttcgcaccggtaaggagaaggtcacctccggctcgactacgacgaccagaagatcctgttccaagacggtgacgaaaactgtgatagggccagatggacataaagaagtgaccaaagaagttgtgacctctgaagatggaagcgattgtccggaggcgatggatctgggaactctctcaggcataggtaccctcgatggctttcgccacagacatccagatgaggcagccttctttgacaccgcgtccactggcaaaacttttccaggcttcttttctcccatgcttggagagtttgtctccgaaaccgagagcagaggctcggagtccggtatattcaccaacaccaaggaaagctcctcccatcatcctggtatcgcagaattcccttcgcgtggcaagtcctcatcatactcgaagcaatttacttcctcaacgtcctacaaccgtggagactccacctttgaaagcaaaagctacaagatggccgatgaggcaggctcggaagcggaccatgaaggtacccattcaaccaagcggggccatgccaagtcaagacctgtgagagactgcgacgatgtgctgcagacccatccttcaggaactcaatccggcatattcaatatcaagctccctggttcatcaaagattttctcagtttattgtgaccaggaaaccagccttggggggtggcttcttattcagcagcgaatggacggctccctcaactttaacaggacctggcaggattacaagcgggggtttggaagcctgaacgatgagggcgagggcgagttttggctgggtaacgactacctgcatctgcttacccaaaggggatcagtgctgagagtcgaacttgaggattgggcaggtaacgaggcttatgcagagtaccatttcagagtgggatcggaagcagaagggtacgcactgcaggtgtccagctacgaagggacggcgggagacgcacttattgaaggatcggtggaggaaggggccgaatacaccagccacaacaacatgcagttttcgacttttgatagagacgctgatcaatgggaagaaaattgcgctgaagtgtacggcgggggttggtggtacaacaattgtcaggccgctaacctgaacggaatctactaccccgggggatcctacgaccctaggaacaattcaccttacgaaatcgagaacggtgttgtgtgggtgtcatttcgaggggcagactacagcctgcgggcagttagaatgaaaatccggccacttgtgacgcaa

SEQ ID NO: 11053 - DNA, 2598 bp, Artificial Sequence
  Description of Artificial Sequence: Synthetic coding sequence
atgttttctatgcgtattgtgtgtcttgtgctttcggtcgttggtacggcttggaccgcagattccggcgagggggatttcctcgcagagggcgggggcgtgcgaggaccgagagtagtggaacggcatcagtcagcatgcaaggattccgactggccgttttgtagcgatgaggattggaactacaagtgcccctctggttgtcgcatgaaaggacttatagatgaagtcaatcaggactttacgaatcgaatcaataagctgaagaattccctttttgaataccaaaagaacaataaggactcccacagccttaccaccaatatcatggagattctgcgtggcgatttctcatcagcaaataacagagataacacctacaaccgggtgtccgaagatctgagatcacggatcgaagtgctgaagcggaaggtcattgagaaggtccagcacatccaacttcttcagaagaacgtcagagctcagctggtggatatgaagcgacttgaagtggacatcgatatcaagatccgttcctgtagaggatcatgctcacgagcactggcccgagaggtggatctcaaggactacgaagatcagcaaaagcagcttgaacaggtgattgccaaggacctcctcccctcgcgcgacagacaacatcttccattgatcaagatgaagcccgtgccagatcttgtgccaggcaactttaagtcgcagcttcagaaagtgcctccagaatggaaggcacttactgatatgccccaaatgagaatggaactggaacggcccggaggaaatgagattacccgcggcggttcgaccagctacggtaccggttccgaaaccgagtcgccgcgaaaccctagctcggcgggctcttggaacagcgggagctccggcccaggttcgaccgggaatagaaaccccggctcatccggaactggcgggacggcaacttggaagcctggcagctctggtcccggatctactggtagttggaacagtggatcaagcggaactggaagcacgggcaaccagaaccctggatcccctaggcctggatccaccggaacctggaacccaggatcctcagaaagaggatcagccggacactggacctcagagtcgtccgtgagcggatcgactggacagtggcatagcgaaagcggttccttccggccggactcaccaggatccggaaacgcaagaccaaacaacccagactggggtacgtttgaggaagtgagcggaaacgtcagccctggtactagaagggaataccacactgagaaactcgtcacctctaaaggtgacaaagagcttcggactggtaaagaaaaagttacctcgggttccacgactacgactagaaggagctgctcgaaaactgtcactaaaaccgtgattggaccagatggccataaagaagtgaccaaggaagtggtgactagcgaggatggtagcgactgtcctgaagccatggatctcgggaccctttcgggcataggtactctggatggattccggcatcgtcatccagacgaggccgcgttctttgacaccgcaagcactggtaagacgtttccagggttcttctccccaatgctgggggagtttgtgtcagaaaccgaatcgaggggatcggaatccgggatattcaccaatactaaggaatcgagctcccaccaccctggaattgcagaatttccgtcacggggaaaatcgtcgtcatactccaagcagttcacttcctccaccagctataaccggggagattcgacttttgagtccaagagctacaaaatggcagacgaagcagggtccgaagccgaccacgaaggtactcattcgactaagcggggtcacgcgaaaagccggccagtgagagattgtgatgatgtgcttcagactcacccgtccggtactcagtcagggattttcaacataaagctgcctggaagctccaagatctttagcgtgtactgcgatcaagaaactagcctgggtgggtggctgctcatccaacaaaggatggatggttcgttgaacttcaatcgcacttggcaggattacaagcgagggttcggttccctcaacgatgaaggagaaggcgaattctggctgggcaacgactacctccatctcctcacccagcggggttcagtgcttcgggtggaattggaggactgggcaggtaatgaggcatacgcggagtaccattttcgtgtcggaagcgaagccgagggctacgcacttcaggtgtcatcgtacgaaggcaccgcaggtgatgctttgatagaaggttcggtggaagagggagctgaatacacttcgcataacaacatgcagttttccacgtttgatcgcgacgcagatcaatgggaagaaaactgcgccgaagtgtacggagggggttggtggtacaacaactgtcaggcggctaacctcaacgggatatactatcccggtggatcgtacgaccctcgcaacaattcgccgtacgaaatcgaaaatggggtggtctgggtttcctttaggggcgcggattactcactccgggcagtgaggatgaagattagaccgctggtgactcaa

SEQ ID NO: 11054 - DNA, 2598 bp, Artificial Sequence
  Description of Artificial Sequence: Synthetic coding sequence
atgttcagcatgcgaatcgtctgcctggtgttgtcggttgtgggcaccgcctggacggccgattcgggagaaggcgacttcctcgccgagggaggaggagtgcgcggaccacgggtagtggagagacaccagagcgcctgcaaggactccgactggcctttttgttcagatgaggactggaattacaaatgtccgtccggctgccgaatgaaaggcctgatcgacgaggtgaaccaggatttcactaaccggatcaacaaactgaagaactcgctcttcgagtaccagaagaacaataaggacagccatagcctgacgactaatatcatggaaatcctgagaggtgacttttccagcgcgaacaatcgggataatacctacaatcgcgtcagcgaagatctccggtcacggatcgaggtactgaaacgcaaggtcatagaaaaagtacagcatatccagctcctgcagaagaatgtccgcgcccaactcgttgacatgaaaagactcgaagtcgatattgacattaagattaggtcatgtcgcggttcatgctcacgcgccctcgcaagggaagtggacctgaaagattacgaggatcaacagaaacagctggagcaagtgatcgcgaaggacctgcttccgtcgcgtgaccgccagcacctgccccttatcaaaatgaagccggtcccggatctcgtgccgggcaactttaagtcgcagctgcagaaggtgcctcctgagtggaaggccctcacggacatgccacagatgcgtatggaactggagaggccaggtggtaacgagatcacccgcgggggaagcaccagctacggtaccggatccgagactgagtcgccacgcaacccttcatctgctggatcgtggaacagtgggagctccggtccagggtcgactggcaaccgcaatccggggtccagcggcactggcggcaccgcaacctggaagccaggctcatcagggcccggctcgaccgggtcgtggaattctggatcatccggaactggctcgaccggaaaccaaaatccgggaagcccgcgccctggatcaactggaacttggaacccggggagcagcgagcgcggctcagcgggacactggacctcggaatcctcagtgtcaggctcgacgggacaatggcactctgaatccggatcgttcagaccggactcacccggctccggaaacgctcggcctaacaacccggactggggcacctttgaggaagtgtccgggaacgtgtcacccggaacccgcagagagtaccatacggagaagctggtcacttcaaagggagataaagaattgcgcactggaaaggaaaaagtcacttcgggctcgactaccactactagacggagctgctccaagacggtcaccaagactgtgatcggaccggatggtcacaaagaagtcactaaagaagtcgtgacctccgaggatgggtcagactgcccggaagcgatggacctgggaactctgagcggtatcggcaccctcgatggcttcagacatcgccaccccgatgaggcagcgtttttcgacacggcaagcaccggaaaaacctttccaggttttttctcaccgatgcttggagagttcgtgtccgaaactgaatcacgcgggtcagaatcgggcatcttcaccaacacgaaagaatcgtcctcccaccatccagggatagccgagttcccgtcacgcggcaagagcagctcatattcgaagcagttcacctcatctacttcctataaccggggggatagcactttcgagtcgaagtcgtacaagatggcagacgaagctggctccgaagctgaccatgaggggacgcactctacgaaacgcggtcatgcgaagtccagaccggtgcgcgattgcgacgacgtgctgcagacccacccaagcggaacccaatcaggcatcttcaatatcaagctcccagggagctcgaagatctttagcgtctactgcgatcaggaaacctcgctcggtggctggctgttgatccagcaacggatggacggctccctgaacttcaatcgcacctggcaggactacaagcggggattcggatccctgaatgatgaaggcgaaggggagttctggcttggaaatgactatcttcacctgctgacccagagaggctccgtgttgagagtcgaactggaggactgggcgggaaatgaggcttacgctgaataccacttccgcgtgggttccgaggcagaaggatacgcccttcaagtctccagctacgaaggcaccgccggagacgcgcttatcgagggttcggtggaagagggcgcagaatataccagccacaataacatgcagttttcgactttcgacagagacgcagaccaatgggaagaaaactgtgcggaagtgtacggaggaggctggtggtacaacaactgtcaagccgccaacctgaacggaatctattacccagggggatcctacgacccgcgcaacaacagcccgtacgagattgaaaatggtgtggtgtgggtgtccttccgaggggccgattactcgctccgcgccgtcagaatgaagatccggcctctggtgactcaa

SEQ ID NO: 11055 - DNA, 2598 bp, Artificial Sequence
  Description of Artificial Sequence: Synthetic coding sequence
atgtttagcatgcgcatcgtgtgcttggtgctgagcgtcgtgggaaccgcctggacggccgactccggtgaaggagacttcttggccgagggcggaggagtccggggaccccgtgtggtggaaaggcatcagagtgcgtgcaaggactccgactggccattctgttccgacgaggactggaactacaaatgtcctagtggctgccggatgaaagggctgatcgacgaagtgaaccaagatttcactaaccgcatcaacaaattgaagaattcgctgttcgagtaccaaaagaacaataaagattcgcactcgctgactaccaacatcatggaaatcctgcgcggtgacttctctagcgcaaacaaccgcgacaatacctacaatcgtgtgtcagaggatctgcgcagcagaattgaagtcctgaagagaaaggtgatcgaaaaggtccagcacatccagctgcttcaaaagaacgttcgagctcaactggtcgatatgaagaggctggaggtggacatcgacatcaagatccgctcgtgcagaggatcctgctcacgcgccttggccagagaagtcgacctcaaggattacgaagatcagcaaaagcagctggagcaagtcatcgctaaggatctccttccatcgcgggacagacagcatctcccgctgattaagatgaaacccgtgcctgacctggtcccggggaactttaagtcccaactgcagaaagtgccaccggagtggaaagccctgaccgacatgccacagatgcgtatggaacttgagcgcccgggaggaaatgagatcaccagagggggtagtactagctacggaaccgggagcgaaactgaatcgcctcgaaacccgtcgtccgcaggctcgtggaactctggttcctccggaccaggatccaccggaaaccgaaaccctggatcatcggggacgggaggaaccgcgacctggaagccgggctcgagcggtccgggtagcactggaagctggaattccggttcgtcaggaaccggctcgaccggaaaccagaatcctggttctccccgcccgggctcaaccggcacttggaatccgggatcgtctgaacgcggaagcgcggggcattggactagcgagtcctccgtgtcaggaagcaccggacagtggcattcggaatccgggtccttccggccagattcgccgggctcaggcaatgctagacctaacaacccggattggggcacctttgaggaggtatcgggaaatgtaagccctggaacgcggagggagtaccacaccgaaaagctcgtcacctcgaagggtgataaggaactgcgcactggaaaggaaaaggttacgtccggaagcactaccacgacccgtagatcctgctcgaaaactgtgactaaaaccgtgataggcccagatggacataaggaagtgaccaaagaggtggtcactagcgaggacggttcggactgcccggaggcgatggatctgggcaccctttccgggatcggaaccctggacggctttcggcataggcacccagatgaagcggcatttttcgacaccgccagcactggcaagaccttccccggcttcttctcaccgatgctgggcgaattcgtctccgagactgaaagccgcggatcggagagcggaattttcactaatactaaggaatcatccagccatcatccgggcatcgcggagttcccgtcaagggggaaatcctcgtcatactccaagcaatttacctcatcgacgtcatacaacagaggcgactcaacgttcgagtcgaagtcttacaagatggcagacgaagctggatcagaggcagatcacgaaggcactcacagtactaagcgaggacacgcaaagagcagacctgttagagattgcgacgacgtgctccaaacgcacccgtcgggcacccagtcaggaatcttcaacattaaactccccggctcctccaaaatcttcagcgtttactgcgaccaagaaacttcgcttggtggatggctcctcatccagcagcgcatggatggatcacttaacttcaaccgcacctggcaggactataagcgcggatttgggtcactgaatgatgaaggggaaggagaattctggctcggaaatgactatctccacttgctcacgcagcgcgggtcagtgctgcgagtcgaactcgaagattgggccgggaacgaggcctacgcggaataccactttagggtgggatcagaagctgaggggtacgccctccaggtgtcatcatacgaggggaccgcgggagatgcactgattgaggggtccgtggaggaaggagccgaatacacttcgcacaataacatgcaattctcgactttcgatcgggacgctgaccagtgggaagagaactgtgccgaggtgtacggaggcgggtggtggtacaacaattgtcaggcggccaacctgaacggaatctattacccaggaggatcctacgacccacgcaacaattctccgtacgaaatcgaaaacggcgtggtgtgggtatctttcagaggcgctgattactcgttgcgcgcagtgcggatgaagatccggccactggtcactcaa

SEQ ID NO: 11056 - DNA, 2598 bp, Artificial Sequence
  Description of Artificial Sequence: Synthetic coding sequence
atgttttccatgagaattgtctgcctggtcctctcagttgtgggcaccgcctggactgccgacagcggggaaggagacttcttagccgaaggagggggggtaaggggcccccgggtagtagagaggcaccagagcgcctgcaaggatagtgactggccgttctgttcagatgaggattggaattacaaatgcccttccgggtgtcggatgaaaggccttatagatgaggtgaaccaagatttcaccaatcgaatcaacaagttaaagaactccctcttcgaataccagaaaaacaacaaggacagccacagtctgaccacgaatatcatggagatacttcgcggagatttttcttcggctaataatcgcgataatacatataaccgggtgagtgaagacctacgcagcagaatcgaggtgctcaagaggaaggtgatagagaaggtccagcatattcagctgctccagaaaaacgtgagagctcagctagtagatatgaagcgtctggaggtggacatcgacatcaagattaggtcatgtcgagggagctgctcccgagctttagcacgggaagtagatctaaaggactatgaggatcagcagaagcagcttgagcaagttatcgccaaagacttgttgcccagccgggatcggcagcatcttccactgatcaagatgaagccagttcctgatctagtgccaggaaactttaagagccaactgcagaaggtgccaccggagtggaaggccttaactgatatgcctcagatgaggatggaactggagagacctgggggaaacgagatcacccgtggagggtctaccagctacggaacagggtccgaaaccgagtcccctcggaaccctagctccgccgggtcatggaatagcggcagtagtggtcccgggtccacagggaacagaaaccctggctcttcaggcaccggtggcactgcaacttggaaacccggatcttccggcccaggcagcacgggcagctggaactctggaagttctgggacaggatctacaggcaatcagaatcctgggtccccacgtccaggcagcacaggtacttggaacccagggtctagcgaaagggggagtgcgggtcattggacaagcgagtcaagtgtgagcggtagtaccgggcagtggcactctgaaagcggctcttttcggcccgacagtccaggctctggtaacgctcgtccaaataaccccgactggggcacgtttgaggaggtgtctggaaacgtgagccctgggacaaggagggagtatcacacggaaaagctggtcacaagcaaaggggataaggaactgcgtaccggtaaagagaaagttacctccggctcaactacgaccacccggcgcagctgctctaaaacggtgacgaagacggtaattggacccgatggtcacaaagaagttacaaaggaagtggtgacatccgaggacgggagcgattgtcccgaggcaatggacttggggaccttgtccggcattggaactctggatggctttcgccacaggcatccagacgaggctgctttctttgataccgcatccacgggtaaaacatttcctggtttcttcagccctatgttgggcgagttcgtgagcgaaactgaaagccggggtagcgaaagcggtatcttcactaatacaaaagagagttcaagccaccatcccggtattgcagagtttccatccaggggcaagtcttccagctacagtaaacagtttactagcagcacttcatataatcggggggattcaacctttgaatcgaaatcctacaaaatggctgatgaggccgggagtgaggccgatcatgaaggcactcattctacaaagagggggcacgccaaaagtcgccctgtgagggattgtgatgatgtgctgcaaacccaccccagtggcacccagagcggcatttttaatatcaagctgccaggaagttcgaagattttcagtgtctattgcgaccaggagacgagtcttgggggctggctgctgatacagcagcgtatggatggtagccttaacttcaaccgcacatggcaggactacaaaagaggttttgggtccctgaatgatgagggcgagggagaattttggctggggaatgattatctgcatcttcttacgcagcgcggatccgtattgagggtcgaactggaggactgggccgggaatgaggcttacgcagagtatcactttcgcgtgggcagtgaggccgagggctacgcccttcaggtatcttcctacgaaggaaccgccggagacgccctgatagagggctccgtggaagagggcgccgagtacacaagtcacaacaatatgcagttttccacttttgatcgagacgcggaccagtgggaagaaaattgcgccgaagtctatggcggaggttggtggtataataactgccaggccgctaatctcaatgggatttactaccccgggggctcctatgatccccggaacaatagtccctatgagattgaaaacggagtggtctgggtgtcctttagaggcgcagactattccctgcgcgctgtaaggatgaagatccgccctcttgtaactcag

SEQ ID NO: 11057 - DNA, 2598 bp, Artificial Sequence
  Description of Artificial Sequence: Synthetic coding sequence
atgttctcaatgaggatcgtctgtcttgttctgagcgtggtcggcaccgcctggaccgccgattcgggtgagggggactttcttgcagaaggtggaggcgtgagaggcccgcgggtcgtggagcgccaccaaagcgcatgtaaagattcggattggccattttgttcagacgaggactggaattacaagtgtccgtcaggctgccggatgaaaggacttattgacgaggtgaaccaagatttcaccaacaggatcaacaaacttaagaactcactctttgagtaccagaagaataacaaggattcgcactcgctcacgaccaacataatggagattcttcgcggtgacttttcatcggcaaacaaccgggacaatacctacaaccgtgtgtcggaggacctccgctcccgcattgaggtgctgaagagaaaggtcatcgaaaaagtgcagcatattcagctgttgcagaagaacgtccgggcacagttggtggatatgaagagactggaagtcgatattgacataaagataagatcgtgtcgcggatcttgctcgagggcacttgcaagggaagttgatctgaaggattacgaggatcagcagaagcaactcgaacaagtgattgcgaaagaccttcttccctcaagagatcgacagcatctgcctcttatcaagatgaaacccgtgccggatctcgtgcccggaaactttaagtcgcaactgcaaaaggttcctccagaatggaaggcactgaccgatatgccccaaatgcgcatggaactcgaaagaccagggggaaacgaaattacccggggtgggtccacttcctacggcaccgggagcgaaacggaatcccctagaaatccctcgtccgccggttcttggaactccggtagctcgggcccaggttcgacgggcaatagaaaccccgggtcgtccggaaccggtgggactgcaacttggaagccaggaagcagcggtcccggatcaaccggcagctggaacagcggttcctctggaaccggttctactggaaaccaaaaccccggttcaccaagaccgggcagcactgggacctggaatcccggatcgtcggaacgcgggtcggcaggccactggacttccgaatcctccgtgtcgggatcaaccggtcagtggcattcggaatcaggttcgtttcggcctgatagcccgggctcgggtaatgcaagaccaaacaaccctgattggggtacctttgaagaagtgtcaggaaatgtgtcgccaggaacccgacgggaataccacactgagaaacttgtgactagcaaaggggataaggaattgcgcaccggaaaggaaaaggtgacttccggatcgaccaccactactcgtcgctcctgctcaaagactgtgactaagaccgtgattggacccgatgggcacaaggaagtgactaaagaggtggtcacgagcgaggacggatcggattgccctgaggcgatggacctcggcaccctctccggaatcggtaccctcgatggatttcggcatagacatccagacgaggctgcgtttttcgataccgcatcgaccggaaagacgtttcctggcttcttttctccaatgctgggagaatttgtcagcgaaactgagagcagaggatcagaatctgggatattcaccaataccaaggaatcttcatcccatcatccaggaatcgcagaattcccttcccggggtaaatcgagctcgtactcgaaacaatttactagctcgaccagctacaataggggagactcgacctttgaatccaaatcttacaagatggcggatgaggcaggaagcgaggccgaccatgaggggacccacagcaccaaacgaggccatgctaagtcacgcccagtgcgcgattgtgacgatgtgctgcaaacccatccttcggggactcagtcaggtattttcaacataaagctgcccggttcctcaaagatctttagcgtctactgtgatcaggagactagcttgggagggtggcttcttattcagcaacgcatggacgggagcctgaacttcaatcgaacttggcaagactacaagcgcggatttgggtccctgaacgatgaaggagaaggcgaattttggctcggaaatgattacctgcatcttctcactcaacgcgggagcgtgctccgcgtcgaactggaagattgggctgggaacgaagcatacgcggagtaccatttccgtgtcggatcagaagcagagggttacgcactgcaggtgtcatcgtacgaaggtactgccggagatgcactcatagaaggaagcgtggaagagggcgcagagtacacttcacacaataacatgcaatttagcacttttgatcgagatgccgatcaatgggaggaaaactgcgccgaagtctatggaggtggatggtggtacaacaattgtcaggcagctaatctcaacggtatctactatccaggcggttcctacgatcccaggaataactccccatacgaaatcgaaaatggtgtggtgtgggtgagcttcagaggtgccgactattcgctccgggcggtgcgcatgaaaatccgtccgttggtcacccaa

SEQ ID NO: 11058 - DNA, 2598 bp, Artificial Sequence
  Description of Artificial Sequence: Synthetic coding sequence
atgttcagtatgagaatcgtctgcctggtcctctcagtcgtgggaaccgcctggaccgcagactcaggggaaggtgacttcctggccgagggcggaggagtccgcggccctagagtggtggaacgccatcaatcagcctgcaaagattcggactggcctttctgtagcgacgaagattggaactacaagtgcccctcgggatgcaggatgaaggggttgatcgacgaggtgaatcaagactttactaataggatcaacaagctcaagaactcactgtttgagtaccagaaaaacaacaaagattcccattccctgacgaccaacatcatggaaattcttagaggcgatttttccagtgcgaataaccgggataatacctacaacagagtgagcgaggacctgcgctcccggatcgaagtgcttaaacgcaaggtgattgagaaggtgcagcacatccagttgctgcagaagaatgtgcgcgcgcagctggtggacatgaaacggctggaggtggacatcgacataaagatccggtcttgccggggaagctgttctcgcgccctcgcgcgggaagttgacctgaaggactacgaggatcaacagaagcaactcgaacaggttattgccaaggatctgctgccttcgcgcgatagacaacacctcccgttgatcaagatgaagccagtcccggatctggtgccagggaacttcaagtcccaactgcaaaaagtgcccccagaatggaaggcactgactgacatgccgcagatgagaatggagctcgaacgtcccggcggaaatgaaataaccagaggcgggtccacctcgtacggcaccggctcagaaacggagtcgccgcggaacccgtcgagcgccggttcatggaactctggatcctcgggaccgggttcaactggaaacagaaacccagggtcaagcggaactggaggaaccgcgacttggaagccgggatccagcggccccggaagtacgggatcgtggaactcgggatcttcaggaacgggatccactgggaatcagaatccgggaagcccacgcccgggatcgaccggaacttggaaccccggatcctctgaacgcggctccgctggacactggacctcggaaagctccgtgtcgggcagcacgggacaatggcactccgagtccggaagttttcgccctgacagcccgggctctggaaacgcacgccctaacaaccccgactggggcacgttcgaggaggtgtcaggaaatgtgagcccagggacccgacgcgagtaccataccgaaaagctggtcacgtcgaagggcgataaggagctgaggactgggaaagagaaggtcaccagcggatcaaccactaccacccggaggtcctgctccaagactgttactaagactgtgatcggtcctgacggtcataaagaggtgactaaagaagtcgtgacttcggaggacggatccgactgcccggaggcgatggatctcgggactctgtccggtatcggcaccttggacgggttccggcatcggcacccagatgaggccgctttcttcgataccgcctcaactggcaagactttcccgggtttcttctcgccaatgctcggagagtttgtgtcagaaaccgagtcgcgaggatcggagtccggtatcttcaccaacactaaagaaagctcatcacaccatccgggaatcgcggaattcccgtcgagagggaagagttccagctactcgaaacagtttacttcaagcacctcctacaacaggggagacagtaccttcgagtcgaagtcatacaaaatggccgacgaagccggtagcgaggctgatcatgaagggacgcacagcaccaagcgaggccatgccaaatcacggccagtgcgggattgtgacgacgtgttgcaaacccacccttctggcacccagagcgggattttcaacattaaactccctggatcgtccaagatcttttccgtatactgcgatcaggagactagtctgggaggctggcttctgatccagcaacgcatggacggctccctgaactttaatcggacttggcaggattacaagagaggtttcggctcacttaacgatgaaggtgagggcgaattctggcttggaaacgactacctccacctgctcactcagcgcggaagcgtcctgcgggtggaactcgaggactgggctggtaatgaggcttacgcggaataccacttccgcgtcggatctgaagcggaaggatacgcactccaggtatcctcgtacgaaggaaccgcaggggacgccctcatcgaaggatcggtggaagaaggagcggaatacacctcccacaacaatatgcagttctctaccttcgacagggacgcagatcagtgggaagaaaattgcgctgaggtgtacgggggcggatggtggtacaacaattgtcaggccgcaaatctgaatggaatctattatccgggcggatcgtacgacccccgcaataactctccgtacgaaatcgaaaacggtgtcgtgtgggtgtcattcagaggagcagattattcgttgagagctgtgcgcatgaaaatcaggccgctggtcactcaa

SEQ ID NO: 11059 - DNA, 2598 bp, Artificial Sequence
  Description of Artificial Sequence: Synthetic coding sequence
atgttctccatgcgcatcgtgtgcctggtgctgtccgtggtcggaacggcctggactgctgactccggcgaaggggacttcctggcggaagggggtggagtgcgcggaccgcgggtggtggaacggcatcagtcggcctgcaaagattcggattggccattttgttcggacgaggactggaattacaagtgtccatcggggtgtaggatgaaaggcctcattgacgaggtgaaccaggacttcacgaacaggatcaacaagttgaagaattcgctctttgaataccaaaagaacaacaaagactcacactcgctgaccactaatatcatggaaatccttagaggagacttcagttcggcaaacaaccgggataatacctacaatagggtcagcgaagacctgcgcagccggatcgaggtcctgaagcggaaggtcatcgaaaaggtgcagcatatccaactgctgcaaaagaatgtcagggcccaactggtcgacatgaagcgccttgaagttgacattgatatcaaaatccggtcatgccgcggctcgtgcagccgggccttggcaagagaagtcgacctgaaggactacgaagaccagcagaagcagctggagcaggtgatcgctaaggatctcctgccatcaagggacagacagcaccttccactcatcaaaatgaagcccgtccctgatcttgtgccaggcaacttcaaatcccagttgcaaaaagtgccaccggagtggaaggctctgactgacatgccgcaaatgcggatggagctcgaacggccggggggaaatgaaatcaccagaggcggcagcacctcgtacggcactggatcagaaactgagtcgccgcgcaacccgagctcggcaggttcatggaacagcgggagctccggacccggttcaaccggaaatcggaacccgggcagctctggcacgggtggcactgccacctggaaacccggctcaagtggacctggaagcaccggttcctggaactctggctcgtcgggaactggtagtaccgggaaccagaaccccggctcaccgcggcctggatcaacgggaacgtggaaccctggttcatccgagcgcgggtcagccggacattggactagcgaaagttccgtgtccgggtccaccggccagtggcactcggaaagcggctcatttcggccagattcgccaggttcggggaacgccaggccaaataacccggactgggggacctttgaagaggtgtcgggcaatgtgtcaccgggaacccgcagagaataccataccgagaagctcgtgacctcaaagggagacaaggagctgcgaactggaaaggaaaaggtgacctcgggatcgaccaccactactaggcgttcgtgctccaaaactgtgaccaagaccgtgatcggacctgacggccataaggaggtgaccaaggaggtggtgaccagcgaagatggatccgactgtccggaggccatggacttggggactctctccggtatcgggaccctggatgggttccgccaccgccatccggacgaagctgcgttcttcgataccgcttcaactggaaaaacctttccgggattcttctcgccgatgctcggtgagtttgtgtccgaaactgaaagccgcggaagtgagtccggaattttcactaacactaaggaatcatcctcacatcacccaggaatcgcagaattcccatcgcgaggtaaaagttcgtcctacagcaagcaattcacctccagcacttcctacaaccgcggagactcgactttcgaatccaagtcatacaagatggcggacgaagcagggtccgaagccgaccatgagggtacccacagtaccaaacgcggacacgcaaagtcaagacctgtgcgcgattgcgatgatgtgcttcagacgcacccgagcggaactcaatcgggaattttcaacattaaactgcccgggtcatcaaagatcttttccgtatactgcgaccaagaaacgtctctgggtggatggctcctgatccaacagagaatggacggatcactcaacttcaatcgcacttggcaggattacaaacgcggctttggaagcctgaacgatgagggagagggcgagttctggctgggaaacgactacctgcacttgctgactcagagagggagcgttctgcgggtcgaactcgaggattgggcgggaaatgaagcgtacgccgaatatcacttcagagtcggatcagaagcagagggctacgcccttcaagtgtcctcctacgagggaactgccggcgatgccctgatcgaaggatcagttgaagagggagccgaatacaccagtcacaacaatatgcagttcagcacgttcgaccgggacgcagatcaatgggaagagaattgcgctgaggtctacggcggaggctggtggtacaataactgccaggccgcgaacctcaatggaatatactatcctggaggatcctacgatccccggaataactccccgtatgagatcgagaacggagtcgtgtgggtttcattcagaggagcggactactctctccgcgcggtgagaatgaagatcagacctctggtcacccag

SEQ ID NO: 11060 - DNA, 2598 bp, Artificial Sequence
  Description of Artificial Sequence: Synthetic coding sequence
atgttctcgatgcggatcgtgtgtctcgtgctgtctgtggtgggaacggcttggaccgcagatagcggcgagggcgactttttggccgaaggtggtggtgtgcgcggaccgcgcgtcgtcgaaaggcatcagtctgcctgcaaggattcggattggccattctgctcggatgaggactggaattacaagtgcccttccgggtgccgcatgaagggactgatcgacgaggtgaatcaagactttactaatcgcattaacaaattgaagaatagcttgttcgaataccagaaaaacaacaaggattcccattcactcactactaatatcatggaaatccttcgcggagacttctcctctgccaataatcgcgataatacctacaacagagtctctgaggatctgcggtcccgcattgaagtgcttaagcgtaaagtcattgagaaggtgcagcacattcagctgctccaaaagaacgtccgcgcacagctcgtcgacatgaagcggctggaagtcgacatcgatatcaaaatacggtcatgtaggggatcgtgctcgagagcgctggccagggaagtggacctgaaggactacgaggaccagcaaaagcagctcgaacaggtcatcgccaaagatttgcttccatcccgcgaccggcagcacctgccgctcatcaaaatgaagccggtgccggatctcgtgcctggaaactttaagtcacagttgcagaaggtgcccccggagtggaaggcgctcacggacatgccgcaaatgagaatggaattggaacggccgggtggcaacgagatcacccgcggaggatccacctcgtatggtaccgggtcagaaactgaatctccgcggaatccctcgagcgccggatcctggaatagcggaagctctggacctggtagcaccggaaataggaacccaggatcgtccggaaccggaggaaccgctacttggaagccgggctcttcgggaccgggatccacggggtcgtggaactccggatcctcgggaactggatcgaccggcaaccagaatccagggtcaccgcgcccaggttccactggtacttggaaccctggctcttccgaacgtggtagcgcggggcactggaccagcgaatcatctgtgtccggatcaaccgggcagtggcactcggagagcgggtcattcagaccggactcgccgggatcgggcaacgcccgcccaaacaaccccgattggggtacttttgaagaggtcagcggaaatgtgagcccgggtacccgcagagaataccacaccgaaaagctcgtgacttcgaagggcgacaaagagctgcgcaccggaaaggaaaaggtcactagcggatcaaccaccaccactagaaggagctgcagcaagaccgtcaccaagaccgtgattggacccgacggacacaaggaagtgactaaagaagtggtgacctcggaagatggctcggactgtccagaggccatggacctgggcaccctttcggggattgggaccttggatggctttcggcacagacacccagacgaggcagccttctttgataccgccagcactggaaagactttccctggattcttctccccaatgctgggcgaattcgtctcagaaactgagagccgcggaagcgaatcgggaatctttaccaacacgaaagagtcgagcagccatcatcctggaatcgcggaattcccttcgagagggaaatcctcctcctacagcaagcaattcacgtcgtcaacctcctacaatcggggagacagcaccttcgagtcgaagtcctacaagatggcggacgaggcggggtctgaagccgatcacgaaggcacccattcgacgaaacgcggccacgcaaagtcgaggccagtccgggactgcgatgatgtcctccagacccacccgtcgggaacccagtccggcattttcaatatcaaactgccaggaagcagcaaaatcttctccgtgtactgcgaccaggaaaccagcttgggtggatggctgctgatccagcagaggatggacggtagtctcaatttcaacagaacttggcaagattacaagcggggctttggctcactgaacgacgaaggcgaaggggagttctggctcggaaacgattacctccacctgcttacccaaagaggctcggtgctgagggtggaactggaagattgggcgggcaatgaagcgtacgcagaataccacttccgcgtcggttcagaagctgaggggtacgcgctgcaggtgtccagctacgagggcacggcgggagatgctctcatcgaggggtcagtcgaagaaggggccgaatacacgtcccacaacaatatgcagtttagcaccttcgatcgagacgccgaccaatgggaagagaattgcgcggaagtgtacggcggcggatggtggtacaataactgtcaggccgccaacctcaatggcatctactaccctggaggctcatacgacccgcgcaacaactcaccgtacgaaatcgagaacggagtggtctgggtgtcatttcgcggcgccgactactcgctgcgggcggtgagaatgaagatccggccactggttacccaa

SEQ ID NO: 11061 - DNA, 2598 bp, Artificial Sequence
  Description of Artificial Sequence: Synthetic coding sequence
atgtttagtatgaggatcgtttgtctggttcttagcgtggttggcaccgcttggaccgctgatagtggtgaaggggacttcttggctgaggggggcggcgtgcgcggccctcgggtagtggagaggcatcagagtgcatgcaaggattccgattggcccttctgtagtgatgaggactggaactataagtgcccttcagggtgtagaatgaaaggcctgatagatgaggtaaaccaggatttcaccaatagaatcaacaagttaaagaattccctgttcgagtaccaaaagaataataaggactctcactcattaactacgaacatcatggagatcttgcgaggggacttctcttccgcgaacaaccgagataacacatataatagagtgagcgaggaccttaggagcagaatagaggttcttaagagaaaagtgattgaaaaggttcagcacatacaactgttgcagaagaacgtgcgcgcccaactcgtggatatgaagaggttggaggtagacatcgacataaaaattagatcttgcaggggaagctgttcacgagctctcgcacgtgaagttgacctcaaggactatgaggaccaacagaaacagttagaacaagtgattgcgaaggatctgctgccctcgagggacagacagcatctcccattgattaaaatgaagcccgtcccagatctggttccaggaaattttaagagccagctccagaaggtcccaccggaatggaaggctctgaccgatatgcctcagatgaggatggagctcgaacgacccggtggtaacgagatcacccgcggtggttccacatcctacgggactgggagcgaaacagagtctccgaggaacccgtcctcagctggtagctggaattccggaagttcagggcccggatcaacagggaaccgaaatccaggcagttccgggacaggggggaccgcaacttggaagcctggcagcagcgggcccgggagtacaggttcttggaactcaggcagttctgggacgggatccacaggtaatcagaacccaggctctcccaggcctggatctacaggcacttggaaccccgggagctcggagagaggatctgccggccattggacaagtgagagttctgtctccgggtctaccggtcaatggcactcagagtcgggctcgttcaggccggattctcctggaagtggaaatgcaaggcccaataatcccgattggggtacattcgaggaagtatccgggaatgtttcccccggcactagacgcgaatatcatacagagaagctggttacaagcaaaggcgataaggaactgagaacaggaaaagaaaaggtcacttcaggttctaccacaaccaccaggcgaagctgctcaaagactgtgaccaaaactgtgataggtcctgacggccacaaagaagtaacaaaggaggtcgtgacatcagaagatgggtccgactgtcccgaggcgatggatttaggcacactgtcgggcattggcacactggatggttttaggcacagacaccccgacgaggccgccttctttgacacagcctctacgggaaagacctttcccgggtttttctctcccatgcttggcgaattcgtaagcgaaacggagtccagaggctctgaatctggcattttcaccaatacgaaggagtccagctctcaccaccccgggattgctgaatttccgtctaggggcaagtcttcgtcatactctaagcaattcacgtcttcaacctcctataatagaggcgatagtaccttcgagagcaaatcatataaaatggctgacgaagccggatcagaggccgaccatgaaggaacacactccactaaaagaggacatgcaaagagcagaccggtccgagattgcgatgacgtccttcagactcatccgagcgggacacagtctggaatattcaacattaaactcccaggcagctcaaaaatattcagcgtctattgtgaccaggagacttcactgggaggatggctgcttatccagcagaggatggacgggtccctcaacttcaaccgaacgtggcaggactataaacgagggttcggatctctaaatgatgagggcgaaggagaattctggctagggaatgactatctgcatctgttgacccaaagaggatccgtgctgcgggtggaacttgaggattgggccggcaacgaagcctatgcagagtatcacttcagagtcggttctgaggccgaagggtacgccctgcaagtgagctcttatgagggcacagccggagatgctttgatcgaaggatcagtggaggagggtgccgaatatacgagccataacaatatgcagtttagcacatttgaccgagacgccgaccagtgggaagaaaattgtgccgaggtttatggcgggggctggtggtataataattgtcaggccgcgaatctgaatggcatctattaccccggagggtcctacgacccacggaataattctccttatgagatcgagaatggagtcgtctgggtgtcctttaggggagccgactatagcctgagagcggtgaggatgaaaatcagaccactggtaacgcaa

SEQ ID NO: 11062 - DNA, 2598 bp, Artificial Sequence
  Description of Artificial Sequence: Synthetic coding sequence
atgttttctatgcgaattgtttgcctcgtcctgtcagttgttggaaccgcatggaccgctgactccggcgaaggcgacttcctcgccgaaggcggaggcgtgagggggcctcgggtcgtcgaacgtcatcaaagcgcctgtaaggactcagactggcccttttgctccgacgaggactggaactataagtgtccttccggctgcaggatgaaggggctaatagatgaggtcaatcaggattttaccaataggattaataagcttaagaatagcttatttgaataccagaaaaataacaaagactcacactctctgaccacgaatatcatggagatcctgaggggggatttttcctcagctaataacagagataatacctataaccgagtctcggaggatctgagatctcgaatagaagtgctcaaacggaaggtcattgaaaaagtacagcacatccagctgcttcagaagaatgtgcgtgctcagctggtcgacatgaagagactggaagtggatattgacattaagatccggtcgtgcaggggttcctgttcacgggccctggctcgagaggtggatcttaaggactatgaagatcagcaaaaacagctggaacaggtcatagctaaggatctgctgccctccagagacaggcaacacctgcccttaataaaaatgaagcccgtgcctgatctcgtccctggcaactttaagtcacagctgcaaaaggtgccacctgagtggaaagcattgaccgatatgcctcagatgcgcatggagttggaaaggccgggggggaatgagattacccgcggcggctctacctcttacggtaccggaagcgaaactgagtccccacgtaatccatccagcgcggggagttggaactcaggatcctccggacctggatcaacaggtaaccgcaatcctggatcaagcggaaccggcggcacagcaacatggaagcctggctcgagcgggcctggctccaccgggtcctggaactccgggagtagtggtactggctccactggcaatcaaaaccctggttcacccaggccagggagtacaggcacttggaatccaggatctagtgagaggggttctgcaggccactggacctcggagagcagtgtgtcagggagcacaggacaatggcactccgagagcgggtcctttcgcccagattcacccggaagtggaaatgcccgccccaataaccccgactggggcacattcgaagaggtctctggcaacgtgtctccgggaactagacgcgaataccataccgagaagctggtgactagcaagggggataaggagttgcgtacaggcaaggagaaagtcacttctgggtcaaccacaactactaggcggtcctgtagtaagaccgttacgaaaactgtgatcggaccagacggccataaagaagtgacaaaggaggtggtgacatcggaggacggttccgattgccctgaggccatggacctgggcactttgtcagggataggtacactagatggattcaggcatcgacatccagacgaggctgcattcttcgacactgcctcaacaggaaaaacttttccaggtttctttagtcccatgctgggagagtttgtgtccgagactgagtcccgcggttctgagtccggcatatttaccaatacaaaagagtctagcagccaccatcctggtatagctgagttccctagcagaggtaaaagcagttcctactccaagcagtttacctccagtacatcttacaatagaggcgacagtacattcgagtcgaagtcatacaaaatggccgacgaagcgggctcagaggcggatcacgagggcacacactccactaagcgtggccacgccaagagcaggcccgttagagattgcgacgacgtccttcagacacacccctcaggcacacaatcaggcattttcaatatcaagctgcctggaagttctaagattttcagtgtttattgcgaccaggaaacgtcgttgggaggctggcttctgatccagcagagaatggatggatcccttaattttaatcgtacgtggcaggactataagagaggtttcgggagcttaaatgacgagggagagggcgagttctggttgggtaatgactatctacatctcctgacgcagaggggttccgtgctaagagtcgagctcgaggattgggcaggaaacgaagcatacgctgagtatcattttcgggtggggagcgaggccgagggatatgcattacaggtaagcagctatgaagggacggcgggagatgcccttatcgaaggttccgtcgaggaaggggccgaatatacatcccataataacatgcagttcagtactttcgaccgggacgctgaccagtgggaggagaattgtgccgaggtatatggcggcggatggtggtacaacaactgccaagctgccaacttaaatgggatctactatcccggagggtcatatgacccccgtaataacagtccttacgagattgagaatggtgttgtgtgggtgagctttcggggcgctgattactctttgagggcggtgcgaatgaagattaggcctctcgtaacccag

SEQ ID NO: 11063 - DNA, 2598 bp, Artificial Sequence
  Description of Artificial Sequence: Synthetic coding sequence
atgttttccatgcgtatcgtgtgcctggtgctgagtgtcgtgggcacagcatggaccgctgattctggagaaggagactttcttgccgagggtggcggggttcggggccctcgggtggtagagcgtcatcagagtgcctgcaaagacagtgattggccattctgttccgacgaagattggaattacaagtgtccctcaggatgccgaatgaaaggtctgatagacgaggttaaccaggattttacaaataggatcaataagctgaaaaattccctgtttgagtaccagaagaataataaggattctcactcgcttacaaccaacataatggagatcttgcggggtgatttctctagtgctaacaatcgggataacacctataatcgagtgagcgaggacttgcggtcccggatcgaggtgttgaaacgcaaggtgatagagaaggtgcaacacatccagttgctgcagaagaatgtaagggcccagcttgtcgacatgaagagactcgaagtggatatagacattaagattcggtcctgcaggggcagctgcagccgagccctcgccagagaagtcgatctaaaagattacgaagaccagcagaagcaactggaacaggttattgctaaagacctgctcccctcaagagaccgacagcatcttcccctcatcaagatgaaaccggtacccgatcttgtgccagggaatttcaaatcacagctgcagaaggtaccccccgagtggaaagccttgacggatatgccacaaatgcggatggaactcgagcgcccaggaggcaatgagatcactagaggcggatcaacgagttatggcaccggctctgaaaccgagtcgccgaggaatccatcctcggccgggtcttggaactccgggtcatccggacccggttccaccgggaaccggaacccagggtcctccggcacgggtggtacagctacctggaaacccgggtccagcggccctggatcaaccggctcctggaactccggaagttctggcacaggtagcacaggcaatcagaaccccggttctccccggcctggatccacggggacatggaatcctggctcttcagagagggggagcgccgggcactggacctcagagagctcagtcagcggtagcaccggacagtggcattccgagtcgggatccttccggcctgactcccctgggtccggcaatgctaggcccaacaacccagactggggtactttcgaagaggttagcggaaatgtcagtcccgggacaaggcgagaataccatacagaaaaactagtcacctcaaagggcgataaggagctgcggactggcaaggagaaagtgacctctggctccacaaccaccacccgtcggtcttgcagcaagaccgtgacaaagacagtgatcggtcccgatggccataaggaagtgactaaggaagttgtcacgagcgaggacggcagcgactgtcccgaggcaatggatctcggaaccttatccggtatcggaacgctggatgggttccgtcatagacaccccgacgaggccgcattcttcgacaccgcgagcactggcaaaaccttccccggatttttttcccctatgctcggtgagtttgtttccgagactgaatctcgagggtcagagtcggggatcttcaccaacacaaaggaaagctccagccaccacccagggatcgccgagttcccatcacgcggcaagagttcctcctattcaaagcagtttaccagcagtacatcttacaaccggggagattcaactttcgaatcaaagtcttacaagatggccgatgaggccggatcagaggccgaccacgagggtacacattcaactaaacgagggcatgcaaagtcccggccggttagagattgcgatgatgttcttcaaacacacccctcagggacgcaaagcggtattttcaacatcaaacttcccgggtcctcaaaaattttctctgtgtactgtgatcaggaaacttctttaggcggctggctcctaatacaacagcgcatggatgggtccctcaacttcaaccgaacctggcaggactacaagaggggcttcgggtcactgaatgacgagggcgagggagaattttggctgggcaacgattatctgcacctcctgacccaacgagggagtgttttgcgggtggagctggaggattgggccggtaatgaggcatatgcggaatatcacttccgcgtgggaagtgaggctgagggctatgcattacaggtcagttcgtacgaaggtaccgctggagacgccttaatagaaggctctgtggaagagggtgctgagtacacttcacataacaacatgcagttcagcaccttcgaccgcgatgcggaccagtgggaggaaaattgcgccgaggtgtatgggggagggtggtggtataataattgccaggccgctaatttaaatgggatttactacccagggggcagttatgatcccaggaacaactcaccgtatgaaatcgaaaacggagtggtatgggtcagtttcagaggggccgactacagtctgcgggctgtgagaatgaaaattcgccccctggtgacccaa

SEQ ID NO: 11064 - DNA, 2598 bp, Artificial Sequence
  Description of Artificial Sequence: Synthetic coding sequence
atgttctcaatgagaatcgtgtgtcttgtgctgtccgtggtcggaactgcgtggaccgccgactccggagaaggggatttcctcgccgagggcggaggtgtgcgggggccgagagtggttgaaagacatcagtccgcgtgcaaggactcggactggcctttctgctcagacgaggactggaactacaagtgcccttcgggatgcaggatgaagggactcatcgatgaagtcaaccaggatttcaccaacagaatcaacaagctgaagaattcgctgttcgagtaccaaaagaacaataaggacagccactccctcaccaccaatatcatggagattctgcgcggggattttagcagcgccaacaatagggacaatacttacaaccgagtgagcgaggatctccggtcgcgcatcgaagtgctgaagagaaaggtgatcgaaaaggtgcagcacattcaattgcttcagaagaatgtgcgcgcccagctggtggacatgaagagactggaggtggacattgacatcaagatccgttcgtgccggggatcctgctcgagggccctggcgcgggaggtggacttgaaggactacgaagatcagcaaaagcagctggaacaagtgatcgcaaaggatctgctgccgagccgggacagacagcatctgccgctgatcaagatgaagccagtgcctgacctcgtcccggggaatttcaaatcacagctgcaaaaagtgcctcctgaatggaaggccctcactgacatgcctcaaatgcggatggagctcgagcggccggggggtaacgagatcactcgcggtggctctacttcctacggcacgggctcagaaactgagtcgccgcgcaacccatcttccgcggggagctggaatagcggaagcagcggaccgggctccaccggcaatcggaacccgggatcatcgggtactggaggtaccgccacttggaagccgggttcgagcggacccggatcgaccggatcctggaactcggggtcgtcgggaactggatcgactgggaaccagaatccggggtcgccgcggcccggatccaccggcacgtggaatcctggttctagcgaaagaggatccgccggacattggacttcggaaagctcagtgtctggttcaaccggacaatggcactcagagtcaggatcgttccggccggattcgccgggaagcggaaatgccaggcccaataacccggactggggtaccttcgaggaggtgtcaggaaacgtgtccccgggtaccagacgcgagtaccacaccgaaaagctggtgacctccaaaggcgacaaagagttgaggaccggcaaggagaaggtcacgtcaggcagcacgaccacgacccgccgatcatgcagtaaaaccgtgactaagactgtgattggaccggatggtcataaggaggtcaccaaggaagtcgtgacgtcagaagatggctcggattgccctgaggcgatggacctgggaaccctttcgggaatcgggactctcgacggattcaggcataggcatccagacgaagcggcttttttcgataccgcgtctaccggcaaaactttcccgggctttttcagcccgatgctcggagaattcgtctcagagacggagtcccgcggttcggaaagcggaatcttcaccaataccaaggagtcgtcctcccaccatccggggatcgcggagttcccttcaagaggaaaatcctcctcctactcaaagcagtttacgagctcgaccagctacaatcggggcgattcaacttttgaatcaaagagctacaagatggcagatgaggctggaagcgaggctgaccatgagggtactcactccaccaagcgtggtcacgctaagtcaagaccagtgagagactgtgacgacgtccttcagacccatcccagcggaacccagtcgggaatcttcaatatcaaacttccgggatcgagcaagatctttagcgtgtactgtgatcaggaaaccagcctgggaggatggctgctgattcagcagaggatggacggatccctcaacttcaatagaacttggcaagattacaagagaggattcggctccctgaacgacgagggagagggcgaattctggctgggaaacgattacctccatctcctgacccagcgggggagcgtgctccgggtggaactggaggactgggccggaaacgaggcctacgccgagtaccatttccgcgtgggatccgaagccgaaggatatgcactgcaggtttcctcctacgagggtactgcgggcgatgccctcatcgagggatcagtggaagagggagccgagtataccagccacaataacatgcagttctcgaccttcgacagagacgctgaccagtgggaagagaactgcgcggaagtgtacggtggaggatggtggtacaataactgccaggcagctaatctgaacggaatctactaccctggaggcagctacgacccccgcaacaactccccatacgaaatcgaaaacggagtggtgtgggtttccttccggggagctgactactccctgcgggccgtcaggatgaagatccggcccctcgtgactcaa

SEQ ID NO: 11065 - DNA, 2598 bp, Artificial Sequence
  Description of Artificial Sequence: Synthetic coding sequence
atgtttagcatgaggatagtgtgcctggtccttagcgtggtgggtacagcttggaccgcagactcgggagagggcgattttcttgcggaaggcggaggagtgcgcggaccccgcgtcgttgagcggcatcagtcagcctgtaaggatagtgactggcctttttgcagtgacgaagactggaattataagtgtccatccggttgtagaatgaaaggactcatcgatgaggttaaccaggatttcaccaaccggattaacaaactcaagaacagtttgtttgaatatcagaaaaacaacaaggactcccacagcctcacaactaacatcatggaaatcctcagaggcgatttcagctctgccaacaatcgagataacacctataatcgggtgagtgaggatctgcgctcccggatagaggttctgaagagaaaggtcatcgaaaaggtgcagcatattcagcttcttcagaaaaatgtgcgagctcagctcgtagatatgaagaggctcgaggttgacatcgacatcaagatccggagttgtagagggagttgttccagagccctggcccgcgaggttgatcttaaagattacgaagaccagcaaaagcaattggaacaggttatagctaaggatttgctgccatcacgcgacaggcagcaccttcctctgatcaagatgaaaccagtaccagacttagtgcctgggaattttaagtcccagctccagaaagttcctcccgagtggaaagcgttgacagatatgccacagatgcggatggaacttgagaggccaggaggcaacgaaatcactcgcggaggatccacatcatacggaaccggatccgagaccgaatcacctcgcaatccctccagcgcgggatcttggaatagcggctcaagcgggcctggctcgactggaaatcgcaacccagggtcttccggaaccggcggcactgccacctggaagcctggatcgtctggccccgggtctacaggtagttggaactctgggtccagcggcacgggcagtacagggaaccagaaccctggatcccctaggcccggcagcaccggaacttggaaccccggttcgtctgaacggggttctgcagggcactggactagcgagtccagcgtgtccgggtcaaccggccagtggcactcggagtctggatctttccgccctgactccccaggttccggcaacgctcgaccgaataatcctgactggggaacctttgaggaggtgtcgggaaatgtgtcacccggtacccgcagggaataccacactgagaagctcgtcacaagcaagggggataaagaactgagaacaggaaaagaaaaggtgacaagcggcagcactacaaccacacggagatcctgttctaagaccgtgacaaaaactgtcataggtcctgacggccacaaggaggtgactaaggaagtcgtgacctcagaagacggaagcgactgcccagaagcaatggatttgggcaccctttccggcattgggacattggacggctttcgacaccgccatcctgatgaggccgcttttttcgatacagctagcactggtaaaacttttcccggcttcttcagtcctatgctaggcgaattcgtatccgaaactgagtcccgcgggtcagagtccggtatcttcacaaacaccaaagagagtagcagccaccatccgggaatcgccgaattcccctcgcggggcaagtcctccagttatagtaagcagttcaccagcagcaccagttacaaccgcggggactctacgttcgaaagcaaaagctataagatggctgatgaagccggatccgaggccgaccacgagggcacacacagtaccaagcgagggcatgctaagagccgacccgttagggattgtgacgatgtcctgcagacacatcccagcggaacacagtctggaatcttcaatatcaagctgcccggctcttctaagatcttttctgtgtattgtgatcaggaaacatcactaggcggttggcttttgatccagcagagaatggacgggtccctgaattttaatcggacttggcaggactataaaagaggttttggctcattgaacgatgagggggaaggagagttctggttgggtaatgattacctgcacctactcacccagcgtggttctgtgctccgcgttgaacttgaagattgggccggcaacgaggcttacgcggaataccacttccgggtcggcagtgaagcagaggggtatgccctgcaggtgtcaagctacgaaggtactgccggcgatgcattgattgaaggaagcgttgaagagggagcagagtacaccagtcataacaatatgcaatttagcaccttcgacagagacgccgatcagtgggaggaaaattgcgcggaagtgtatggagggggctggtggtacaacaattgccaggccgctaacctgaatggaatctattacccaggggggtcttacgatcctcgcaacaatagcccttacgagatcgaaaatggtgtagtttgggtctccttcagaggggccgattattcattacgagcagtcaggatgaaaatccgcccgcttgtcactcaa

SEQ ID NO: 11066 - DNA, 2598 bp, Artificial Sequence
  Description of Artificial Sequence: Synthetic coding sequence
atgttcagcatgcgcatcgtttgcctcgtgctctcggtggtcggtaccgcttggaccgcagattccggtgagggtgacttcctggctgagggaggtggtgtgcggggaccaagggtagttgagaggcaccaaagcgcgtgcaaagattccgactggccattttgctccgatgaggactggaattataagtgtcccagtggctgccgcatgaagggcctcattgatgaagtgaatcaagatttcactaatcgcatcaataagctgaagaacagcctgttcgagtatcagaaaaataataaggacagtcattcgctgaccactaatatcatggagattctgcgtggcgatttctccagcgcaaacaatcgagataatacgtacaaccgcgtgagcgaagatctgaggtcgcgtatcgaggttctcaagcggaaggttatagaaaaggtgcagcatatccagctcctgcagaagaacgttagggcccagctagtcgacatgaagcgcttggaggtggatatcgatataaagattcgttcgtgccggggttcctgcagccgggctctggctcgagaggtagatttgaaggactacgaggaccagcagaagcagctggagcaagtgattgcgaaggatctactcccgtccagggatcgacagcatctgccactaatcaagatgaagccggtccccgatctagtaccaggtaatttcaagtcacagctgcagaaagtaccgcctgaatggaaggcattgacagatatgcctcagatgcggatggagctagagcgcccaggaggcaacgaaatcacccgtggcggctcgacctcctacggcacgggatccgaaaccgaaagcccacggaacccctctagcgcaggctcgtggaatagcggatcgtccggaccaggctctaccggcaacagaaacccaggaagctcggggacgggtggcaccgccacctggaagccgggcagcagcggcccgggaagtacgggttcgtggaacagtggttcatcgggcactggctccacgggcaaccaaaaccctggcagcccccggccaggctcaacaggaacgtggaaccccggtagctcagagcgcgggagcgccggtcactggacgtcggaatcttccgtgtccggatccactggccagtggcactccgaatccggtagcttccgtccggattccccgggcagcggcaacgcccgcccaaataaccccgactggggtacgttcgaggaggtgtcaggcaacgtgtcccccggaacgcgtcgcgagtaccacacagagaaacttgttaccagtaaaggggacaaagaactgcgcacgggcaaagagaaggttaccagtggaagcacaactacaacgagacggtcgtgctcgaagactgtgaccaagacagttatcggccccgatggccacaaggaggttaccaaggaggtggtgacgagcgaggacgggtctgattgtccggaagcgatggatttgggaacattgagtggtataggaaccttggatggttttcgccaccgccatccagatgaggctgcattcttcgatactgcgagcacgggaaaaaccttcccgggcttttttagcccgatgctgggcgagttcgtcagtgagactgagtctcgcggcagtgagagcggcatttttaccaacaccaaggagagtagcagccatcatcccgggatcgctgaattcccgtcccgaggaaagagcagcagctattccaagcagtttacctcgagcactagctacaacagaggcgacagcacgttcgagtccaaaagctacaagatggccgacgaggcaggctcagaggccgatcatgaaggaacccactcaaccaagcgcggacacgctaagagtcgcccggtgagggattgcgatgatgtcttacagacgcaccccagcggaacccaaagtggcatcttcaacattaagctgccgggttcgtctaaaatcttcagtgtatactgtgaccaagaaacgagtttgggcggctggttgctgattcaacagcgcatggatggctcgctaaatttcaatagaacttggcaggattacaagcgcggctttggtagcctgaatgacgaaggagaaggagagttttggttgggtaacgattatttgcacttgctgactcaacgtggctcagtcttgcgagtcgagctggaagattgggccggcaacgaggcctacgccgaatatcacttccgggtgggatccgaggccgaaggctatgccttgcaggtgtcaagctacgagggtaccgctggagacgccttgatagagggatcagttgaagagggcgcagagtataccagccacaataatatgcagttctccacgtttgaccgtgacgcagaccaatgggaggaaaattgtgctgaggtatatggtggcggttggtggtataataactgccaagccgccaacttaaacggtatctactaccccggaggaagctatgatccaaggaacaattcaccatacgaaattgagaatggtgtggtttgggttagtttccggggggcagactattcgctgcgcgccgtacgtatgaagatccggcccctggtaacccag

SEQ ID NO: 11067 - DNA, 2598 bp, Artificial Sequence
  Description of Artificial Sequence: Synthetic coding sequence
atgttcagtatgagaatcgtgtgtctggtactcagtgtggtcggcaccgcttggacggccgacagtggagagggagactttcttgccgagggaggcggggttagaggtcccagggtggtggagcgacaccagagtgcatgcaaggattctgactggccgttctgtagcgatgaggattggaattataaatgcccatcagggtgcaggatgaaaggcttgattgacgaagtgaatcaagactttacaaatcggattaacaagctgaagaatagtctgttcgagtaccagaagaacaacaaagattcgcactccctgactactaacattatggagatcctgaggggcgatttctcctccgcgaataacagagacaatacctacaacagggtgagcgaagatttaaggtcacgaattgaggtgttgaaaaggaaagtgatcgaaaaggttcagcacattcagttactgcagaaaaacgtgcgcgctcagctggtagatatgaaaaggctcgaggtggacatcgatattaagatcagatcttgcagggggagctgctctcgcgcactggcccgcgaagtagatttgaaggactatgaggaccagcaaaagcagctggagcaggtgatcgctaaagatctgctgcccagccgcgacaggcaacatctccctctgataaagatgaagccggtgcctgacttggttccaggtaatttcaaaagccagctccagaaggttcctccggaatggaaggctctgacggatatgccacagatgcgtatggaattggaaaggcccggcggaaatgagatcacccgcgggggtagcacgtcttacggtactgggtccgagactgagtcacccaggaacccaagttctgccgggagctggaatagcgggtccagtggccctggcagcactggcaatcgaaatcctggctcgagcggaaccggcgggactgctacctggaagcccggctcctcggggcctggtagcaccggctcctggaattcgggctcctcaggcaccggttcgaccggcaaccagaaccccggcagccccaggccaggcagcacaggaacttggaaccctggtagcagtgaacggggcagtgctgggcattggacttctgagtcttcagtgagcggaagcactggccaatggcattcagaatctgggtctttcagaccggactcccccggctcggggaatgccagacctaacaatcccgattggggtacctttgaggaagtgtccggaaatgtgtctccgggaactcgccgtgagtatcacactgagaagctggttacctctaaaggagataaggagctgaggactgggaaggagaaagtgacaagtgggagcactacaactactaggcgatcttgcagcaagaccgttacaaagaccgtgattgggccagacgggcacaaggaggtcacgaaggaagtggtgacctctgaggacggatcagattgccctgaagctatggacctgggaacattgagcggcattgggaccctggatggcttccgtcataggcatcctgatgaggcggccttcttcgacactgcctctaccggcaagacatttcctgggtttttcagccccatgctcggcgaattcgtgagcgagaccgagagcaggggcagcgagagcggcatcttcacgaataccaaagagtcctcatcccatcaccccgggattgcagaattccccagtagagggaagtcctcaagctatagtaaacaatttacctcaagtacgagttataaccggggcgactctacttttgagagtaaatcgtacaaaatggccgacgaggcaggttccgaggctgaccatgaggggacacattccactaagagggggcacgccaagagtagacccgtccgggactgtgacgacgtacttcaaacacacccctccgggacacagtccggaatcttcaatataaagctaccaggcagcagcaagatcttcagcgtctactgcgaccaggagacttccctcggcggatggctgctcatccaacagagaatggatggctccctgaatttcaaccggacatggcaagattacaagcggggtttcggaagtcttaacgacgagggcgagggcgagttctggctgggcaacgactacctccatttgttgacacagcgcggatctgttctgcgagtcgaactcgaggactgggccggaaacgaggcctacgcggaataccactttcgcgtcggtagtgaggccgaagggtacgctctgcaggtgtcgagctacgaaggcaccgcgggggacgccctgattgaggggtctgtagaggagggtgcggaatacacctctcataacaatatgcagttctccacctttgacagggacgctgaccagtgggaagagaattgcgccgaggtgtacgggggcgggtggtggtacaacaactgccaggctgcaaaccttaatggcatctattatccaggcgggtcatacgaccctaggaacaacagtccctacgagatcgaaaatggtgtggtatgggtttctttcaggggggcagactatagcctcagagcggttagaatgaaaatacgccctctggtgacccag

SEQ ID NO: 11068 - DNA, 2598 bp, Artificial Sequence
  Description of Artificial Sequence: Synthetic coding sequence
atgttttccatgaggatagtgtgccttgtgctgagcgtggtcggaactgcctggactgcggattcgggtgagggggacttccttgcagaagggggcggcgtccggggtccgagagtggtcgagaggcaccaatcggcatgtaaggactccgattggcctttctgttccgatgaggattggaattacaaatgcccaagcggctgccggatgaagggactgattgatgaagtgaaccaagattttacgaacaggatcaacaagctgaagaactcgctgttcgaataccagaagaacaacaaagattcacactcgctgaccaccaatatcatggaaatacttcgtggtgatttttcgagcgccaacaacagggataacacttataaccgcgtcagcgaggatcttcggtcgagaatcgaggtgctcaaacgcaaggtcattgaaaaggtgcagcatattcagctgctgcagaagaatgtgcgcgctcaattggttgatatgaagcgacttgaagtggatatcgacataaagatcagatcgtgtcgcgggtcatgttcgagggccctggctagagaggtggatttgaaagattacgaggaccaacagaagcagcttgaacaagtcatagccaaggatctgttgccctcaagggatagacaacatctcccattgattaagatgaagcccgtgcccgatcttgtgcctggtaactttaagtcccaacttcagaaggtgccgccagagtggaaggctctcaccgacatgccccaaatgagaatggaactggagcgtccaggcgggaatgagattactcgtggaggttcgacctcctacggaaccggatcggaaaccgaatccccacggaatccatcgtcggcaggctcgtggaattcgggaagctcgggacctggttcaacgggaaatcggaaccccggaagctcgggtaccgggggcaccgcaacttggaagccgggttcgtcgggtcctggttcgactggctcttggaactcaggtagctcaggcaccggatctactggaaaccaaaaccctggatcacctcgcccaggttcaactggtacttggaaccctggatcgagcgagcgggggtcagcaggacactggacctcagaaagctcagtttcgggttccacgggccagtggcacagcgaatcaggctccttccgacctgattccccgggctccgggaatgcacggcctaacaatcccgactggggcacttttgaggaagtcagcggaaatgtcagccctggaactagaagagaataccacaccgaaaagctcgtcacctcaaaaggagataaggagctgagaactggcaaagaaaaagtcacctccggttccaccaccacgactaggagaagctgctccaagacggtgactaaaaccgtgatcggaccagacggtcataaggaagtcaccaaagaagtcgtgacttcggaggatggatcggattgtccggaagcgatggacctcggaacccttagcggaattgggacgcttgacggatttcgtcacagacatccagacgaggcagcatttttcgacaccgccagcaccggtaaaacgtttcccgggttcttttcccccatgctgggggaatttgttagcgagactgagtctcgcgggtcggaaagcgggattttcaccaacactaaagaatcctcatcacatcatccaggcatagcagaattcccttcacgggggaagtcgagctcctacagcaagcaattcacttcctcaacttcatacaatcgtggcgattcgacctttgaatcgaagtcctacaagatggcagacgaggccgggagcgaagcggatcatgaaggcactcattcaactaaacggggacacgctaagagcagacccgtgagggactgtgacgatgtgctccagacgcatccttccggtactcagagcggtattttcaacatcaagttgcctggtagcagcaaaatcttctctgtgtattgtgatcaagaaacctcacttggcggatggctgctgattcaacaaaggatggacggatcattgaatttcaatagaacgtggcaagattacaaacgggggttcgggtcccttaatgacgagggcgagggagagttttggctgggcaatgattacctccatcttctcacccaacggggatcagtccttcgggtcgaactggaagattgggcaggtaacgaggcctacgcggagtaccatttccgtgtgggatcggaagcggaaggatacgcgcttcaagtctcatcctacgagggaaccgcgggtgacgcactcattgagggatcggtggaagaaggtgcagaatacacttcgcacaataacatgcagttctcaaccttcgatagagatgcagaccagtgggaagaaaactgtgcagaagtgtacggtggtggatggtggtacaataactgccaagccgcaaacctcaacggcatttactaccctggcgggtcgtatgatccccgtaacaactcgccgtacgagattgagaacggagtggtgtgggtgtcgtttcgtggtgcggactactcgcttcgagctgtgcggatgaaaatcaggccccttgtgacccag

SEQ ID NO: 11069 - DNA, 2598 bp, Artificial Sequence
  Description of Artificial Sequence: Synthetic coding sequence
atgtttagcatgcgtattgtgtgtctggtgctgagcgtagtggggacggcatggactgccgatagcggagaaggggacttcctggccgagggcggaggagtccgagggcctcgcgtggtggagcgacaccagtccgcatgtaaagactctgattggccattttgttcagacgaggattggaactacaaatgcccatccggttgtagaatgaagggattgatcgacgaggtcaaccaagacttcaccaatcgaattaacaaattgaaaaactcgctgttcgagtaccaaaagaataacaaagactcccattcgctgaccaccaacattatggagatcctcagaggcgatttttcgtcggctaacaacagggataacacctataatcgagtttcagaagatcttcggagcagaatagaagtcctcaaacgtaaggtcattgaaaaggtgcagcacattcaactccttcagaagaatgtccgtgcgcaactggtggatatgaagcgcctggaagtcgacatcgatatcaagatcagatcctgccgcggttcctgttcgagagcgcttgctcgcgaagtggacctcaaggactatgaggatcaacaaaagcaactggaacaagttatagccaaggatctgttgccaagccgcgataggcagcatctccctcttatcaagatgaagccagtaccagaccttgtgcctggaaacttcaaatcgcaacttcagaaggtgcccccagaatggaaggcgctgaccgatatgccccaaatgaggatggaattggaacggccgggaggaaacgaaatcacccgaggcggatcaacttcatacggaactggttcggaaaccgaatccccgcggaatccttcctctgcaggctcgtggaatagcggttcctcggggcctggaagcacgggaaacaggaatccgggatcctctggcactggaggtactgccacctggaagcccggatcaagtggtcctggttccactgggtcgtggaactcaggatcctcagggaccggctccaccggtaaccaaaacccggggtccccccgtcccgggagtactggaacttggaaccctggatccagcgaacgcggatcggcaggacattggactagcgaaagttccgtctccgggtccactgggcagtggcattcggagtcgggctcttttagaccagattctccaggatcaggtaacgcacgtccaaacaatcctgattggggtactttcgaggaagtgtcaggaaatgtgagccctggaactcggagagaataccatactgaaaaactggtgacttcgaagggtgacaaggaactcagaaccggaaaggaaaaggtgaccagcggaagcaccaccacgaccagaagaagctgctcaaagaccgtcacgaaaacggtgatcgggcccgacggacataaagaagtcacgaaagaagtggtgacctcagaggacggatccgattgcccagaagcaatggacctcggtactcttagcggaatcggcactcttgatggctttagacaccgccaccctgatgaggcggccttctttgatactgcttcgactggcaaaacttttcccggttttttctcaccaatgcttggagagtttgtgtctgaaaccgaaagccggggatcagaatccggtatattcacgaacactaaagaaagctcgtcacaccatcctggcatagcagagtttcctagtaggggtaagtcgagctcgtactccaagcaattcacctcgtcgaccagctataatcgaggagactcaacctttgaatccaagtcgtacaagatggccgacgaagccggttcagaagcagatcatgaaggtacccactcgaccaagcgtggacatgcaaaatcccgccccgtccgcgactgtgatgatgtgctgcagactcatccttccgggacccagtccgggatctttaacataaagctccccggttcatccaagatctttagcgtgtactgcgatcaggaaacgtctctgggagggtggcttcttattcagcaacgaatggacggttcgctcaatttcaatcgcacctggcaagattacaagcgtggcttcggatcgcttaacgatgagggagaaggcgaattttggctgggtaatgattacctgcatctgctgacccagagaggttcagtgctgagggtggagctcgaggattgggcgggtaacgaggcctacgcagaataccacttcagagtcggatccgaggcagaagggtatgcacttcaggtgtcgagctacgaaggtaccgcaggcgatgcacttatcgaaggctcagtggaggagggagctgagtacactagccataacaatatgcagttttcaacttttgatagagatgccgatcaatgggaggagaactgtgcagaagtgtacggaggaggctggtggtacaacaattgtcaagctgcaaaccttaatgggatatactaccccggcggatcatacgatccgcgaaacaactctccttacgagattgagaacggtgttgtgtgggtttcctttcgcggcgcagactactcattgcgagccgtgaggatgaagatacggccacttgtcactcaa

SEQ ID NO: 11070 - DNA, 2598 bp, Artificial Sequence
  Description of Artificial Sequence: Synthetic coding sequence
atgttttcaatgagaattgtttgtcttgttctttcggttgtgggaactgcctggaccgcagattcgggcgaaggagactttcttgcagaaggtgggggagtgaggggccccagggtagtggaacgtcaccagagcgcctgtaaggactccgactggcctttctgttccgatgaagattggaactacaaatgtccttcgggatgcagaatgaagggattgatcgatgaggtcaaccaagatttcactaatcgcataaacaaacttaagaatagcctgtttgaatatcaaaagaacaacaaggactctcacagcttgacgaccaacattatggaaattctgcgcggtgatttttcatcggctaacaaccgagataatacttacaatcgcgtcagcgaagatcttagatcgagaatcgaagttctgaaaaggaaggtgattgagaaagttcagcatattcaactgctccagaaaaacgtgcgcgcacagctggtcgatatgaagagacttgaagtcgacattgatatcaagatccgctcctgccgcgggtcgtgctcaagagcccttgcgcgagaagtggatctcaaggattacgaagatcaacagaagcagcttgaacaagtcattgcaaaggacttgctccctagccgtgaccgtcagcatcttcctcttatcaaaatgaagccagtgccagatcttgtgccaggaaactttaagagccaacttcaaaaggtgccacctgagtggaaggcactcactgacatgcctcaaatgagaatggaactcgaaaggccgggtggaaacgagattacccgcggcggctccacttcgtacggtaccggttcagaaaccgaaagcccacgaaaccctagcagcgctggatcctggaattccggatcatcaggaccaggttcaacgggaaaccgtaaccccggttcgtcaggaaccggaggaaccgctacttggaagcctggctcttccggacctggttcaaccggtagctggaattcgggtagctcgggtactggtagcactggtaaccaaaacccaggttcccccaggccagggagtactgggacgtggaatcccggatcatccgagaggggatccgcaggacattggacttcggagtccagtgtttccggttcaactggtcaatggcatagcgaatccggatcattcagacccgactcaccgggatctgggaacgccagacctaacaatcctgactggggaactttcgaagaggtgtcaggaaatgtgagccccggcactcgcagggaatatcatactgagaaactggtcacgtctaagggtgataaggaactcaggaccggcaaggagaaggttacgtcgggaagcaccactactactaggcggagctgttcaaagaccgtcacgaaaaccgtgatcggtccggacggacacaaggaagtgactaaagaagtggtgacctcggaagatggttcggactgtcccgaggcaatggatctgggtactctgtcgggtattggtactcttgatggattccgacaccgacatccggatgaagcagccttcttcgacactgcctcgaccggtaagacttttcctggtttcttctcgcctatgcttggtgaatttgtgtctgaaaccgagtcgagaggtagcgagtcgggaattttcaccaataccaaagaatcgagctctcatcatccagggattgcagagttcccttcgaggggtaagtcatcgtcctactcaaaacagttcacctcctcgacttcatacaaccgaggagattccacctttgagtcgaagagctacaagatggcagacgaggcagggtcggaggccgatcatgagggtactcattcgaccaagagaggacacgcaaagagcagacccgtcagagattgcgatgatgtgcttcaaactcacccatcgggaacccagtcgggtatcttcaatatcaaacttcctggaagctccaagatctttagcgtgtactgcgatcaggaaacctcccttggcgggtggcttctgatccaacagcgcatggatggcagcctgaactttaaccgtacttggcaggattacaagagaggatttggttcccttaacgacgaaggggaaggagaattttggctggggaatgactaccttcaccttctgacccaacgcggatccgtgcttcgcgtggaactggaggattgggcaggtaacgaagcatatgccgagtaccattttagggtcggatcggaagcagaaggatatgcacttcaggtgtcatcttacgaaggaaccgccggggatgcgctgattgaggggtccgtggaagaaggagcagaatacacctcccataacaatatgcaattctccacttttgaccgggacgcagatcaatgggaggaaaactgtgcagaagtgtacggtggcggctggtggtacaataactgtcaagcagcaaacctgaatggtatctactacccaggaggatcatatgacccccggaataacagcccatacgagatagagaacggagtcgtgtgggtgtcgttcagaggggcggattattcgctccgggcagtgagaatgaagattcgacctctcgtcacccag

SEQ ID NO: 11071 - DNA, 2598 bp, Artificial Sequence
  Description of Artificial Sequence: Synthetic coding sequence
atgttcagtatgaggatcgtgtgcctggtgctcagcgttgtggggacggcctggaccgcagacagcggagaaggcgactttctggccgaaggaggaggtgtcagaggaccgcgcgtggttgaaagacaccagagcgcctgtaaggactcagactggcctttctgtagcgatgaggattggaattacaaatgcccgtccggctgcaggatgaaaggactgatcgacgaggtgaaccaagacttcaccaatagaatcaataaactgaagaacagcctcttcgaataccagaaaaacaataaggactcccactccctgactactaacatcatggaaattctgcgcggagattttagctcggcgaacaatagagacaatacgtataaccgggtttcagaggacctgcgctcgcgcatcgaggtgctgaaacgcaaggtcatcgaaaaggtgcaacatatccagctcttgcaaaagaacgtgcgggcacaactcgtggatatgaaacgcctggaggtggatatcgacatcaaaatccgatcttgccgcggatcgtgctcgcgggctctggcccgcgaggtcgacctgaaggattacgaggatcagcagaaacaactcgagcaggtcatcgcgaaggatctcctgccctcacgcgatcggcagcatcttccactcatcaaaatgaaaccggtgcctgacctggtgcccggaaacttcaagtcccaactccagaaggtgccaccggaatggaaggccctcactgacatgcctcagatgaggatggaactcgaacgcccgggtggaaatgaaatcacccggggagggtcaacctcctacggaactggttccgaaactgaatccccacgcaaccctagcagcgctggatcctggaactcgggatcgtcaggaccgggaagcactggaaaccggaaccctggaagcagcggaacgggaggcactgccacttggaaaccaggctcgtccggacctggatccaccgggtcgtggaactctggctcgtcgggaaccggctcgactgggaatcagaacccgggtagccctcgcccaggatccactggaacttggaacccaggttcatcggaacgcgggagcgcaggacactggacctcggagagttccgtctcgggatctaccgggcaatggcactccgagtccggatcattcagaccggatagcccgggcagcggaaacgctcgccctaacaacccggactgggggactttcgaggaggtatcaggtaacgtctcaccgggaactcgccgggagtaccatactgaaaaactcgtcacttccaagggagacaaggagttgcgcactggcaaggaaaaggtgacttcgggaagcacgaccaccactcgccggagctgttctaagacggtcacgaaaactgtgatcggaccggacggacataaagaggtgaccaaagaagtggtgacgagcgaagatggaagcgactgcccggaggccatggatctcggaacgctcagcggaattgggaccctggacgggttccggcacagacacccggatgaagccgcattctttgacactgctagcaccggcaagaccttcccaggattcttttccccaatgctgggcgaatttgtctcggaaaccgaaagccggggatcagagtctggcattttcactaacaccaaggagagctcctcgcatcatcctggaatcgccgaattcccgtcgcggggcaaatcctcttcatactccaagcaattcacctcgagcacttcctataatcgcggagattccactttcgaatcgaagtcgtacaagatggcagacgaagccggatccgaagccgaccacgaaggaacccacagcaccaagcggggacacgcaaaaagtagaccagtgagggactgcgatgatgtgttgcagacccaccctagcgggactcagagcggaatcttcaatatcaagctccctggctcatcaaagatcttctcggtctactgtgatcaggagacgtcgctcggtggttggctgctcatccagcagcggatggatggatccctgaacttcaatcgtacctggcaggattacaagagggggttcggatccttgaacgacgaaggcgagggagaattttggctggggaatgactaccttcacctccttactcagcgcggatcagtgttgagagtggaactggaagattgggcgggtaatgaggcgtacgcagaatatcatttccgggtgggatcagaagctgaaggatacgccctccaggtgtcgtcgtatgaagggacggccggagacgccctgatcgagggaagcgtggaagagggcgccgagtatacttcccataacaacatgcaattcagcactttcgaccgagacgccgatcaatgggaagaaaactgtgcagaagtgtatggaggaggctggtggtacaataactgccaggccgcaaatctcaacggtatctactacccaggcggctcctacgacccgcgcaacaattccccgtacgaaatcgagaatggggtcgtctgggtgtcctttagaggagcggactactccctgagggctgtccggatgaaaatccgcccgctggtcacgcag

SEQ ID NO: 11072 - DNA, 2598 bp, Artificial Sequence
  Description of Artificial Sequence: Synthetic coding sequence
atgttctcgatgcggatcgtttgtctcgtcctctcggtggtgggtactgcttggaccgcagactcgggggagggtgattttctggccgaaggtggcggggtcagaggaccgcgagtggtggagcgccatcagtcagcctgtaaagactcggattggccgttctgttcggatgaagattggaattacaagtgtccgtcgggatgcaggatgaagggattgatcgatgaggtgaaccaggatttcaccaatcggatcaataagctgaagaattcgctgttcgagtaccagaaaaacaacaaggattcccactcactcaccactaacatcatggagatcctcaggggcgacttcagctcggccaacaacagggacaacacctacaaccgtgtctcggaggacctcagatcccgaatcgaggtgctgaaaaggaaggtgattgaaaaagtgcagcacatccaactgctgcagaagaatgtgcgcgctcaactggtcgacatgaaaagactggaagtggatatcgacatcaaaatccggtcctgcagaggatcctgctctcgggcactggcaagagaggtggatctgaaagactacgaggatcaacagaagcaattggagcaagtcattgctaaggaccttcttccttcccgcgatcgccagcacctgcctctgatcaagatgaagccagtcccagatctggtgccgggaaatttcaaatcacagctgcaaaaagttccgccggagtggaaagcccttaccgatatgccacagatgagaatggagctggaacgcccgggaggaaatgagatcacccgcggcggatccacctcgtacggtactggctccgaaacggaaagcccaaggaacccttcatcggccggatcctggaactcaggctccagcgggccaggttcaaccggtaaccgcaatccgggaagcagcggaacgggcggaactgcaacttggaagcccggatcatcaggccctggctcgactggatcatggaactcagggtcctcgggaaccggatcgacgggcaatcaaaatcctggcagcccgcgaccaggatcgactggaacgtggaacccggggtcgtctgaacggggatcggccggacattggacttccgagtcgtcggtgtcgggatcaaccggccaatggcactcagagtcgggctccttcagaccggacagcccgggctccggaaacgcccgcccgaataaccccgattggggaactttcgaagaggtgagcggaaatgtgtcgccgggtactcgcagggaataccataccgaaaagctggtgaccagcaagggagacaaagagctgagaactggaaaggaaaaagtgacttcaggaagcaccactactaccagacggagctgcagcaaaaccgtgactaagactgtgatcggaccagacggccacaaggaggtgactaaggaggtggtgacctcggaggacggatcagattgccctgaagccatggaccttggcactttgtcgggtatcggaacccttgacggattccgccatagacatcctgacgaggcggcgttctttgatactgcttccaccggaaagacttttcctggcttcttcagcccgatgctgggagaattcgtctcagaaaccgaatcacgcgggtcggaatctggaatctttactaatactaaggaaagctcgtctcaccacccgggaatagccgagttcccgtcgagaggaaagtcatcatcatactcgaagcaattcactagctcgactagctacaataggggagattcaactttcgagtccaaaagctacaaaatggccgacgaagcgggatcggaagccgaccacgaaggcacccactcaaccaagcggggacacgccaagagccgccctgtgagggattgcgacgatgtgctccagactcatccgtccggaactcagagcggcatcttcaacataaaactgccaggctcttcaaagatctttagcgtttactgcgaccaagagacttcgctcggaggttggctgctcattcagcaacggatggacggatcgctcaacttcaatcgcacctggcaggattacaagcgggggttcggatccctgaatgatgaaggggaaggcgagttctggctcggcaatgactacctgcacctgctcactcagcgcggctccgtcctgagagtcgaacttgaggactgggcaggaaacgaggcatacgcagagtatcacttcagagtgggatcggaggcagaaggctacgcgctgcaggtgtcctcctacgagggaaccgcaggcgatgcattgatcgagggttcggtggaggagggagcggagtacaccagccataacaatatgcaattttcgacgttcgatcgggacgcggaccagtgggaggaaaattgcgccgaggtctatggaggcggttggtggtacaataactgccaggccgcgaacctgaacgggatctactatccaggtggcagctacgacccgcgcaataacagcccatacgaaatcgaaaacggcgtggtctgggtgtccttccgcggagcggactactccctcagggctgtgcgcatgaagattcggccgctggtgactcaa

SEQ ID NO: 11073 - DNA, 2598 bp, Artificial Sequence
  Description of Artificial Sequence: Synthetic coding sequence
atgttctccatgagaatcgtgtgcctggtgctctccgtggtgggcacggcatggactgctgattcaggagagggcgatttcctggccgaaggaggtggggtccgtggtccgcgggtggtggagcggcaccaatctgcatgtaaagacagtgactggcctttttgctccgacgaggattggaactacaagtgcccctcaggttgtcggatgaaaggtttgatcgacgaagtcaatcaggacttcactaatagaatcaataagctcaaaaactcattgttcgaataccagaagaataacaaggattcccactccctgaccacgaatatcatggagatccttaggggcgatttctccagcgcaaacaacagggataatacttacaaccgggtttcagaggacctcaggtcaagaattgaagtcttgaagcggaaggtgatcgaaaaggtccaacatatccagctgctgcagaaaaatgtgagagcccaactggtcgatatgaaacgccttgaagtggatatcgacatcaagattcgctcctgccgggggagctgcagtcgggcactggcccgcgaggtggatctcaaggactatgaagatcagcagaagcaactggagcaagtgatcgcgaaggacctgctgccgagccgcgacagacagcaccttccactcatcaagatgaagccggtgcccgacctggtccctggaaacttcaaatcgcagctccagaaggtgcctccagagtggaaagcgctgaccgacatgccgcaaatgcgcatggagctggaaaggcctggaggaaacgaaatcactaggggaggatccacctcttatggcactggcagcgaaacggagtccccccgaaatccgagctcagcgggaagctggaattccggatcctcgggcccagggtccaccggaaaccggaacccgggctcctcgggaaccggcggcaccgcgacttggaagccgggcagctcggggccgggatccaccggatcttggaactcaggatcgtccggtactgggtcaacggggaaccaaaatccagggtcgccgcgcccgggctccactgggacctggaatcccggttcgtccgaacgcggttcagcaggccattggacgtccgaatcttcggtgagcggcagcactggtcagtggcactcagaaagcggttcttttaggccggacagcccaggaagcggaaatgctcgccccaataatccagattggggaactttcgaagaagtgtcgggaaacgtgtcacccggaactcgccgggaataccacaccgagaaactggtcacttcgaagggagacaaagagctccggaccgggaaagagaaagtcacctcgggctcgaccaccacgacccggcgctcctgtagcaaaacggtgaccaagaccgtgattggacctgatggacataaggaggtcaccaaggaagttgtcacttccgaagatggaagcgactgcccagaggcgatggatctcggaaccctgtctggaatcggcaccctggacggtttccgccatcggcatcccgatgaggcggccttctttgataccgcatcgaccggtaagactttccccggattcttctcgcctatgctgggagaatttgtgagcgaaaccgaaagccgcggatcggagtccggtatattcaccaacaccaaagaatcttccagccaccaccccggaatcgcagaatttccttcacggggtaagtccagttcgtactcgaagcagttcacttcgtcaacctcgtacaaccgcggagacagcacttttgagtcgaagagctacaaaatggcggacgaagccggcagcgaggctgaccatgaggggacgcactcgaccaagcgcggccacgccaaatcacgccctgtgcgcgattgtgacgacgtcctgcagactcacccatccggcactcagtccggaatcttcaacataaagctgcccggcagctccaagatcttcagcgtgtattgcgatcaggaaacttccctgggcgggtggctcctgatccaacaacgcatggacggttcgctgaactttaatcggacttggcaagactacaagcggggttttggaagcctcaacgatgagggggaaggtgaattttggctgggaaatgactacttgcacctcctcacccagcgcgggtctgtgctccgcgtggagctcgaagattgggctggcaacgaagcctacgccgagtaccattttcgcgtaggatcagaagccgaaggctacgcacttcaggtgtccagctacgaaggcactgccggggacgctctcatcgaaggaagcgtggaagagggagctgaatacaccagccataacaacatgcagttcagcacgttcgatcgggacgccgatcaatgggaagaaaactgtgccgaggtttatggaggaggttggtggtacaacaactgtcaagctgcgaacctgaacggtatttactacccggggggttcctacgaccctagaaacaacagcccctacgaaatcgaaaacggagtcgtgtgggtgtcgttcaggggcgccgactattcattgcgggccgtgcggatgaaaattcggccactggtgacccag

SEQ ID NO: 11074 - DNA, 2598 bp, Artificial Sequence
  Description of Artificial Sequence: Synthetic coding sequence
atgttctccatgagaatcgtctgcctggtgctgtcggtggtgggaactgcatggaccgcagactcgggagaaggcgatttcctggcagaaggcggaggggtgcggggaccgagggtcgtcgagagacaccagtcagcatgcaaggactcagactggcccttttgctcagacgaagattggaattacaagtgcccatcagggtgtcgcatgaaaggactgattgacgaagtgaaccaggatttcacgaatagaatcaacaaacttaagaattctctcttcgaataccagaaaaacaacaaagattcacattctttgaccactaacatcatggagatcttgcggggggacttctcctcagcgaacaatcgggacaatacttacaacagagtgtcggaagatctgcgcagcagaattgaagtgctgaaacgaaaggttatcgaaaaggtgcagcatatccagctgctgcagaagaacgtccgtgcccaacttgtcgacatgaagaggctcgaggtggacatcgacatcaagatccgatcatgccgcggatcctgcagcagagcactggcgagagaggtggatcttaaggactacgaagatcaacaaaaacagctcgaacaggttatcgcaaaggatctcctgccatcgagggacaggcagcacctcccattgatcaagatgaagccagtgcccgacctggtcccgggcaacttcaagtcccaattgcaaaaggtcccgcccgaatggaaggctctcacggacatgccgcagatgcggatggagcttgaacggccggggggaaacgaaattactcgcggagggagcacctcctacggaactggaagcgagactgaatcccctcgaaatccatcgtcggccggttcatggaactctggatcgtccggaccggggtccacgggaaatcggaatcctggctcctccggaaccggcgggactgcgacttggaagcctggatcgtcgggccccgggagcaccggctcatggaacagcggatcgagcgggactggatccaccggaaatcagaatccgggatcaccaagacctggatccactggcacctggaacccgggatcatcagaacgcggatccgccggtcattggacctccgaatcttcggtgtcgggttccacgggacaatggcattccgaatcaggatcatttcggccagactcgcctgggtccgggaacgctcgcccaaacaatccagactggggcacgtttgaagaagtctcgggcaatgtgtctccgggaaccagaagagagtaccacactgagaagctcgtcacctctaaaggagataaggagttgcggaccggaaaggaaaaagtgacttccggatccaccaccactactcggcggtcgtgcagcaagaccgtcacgaaaaccgtgatcggtcctgatggacacaaggaagtcacgaaagaggtggtgacctcagaagatgggagcgactgccccgaggcgatggacctgggcactctgagcggaattggaactctcgatggcttccgccatcgccatccggatgaggctgcatttttcgacaccgcttcgaccggaaagaccttccctggattctttagccctatgctcggcgaattcgtgagcgaaaccgagtcccgcggctccgaatcaggtatcttcactaataccaaagaatcctcctcccaccacccgggaatcgccgagtttccgtccagaggcaagtcatccagctactcaaagcagttcactagctcgacttcgtacaacaggggtgactccacctttgaaagcaagtcgtataagatggccgacgaggcaggatcggaagccgaccacgagggcactcactcaactaagcgggggcacgccaagtcgcggcctgtccgcgattgcgacgatgtgctgcagacccacccttcgggcacccaatcgggtatcttcaacatcaaactgccggggtcatcgaagatcttctcggtctactgtgatcaggaaacgagcctgggtggatggcttctgatacagcagcggatggatggatccttgaacttcaaccggacttggcaagattacaagcggggattcggttcactgaacgacgaaggcgagggagagttctggcttggaaatgactacctgcacttgcttactcagagaggatcggtgctccgggtggaacttgaggactgggctggaaacgaggcctacgcagagtaccacttcagagtgggatcggaagcggaaggatacgcgctgcaggtgtcatcgtacgagggtaccgcgggcgacgcgctgatcgaggggtcggtggaggagggagcagaatacacgtcccacaacaacatgcagtttagcacctttgatagagacgcggaccagtgggaggagaattgtgccgaagtgtatggtggtggttggtggtacaacaattgccaggccgcaaacctgaacggaatctactaccctggcggatcatatgaccctcgcaacaattcgccttatgagatcgaaaacggagtggtgtgggtttccttccggggcgctgattactcactgcgcgcggttcgtatgaaaatccgcccgctggtgacgcag

SEQ ID NO: 11075 - DNA, 2598 bp, Artificial Sequence
  Description of Artificial Sequence: Synthetic coding sequence
atgtttagcatgcggattgtgtgcctggtcctgtctgtcgtgggaaccgcctggaccgctgattcaggggagggcgattttcttgctgagggtgggggcgtaagaggcccaagagtcgttgaacgacaccagagcgcctgtaaagactcagattggccattttgttctgatgaggattggaattacaagtgcccttctggttgccgaatgaaagggctgattgatgaggtaaatcaagactttacaaatagaataaataagttgaagaacagcctgttcgagtaccagaagaacaacaaagattctcactctctgacaaccaatatcatggagatcctccggggagatttttcatcggccaataaccgtgacaatacatacaacagagtgtctgaagatctgcgctctcgcatcgaggttttaaagcgcaaggttatagaaaaggtgcagcacatccagctgctgcagaaaaatgtgagggcccaactggttgacatgaagagattggaggtggatatcgatattaaaatcaggtcctgcaggggctcctgctctcgcgccttggcccgagaggtggatctcaaagattatgaggatcagcagaaacagctggagcaggtgatagcaaaggatctgttgcccagtcgggataggcagcatctgcccctgattaagatgaaacccgtgccagatcttgttcccggaaatttcaagtctcaactacaaaaggttccaccagaatggaaggcactgaccgacatgccgcaaatgcggatggaactcgagcggccaggcggaaatgagatcaccagaggggggtctaccagctacggaacaggtagcgagaccgaatcacctaggaatcctagttccgcgggatcttggaattctggatcgtccggacccggttccaccggcaaccggaatcctggttctagcgggactggagggaccgcgacgtggaagcccggttcctcaggccctggctcaaccgggtcctggaactctggcagctcagggaccggtagcacagggaatcagaatcctggctccccaagacctggctcaaccggtacttggaatcctggttccagtgaacgtggatcagcgggccattggacctccgagtctagcgtttctggctctacaggccagtggcactcggaaagcggcagttttaggcccgatagtccaggttctggcaatgcacgccctaacaaccccgattggggcacctttgaggaggtgagtggtaatgtcagtcccggtaccaggcgggaataccacactgaaaagctcgttacgagcaagggcgacaaagagctaaggacagggaaggaaaaggtaaccagtggctcaaccactacgacccggcggtcttgtagtaagaccgtcaccaaaaccgttattggccccgatgggcacaaggaggtcacgaaggaagtggtgactagtgaagacgggagcgattgtcccgaggccatggacctgggaactttatcagggatcgggactctggatggatttaggcatcgccacccagacgaggcggccttttttgacaccgcgtccaccggaaagacattccctggattcttttcacctatgctcggggaattcgtgtccgagactgagagtaggggtagcgaaagcggcatctttaccaacacaaaggaatctagctcgcatcacccaggaatcgccgagttccctagtagaggaaagtcttccagttactcaaagcagttcacttccagcacatcttataataggggtgatagcacgttcgagtctaagtcatacaagatggccgacgaggctggctctgaagctgatcacgagggaactcacagtacgaagcgtgggcacgcaaaatctcggccggtgcgagactgtgacgacgtccttcagacacacccctctggaacacaaagtggcattttcaacatcaaactcccaggctctagcaagatcttcagtgtgtactgcgaccaggaaacatctctagggggatggttgttgatccagcagcgcatggacggcagcctgaactttaacagaacctggcaggattacaaacgaggattcggttcactcaacgatgagggtgagggagaattctggctcggaaacgattatttgcacctgctcactcagagaggctccgtccttcgcgtcgaactggaggactgggccggcaacgaggcatacgccgagtatcatttccgcgttggcagtgaggcggagggctatgcgctgcaggtgtcttcttatgagggaaccgccggtgacgccctaatagagggcagtgtcgaggaaggagccgagtacacaagccataacaatatgcagttttctaccttcgacagggatgccgaccagtgggaggaaaactgcgccgaggtgtacgggggcggttggtggtataacaactgtcaggcagcgaatttaaatggaatttactatccaggagggtcgtatgacccacgcaataacagcccttacgaaatagagaatggagtggtatgggtgagctttcgaggagctgactattccctacgggccgtgcggatgaagatccgcccactcgttacccag

SEQ ID NO: 11076 - DNA, 2598 bp, Artificial Sequence
  Description of Artificial Sequence: Synthetic coding sequence
atgttctcgatgcgcatcgtctgcctggtgctaagtgtcgtggggacagcctggacagcagactccggagaaggagatttcctcgccgaaggcggaggcgtgcgaggcccacgggtggtggaaagacaccagagcgcttgtaaagattcagattggccgttctgctcagatgaggactggaattataagtgtccatccggctgccgaatgaagggcctgatcgatgaggtgaatcaggattttaccaacaggatcaacaagctgaagaatagccttttcgagtatcagaaaaacaataaggattcacatagtctcaccaccaacattatggagattctacgcggcgatttctcatccgccaataatcgggataacacatataatcgcgtgtctgaagacttgcgatcacggattgaagtgctgaaacgcaaagtaatcgaaaaggtgcagcacatacagctcctgcagaagaacgttcgggcccagctggtcgatatgaagaggctcgaggtggatatcgatatcaaaatccgaagctgcagaggctcttgctcacgagccctcgcccgggaggtggatctcaaggactatgaagaccagcaaaagcagcttgaacaggtgatcgccaaagacctgcttcctagtcgcgatcgtcagcacctacctcttatcaaaatgaagcctgtgcctgacctggtcccgggcaacttcaaaagtcaactccagaaggtcccccccgagtggaaggccttgacggacatgccgcagatgagaatggaactcgaaaggccgggtggcaacgaaatcacccgtggtggcagcacatcatatggcacagggtctgagaccgagtcaccccgaaacccgtcatctgcaggatcatggaactccggctcaagcggacctggttccacggggaacaggaatccaggttcaagtggtactggcgggactgctacttggaaaccgggatcatcaggccctggcagcacaggctcttggaactccggttcttccgggacgggctccacaggcaaccagaaccccggctccccaaggcccggcagcacgggcacttggaacccgggcagctccgaaaggggaagtgccgggcactggacatccgaaagttcagtgtctggatccacagggcagtggcatagtgagtctgggagctttcggcctgactcccccggctcaggtaacgcccgtccaaataatcccgactggggaaccttcgaagaagttagcggaaacgtcagccctggcactcggcgagagtaccacactgaaaagttggtgactagcaagggcgacaaagagctgcggacgggcaaggaaaaggtgacaagtgggagcacaactactactcggcgctcctgtagtaagactgtcacgaaaactgtgattggccccgatggacataaggaagtgaccaaagaggtggtcacttcagaggacggctctgactgcccagaggcaatggacttgggcaccctctccggcatcggtacccttgatgggtttcgacaccgccatccggatgaggctgccttttttgacactgcgtcaactggcaaaaccttcccaggctttttcagccctatgctcggcgagttcgtcagtgaaaccgagtcgcgagggtccgagtccggaattttcacaaatactaaagaatcaagcagccatcacccaggcatcgccgaattccccagcaggggcaagtcgtcttcttactccaaacaattcacatcttccacctcctacaaccgcggcgactccacattcgaatccaagagctataagatggccgatgaggcagggagcgaggcagatcatgaagggacacacagcacgaaaagaggacacgcgaaatcaagacctgttcgggactgtgatgacgtcctgcagactcacccatccggcacccagtctggcatcttcaatattaaactgccggggtcgagcaagattttctccgtttattgcgatcaagagacaagcctgggcggatggcttctgattcagcagagaatggatggctccttaaatttcaacaggacatggcaggactacaaacgggggtttggatcactgaacgacgagggagagggagagttctggcttggcaatgactacctgcatttactgacccagcgaggttccgtcctgagggttgagcttgaagactgggcaggtaacgaagcctatgccgaatatcactttcgggtgggctctgaagccgaagggtatgcattacaggtttcatcttatgagggcaccgccggagatgctctcatagaggggtccgtcgaggagggtgcagagtacactagtcataacaacatgcagttcagcactttcgaccgtgacgcagaccaatgggaggagaattgcgcagaggtctatggagggggctggtggtataacaattgccaggctgcgaatctcaacggcatctactatcctggggggtcctacgaccccaggaataacagcccctatgaaatagaaaatggtgttgtgtgggtgtccttcaggggcgcagactactcgctgcgagctgtccgaatgaaaattcgacccctcgtaacgcaa

SEQ ID NO: 11077 - DNA, 2598 bp, Artificial Sequence
  Description of Artificial Sequence: Synthetic coding sequence
atgttctctatgcggattgtgtgtctcgtcttatccgtcgtgggtacagcttggacagctgattctggtgaaggagatttcctggccgagggcgggggcgttagaggtccacgggttgtcgagcggcaccaatcagcttgtaaagactctgactggccattctgttcagatgaggattggaattacaaatgtcccagcgggtgtcgcatgaagggtctgattgatgaagttaaccaggactttaccaaccggattaacaagctcaagaattctctgtttgagtaccagaaaaacaataaagactctcactcactcacgactaacatcatggagattctgagaggtgacttcagctcagctaacaaccgggataacacctataacagagtgagtgaagatctgcgaagcaggatcgaggtgctcaagcggaaggtgattgaaaaggttcagcacattcaactgctacagaaaaatgtacgcgctcagctggtggacatgaaacgcctcgaggtggacattgatatcaagatccgatcttgcagggggtcctgctcccgggcgttagccagggaagtggatcttaaagactacgaagatcagcaaaaacaactcgaacaagtcatcgctaaggacctgcttccatctagggatagacagcacctccctcttatcaagatgaagccggtgcccgatctagtacctggtaatttcaagagccagcttcaaaaagttcctcctgagtggaaagctcttacagatatgccacaaatgagaatggaactggagcggccaggaggtaacgaaatcacacggggagggagtacatcttatggtaccggcagtgagactgaatcacctcgtaacccgagcagcgcaggttcctggaattcagggtctagtggccccgggagcacggggaacaggaatccagggagtagcggaacaggtgggacagccacctggaagcccgggagctccgggccaggtagcaccgggagttggaacagtgggtcttctggcaccggcagtactggcaatcaaaatccaggaagtccaaggcccggcagtaccggcacgtggaaccctggctctagcgagagaggcagcgcaggacactggacatcagaatcttcagtttccggatctactggacagtggcattccgagagtggcagcttcaggcccgacagcccagggagtggcaatgcaaggcctaacaatcctgactggggcacttttgaagaggtttcaggaaacgtgtcccccggcacccggcgcgaatatcacactgaaaagctcgtgactagtaaaggtgataaggagctcaggacaggaaaagaaaaagtgacgtcaggctccactactacaacgagaagaagctgctctaaaacagtaaccaagactgtgattggcccggatgggcataaggaggtgaccaaggaggtcgtcacgtctgaagacggctcagattgccctgaggcaatggatttaggtacactgtccgggataggcacacttgacggatttcgccatcgacatcctgacgaggctgcattttttgataccgcaagcacggggaaaaccttcccaggattcttctctcctatgctcggcgagtttgtctcagaaacagaatctcgaggttcagagagcggcatctttactaacacgaaagagtcatctagccatcatcctggcatagcagagttcccaagcagaggcaagtcctcctcgtactccaagcagtttacctcatccacctcctataatcgtggcgactccacattcgagtccaaatcttacaagatggcagacgaggcaggatctgaagccgaccacgagggcacacacagtactaagagaggacacgctaaatcgcgccctgtgagagattgcgacgatgtgctgcaaacgcaccctagcggaacacagtcagggatttttaacatcaaactcccaggctcaagtaagatttttagcgtgtactgtgaccaggaaacttcccttggcgggtggctgctaattcagcagcgcatggatggcagcctcaatttcaaccgcacttggcaggattataagagaggcttcggatccctcaacgatgagggcgaaggggaattttggctcgggaacgattatcttcatctgctgacccagagaggttcggtgctgagagttgaattggaggattgggctgggaacgaagcctatgcagaatatcacttccgggtgggctccgaagccgaaggatacgcgcttcaggtgtcttcatatgaaggcaccgcgggtgacgccctgattgaggggtccgtggaggaaggggcagaatatacatctcataacaacatgcagttttccacctttgacagagatgccgatcaatgggaggagaattgtgcagaggtctacgggggcggttggtggtacaataactgccaggcggccaacctgaacgggatttactatccaggaggctcatacgaccccagaaacaactccccgtacgagatcgaaaatggagtcgtgtgggtttctttcagaggagctgactattcgcttcgggctgtgcgcatgaagatccggcctttagttacacag

SEQ ID NO: 11078 - DNA, 2598 bp, Artificial Sequence
  Description of Artificial Sequence: Synthetic coding sequence
atgtttagcatgagaatcgtgtgtcttgtactgtctgtggtcggaaccgcttggaccgccgactcgggagaaggcgatttccttgctgaaggcggcggtgttaggggacccagagtggttgagagacaccaaagtgcctgcaaagacagcgattggcccttctgctcggacgaagactggaactataaatgtccaagtggctgtaggatgaaaggacttattgacgaggtgaatcaggacttcacgaaccggatcaataaactcaaaaactctctctttgagtaccaaaagaacaacaaggattcccactcgctgacaacaaatattatggaaattctgagaggcgatttttctagtgcgaataacagagataacacctataatagagtgtcggaagatctgcgctccagaatagaggtgttgaagagaaaggtgatcgagaaggtccagcacatacaacttttgcagaagaacgttcgagcgcagctggtcgacatgaagaggctggaggttgacatcgatattaaaatacgctcatgtcgtggaagctgctctcgcgctctagcacgtgaggtggatctcaaggactacgaagatcagcagaaacaactggagcaggtgattgctaaagacttgctgccctctcgcgatcgtcagcatctcccccttataaagatgaaacctgtccccgacctagtgccaggtaactttaagtctcagctccagaaggtgcctcctgagtggaaagcactaacagatatgcctcaaatgcggatggaattggagcggcccgggggtaacgaaattacccgcggcggttcaacgtcctatggcaccgggagcgagactgagagtcctcgaaacccatccagcgccgggagctggaatagcgggagctctggtcccgggtccaccggaaacaggaatcccgggagcagcggcacaggtggcaccgctacctggaagccagggtccagtgggcctggttccaccgggtcctggaacagcggcagtagcggtacagggtccacgggcaatcaaaacccagggtcacctcggccaggctccactggcacctggaacccagggagcagtgaacggggatccgccggtcactggacatctgaaagtagcgtaagcggctctactgggcagtggcactcagagagtggatccttcagacctgactctcccggaagcggtaatgcccggccaaataaccccgactgggggacctttgaggaggtcagcggcaacgtcagtccgggaactaggcgggaataccacaccgagaaactggtgacttccaagggcgataaggagcttagaactgggaaagagaaagtgacaagcggctccacaaccactacaaggcggtcctgttcgaagaccgtcaccaaaactgttattggtcccgatggacacaaagaggtgaccaaggaagtggtgacttcagaggatgggagtgattgtccagaagctatggatctcggtacgttgtctgggatcggaacactagatggttttagacacagacacccagacgaggccgccttcttcgatacggccagtacaggcaagacctttccaggcttttttagccctatgttgggcgagttcgtctcggagaccgagtctcgcgggtccgagtcaggtatttttactaacaccaaggaaagctccagtcaccatcctggtatcgctgaatttccttcgagaggtaagtccagcagttactctaagcagtttactagcagcacctcatataacaggggcgactctaccttcgaatcaaagtcttacaagatggccgatgaagcaggatccgaagcagatcacgagggtacccactctaccaagagaggacatgccaaaagtcgccccgtgagagactgtgacgatgtgctacaaacacatccttccggaactcagtccgggattttcaatatcaagctgccaggcagcagcaagatattttccgtatattgtgatcaggagacaagcctgggcggctggctgcttattcaacaacggatggacggcagcctgaacttcaaccgaacatggcaggactataaacgtggattcggttccctgaacgatgagggtgagggagagttctggctcgggaacgactacttgcacctccttacccagaggggaagcgtgttaagagtggaactagaggactgggccgggaacgaagcttacgccgagtaccacttccgggtgggtagcgaggccgaggggtacgccctgcaggtgtcctcttatgagggtaccgcaggcgatgcactcattgagggctcggttgaagagggggcagagtacacgagccataacaacatgcagtttagcacatttgacagagatgccgaccaatgggaagaaaactgcgcagaagtgtacggtgggggttggtggtacaacaactgccaggcagccaacctgaacggtatttattatcccgggggcagctatgacccccgcaataattctccttatgaaattgagaacggcgtggtctgggtcagcttccggggcgccgactactccctgagagccgtccgaatgaagatacgccctctcgtcacccag

SEQ ID NO: 11079 - DNA, 2598 bp, Artificial Sequence
  Description of Artificial Sequence: Synthetic coding sequence
atgttttcgatgcgaattgtttgtctggtgctttcagtggtcggtactgcatggaccgcagactcgggagaaggagatttccttgctgaaggaggaggagtgcggggaccgagagtggtggaacgtcatcaatcggcatgtaaggactcagattggcccttttgttcggacgaggattggaattacaagtgtccatcgggatgccggatgaaaggactgattgatgaagtgaatcaagattttactaaccgcattaacaagctgaagaatagcttgtttgaataccagaagaacaataaggactcgcattcgcttactactaatatcatggaaattctgagaggggatttttcaagcgcaaacaacagagataacacctataacagagtgtcagaagatctccggtcgcgcatcgaggtcctgaagcgtaaggtcatcgaaaaggtccaacatattcagcttctgcagaaaaacgtccgcgcacagcttgtcgatatgaagaggctcgaggtagacatcgatatcaaaatccgttcgtgtagaggctcgtgctccagagccctggctagagaggtggatcttaaggattatgaagatcaacaaaagcagcttgagcaggtgattgcaaaggacctgctcccatctcgggatcggcagcacctgccactcattaagatgaagcccgttccagatcttgtgccagggaatttcaagtcgcagcttcagaaagtgccccctgaatggaaagcattgactgatatgcctcagatgcggatggagctggaaagaccgggcgggaatgagatcacccgaggtggatcgacttcgtacggtaccggttccgaaacggagtctcctagaaatccatcgagcgcgggatcctggaacagcggtagctcgggaccaggaagcactggaaaccgcaatccaggttcttcgggtaccggtggcaccgcaacttggaaacccgggtcatcggggcctgggtcgaccggtagctggaattcaggctcttccggcactgggagcaccggcaaccagaacccgggatctccccggcctggatcgactggtacctggaaccccggatcgtcagagcgcggatcagcaggtcactggacttcagagtcctccgtgtcgggctccaccgggcagtggcacagcgagtccggttcgttccgcccagatagcccaggtagcggaaacgcacgcccgaataaccccgattggggaactttcgaggaggtgtccggtaacgtgtccccaggaaccagaagggaatatcataccgaaaaactggttacttcgaagggagataaggaacttcgcactggaaaggagaaggtgacgtccggcagtaccaccactactaggaggagctgttcgaaaaccgtcacgaaaactgtcataggtccagatggacacaaggaagtgaccaaagaggtggtgaccagcgaggacggatcggattgtcccgaggcaatggatctgggaaccctgagcggaataggtaccctcgacggatttcgtcaccggcatccagacgaagcggcgttctttgatactgcgtcaaccggcaaaacttttcctggcttctttagccctatgcttggagaatttgtctccgaaaccgagtcacggggttccgagtcgggaatcttcacgaataccaaggagtcatcctcgcatcatcccgggatcgcagaattccctagccgggggaaatcgtcctcctattccaagcaatttaccagctccacgtcatacaacaggggcgattcgaccttcgagtccaagtcctacaagatggcagatgaagcaggaagcgaggcggatcacgaaggtacccatagcacgaagcggggacatgcaaagtcgaggcccgtgcgggattgcgacgatgtgcttcaaactcacccttcaggtactcagtccggcatctttaacatcaaactgcctggatcctcgaaaatctttagcgtctattgtgaccaagaaacctcactgggtgggtggctgcttattcagcaaagaatggatggatccctgaactttaaccggacctggcaggattacaaacgcggtttcggatcactgaatgatgaaggagagggggagttttggcttggaaacgattaccttcacctgctgacccaaagaggatccgtcttgcgagtggaacttgaagattgggcaggcaacgaagcatacgcagaataccatttccgtgtgggatccgaagccgaaggttacgctcttcaagtctcgagctacgagggcactgcaggggacgctctcattgagggatcggtcgaggaaggggcagaatacacgtcccacaataacatgcagttctcgacgttcgatagagacgccgatcaatgggaagagaattgtgcagaggtgtacggaggcgggtggtggtacaacaattgtcaagcagcgaacctcaatggaatatactacccaggtggatcgtacgacccaagaaacaactcaccatacgagattgagaacggtgtcgtctgggtcagttttcgcggtgcagattacagcctccgggcagtgagaatgaaaatacgaccgctggtgactcaa

SEQ ID NO: 11080 - DNA, 2598 bp, Artificial Sequence
  Description of Artificial Sequence: Synthetic coding sequence
atgttcagcatgaggattgtgtgtctagtcttgtcagtcgttgggacagcttggactgcagactctggagaaggtgatttcttagccgaaggaggtggagttcggggccctcgtgtggttgagaggcaccaatccgcttgcaaggacagtgactggccattctgctctgacgaggactggaattataaatgtccatccggctgccgtatgaagggactcatcgatgaagtgaaccaagatttcaccaaccgcattaacaagttgaagaatagtctgtttgagtatcaaaagaacaacaaggacagccactctttgacaacaaatataatggagatccttaggggcgatttttctagcgcgaataatcgggataatacctataacagagtctccgaagaccttcgcagcaggattgaggtgctgaagcgcaaggtaatcgagaaggtacagcacatacaactgttgcagaagaacgtcagggctcaacttgtcgacatgaaacgcctggaagtggacatcgatattaagattaggtcttgtagaggctcctgttcacgggcattagcacgggaggtcgacctgaaagattacgaggaccagcagaagcagctggagcaggtcatagccaaggacttactccccagtagggatagacagcatcttccactaataaagatgaagcccgttcctgacttggtgccaggcaatttcaagtcacagctccagaaagtccctcctgagtggaaagccctgacagatatgccacagatgcggatggagctggagagacccgggggaaacgagatcactaggggcgggagcacttcctatgggaccgggtcagaaactgaaagtcctaggaacccatcgtctgccggcagctggaattccggctcttctgggccggggagcacaggaaatcggaaccccggaagtagcggcacaggaggaacggcaacatggaagcccgggtctagtgggcctggttccacagggtcctggaattccggttcgagcggtaccggctccaccggaaatcaaaatcccgggtcccccaggcccggatctacaggaacatggaaccctggtagttccgagagaggatctgccggccactggacgtcagagtctagcgtgagcgggagcactggacagtggcacagtgaaagcggctcgtttcgccccgactcacccggaagcggaaacgcacggcccaacaaccccgattggggaacatttgaggaagtgagcggcaacgtgtcccccggcactcggcgcgaataccatacggagaagttggtgacttctaagggtgacaaggagcttagaacggggaaagagaaagtgacttcgggcagtacgacaaccacccgcaggtcttgcagcaaaacggtgacaaaaaccgtgatcggccccgatggacacaaagaggttacaaaggaggtggtcacaagcgaggacggctccgattgcccagaagccatggacctcggcacattgtctggcattggaactctcgatggattccgtcacagacaccctgacgaggccgccttctttgacaccgcttccaccggaaagacatttcccgggttcttcagtccgatgctcggtgaatttgtgtcggaaaccgaatcccgcggatctgagagcggaattttcacaaacaccaaggagtcctcttcccatcacccaggaatcgccgagtttcctagccgcgggaagtccagtagttacagtaagcagtttacctccagtacgtcttacaaccgcggggactccactttcgaatcaaaatcttacaagatggctgatgaggcggggagtgaagccgaccacgaggggacacactccacaaaaaggggacatgctaaatcaagaccggttagagactgcgacgatgtactgcagacacatccctccggcactcagagcggcatattcaacattaagctgcctggctcgtccaaaatattctctgtctattgtgatcaggagacgtcactgggcggatggctcttgattcagcagcggatggatggctcactgaactttaaccgaacttggcaggactataaaaggggattcggtagcttgaacgacgagggagaaggggagttctggctcgggaacgactatctgcacttgttgacgcagaggggctctgtactcagagtcgaactggaggattgggcggggaacgaggcatacgccgagtaccacttcagagtgggttccgaggccgaagggtacgccctgcaggtttctagctacgagggtacagcgggcgacgcgctcatcgaaggttccgtggaagagggggctgagtatactagtcacaataatatgcagttctctacattcgacagagacgcggatcaatgggaggaaaattgcgccgaggtatacggcggaggttggtggtacaacaactgtcaagctgccaacctgaacgggatttactacccaggcggctcttacgatccccgcaacaactccccatacgagattgaaaacggggtcgtgtgggtgagctttcggggagctgactactctttgagggcagtccgcatgaagatacggcctctggtgacccag

SEQ ID NO: 11081 - DNA, 2598 bp, Artificial Sequence
  Description of Artificial Sequence: Synthetic coding sequence
atgttctcaatgagaatcgtatgcctggtcctttccgttgttggcaccgcctggactgcagactcaggggagggcgacttcctggccgagggaggcggcgtgcgtggtccccgcgtggtggaacgccaccagtctgcatgcaaggattctgattggccattctgttccgatgaggactggaactacaagtgtccttccggctgtcgtatgaagggactgatcgatgaggttaaccaggatttcacgaaccgcatcaacaagttgaagaattcacttttcgaataccagaagaataacaaagactcccactcccttactactaatattatggagattttgcgcggtgatttcagctccgcaaataatagggacaacacgtataaccgggtttctgaggatctgcggtcccgcatcgaggtcctcaagcgtaaggtcatcgagaaagtgcaacacatccagctgttgcagaagaatgtcagagcgcagttggtcgatatgaagcgtctcgaggttgatattgatatcaagattcggagctgccgcggcagctgctcacgcgctctggcacgtgaggtggacttgaaagattacgaggaccagcaaaagcagctcgagcaggtcattgctaaggaccttttaccttctcgggacaggcagcatctccccctgattaagatgaagcccgtcccggaccttgtgcccggcaactttaagtcccagctgcaaaaggtcccccccgagtggaaggccctgacggacatgccgcagatgcgtatggagctggagcgtcccggcggtaacgaaataacccgcggtggtagcacctcctacggaactggatcggaaacagagtcaccccgcaaccccagtagcgccggctcctggaactcgggcagttctggacccggtagcactggtaacagaaaccccggatcctcgggaactggaggcaccgctacgtggaagcccggatcctccggaccgggctccaccggctcctggaactccggttcttcgggcaccggcagcactggaaaccagaatcctggcagtcctcgccccggcagcaccggtacctggaatcccggaagctccgagcggggcagcgccggacattggacatctgagagcagcgtctctggctccacgggacaatggcacagcgagtcaggttcctttcgccccgattcccccggttcgggcaatgccagacctaataatcccgattggggtacttttgaggaggtttccggtaacgttagccccggcacacggcgggagtatcacacagagaagttggttacgagcaagggcgacaaggagcttcgtaccggcaaggagaaggtgacctccggtagtaccaccaccacccgtcgatcctgttcgaaaaccgtcaccaaaaccgtcattggaccggacggacacaaggaggttaccaaggaggttgtgacgagtgaggacggctctgactgtcccgaggccatggacctgggtaccttatctggtattgggacgctggatggatttcggcataggcaccctgacgaggccgccttcttcgacacggcttcaacgggtaagacgttccccggcttctttagcccgatgttgggcgaatttgtttctgagaccgagtctcgtgggagcgagtccgggattttcacaaacaccaaggagtcctcttcacatcaccccggcatcgctgagtttccgagccgcggcaaaagcagctcctattcaaagcagttcacctcttccacgtcctacaatcgtggtgacagcacttttgagtcgaagagctacaagatggccgacgaggccgggtcggaggccgaccacgagggcacccactccactaaacgcgggcacgcgaagtcccggcccgtgagagactgtgatgacgtccttcaaacccatcccagcggaactcagagcggaatttttaacatcaagctgccaggatcatccaagatcttttctgtgtactgcgatcaggagacgtctctcggcggctggctgttgatccagcagcgtatggacggatccctcaacttcaaccgcacctggcaggattataagcggggttttgggagccttaacgacgagggcgagggggaattctggctcggtaatgactatctacatctcctcacccagaggggttctgtactacgcgtcgaactcgaggattgggccggcaacgaggcctatgctgaataccacttccgtgtgggttccgaggccgagggctacgcccttcaggtttcctcctacgaggggaccgccggcgacgccttaattgagggttcggttgaggagggcgccgagtatacaagccacaacaacatgcagtttagtaccttcgatcgcgatgctgaccagtgggaggaaaactgcgccgaggtctacgggggcggctggtggtacaataactgccaggccgctaaccttaacggtatctactaccctggtggctcttatgaccctcggaataacagtccgtacgaaatcgaaaatggagtggtctgggtctcgttccgtggcgctgactactccttgcgtgcagtccggatgaaaatcagaccactggtcacgcag

SEQ ID NO: 11082 - DNA, 2598 bp, Artificial Sequence
  Description of Artificial Sequence: Synthetic coding sequence
atgttcagcatgcgcattgtgtgcctggttctctccgtggtagggaccgcctggacagctgatagcggagaaggagatttcttagctgaaggtgggggtgtacgaggcccaagagtggttgagaggcaccagtctgcatgcaaggattccgactggccattttgttctgatgaggattggaactataagtgcccaagcggatgccggatgaaggggctcatcgacgaggtgaaccaagattttacaaacagaatcaacaagctaaaaaatagtctgttcgaatatcagaagaataacaaagacagtcactccctgaccacaaacatcatggaaatactccggggagatttttcaagtgctaataacagggacaacacttataatcgtgtaagtgaggatctaaggtctcgaattgaggtgctaaaaaggaaggtgatcgaaaaagtccagcacattcagcttttacagaaaaatgtgcgggcccaactcgtagatatgaagagactcgaggtggacatcgatatcaagatccgttcctgccggggctcctgcagcagggcattggctcgcgaagtggatctgaaggattacgaagaccagcagaaacagctcgagcaggtaatcgctaaagacttgctgccatctcgggaccggcagcacttgcccctgattaagatgaagccagtgcccgacctggtgccgggtaattttaaatcgcagctccagaaagtacccccagagtggaaagctctgacagatatgccacaaatgagaatggaacttgaacggcccggcggcaacgaaatcacccgaggcggtagtacaagctacggtacgggatccgaaacagagtctcctagaaatccaagctcagcaggctcctggaacagtggctcatcaggaccaggctcaactggcaaccggaatccgggtagtagcggcaccgggggcacagccacctggaaaccaggcagctccggaccaggtagcacaggctcatggaatagcggttcttctggaactggctccacaggaaaccagaaccccggcagccctaggccgggcagcacgggaacctggaatccaggaagctcagaacgaggtagcgctgggcactggacctccgaaagctcagtctcaggctcaacaggccagtggcactctgagtctggatcatttcggcccgacagccctgggtcaggcaacgccagaccaaataaccctgactggggtaccttcgaggaagtctcaggcaatgtctcaccaggcacaagacgtgagtaccacacagaaaaactggtgacctccaaaggagacaaagagctccggaccggcaaggagaaggtcacctccggttcaaccactaccactcggagaagttgctcaaaaaccgtgactaaaaccgtgatcgggccagacggccataaagaggttacaaaggaagtagtgacaagcgaagacggatccgattgtcctgaggctatggacttaggcaccctgtcaggaattgggaccctggacgggtttcgacataggcatccagatgaggccgctttttttgatactgccagcaccgggaagacctttcctggcttttttagtcccatgctcggcgaatttgtgagcgagacagaaagcagaggatcagaaagtggcatatttacaaataccaaggaatcatcctcgcaccaccctggcattgcagaatttccatctcgcggcaagtcctcctcttatagtaagcaattcacttcatcaaccagctacaaccggggagattctacattcgagagcaaatcatataaaatggccgatgaggcaggcagtgaagctgatcacgagggaacccactccaccaaacgtgggcatgccaaatctcggccagtacgtgactgcgacgacgtcctccaaacacacccgtccggaactcagagcggcatttttaacatcaagttgccagggtcgagcaagattttcagcgtctattgcgatcaggaaacctccctgggaggctggttgctcattcagcaacgcatggatggttccctcaatttcaaccgaacatggcaggactataagcgaggttttggttctttgaatgacgagggggaaggcgaattctggctgggtaatgactatctgcacctgctcacgcagagaggaagcgtgcttagagtggaactggaggattgggctggcaacgaggcctacgcagagtaccactttcgcgtcgggtctgaggcagaggggtatgctctccaagtaagctcctatgaaggaacggcgggcgatgccctgatcgagggctccgtggaggagggcgctgagtatacaagtcacaacaacatgcagtttagtacctttgatcgcgacgctgaccaatgggaagagaattgtgccgaagtttacggcggaggatggtggtataataattgtcaggcagctaatctgaacggcatctactaccccggggggtcgtatgacccccggaataattcaccatacgagatcgaaaatggtgttgtgtgggtgtctttccgcggcgcagactacagtctgcgggccgtaagaatgaagatacgtcccctggtgacccag

SEQ ID NO: 11083 - DNA, 2598 bp, Artificial Sequence
  Description of Artificial Sequence: Synthetic coding sequence
atgttttctatgagaatcgtgtgtcttgtcctgagcgtggtgggtacagcgtggacagcagattcaggggagggcgacttcctggccgagggtggaggagtacgagggccacgagtcgttgagagacatcagtctgcttgcaaggatagtgactggccattctgctctgatgaagattggaattataagtgcccctcaggatgcaggatgaaaggattgatcgacgaagtgaaccaagatttcactaaccgcattaacaagcttaaaaacagcctgtttgaataccagaaaaacaacaaggactcccacagtctcacaaccaatattatggagatcctgcgcggtgacttctcatctgctaataaccgtgacaacacttacaacagagtgtccgaagatctcagatctaggattgaggtactgaagcgaaaggttatagagaaggtgcagcacatccagctgctacaaaaaaatgtcagggctcagctggttgatatgaaaagactcgaggtggacatcgatatcaagataagaagttgtcgggggtcttgttcacgggctctggcccgagaagtggatctcaaggattatgaggatcagcagaagcagctggaacaagtgattgccaaggatcttctcccttcacgggacagacaacatttaccactcattaaaatgaagcctgtgcctgatttggtacccggaaacttcaagtcacaactccagaaggtccctcccgaatggaaagcactcacagacatgccccagatgagaatggagctggaaagaccgggaggtaatgaaataaccaggggtgggagcacaagctatggcacgggttccgaaacggagagccccagaaatccgtcaagcgccggctcctggaactccgggtcatcggggccaggaagtaccgggaacaggaaccctgggagttctggcaccggaggaactgctacatggaaaccaggcagttcgggaccaggttcgaccggaagttggaactctggtagcagtggtaccggttctacaggtaaccagaatcctggatctcccaggcctggatccacaggaacttggaatcccggctccagcgagcgcggatccgctggacattggacaagtgaatcctcggtatctggcagcacggggcaatggcactcagagagcgggtctttccggccagactcccccgggtcggggaacgccagacctaacaatcccgactggggcaccttcgaggaggtgagcgggaatgtgtctcccgggacaagacgagagtatcacactgaaaaacttgtgacttccaagggtgataaggaactgcgcacagggaaggaaaaagttacctcaggctcaaccacaactacgcgtcgcagctgttctaagaccgtcaccaagaccgtcatcggaccagatgggcacaaagaggtgaccaaggaggtggtgacctccgaggatgggtccgactgccctgaagccatggacttgggaaccctatcaggtatcgggacattagatggcttcaggcatcgccaccccgatgaggccgccttttttgacactgcttccacgggaaagacgttcccaggttttttctctcctatgcttggtgagtttgtcagcgaaacggaatctcgaggctctgagtccggtattttcacaaataccaaagagtcttcctcacaccacccaggcatcgctgagtttccatcacggggtaaatcatctagctactccaaacaatttacgtcctcgacatcatataaccgtggggatagcacatttgaatccaagtcttacaagatggctgacgaggccggatctgaagccgatcacgaagggactcattccacgaagaggggccacgcgaagtccagaccggttcgcgactgtgatgatgtgctacagacgcatccatccggaacacagagcggcattttcaatatcaaactgcccgggtcctccaagatattctctgtctactgcgaccaggaaacgagcctgggcggctggctgctgatacagcaaaggatggacggctcacttaatttcaatcgcacatggcaagactacaagagaggctttggttcactcaacgacgagggggagggcgagttttggctgggaaatgactacctgcacctgttaacccagcgcggcagtgttctcagggttgagctggaagattgggcgggcaacgaggcatacgccgagtaccactttcgcgtgggatctgaggcagaagggtatgctttgcaggtctcatcttatgaagggactgcaggcgacgccctgatcgagggttccgtggaggagggagctgagtacactagccataataacatgcagtttagcacctttgacagagacgccgatcagtgggaagaaaactgtgctgaagtttacgggggcgggtggtggtataacaattgccaagctgcaaacctcaatggcatctactaccctggcggaagctatgatccgcgcaataattccccctacgaaatagagaatggtgttgtttgggtcagctttcgcggagctgattacagtctgcgggctgtaaggatgaagatcaggcctctggtaacacag

SEQ ID NO: 11084 - DNA, 2598 bp, Artificial Sequence
  Description of Artificial Sequence: Synthetic coding sequence
atgttttccatgaggatcgtgtgtctggtgctgtccgtcgtcggcaccgcttggacagccgactccggagagggggacttccttgcagaggggggcggcgttagaggcccaagagtagtggagcggcatcaatcagcctgtaaggactccgattggcctttttgttccgatgaggactggaactacaaatgcccctccggttgtagaatgaaggggctgattgatgaggtaaaccaggattttacaaaccggataaataaactcaagaactcattgtttgaataccaaaagaacaacaaagactcacattccctcactacgaatatcatggagatccttcgcggtgatttcagctcagcaaacaacagggacaatacctacaaccgcgtgagcgaagacctcaggagccgaatagaggtgctgaaaaggaaggtgattgagaaggtacaacacatccagcttctccagaaaaacgtcagagctcagctggtggacatgaagcgacttgaggtggacattgacatcaaaattcggtcatgccgcggaagctgttcaagggccctggcgagggaggtggacctgaaggactacgaggaccagcagaaacagctggagcaagtgattgctaaagatctgcttccaagccgggaccgccagcatttgcctttgatcaaaatgaagccggtgcctgatctggtgcccgggaactttaagagccagcttcaaaaggtacctccagaatggaaagctctgacagacatgcctcaaatgcggatggagctggagagacctgggggaaatgaaatcacacgcggcggatctacctcctacgggactggctctgaaacagagtcccctcgcaaccccagttccgctgggagttggaacagtggctcctctgggccaggttccacagggaaccgaaaccccggctccagtgggacaggcggaaccgccacctggaagcccgggagttcaggcccggggtctacagggtcctggaactcagggagtagcgggacaggtagcaccggtaaccagaatcccggcagcccccggccggggagtacaggaacttggaacccgggctccagtgagcgaggaagtgcaggacattggacctctgaatcttccgtgagcggatctactggacagtggcacagtgaatctggctctttccggccggattctccgggttccggaaatgctaggcccaacaatccggactggggcacatttgaggaggtctcaggcaatgtctcccccgggactcgccgagagtatcatactgagaagcttgtgaccagcaagggggataaagagctccgcacaggcaaggaaaaggtcacatcaggaagcaccactaccactcgaaggtcttgctccaagactgtaaccaagaccgtcatcgggcctgacggccacaaggaggtcacaaaggaagttgtcacctccgaagatggttccgactgcccagaggcgatggacctcggcacgctgagcgggattgggaccctcgatggtttcaggcacaggcatccagatgaggccgcgttcttcgatactgcaagtaccgggaagacattccctggcttcttctcacctatgctgggggagtttgtttccgaaacagaaagtcgcggatctgaaagcgggatctttaccaacacaaaagaatcttctagccaccatcccggaatcgctgagttcccatcaagagggaagtcttcatcttactctaaacaattcacctctagcacctcttacaataggggggatagtaccttcgagtcaaagagctataagatggcagacgaggccggtagcgaggccgatcacgaaggcacacattccacgaagcggggacatgccaagtccagacccgtgcgggactgcgatgacgtgcttcagacacatcccagtggaacacagtctggtatctttaacataaagttgcctggctccagcaaaatattctctgtctattgcgaccaagagacatctctgggcgggtggttgttgatccaacagcgcatggatggcagtctcaatttcaacaggacctggcaggattataaacggggattcggctctctcaacgacgaaggcgagggagaattctggttggggaacgactatctccacctcttgacccagcgaggcagcgtcctgcgagtcgagctggaagactgggctggtaacgaggcatacgccgaataccacttccgagtcggaagtgaggcagaggggtacgcccttcaagtcagttcatacgaggggaccgctggggatgcgctcatcgagggctctgtggaggaaggcgcagagtatacctctcacaacaatatgcagttttccacatttgatcgggacgctgaccagtgggaggaaaattgcgctgaggtgtatggcggcggatggtggtataataactgccaagcagcgaacttgaatggaatctactatccgggaggctcatatgacccaaggaataattccccctacgagattgagaacggggttgtctgggtgagtttcagaggggctgattactccctgcgcgccgtccgcatgaaaatccgcccactcgtgacccag

SEQ ID NO: 11085 - DNA, 2598 bp, Artificial Sequence
  Description of Artificial Sequence: Synthetic coding sequence
atgtttagcatgaggatcgtgtgtctggtcctgtcagtcgtgggcaccgcctggaccgccgactctggagaaggcgactttctggccgagggcggaggcgtccgcgggccaagagtcgttgaaaggcaccagagcgcctgtaaagacagcgattggcccttctgcagcgacgaagactggaattataagtgtcctagtggctgtagaatgaaggggctgatcgacgaagtaaaccaagacttcaccaatcgaattaacaaattgaaaaactctcttttcgaataccagaaaaataataaggattcgcactcgttaaccacaaatataatggagattctgaggggagacttcagctcagccaataaccgagataacacatacaatcgcgtaagtgaagatttacggagtcgaatcgaggtgcttaagaggaaggtgattgaaaaggtgcagcacattcagttgctccagaagaatgtgcgtgctcagttggtagatatgaaacgcctggaggttgacatcgacatcaaaatccgaagctgtaggggctcatgtagcagggccctagcccgagaggtggatctgaaggattatgaggaccagcaaaagcagctggaacaagtgattgctaaggacttacttcccagtcgggaccgacagcacctgcccctgatcaagatgaagccggttcccgacctcgtgcctggcaacttcaaatctcagttgcagaaagtgcctccagaatggaaggcgctaacagacatgccgcagatgagaatggagctagaacggcccggggggaatgagatcactagagggggatcaaccagctacggcactggtagcgagaccgagagccctcggaacccctcctctgctggatcctggaacagcggaagctcaggccccggatcaacagggaatcgcaaccccgggtcctcaggaacgggcggcactgccacatggaaacccggaagttccggacctgggagcacgggatcttggaactccggctcttctggtacgggctctacgggaaatcaaaacccggggtcccccagaccggggagcacgggtacctggaatcctggcagcagcgaacgtggctccgctggccactggacctcggaatcctccgtaagtggctccacaggacaatggcacagtgagtctggctcttttagacccgactcgccaggttctgggaatgcgaggcctaacaaccccgactggggcacctttgaagaggtcagtgggaatgtgtctcccggcacgcgtcgcgaatatcatacagaaaagctcgtgacatctaagggagacaaggaactccgaactggaaaagagaaggtgacttctgggtccaccactacaacgagaagaagctgctcaaaaacagttaccaagactgtaatcggccccgatggtcataaggaggttacaaaggaggtcgtgacttccgaagatggatcggattgccctgaggcaatggatctgggcacgttgtcagggatcggtacattagatggtttccggcaccggcacccagatgaggccgccttcttcgatactgcatctacggggaaaacattcccagggttcttcagtcccatgctcggggagttcgttagtgagactgagtcccggggatctgaatccggtatcttcactaataccaaagaatcttcctcccatcaccccgggatagctgagttcccttcccggggtaaatcatcctcttactctaaacagttcaccagttccactagttataaccgtggcgacagtaccttcgagagcaagtcatataaaatggcggacgaagctgggtcggaggcagaccacgaaggcactcactcgactaaacgcggccatgctaaatctcgtcctgtgcgggactgcgacgacgtgttgcagacacatccttccgggacccagagcgggatttttaatatcaagctgcctggctcctccaagatctttagtgtctattgcgatcaggaaacatcgctggggggttggctgctcatacaacagcggatggatggatctctaaactttaatcggacctggcaggattacaagcgtggtttcggcagcctcaacgacgagggagagggcgagttttggctcgggaacgattacttgcatttgcttacgcagcggggtagtgtgctccgggttgagctcgaggactgggctgggaacgaggcatatgccgagtatcattttagagtgggctcagaggcggagggatacgccctgcaggtgtcatcctatgaggggacggcaggtgatgccttaattgaaggctctgttgaggaaggggcagaatacacatcacacaataatatgcaattctcaacgttcgatcgcgatgctgaccaatgggaagaaaactgcgcagaggtttacggcggaggttggtggtataataattgccaggctgccaacctcaacggcatctactaccctggaggctcctatgatccacgcaacaacagcccatacgaaatagagaacggagtcgtgtgggtgagtttccgaggagccgattacagcctgagagcagttcggatgaaaatccgacctctagtgactcag

SEQ ID NO: 11086 - DNA, 2598 bp, Artificial Sequence
  Description of Artificial Sequence: Synthetic coding sequence
atgttcagtatgcgaattgtgtgtcttgttctgagtgtggtgggaacagcgtggacagctgactccggagaaggcgatttcctggcagagggagggggagtacgggggccacgggtagtcgagcggcatcaatccgcttgcaaggactcagattggcctttttgctctgatgaggactggaactataagtgcccttcgggatgtcgaatgaagggactcatagacgaagtgaaccaagacttcacgaataggatcaacaaactcaaaaactccctgtttgaataccagaagaataacaaggacagtcacagtcttacgaccaatatcatggaaatactcagaggggacttttcaagcgccaacaatcgggacaacacgtacaatcgcgtgtcggaagatcttcgaagcagaatcgaagtgctgaaacgtaaagtgatcgaaaaggtccagcacatccagctgctccagaagaacgtgcgcgcgcagctggtggatatgaagcggctggaagtggacatcgacatcaaaatcagatcttgccggggctcctgctcaagggccctcgctcgagaggtcgatctcaaagattatgaggatcagcaaaagcaactggaacaggtcattgcaaaggacttgcttccatctcgcgacagacagcacttgccactgattaagatgaagcccgtccccgacttagtccccgggaactttaagtcccagttgcagaaagtccctcccgaatggaaggctctgacagatatgccccagatgagaatggagctcgaaagaccaggtggaaacgagattacaaggggtggatctacatcttacgggaccgggtctgagactgaatctccacggaatccgtcaagtgctgggagctggaattctggcagttcagggccgggttcaacaggtaaccggaaccctggctcttcaggaactggaggcacagcaacctggaagcctggaagcagcggaccaggctctactggctcctggaactcaggctctagcggcacaggctcaaccggcaaccaaaatcccggaagtccccgtcccggcagtactggaacatggaatcctggaagctcagagcgaggctcagcaggccactggacctccgagtcctcagtgagtggatcgactggacaatggcatagcgagagcgggtcatttcgaccagactctccaggatctggcaatgcacgaccaaataatcccgactggggcacttttgaggaggtgtcgggaaacgtgtcgccaggaacgcgccgggagtatcacacagagaaattagtcaccagtaagggggataaagagctcagaacggggaaagaaaaagtgaccagtggatcaactaccacaacaaggcgctcatgttcaaagacagtaaccaagacagtgatcgggccggacgggcacaaagaggtgaccaaagaagttgtgacctccgaagacggttccgactgtcccgaggccatggacctggggacactttctggaatcgggactctggacggctttcggcaccggcacccggacgaggcagcctttttcgacacagccagcaccggcaaaaccttcccgggcttcttttccccgatgcttggggagtttgtgtcagagaccgaatcgcgcgggtcggagagcggaattttcaccaatactaaggagagttcaagccaccaccctgggatcgctgagttcccaagtcgaggtaagtcaagttcctatagcaaacaatttacatcctccacaagttataatcgaggtgattctacattcgagtccaagtcttacaagatggcggatgaggctggttcagaggctgatcacgaaggtacacactctaccaagagggggcatgctaagagccggccggtacgtgattgcgacgatgtgctgcagacccatccaagcgggacccagtcgggcatcttcaacattaaactgcccggatcatccaagattttctctgtatactgtgaccaggagacgtcactggggggatggctcttgattcagcagagaatggatggttctctaaattttaacagaacatggcaggactacaagcggggatttggcagcctgaatgacgagggagagggagaattttggctgggcaatgactatctacacctgcttacccaacgtggatctgtgctgcgcgtcgagctggaagattgggccgggaatgaggcgtacgccgagtatcacttccgcgtggggtccgaggctgaaggctatgctttgcaagtgtcctcctacgagggtaccgccggcgacgctttaatagagggttcggtagaggagggagctgaatatacatctcacaataatatgcagttctcaacctttgatcgtgacgcggatcagtgggaagaaaactgcgcggaggtctacggtggaggttggtggtacaacaactgccaggccgcaaacctgaacgggatctattatccaggggggtcctacgacccgcgcaataactcaccctatgaaatcgaaaacggcgtcgtttgggtcagcttccgtggagctgattatagcttgcgcgctgttcgaatgaagatccggccattggttactcaa

SEQ ID NO: 11087 - DNA, 2598 bp, Artificial Sequence
  Description of Artificial Sequence: Synthetic coding sequence
atgttttctatgcgcatcgtatgcctcgttctgtccgtagtgggaactgcttggacagccgattcaggagaaggagattttttagccgaaggaggaggggtcaggggaccacgggttgtagaaagacaccagtccgcatgcaaagactcagattggcccttctgtagtgatgaagattggaactataaatgcccctccggatgcagaatgaaagggctgatagatgaggtgaatcaggatttcacaaatcggataaacaagctcaaaaactcattattcgaatatcaaaaaaataacaaagattcccacagtctcactactaacataatggaaatacttcgaggagatttctcttctgctaataatagggataacacatacaatcgagtatcagaagacctgaggtcccgaatcgaagtgctcaagaggaaagtaatagaaaaagttcagcacatccagctgctccagaaaaatgtgcgggcccagctagtagatatgaaacgcctggaggtcgacattgacatcaagatacgctcatgtcgggggtcgtgctctagagctttagccagagaagtggatctcaaagactatgaagatcagcagaaacagctcgaacaggtaatcgctaaagatctcctgccttcccgagatcgccagcatctacctctcataaaaatgaaacccgttcccgacctggttccgggaaacttcaaatcacagttacagaaagtgcctcccgagtggaaagccctgactgatatgccacagatgcggatggaactcgagcgaccaggaggaaacgagatcactcggggaggatccacatcgtacggaactgggagtgaaactgaatcacccaggaatccatcttccgctgggtcctggaactccggatcctccggaccaggatcgacaggaaatcggaatccagggtcatcagggactggggggacagcaacatggaaacccgggtcttcagggcctggatccacaggatcttggaactccggaagttcaggaactgggtcgacaggaaaccagaacccagggtcgcctagacccgggagtactggaacttggaaccccggatcatcagaaagggggtcagccgggcactggacttcggaatccagtgtgtctgggtctacaggacagtggcatagtgaaagtggaagttttcggccagatagtcctgggtctggaaacgcccgaccaaacaaccctgattggggaacattcgaagaagtatccggaaatgtctctcctgggactagaagggaatatcacactgaaaaacttgtgactagtaaaggggataaggaactgagaactgggaaagaaaaggtgacatcaggatccactacaacaactaggaggtcctgttctaagactgtcacaaaaactgtgattgggcctgatgggcataaagaagtgacaaaagaagtggtcactagtgaagatggatctgattgtcccgaagccatggatctggggactctctctgggatcggaacacttgatggatttcgccatcggcatcctgatgaagccgcgttttttgatacagcatctacaggaaaaacatttcctggattcttttccccaatgctcggggagtttgtttctgaaacagaaagtaggggatccgaaagtgggatattcacaaacactaaagaatcttcatcccaccatcccgggattgcggaattcccctctagggggaagtcatcaagttactctaaacagtttacatctagtacttcttataacagaggggattccacattcgaatcaaagtcctataaaatggctgacgaagccgggagtgaagccgatcatgaagggactcattccacaaaacggggacacgctaaatcccgcccagtcagggattgtgatgatgttcttcagacacatccctctgggactcaatcaggaatatttaacatcaagctgcctggaagttctaaaattttctccgtgtattgtgatcaggaaacttcactcggagggtggctactcatccagcaaaggatggatggatccttaaattttaaccgaacttggcaggattataaacgggggttcggaagtctcaatgatgaaggagaaggagaattttggcttggaaacgattatcttcatcttttaacacagcgggggtctgtgctgcgagtggaactcgaagattgggccggaaacgaagcatatgctgaatatcatttcagagtagggtccgaggccgaagggtacgctttacaggtttcatcctacgagggaactgctggagatgccctgatagaagggtctgtcgaagagggggccgagtatacttctcataacaatatgcagtttagtacattcgatcgggatgctgatcagtgggaagaaaactgtgccgaggtttacgggggggggtggtggtataacaattgccaggcagccaatcttaacggaatctattaccccggaggatcttatgatcctcgaaacaatagtccatacgaaatcgaaaacggggtcgtgtgggtcagtttccggggggctgattattctctgcgcgctgttagaatgaaaattcggcctctcgtgactcag

SEQ ID NO: 11088 - DNA, 2598 bp, Artificial Sequence
  Description of Artificial Sequence: Synthetic coding sequence
atgttttcaatgcggattgtgtgcctggttttatcagtggtaggtaccgcttggactgccgattctggcgagggagacttcttggccgagggagggggagttcgggggccacgagtggtggagcggcaccagtctgcctgcaaggatagcgattggcccttttgtagtgacgaagactggaattataagtgtccaagtggctgcagaatgaagggtctgattgatgaggtgaaccaggacttcaccaatagaatcaacaaactaaagaattcactattcgagtaccagaagaacaacaaagacagtcactctctcacaaccaacatcatggagattttaaggggcgatttctcatccgcaaataatcgtgacaacacctacaatcgtgtgagtgaggatctacggagccgtatagaagtactgaagcggaaagtgattgaaaaggtgcagcacatccagctgcttcagaaaaacgtgagggcccagctagtcgatatgaaacggctcgaggtcgatatcgacataaaaataaggagttgtcgaggaagctgtagccgagccttagcacgggaagtggatctgaaagactatgaggatcaacagaagcagctggaacaagttattgccaaggaccttctgccgtccagagacaggcaacacctgccgctcatcaagatgaaacccgtcccagatctggtgcccggaaatttcaagagtcagctacagaaggtgcctcctgaatggaaggctttgactgatatgccccaaatgcgcatggaattagaacgacctggtggcaatgaaattacccgtggggggtcgacatcttatggtacaggcagtgaaacggagagtccaaggaaccccagctctgctggatcctggaactctggatccagtggaccgggatcaactggcaatagaaatcccgggagcagtggcacaggggggaccgcaacttggaaacctggctccagtggacctggatcaaccggctcttggaatagcggttcctcaggcaccgggtccaccggcaatcagaaccctgggtcaccgagaccaggaagcactgggacatggaacccaggatcatcagaaaggggctctgctgggcattggacaagcgagtcttcggttagtggctctacggggcagtggcattctgagtcaggttcctttcgcccagactctccaggctctggcaacgctaggccaaacaatcctgattggggtaccttcgaggaagtaagtggcaacgttagccctgggacccgcagagagtatcacactgaaaagctggtaacttcaaaaggcgataaagagctgcgtaccggcaaagagaaggtgaccagcggatctacaacaacaacccgtaggagctgctctaagaccgtgactaaaactgtcataggtccggacggccacaaggaagttacaaaggaagtggtgaccagtgaagacggtagtgattgtcctgaagcaatggatttagggaccctttccggtataggcaccctagacgggttccggcacagacacccagatgaagccgcgttttttgacacagcctccactggcaaaacatttcccggtttcttttctccgatgctcggggaattcgtcagcgagacagaatcccgtggatccgaatcaggaatctttacgaatactaaggagagcagcagccatcatcccggcattgcagagttccccagtagaggcaaatctagtagttatagcaaacagtttaccagttccaccagctacaacaggggggatagtacctttgaatctaaatcctataagatggccgatgaggctgggtccgaagccgatcacgaaggcacacattccacgaaacggggccacgctaagagcagaccagtacgtgattgtgatgacgtgctccagacccacccgtctggcacacagtccgggatattcaatatcaagctgccaggatcaagcaagatttttagcgtgtactgtgatcaggaaacttctttaggaggctggcttctgatccagcaacggatggacgggtccttgaacttcaaccggacctggcaagattacaagcgcggcttcggctccctgaatgacgaaggagagggcgagttctggctggggaacgactacctgcacctgttgacgcaaagggggagtgttttgcgagtggagctggaggattgggctggtaacgaggcatatgccgaataccactttcgcgtggggagcgaagccgagggctatgcactgcaagtctcgtcatatgagggcaccgctggggatgctctcatcgaaggcagtgtggaggaaggggccgagtatacctctcataacaacatgcagttcagtacattcgaccgcgatgccgatcagtgggaggagaactgcgcggaagtctatggcgggggatggtggtataataactgtcaggccgccaatctaaacggtatctactaccctggtggctcgtacgacccccgcaacaattctccatacgaaattgagaacggcgtcgtttgggtgtcttttagaggtgctgactacagcctccgtgcagtccgcatgaagatacggcctcttgtgacccaa

SEQ ID NO: 11089 - DNA, 2598 bp, Artificial Sequence
  Description of Artificial Sequence: Synthetic coding sequence
atgttttcgatgagaatcgtgtgcctcgtgctttccgtggtgggaactgcatggaccgcagactcaggggaaggtgactttctcgcagagggtggtggggttcgtggcccgagagtggtggagcgccatcagagcgcgtgcaaagatagcgattggcctttctgttcggatgaggattggaactacaagtgcccttccgggtgcagaatgaaggggctgatcgatgaagtcaaccaagacttcacgaacagaatcaacaaactgaagaattcactcttcgagtaccagaagaataacaaagattcgcattcgctgactaccaatatcatggagattctgcggggggatttctccagcgcaaataaccgggacaacacctacaacagagtgagcgaggacctgcggagcagaattgaagtgctgaagcgaaaggtcattgagaaagtgcaacacatccagcttttgcagaaaaacgtgagagcccagcttgtcgacatgaagagactggaggtggacatcgacattaagatcaggtcatgtagaggctcctgtagccgtgcgctggcacgcgaagtcgacctgaaagactacgaggaccaacagaagcaacttgagcaggtgatcgccaaggatttgcttcctagccgagatcgccagcatcttcctctgattaagatgaagcctgtcccagatctcgtgccggggaatttcaagtctcagcttcaaaaggtgccacctgaatggaaagccctgactgacatgcctcaaatgcgtatggagttggagaggccaggtggtaacgagattacgagaggtggctcgacgtcatatggcaccggttcggaaacggaatcgcctcggaacccttcctcggcagggtcgtggaactccgggagctccggacccgggtcaactggaaataggaatcccggcagctctggaactggtggaaccgcaacttggaaacccggttcgtcgggaccggggtccactggtagctggaacagcggttcatctggtaccgggtcgaccggtaaccaaaacccaggatcaccaaggcctggatccacgggaacgtggaatcctggttcctccgaacgggggtccgcaggacactggacttcagaatcctcggtgtccggatcgaccggtcagtggcacagcgaaagcggatcatttcggcctgattctccaggttccggtaacgcacggccgaataaccctgactggggtacttttgaagaggtgtcaggtaatgtctctcccggcactcggcgcgagtaccacactgaaaagctggtgacctcaaagggggacaaagaacttcgcaccggtaaggaaaaggtgacctcgggaagcactaccactactagaagatcatgttccaaaaccgtgactaagaccgtcatcggtccagatgggcataaagaagtgaccaaagaagtggtcacctcggaggatggaagcgactgtcctgaggcaatggatcttgggacgctctcgggtattgggacgcttgatggcttccggcatagacatcccgatgaagctgctttcttcgataccgcatcaactggcaagacgtttcctggatttttctcgcctatgctcggtgagtttgttagcgaaactgagtccaggggatcggaatccggcattttcaccaacaccaaagagagctcctcacaccacccgggaatcgccgagtttccatcgaggggtaagtcgagctcgtactcgaaacagtttacgagctctacttcgtacaatcgaggtgattccactttcgaatccaaatcctataagatggccgatgaggcaggttccgaggccgatcacgaaggtactcactcgactaagcgcggacatgccaaatcaagacccgtgagggattgtgatgacgtgctccagactcatccatcaggtacccaatcgggaatattcaatatcaagctgccaggatcgtcgaagatattctcggtgtactgcgatcaagagacttccttggggggctggctgctcatccaacagcggatggacggaagccttaacttcaatagaacgtggcaagattacaagcgtggttttggatcactgaatgacgaaggtgaaggggaattttggcttggaaacgactacctccatcttctgactcagaggggctcagtcctgcgggtcgaactggaagattgggcaggaaacgaagcgtacgcagaataccatttcagagtcgggtcggaagcggaagggtatgcacttcaggtgtctagttacgaggggaccgccggagatgcactgattgaggggtccgtcgaagagggcgcagaatacactagccacaacaatatgcaattctccacttttgatagggatgcagatcaatgggaggaaaattgtgcagaagtctacggagggggttggtggtacaacaactgtcaggccgcaaacctgaacggaatttactaccctggtggaagctacgatcctagaaacaactccccctacgaaatcgagaacggagtggtgtgggtttcgtttcgaggcgcagactactccctgcgagcggtgcgaatgaagatacgcccccttgtcactcag

SEQ ID NO: 11090 - DNA, 2598 bp, Artificial Sequence
  Description of Artificial Sequence: Synthetic coding sequence
atgttcagcatgcgtatagtgtgcctggtgctcagtgtagtgggcaccgcgtggacagcagattcgggagagggcgatttccttgccgaaggcgggggtgttagaggcccaagggtcgtcgagagacaccagagtgcctgtaaggacagtgactggccattctgctccgacgaggattggaactataagtgccctagtggttgccgcatgaaaggcttaatcgacgaggtgaatcaggacttcaccaatcgcattaataagctgaagaactccctgttcgagtaccaaaaaaacaacaaggacagccattcgttgaccactaatataatggagattttgaggggagacttttcttcagccaacaacagagacaatacatacaatcgtgtgagcgaggacctaaggtcacgtatcgaggtcttaaagcgtaaggtcattgaaaaggtgcagcatatccaactcctgcagaagaatgtgagggcacagctggttgatatgaagcggttggaagtcgacattgatataaagattcggtcttgtaggggctcttgtagccgggccctggctagggaagtcgacttgaaggattacgaagaccaacagaaacagcttgagcaggtgatagcgaaagacctcttgccaagccgcgatcgccagcatctgccccttatcaagatgaagcctgttccagatctagtccccggaaacttcaagtcccagcttcagaaggtcccaccggaatggaaagccttgacagatatgccacagatgcgcatggagctagaaaggccgggtgggaacgagattacacgtgggggatcaacgtcttacggcactgggtctgagacagaatctccccgaaacccaagcagcgctggatcctggaacagcggtagcagcggccctggctcgacaggtaataggaatcctggtagttctggtacgggtgggaccgcaacttggaaacctgggtcttccggcccaggctcaaccgggtcctggaatagcggatcttctgggacaggctcaacaggaaatcagaaccctggctccccccgtcctgggtctacgggtacatggaacccgggatcctcggaacgcggttctgctggacactggacaagcgaaagtagcgtgtcaggctcaaccggtcaatggcacagcgaaagtggctcgttccgacctgactcaccagggtccggtaacgctcgtcccaacaatcccgactggggcacctttgaagaagtctctgggaacgtgtccccgggcactcgccgggaataccacacagagaagctcgtgacatcaaagggggacaaagagctgcgcactggtaaagagaaggtaacttcgggctcaactactactacccgccgctcctgcagcaaaacagtaaccaagactgtaatcgggcctgacgggcataaggaggtgaccaaggaggtggtcacctctgaagatggatcggattgtcccgaagctatggacttaggaaccctcagcggcatcgggacactggacggattccgccatagacacccagacgaggcagccttttttgacaccgccagtactgggaagacctttccaggctttttctccccgatgctcggagaattcgtgagcgagacagagtctcgaggttcggagtccggcattttcaccaacacaaaggagtctagcagccatcatcccggcattgccgagttcccaagtcggggaaaatccagctcatattctaaacagtttacatcttcgacttcatacaatcggggcgactcaacctttgagagcaaaagctacaaaatggctgatgaggccggctccgaggcagaccacgaggggacccattcaaccaagcgcggccatgccaaaagcaggcccgtgagggattgcgacgacgtgctccagacgcatccctctggcacacagagtggcatctttaatatcaaattaccgggatctagcaagatatttagtgtgtactgcgatcaggagacatccctggggggatggttgctgatacagcagcgcatggacggctcattgaattttaataggacatggcaggactataaaaggggcttcggctcactcaacgacgagggcgagggcgagttttggttaggcaacgactacttgcatctcttgacacagagagggtccgtcctgcgggtggagctcgaagattgggctggaaacgaagcctacgcggagtaccatttcagagtagggtctgaggcagaagggtatgccctgcaggtctcctcgtatgaagggaccgccggagacgcattaatcgagggaagcgttgaagaaggagcagaatacaccagccacaataacatgcagttttccacctttgacagagatgctgaccaatgggaggagaattgcgccgaggtttatggagggggttggtggtataacaattgccaggccgccaacttaaatgggatctactatccgggaggcagttacgacccacgaaataatagtccctatgaaatcgagaacggagtcgtttgggtcagtttcaggggagccgattattctctgcgcgccgtgcgaatgaaaataagaccccttgtgacccag

SEQ ID NO: 11091 - DNA, 2598 bp, Artificial Sequence
  Description of Artificial Sequence: Synthetic coding sequence
atgttctcaatgagaattgtatgcctggttctctcagtggtcggaaccgcctggactgccgacagcggagaaggggacttcctggctgaaggaggcggagttagaggaccgcgggtcgtcgaacgccaccaatcagcctgtaaagactcggactggccgttctgtagcgacgaagattggaattacaagtgtcccagcggatgcagaatgaaaggactgattgatgaagtgaaccaggattttactaatcgcataaataagctcaaaaactcgctgtttgaataccagaaaaataataaagactcccactcgctgaccaccaacatcatggaaatcctgcgtggagacttctcctccgccaacaaccgcgacaatacctacaacagggtttccgaggatctccgatcgaggatcgaggtgctcaagcggaaggtgatcgagaaggtgcaacatatccagctgctccaaaagaacgtgcgagcgcaactggtggacatgaagcgcctggaagtcgacatcgacatcaagatccgctcgtgccgcggatcctgcagcagagccctggccagagaagtggacctgaaggattacgaagatcagcaaaagcagctcgaacaggtgatcgctaaggaccttcttccgtcacgggaccgccagcacctcccacttatcaaaatgaagcctgtgccggacctggtgccggggaatttcaagtcgcagttgcagaaggtcccgccggagtggaaagcacttaccgatatgccacaaatgcggatggaactggaacgccccggaggcaacgaaatcactcgcggaggcagcactagctacggaactggatcggaaactgagtcgccgcggaacccgtcatcagcagggtcctggaactcgggttcctcgggaccgggaagcactggaaacagaaaccctggatcctcgggaaccgggggaaccgctacttggaagccaggctcgtccggaccgggttcaactggctcgtggaatagcggaagcagcgggaccggctcaaccggtaaccagaatccaggaagcccgcggcccggatcaactgggacttggaatcccggttcatccgagcgcggctcagctggtcactggacttcagaatcgagcgtctcaggctctactggacaatggcattcagagtcaggatcgtttagaccggactcgcctggctctgggaacgcccgcccaaataatcccgactggggaactttcgaggaagtgtccggaaacgtctcccctggtacgcgccgcgaataccatactgagaagttggtgacgagcaagggagacaaggaactgcgcaccggaaaagagaaagtgacttcgggatccaccaccactacccgcagaagctgctcaaagactgtgacgaaaaccgtgattggccctgacggacataaggaggtcactaaggaagtggtcacttccgaagatggatccgattgtccggaggctatggatctgggcactttgtcgggcattggcactctggatggattccggcatcgccacccggacgaagcagcgttcttcgacaccgcttcgactggtaaaaccttcccgggcttcttctcgccaatgctgggagagttcgtgagcgaaaccgaatcgagaggaagcgaatcgggcatcttcaccaacaccaaagaaagctcatcccaccatccaggaatcgccgagttcccttccagagggaaaagtagctcgtactccaagcagttcaccagctcgacctcctataacaggggtgacagcacgtttgagtccaagtcatacaagatggcggatgaagccggatccgaagccgaccatgaaggcacccacagtaccaagaggggacacgcaaagtcgcggccagtgcgcgactgcgacgatgtcctccagacgcaccctagcgggacccaatccggaatcttcaatatcaagttgcccggctcgagcaagatcttctcggtgtattgcgatcaggagacttcgctggggggttggctgctcatccaacagcggatggatggatccttgaacttcaatcggacgtggcaggattataagcggggctttggatccctgaacgacgaaggtgagggcgagttttggctgggtaatgactacctccacctcctgacccagcgggggagcgtgctcagggtcgagcttgaggattgggcgggaaacgaggcgtacgcagagtaccatttcagagtcggctccgaggccgaggggtacgcgctgcaggtgtcctcttacgagggaacggctggagatgccctgatcgaagggagtgtggaagaaggagccgaatacacctcacacaacaacatgcagttttccaccttcgaccgagacgccgatcaatgggaggagaattgcgcagaagtgtacgggggcggttggtggtacaataactgccaagcagcgaacctcaacggaatctactaccctggcggctcttacgatccacggaacaactcaccatacgagattgagaacggcgtcgtgtgggtgtcgtttcggggtgcggactactccctgagggccgtgcgtatgaagatccggccgctcgtgacccag

SEQ ID NO: 11092 - DNA, 2598 bp, Artificial Sequence
  Description of Artificial Sequence: Synthetic coding sequence
atgtttagcatgcgcatcgtctgcctcgtgctctcagtggtcgggacggcatggacggcagactcgggggaaggtgattttctggccgaaggcggaggcgtgcgaggtccccgcgtagtggagcgtcatcagtctgcgtgcaaagactctgactggcccttctgcagcgacgaggactggaactacaagtgtcccagcggctgtagaatgaagggtctcatagatgaggtcaatcaggattttaccaacagaattaacaagttaaaaaattcattattcgagtatcagaagaataacaaagatagccacagtcttactacaaacatcatggaaatcttacgaggcgattttagctcggcaaacaaccgtgataacacctacaacagagtgtcggaggaccttcgtagtagaatagaggtgctcaaacggaaagttatagagaaagttcagcatattcagcttctccaaaaaaatgtgagggcacagctggtggatatgaaaagactcgaagtagatattgatatcaagatcaggagctgccgagggtcttgctctcgagcgctcgcgcgggaagtcgatttgaaagactacgaagaccagcagaagcagctcgagcaggtgatcgctaaggacttgttgccctccagggacaggcagcatctcccgctgatcaagatgaagccagtgccagatttagttccaggtaacttcaaatcacaactgcaaaaagttccccctgagtggaaggcattgacagacatgccgcagatgcgcatggagctggagaggccaggaggaaacgaaattactcggggcggttctacatcctacggtactggttccgagaccgagtccccacggaatccctcttcagcggggtcgtggaacagcggctcgagcggacccgggtcgactggcaaccgcaaccccgggagctctggaaccggcggtaccgccacctggaagcctgggtcctcgggtccgggctctaccggcagctggaacagcggcagctccggaaccggctccacggggaaccaaaaccccggctccccacgccccggcagcacagggacgtggaacccaggtagttccgagcgaggcagtgctggtcactggacgtcggagtcgagtgtgtcaggaagtacgggtcagtggcatagcgagtctggctctttcaggccggactctcctggttctggtaatgcccggcctaataaccccgactggggaacctttgaggaggtgtctggaaatgtaagtccaggcactcgccgtgagtaccacaccgagaaattggtcactagtaagggcgataaggagttgcgtacaggcaaggagaaagtgacttcaggctcaacaactaccactagaagatcttgttcaaagaccgtgacgaagaccgtcatcggacccgacggccacaaggaagtgaccaaggaagtcgtcacttcagaggacggtagcgattgcccagaggctatggacctgggtacgttgagtggtattgggacgctagatggatttcgtcaccggcatcctgatgaagctgcgttcttcgatacggcaagcaccggcaagacgttcccgggattttttagccctatgctcggcgaatttgtgtcggaaaccgagagtcgggggtcggaaagtggaatttttaccaacaccaaagagagctcttcccatcaccctggtatcgccgagttccccagccgaggtaagtccagcagttactccaaacagttcacctcttctacttcttataatcgcggcgattcgacctttgagtctaagtcctacaagatggctgatgaagctggctcggaggcagaccacgagggcacccattctactaagcgtggacatgccaagagcagacctgttcgagattgcgacgacgtgcttcaaacccatccaagcgggactcagtctggcatcttcaacattaagctcccaggttcaagtaaaatattttctgtgtactgtgaccaggagacgtcgttgggggggtggcttcttatccagcaacgcatggacggtagcctgaactttaaccgcacgtggcaggattacaagcgtggtttcgggtccctaaacgatgagggggagggggagttctggctgggtaacgactacctgcatctattaacacagaggggttcagtgttgcgcgtcgaactagaagattgggctgggaatgaagcatacgctgaataccatttccgcgttggatctgaagcggagggttatgcgctccaagtctcaagttatgagggtacagctggcgacgctctcatcgagggctccgttgaagagggagccgagtacacgtcgcacaacaacatgcaattttccacgttcgaccgcgatgctgatcaatgggaggagaactgcgcggaggtttatgggggcgggtggtggtacaacaactgtcaggccgccaacctcaacggaatttattatccgggcgggtcgtatgacccgcgaaataatagcccctacgaaatagaaaacggagtagtctgggtaagttttcggggggcagattactcactgcgtgcagtccgcatgaaaatacgtccactggtgacacaa

SEQ ID NO: 11093 - DNA, 2598 bp, Artificial Sequence
  Description of Artificial Sequence: Synthetic coding sequence
atgtttagcatgcgaattgtatgtctcgtcctgtccgtggtggggactgcatggaccgccgattcgggagaaggtgattttctcgcagaggggggcggtgtccgggggcctagagtggtggagcggcatcaatccgcatgtaaggattcggattggccgttctgttcggacgaggactggaattacaagtgtccatccgggtgccggatgaaaggattgatcgacgaagtgaaccaggattttacgaaccggatcaacaagctgaagaactcgctttttgagtaccaaaagaacaacaaagattcgcactcgctgactaccaacattatggaaatcttgcgaggggatttctcatcggcaaacaacagagacaatacctataacagggtcagtgaagatctccgctctcgaattgaagtccttaagagaaaggtgatcgagaaggtccaacatattcaacttcttcaaaagaacgtgcgcgcacagctcgtggacatgaaacggttggaagtcgacatcgacattaagatcagatcatgcagaggatcgtgcagccgcgctcttgctcgtgaagtggatctcaaggattacgaagatcagcaaaaacaacttgaacaggtcatcgccaaggatctgctgccctcacgcgaccggcagcacctgccactgataaagatgaagcctgtgcctgacctggtgcctggaaactttaagtcccagcttcagaaggtgccacctgaatggaaagcattgaccgacatgcctcaaatgagaatggaactggaacggcctggtggaaacgagattaccaggggcgggagcacctcgtacggaaccggatcagaaaccgagtctcctcgtaatccgagctcggcaggttcatggaactcaggctcgtccggtcctggttccaccgggaacaggaatcctggctcatccggaaccggtggtaccgcgacctggaagcctggatcttccggccctggaagcaccggttcctggaattcgggttccagcggtaccggatcgaccggaaaccagaacccaggttcccccagacctggcagcaccggaacctggaaccctggaagcagcgaaagaggttcggccggacattggacctcggaaagctcggtgtcgggaagcaccggccagtggcattcagaatcaggtagcttcaggcctgattcgccgggctcaggaaacgcaaggcctaataaccccgattggggaacttttgaggaagtgtcaggaaatgtcagccccggaactcgtcgtgaataccataccgaaaagctggtgacctcgaaaggagataaagaactcagaacggggaaggaaaaagtcacctctggaagcactacgaccacccggagatcctgttctaaaaccgttaccaagacggtgatcggacccgatgggcataaagaagtgaccaaagaggtcgtgaccagcgaggacgggtcagattgtcccgaagcaatggacctgggaaccctgtcgggcattggaactctggatgggtttagacaccgacatccggatgaggcggccttttttgatacggcatccactggaaagacgtttccaggattctttagcccgatgcttggtgaatttgtgagcgagactgagtcgagagggtccgagtcaggtatcttcactaacactaaggaatcatcgtcacatcatcctggaatcgctgaatttccttcgcgggggaagtcgtcgtcttactcgaagcagttcacctcctccacgtcctacaataggggagattccacttttgaaagcaagagctacaagatggccgatgaagccggtagcgaagccgaccacgaaggaacccattcaactaagcgtggacatgcgaagtcacgccctgtccgcgattgcgatgatgtgctgcagacgcacccgtcgggcacccaatccggtattttcaacattaagctccctggttcctccaagatattctctgtgtactgcgaccaagaaacctcactcggaggatggctgctcatccagcagcgcatggatggttccctcaactttaacagaacctggcaagactacaagcgaggatttggatcacttaatgacgagggcgaaggtgaattttggctcgggaatgactacctgcatcttcttacccaacgtggatcggtgctgcgggtcgagctcgaggactgggcgggtaacgaagcgtacgccgaataccatttcagagtgggctccgaggcagaaggttacgccctccaggtcagttcgtatgaaggtaccgccggcgatgccctgattgagggcagcgtcgaggagggtgcggagtacacctcccataacaatatgcagttctcgacttttgatcgcgatgcagatcaatgggaggagaactgtgctgaggtctacggtggaggatggtggtataacaactgtcaggcagcaaacctgaacggtatttactacccgggtggttcgtacgatccccgtaacaacagcccatacgaaatcgaaaacggcgtggtgtgggtgtcgttcaggggagcagactattcactgagagcggtccggatgaagattagacccctggttacccag

SEQ ID NO: 11094 - DNA, 2598 bp, Artificial Sequence
  Description of Artificial Sequence: Synthetic coding sequence
atgttttccatgaggattgtgtgccttgtgctgtccgtggtgggtaccgcctggactgctgactccggagagggggacttcctcgcagaaggaggcggagtgcgaggaccgcgggttgtcgagcggcaccaatcggcctgcaaagactcggactggcctttctgctcggacgaagattggaattacaagtgcccgtcgggatgcagaatgaagggcttgattgacgaggttaatcaggacttcaccaaccgcatcaacaagctcaaaaactccttgttcgaataccagaaaaacaacaaagactctcacagcttgaccaccaacatcatggagattctcaggggagatttctcctccgctaacaacagagataatacctacaaccgggtgtcggaggacttgcggtccagaatcgaggtgctcaagcgcaaagtcatcgagaaggtgcagcacatccaactgctgcagaagaacgtgcgcgcgcaactggtcgacatgaagcgccttgaagtggacatcgacattaagatccggtcctgtcgcgggagctgttctcgcgctctggccagggaagtggacctcaaggactatgaggaccaacagaagcagctggaacaagttatcgctaaagacctcctgccgagcagggaccgccagcatctgccgcttatcaagatgaagccggtgccggacctggtgcctggaaactttaagtcccaactccagaaggtgcctcctgaatggaaggccctcaccgacatgccccagatgcgcatggaactggagcgccctggcggaaatgagatcacccggggaggaagcacttcatacggaaccgggtccgaaaccgagagcccacgcaacccgtcctccgccgggagctggaacagcggctcatccggacctggctcgacgggtaaccgcaaccctggctcgtcagggacgggcggaaccgcgacgtggaagcccggcagttcaggacctgggtcaaccggatcatggaactcaggttcctccggaactggatcgaccggaaaccagaacccagggtccccgcggccgggatcgaccggcacttggaacccgggctcgtcagagcggggcagcgccggtcactggacctcagaatcctcggtgtccggctccacgggacaatggcacagcgagtcaggatctttcaggccagattctcctggctcaggaaatgcgcgaccaaacaatccggactggggcaccttcgaagaggtcagcggcaatgtgtcgcccgggactcggcgcgaatatcacactgaaaagctggtgacgtccaagggcgataaggaactgaggactggaaaggagaaggtgaccagcgggtcaactaccactactagaagatcctgctctaagaccgtgactaaaactgtcatcggaccggatggacacaaggaggtcaccaaggaagtggtcacttcagaggatggatcggattgcccagaagctatggatctgggcactctgagcggcatcggcaccctggacggcttcagacacaggcatccagacgaagctgctttcttcgacactgcgtctaccggcaagactttcccgggattcttctcaccaatgctcggcgaattcgtctccgagactgagtcccgggggtcagagagcggaatcttcactaacactaaagaaagctcgagccaccaccccggaatcgccgagtttccttcgcggggtaaatcctcgtcctactcaaagcaatttacctcgtcgacttcgtacaataggggagacagcaccttcgaaagcaaaagctacaaaatggccgacgaagcaggaagcgaggcagaccacgagggcacccactcgaccaagcggggacatgccaagtcgcgcccggtgcgcgattgcgatgacgtgctccagacccacccttcgggaacccagagcggaatattcaacatcaaacttccggggagcagcaagatcttctccgtgtactgcgatcaagaaacttcgctcggagggtggcttcttattcaacagcggatggacggatcgctgaatttcaaccgcacctggcaggactacaagcgggggttcgggtccctgaacgacgaaggagagggagaattctggctgggtaatgattaccttcacctgcttacccaaagaggatcagtgctgagagtggaactggaggactgggctgggaatgaggcatacgccgaataccatttccgggtgggctcagaagcggagggatacgcactgcaggtcagtagctacgaagggaccgccggagatgccctgatcgaaggatccgtggaggaaggagcggaatacacttcgcacaacaacatgcaattttctactttcgatcgcgatgcggaccagtgggaagagaactgcgcggaagtttacggaggtggatggtggtacaacaactgccaggcagccaacctcaatggaatttactacccgggaggctcgtacgacccacgcaacaattctccctacgaaattgaaaacggtgtggtgtgggtgtcattccggggtgccgactattccctgcgggctgtgcggatgaaaatccggcccctggtcactcag

SEQ ID NO: 11095 - DNA, 2598 bp, Artificial Sequence
  Description of Artificial Sequence: Synthetic coding sequence
atgttcagcatgcgaatagtttgtctggttttgtcagtcgttggaacggcctggacagcggattcgggcgagggggactttctcgcagaaggcggcggagtgcgaggccctcgcgttgtcgaaaggcaccagagcgcatgtaaagatagtgattggccgttctgctccgacgaagattggaattataaatgcccctcaggctgcaggatgaaaggacttattgacgaagttaatcaggacttcaccaaccgaatcaataaattgaaaaactccctgtttgagtaccaaaagaataataaggactcacattccctcactacaaacatcatggaaatcctgcgtggggacttcagctctgctaataaccgcgacaacacttacaatcgagtatcggaggatctgaggtctcgcatagaagttttgaaacgaaaagtaatcgagaaagtacaacacatccagttgcttcagaaaaacgtaagggcacagctggtcgacatgaagaggctggaggtggatatcgacataaaaataagatcctgtcgcgggtcctgttctagagcactggcccgagaagtggatctgaaggattatgaagatcaacagaagcagctcgaacaagtaattgcgaaagacctgcttccctctcgagatcggcagcacctgccccttatcaagatgaaaccagtgccagatctagtgcctgggaatttcaagtctcagctccagaaggttcctcctgaatggaaggctctgactgatatgccgcagatgaggatggaattggaaaggcctggcggcaacgagataaccagaggtggttcaacctcatatggcacaggtagcgaaacggagtccccccggaatccaagttctgctgggtcctggaattctggttcttcggggccaggctccaccggcaaccggaatcccggctcctcaggcactgggggtactgctacctggaagccgggatcatcaggccccgggagtacaggttcttggaacagtgggtctagtgggactggatctaccgggaatcagaatcccgggtctcccagaccaggttccacgggtacgtggaatccaggcagctcagagcggggaagcgcaggacactggacatcagagtccagcgtgagtggttccactggacaatggcacagcgagtctggtagttttaggcccgatagtcccggcagtggaaacgcccggcccaataatcccgattgggggaccttcgaggaggtctctgggaatgtctctcccggcacccggagggagtaccacactgagaaactcgtgacttcgaaaggagataaggagctgcgtacaggcaaagaaaaagtcacttccgggtcgacgacgacaactaggagaagctgctccaagactgtgaccaagacagtcataggcccagatggtcacaaagaagttaccaaggaggtagtcaccagtgaagatgggtccgattgccccgaggcaatggaccttggaactttgtccgggatagggacactggacggattccgccaccgtcaccctgatgaggccgctttcttcgacaccgcctcaacaggcaaaacgtttcccggttttttttcgccgatgctaggggagttcgtctctgaaacagaatcgcgggggagcgagagcggcatatttacaaatactaaagagtcatcgtctcaccacccagggatcgccgaatttccttcaaggggaaaatccagcagttactccaagcagttcacatcttccactagctacaacaggggagattcaactttcgaatcaaagtcatataagatggccgacgaagcgggctccgaagccgatcatgaagggacccacagtactaaacggggacatgcgaagtcccggcccgtccgagactgcgacgatgtgctccagacccacccctctggtactcagagcggtatcttcaatataaagctccccggttcatctaagatattttccgtgtactgtgaccaggaaacaagcctgggcggatggcttctgatccaacagaggatggacggatcgctgaatttcaaccggacgtggcaggactataagaggggctttggtagtctcaatgacgagggcgagggggagttttggctgggcaacgattatctgcacctgttgacccagcggggcagtgtcctcagagtggaactggaagattgggccgggaacgaggcttacgccgagtaccacttcagagtaggctcagaagccgagggttacgccctgcaggtgtctagctacgagggaactgcaggagacgctctcatcgaaggctcggtagaagaaggtgccgagtatacttcacacaataacatgcagttcagtacctttgaccgggacgctgatcagtgggaagaaaattgtgcggaagtgtatggtggaggctggtggtataacaactgccaagcagcaaaccttaatggaatatattatccggggggttcatacgacccccggaataatagtccatacgagattgagaatggggtagtgtgggtgtcttttcgcggggccgactactctctacgagcagtgcgcatgaaaatacgccccttagttacacag

SEQ ID NO: 11096 - DNA, 2598 bp, Artificial Sequence
  Description of Artificial Sequence: Synthetic coding sequence
atgtttagcatgcgcatagtttgtctagtgttatcggtggtcgggaccgcctggaccgcagattctggcgaaggggacttcctggctgagggtgggggtgttcgggggccacgggtggtcgagcgccaccaatccgcctgtaaggactcagattggcccttttgtagtgacgaggactggaattataagtgcccttctggttgcaggatgaaagggctgattgatgaagttaatcaggacttcaccaaccgaatcaataagcttaagaatagcctgtttgaatatcaaaaaaataataaggactctcattccctgactaccaatatcatggagatcctgagaggggatttttccagtgcgaataatagggacaatacatacaaccgcgttagcgaagaccttagatctagaatagaggtcttaaaacgaaaagttatagagaaggtccagcatatacagttgctccagaagaacgtaagggctcaactggtggacatgaagagactggaagttgacatcgatatcaagatccgaagttgccgaggctcctgctcccgggctctcgcgcgagaggttgacctcaaagactatgaggatcagcagaagcagttggagcaggtaatcgccaaggatctcttgccttctagggataggcagcatttaccgctcatcaaaatgaaaccagtgcctgacctggtgccagggaatttcaagagccagcttcaaaaagttcctccagagtggaaggcgcttaccgatatgcctcaaatgagaatggaattagagagacccggtggcaatgaaattacacgcggaggttcaactagttacggcaccggatcagagaccgagtctcctagaaatccatcttctgcggggagctggaattccggatcttccggccccggaagtactggtaaccggaatcctggctccagcggaacaggcggaaccgcgacatggaaacctggcagttcaggacccggcagtaccgggagctggaatagtggaagctcaggaaccggcagcaccggaaatcagaaccccggttcaccacggccagggagcacaggaacatggaacccgggttcctccgagagagggtcagccggccactggaccagcgaatctagcgtttctggctctaccggccagtggcattcagaatctgggtcctttcgcccagatagcccggggtccggaaacgcgagaccaaataacccagactggggcaccttcgaagaggtctcagggaatgtctccccaggaacccgacgcgagtaccacaccgaaaagctggtgacttcaaagggcgacaaagagctgcgaacaggcaaggagaaggttacctcaggatctacaaccaccaccaggcgtagctgcagcaagaccgtgacgaagacggttataggtcccgacggccataaagaagtgactaaggaggtggtgacttctgaagacggcagtgactgtcctgaagcgatggatctcgggaccctctcgggtatcggaacattggacgggttcaggcaccgacacccagatgaggccgcatttttcgacacagcttcgacgggcaagactttccctggattcttcagccccatgctgggcgaattcgtttcggagactgaaagtcgagggtccgagagcggcatctttacaaacactaaagagtcatcctcccaccatcccggaattgctgaattcccgagcagagggaagagctctagctatagcaagcagttcaccagtagcacgtcatataatcgaggtgactcaacgttcgagtcaaagagctataaaatggccgatgaggccgggtcagaagcagaccacgagggaacacattctacaaagcgaggacacgcaaaatcccgcccagtcagggattgtgacgatgtgttgcaaacacacccttcaggcacgcaatcagggatttttaatataaagttgccagggtcctccaagatctttagcgtctactgcgaccaagagacaagcctgggtggctggttattaatccagcagcgcatggacgggagtctcaacttcaaccgaacatggcaggattataagcgcggattcggaagcttaaacgacgaaggagagggcgaattctggttggggaatgactatctgcatctgctgacacaaagggggtcagtgctgcgagtagagctggaggattgggccggcaacgaagcatatgctgagtaccatttcagggtggggagcgaggcagaggggtacgctctacaggtaagctcatacgagggcacagccggcgacgcacttatcgaagggagcgtcgaggagggagcggagtatacgagccataataatatgcagtttagcacgttcgaccgcgacgcagaccagtgggaggaaaattgcgcagaggtctacggcggcggctggtggtacaacaattgccaggctgccaatttaaatggaatctactatcccggtggtagttatgacccgaggaacaactcaccctacgaaattgaaaacggcgtggtatgggtcagcttccgtggggcagactattcactgcgggcggtgcgaatgaaaatacgccccttggtgacccag

SEQ ID NO: 11097 - DNA, 2598 bp, Artificial Sequence
  Description of Artificial Sequence: Synthetic coding sequence
atgttcagtatgcgaatcgtttgcctggtcttgtccgttgtcgggaccgcatggacagccgactctggagagggagatttcctggccgaaggcgggggggttcgcggacccagggtggtggagaggcatcagtcagcatgtaaagacagcgattggccgttttgtagcgacgaggactggaattataaatgtccaagtggctgtagaatgaagggcctgatcgacgaggttaaccaggacttcactaaccgaatcaacaaactgaagaacagtttgttcgagtatcaaaagaacaacaaagattcccatagcctgaccaccaacattatggagatattgagaggggacttctcatccgctaataatcgggacaatacttataatagagtgagtgaagacctgcgatctcgcatcgaagtcctgaagaggaaagtgattgagaaggtgcagcacattcagctgctgcagaagaatgtgcgagcccagctggtggatatgaaaaggctcgaagtggatattgatattaaaatcagatcctgtagagggtcctgctctcgggccctggccagagaagtcgatttgaaggattacgaagatcagcaaaagcagttggagcaggtgatcgccaaggacctcctgcctagtagagacaggcagcatctgccactgatcaaaatgaaaccggttcctgatcttgtccccggtaacttcaagtctcagttgcagaaagtaccaccagaatggaaagcactgacagacatgccccaaatgcgaatggaactggaacgccccggcggaaatgagattacccgcggcgggagtacaagttatggaacaggttccgagacggagtcccccagaaatccttcctctgccggctcctggaactctggctcctctggtccagggagcactggcaatagaaaccccggatcaagtggtacaggcgggaccgccacatggaagccaggatcaagcggccctggttctaccggttcatggaacagcggttcctctgggaccggctcaaccggtaatcagaacccggggagtcccaggccaggcagcacaggcacctggaatcctggctcctctgaacgaggcagtgccggccactggacttcagagtcaagcgtgagtggaagtaccggccagtggcacagtgagagcgggagcttcaggcctgatagtccaggctcaggcaacgcgcggccgaacaaccctgactggggcaccttcgaggaggtgtctggcaatgtaagtccagggaccagacgggaataccatacagaaaaattggtgacatccaagggcgataaggaacttaggaccggcaaggagaaagtgaccagcggttctactacaacaacccgaaggagctgttccaagaccgttactaagaccgtgattgggcccgacggtcacaaagaggttaccaaagaagtggtgacttcagaagacggatctgactgtcccgaggccatggacctggggaccttgagcggaataggaactttggacggttttcgccacaggcacccggacgaagcagctttcttcgatactgcttcaaccggaaaaacatttccgggattctttagtccaatgctcggggagtttgtgagtgagacagaatctcgaggcagtgaaagcggtatttttaccaataccaaggaatcctctagtcatcacccggggatcgccgaatttccttctcgcggaaaatcttccagctactcaaaacaatttactagtagtaccagttataaccggggcgactcaacatttgagagcaaaagttacaagatggcggacgaagcgggaagtgaagcagatcacgaaggtactcactccacaaagagaggccacgcaaagagtagaccagtacgcgactgtgatgatgtgctgcaaacacacccttctggcacacagtcaggcatcttcaacatcaaactgccggggtccagcaagatcttctcagtttactgtgatcaggagaccagccttggcggatggctgctcattcagcagcgcatggatgggagcctgaatttcaacagaacttggcaggactataaaagaggatttggctctcttaacgacgagggggagggtgagttctggctcggaaacgactatctgcacctgttgacccaacggggcagtgttctccgagtggagctcgaggattgggcagggaacgaggcatatgcagagtatcattttcgagtggggagtgaagcagagggatatgccctgcaggtgagctcctacgagggtactgctggagacgcattgatcgaggggtcagtagaagagggagctgagtatacgtcccacaataatatgcagttttcaacctttgatagggacgccgatcagtgggaggagaattgtgccgaggtgtacgggggcggctggtggtacaacaactgccaggctgccaatcttaacggtatctactatcccggagggtcttatgacccgcgaaacaatagcccatacgaaatcgagaacggcgttgtgtgggtttctttcagaggggcagattacagcctccgggcagtgcggatgaagatccgccctctcgtgactcag

SEQ ID NO: 11098 - DNA, 2598 bp, Artificial Sequence
  Description of Artificial Sequence: Synthetic coding sequence
atgttctcaatgagaatcgtgtgcctggttctgagcgtagtcggcacggcgtggaccgccgactctggcgaaggtgacttcctagcagagggtgggggcgtgagggggccacgcgttgtagagcgacaccagtcagcttgtaaagattctgattggccgttctgttcagacgaagattggaactataagtgtccatctggttgtagaatgaaaggcctcatagatgaagtcaaccaggactttactaataggattaataagctcaagaacagtctattcgaatatcagaagaacaacaaggactcccattccctgactaccaacattatggagatacttcggggtgatttctcgtccgcaaataatcgagataacacttacaatagagtgtctgaagacctccgcagtcggattgaggtgctcaagaggaaggtaattgagaaggtgcagcatatccagcttctacagaaaaacgttagggcgcagctcgtggatatgaagcggctagaggttgatatcgacatcaaaattcggagctgcagaggcagttgctctcgcgcccttgctcgggaggtggacctcaaggactacgaggaccagcagaagcagctggaacaggtcatcgccaaggaccttctaccctcccgcgaccgtcagcacctgccattaatcaaaatgaagccagtcccagatctggtgcccgggaactttaaaagccagttacagaaggttcctccagagtggaaagccttaactgatatgccgcagatgaggatggaactggaacgccccggcgggaatgagatcactcgaggagggagcacctcttacgggaccggttccgagactgaatctccccggaatccatcatcggccggcagctggaacagtggctcatccggccccggcagcactgggaaccgaaatccaggctctagcggcacagggggaaccgccacctggaagcccggttcctccggcccagggagcacaggcagctggaattccggctcaagcggcactgggagcaccgggaatcagaacccgggcagcccacgtcctggttctactgggacttggaaccctggctctagtgaaagaggttctgcgggtcattggacttctgagtcctcggtctctggttcgacagggcagtggcatagcgaaagcgggtcgttccgccccgacagccctggatctggcaatgcacgtccaaataacccagactggggaaccttcgaggaggtgagtggaaacgtgtctcctggaaccagacgagagtatcacaccgaaaagcttgtcacgtctaaaggggataaggaactccgcaccggcaaggaaaaggtgacatcaggctccaccaccaccactcggaggtcttgttcaaaaacggtgactaaaaccgtgatcgggccagatgggcacaaagaggtgactaaggaggtagtgacctctgaagacggaagcgactgtcctgaggcgatggatttagggacattgtccggaattggaaccctggacggctttagacatcgccatccagacgaggctgctttttttgatactgcttcaacaggcaagacattccctggttttttcagtcccatgctgggtgagtttgtctctgagactgagtctaggggctccgagtcaggtatatttacaaacactaaagagtcctcctcccaccacccaggtattgctgagtttccctctcgcggaaaatcctctagttattcgaaacagttcacttcctctacctcttataacaggggcgacagtacgttcgaatcaaaaagctacaagatggctgacgaagccggttccgaagcggaccatgaagggacccatagcactaaacgtgggcacgccaaatctcggcctgtacgtgattgtgacgatgtcttacagacccatcccagtggtactcagagcggaattttcaacattaagctgcccggcagctctaagatcttcagcgtctattgtgatcaggagacatcgctcggcgggtggctcctgatccaacagagaatggacggcagtttgaattttaaccgcacctggcaggactataagaggggcttcggaagcctgaatgacgagggggagggtgaattttggttaggtaacgattatctccacttacttacgcagaggggatcagtgcttcgcgtcgagctggaagattgggcgggaaacgaagcatatgcagaataccactttcgcgtcggatccgaggcggaagggtatgcgctacaggtgtctagctacgagggcacagcaggggacgcgcttatcgaggggtccgtggaggaaggcgcagagtacacaagccacaacaacatgcagtttagcacgtttgaccgagatgctgaccagtgggaagagaactgcgcagaggtctatgggggagggtggtggtacaacaattgccaggcagccaatctgaatgggatatattacccagggggttcatacgatcctcggaacaactccccgtacgagatagaaaacggggtggtgtgggtgagctttcgaggcgccgactacagtttgcgggcagtccggatgaaaatcagaccactggttacccag

SEQ ID NO: 11099 - DNA, 2598 bp, Artificial Sequence
  Description of Artificial Sequence: Synthetic coding sequence
atgttctccatgagaatcgtgtgtctggtacttagtgtggtggggactgcctggactgctgactctggagaaggagacttcctagcagagggagggggagtgcgggggcctagggttgtagaacgacaccagtccgcctgcaaagattcagattggcccttctgctccgacgaagattggaattataagtgtcccagtggatgtcgaatgaaggggctcatagacgaggtgaaccaggactttacaaataggatcaacaagctaaaaaattctctgtttgaataccagaagaataataaagattctcattctctgacaactaatatcatggaaatcctgagaggagatttttcaagtgccaacaaccgggataatacgtataaccgggtctccgaagacctacgaagtcggatcgaagtgctcaagcgaaaagtcattgaaaaagtccagcacatccaactcctacagaaaaacgttcgagctcagcttgtagacatgaagaggctagaagttgatattgatatcaaaatcagatcatgccgtggaagttgttctagagccctggctagggaagtcgatttgaaagattacgaagatcagcagaaacagctcgagcaggtgatcgctaaagatctgttgccttcacgcgaccgacagcacttacccctgataaaaatgaaaccagtgccagatcttgtccctgggaactttaagtctcagctgcagaaggttccaccagaatggaaagctctgactgatatgccccagatgcgaatggagctcgaaagacccgggggaaacgagataacaaggggagggagtacttcatatggaactggatctgagacagaatcacctcgcaacccctcctcagccgggagttggaactcagggagttcaggacctggatccactgggaatcgcaaccctggatcttcgggaacaggagggactgcgacatggaaacccggatcatcaggacccgggtctactgggagttggaactccgggtccagtggaacaggatcaacaggaaaccagaacccaggatccccccgaccaggatctactgggacgtggaaccccggatcctctgaaagagggagtgctggacattggacatcagaaagttccgtctctgggtcaactggacagtggcatagtgaatcagggtcatttaggcccgattcacccggatcagggaatgcacggcctaacaacccagactggggaacattcgaagaggtgtccggaaacgtgtctcctggaacaaggagggagtatcacacagaaaaactcgtcacttctaaaggggataaagaattgcgcactgggaaggagaaagtcacttctggatcaactacaacaactcggcggtcgtgttccaaaactgtgactaaaactgtaatcgggcccgatggacataaagaagtgacaaaggaagtggtgactagtgaagatgggtcggattgtcccgaagcaatggatctcggaacactgtctggaatagggacactcgacggatttcggcatcggcaccctgatgaggccgcattctttgatacagctagtactggaaaaactttccccggattcttttcccccatgttgggagaatttgtgagtgaaacggaatctagaggatctgaatcagggatcttcacaaacactaaagaatcttcatcccaccaccctgggatcgctgaattcccctctagggggaaaagttcttcctatagtaaacagtttactagttccactagttacaaccgaggggattccacatttgagtcaaaatcttataaaatggcagatgaagcaggatccgaagccgaccatgaagggacacactctacaaaaagggggcatgccaaatccagaccagttcgggattgcgatgatgttcttcagactcatccctctggaacacagtcaggaatatttaatatcaaacttccaggatcctcaaagatttttagtgtgtattgtgatcaggagacttctttgggaggatggctcctgatacagcagaggatggacggatcgctcaattttaataggacgtggcaggattacaaacggggatttgggtcgttaaacgacgagggggagggggaattttggttgggaaatgattatcttcacctgctgacacagagagggtccgttttacgtgtagagcttgaagattgggccgggaacgaagcctacgcggagtatcacttcagggtgggatctgaggccgagggatacgcactacaggtttcctcctatgaaggaactgccggagatgccctaatcgaaggatctgtggaagaaggggccgaatatacttcacacaacaatatgcagttctcaacatttgatcgggacgcagatcagtgggaggaaaattgtgcagaagtttacggaggaggatggtggtataataattgccaggccgctaatctcaacggaatctattaccctggagggtcctacgaccctaggaataatagtccttatgagatagaaaatggggtggtgtgggtgtcattcagaggggcagactattctttgcgggccgttaggatgaaaattaggccactcgttacgcag

SEQ ID NO: 11100 - DNA, 2598 bp, Artificial Sequence
  Description of Artificial Sequence: Synthetic coding sequence
atgttctcaatgcgaatcgtgtgcctggtcctttcggtcgtcggaacggcatggacagctgactcaggcgaaggcgactttctggcggagggcggtggagttagagggcctcgagtggtggaaagacaccaatctgcatgcaaggattctgattggccattttgttcagatgaggattggaactataagtgtccatccggctgccgtatgaaaggattaattgatgaggtgaaccaagattttacaaatcgcatcaacaaacttaaaaatagtctatttgagtatcagaaaaataacaaagattctcactcactaacaaccaacattatggagatcctgagaggtgatttctcgtcggcaaataatagagataacacgtataatcgagtaagcgaagatttacgctctcgtatagaggtacttaaacgtaaggtcattgagaaggtgcaacacattcaacttcttcaaaaaaatgtgcgggcgcaattggtcgatatgaaacgcctggaagtagatatcgatattaaaataagatcatgtagaggttcatgcagccgtgctctcgcccgagaggttgatcttaaagattacgaggaccagcaaaagcagcttgaacaagtaatcgccaaagaccttctaccgtcccgggatcgccaacatttgccattaatcaaaatgaaacctgtacccgacttagtcccaggaaattttaaatcacagttgcagaaagtgcctccggaatggaaagctctgacagacatgccgcagatgcgaatggagcttgaacgtccaggcggaaacgaaatcacgcggggagggtcgacatcctatgggacaggctctgaaaccgagagtccacgaaatcccagctccgctggctcttggaatagcgggtcaagcggaccgggaagtacgggcaatcgaaatcctggtagcagcggaaccggtggtacggcgacatggaaaccagggagctcaggaccaggatctactggcagctggaattctggcagcagcggcacaggatccacaggcaaccaaaatccgggctcgcccagaccaggaagcactggcacctggaatccgggcagctctgaacgggggtcggcgggccactggacatcggagtcaagcgtgtctggttcgaccggccagtggcactcagaatctggctcttttagaccggattctccgggtagcggtaatgcaaggccaaacaatcctgattggggaacatttgaggaagttagtggaaacgtatctcctggtactcgaagagagtatcacacagaaaaattggttacctcaaaaggggacaaagaacttagaacgggaaaagaaaaagtaacttcaggcagtactacgacaacacggcgatcatgctccaaaacggttaccaaaactgtcattggaccggatgggcataaagaagtgacaaaagaagttgtcacaagcgaggatggatctgattgtcctgaagcaatggacctaggaactttgtctggcattggtacattagatggatttcggcaccgacatcctgatgaggcagcgtttttcgataccgccagtacaggaaaaacatttcccggatttttcagcccgatgttaggagaatttgtgtctgaaacagaatcgcgcggttctgaatcgggaatttttactaatacgaaagaaagttcaagccatcatccggggatcgcggaattcccgtcaagaggcaaaagctcctcatatagtaaacagtttacatcttctacaagctataaccgtggagacagcacatttgagtcaaaaagctataagatggcggatgaagctggctctgaagcagaccatgagggaactcattctacaaagagaggccatgcaaaatcccgtccggttcgagattgcgatgatgttcttcaaactcacccgtcgggaacacaatcaggcatttttaacatcaagctgcctggcagttctaaaattttttcagtctattgcgatcaagaaacgagtttaggaggctggttgctcattcagcaaaggatggatggtagcctaaactttaaccgcacatggcaagattacaaacggggcttcggcagtttaaacgatgaaggcgaaggtgagttttggttaggaaatgactatttacatttgcttacgcaaagaggatctgttctgagagtggagcttgaggattgggcggggaacgaagcgtatgctgaataccactttcgtgtgggaagcgaagcggaaggatatgcactccaagtaagtagctacgagggtacagctggggacgccctcattgaggggagcgtcgaagaaggcgcagaatatactagccataataacatgcaattttccacctttgaccgcgatgcggatcagtgggaagaaaattgtgcagaagtgtatggaggaggatggtggtataacaattgtcaggccgcaaatctgaacggtatctactatccgggaggatcatatgatcctcgtaataacagcccgtacgaaatagaaaatggtgtcgtctgggtgagcttccgaggggccgattattctcttagagctgtacgtatgaaaattagaccgttagtcacgcaa

SEQ ID NO: 11101 - DNA, 2598 bp, Artificial Sequence
  Description of Artificial Sequence: Synthetic coding sequence
atgttttcgatgcgtatagtttgtttagttttatcggtagttggtacggcgtggacggcggattcgggtgaaggtgattttttagcggaaggtggtggtgttcgaggtccgcgagttgtagaacgacatcaatcggcgtgtaaagattcggattggccgttttgttcggatgaagattggaattataaatgtccgtcgggttgtcgaatgaaaggtttaatagatgaagtaaatcaagattttacgaatcgaataaataaattaaaaaattcgttatttgaatatcaaaaaaataataaagattcgcattcgctaacgacgaatataatggaaatattacgtggtgatttttcgtcggcgaataatcgagataatacgtataatcgtgtttcggaagatttacgttcgcgaatagaagtactaaaacgtaaagtaatagaaaaagttcaacatatacaactactacaaaaaaatgtacgagcgcaactagtagatatgaaacgtctagaagtagatatagatataaaaatacgttcgtgtcgtggttcgtgttcgcgagcgctagcgcgagaagtagatttaaaagattatgaagatcaacaaaaacaactagaacaagttatagcgaaagatttactaccgtcgcgtgatcgtcaacatttaccgttaataaaaatgaaaccggtaccggatttagttccgggtaattttaaatcgcaattacaaaaagttccgccggaatggaaagcgctaacggatatgccgcaaatgcgtatggaattagaacgtccgggtggtaatgaaataacgcgtggtggttcgacgtcgtatggtacgggttcggaaacggaatcgccgcgaaatccgtcgtcggcgggttcgtggaattcgggttcgtcgggtccgggttcgacgggtaatcgtaatccgggttcgtcgggtacgggtggtacggcgacgtggaaaccgggttcgtcgggtccgggttcgacgggttcgtggaattcgggttcgtcgggtacgggttcgacgggtaatcaaaatccgggttcgccgcgtccgggttcgacgggtacgtggaatccgggttcgtcggaacgtggttcggcgggtcattggacgtcggaatcgtcggtatcgggttcgacgggtcaatggcattcggaatcgggttcgtttcgtccggattcgccgggttcgggtaatgcgcgaccgaataatccggattggggtacgtttgaagaagtatcgggtaatgtatcgccgggtacgcgtcgtgaatatcatacggaaaaactagtaacgtcgaaaggtgataaagaactacgaacgggtaaagaaaaagttacgtcgggttcgacgacgacgacgcgacgttcgtgttcgaaaacggtaacgaaaacggtaataggtccggatggtcataaagaagttacgaaagaagttgtaacgtcggaagatggttcggattgtccggaagcgatggatttaggtacgctatcgggtataggtacgctagatggttttcgtcatcgtcatccggatgaagcggcgttttttgatacggcgtcgacgggtaaaacgtttccgggttttttttcgccgatgttaggtgaatttgtatcggaaacggaatcgcgaggttcggaatcgggtatatttacgaatacgaaagaatcgtcgtcgcatcatccgggtatagcggaatttccgtcgcgtggtaaatcgtcgtcgtattcgaaacaatttacgtcgtcgacgtcgtataatcgtggtgattcgacgtttgaatcgaaatcgtataaaatggcggatgaagcgggttcggaagcggatcatgaaggtacgcattcgacgaaacgaggtcatgcgaaatcgcgaccggtacgtgattgtgatgatgttctacaaacgcatccgtcgggtacgcaatcgggtatatttaatataaaattaccgggttcgtcgaaaatattttcggtatattgtgatcaagaaacgtcgttaggtggttggttactaatacaacaacgtatggatggttcgttaaattttaatcgtacgtggcaagattataaacgaggttttggttcgttaaatgatgaaggtgaaggtgaattttggctaggtaatgattatttacatttattaacgcaacgaggttcggtactacgagttgaattagaagattgggcgggtaatgaagcgtatgcggaatatcattttcgagtaggttcggaagcggaaggttatgcgttacaagtatcgtcgtatgaaggtacggcgggtgatgcgttaatagaaggttcggttgaagaaggtgcggaatatacgtcgcataataatatgcaattttcgacgtttgatcgagatgcggatcaatgggaagaaaattgtgcggaagtatatggtggtggttggtggtataataattgtcaagcggcgaatctaaatggtatatattatccgggtggttcgtatgatccgcgtaataattcgccgtatgaaatagaaaatggtgtagtttgggtatcgtttcgaggtgcggattattcgttacgtgcggtacgaatgaaaatacgaccgttagttacgcaa

SEQ ID NO: 11102 - DNA, 2598 bp, Artificial Sequence
  Description of Artificial Sequence: Synthetic coding sequence
atgttctcgatgcggatcgtgtgcctggtgctgtcggtggtcggaacggcctggaccgccgattctggcgaaggcgatttccttgctgagggcggtggagtccgcggcccgcgcgtggttgagcgccatcagtcggcatgcaaagattccgactggcccttctgctcggacgaagattggaattacaagtgccctagcgggtgcaggatgaaaggcttgatcgacgaggtgaaccaggacttcaccaacagaattaacaaactgaagaatagccttttcgagtaccagaagaacaacaaggattcgcattccctgaccaccaacataatggagattctgcggggcgacttctcgtcagccaataacagagacaatacctacaatcgggtgtcagaagatctgcgctccaggatcgaagtcctcaaacgcaaggttatcgaaaaggtgcagcatatccagctgctgcaaaagaacgtgcgcgcgcaactggtggacatgaagcgcttggaggttgacatcgatatcaagatacgcagctgtcggggaagctgctcacgggcgctcgctcgcgaggtggatctgaaggactacgaagatcaacaaaaacaactggagcaagtgatcgctaaggacctcctgcctagccgcgacagacagcatctgccactcatcaagatgaagccggtcccggacctggtcccaggaaatttcaagtcccagctccagaaggtccccccggagtggaaggccctcacggacatgccacagatgagaatggaacttgaaagaccgggaggcaacgaaatcactcgtggaggttctacgtcgtacgggactgggtccgagactgaatccccgcgaaacccgtcaagcgctggctcatggaactcgggatcgtcgggaccggggtcgactggaaaccgcaaccctgggtcatcaggcacgggcggaactgcgacttggaagccaggaagcagcggaccgggcagcactgggtcgtggaatagcggctcctccggaaccggcagcaccggaaaccagaatccaggatcccctagacccgggtcgactggcacttggaaccctggatcatcggaacggggaagcgccggacactggacttccgagtcctctgtctccggatcgacgggccagtggcattctgaatcaggtagcttcagacccgattcgcccggatcgggtaatgcgcgccctaataaccccgactgggggacgttcgaagaagtttcgggcaatgtgagcccgggcactagacgcgagtaccatactgaaaagctggtgacttccaagggagacaaagaactccggactggaaaagaaaaggtcacttccgggtcaaccaccaccaccagacggtcatgctcgaaaacggtgaccaagaccgtgatcggaccggatgggcacaaggaagtgactaaggaagtggtcaccagcgaagatggctccgattgccccgaggcgatggatctcggtaccctgagcggcattggcaccttggatggatttagacataggcacccggacgaagcggcattcttcgacactgcctcaaccggaaaaaccttcccgggattcttctccccgatgctgggagaattcgtgtcggagactgagtcccggggttcagagagcggaatcttcaccaataccaaggaaagctcgtcacaccaccctggtatcgccgaattcccttcccgcggaaaatcttcatcatactccaaacagttcacttcgtccacctcctataaccgcggagattcgacgttcgaatccaagtcctacaagatggctgacgaggccggctcggaggcggaccacgaaggaacccactcaactaaacgcgggcacgccaaaagccgcccagtgcgcgactgtgacgatgtgctgcaaacccacccgtccggaactcaaagcggaattttcaacatcaagctgccgggatcctctaagatcttttccgtgtactgcgaccaggaaacctcacttggcggttggctcctgattcaacaaaggatggacggatcgctgaacttcaatagaacctggcaggattacaaaagaggattcggatctctgaacgatgagggagagggggaattttggctgggaaatgattatctccacctgctgacccagcgcggatcggtgctcagagtggagctggaggactgggccggcaacgaagcctacgcagagtaccactttagagtcggttcggaggccgaaggatacgcactgcaagtgtcaagctacgaaggcaccgcgggagacgccctcattgaagggtccgtggaagagggagctgaatacacgtcccacaacaatatgcagttctcgactttcgaccgggatgcagatcaatgggaagaaaattgtgccgaagtttacggtggcggatggtggtacaacaattgccaggctgccaacctgaacggtatctactaccctggcgggtcatacgaccctcggaacaattcgccgtacgagatcgagaatggggtcgtgtgggtgtccttccggggggccgactactcactgagagcagtgcggatgaagatccgccctctcgtcacccaa

SEQ ID NO: 11103 - DNA, 2598 bp, Artificial Sequence
  Description of Artificial Sequence: Synthetic coding sequence
atgttctccatgagaatcgtctgtctggtcctttccgtcgtgggaactgcttggacggcagactccggtgaaggagactttttggcagaaggaggaggagtgcgcggcccacgggttgtggaaagacatcaatcggcatgtaaggattccgattggccgttttgcagcgacgaagattggaactacaagtgcccgtcagggtgtagaatgaaggggcttatcgatgaagtcaaccaggacttcaccaacaggataaacaaactgaaaaactccctttttgaatatcaaaagaacaacaaggatagccattccctcactactaacattatggaaatcctgagaggcgattttagctccgcaaataacagagataatacctacaaccgggtgtccgaagatttgcggtcgaggatcgaagtgctcaagcggaaggtgattgagaaggtgcagcatatccagcttcttcagaagaacgtgcgggcacaattggtcgatatgaaacgcctggaagtcgacatagacatcaaaatacgcagctgtaggggttcttgttcgagggcactggcgcgagaagtggatcttaaggactacgaagatcagcaaaaacaactggaacaggtgattgccaaggatctccttccatcgcgggacagacaacatctgcctctcattaagatgaagccagtgcccgatctggtccccgggaatttcaaatcccaacttcagaaggtcccgcccgaatggaaggcactgactgatatgccccaaatgcgcatggaactcgaacgacctggaggaaatgagatcactaggggagggtccacttcctacggaacgggaagcgagactgaatcgcctcgcaatccttccagtgcaggctcgtggaactctggttcctccggcccaggctcgaccggtaatcggaacccaggttcaagcggtactggaggaaccgcaacgtggaagcctgggagttctggtccagggtctaccggtagctggaatagcggaagcagcggaaccggaagcaccggcaatcaaaaccctggttcgccaagacctggaagcacgggaacctggaatccaggttcatcggaacgcggttcggcaggacattggacctcggagtcatcggtgagcgggtccactggccaatggcatagcgaatccggttcgtttcgtcccgactcgcctgggagcggtaatgcgcgtccgaacaatcctgactggggtacttttgaggaagtgtcaggaaatgtttcgcccggaaccagacgggagtaccacactgagaagctggtgacttccaagggagataaggagctgaggaccggaaaggagaaagtcacctcgggatccacgaccactaccagacggtcctgtagcaagaccgtgaccaaaaccgtcataggacctgacggtcataaggaagtgactaaggaggtggtcacttcggaagatggaagcgactgtcctgaggcaatggatttgggtactctttcgggcattggtactctcgatggatttagacaccgacatccggatgaagcagcatttttcgacactgcctcgactggtaagaccttccctgggtttttcagccctatgcttggggaatttgtgtcggaaactgagtcacgtggtagtgagagcggaatctttaccaacaccaaagagtcatcgtcgcatcatccaggtattgcggaatttccttcccggggcaagagcagctcctacagcaaacaatttactagctcaacctcgtacaaccgtggggattccactttcgaatccaagagctacaagatggcggatgaggcgggttcagaagcagaccatgaaggcactcattcaaccaagagaggacatgctaagtccagacccgttagagattgtgatgatgtgcttcaaactcatccttcaggtacccagtcggggatcttcaacataaagctcccaggtagctccaagatcttctccgtgtattgtgatcaagagacttcgttgggaggatggctgttgattcagcaacggatggatggttcactgaactttaatcgcacttggcaggactataaacgagggttcggttcgcttaacgacgagggagagggtgaattttggcttggtaacgattaccttcatctcctcacgcaaaggggttccgtcctgcgtgtcgagctggaggattgggcaggtaacgaggcgtacgcagaataccatttcagggtcggatcggaagcggaaggatacgccctgcaagtgtccagctacgaaggaactgcaggagacgcgctgatcgagggttccgtcgaggaaggggcagagtacacttcgcacaataacatgcagttttcaacttttgatcgcgatgcagaccaatgggaggagaactgtgcagaagtgtacgggggtggttggtggtacaacaactgtcaagcagccaacctcaacggcatctactaccccggtggaagctacgatccgcgtaacaactcaccatacgagatcgaaaacggagtggtgtgggtgtcatttcgaggagctgactactccctccgtgccgtgcggatgaaaatcagaccactggtgactcag

SEQ ID NO: 11104 - DNA, 2598 bp, Artificial Sequence
  Description of Artificial Sequence: Synthetic coding sequence
atgttctctatgagaattgtctgtttggttttgagtgtcgttggaaccgcctggacggctgactcaggtgagggagatttcctagcagaaggaggtggagtgcgaggaccaagagtcgtagagcgacatcaatcggcatgtaaggatagtgattggcctttttgttctgacgaagattggaactataagtgcccatctggttgccgcatgaaaggactaatagatgaagtgaatcaagattttacaaaccggattaacaagcttaagaatagtctcttcgaataccaaaagaataacaaggatagtcatagtctcactacaaatattatggaaattttgagaggggatttcagttcggccaataatcgcgataacacgtataatagagtctcagaggaccttagatctcggatcgaagttctgaaacggaaggtaatagaaaaagtgcaacacattcaactcctacagaagaacgttcgcgcacaattggttgacatgaaacgacttgaagttgacatcgatattaagatccgatcatgcaggggatcttgtagtagggctttggctcgtgaagtggacctgaaggactatgaagatcagcagaaacagctggaacaagtaattgctaaggatttattgccttctagagataggcaacacctgccattgattaaaatgaaaccggtccctgatctcgtgccaggtaacttcaaatcgcaattgcagaaagttccaccagaatggaaggctcttaccgatatgccacaaatgcgaatggaactagagagaccgggcggtaacgagataacgcgaggaggttcaacgagctacggaacaggcagcgagactgaatcgccaaggaacccatcttcggccggctcttggaactccggttcatcagggccaggaagcacaggaaacagaaacccaggatcttctggcacaggaggaacagcaacatggaagccaggatcctcagggccagggtctacaggatcatggaattcaggatctagtggaacaggatcaacaggaaatcaaaatccggggtcgccccgtccaggatcaactggaacatggaatcctggatcgagtgagagaggttcggcaggacattggacatcggaatcgagcgtctcgggatcaacaggacagtggcattctgagtcaggttcctttcgacctgactctccgggttctggcaatgcccgcccaaataatcccgattggggtactttcgaagaagtctctggtaatgttagtccgggaacgcggcgtgaatatcatacagaaaagctagtcacttcaaagggagataaggagctccgtactgggaaggaaaaagtgacttctggctcaactaccacgacgcggagatcttgttcaaaaacagtgaccaaaacagtgattggaccggacggacacaaagaggtgacgaaggaagttgttacctcagaggatggaagtgattgcccagaagcaatggacctgggaacgttgtcaggaattgggacccttgatggtttcagacaccgtcatccggacgaagccgcgtttttcgatacggcgtctaccggtaagactttcccaggcttttttagtccgatgcttggggaattcgtttcggaaacagaaagtagaggaagcgagtccggaatttttacgaatactaaagagtcctcgtctcatcacccaggtatcgctgaatttccgagtcgcggcaaatcttcctcttactctaaacagtttacctcgtctacttcttataatagaggagattcgacttttgaaagcaagtcttacaagatggcagacgaagcgggatccgaggcagatcatgaaggaacgcattccactaaaagaggacatgctaaatcaagaccagtcagagactgcgacgatgttttacaaacccacccatcagggacacagtctggaatattcaatattaaattaccgggatcatcaaaaatcttttctgtttattgtgatcaggaaacatcattgggcggatggcttctcattcaacaacgaatggatggatccttgaacttcaatcgaacatggcaggactacaaaagaggcttcggatcacttaatgatgagggagaaggagaattctggttaggcaatgattaccttcatttactgacgcagaggggatcggttctaagagtggaattggaagactgggcaggtaatgaagcatatgctgagtaccattttagggttggtagcgaagcagaaggttacgctttacaggtatcatcgtatgaaggaactgcgggagacgcgttgattgagggttcagttgaagaaggagcagagtacacatcccataataatatgcaattttcaactttcgaccgagatgcggatcaatgggaggaaaattgcgcagaagtctacggaggagggtggtggtacaataattgtcaagccgcgaatcttaacggtatttattacccaggaggatcctacgatccacgaaataattctccatatgaaattgaaaatggagtggtttgggtctcttttagaggcgcggattattctttgcgggccgtacggatgaagatacgaccgctagtgacacaa

SEQ ID NO: 11105 - DNA, 2598 bp, Artificial Sequence
  Description of Artificial Sequence: Synthetic coding sequence
atgttctccatgagaatagtgtgcctggttctgtctgtggtgggcaccgcctggacagctgacagcggagagggggacttcttagctgaaggcggcggggttcggggcccccgggtggtcgaaagacaccagagcgcctgcaaggattctgattggcccttctgctcagatgaagactggaactacaagtgtccatccggatgtcggatgaagggccttattgatgaagtcaatcaagattttaccaataggataaacaaattaaaaaattctctgtttgaataccaaaaaaacaacaaggatagccactccctgacaactaatattatggaaatcctacggggcgactttagcagtgctaacaacagggacaacacctacaacagggtgagcgaagacttaaggagccggatagaggttttaaaacgcaaggttatagaaaaggtgcaacatatacaattactgcagaagaacgttcgggcccaactcgtagacatgaaacgtctagaggtggatattgatatcaaaattcgtagctgtcggggtagttgcagcagggccctggcccgagaggtggatctcaaagattatgaagatcagcagaagcagctcgaacaggttatcgccaaagatctgctgccaagccgagaccgccagcatttacctctcatcaagatgaaacctgtgcccgacctggttccagggaactttaagtctcagctgcaaaaggtccctcctgagtggaaggccctgactgatatgccacagatgcggatggaactggaaagacccggcggcaacgagatcacccgaggggggtccacatcctacggaacaggatccgagaccgagagtcctagaaatccaagctctgccggctcttggaactccgggtcctctgggcctggcagcaccgggaaccggaatcctggatcctcaggaaccggcggaaccgccacctggaagcctggctcttctggccctgggtccactggtagttggaactccggatcctccggtaccggtagtacaggtaatcagaaccccgggagcccccgtcctgggtcaactgggacttggaaccccggcagcagtgaaagaggatccgctggacactggacatctgaaagcagcgtatctgggtccaccggccagtggcattcagagtcaggcagctttcggcccgactctccaggatcaggcaacgcaagacccaacaatccagactggggcacattcgaggaggtgtctggtaacgtgtccccaggcacacggagagaataccatactgagaaactggtgacctccaaaggcgataaggaactgcggacaggcaaggagaaagtgacctctggctctacaacaactactcgtcgttcctgcagcaaaaccgtgaccaagactgtgatcgggccagatggccacaaggaggtcacaaaggaggtggtaacttccgaggatggtagcgattgtcctgaggccatggacctgggaactctgtctggaatagggaccctcgacggcttcagacatagacatcctgatgaggcagctttctttgataccgctagcacaggcaaaaccttccccggcttcttttccccgatgctaggggagttcgtcagcgagactgagtctcggggctcagagagtgggatattcacaaacacaaaggagtccagtagccatcatccaggcattgctgagtttccctccagaggtaaatcttcatcctattctaaacaattcaccagctctacctcatataatcgtggtgactcaacattcgaaagtaagagttataaaatggccgacgaggccggaagcgaagcagatcatgagggcactcactcaacaaaacgtggtcatgccaaaagccgaccagtgcgcgactgtgacgatgtgcttcagactcatcctagtggcactcagagcgggatcttcaatataaaactgcccgggtcttccaaaatattcagtgtctactgcgaccaggagacttcactggggggttggttactcattcagcagagaatggatgggagcctgaacttcaacagaacctggcaggactacaaacgggggtttggcagcctgaacgacgagggagaaggcgaattttggctgggcaacgactacctgcatcttttaacccaaaggggatccgtactgcgggttgagctggaggattgggccgggaatgaggcttatgccgagtatcatttcagggtcggcagcgaggctgaagggtatgctcttcaggtttcttcctatgagggaaccgcaggagatgctctgattgaaggctcagtagaggagggggccgagtacacctctcacaacaacatgcaattttccacctttgaccgggacgctgaccagtgggaagaaaattgcgctgaagtatatggcgggggctggtggtacaacaattgtcaagcagccaatctgaatggcatctattacccagggggttcctacgacccccgaaacaatagtccatacgagatcgagaatggggttgtgtgggtgtcattcaggggggccgattacagcctaagagctgttcgtatgaagattagacccctagtgactcaa

SEQ ID NO: 11106 - DNA, 2598 bp, Artificial Sequence
  Description of Artificial Sequence: Synthetic coding sequence
atgttctctatgcgcatagtatgccttgttctgtccgtggtgggtaccgcctggactgctgactctggtgaaggtgatttcttggcagagggtggaggagtcagaggcccccgcgttgttgagcgtcaccagtctgcctgtaaggacagcgattggcccttttgctccgatgaggactggaattacaagtgccccagtggatgcagaatgaagggcctgatcgatgaggtcaatcaagattttactaacaggatcaacaaactgaaaaactccttgttcgaatatcagaagaacaataaggacagtcattctcttaccacaaacattatggagatcctgcgcggagatttcagtagtgccaacaaccgcgacaatacatacaacagggtcagtgaagatctcaggagtaggattgaagttctcaaaagaaaagtaatcgagaaagtccaacatatccagctgctgcagaaaaacgtaagagcccaattggtcgatatgaaaagattggaagtggacatcgatattaaaatcagatcatgccgtggctcatgttctagagcattggcaagagaagtggacctgaaggactatgaggatcaacaaaagcagctggagcaggtgatagctaaggatctgctcccatctcgtgatagacaacatctgccacttatcaaaatgaagcccgtgcccgatcttgtgcctggcaactttaagagtcaattgcagaaggtacctcctgagtggaaggctctgaccgatatgcctcagatgaggatggaattggaacgccctggcggaaacgaaatcactagaggtggatcaacttcctacggtactggtagcgaaactgaatcccctaggaatccaagcagtgccggaagctggaattcaggctcatctggcccaggttccaccggaaacagaaacccaggctcctctggtacaggcggaactgcaacttggaaacctggatcttctggtcctggctctactggatcttggaatagtggtagctctggcactggttcaaccggaaaccaaaatcctggtagccctcgtcctggatccaccggcacatggaatcccggatcaagcgagaggggttccgccggccactggacaagtgagtcttcagttagcggctctaccggacagtggcatagcgagtctggctctttccgtcccgactcccctggttccggaaacgcaaggcccaataaccctgactggggtactttcgaggaagttagtggcaatgtatcccctggaactaggcgcgaataccacacagaaaagttggtgactagtaagggagataaggagctcaggacaggaaaggagaaggtgacatcaggttctactacaactacacgtagaagctgctctaaaaccgtgaccaaaactgtcatcggtccagatggtcataaggaagtcacaaaggaggtggtgacctccgaagacggctcagactgccctgaggcaatggaccttggaactctgtctggcatcggtactcttgatggattccgtcacagacatccagatgaggcagccttttttgacaccgcatcaacaggtaaaacctttcctggctttttctccccaatgttgggagaattcgtttctgaaaccgaatctagaggttctgagtccggcatttttacaaatactaaggagtccagctcccaccatcccggcatagcagaatttccatccaggggtaagagtagcagttattccaagcagttcaccagttccactagctataacaggggagattccactttcgagtctaagtcttataagatggccgatgaagctggatctgaagcagaccatgagggtacacactcaactaaacgtggtcatgccaagtccaggcctgtgcgtgactgtgacgacgttctccagacccacccttccggtactcaatccggaatcttcaacatcaagctgcctggcagtagtaagatcttttccgtctactgcgaccaagagaccagccttggaggctggctgctgatccagcagcgcatggacggaagcctcaacttcaaccgtacttggcaggactataagcgtggtttcggatcactcaacgacgagggagaaggagagttctggttgggtaacgattacctgcaccttttgacacaaaggggatccgtgctcagagtggagttggaagattgggcaggaaatgaggcttacgccgagtaccacttcagagtgggctccgaagctgagggatacgctttgcaggtttcatcctacgagggtacagccggcgatgctctcattgagggatccgtcgaggagggagctgaatacactagtcataacaacatgcagttctcaacctttgaccgtgatgctgatcagtgggaggaaaattgtgcagaggtgtacggtggcggatggtggtataataactgtcaagccgcaaatttgaatggcatttactatcccggcggctcctacgatcctagaaataactctccatatgagatcgagaatggagtcgtgtgggtatccttccgtggcgccgactattccctgcgcgcagttaggatgaagatccgcccactggtgacccag

SEQ ID NO: 11107 - DNA, 2598 bp, Artificial Sequence
  Description of Artificial Sequence: Synthetic coding sequence
atgttcagcatgcgaattgtctgcctcgtgctgtcagtagttggaacggcttggacagcagattccggcgaaggggattttctagccgaaggggggggggtgcgcggtcccagagttgttgaacgccaccagtcagcctgtaaagattccgattggcctttctgcagtgacgaagattggaactacaaatgcccaagcggctgccgtatgaaaggactcattgatgaggtgaaccaagatttcacgaatcgaatcaataaactgaagaatagtttgtttgagtaccaaaagaataacaaggatagccactccctcacaaccaacatcatggaaattctgagaggggacttctcttccgcaaacaatagagacaatacttataatagagtttccgaagatttacgtagccgaattgaggtgctgaagcggaaagtcattgaaaaagtgcagcatatccagttgctgcaaaaaaatgttcgcgcacagttagtggatatgaagcgacttgaggtagatatagacatcaaaatcagatcatgccgagggagctgttccagggccctggctagggaagtcgacctaaaggactatgaggatcaacagaaacagttagaacaagtgattgccaaggacctcctaccatcacgagaccgtcagcatttgcctttgatcaaaatgaagccagtgccagacttggtgccaggtaattttaagagccagctgcaaaaggtgcccccagagtggaaggccctgactgatatgccgcagatgcgaatggagttagagagacccggcgggaacgagatcacgagaggaggctccacgtcttatgggactggatctgaaaccgagtccccacgaaatccaagctctgctggcagctggaatagtggctcttcggggcccggctcgacgggaaatagaaatccagggtcatcgggcaccggcggaacagctacctggaaacccggctcgtcaggccccggatctactgggtcctggaattctgggtctagtgggaccgggtcgacagggaatcaaaacccgggatcaccgcgacccggaagcacaggaacatggaaccccggctcttctgaaaggggtagcgcaggacattggaccagcgaaagttcggtgtccggatcaacagggcagtggcattccgagagtgggtcttttagacccgactcccccggatcgggtaatgccagaccgaataatcccgattggggtacctttgaggaggtatcgggcaatgtctcgccgggaacccgcagggagtatcacactgaaaagttggttacaagcaagggcgataaggaactgcgaaccggaaaggaaaaggttacctctgggagcaccacaacaaccaggaggtcctgttctaagactgtcacaaaaaccgtaatcgggccggatggccacaaggaggtgactaaagaggtcgttacgagcgaggacggttccgattgcccagaagccatggacctgggcacactgtccggaattggcaccctggatggattcagacacaggcacccggacgaagccgctttcttcgacactgcctctaccggtaaaaccttccctgggttcttctctccaatgctgggcgagtttgtgtccgaaactgagtcaagggggtctgaaagcggcattttcaccaacaccaaagagtcctccagtcatcaccccggaatagccgaattcccttcacgaggcaaaagctcctcctactccaagcagtttacaagctcaactagctacaacaggggtgatagtacattcgaaagcaagtcttacaagatggctgacgaagctggtagcgaagcagaccacgagggaactcattcaacaaaacgaggccacgctaaaagtcggcccgtgcgagattgcgatgatgtgctgcagacccaccccagtgggacacagagcggtatctttaatatcaagcttccggggagctccaagattttctcagtgtactgtgaccaggaaacctctttgggtgggtggttactgatccaacagagaatggatggctcactgaattttaataggacttggcaggattacaagaggggtttcggatccctgaatgacgagggagaaggagaattttggctgggcaacgactatctccaccttttaacccagagagggtcagtactcagagtggaacttgaggattgggcgggtaacgaagcttacgcagaatatcacttccgagtaggtagtgaagcggagggatacgcgctgcaggtctcgtcatatgaggggaccgctggagatgccctgatagaagggtctgttgaagaaggagccgagtacacgagtcacaataacatgcaattctccacgttcgatcgtgatgccgaccagtgggaggaaaactgtgctgaagtttacggaggcggctggtggtacaacaactgtcaagcagctaacctgaatgggatatattatccaggaggttcctatgatccacgaaacaattctccctacgaaatcgaaaatggagtcgtctgggtttccttcagaggggctgattactccctgagagctgtaagaatgaagatccggccactagtcactcaa

SEQ ID NO: 11108 - DNA, 2598 bp, Artificial Sequence
  Description of Artificial Sequence: Synthetic coding sequence
atgttctccatgcgtatcgtgtgtctggtccttagcgtggtgggaaccgcatggactgcagactcaggggagggtgacttccttgccgaaggtgggggcgtgagaggacctcgggtcgtcgagcgtcaccagtccgcctgtaaggactcggactggcccttttgttccgacgaggattggaactacaagtgtccttcgggttgtaggatgaaagggctcattgatgaggtcaaccaggacttcactaacagaattaacaaacttaagaattccctgttcgaatatcagaagaacaataaggattcgcactcacttaccaccaacattatggaaatcctgcgaggggacttctcctccgctaacaacagggataacacctacaatcgggtttcagaagatcttagatcaagaatcgaagtgctgaagcgcaaggtcatcgagaaggtgcaacatatccagcttctccaaaagaatgtccgcgcacagttggtggatatgaagcgcctggaagtcgatattgacattaagatccggtcatgtcgagggtcctgttcgcgggcgctggcgagggaagtggatctgaaagattacgaagatcaacaaaagcagttggaacaggtgatagcgaaagaccttctgccttcgcgggacagacagcatctgcccctgattaagatgaagcccgttccggacttggtgcctggtaatttcaagtcgcaacttcagaaggtgcctccagaatggaaggcactgaccgacatgccgcagatgagaatggaattggaacgtcctggtggaaacgagattactagaggaggttccacctcgtacggaaccggttctgaaactgaatcgcctcggaacccttcctccgcaggatcgtggaacagcggctcgtcaggacctggtagcactgggaaccgcaacccagggtcctccggaactggaggaaccgcaacgtggaagccaggttcgtcgggccccggatctacgggatcctggaattccgggagcagcggaaccggctcgaccggaaaccaaaatcccggatcacctcggcccggatcaactgggacgtggaacccgggctcgtcggaacgaggctcggccggtcattggacttccgaatcctcggtatcaggttcgaccgggcaatggcattccgaaagcggcagcttcagaccagacagccccggatcaggaaacgcacgaccaaacaatccagattggggaaccttcgaagaagtgtcaggtaacgtgtcacctggcacccgcagggaataccatacggagaaactggtgacctcaaagggagataaagaactgagaactggcaaggaaaaagtgacttcgggaagcacgactaccaccaggagatcatgttccaagactgtgaccaagaccgtcataggacctgatggccacaaggaggtgactaaggaagtcgtgacctcagaagatgggtccgactgtcctgaggcaatggatctgggtaccctgtccggaattggtacgcttgatggattcagacacagacacccagacgaggccgcgttttttgataccgccagcactggtaagacctttcctggctttttcagtccaatgctgggagaattcgtgtccgaaaccgagtcgcgcggaagcgaaagtggaatctttaccaacacgaaggagtcgtcgtcgcaccaccctggaattgcagaatttccatcccgaggaaagtcctcatcctactcgaagcagttcacgtcgtcgacctcctacaaccgaggggactccacctttgagagcaagtcctacaagatggcagacgaggcgggttcagaggctgaccatgaaggaactcattccaccaagagaggacatgcaaagagcagaccagtgagggattgcgatgatgtccttcaaacccatccttccggaactcaaagtgggatctttaacattaagttgcctggatccagcaagatcttcagcgtgtactgcgatcaagaaacttcactcggaggctggctcctgatacaacagcgcatggatggaagcctcaatttcaacaggacttggcaagactacaaacgcgggtttggaagcctgaacgacgaaggcgagggcgagttctggcttgggaatgattacctgcatctcctgacccagagaggttcggttctccgtgtggaacttgaggattgggcaggcaacgaggcgtacgctgaataccattttagggtgggtagcgaagcagagggttacgccctccaggtgtcatcctacgagggaactgcaggtgatgcgcttatcgaaggttcagtggaagaaggagccgagtacacctcgcataacaacatgcaattttcgacgtttgatagagatgcagatcaatgggaagaaaactgtgcagaagtgtacggcggaggatggtggtacaataactgccaagccgcaaatcttaatgggatttactacccaggtggatcctacgatcctcggaacaattcgccttacgaaatagaaaacggagtggtgtgggtgtcgttccgtggcgcagattactcactgagagcagtgcggatgaagattcgacctctggtgactcaa

SEQ ID NO: 11109 - DNA, 2598 bp, Artificial Sequence
  Description of Artificial Sequence: Synthetic coding sequence
atgttctctatgcggattgtgtgccttgtgctttctgtggtcggcaccgcatggacggccgacagcggcgagggggactttctcgccgagggagggggcgtgcgcgggcctcgtgtggtcgaacgacaccagtctgcgtgtaaggactccgattggcctttctgctctgacgaagactggaactataagtgtccgagtggctgcaggatgaagggcctgattgatgaggtgaatcaggacttcacgaatcgcatcaataagcttaagaatagcttatttgaataccagaaaaacaacaaggattcccactcactgacaacgaatatcatggagatattgcggggcgacttttctagcgccaataaccgcgacaacacctacaaccgagtttccgaggatctgcggtctaggattgaggtcctcaaacggaaggtgattgagaaggtgcagcatatccagctgctccagaaaaatgtcagagcccagctggtagacatgaagagactagaagttgacattgatataaaaattaggagttgtcgaggatcttgctctcgagctctagcacgcgaagtggacctgaaggattatgaggaccagcagaagcagcttgaacaggtcatagctaaagacctccttccttcacgcgatagacaacatctgccccttattaagatgaaacctgttcccgatctcgtccctgggaattttaaaagccagcttcagaaggtaccgcctgagtggaaagcgttaacggacatgccacagatgcgcatggagctggagaggcctggcggcaacgagatcactaggggcggaagcaccagctacggcacaggatccgagactgagagtcctcgtaatccctcgtccgctggtagctggaactccggctcctccgggcccgggtctaccgggaacagaaatccaggctcatcaggaaccggcgggaccgccacatggaaacccggaagctctggccccggaagcaccggtagctggaatagcggtagttcaggtacagggagcactggaaatcagaacccgggaagcccacggccaggttctactggtacctggaatcccggctctagtgagcgggggtctgccgggcattggacttccgagtcctcagtgtctggctccaccggacagtggcatagcgagtccgggtcgttcagaccggactctccaggttcagggaatgctcgcccgaacaaccccgattgggggacgtttgaagaggtaagtggaaacgtatcccccgggacacgccgcgaatatcatacggagaagctggtgacttccaagggcgacaaggaattgaggactgggaaggagaaggtgaccagtggctcaaccacaaccaccagaaggagctgttcaaaaactgtgaccaagaccgtcatcgggcctgacgggcacaaggaagtgactaaagaagttgtgacttcagaagacggatccgattgtcctgaagcaatggacttgggcacactttccggaataggaacgctggacggatttaggcatcggcaccctgatgaggctgcatttttcgacacagcatccacaggaaaaacctttccagggtttttctcccccatgttgggagagtttgtttcagaaactgagagtcggggttcagagagtggaatttttaccaatactaaagaaagcagtagccaccacccgggaatagccgaatttccgtcaagaggaaaatctagctcgtactctaagcaattcacatcgagcacgtcatataatcggggagactccacattcgaaagcaagtcttataagatggcagatgaggccggcagcgaagcagaccatgagggaacgcacagcacgaaacgcggacacgctaaaagtagacccgtccgtgattgtgatgatgttctgcaaacacatccctccgggacccagtccggcatttttaacattaaactgcctgggagcagcaagattttctccgtttactgtgaccaggagacttccttaggaggctggctgcttattcagcaaagaatggacggaagcctgaactttaacagaacatggcaggactacaagcggggatttggaagcctgaacgacgagggcgagggggagttctggctgggcaacgattaccttcatctcctgacacagcgggggtctgtcctcagagttgagttggaagattgggccgggaacgaggcatatgcagaataccatttcagagtgggcagcgaagccgaaggctatgcactccaggtatcgtcctacgaaggaacagccggggacgccttgattgaggggagtgtggaggaaggggccgaatacaccagccacaataatatgcagttttcaactttcgatcgagatgcagatcagtgggaagagaattgcgcggaagtttatggaggcggctggtggtacaacaattgccaagccgccaatctgaatggcatttactatcctgggggttcctatgaccctagaaacaacagcccctacgagatcgagaatggggttgtttgggtatcctttcgcggagctgactattctctgcgtgcagtgcggatgaagattcgcccactggtcacacag

SEQ ID NO: 11110 - DNA, 2598 bp, Artificial Sequence
  Description of Artificial Sequence: Synthetic coding sequence
atgttcagcatgagaatagtctgtctggtgctctcggtggtcggcactgcgtggacggccgattcgggtgagggagattttctggccgaaggcggaggagtgagaggtccacgcgtggtggagaggcatcaaagcgcatgtaaggactccgattggccattctgctcggatgaggattggaactacaagtgcccgtcggggtgtcgtatgaaggggctgattgatgaggtcaatcaagattttaccaaccgcataaacaagctgaagaattcactcttcgagtaccagaagaacaataaggacagccattcccttactaccaacattatggaaatcctgcgaggagatttttcctcggccaataatcgggacaatacctacaacagagtgtcagaagatctgcgatcaaggatagaagtcctgaagcgcaaggtgattgagaaggtgcagcatatccagctgcttcagaagaatgtgagagcccagctggtggacatgaagcggcttgaagtggatattgacattaagatcagaagctgtcgcggctcctgctcgagggcacttgcaagagaagtggaccttaaagattacgaggaccagcagaagcaattggagcaagtgatagcaaaggacctcctgccatcgcgcgatcgccaacatttgccactcatcaaaatgaagcctgtgccggatctggtgcctggtaacttcaaatcacaacttcaaaaggtgccccctgaatggaaggcgctgactgatatgccacaaatgaggatggagctggaacgcccagggggtaacgaaattaccagaggaggaagcacctcgtacgggactggaagtgagactgaatcccctcgcaacccttcatcagctggaagctggaactccggttcgtccggacctggatctactggcaacaggaacccaggctcgtctggtaccggtggaactgccacttggaaacctggatcgtcgggaccaggctcgaccggatcatggaattcagggtcgtccggaaccgggtctaccggtaaccagaaccctggctcgccccgccctggatcgaccggcacctggaacccaggttcaagcgaaagagggtccgcaggtcattggacctcggagagctcggtgagcggatcaacgggccagtggcacagcgaatccggctcgtttcggccggactcaccaggttcgggaaacgctagacctaacaaccctgattggggaacctttgaggaagtctccggtaatgtctcccccgggacccgtcgtgaataccatactgaaaaacttgtgacttccaaaggcgacaaagagctgcggaccggtaaggaaaaggtcacctccggaagcaccaccacgacccgtagatcctgttccaaaaccgtgaccaagaccgtcataggtccggacggtcacaaggaagtgactaaggaggtggtgacttcagaagatggatccgactgtcctgaagcaatggacttgggaactctttccggaattgggacccttgacggatttaggcatagacaccctgatgaagccgcctttttcgataccgcatccactggaaagaccttccccggtttcttctcacctatgctcggtgagtttgtgagcgaaaccgagagcagaggaagcgagtcgggaatcttcaccaatactaaggaaagctcctcccatcatcctggaattgctgagttcccatctcgcggtaagtcatcatcttacagcaagcagttcacctcgtctactagctacaacagaggagattcgacctttgagtctaagtcgtacaagatggccgatgaggcaggctccgaagcagatcatgaaggtactcattccactaaacgggggcacgcgaaatcgcgacctgtgagggattgtgatgatgtccttcaaactcaccctagcggaacccagtccggaattttcaacatcaaactgccgggtagctcgaagattttctcggtgtactgtgatcaagaaactagccttggagggtggcttcttatccagcaacgcatggacggatcactcaatttcaatcggacttggcaggactacaagaggggctttggatcgctgaacgatgaaggggagggggaattctggctgggtaacgattacctccatctgctgactcagagaggctcagtgcttagagtagaactcgaagattgggcaggaaatgaagcatacgctgagtaccattttcgggtcggatcagaagcagaaggatacgcccttcaagtctcctcgtacgaaggcacggcaggggatgcacttattgaaggatctgtcgaggagggagcagaatacacctcccacaacaacatgcaattctccacctttgaccgggacgccgatcaatgggaagaaaactgtgcagaagtgtacggaggcggatggtggtacaacaactgccaagccgcaaaccttaatggcatctactatcctggtggtagctacgaccctagaaacaactcaccctacgagattgaaaatggtgtcgtgtgggtgtcgtttcggggagcagattactctcttcgagcagtgagaatgaagattaggcctctcgtgactcaa

SEQ ID NO: 11111 - DNA, 2598 bp, Artificial Sequence
  Description of Artificial Sequence: Synthetic coding sequence
atgtttagtatgcgtatcgtttgccttgttctgagcgtggtaggcacggcctggacagccgattccggcgaaggagattttctcgcagaggggggaggggttcgcggtccacgggtagtggaaagacaccagagcgcctgtaaggattccgattggccgttttgcagcgatgaggactggaattataagtgtccatcagggtgtaggatgaaggggttgatcgacgaggtcaaccaggactttaccaacagaatcaacaagctgaagaactctttgttcgaataccagaagaacaataaggattcccacagtctaaccaccaacatcatggagattttacggggcgacttttctagtgctaataatcgggataacacttataatcgcgtgtccgaggacctccgcagccggattgaagtcctcaagcggaaagtaatcgaaaaagtccagcatattcagctgctccaaaagaacgtgcgagctcagctcgtggatatgaagagactggaggtagatattgatataaagatccgtagctgtcggggatcatgttccagggcgctcgcgagagaggtagacctgaaagattacgaagatcagcagaagcagcttgagcaggtgatagcaaaagacctgctgccgagccgcgaccggcagcacctcccactgatcaaaatgaagccggtgcccgatcttgtccctgggaattttaagagccagttgcagaaggtgcccccggaatggaaggctctgactgacatgcctcagatgaggatggaattagagaggccgggaggaaatgagattacacgcggtggctccacctcttatgggaccggctctgagaccgagtccccccgcaacccatccagtgccggctcctggaattctggctcttcggggcctggaagtaccgggaatcgaaaccctggcagcagtgggaccggaggcactgcaacctggaagcccggaagctcaggccccgggtctactggatcgtggaacagcggctccagtgggaccggctcaaccggaaatcagaaccctgggagtcctaggccagggagcacaggcacatggaatcctgggtcatctgaacgggggtctgccggacattggacatcagagagttccgtgtcggggagtacagggcagtggcacagcgagagcgggagcttccggccagactcgcctggctccgggaacgcccgacctaacaaccctgactggggaactttcgaggaagtgtcaggaaacgtgtcacccggcacgcggcgggagtaccacactgagaaactggtaacttccaaaggcgacaaggagctcagaactggcaaggagaaagtcacaagcggtagcaccactacaactaggcgcagctgctccaagacagtgaccaagacagtgataggcccagatggccataaagaggtgaccaaagaggtggtgaccagcgaggatgggtctgactgtcccgaggcaatggacctgggcaccctgagtgggattggcaccttggacggattccgacatcggcaccccgatgaggcggccttctttgataccgctagcaccgggaagacattccctgggttttttagccccatgcttggcgaatttgtcagcgaaactgagtcccgcgggagcgaatccggcatctttaccaataccaaggaaagctcctctcaccaccccggaatagctgagttcccttcacggggcaagagctcaagttactcaaaacagtttacaagtagcaccagctacaacagaggtgacagcacatttgaaagcaagtcatacaagatggcagatgaagctggatccgaggcggaccacgaagggacccacagtacaaaaagagggcacgccaaatctcggcctgtacgcgactgtgatgatgtcctccaaacgcacccttccgggactcagagcggaatcttcaacatcaaattgcctgggtccagcaagattttctctgtgtactgcgaccaggagaccagcttagggggatggctgctcatccagcaaaggatggacggatcgctgaactttaataggacttggcaggattacaaacgaggatttggcagcctaaatgatgagggagagggcgaattctggttaggcaatgactacttgcatctgttgacccagagaggatctgtgctccgagtggaattagaagactgggccggaaacgaggcatatgcagagtaccatttccgggtgggaagtgaggcagaaggttatgcactacaggtcagctcttatgaagggacggccggggacgcgctgattgagggctcggtagaggaaggggccgagtatacctcccataataacatgcaattttccacattcgacagagatgcagatcagtgggaggagaattgcgcagaggtgtacggggggggctggtggtataataattgtcaggctgcgaacctgaatggcatctattaccctggcgggtcctacgaccctagaaataattctccgtatgaaatcgagaatggggtcgtttgggtgagttttcgaggtgccgattattctcttagagcagtccgcatgaaaatcagaccactagttactcag

SEQ ID NO: 11112 - DNA, 2598 bp, Artificial Sequence
  Description of Artificial Sequence: Synthetic coding sequence
atgttctcaatgcgcatcgtgtgcctcgtgctcagcgtggtgggcaccgcgtggaccgctgactccggagaaggggacttcctggccgaaggtggcggggtccggggccctcgagtcgtggagagacatcagtccgcctgtaaggattccgattggccgttctgctcggacgaggactggaactacaagtgcccctcggggtgtaggatgaagggactgattgacgaggtgaaccaggacttcaccaacagaatcaacaaattgaaaaacagcctgtttgagtatcagaagaacaataaggatagccattcgctgactaccaacattatggagattcttcggggggacttctcaagcgccaataatcgcgataacacctacaatcgcgtgtccgaagatctgagaagccggatcgaagtgttgaagaggaaagtgatcgaaaaagttcagcatattcaactgctccagaagaatgtgagagcacagctggtggacatgaagcgactggaggtggatatcgacatcaagataagaagctgccgtggttcctgttctcgcgcactggcccgggaggtggatctgaaggactacgaagatcaacagaagcagcttgaacaggtgatcgctaaggatctgctgccgagccgcgaccggcagcacctccctttgatcaagatgaaaccggtgcctgatctggtcccaggaaactttaagtctcagttgcagaaggtgccgccggagtggaaggctctgacggatatgccccaaatgcggatggaactggaacggccgggcggcaacgagatcacccgcggaggatcaacttcctacggcactggcagcgagactgaatcaccgcggaatccgtcatccgccggttcctggaactcggggtcgtccggaccgggttccaccggaaataggaatccaggatcgagcggtaccggaggaacggcgacgtggaagcctggatcctcaggccctggctcgaccgggagttggaactcgggaagctcaggaacgggatccactggaaatcagaaccccggcagcccgcggcccgggtcgactggtacctggaaccccgggtcctcggaacggggaagcgccggacactggacctcggaaagcagcgtgagcggaagcactggtcaatggcactcggagagcggttcctttaggccggactctccgggcagcggcaacgcccgccctaacaaccccgactggggcactttcgaagaggtcagcggcaatgtgtccccgggaactcgacgggaataccacacggaaaaactggtcacctccaagggtgataaagagttgcggacgggaaaggagaaggttacttcggggtcaacgaccactactcggcgctcatgctccaagaccgtgaccaagactgtcattggtcctgatggacacaaggaggtgaccaaggaagtggtgaccagcgaggacggcagcgactgccctgaagccatggacctgggaacccttagcggcatcggtacgttggatggattccgccatagacacccggatgaggctgcgttcttcgatactgcctctacgggaaaaaccttcccaggttttttctctccaatgcttggggaatttgtgagcgaaaccgaaagcaggggatccgaatcaggtattttcactaacactaaggaatcttcctcccaccacccggggattgccgagttcccatcccgaggaaagtcatcgtcatactcgaagcagttcacgtcgtccacctcctataacagaggggattcgaccttcgaatccaagtcctacaaaatggcggacgaagcggggtcggaagcagaccatgaaggtacccacagcactaaacggggacacgccaagagcaggccagtccgcgattgcgacgacgtgctccagactcacccgtccgggactcaatccggaatctttaacatcaagttgccgggctcctccaaaatcttctccgtctactgcgaccaagaaacttccctgggagggtggctccttatccaacagaggatggacggttccctgaatttcaatcggacttggcaggactataaacggggattcggatcgctcaacgacgagggggagggagaattctggctgggaaacgactacctgcatctgctcacccaacggggatcggttctgagagtcgaactggaggattgggctggaaacgaggcctacgccgagtaccactttcgcgtaggatccgaagcagagggatacgcactgcaagtctcatcgtacgagggtactgctggagacgcgttgatcgaaggttccgtggaagagggagcggaatacacctcccataacaacatgcaattctcgacttttgacagggacgctgaccagtgggaagagaactgtgcagaagtgtacggtggaggctggtggtacaacaattgtcaagctgcaaacctgaacgggatctactatcctggaggaagctacgacccgcggaacaacagcccttacgaaatcgagaacggagtcgtctgggtcagcttccggggtgctgactacagcttgagagctgtcaggatgaagatcagaccactggtgacccag

SEQ ID NO: 11113 - DNA, 2598 bp, Artificial Sequence
  Description of Artificial Sequence: Synthetic coding sequence
atgtttagcatgcggatagtgtgccttgtgcttagcgtggtgggaaccgcgtggaccgctgattcgggagaaggagatttcctcgcagaaggaggaggtgtgaggggtcctcgcgtggtcgaacgacatcagtctgcctgcaaagatagcgattggcccttttgcagcgacgaggactggaattacaagtgccctagcggatgtagaatgaagggtctgattgatgaggtaaaccaggactttactaacaggatcaataagctcaagaactcgctttttgaataccagaagaacaataaagattcccacagcttgaccaccaacattatggagattctgagaggcgatttttcatcagcaaacaacagagacaatacttacaaccgggtgtcggaagatctgcgcagccgtattgaggtcctcaagcgcaaggtcattgagaaggtgcaacatatccaactcctgcagaagaacgtgcgcgcacagctcgtggatatgaaacgtttggaggtggatattgatatcaagatccgctcgtgtcgagggtcatgttcacgcgcacttgcaagggaagtggatttgaaggactacgaggaccagcaaaagcaactcgagcaggttatcgcaaaggatttgctgccgagcagggacagacagcacctgcccttgataaagatgaaacctgtacctgatcttgtgcccggaaatttcaagagtcagttgcagaaggtgcctccagaatggaaggcactgactgatatgcctcaaatgaggatggaactcgaaagacctgggggaaacgaaattactcgaggcggaagcacgtcctatggtactgggagcgagactgaatctcctcgcaatccatcgtcagctggatcttggaatagcggttcatccggcccaggatcgactggaaaccgcaaccctggttcctctgggactggggggactgcaacctggaagcctggttcgtcaggccctggatcgacgggatcgtggaacagcgggtcgagcggcacgggatccaccggaaaccaaaatccaggatcccctagaccaggatcaactggcacgtggaatcccgggtcctcggagcgtggctcagcagggcattggaccagcgaatcctccgtgtcgggatcaaccggacaatggcatagcgaatcggggtccttccgcccagactcccccgggtcgggtaatgcccgcccgaataatcctgattggggtacttttgaagaggtcagcggaaacgtgtcccctggcacgaggcgggagtaccatactgagaagctcgtcacttctaagggggataaagagctccggactggaaaggaaaaggtcacctcaggttccactaccactactcggcgctcgtgttcaaaaacggtgactaaaactgtgatcggacctgatggtcataaagaagtgaccaaggaagtggtcacctccgaggatggctccgattgtcccgaagccatggatctggggaccctcagcgggattggaaccctggacggtttcagacacagacaccccgatgaggccgctttcttcgacaccgcatcaaccggaaagaccttcccaggttttttctccccaatgctgggtgaattcgtgtccgagactgagtcaaggggtagcgagtcaggtattttcaccaacacgaaggaatcttcctctcaccatccaggaatcgcagagtttccatcgagggggaaatcgtcatcgtacagcaagcaattcacttcaagcacctcgtacaaccgcggggattccacttttgaatcaaaatcctacaagatggccgatgaagcaggatcggaagcagaccatgaaggaacccattcaacgaaacgcggacacgccaaaagtagacctgtccgggactgtgatgatgtgctgcaaacccacccatcaggaacccagtcgggcattttcaacatcaaacttccgggatcctccaaaatcttctccgtgtactgtgaccaggaaacttcgcttgggggatggttgctgatccagcagagaatggatggaagcctgaactttaatcggacctggcaggattacaagagagggtttggaagcctcaacgacgaaggtgaaggagagttttggctcggcaacgactaccttcatctgttgacccagcgaggtagcgtcctgagggtggaactcgaggattgggcaggaaatgaagcctatgccgaataccattttcgggtcggctcagaggcggaaggttacgcattgcaagtttcctcgtacgaaggaactgctggggacgcgcttatcgagggttcagtggaagagggagcagaatacaccagccacaataacatgcaattcagtaccttcgacagagacgcggatcaatgggaagaaaactgcgccgaagtgtacggaggaggttggtggtacaacaattgtcaagcagcaaacctgaatggaatttactatcccgggggctcgtacgatccgcggaacaattccccatacgaaatcgaaaatggagtcgtctgggtgtcatttcgcggcgcagactacagcctcagagcggtccgcatgaagattagacctctggtgacccag

SEQ ID NO: 11114 - DNA, 2598 bp, Artificial Sequence
  Description of Artificial Sequence: Synthetic coding sequence
atgttttctatgcggatcgtgtgcctggtcctgtcagtggttggaaccgcttggacagccgacagtggcgagggggattttctagccgaggggggcggcgtcagagggccacgggtggttgagaggcaccaatccgcctgcaaggatagcgattggccgttttgctctgacgaggattggaattacaagtgtccctccggatgtaggatgaaaggccttatcgatgaggtgaaccaagattttacaaacaggattaataaactcaagaatagcctcttcgagtaccaaaaaaataataaagactcacactctctaacaacaaatataatggagatcctccggggggatttttcaagcgccaacaaccgcgacaatacctataaccgtgtgtccgaagacctgagaagccggatcgaagtgctgaagaggaaggtcatagagaaggtgcaacacattcagctgctacagaagaatgtcagagcccagctggtcgatatgaaaaggctggaagtggatatagacatcaagattaggagttgtagggggtcttgtagtcgggcccttgcccgggaagtggatctaaaagactacgaggaccagcagaagcaacttgaacaggtgattgctaaggatctcttgccctcacgcgacagacaacacctgccgctgatcaaaatgaaacctgtgcctgatttggtgcccgggaactttaagtcacagctacagaaggttccccctgagtggaaggcccttaccgatatgccccagatgaggatggagctagaaagacctggagggaacgagattacccggggggggagtacctcttatggtacaggctcagagaccgaatctcctagaaatccttcgtctgctggctcctggaactccggttcttctggccccggtagcaccggcaatagaaatccaggcagctctgggacaggaggaaccgcaacgtggaagcccggatcctctggccccggcagtaccggatcctggaacagtggaagtagtggcacaggatccacaggaaaccagaacccaggctctccccgccccggctcaactggaacatggaatcccggtagtagcgagcgagggtccgctggtcactggacctccgaatcaagcgtctccggaagcacgggccaatggcactccgaatctgggtccttcaggccagactcccctggaagtggcaatgcccgcccaaacaacccggactgggggacgtttgaagaggtaagtggaaacgtgagtccaggaacacgacgagagtaccataccgaaaagctggtgaccagcaaaggtgataaagaactgcggaccggcaaagagaaggtgaccagcggcagcacgacaacaacccgaaggtcctgtagcaagaccgttactaagaccgtcatcggccccgatgggcataaggaggttaccaaggaggtggttacttccgaggacggatccgactgtccggaagccatggatctcggtaccctgtcgggaatcggcacactagacggttttagacatagacaccccgacgaggccgcattcttcgataccgcatccactggcaagacctttcctggatttttctctccaatgttgggagaattcgtgtcagaaacagagtccaggggtagcgagagcggcatctttaccaacactaaggagagctcatcacaccatcctggcatagccgagttcccatcacggggcaagagcagcagctatagtaagcagtttacctcgtcgactagttacaaccggggggatagcaccttcgagagcaagtcatataaaatggcagatgaggcgggcagcgaggcggatcacgaagggacccactcaaccaagagggggcacgccaaatctcggcctgtgagagactgcgacgacgtactgcagactcacccctcaggcactcagtcagggatttttaatattaagctgccagggtcttccaaaattttctcagtttactgtgaccaggagacatccttaggtgggtggctgctgatccagcagcggatggacggtagcctgaattttaatcggacatggcaggactacaaacgcggctttggcagccttaacgatgaaggagagggcgaattctggttaggaaacgactacctgcacctgctcacgcagcgcggaagtgtcctgagggtggagcttgaggattgggcggggaatgaggcatacgctgaataccatttccgtgtagggagtgaggcggagggatacgcacttcaggtgtctagctacgaaggtaccgcaggagacgccctcattgaaggatcagtggaagaaggcgcagaatacacttcccataataatatgcagtttagtactttcgacagagatgcggaccagtgggaggaaaactgtgcagaggtgtacgggggcggttggtggtataacaattgccaggcggcaaacctgaacggtatctactatcctggagggtcttacgacccccgtaacaacagtccgtacgagattgagaatggtgtagtgtgggtgtcgttcaggggcgctgactatagcctgagagccgtgcgaatgaaaattcggccactggtgacgcag

SEQ ID NO: 11115 - DNA, 2598 bp, Artificial Sequence
  Description of Artificial Sequence: Synthetic coding sequence
atgttctcgatgcggatcgtgtgccttgtgctctcagtggtgggcactgcctggaccgcggactccggcgaaggagactttctggccgaaggaggtggcgtgagaggcccgcgcgtcgtcgaacgccaccagtcagcatgcaaggattccgactggccgttctgctccgacgaggattggaattacaagtgcccgagcgggtgcaggatgaaagggctgattgatgaagtgaatcaagattttaccaatcggattaacaaattgaagaactcgctgttcgagtaccagaagaacaacaaggacagccactcactcaccactaacattatggagatcctgcggggagatttctcatccgcgaataacagggacaacacttacaacagagtcagcgaggacctgcggtcaagaatcgaagtgctgaagcgcaaggtgatcgagaaggtgcagcatatccagctgcttcaaaagaacgttagggctcagctcgtggacatgaaaagacttgaagtggacatcgatatcaagatcaggtcgtgccgggggtcgtgcagcagggctctggcccgggaagtcgacctcaaggattatgaggaccagcaaaagcaacttgaacaagtgatcgcgaaagatttgctcccgtccagagatcggcagcacctgcctctgatcaagatgaagcctgtgccagacctggtgcccggcaatttcaagtcgcaactgcagaaagtgccgccagagtggaaggctctgaccgacatgccacagatgaggatggagctggaacggcctggagggaatgaaatcactcgcggaggctcgacttcgtacggcactggctccgaaaccgaatcaccacgtaaccctagcagcgccggttcctggaacagtggctcatcgggcccgggatcaactggcaatagaaacccagggtcgtcaggaaccggaggaactgccacctggaaacccggctcgtcaggacccggatctacggggtcatggaactcgggaagctccgggaccggatcgacgggtaaccagaaccctggatcaccgcgtccgggaagcactgggacttggaatccgggatcgtccgaacggggatcagccggacactggacgtcggaaagctcggtttctggatccaccggtcagtggcattcggaatcgggctccttccgcccggattcccccggaagcggaaatgctcggccaaacaacccggattgggggaccttcgaagaagtgtcgggtaacgtgtcccccggaacccgcagagagtaccacaccgaaaagctggtcacgagcaagggagataaggaactccggaccgggaaggaaaaggtcacttccggctcaactaccactactcgccgctcgtgttcgaaaaccgttaccaagactgtgatcggaccggacggacacaaggaagtcaccaaggaagtagtgaccagcgaggacggttccgattgtccggaagccatggatttgggaacgctctcaggaatcggaacgcttgacggattccggcacaggcaccctgatgaggccgccttctttgataccgcctcaactggaaaaaccttcccaggattcttctcgccgatgctgggagaattcgtctccgagactgaatcccggggctcggagagcggaatctttactaacactaaggagtcgtcgtcacaccatccaggcatcgcagagttcccgtcccggggaaaatcctcctcatactcgaagcagtttacctcgagcacctcatacaatcgcggagactcgactttcgaaagcaaaagctacaagatggctgacgaagccggctcggaagccgaccatgaggggacccatagcacgaaacgcggacacgctaagtcgaggccggtccgggactgcgatgacgtcttgcagacccacccctcaggaactcagtcgggtattttcaacatcaagctgccgggatcgtcgaagattttcagcgtctactgcgatcaagaaacctccctgggaggatggcttcttatccagcagcggatggacggctcgttgaatttcaaccgcacctggcaggactacaagcggggtttcgggtcgttgaacgatgaaggcgagggtgagttctggcttggcaacgactacttgcacttgcttacccagcggggttcggtgttgagagtggagctggaggactgggctggaaacgaggcatacgccgaataccactttagggtgggatcggaggccgaaggttacgccttgcaagtctcctcctacgagggaacggctggagacgcgctgatcgaagggtcggttgaggaaggagcagagtacacctcccacaacaacatgcagttctcaaccttcgatagggatgcagaccaatgggaagaaaattgcgctgaggtgtacggaggcggctggtggtacaacaactgccaagcggcaaatctgaacggtatctactatccaggtggatcctacgacccgagaaacaattccccgtacgagatcgagaatggagtcgtgtgggtcagtttccggggcgcagactactcactgcgcgccgtgcggatgaagatcagaccactggtgactcag

SEQ ID NO: 11116 - DNA, 2598 bp, Artificial Sequence
  Description of Artificial Sequence: Synthetic coding sequence
atgttctctatgcgcatcgtatgtctggtgctgtcagtggttggaactgcctggacagctgactcaggcgaaggtgacttcctggcagagggaggtggagttaggggacctagggtggtcgagcgccatcagagtgcctgtaaagactccgactggcctttttgctctgacgaggactggaactacaaatgcccctccggttgccgcatgaagggcctgatcgatgaagtgaaccaagactttaccaacaggattaataagctcaagaatagcttgtttgaataccagaagaacaacaaagattcacattctctgactacgaacatcatggaaatcctgcgcggcgacttctcatccgccaataatagagacaacacttataacagggtgtccgaggacctgcgcagtagaatcgaggtgttgaagaggaaggtcatagagaaggtacagcatatccagctccttcagaagaatgtcagagctcaactggtcgacatgaagagactggaagttgacattgacatcaaaattcgctcatgtagaggaagttgctcaagagcgctggcaagagaggtagaccttaaggattatgaagaccagcagaagcaactggagcaggtgattgctaaggacttgctccccagccgcgatagacagcacttgcctctgataaagatgaagcctgtcccggatctcgtgcctggcaactttaagtcccaactccagaaggttccacctgagtggaaagccctgaccgacatgccccagatgagaatggaactggaaagaccaggaggaaacgagataacacgcggaggtagcacatcatacggaaccggctccgaaaccgagtctcctagaaacccttctagtgcaggcagctggaacagcggtagtagcggaccaggctccaccggaaatagaaaccccggctcctctggtaccggaggtacggccacgtggaagccaggttcttctggacccggatccactggttcctggaactccggttcttccggtaccggatctacgggcaaccagaacccaggttcaccaaggcctggttcaaccggaacatggaaccctggctcttctgaacgcggttccgcgggtcattggacttcagagtcttccgtatccggatctaccggccaatggcacagcgagagcggttccttccgcccagactcaccaggatccggaaacgctagacccaacaatcctgattggggcactttcgaggaggtatcaggcaacgtgtccccaggcacacgcagggaataccataccgagaagctggttacatcaaagggagacaaggaactgagaacgggaaaggaaaaagtgacatcaggttcaactacgacaactaggcgcagctgctccaagaccgtgactaagacagtcatcggccccgatggtcacaaggaagtgaccaaagaggtggttacctctgaggacggcagcgattgccctgaggccatggatctgggaaccttgtctggcataggcaccctcgacggctttaggcacaggcaccccgacgaggccgccttttttgataccgcgagcactggcaagaccttcccaggctttttttctcctatgctcggtgagttcgtcagtgagacagagtcccgcggtagcgaaagcggaatctttactaacactaaggaatcatcttcccatcaccccggtatcgcggagtttccttcccgcggtaagagctccagctacagcaagcagttcacatcatctacttcttacaacagaggtgatagtactttcgagtcaaagtcctacaagatggccgacgaagcgggttcagaggccgatcacgagggaacacattccacaaagaggggtcacgctaaaagcagaccagtgcgcgattgcgatgacgtgttgcagacccacccaagtggaacgcaatccggcatcttcaacatcaaacttcctggctcttctaagatattttctgtgtactgtgatcaggaaacttctcttggtggctggctgctgatacagcagaggatggatggttcactgaacttcaaccgcacctggcaagactataaaagaggctttggttccttgaacgatgaaggcgagggtgaattttggttgggtaacgactacttgcacctgctgacacagaggggctccgtcctgagggtggagctggaagactgggccggtaacgaggcttatgccgaataccacttcagggtcggatccgaagctgaaggttacgcactccaggtttcatcctacgagggaacggctggcgacgcattgattgagggatcagtcgaagagggagccgaatacacgtctcataacaacatgcagttctccacctttgatagagacgcggaccagtgggaggaaaattgcgcagaagtgtatggcggcggatggtggtataacaactgccaagctgctaacctgaatggcatttactaccccggaggtagttacgacccaagaaataactccccctacgaaatcgaaaacggtgttgtctgggtgagcttccgcggagctgactatagtctgcgcgctgttaggatgaagattcgccccctggtcactcag

SEQ ID NO: 11117 - DNA, 2598 bp, Artificial Sequence
  Description of Artificial Sequence: Synthetic coding sequence
atgttcagcatgaggatcgtgtgcctagtattgtctgtagtgggcactgcatggacagcggactctggagagggcgacttcctcgcggaaggaggcggggttagaggaccccgggtggtagaaaggcatcagtccgcctgtaaggacagcgattggccgttttgcagtgacgaagactggaactacaagtgtccatccggttgtaggatgaaaggcctgattgatgaagtcaatcaggactttaccaaccggattaacaagctcaaaaactccctatttgagtaccagaagaataacaaagactctcacagcctgaccactaatattatggagattttacgcggcgacttcagtagcgccaataatcgtgacaatacttacaatagagtgagtgaggaccttaggtcccggatcgaagtgttaaagcgcaaagtgatcgaaaaggtccagcacattcagcttcttcagaagaatgtgagggcccagcttgtagatatgaaacggctcgaagtggacatcgacataaaaatccgatcctgtcgcggctcatgtagtcgggccctcgccagagaggtggatctgaaagattacgaggaccagcaaaaacagctggagcaggtgatcgctaaggacctcctgccttcgcgcgacaggcaacatctgcctttgatcaagatgaaacccgtgcccgatctcgtgccaggcaactttaaaagccagttgcagaaggtaccacctgaatggaaagccctgaccgatatgccacaaatgcgcatggaactggaaaggccagggggaaatgagatcacaagaggtggatcaacctcgtatgggaccggctcagagaccgaaagtcctcgcaatccgagtagcgccgggtcatggaattcaggatcatctggccctggcagcacagggaatcgaaacccggggtcatcaggcactggtggcaccgccacttggaaaccgggcagttcaggccctggctctaccggttcatggaatagcgggtcttcaggaactgggtctaccgggaaccagaacccaggttccccccgaccagggagcactggcacctggaaccccggcagtagtgagcgcggctctgcaggacactggacctctgagtcgtccgtctccggctctaccgggcaatggcactctgagtcggggtccttcaggcccgacagccccggcagcggcaatgctcgtcccaataacccagactgggggacgttcgaagaagtctccggtaatgtgtccccagggacccggcgcgagtaccatacagagaagcttgtgacctctaaaggtgataaggaattgagaaccgggaaggagaaggtgacatctggctccacaacaacaacgcgccgctcatgtagtaaaaccgtcacaaaaacagtgatagggcccgacggccataaggaagtgaccaaggaagtggtaacctctgaagatggatccgactgtccagaggccatggacttggggacactgtctggcatcggcactctggatggcttcagacatcggcaccctgacgaggccgctttcttcgacaccgcgtcaaccgggaagactttcccaggtttcttttctccaatgctcggtgagttcgtcagtgagacagaatctcgggggagtgagtccgggattttcacaaacaccaaggagtcttcttctcaccaccccggtattgcagagtttccctctcgcggaaagagctctagctactccaagcagttcacttcgtccacctcatataacagaggagattccaccttcgagagcaaaagctataagatggcagacgaggctggctcggaggccgatcatgaagggacacattccaccaagcgcggacacgccaagtccagaccagtccgtgattgcgatgacgtgctgcagactcacccttccggtacccagtcaggcatttttaacatcaagctgccggggtctagtaaaatcttcagtgtgtactgcgatcaggagaccagtcttggaggatggcttctgatccagcagagaatggatggcagtctgaatttcaaccgcacatggcaggactataaacgagggtttggatcactgaatgacgagggcgagggagaattttggctgggtaacgattacctccatctgctcacacagcgtggttctgtcctccgcgtggagctggaggactgggccggcaacgaggcatacgcggagtaccatttcagggtcggttccgaggccgagggctacgccctgcaggtgagtagttacgagggaactgcaggagatgctctgatcgaaggttccgtagaggagggggctgaatacacctcccataacaatatgcagttcagcaccttcgatcgggacgccgaccagtgggaggaaaattgcgccgaggtgtatgggggcggctggtggtacaacaactgccaggcagcaaacctcaatggaatttattatcccggaggcagctacgatccccgcaacaactctccatatgaaatcgagaatggagtggtgtgggtttccttccgcggcgctgattacagcctgcgggccgtgcgaatgaaaatcagaccactggtcacacag

SEQ ID NO: 11118 - DNA, 2598 bp, Artificial Sequence
  Description of Artificial Sequence: Synthetic coding sequence
atgttcagcatgagaatcgtatgcttggttctctcagtagttgggacagcatggaccgccgattccggtgaaggcgactttcttgcggaagggggcggggtgaggggccctcgcgtggtggagagacatcagagtgcctgcaaagatagcgactggcctttctgctctgatgaggattggaactataagtgcccaagtggctgcagaatgaagggtctgatcgacgaggttaatcaggatttcacaaatagaattaataaactgaagaatagcctgttcgagtaccagaaaaacaataaagactcccacagtttgactactaacattatggagatcctgcgcggcgacttttcctcggccaacaacagagacaatacctacaatagggtttcagaagacctgcgctcgcggatcgaagtgttaaagcgcaaagtaattgaaaaggttcagcacatccagctgctgcagaaaaacgtcagggcccagttggtggatatgaaaaggctggaagtggatatcgacattaagattcgctcttgccgggggtcttgttctcgcgcattggcgagggaagtggatctaaaggattacgaagatcagcaaaaacaactagagcaggtaatcgcgaaagacctcttgccttcacgggaccgacagcacctccccttgattaagatgaagccagtgcctgacctcgttcccggcaacttcaaatcacagttgcagaaggttccacctgaatggaaggctctcactgacatgccccaaatgcgaatggaactcgagcgccccggaggcaatgaaattactaggggagggtcgaccagttacggaactggtagtgaaaccgaatctccacgcaacccatcaagtgccgggagctggaacagcgggtcttctggccctggatccacaggtaaccgcaatcctggtagtagcggcaccgggggcaccgctacctggaagcccgggagctcaggacccggctcaactggatcgtggaatagcggatcctcaggaaccggctcaaccggtaaccaaaatcctggaagcccacgtccagggagtacagggacatggaatccgggatccagtgaacgggggagcgctggtcactggacaagcgagtcaagcgtgtcaggctctaccggccaatggcatagtgagtcagggagcttcaggcccgattctcctggcagcggcaacgcccgccctaataacccagattggggtaccttcgaagaagttagcggaaatgtcagccctggcacccgacgagagtatcatactgagaaactggtcacgagcaagggcgataaggagcttagaactgggaaggagaaagtaactagcggttcgacgactacaacccgccgcagttgtagcaaaactgtcacgaaaacggtgattggtccagatggacacaaagaggtcaccaaggaagtggtcacaagcgaggatggttcggattgccccgaggcaatggaccttggaactttgtccggaataggaaccctcgatggatttcggcacagacatcccgatgaggccgctttttttgataccgcttcgaccgggaagacatttcctggattcttctctccgatgttaggcgagttcgtcagcgagaccgaatcacgcggttcagagagcggcatttttaccaacacgaaggagtctagcagtcaccaccccggaatagcagagtttccctctcgcggcaagagctcgtcctattccaagcagtttacttcctcaacgtcctataaccgcggcgacagcaccttcgaaagcaagtcctataagatggctgacgaagccggatccgaggcagaccatgaggggactcattccaccaaaagagggcatgccaagtcccggcccgtccgagattgcgatgatgtgctgcagacccatcctagcgggacccagtcaggaatattcaatattaaactacccggatcctctaagatcttcagcgtttattgcgatcaggagaccagtctcggcggttggctcttgatccagcagcgaatggatggctcactgaattttaacaggacgtggcaggattacaaaaggggattcgggagcttgaacgacgaaggtgagggcgaattttggctcggaaacgactatctgcatctacttacccagagaggaagcgtgttgcgggtcgagctcgaagactgggccggtaatgaggcttatgcggagtaccacttccgcgtgggttcagaggcagagggctatgcgctgcaggtaagctcatacgaaggcacagccggggacgccctgatcgaaggctccgtcgaggaaggcgccgagtacaccagccataacaatatgcagttcagcacattcgaccgagatgccgatcaatgggaggagaactgtgctgaagtatatggaggcggctggtggtataacaattgtcaggccgctaatctcaacggcatctactacccaggcggctcgtatgatcctcgcaataattcaccatacgagatagaaaatggggtagtttgggtcagctttcggggcgctgattactcgctacgggcagtgcgaatgaagatacgtcctttggtaacccaa

SEQ ID NO: 11119 - DNA, 2598 bp, Artificial Sequence
  Description of Artificial Sequence: Synthetic coding sequence
atgttttcgatgcgcattgtgtgtcttgtcttgtccgtggtgggcaccgcctggactgctgactccggagaaggcgactttcttgccgaaggtgggggcgtcagaggtccacgagtggtcgagagacaccagagcgcgtgtaaagattccgactggccattttgttccgacgaagattggaactacaagtgtccatccggatgtcgtatgaaaggactgattgacgaagtgaaccaagactttactaaccgcattaacaaacttaagaactcactttttgaataccaaaagaacaacaaagattcccattcgcttactaccaacataatggaaatcctgagaggcgatttctcctccgcaaataaccgtgacaatacgtacaatcgagtgtccgaagatctgaggtcgcgcatagaagtgctcaagcggaaagtcattgagaaagtccaacatatccaactgctccaaaagaacgtcagggcccaattggtggatatgaagcgccttgaggtggatattgatatcaagatccgttcatgtcgaggctcatgttcgagagcactcgcgagagaagtggatctgaaagattacgaggaccagcaaaagcagctcgaacaagtgatagcaaaggacctgctcccatcccgtgaccggcaacatcttcctctgattaagatgaagccagtgcccgatctggttccaggtaatttcaagtcccagcttcagaaggtgcccccagaatggaaagcactgaccgatatgccgcagatgcgcatggaacttgagaggcctgggggaaacgagattacgcgaggaggaagcacctcatacggaaccgggtccgaaactgaaagccctcgaaacccaagctccgcaggttcgtggaattcagggtcgtctggaccaggaagcacgggcaaccggaatccaggctcgtcgggcaccggtggcaccgccacttggaagccgggttcgtcaggtcctggaagcactgggagctggaattcgggttcttccggcactggtagcaccggaaaccaaaaccccggatcaccacgacctggatccaccggaacctggaacccagggtcatctgagcggggttcagcgggtcattggaccagcgaatcatccgtgtcggggtccaccggtcagtggcacagcgagtccgggtcgtttcgtcccgattcccctgggtcaggaaatgctcggcctaataaccctgattggggaacctttgaagaagtatccggaaacgtgtcacctggaactcggagagagtaccataccgagaaacttgtcacctcgaaaggggataaagaattgcgtaccggaaaagaaaaggtgacctcgggctcgactaccactactcgacggagctgttccaagacggtgaccaagacggtcatcgggcctgacggacataaggaagtcaccaaggaagtggtgacttcagaggacgggtccgattgtcctgaagccatggacctgggcactttgtccggtataggcaccttggatggttttagacacaggcaccctgatgaagccgcattctttgataccgcctcgaccggaaagaccttccccggttttttctcaccaatgctcggagaatttgtgtcggaaaccgagtcaagaggaagcgaatcaggaattttcactaacacgaaggagtcgtcctcccatcaccctggcatcgccgaatttccgtcgaggggtaaatcgtcgtcatactccaagcagttcacttcatctacttcgtacaaccggggtgactcgacgtttgagagcaagtcctacaaaatggcagatgaggcggggtccgaggcggatcatgaaggcacccatagcaccaagaggggacacgccaaatcaaggccggtgcgcgattgtgacgacgtgcttcagactcatccttcaggcactcagtcggggatctttaacatcaagctccccgggtcctccaaaatcttctctgtgtactgtgatcaggagacttctctgggtgggtggctgcttattcaacaacgtatggatgggtcactgaatttcaacaggacctggcaagactacaagagggggtttggatcgctcaatgatgagggagaaggcgaattttggttgggaaatgattacctccatttgcttactcagagagggtcggtgctgcgcgtcgaactggaagattgggctggtaacgaggcctacgcagaataccatttccgagtcgggtcggaagcagagggctacgctctgcaagtctcgtcatatgagggaactgccggcgacgccttgattgagggatcggttgaagagggagctgagtacacttcgcacaataacatgcagttctcgaccttcgacagggatgcagatcaatgggaggaaaactgtgcagaggtgtatggaggaggttggtggtataacaattgtcaagcagcaaacctgaacggtatttactatccgggcggatcatacgaccctagaaacaattcgccatacgaaatcgaaaacggggttgtgtgggtgagcttccgcggagccgattactcacttagggcagtgcggatgaagattcggccccttgtgacccaa

SEQ ID NO: 11120 - DNA, 2598 bp, Artificial Sequence
  Description of Artificial Sequence: Synthetic coding sequence
atgtttagcatgagaattgtttgcctggtgctcagcgtggtcggcactgcttggaccgccgatagcggcgaaggagatttcttggccgagggaggtggcgtgaggggcccgagagtcgtggaacgccaccagtcagcctgcaaagattcagattggcctttttgcagtgatgaagactggaattacaaatgcccaagcggatgtaggatgaagggcttaatcgatgaggttaatcaggactttacaaacagaattaacaagctgaaaaacagcctgttcgagtaccaaaaaaacaacaaagattcccacagtttgactactaacattatggagatcctgcgcggagacttcagctctgcgaacaatagagacaacacatacaacagggtgagcgaggacttgaggtctagaatcgaagtgctcaaaagaaaggtaatcgaaaaagtgcaacacatccagcttctacaaaaaaacgtccgtgcacaactagttgatatgaagcggctagaagttgatattgacatcaagatcaggtcttgcagggggtcctgctcccgggcactggcacgcgaagtcgatctgaaagactacgaagaccagcaaaagcagctggaacaagtaattgcaaaagatcttttaccgtccagggacagacagcatctgcccctgatcaaaatgaagcctgtaccggacctggtgcccggaaactttaagtcgcagcttcagaaagtgccacctgaatggaaggctttaactgatatgcctcaaatgagaatggagcttgaacgaccagggggtaatgagatcacacggggaggaagtacctcctatggcaccggtagtgaaaccgagagccccaggaacccctcctccgccgggagctggaacagcggatcaagcgggccagggtctacaggaaacaggaaccctgggtcaagtgggaccggaggcacagctacctggaaacctggatcaagcggccctggtagcaccggaagttggaacagtggctccagcgggaccgggtccaccggaaaccagaacccgggatccccaagacccggaagcacagggacctggaaccctggatccagcgagagagggagcgctggccactggacaagcgagtccagtgttagcgggagcaccggccagtggcactccgagtcagggtcattcagacctgattcgcctggaagtggcaacgctcgcccaaacaacccagactggggcacctttgaggaggtctcaggcaatgttagccctggcaccaggcgagaataccatacagagaaactggtcacctctaagggagataaagaactcagaaccggtaaggaaaaagtgacctcagggtcaactactaccacgaggcgcagttgctccaaaactgtgactaagaccgtcattgggcccgatggccacaaagaggtcacaaaggaggtggttactagcgaagacggatcagattgccccgaagcaatggaccttggtacactcagcggcatcggaaccctcgatggtttccggcacagacatcccgatgaagcagccttcttcgataccgcctctacaggcaagacctttcccggtttcttcagtcccatgcttggggaatttgtttccgaaactgaatccaggggcagtgaaagcggcatatttaccaatacaaaggagtctagctcacaccaccccggaatcgctgaatttccaagccgaggaaaaagtagcagctacagtaaacaatttacgagttcgacaagctacaatcgcggagacagcacatttgaaagcaagtcttacaagatggcagatgaggcgggaagcgaggctgatcacgagggaactcacagcactaagagaggacacgctaagagccgccccgtgagagattgcgatgatgtcctgcagactcatccctccggcacacaaagcggcatcttcaacattaagcttcccggcagctccaagatattttcagtctactgtgaccaggagacgtcactcggtgggtggctcctgattcagcagagaatggacggctccctgaactttaacaggacttggcaggattacaagagaggattcggatcactgaatgatgagggcgaaggcgagttttggcttggcaacgactacttgcatcttctgacgcaaaggggcagtgtgctgcgcgtcgaactggaggactgggcaggcaatgaagcctatgccgagtaccactttcgagttggcagtgaagctgagggatacgccctccaggttagttcatacgaaggaactgctggagacgcgttgattgaagggtcagtagaagaaggagcagagtataccagccacaacaacatgcaatttagcaccttcgacagggatgccgaccagtgggaggaaaactgtgcggaagtgtacggtggaggatggtggtacaacaattgtcaagcagcaaatctcaacggcatttactatcccggtggcagctacgacccccgaaacaacagcccttatgaaatagaaaacggtgtggtgtgggttagctttagaggcgcagactactcgctccgggctgttagaatgaagatcaggccccttgtaacacag

SEQ ID NO: 11121 - DNA, 2598 bp, Artificial Sequence
  Description of Artificial Sequence: Synthetic coding sequence
atgttttcaatgagaattgtctgtctggttctgtccgttgtgggaactgcttggactgcagattcaggtgagggcgatttccttgcggaaggtggaggagtgagaggaccccgcgtcgtggaacgccaccaatcagcatgtaaggattcagattggcccttctgctcggatgaagattggaattacaagtgcccttcaggctgtagaatgaagggtttgattgacgaagtgaatcaagactttacgaaccgaattaacaagttgaaaaacagcctctttgaataccagaaaaacaacaaggattcccactcccttactaccaacattatggagattcttaggggagatttttcctccgcgaataaccgagacaatacctacaaccgggtcagcgaggatctgcggagccgaattgaggtgctgaagagaaaggtgatagagaaggtgcagcatattcaattgctgcaaaagaacgtgagggcccaactggtcgacatgaagagactcgaagtggatattgacataaagatccgttcctgtagaggatcctgcagccgggcgctggcacgcgaggtagatcttaaggattacgaggatcaacagaagcagctggaacaagtgatcgcaaaagacctccttccttctagggatcggcagcatcttccccttatcaaaatgaagcccgtcccagaccttgtgccaggaaactttaagtcccaactccagaaagtgccacccgaatggaaggcactgacggatatgcctcaaatgcggatggaattggaacgcccaggcgggaacgaaattactagaggtggaagcacttcgtacgggactggctcggaaaccgagtcaccgagaaatccaagctcggcaggaagctggaattctggaagctcggggcccggatcgactggaaatcggaacccgggatcgtccggtactggcggtacggcaacctggaagccaggctcgtcaggtcctgggagcaccggttcatggaactcgggctcctccggcaccggttccactggaaaccaaaacccaggttccccgaggcctgggtccacgggaacttggaatcctggatcttccgaacgtgggtcagcgggacactggacctctgaaagctcagtgtcgggttcaacgggccaatggcatagcgaatcaggatcctttcggcccgatagcccaggaagcggcaatgcgcggccaaacaatcccgactggggaaccttcgaagaagtgtccggcaacgtgtcacctgggacccgcagggaataccacactgaaaagctggtgacttctaagggtgacaaagaattgaggaccggtaaagagaaagtgacttcgggatcgaccaccactactagaaggtcatgttcaaagaccgtgactaagaccgtgatcggacctgatgggcacaaggaagtgacgaaggaagtggtcacttccgaagatggcagcgattgtcctgaagccatggatctgggaactctctcaggtattggcactctggatggcttcaggcatcggcaccctgacgaagccgcgttttttgataccgcatccaccggtaaaacttttcctgggtttttctcaccaatgctgggagaatttgtgtccgaaaccgaatcccgtgggtccgaatcgggcatctttactaacaccaaagagagctcttcgcatcatccgggtattgctgagttcccatccagaggaaagtctagtagctattccaagcagtttacgagcagcactagctacaatcgcggagattcaacttttgaatcgaagagctataagatggcagacgaagcaggttctgaggcagatcatgagggaacccattcaaccaagcggggtcatgcaaagtcgcgacctgtgcgcgactgtgatgacgttcttcagacccatccgagcggtactcagagcggaatctttaacattaagctgcccggatcctccaagattttctccgtgtactgtgatcaagagacttctcttgggggttggcttctgattcagcagcggatggacggttccttgaactttaaccgcacctggcaagattacaaacgtggatttggaagccttaacgatgaaggagaaggagaattttggctgggtaatgactacctgcatctcctcactcaacgcggttcggtgctgagagtggaactggaggactgggcaggaaacgaggcatacgcggagtatcacttcagagtgggttccgaggcggaaggatacgcactgcaagtgagctcatacgaaggcactgccggagatgcacttatcgagggttcagtggaagaaggtgcggaatacacgtcacacaataacatgcagttctcaaccttcgatagagacgcagatcagtgggaagaaaactgcgcagaagtctacggtgggggatggtggtacaacaactgtcaagcagcaaatctgaatggcatctactaccctggtggctcgtacgaccccagaaacaactccccttacgaaatcgaaaatggggtcgtctgggtgagcttcagaggagcggattattcacttcgggcggtgaggatgaaaattcggcctctggtgactcag

SEQ ID NO: 11122 - DNA, 2598 bp, Artificial Sequence
  Description of Artificial Sequence: Synthetic coding sequence
atgtttagcatgcgaatcgtgtgcctcgtactgtccgtagtgggtacggcctggactgccgacagtggagaaggagactttctggcggaagggggcggcgttcgcgggccccgagtcgtcgagaggcaccagtctgcttgtaaggacagcgactggccattttgttccgacgaagattggaattacaagtgcccgtcgggatgccgcatgaaaggcctcatagatgaggttaaccaggactttaccaatagaataaataagctgaagaattccctctttgagtatcagaagaataacaaggactcgcacagtctcaccacaaatatcatggagatactgcggggtgatttttcatccgccaataatcgcgacaacacctacaatagagtcagcgaagatctgcgttcccggattgaagtacttaagcgaaaagtcatcgagaaggtacaacatatccagctcctccagaagaatgtacgggcgcaactggtagatatgaaacgcttggaggtagatattgatatcaagattcgaagttgcaggggcagctgttctagggctctggctagggaggtggacctgaaggattacgaggatcagcagaagcaactggagcaggtaattgccaaggatttgctccccagcagagataggcaacacctccccctcataaagatgaaacctgtgccagaccttgtgcccgggaattttaagagtcagctacagaaagtcccaccagagtggaaagccctaacagacatgccccagatgcggatggagctggagagacccggtgggaacgaaatcacacgcggcggttctaccagttatgggactggctccgagactgaatctcctcggaatccttcgtccgcagggtcctggaacagcggctcaagtggcccaggcagcacaggaaacagaaatcctggcagctccggcactggtggtacagctacatggaagccaggaagctctggccctggtagcactggatcttggaatagtggctccagcggtacgggctccacgggtaatcagaacccagggtctcctcgccctgggtccacagggacgtggaaccctggtagcagcgagagagggagtgcagggcactggacatctgagtctagtgtttccggttctactggccaatggcatagtgagtcaggtagcttccggccagactctcccggaagtggaaatgctcggccgaacaaccccgattggggaactttcgaagaggtgtctgggaacgtatcacccggtactcggcgggagtatcataccgagaagctcgtcacgagtaagggggacaaagaacttcgtactgggaaggagaaggtgacttctggcagtacaacaactacccgcaggagctgctcaaagacagtcaccaagaccgtaatcggtcctgacggacacaaagaagtcactaaggaagtggtcacctctgaagacggaagtgactgccctgaggcaatggatttgggtacgttatctggaatcggaaccctggacggctttcgccatcgccaccccgacgaggcggctttcttcgatactgcaagtacaggaaagacttttccaggcttcttcagtcccatgctgggagaattcgtgagtgaaaccgaatcacgcggaagcgagagcggcatctttaccaacacgaaggaatcctcctcccatcacccaggaattgcagaatttccatccaggggcaagtcaagcagctactcaaagcagttcacctcatcaacgtcgtacaatcgcggtgattctacattcgagtctaaaagttacaaaatggcggatgaggccggtagtgaagccgaccacgaggggacccactctacgaaacggggacacgcgaagtctcgcccggtaagggactgcgatgacgtgctacagacgcatccttctggcacacagagcgggatattcaacatcaaactgcctgggagtagcaaaattttcagtgtttattgcgatcaggagacctccctgggtgggtggctgttgattcaacaacgcatggacggttccctaaacttcaaccggacctggcaagactataagaggggcttcggcagcctcaacgacgaaggcgagggcgagttctggctaggcaatgattacttgcacctgctgacacagaggggcagtgtgttgcgagtagaactggaggactgggccggcaacgaggcctacgcggagtaccatttcagagtggggagcgaggctgaggggtacgccctgcaggtatctagctatgagggcactgcgggcgacgctcttattgagggtagcgttgaggagggcgccgaatatacttctcacaacaatatgcagttctccacattcgaccgagatgctgaccagtgggaagagaattgcgcggaggtctatggtggggggtggtggtacaacaactgccaggcagctaatcttaacggaatatattacccagggggatcatacgaccctcgcaacaattctccatatgaaattgaaaacggcgttgtctgggtgagctttaggggtgcagactactcgctgagagcagtccgaatgaagataagacccttggtaacccag

SEQ ID NO: 11123 - DNA, 2598 bp, Artificial Sequence
  Description of Artificial Sequence: Synthetic coding sequence
atgttcagcatgagaattgtgtgccttgtgctttccgtggtcggtaccgcgtggaccgcagattcgggagaaggcgactttctcgcagagggagggggagtgaggggaccccgtgtggtggaaagacatcagagcgcatgtaaggattctgattggcctttttgttcagacgaagattggaactacaaatgtccatccgggtgtagaatgaagggactgatagacgaggtgaaccaggacttcacgaacagaattaacaaacttaagaactcgctctttgaataccagaagaacaacaaagattcccattcgctcacgaccaatatcatggaaatcctgcgtggtgacttttcgtccgcaaacaatagggataacacttacaaccgagtctcggaggaccttagatcccggatagaagtgctcaaaaggaaagtgattgagaaggtgcagcacattcaattgcttcaaaagaacgttcgcgcacagttggtggacatgaaaagattggaggtcgacatcgatatcaagattagatcatgtagaggatcctgttctcgggctctcgccagggaagtcgatctgaaagattacgaagatcaacagaagcagcttgagcaagtgattgcgaaggaccttctgccgtcacgggatcgccagcacctgccgctgattaagatgaagccagtgcctgatctggtcccgggtaatttcaagtcccaattgcaaaaggtcccccctgagtggaaggcacttaccgatatgcctcagatgcggatggagctggaacgtcctggggggaacgaaatcaccagaggcggttcgaccagctacgggactggatcggagacggagagcccaagaaaccctagctcggcaggttcttggaattccggcagctcaggacccggatctaccggaaatagaaacccaggctcctccggaactggtggcacggcaacctggaaacctggttcaagcgggcccggctcaactgggtcgtggaactccggatcatcagggactggtagcaccggaaaccaaaatccaggatctcctaggcctgggtcaacgggtacctggaaccccggttcatccgaaagaggttcggccggccattggacgtccgagtcatcggtgtccggttcgactggtcaatggcactccgagtcaggatcctttcgccctgattcgcctggtagtggtaatgcgcggcctaataaccctgattggggtacctttgaagaagtgagcgggaatgttagccctggtaccagaagagaataccatactgaaaagctggtgacctcgaagggagataaggagctgagaaccgggaaagaaaaggtgacctcgggatcgaccacgacgactcgaaggtcctgtagcaagactgtgactaagactgttattggtccagatggtcataaagaagtgacgaaggaagtggtgacttccgaggacggttcggactgtccagaagccatggacctgggcaccctttccggaattggaactcttgatggttttagacatcggcaccctgacgaagcagcgtttttcgatactgcgtccaccggtaagacgtttcctggcttcttttctccaatgctcggagaatttgtgtccgagactgaatctaggggatccgagtccggcatattcactaacaccaaagaatcaagctcacatcatccagggattgccgaatttccatcccgcggtaagtcatcatcatactccaagcaatttacgtcctcaaccagctacaacaggggggactcaacgtttgaatctaagtcgtacaagatggcagatgaggctgggtcagaagctgaccacgaaggcactcattcaactaagagaggccatgcaaagtcacgaccggtgagagactgtgacgatgttctgcaaactcacccttccggaacccaatccggtatcttcaacattaaactgcctggatcgtcaaagatattctcggtgtactgcgatcaggaaacctcgctgggcggatggctgctgatccagcaaaggatggacggaagcctcaactttaaccgcacctggcaagattacaagcgtggatttggctcactcaacgatgaaggtgagggtgagttctggctgggcaatgattacctgcacctgcttactcaacggggatcggtccttcgggtcgaactggaggattgggcaggaaatgaagcatacgcggagtaccatttcagagtgggaagcgaagcagaaggatacgccctgcaagtctcgtcctacgagggaactgcgggggacgcactcattgaaggatcagtcgaagaaggggcagagtatacctcccataacaacatgcaattcagcacttttgaccgggatgcggaccaatgggaagaaaattgtgcagaggtgtacggtggcggctggtggtacaataactgtcaggccgcaaatcttaacggtatctactatcctggaggttcctacgaccctcggaacaattctccctacgagattgagaatggcgtggtctgggtgtccttccgcggtgcagactactcgcttcgggctgtcagaatgaaaattcggcctctggtgacccag

SEQ ID NO: 11124 - DNA, 2598 bp, Artificial Sequence
  Description of Artificial Sequence: Synthetic coding sequence
atgttctccatgaggattgtctgtttggtgcttagcgtagtgggcactgcgtggaccgccgattccggtgagggcgactttttagctgaaggggggggggtgagaggccctcgagtggttgagcgacaccaaagtgcctgcaaagacagcgactggcctttctgctcagacgaagactggaattataaatgcccttcaggatgcaggatgaagggattaattgacgaagtcaatcaggacttcactaatcgtatcaacaaacttaagaattcattatttgagtatcaaaaaaataataaggactctcatagcctcacgacgaatatcatggaaatacttagaggggatttctcttctgcaaataaccgtgataatacttataatcgggtttctgaagatctccgctcacggatcgaggtcctcaagcgtaaagttattgaaaaggttcaacatatccagttattgcaaaagaatgtgcgggcccagctcgttgatatgaaacgtctagaagtggatattgatattaaaataaggagttgtaggggttcttgctcccgagccttggcccgagaggtggatttaaaagattacgaagaccaacagaagcaattagaacaagttattgctaaagatctgcttccctctagggatagacaacatctcccacttatcaaaatgaagccagtccctgatctggtgccaggaaattttaagtcccaattgcaaaaagtgccacctgaatggaaggctttaactgatatgccgcagatgcggatggagttggaacgtccagggggcaatgagataactagaggaggatcgacatcgtatggaactggcagtgagacggagtccccccgtaatccttcatcagctggctcatggaattcaggcagctctggtccaggatccaccggtaataggaacccaggatcttccggaacaggtggtaccgctacttggaaaccaggttcttccggacctggttctacaggtagttggaactccggatccagtggaacaggaagtaccggcaatcagaaccctggaagcccgcgtccaggtagcactggaacttggaacccgggttcatcagagaggggaagtgctgggcattggactagtgaatcatctgtctctggttctacgggacagtggcactcagaaagcggtagtttccgaccagatagtccgggtagcggaaacgcacgtcccaacaatccagattggggtacgttcgaggaagttagcgggaatgtgagtccaggcaccagaagagaatatcataccgagaaacttgttacaagcaagggagataaagagttgaggaccggcaaggaaaaggtcaccagcggatctacgactactactaggagatcttgttcaaagactgttacaaaaactgttatcggtccagacggacataaagaggtaacgaaggaagtagttacctctgaagatggttcagattgccctgaagctatggatttgggtactctttcaggtattggaacattggacggctttaggcatagacacccagatgaggcagctttctttgataccgcttcaaccggcaagactttccctggatttttttcacctatgctgggagaatttgtttccgagactgagtcaagaggttctgagagcggcattttcaccaatactaaagagtcttcctctcatcacccaggcattgctgagttcccttctaggggcaagtctagttcgtactctaagcaattcacatcaagcacgtcgtacaatcgaggagactccacattcgagtcaaagagttacaagatggcggatgaggccgggtccgaggccgatcatgagggaacacattccacaaagagaggtcatgcaaagtctcgtcctgttagagactgtgatgacgtgttacaaacacacccttcaggaacccaatcaggcattttcaatattaagttgccgggtagttctaagatcttttctgtttattgtgaccaagagacttctttgggggggtggctcctcattcaacagcgtatggacggctctcttaactttaatcggacttggcaggattataaaagaggatttggatcgctgaacgatgaaggagagggtgagttctggttaggtaatgattatttgcatctgttgactcagaggggcagcgttctgagggtggagcttgaagattgggcaggaaatgaggcgtatgccgagtatcatttcagggtgggaagcgaggctgaaggctacgcattgcaagtgtcgtcctacgaaggtacggctggcgatgccctcattgagggatctgttgaggaaggagcggaatacactagccacaataatatgcaattcagtacttttgacagagatgcagaccagtgggaagaaaactgtgccgaagtgtacggagggggatggtggtataacaactgtcaagctgccaacttgaacggcatatattaccctggaggttcatacgatccccgtaacaacagtccttacgagatagaaaatggtgttgtatgggtgagctttagaggcgctgattatagtttgagggctgtcaggatgaaaattagaccactcgttacccag

SEQ ID NO: 11125 - DNA, 2598 bp, Artificial Sequence
  Description of Artificial Sequence: Synthetic coding sequence
atgttcagcatgcgcattgtctgtctggtgttgtccgtggtgggaaccgcctggactgccgactcgggcgaaggagacttcctcgctgagggcggaggggtccggggaccacgtgtcgtggaaagacaccagtcggcatgcaaggactcagactggccattctgcagcgacgaagattggaactacaagtgcccatctgggtgccgcatgaagggcctcatcgacgaagtcaaccaggacttcactaatcggatcaataaactgaagaactcgctgttcgagtatcagaagaataacaaggactcgcactccctcaccactaacatcatggagatcctcaggggcgattttagctcagccaacaaccgtgataacacctacaatcgagtctccgaagatttgcgctcgcggatcgaggtgctgaagagaaaggtcatcgagaaggtccaacacatccagctcctgcaaaagaacgtgcgggctcagctggtggatatgaagaggctggaggtggacattgatatcaagatcaggtcgtgccgcgggtcgtgtagcagagctttggcgcgggaagtcgacctcaaggactacgaggaccagcagaagcagctcgagcaggtgatcgcaaaggatctcttgccctcgagagataggcagcacctgccgttgattaagatgaaaccagtcccagaccttgtaccagggaacttcaagtcacaactccagaaagtgcccccagagtggaaggcactgactgacatgccacaaatgcgcatggagcttgagcgtccaggcgggaatgagatcacccgcggcggctcgacttcctacggaaccggcagcgaaaccgagtccccgcgcaacccgtcgtcggcggggtcatggaactcgggatcatcgggtccgggatcgaccggcaaccggaacccgggctcgagtggaaccggcgggaccgccacctggaagccaggctcatcaggacctggaagcaccgggtcgtggaacagcgggtcatccgggaccggatcgactggaaaccagaatccgggatcccctagacctggatccactggaacctggaacccggggagcagcgaaagaggctctgcgggacactggacttccgaatcctcagtctcgggctcgactggacaatggcactccgagtccgggtcattcagaccagactcgccgggatccggcaacgcacggccgaataatccggactggggaactttcgaagaggtgtcgggaaacgtgagccccggcaccagacgcgagtaccacaccgagaagctggtgacctccaagggagataaggagctccgcactggaaaggagaaagtcacctcaggatccaccactaccacccggcggtcatgctcgaaaaccgtgactaagacggtgattgggccagacgggcacaaggaagtgaccaaggaggtggtgacctccgaggacggaagcgattgcccggaggctatggaccttggaactttgtccggcatcggcaccctggacggttttaggcacagacacccggacgaagcggcgtttttcgacaccgcgagcaccggtaagactttcccgggatttttcagcccgatgctcggtgaattcgtttcggaaaccgagtcgcgaggatcggagtccggaatcttcaccaacaccaaagaaagcagctcgcatcatccaggaatcgctgaattcccgtcccgcggcaagtcgtcctcctacagcaagcagtttacctcgtcgacgtcctacaacagaggtgactcaacctttgaatccaagagctacaaaatggccgacgaagctgggtcggaggcggaccatgaaggaacccactcgactaagcgcggacatgcaaagtcacgcccagtcagagattgcgacgacgtgctccagacccatcctagcggcacgcaatcgggtatcttcaatatcaaactcccgggatctagcaaaatcttttcggtttactgcgatcaagaaacctccctcggtggttggcttctgatccagcaacgtatggacggatcgctgaacttcaataggacttggcaggattacaagcgcggcttcgggagcctgaatgacgaaggagaaggagaattctggctgggcaatgactacctgcacctcttgacccagcgcggctcggtgctgcgggtggaactggaagattgggccggaaacgaagcatacgccgaataccacttcagagtcggtagcgaagccgaaggatacgctcttcaagtctcatcgtacgaaggcacggccggagatgcgctgatcgaaggctcggttgaggagggcgccgaatacacctcccacaacaatatgcaattctcaaccttcgatcgggatgccgatcagtgggaagaaaattgtgccgaagtgtatggcggagggtggtggtacaacaactgtcaagcggccaaccttaatggaatctactatccaggaggatcatacgacccgcgcaacaactccccgtacgaaatcgagaatggagtggtgtgggtgtctttccggggagcggactactcgctccgcgcagtccggatgaagattcgcccccttgttactcag

SEQ ID NO: 11126 - DNA, 2598 bp, Artificial Sequence
  Description of Artificial Sequence: Synthetic coding sequence
atgttttccatgaggatcgtgtgtctagtgctgtctgttgtaggcacagcttggacggctgatagcggagagggagatttccttgccgagggagggggagttcgggggccgcgggtagtggaacgtcaccagtcagcatgtaaagactcagactggccattttgcagtgacgaggactggaactataagtgcccatctggatgtcgaatgaaaggcctgatagatgaggtgaaccaggacttcacaaatcggatcaataaattgaagaacagcctgttcgaatatcagaaaaacaacaaagattcacacagtctgactacgaatatcatggagattctccgcggcgacttctccagcgccaataaccgggacaatacctacaacagggtctcagaggacctgaggtctcggattgaggttcttaaacgaaaggtgatcgaaaaggtgcagcatatacaattgttacaaaagaacgtgcgggcacagctcgtggacatgaaaaggctggaggtggatatcgacattaagatccggagctgtcgcggaagttgctctagggccctagcccgcgaagtggatctgaaagactacgaagatcagcagaagcagctggaacaggtgattgcaaaagacttgcttccatcccgagataggcaacacctgcccctgatcaaaatgaaacccgtgcctgacctcgtgcccggcaacttcaagagtcagctccagaaagtgccccccgagtggaaagccttaaccgacatgcctcaaatgcggatggaactcgagaggcctgggggcaatgagatcacacggggcggttcgacttcgtatggaacaggctcggaaaccgagagccctaggaaccctagctcagccgggtcttggaattccggcagcagcggcccaggatctacaggcaaccgaaaccccggctcttccggaacgggcggaactgccacatggaaaccaggaagctcagggccgggctcaaccggttcctggaacagcggctccagcggtaccggaagcactggcaaccagaatcccggcagtcccagacctgggagtaccgggacctggaatccgggatctagcgagaggggatcagcagggcattggacatccgagtcctccgtgtccgggtccaccggccaatggcattcagagtccggatcatttaggcccgatagtcccggatcaggaaacgctagacctaataaccccgactggggaaccttcgaggaagtgtctggcaacgtgagtcccgggacgagaagagagtaccataccgagaagctggttacttctaaaggggacaaggagctccggaccggtaaggaaaaggttacatctggaagcacaactaccacaagaagatcatgcagtaagactgttaccaaaactgttattggtcccgacgggcacaaagaagtcacaaaagaggtggtcacaagcgaggacggttctgactgtccagaagcgatggacctgggtacactgagcgggattggaaccctggacgggtttcgtcatcgtcatccagatgaggctgccttcttcgacactgcatccactggaaagacctttcctggcttcttttccccgatgctcggtgaattcgtctccgagaccgaaagcagagggtctgagtcggggatcttcaccaacaccaaagaaagcagctcacatcatcccggaattgccgaatttccctctagggggaaatccagtagttactctaaacagtttactagctcgaccagctacaaccgaggggacagcacgtttgaaagtaagtcttataagatggccgacgaggcgggaagcgaggcagatcacgagggcactcattcgacgaagcgtggacatgcgaaatctcggccagtccgggactgcgacgatgtgctgcagacgcaccctagtggcactcagagcgggatttttaacatcaaattgcctggctcctccaagatattttcagtatattgcgatcaggagacttccctggggggttggctgctcattcaacaaagaatggacgggtctttgaactttaatcgaacatggcaggactacaagagaggcttcggatctctcaatgacgagggagaaggcgaattctggctgggcaacgactacctgcacctcctaacacaaagaggaagcgtgctgcgagtggaactggaagactgggccggaaacgaagcatacgccgaataccacttcagggtggggtctgaagccgaagggtatgctttacaggtctctagctacgagggcaccgctggagatgcattgattgagggtagcgtggaagagggcgcagagtatacatcccacaacaacatgcagttttccacatttgatcgcgacgctgaccagtgggaggagaactgcgccgaggtctacgggggagggtggtggtacaataactgtcaggccgccaatctcaatggcatctattacccgggggggagctacgaccctagaaacaattccccttacgaaatcgagaacggagttgtatgggtgtcattcaggggggctgactatagcctccgagccgtccgtatgaagatcaggcccctcgtcacccaa

SEQ ID NO: 11127 - DNA, 2598 bp, Artificial Sequence
  Description of Artificial Sequence: Synthetic coding sequence
atgttcagcatgcgcatcgtgtgccttgtgctgtctgttgtcggaactgcatggaccgcagattcgggtgaaggtgacttcctggcggagggtggtggtgtgaggggaccaagggtggttgaacggcatcaatcggcttgtaaggattcagactggcctttctgctcggacgaggactggaactacaagtgccctagcggatgtcggatgaaggggctgatcgatgaggtgaaccaagacttcaccaaccgcattaacaaactgaagaattccctgttcgaataccagaagaacaacaaggattcacattccctgaccaccaacatcatggaaatcttgcggggcgacttctcatccgcgaacaaccgggataatacctataatcgggttagcgaggatctccgctcgcgcattgaagtcctgaagaggaaggtcatcgaaaaagtacagcatatccaactgctccagaagaatgtccgggctcaacttgtggacatgaagcgccttgaagtggacatcgacatcaagatcaggtcctgccgcggatcgtgctccagagctttggcaagagaagtggacttgaaggactacgaggaccagcagaaacagcttgaacaagtaattgccaaagatctgctgccatcccgcgaccggcagcaccttccgttgattaagatgaagccggtgccggacctcgtgcctggaaatttcaagtctcaactgcagaaagtccccccagagtggaaagcgctgaccgatatgccgcaaatgcgcatggaactggagcgtcctggaggaaacgagatcacgcgaggaggctcaacctcatacggaacgggttctgagactgagtcaccgcgcaacccgtcgtccgccggatcctggaatagcgggtcctccggacctgggtcaacggggaaccgcaatcctggctcgtcgggaaccggaggaactgcgacctggaaaccggggtcctcgggcccgggctcgaccggctcatggaattctggaagcagcggtaccggaagcaccggaaaccagaacccaggcagcccaagaccgggaagcactggaacgtggaaccctggatcgtccgaacggggctcggctggacactggacttcggagtctagcgtatcggggtcgactggacagtggcactcggaatcgggtagctttcgccccgattccccaggaagtggcaatgcacgcccgaacaatccagactggggcacgttcgaagaggtgtcagggaacgtgtcaccgggaacgcgccgagaataccacactgagaagctggtcacgagtaagggtgataaggaactgcggaccggcaaagagaaggtgacctcgggcagcactacgaccactcgaagaagctgctcaaaaactgtgaccaagactgtgatcgggcccgacgggcacaaagaggtgactaaagaggtggtcacttccgaggacggaagcgactgcccggaagcaatggacctggggaccctgtcaggcatcggaactctcgatggcttccgccatcggcacccggacgaggccgccttttttgatactgcctctactggcaagactttcccgggcttcttctcgccgatgctcggcgaattcgtttccgaaaccgaatcgagaggaagtgaatcgggcatctttaccaacaccaaggagtcatcgtcacatcacccgggaattgctgagttcccaagccggggtaagtcatccagctacagcaaacagtttacttccagcacttcgtacaataggggcgactccaccttcgaatccaagtcctacaaaatggccgacgaagccggctcggaagccgaccacgaaggtacgcatagcactaagcggggacacgcgaaatcaagaccagtgcgggactgtgatgatgtcctccagacccatccgtcgggcactcagtccggaatcttcaacattaagctgcccggttcctctaagatcttttccgtgtactgcgatcaagaaacctctctcggaggttggctgctcatacaacagagaatggacggaagcctcaactttaatcggacctggcaggattacaagcgcggcttcggatcgctgaacgacgaaggcgagggagaattttggctgggtaacgattatctgcatcttctcacccaaaggggatcggtgctcagagtcgaactggaggactgggcgggaaacgaagcctacgcagagtaccacttccgagtaggcagcgaagccgagggttacgccctccaagtgtcctcatacgaggggaccgcgggagatgccctcatcgaggggtcggttgaagaaggcgctgaatatacttcgcacaacaatatgcaattctccactttcgacagggatgcggatcagtgggaggaaaactgcgcagaggtgtacgggggaggatggtggtacaacaattgtcaggccgccaacctcaatggaatctactaccctggaggaagctacgacccacggaataactcaccctacgaaatcgagaacggagtcgtctgggtgagcttcaggggagctgactactccctgagagcagtgagaatgaagatccgcccattggtgacccag

SEQ ID NO: 11128 - DNA, 2598 bp, Artificial Sequence
  Description of Artificial Sequence: Synthetic coding sequence
atgttttcaatgcggatagtgtgcctggtcctttcagtggtgggtactgcctggaccgctgacagcggagaaggggacttcctcgctgaaggcggtggcgtacgaggcccccgtgtggttgagcggcaccagtctgcctgcaaggactctgattggccattttgttctgacgaagactggaactacaagtgcccatcaggctgtcggatgaagggcttgatcgacgaggttaaccaggacttcactaaccggataaacaagttgaaaaactcgctttttgaataccagaaaaacaacaaagatagtcactcactgacaaccaatattatggagatactgaggggagacttctcaagtgccaacaaccgcgataatacttataatcgggtgtccgaggatctgcgcagtagaattgaagtgctcaagcgaaaggtgatcgagaaagttcagcacatacagctgctgcagaagaacgttcgtgcacagctcgtggacatgaaaagactggaggttgatattgacattaagatccggtcctgccgggggtcatgtagtagagccctcgcgcgcgaggtggatctgaaggattacgaagaccagcagaaacagctcgagcaggtgatcgccaaagacttgttgccatctcgggaccgccaacatcttccgttgatcaagatgaagccagtcccagacctcgtgcctgggaacttcaaaagccagctgcaaaaggtcccccccgaatggaaagctctaacagatatgccccagatgcggatggagcttgagcggccaggtggaaatgaaatcacacggggcggtagcacatcatacgggacaggtagcgaaacggagtccccgcgtaatccttccagtgcaggctcctggaatagcggttcatcaggaccaggatcaacagggaatcgcaatcccggaagttctggaacaggcgggactgcaacctggaaacccggtagctctggacctggctcaacaggatcctggaacagcggatcttcaggcacagggtcaaccggaaatcagaaccctggcagtccaaggccggggagtacagggacatggaaccccggctcatctgagagggggtccgccggtcattggaccagtgagtcttccgtttctggcagcacaggccagtggcactccgagagcggcagctttcggccggattccccgggatctggtaacgcgcggcctaacaaccctgattggggaacattcgaggaagtgagtggcaacgtatcccccggcacacgcagggagtatcacacagagaaactagttaccagtaaaggcgataaagaattgcggaccggcaaggagaaggtgacctctgggagtactaccaccactaggagatcgtgtagcaaaactgtaactaagacggtcatcggtcccgatggccacaaagaggttacaaaagaggtggttacttcagaagatggcagtgattgtcccgaggctatggacttggggacgctgagtggcattggtacgctggacggcttccggcatcgccaccccgatgaagccgcattcttcgacacggcatccacaggcaagacgtttccaggcttcttctccccgatgctgggtgaattcgtaagcgaaactgagtcccgcggttccgagtcgggaattttcacaaacaccaaggaaagcagctctcaccaccctgggatcgccgaattcccctcccgcggcaagtcttcaagctactcaaagcagtttacctctagcacttcttataaccgtggggattcaacctttgagtcaaagagctacaaaatggctgacgaagccggctctgaggccgaccacgaaggcacccatagtaccaagcgtggtcacgccaaatccagacctgtacgcgactgtgacgatgtgctacagacacatcccagcgggactcagagcggcattttcaatatcaagctgcccggtagctcaaagatcttctcagtttattgcgaccaggaaacctcacttggagggtggctgcttatacagcagagaatggacgggtccttgaattttaaccgaacctggcaggactacaagcgcggatttggttcactcaatgatgagggggagggagaattttggttggggaatgattacctgcatctgctcacccagcgcgggagtgtcctgcgggtggagctggaagactgggctggaaacgaggcttatgcggagtaccattttcgagtgggctctgaggcggagggttacgccctgcaggtgagctcctacgaaggcaccgcaggcgacgccttgatcgagggcagcgtagaggaaggcgccgagtatacctctcacaataatatgcaattctccacttttgatagagacgccgaccagtgggaagagaactgtgcagaggtgtatgggggtggctggtggtacaacaattgtcaggccgcgaatttgaacgggatatactatccggggggctcctatgacccacggaacaactctccgtacgaaatcgagaatggtgtggtttgggtaagttttagaggcgccgattattccctaagggcagtaaggatgaagattcgccccctcgtaacccaa

SEQ ID NO: 11129 - DNA, 2598 bp, Artificial Sequence
  Description of Artificial Sequence: Synthetic coding sequence
atgttttccatgcgtatagtgtgtctggtgctcagtgttgttggcaccgcctggacagctgactcaggggagggggactttttagccgaggggggcggagtgcgaggccctagggtggttgagcggcaccagagtgcctgtaaggactctgattggcccttctgctccgatgaggattggaactacaagtgtccgagcggatgtagaatgaagggcctgatcgatgaagtcaaccaggacttcactaaccgtatcaataagctgaagaattcattgtttgagtaccaaaagaataacaaggactcacactcgctgaccacaaacatcatggaaatcctccgtggtgacttttctagtgccaacaaccgggataacacttacaatcgcgtctcagaagatctgcgcagccggattgaggtcttgaaacgtaaagtgatcgagaaagtccaacacatccaactcctgcaaaagaatgtccgcgctcagctggtagacatgaaaagactggaggtggacattgatatcaaaattagaagttgtcgagggtcctgttccagagccctcgccagagaggtcgacttgaaggactatgaggaccagcagaagcaacttgagcaggttatcgctaaggatttactcccttctagggatagacagcatctgccactgatcaagatgaaacctgtcccagatctggtgccgggcaactttaaatcacagttacagaaagtgcctcccgagtggaaggctctgaccgacatgccccagatgagaatggagcttgaacggcctgggggcaacgaaataaccaggggcgggagtacgtcctatggaacgggctctgagactgagtctccccggaacccatccagtgcgggatcttggaactccggcagttccggccccggctctacaggcaacagaaaccctggatcatcagggacgggaggcaccgccacttggaagcctggatcttctggtcctggcagcactgggtcttggaacagcgggtcttccggcactgggagtactgggaaccagaatcccggatcacccaggcccggtagtaccgggacctggaacccaggctcaagcgagcggggcagtgccgggcactggacgtccgagtcttcagtgtcaggtagcactggtcaatggcatagtgagagcggctctttcagacctgacagccccggtagcgggaatgccaggccaaataaccccgactggggcacttttgaggaagtgtccgggaatgtgtctcccgggaccaggcgtgagtaccacacagaaaagctggtgacatcgaagggggataaggaactccgaactggcaaagagaaggtgacaagcgggagcacgaccaccacacggcggtcgtgctcaaagacagttacaaagactgtaatagggccagatggtcataaagaggtaactaaggaagtagtgacttccgaagacgggtcggattgtcctgaggccatggacctggggaccctcagcggcataggaacgctggatggtttccgccatagacatccagatgaggctgcttttttcgacaccgccagcaccggtaaaacctttccaggctttttcagtccgatgctgggagagtttgtgagcgagacagaaagccgcggaagcgagtcgggtatatttacaaataccaaagagtcttcaagccaccatccagggatagccgagtttcccagccgtggaaaaagttcctcatactcaaagcagtttacttcatctacctcctacaatcggggcgacagcaccttcgaaagtaaatcttataaaatggctgacgaggcaggaagcgaggctgaccacgaaggtacccactccactaaaagggggcatgccaaatcgagaccagtaagggattgtgacgacgttctgcagacccatccctcgggcacccagagcgggatctttaacatcaagctgccgggatcatctaaaatattcagtgtgtactgcgatcaggaaacaagtttggggggatggctgttaatccaacaaagaatggacggcagcctgaattttaatcgtacctggcaagactacaagcgggggtttgggtctctcaatgatgagggagaaggtgagttttggttagggaacgactatctgcatttgcttacgcagcgggggtccgtgctccgtgtggagttggaggactgggccgggaatgaggcttacgcggaataccacttcagggtggggtccgaggcagaggggtacgctttgcaggtttctagttacgaaggaaccgcgggcgacgctctcattgagggctccgtcgaagagggtgccgaatatacctcccacaacaatatgcagttctccacattcgacagagacgccgaccagtgggaagagaattgcgcggaggtttatggcggcggttggtggtacaataactgtcaggcggcaaacctgaatggaatatattatcctggaggcagttatgaccccaggaataacagcccctatgaaatagaaaacggagtggtttgggtttcttttaggggagctgactactcactgcgcgcagtgcgtatgaaaatcaggcctctggttacacag

SEQ ID NO: 11130 - DNA, 2598 bp, Artificial Sequence
  Description of Artificial Sequence: Synthetic coding sequence
atgttctctatgaggatcgtgtgcctggtgctttctgtcgtcggaaccgcatggaccgcagactctggagagggagacttcctggctgagggagggggggtccggggtccccgggttgttgaaagacatcagtctgcttgcaaagacagcgactggcccttctgttctgacgaggattggaattacaaatgcccaagtggatgccgcatgaaggggctgattgatgaagttaaccaggacttcacgaacaggatcaataaattgaagaactccctgtttgagtatcagaaaaacaacaaagatagccacagcctgaccaccaatataatggagattctgcgaggtgacttcagctccgccaacaacagggacaatacctacaaccgcgtaagcgaggatctcaggtccaggatcgaggtgctgaagcggaaggtgatagaaaaggtgcaacatatccaactcctgcagaagaacgtccgagcgcagttggtggacatgaaacgacttgaggtagacattgacatcaaaatccgctcttgtcgcggtagctgttccagagcccttgccagggaagttgatctcaaggactacgaagaccagcagaagcaacttgaacaggtcattgccaaggacctcctgccgagtcgggacagacagcacttgcctctcatcaagatgaagccagttcccgacctcgttccaggaaactttaaatctcagctccagaaggtgcctcccgagtggaaggcgctgactgacatgccgcagatgaggatggaactggagagaccgggaggaaatgaaatcacccggggaggttcaacctcttacggcaccggctccgagaccgagtcccctagaaatccctcttcagcaggatcatggaactcagggagttctgggccaggatcaaccggcaatcggaatcccggaagcagtggcactggtgggactgccacttggaagccaggaagttcaggacccggctccactgggtcatggaactcaggatccagtggcaccggtagtactggcaatcagaacccgggaagcccaagacctggatctactgggacttggaacccaggatcaagcgagcgaggttcagccggtcattggacaagtgaatcctctgtttccggctccacaggacagtggcattctgagtccggttcattccgccccgactccccaggctccggcaacgcaagacctaacaatcctgactgggggaccttcgaggaagtatcagggaacgtgagccccggcactaggagagaataccatactgagaaactggtaacctcaaagggggacaaggagttgcgaaccggaaaggaaaaggtgacgagcggtagcactacaacgacccgaaggtcatgttcaaagactgtgaccaaaacagtcatcgggccagacggccacaaagaagtgaccaaagaggtggtgacttccgaagacggctctgactgcccagaagcgatggatttgggcacattgagcggaatcggcacactcgatgggttccgccatagacatcccgacgaagccgccttcttcgacaccgcttccaccggaaaaacttttcctggctttttctcacccatgctgggcgagttcgtgagtgagaccgaaagccggggcagcgagagcggaattttcactaacaccaaagaatcttcaagtcatcaccccgggattgctgaatttccgtctagaggaaaaagttctagttacagtaagcaatttacaagcagtacgagctataaccgaggcgattcaacattcgagtccaagtcttacaaaatggctgacgaagctgggtctgaagccgaccacgaggggacacactctacgaaaagaggtcacgccaaatcccgccccgtcagggactgtgacgacgtgctgcagacccacccctccggaactcagtccggcatttttaatatcaagctgccgggaagctctaaaatattctccgtgtactgtgatcaagagacgtcactcggtggctggctgttgattcagcagagaatggatggaagcttgaatttcaatcgcacctggcaagattacaagcgggggtttggaagtctgaatgacgaaggtgaaggagagttctggcttggcaatgattacctgcatctgctgacacaaagagggagcgtcctccgcgtcgagctggaggactgggcaggaaacgaggcctatgccgagtaccactttcgggtcggcagtgaagcggagggatacgccctccaggtcagcagttatgaaggcactgccggcgacgcactgatcgagggcagtgttgaggagggggccgagtatacaagtcacaacaacatgcagttctccactttcgaccgagatgctgaccagtgggaagagaactgcgctgaggtctacggagggggatggtggtacaacaattgtcaagctgcgaatctgaatggaatctattatcccgggggttcttatgatccccgcaacaactctccctacgagatcgaaaacggggttgtctgggtaagttttaggggtgcagactactctctgcgcgccgtgcggatgaaaataagaccccttgttacccag

SEQ ID NO: 11131 - DNA, 2598 bp, Artificial Sequence; identical to SEQ ID NO: 11082
  Description of Artificial Sequence: Synthetic coding sequence

SEQ ID NO: 11132 - DNA, 2598 bp, Artificial Sequence
  Description of Artificial Sequence: Synthetic coding sequence
atgttctctatgcggatcgtgtgtctagtgctgagcgtcgtcggtactgcgtggaccgctgacagcggagagggcgactttctcgctgagggagggggtgtccgcggccccagagtcgttgagaggcaccagtctgcttgtaaagattccgactggccattttgctcagacgaggattggaactacaaatgccctagcggctgcaggatgaaaggtcttatcgacgaggtgaaccaggatttcaccaacaggatcaacaagcttaaaaacagtctgtttgagtatcagaagaacaataaagattcccactccttgactacaaatatcatggagatccttaggggagatttctcaagtgccaacaaccgcgacaatacatataacagggtgagcgaagacctgagatcacgcattgaggtcctcaagcgtaaagttatagagaaagtgcagcatatccagctgctgcaaaaaaacgttcgggctcaactggttgacatgaagaggttggaagtggacatcgacatcaaaatacggtcctgcagaggcagctgcagccgtgctcttgcgcgcgaagtggatttaaaagattacgaagaccagcagaaacaactagagcaggtcatcgcaaaagacctgctgccgtccagggacaggcaacatcttcctctcatcaagatgaagcccgtgccagatcttgtacctgggaacttcaaaagtcagctgcaaaaagtccctcctgagtggaaagctttgacagacatgccacagatgagaatggagctcgagaggcccggtgggaacgagattacccgcggagggagcacatcctatgggaccggaagcgaaaccgaatcaccaaggaacccgagtagcgctgggtcttggaactcaggaagcagcggaccaggctctaccggcaacaggaatcctggcagcagtggcaccggaggtaccgctacttggaagcccggatcatccggaccaggcagcactggtagttggaatagcggaagcagtgggactggatcaactgggaaccagaatccagggagccctagaccaggcagcacaggaacctggaatccagggtctagcgagcgaggctcagcaggccactggaccagtgagagttccgtctctggatctaccgggcagtggcacagcgaaagcgggtcattcaggccggattccccagggtcagggaacgctaggcccaataaccctgattggggcacattcgaagaagtaagtggcaacgtgtcccccgggactcgtcgcgagtaccacaccgagaaactggtgacttctaaaggggacaaagaacttagaactggaaaggaaaaagttaccagcggaagcaccaccaccactcgcaggagctgcagcaaaacggtgaccaagactgtgatagggcccgatggtcacaaagaggtgaccaaggaggtcgtgacaagcgaggatggtagcgactgcccagaagctatggatctgggaacacttagcggaatcggcaccctggatggctttcgtcatagacatccagacgaggctgcattctttgataccgccagcacaggcaaaacctttccgggattcttttcaccaatgctgggggagtttgtgagcgagactgagagcagaggctccgaatccggtatctttactaacaccaaggagagctcatcccaccaccctggcatcgccgaattcccctctagaggaaagagttcctcctattctaaacagttcacaagtagtacctcttataaccgcggggacagcaccttcgaaagtaagagctacaagatggcggatgaggctggatccgaggctgatcacgaaggcacacatagtaccaaaagaggccacgcgaagtccaggcccgtcagagactgcgatgacgtgctccaaacacatccgagcggcacccaatccggaatctttaacatcaagttacccggcagtagcaagatctttagtgtttactgtgatcaggaaacttcgttgggcgggtggctgttgatacagcaacgcatggatggctcattgaactttaacagaacatggcaagattacaaacggggctttggcagcctgaacgacgagggggaaggtgaattttggcttggaaacgattatcttcaccttctaacacagcgtggatcagttctccgagttgaattggaggactgggcaggcaacgaggcttacgccgagtatcactttcgtgttggctccgaagccgagggttacgctttgcaagtgtccagctacgagggaaccgctggcgatgcgttgatcgagggaagcgtcgaggaaggagctgagtacaccagtcataacaacatgcagttttccaccttcgatagagacgcagatcaatgggaggagaactgcgccgaggtatacggcggaggctggtggtacaataactgccaggcagcgaacctaaatggaatctactacccaggtggcagctacgaccccagaaacaacagcccctatgaaatcgaaaacggcgttgtgtgggtctctttcaggggagctgactattcattgagggccgtgcgtatgaaaattcgcccgcttgttacacag

SEQ ID NO: 11133 - DNA, 2598 bp, Artificial Sequence
  Description of Artificial Sequence: Synthetic coding sequence
atgttcagcatgagaattgtctgtttggtgctgtcagtcgtggggacggcgtggaccgcggattccggtgaaggcgactttcttgcagagggaggaggagtcagagggcctcgggtggtggaaagacaccagtccgcatgcaaagatagcgattggcccttctgctcggatgaagattggaactacaaatgcccttctgggtgtcgtatgaaaggtctgattgacgaagttaaccaagactttaccaaccgcataaacaagctcaagaactcacttttcgaatatcaaaagaacaacaaagactcacactcactcaccacgaacattatggagattttgcggggagacttcagctccgctaacaatcgcgacaacacttacaatcgtgtgtcagaagatctgcgctcccggatcgaggtgctgaagcgcaaggtgattgaaaaagtccaacatatccagcttcttcagaagaatgtgcgggcccaactggtcgatatgaaacgccttgaagtcgatattgatatcaagatacgtagctgtagaggaagttgcagcagggccctggcgcgtgaggtcgatcttaaggattacgaggatcagcagaagcaacttgagcaagtgatcgcaaaagatctcctgccttctagggacagacagcatcttccacttatcaaaatgaagccggtgcccgatctcgtgcccggcaactttaagtcgcaactgcagaaggttccaccggagtggaaagcacttaccgatatgccacaaatgcggatggaacttgagaggccaggagggaacgaaatcacgaggggcggatcgacgtcatacggcaccgggtcagaaactgagtcgccccggaatccatcttcggcaggaagttggaattccggttcgagcggtcccggaagcactgggaaccgtaacccaggaagttcggggactggcggaactgcaacttggaagcctggcagttcgggccctggttccaccgggagctggaattccggatcttccggtacgggttccactggcaaccagaacccggggtcgccacgccctggatccacgggtacctggaatcctggtagcagcgaacgcggatcggcagggcattggacttcggaatcctccgtgtcagggtctaccgggcagtggcattccgaatccggatcctttagacctgattctcccggctccggcaacgcacgacccaataaccctgattgggggactttcgaggaagtgtcaggcaatgtttcccccggcactagacgggagtaccacaccgagaaactggtgacctccaagggtgacaaggagttgcggactggtaaggaaaaggtgacctcaggcagcaccactaccaccagacgatcgtgtagcaagactgtcactaagacggtgataggaccggatggacacaaggaggtcacgaaggaagtggtaacttcggaagatgggtcggattgtccagaagcgatggatctgggtacgctcagcggaattggaacccttgatgggtttcggcatagacaccctgatgaggctgccttttttgatactgcctctactggaaagacttttcctggatttttctcacccatgctcggagaatttgtgagcgaaaccgaatcccgcggatcggaatcgggtattttcactaatactaaggaaagctcatcccaccatcccgggattgcagaatttccgtcaaggggtaagagcagttcctactcgaaacaatttacctcttcgacctcttacaacagaggggactcgaccttcgagtcaaagtcatataagatggcagacgaggcaggcagcgaagcagatcatgaaggtacccatagcaccaagagagggcatgcgaagagcagaccagtgagggattgtgatgacgtgttgcagacccatccgtcggggacccagtcaggcattttcaatatcaaacttccaggatcgtccaagatcttttccgtctactgtgaccaagaaacctcattggggggttggttgctgattcagcaacgtatggatggatccctgaatttcaacaggacttggcaagactacaagcgcggctttggatcacttaacgacgaaggtgagggtgagttttggctggggaatgactaccttcatctgctgacgcagagaggttccgtcctgagggtggaactggaggactgggcaggtaacgaggcatacgcggagtatcatttccgtgtcggtagcgaggctgaggggtacgcacttcaagtgtcgtcgtacgaaggcactgctggagacgccctcatagaaggctccgtcgaggaaggtgccgaatacacctcccacaacaatatgcagttctcgacctttgacagagacgcagaccaatgggaagaaaactgtgccgaagtctacggcggtggttggtggtacaacaattgccaagccgcaaaccttaatggaatttactatccaggaggtagttacgacccaaggaacaactccccttacgagatcgaaaatggtgtggtgtgggtgtcctttcgcggagccgattactcgcttcgagcagtgcggatgaaaatcagaccacttgtgacccaa

SEQ ID NO: 11134 - DNA, 2598 bp, Artificial Sequence
  Description of Artificial Sequence: Synthetic coding sequence
atgttttcaatgagaatcgtgtgcctcgtgctgtcagtggtgggaaccgcctggactgctgattcaggagagggagatttcctggcagaaggaggtggagtgcggggaccacgggtcgtggagaggcaccagtcagcctgcaaggactccgattggccgttttgctcggacgaggactggaactacaagtgtcctagcggatgccgcatgaagggtctgatcgacgaggtcaaccaggacttcacgaatagaattaacaagctgaaaaactctctcttcgaataccaaaagaataacaaggactcgcattcactgactactaacatcatggaaatcctcaggggagatttctccagcgccaataacagagacaacacttacaatagagtttcagaagatctccgctcccgcattgaagttctgaagcggaaggtcatcgagaaggtgcagcacatccagctgctgcagaagaacgttcgggcacaactggtggacatgaagcggctggaagtggacattgatatcaagattagatcctgccggggctcctgctcaagggctctggcccgggaagtggacttgaaggattacgaggatcagcaaaagcaactggagcaagtgattgccaaggacctcttgccaagccgggatcgccagcacctgccgctcatcaaaatgaaaccggtgccggacctggtgcctgggaacttcaagtcgcaactgcagaaggtgcccccagaatggaaggccctgaccgacatgccgcagatgcggatggaactggaacgccccggtggaaacgagatcactagagggggttcgacttcctacgggaccggatccgaaactgagagcccgcgcaacccctcaagcgctggaagctggaactccggatcctccggacctggatcgaccggaaacaggaaccctggatcttccggcaccgggggaaccgccacttggaagccgggtagctcaggcccgggaagcactggctcctggaacagcgggtccagcggtaccggatcgactggaaaccagaacccagggtcgccgcgcccggggagcactggaacctggaacccaggctcctcagagagggggtccgctggacattggacgtcagaaagctctgtctccgggtcgactgggcagtggcattcggaaagcggatctttccgcccggatagcccgggatcgggaaacgctcgccccaataatcccgattggggaacctttgaagaagtgtccgggaatgtcagcccaggaacgcgcagggaataccacacggaaaagttggtgaccagtaagggagacaaggaactccgcactgggaaggaaaaggtgaccagcggatccaccactactactcgccgctcatgttcaaagaccgtgacgaaaacggtgattggcccggacggacacaaggaggttaccaaggaagtcgtcacgtcagaggatgggtccgattgtccggaagctatggacctcggaaccctgagcgggatcggcactctggatggattccgccaccggcatcctgatgaagcagcgtttttcgacactgcttcgactggaaaaacctttccgggcttcttctcgccaatgctcggagaattcgtgtcagaaactgagtcgaggggatcggaatcgggaatctttacgaacacgaaggaatcatcctcgcaccacccgggaattgcagagtttccatcccggggtaaatcaagctcctactcgaaacagttcacttcgtctacgagctacaataggggagactccaccttcgagtccaaatcctacaagatggcagacgaggcgggatcggaggccgaccacgaaggaacccactcaacgaaaagagggcacgccaagagcagaccagtgcgagactgcgatgacgtcctccaaactcacccttccggcacccaatcagggatcttcaatatcaagctgccaggttcctcgaagattttctcggtgtactgcgaccaagaaaccagcctcggaggatggttgctgatccagcaacggatggatggctctctgaactttaatcggacttggcaggactacaaaagaggattcggctccctgaatgacgaaggcgagggcgaattttggctcggcaatgactacctccatttgctcacgcaacggggctcagtgttgagagtggaacttgaggactgggctggtaacgaagcatacgccgagtaccattttcgcgtgggaagcgaggccgagggatatgcactgcaagtgtcgtcgtacgaaggcactgcaggcgacgccctgatcgaaggatcagtcgaagagggagccgagtacaccagccacaacaacatgcagttcagcaccttcgacagggatgccgaccaatgggaagaaaattgcgcggaggtttacggcggcggatggtggtacaataactgccaggcagcgaatctcaacgggatctactaccctggcggtagctacgaccctcgcaacaactcgccctacgaaatcgaaaatggagtggtctgggtttcatttaggggagccgattactctttgcgcgccgtgcgcatgaagatcagacccctggtgacccag

SEQ ID NO: 11135 - DNA, 2598 bp, Artificial Sequence
  Description of Artificial Sequence: Synthetic coding sequence
atgttctccatgcgaatagtatgtcttgttttgagcgtggttggcactgcatggaccgcggatagcggagaaggagatttcctggcagaagggggaggggtccgtggtcccagagtggtagaacgtcatcagagtgcgtgtaaagacagcgattggcccttttgttcggatgaagactggaattacaagtgcccatctggctgcaggatgaagggcctcatcgacgaggtcaatcaagacttcaccaaccgcataaacaagttgaaaaattccctgttcgaataccagaagaacaacaaggattcgcactccctgacaacgaacataatggagatactgagaggagacttctcttctgcaaacaaccgcgataacacatataaccgggtgagtgaagacctaaggagtaggatcgaagtcttgaagcggaaagtcatcgagaaggttcagcacatccagctactacagaagaatgtccgcgcccaactggtggatatgaaaaggctcgaggtggacatcgacatcaaaatccggtcgtgcaggggaagctgctcacgcgccttggccagggaggttgacctcaaagattatgaggaccaacaaaaacagttggaacaggtcatcgctaaggaccttctcccttcccgagacagacagcacctcccactaataaaaatgaagcccgtcccagacttggtgccaggcaactttaagtctcagttgcagaaggtgccacccgagtggaaggctttgacagatatgccgcagatgaggatggagttagaaagacccggtgggaacgagatcacaaggggggggagcacttcttatggaaccgggtccgagacagagtcgcctcgaaacccatcatctgccggatcttggaatagcgggagtagcggccctgggtccactggcaataggaatccagggtcttcaggcaccggaggaactgccacctggaagcccggcagcagtggtcccggatcaaccgggtcatggaactccggcagtagcggcacgggttctacaggtaaccagaatccagggagcccacgacccggttccactggcacatggaacccgggatcaagcgagagggggagcgccggccattggaccagtgagagcagcgtgtctgggtctactggccagtggcacagcgagtccggatcattcagaccagatagccccggttccggaaatgcacgacccaacaaccctgattgggggactttcgaggaagtgtccgggaacgtgtctcctgggacccggcgggaatatcacaccgagaagctcgtgacaagcaaaggagacaaggagttacgaaccggcaaagagaaggtgacatcgggatccacgactacaactcgtagaagttgctccaaaactgtgaccaaaaccgtcattggtcctgacggacacaaggaggtgacaaaagaggtggtcacttccgaggacgggtcagactgccccgaggcaatggatttaggaaccctgtcaggcatcgggactctggacggctttcgtcatagacatccagatgaggcagcgtttttcgacactgccagcacaggcaagaccttccccggttttttctcacctatgttgggggagtttgtcagtgaaaccgagagcaggggaagcgaatctggaattttcaccaatactaaggaatcctctagccatcaccctgggattgcggaatttccctctcgggggaagagttcctcttactcaaagcagttcacgtcgtcaacctcttacaaccgcggagattcgacgtttgaaagtaagtcatacaagatggctgacgaggccggtagtgaggctgatcacgaggggactcactcgaccaaacgggggcatgccaaaagtcggcccgtgcgggattgcgacgacgtgttacagactcatccatctgggacccaatccgggatcttcaatatcaaacttcctggatcttctaaaattttttctgtttactgtgaccaggagacaagcctgggggggtggctcctcatccagcagcggatggacggtagcttgaacttcaatcgcacatggcaggattacaagcggggctttggatccctgaatgatgaaggcgagggtgaattttggctgggcaacgattatctgcatctgctgacgcagagaggtagtgtgttacgggtggagctcgaggattgggcagggaacgaagcatacgctgagtaccactttcgggtaggcagcgaggccgaaggctatgccctgcaagtgagctcgtatgaagggactgctggggatgctcttatcgaaggaagcgtggaggaaggagctgagtatacttcccataacaatatgcagttttcaaccttcgacagagatgcagaccaatgggaggagaactgtgccgaagtgtacggcggaggttggtggtacaacaactgtcaggctgccaacctgaacgggatttactacccaggaggaagctatgacccaaggaacaattccccgtacgaaatcgaaaacggtgtagtttgggtaagcttcagaggcgctgactattcacttcgagcagtcaggatgaagattcgccctttggtcactcag

SEQ ID NO: 11136 - DNA, 2598 bp, Artificial Sequence
  Description of Artificial Sequence: Synthetic coding sequence
atgtttagcatgcgcattgtttgtttggtgctgtctgtggttggtaccgcttggactgccgatagcggggagggtgattttcttgctgaaggtggtggggttcgaggaccgcgggtggttgagcgccatcaatcagcctgtaaggacagcgactggccattctgttccgacgaggattggaactataagtgcccgtctgggtgtcgtatgaaagggctgatcgacgaggttaatcaggattttaccaatcggattaataagctcaaaaatagcctgttcgagtatcagaaaaacaacaaggactcgcacagcctgaccactaatattatggaaatcctgcgcggggatttcagcagcgccaacaatcgggataatacttacaatcgggttagcgaagaccttagatcacgtatcgaagttttgaaacgcaaagtaatcgaaaaggtacaacacatacagttgctgcaaaaaaatgtccgcgcccaattggtcgatatgaaacgccttgaggtggatatcgatatcaaaatacgcagttgcagaggtagttgctcccgcgcactggcccgcgaagtggacctgaaagactatgaggatcagcaaaagcaactggagcaggtgattgccaaagatctgctgccgtcacgcgaccgccaacatctgccgctaatcaagatgaagccggttcctgatctggtaccgggtaatttcaagtctcagctgcagaaagtgcctccagagtggaaggcactgacggatatgccccagatgcgcatggagctggaaaggcctggaggtaatgagatcactcgcggcggctcgaccagctacggtacaggatccgaaaccgagtcccctcgcaatccaagttctgcggggtcctggaatagcggctcctctggtcctggttctaccggaaacagaaatcctggtagcagcggcacgggcgggaccgcgacctggaaacctggctcatctggtccgggatccacaggcagctggaactccggatctagcggcaccgggagcaccggtaaccagaaccccggcagccctcgccccggtagcaccggtacttggaacccgggcagctctgaacgaggcagcgcgggccattggacctccgagagttcagttagcggtagcactggtcagtggcacagcgagtccggctcctttcgtccagattctccgggctcaggtaacgcccgccctaataatccagattggggcaccttcgaggaggtgtcgggtaacgtttctccgggaactcgccgagaataccacacagagaaactggttactagcaagggtgacaaggagctgcgcaccggaaaggaaaaagtcaccagtggtagcaccacaacaactcgccgcagctgtagtaagacggtcaccaagacggtcatcggtccggacggccataaggaggtaaccaaggaggttgttaccagcgaagacggcagcgattgtccagaagcaatggacctgggcactttgtccggcataggcaccttggatggtttcagacatcgccacccggacgaagccgcgttctttgacaccgcaagtaccggtaaaacgttcccaggcttcttttctccaatgctgggtgagtttgtgtccgagacagagtcccgaggatccgaatcgggtatctttacgaacactaaggagagttcatctcatcaccctggcattgcagagttcccaagccgcggtaagtcctctagctattccaagcagttcacgagcagtacatcttacaacaggggtgactctacgttcgagtctaagtcctacaaaatggcggacgaggctggtagcgaggccgaccatgagggaacccactcaacgaagagaggtcatgccaaaagccgtccagtccgcgactgcgatgacgttctgcagactcatccatcaggaactcagagcgggatattcaatatcaaacttcctggcagcagcaagattttttcggtctattgtgatcaggagacgtcactgggtggttggcttcttatccagcagcgtatggatggctctctgaacttcaaccggacctggcaagattataagcgcggcttcggcagcctgaacgacgagggggagggtgagttctggctcggcaacgactacttgcatctgctcactcaaaggggctccgttctgcgtgtggaactggaggattgggcaggtaatgaagcctatgcggaataccactttcgtgtcggtagcgaggccgagggctatgcgctgcaggtctcgagctacgagggtactgcaggcgatgcactgatcgagggttctgtagaagagggggcagagtataccagccacaataatatgcagttttctaccttcgaccgagatgccgaccaatgggaggaaaattgcgcggaagtgtacggtggaggctggtggtacaataactgtcaagctgcaaatctgaatggtatctattatccaggaggctcatatgatccacgcaacaactctccgtacgagatcgagaacggtgtggtgtgggtctccttccgcggcgccgattattctctgcgcgcggtgcgcatgaagattcgaccactggttacgcag

SEQ ID NO: 11137 - DNA, 2598 bp, Artificial Sequence
  Description of Artificial Sequence: Synthetic coding sequence
atgtttagcatgcgaattgtctgcctcgtgctctcggtggtgggcactgcctggactgctgattcgggtgaaggagatttcctggccgaaggcggcggcgtgcgcggtccgcgcgtggtggaacgccaccagtcggcctgcaaagacagcgactggccgttttgctccgacgaagattggaattacaagtgcccatccggatgcagaatgaagggcctgatcgatgaggtcaaccaggacttcacgaatcgcatcaacaaactcaaaaactcacttttcgaataccaaaagaataacaaagacagccattcgctgaccaccaacatcatggaaatcctgcgcggcgacttctcctccgcaaacaatcgggataatacttacaaccgggtgtcggaagatctgcggtcccggatcgaggtcctcaagcgcaaggtcattgaaaaggtgcagcacatccagctcctccagaagaatgttcgcgcgcagctggtggatatgaagagactggaggtggatattgatatcaagattagatcctgccgcgggagctgctcccgcgcgctggcacgagaagtggatctgaaggactacgaagatcagcagaagcaactcgagcaggtcatcgctaaggacctgctgccgtcccgcgatcggcagcacctcccactgatcaagatgaagcccgtgccggatctggtgccgggaaatttcaagtcccaactccagaaggttcctcctgagtggaaggccctcaccgatatgccgcagatgcggatggagctggaacgcccgggaggaaatgaaatcacgcgcggaggctcaaccagctacggaactggaagcgagacggagtcgccgcgaaatccctcctcggcagggtcgtggaactcgggaagctcaggacctggaagtaccgggaacaggaatccgggctcctccggaactggcgggaccgcgacttggaagcctggatcgtcggggccaggttcaaccggttcatggaactcaggttcgtcgggcactggcagcactggtaaccaaaatccaggatcgcccagacctggatcgactggaacctggaatccggggagctcggaaaggggatccgccggtcattggacttcggagtcgtccgtgtcgggcagcaccggacagtggcattccgaatcgggatcgttcagaccggattcacccggatctggcaacgcgcggcccaacaacccggactggggcacttttgaagaggtgtcggggaacgtgtcgccgggtaccaggagagagtaccacaccgaaaagctggtgacctcaaagggagacaaagaactgcgcaccggaaaggagaaggtgacctccggttcgactactaccacccgcagaagctgctcaaagacggttactaagactgtgataggtccggacggacacaaggaagtcactaaagaggtcgtgacgagcgaggacgggtcggactgcccggaagcgatggacctcggcaccctctcgggaattggcactcttgacgggttcaggcatcgccacccagacgaagcggcctttttcgatactgcatcgactggcaagactttcccgggattcttttccccaatgctcggagaatttgtgtcggaaactgaatctcgcgggtcggaatcgggaatcttcacgaatactaaggagagctcatctcaccaccctgggatcgctgagttcccatccaggggaaaatcctcgtcttactccaagcaattcacttcatctacctcctacaacagaggcgactccaccttcgaatcgaagagctacaagatggccgacgaagccggttcagaagccgatcatgaaggcacccacagcaccaaaagagggcatgcaaaatcccggccagtgcgggattgcgacgatgtgctccagactcacccatcagggacccagtcgggtatctttaacatcaagctgcctggaagctcaaagatcttctccgtgtactgtgaccaggaaacctcactgggaggttggctgctcatccagcaaagaatggacggatcactgaatttcaaccggacctggcaggactacaagcgcggattcggtagcttgaatgacgagggcgaaggggagttctggctgggcaatgattacctgcacctccttacgcagaggggttccgtgctgcgcgtggaactcgaagattgggcaggaaacgaggcttacgccgagtaccacttccgggtgggatcggaagctgagggatacgcgctccaggtgagcagctacgaaggaacggcgggggatgcactcatcgaggggtcagtcgaggagggagccgaatatacctcacacaacaatatgcaattctcaaccttcgaccgcgatgccgaccagtgggaggaaaactgtgcagaagtgtacgggggaggctggtggtacaataactgccaagcggccaatctcaatggaatctactacccaggcggatcctacgatccgaggaataactcaccctatgaaatcgaaaacggcgtggtgtgggtcagcttccgcggagcagactactcgctccgcgcggtgcgcatgaagatccggccgctggtgacccag

SEQ ID NO: 11138 - DNA, 2598 bp, Artificial Sequence
  Description of Artificial Sequence: Synthetic coding sequence
atgttctcaatgagaatagtttgtcttgttcttagtgttgtcggaaccgcatggacagcagattctggagaaggagattttttagctgaaggtggaggagttagaggtccaagagttgttgaacgtcatcaatctgcttgtaaggatagtgattggccattttgttctgatgaagattggaattataaatgtccatctggttgtagaatgaaaggtttaattgatgaagttaatcaagatttcactaatagaataaataaattaaaaaattcattgttcgaatatcaaaagaataataaagattcccattccttaacgactaatataatggaaattttaagaggagatttttcatcagctaataatagagacaatacttataatcgagtttcagaagatttaagatctaggattgaagttcttaagagaaaagttattgaaaaagttcaacatattcaattattacaaaaaaacgttagagcacaacttgttgatatgaaaagacttgaagtagatattgacattaaaattaggtcatgtcgaggttcttgtagtagagcattagcaagagaagttgatttaaaagattatgaagatcaacaaaaacaacttgaacaagttatcgccaaagatttattaccatcaagagatagacaacatttaccattaataaagatgaaaccagtacctgatttagtaccaggaaattttaagagtcaactacaaaaagtacctccagaatggaaagcattaactgatatgccacaaatgagaatggaacttgaaagaccaggaggaaatgaaattacaagagggggatcaacttcatatggaacaggatctgaaacagaatcaccaagaaatccatcatcagcaggaagttggaactcaggaagtagtggtccaggaagtactggaaatagaaacccaggaagttcaggtactggtggaactgctacctggaaaccaggttcttcaggaccaggatctacaggttcttggaatagtggaagttcaggaacaggttctactgggaatcagaatccaggttcaccaagacctggaagtacaggaacatggaatccaggatcttcagaaaggggatcagctggacattggacaagtgaatctagtgtatctggttctacaggtcaatggcatagtgaatctggtagttttcgtcctgattcaccaggatcaggaaatgctagacctaataatccagattggggaacatttgaagaagttagtggtaatgttagtccaggaacaagaagggaatatcatacagaaaaacttgtaacttcaaagggagacaaagaacttcgaacaggaaaagaaaaagtaaccagtggatctacaactacaacaagaagaagttgttcaaaaacggtaactaaaacagttattggtccagatggacataaggaagttacaaaagaagttgttacttcagaagatggatctgattgtccagaagctatggatttaggtacactaagtggaattggtacattagatggatttagacatagacatccagatgaagcagcatttttcgatacagccagtactggtaagacttttccaggttttttttcgccaatgttaggagaatttgtttcagaaacagaaagtagaggatcagaatcaggaattttcactaatactaaggaatcttcatcccatcacccaggaattgccgaatttccatcaagagggaaatcatcttcatattcaaagcaatttactagttcaacttcatataataggggggattcaacatttgaatcaaagtcatataagatggcagatgaagcaggttctgaagctgatcatgaaggaacacattctactaaaagaggacatgcaaagtcaagaccagttagagattgtgatgatgttttacaaacacatccatctggaactcaatctggtattttcaatattaaacttcctggttcaagtaaaatattttcagtatattgcgatcaagaaacttctttaggaggttggcttttgattcaacagcgaatggatggttcacttaattttaatagaacttggcaagattataaaagaggttttggatcattaaatgacgaaggagaaggtgaattctggcttggaaatgattatttacatcttcttacacaacgaggatctgtgcttagagtagaattagaggattgggctgggaatgaagcatatgcagaatatcatttcagagtaggatctgaagctgaaggatatgctttacaagtaagttcttatgaaggaaccgctggagatgcattaatagaagggagtgttgaagaaggagctgaatatacatctcataacaatatgcaattttctacttttgatagagatgcagatcagtgggaagaaaattgtgctgaagtatatggaggtggatggtggtataataattgccaagcagctaatttaaatggaatttattatcctggtggaagttatgatccacgtaataattcaccttatgaaattgaaaacggtgttgtttgggtttcttttcgaggtgctgattattcattaagagctgtacgtatgaagattagacctctagttacacaa

SEQ ID NO: 11139 - DNA, 2598 bp, Artificial Sequence
  Description of Artificial Sequence: Synthetic coding sequence
atgttctccatgaggatcgtgtgcttggtgttgagcgtcgtaggcaccgcctggaccgctgacagcggtgagggcgatttcctggctgaaggtggtggtgtgaggggtcccagggtggtggaaagacatcagagcgcttgcaaagattccgactggcctttttgttctgatgaggattggaattacaaatgccccagtggctgcagaatgaagggactgatcgacgaggtcaaccaggattttactaacagaatcaataaactgaagaactcactcttcgagtatcagaagaataataaggactctcactccttgaccactaacatcatggagattctccgcggtgatttctcctcagcaaataatcgtgacaacacatataatcgtgtttcagaggacctccgttctaggatcgaagtgctcaaacgcaaggtcatcgagaaggtgcaacacattcagttgctgcagaagaacgtgcgtgcacaattggtggacatgaagaggttggaagtcgatattgacattaagatacgtagttgccgcggttcatgctctcgtgcactcgctcgtgaggtcgacctcaaggattatgaggatcaacagaaacaactcgagcaggtgatcgctaaagaccttctccctagcagggaccgccagcacttgccactgataaagatgaagccagtgcctgatctggtacctggtaattttaaatctcaactgcagaaagtgccccctgagtggaaggccttgactgacatgccacaaatgaggatggaactcgagcgccctggcggcaatgagatcactaggggtggaagtacttcctacggtacaggatctgagaccgagtctcccaggaacccttcaagtgctggatcatggaattccggctccagcggcccaggcagtactggaaatagaaacccaggctccagtggcactggcggcaccgccacttggaagcccggttcttctggtcccggttcaaccggctcctggaactcaggaagttctggtaccggttccacaggaaatcagaaccctggctccccacgtccaggatcaaccggaacttggaaccccggttctagcgagcgcggttctgcaggtcactggacttccgagagcagtgtgagcggatccacaggtcaatggcactcagagagcggttctttccgccctgatagccctggtagtggaaacgcccgtccaaataaccccgactggggcacattcgaggaggtcagcggaaacgtctcccctggaactaggcgtgagtaccatacagaaaaactggtgacatctaagggtgacaaggagttgaggacaggtaaggagaaggttacttccggttctaccactacaaccagaaggtcttgttctaagacagtgactaaaaccgtgattggcccagatggacacaaggaggtcactaaggaggtagtcacatctgaggatggatcagattgtcccgaagccatggacctgggcaccctgagtggcatcggtaccctggacggatttagacaccgccatccagacgaagccgcattcttcgacactgcaagcacaggtaaaacttttcccggtttttttagcccaatgctgggagagtttgtgtctgaaaccgagagtaggggcagcgagtctggcatttttacaaacactaaagaaagttcctcccaccacccaggaatcgctgagtttccatcaagaggcaagagttcttcatattcaaagcagttcacatcctctacaagttacaataggggtgacagcacatttgaatcaaagtcttataaaatggctgatgaagctggtagtgaagctgaccacgaaggaacacacagcaccaagcgtggacatgccaagtctagacctgtcagagattgtgacgacgttcttcaaacccatccctccggaacccagagcggaatctttaatatcaagctgccaggaagctccaaaatattctctgtgtattgcgatcaagagacttctttgggcggatggctcctgattcagcagcgtatggacggaagtctcaatttcaacagaacctggcaagattataaaaggggatttggcagccttaacgacgagggcgagggcgagttctggcttggtaatgattatctgcatctgctcactcagcgcggcagcgttctcagagtggagttggaagattgggctggtaacgaggcttacgccgaatatcatttccgtgtgggctctgaggctgaaggctacgcattgcaagtcagttcttacgagggcaccgccggtgacgccctgatcgaaggttccgtagaggagggtgctgagtatacaagccacaataatatgcagtttagcacttttgaccgcgacgctgatcaatgggaagaaaactgcgctgaggtgtacggaggtggctggtggtataacaactgccaggctgccaatctgaacggtatctactatcctggtggctcttacgaccccaggaataacagcccctatgaaattgaaaatggcgtggtgtgggtcagctttaggggagcagactacagtctgagggccgtcagaatgaaaattcgcccactggtgactcag

SEQ ID NO: 11140 - DNA, 2598 bp, Artificial Sequence
  Description of Artificial Sequence: Synthetic coding sequence
atgtttagtatgcgcatcgtgtgcctagtgttgtcagtcgtgggcaccgcctggacagctgactctggtgagggcgactttctggctgagggcgggggtgtgcgtgggccgcgggtggtggaacgtcatcaaagtgcctgtaaggacagcgattggccattctgctcagacgaggactggaactacaagtgtccaagcggatgccgcatgaagggactgatcgacgaagttaatcaggactttactaaccgtattaacaaacttaagaattctctgttcgaatatcagaagaataacaaggactcacattccctgaccacaaacatcatggagatccttcgaggtgacttcagctccgccaataaccgagacaacacctacaatagggtgtccgaagacctccgatctagaatcgaggtgctcaagcgcaaggtgatcgagaaagtacaacatatccagctcttgcagaagaatgtgagggcccagttagtagatatgaaaagattggaggtagatattgacatcaagatacgatcttgccggggatcttgtagtagggcgctggcccgtgaggtggatttgaaagattatgaagatcagcagaaacaactagaacaggtcattgccaaagatttattgccatcgagagataggcagcacctgcccctcataaagatgaagcccgtgcccgacctcgtaccaggcaatttcaaatcccagctacaaaaggtgcctcccgaatggaaggcgctcacagacatgccacagatgcgcatggagctggagcgtcccggaggaaacgaaatcacccgaggagggtcaacatcttacggtactggctcagaaaccgaaagtcccagaaatccgagctctgccggtagctggaactcaggctcctcagggcctggttctacaggtaacaggaatcctgggtcgagcggcactggggggaccgccacctggaaacccgggtcttctggcccaggaagtacaggttcatggaacagtggatcgtctgggacagggagcaccggcaatcagaatccggggagtcccagacctggaagcacagggacatggaacccaggctcatctgagaggggaagtgccgggcactggacatccgaatcctctgtctcagggagcactggccagtggcattcagagtctggctcttttcgccccgattcccctgggtccggtaatgctcgacctaacaatccggactgggggacgttcgaagaggtttctggaaatgtgagccccggcactaggcgcgaatatcatactgagaagctcgtgacgagcaagggggacaaagagcttcggacagggaaagagaaagtcacgtcaggcagcactacaacgactaggcgatcgtgttctaagactgtcacaaagactgttatcgggcctgatggacataaagaggtcacaaaggaggtggtgacatccgaggacggctcggattgtcccgaagccatggatttgggcacactgtcagggatagggaccctggacggatttagacataggcatccagacgaggcggcctttttcgatactgcctcaactggcaaaacgtttccgggcttcttctctcccatgctgggagaattcgtttccgagactgaaagcagaggtagtgagtcaggtattttcaccaatactaaagaatcttcctctcaccatccggggattgctgagtttccatcccgcgggaagtccagctcctacagcaagcagttcacatctagtacgtcgtacaaccgaggcgatagtacctttgagagtaagagttataagatggcggacgaagcagggagcgaagccgaccacgaaggtactcactcaaccaaaagagggcatgcaaagtcccggccagtgagagactgcgatgacgtgctccaaacacacccttccggaactcagtccgggatctttaacataaaactccccggatcgtctaaaattttcagcgtttattgtgatcaggagactagcctcgggggatggctcctgatacaacagagaatggacggctccctgaattttaaccggacctggcaggactacaagagaggttttggaagcctgaacgacgagggggagggtgaattttggttgggcaacgactatctacacctactcactcagcgcggcagcgtcctgcgggtcgagctcgaagactgggccggaaatgaggcctacgcagagtaccactttcgcgttggttccgaggccgaggggtacgcactgcaggtttctagttatgagggcaccgctggcgacgcacttattgagggaagcgtagaagagggagccgagtatacatctcacaacaatatgcagttttccacattcgaccgggacgcagatcagtgggaggagaactgtgcagaggtgtatgggggcgggtggtggtataacaactgtcaagccgcaaatctaaacggcatttactacccaggagggtcatacgacccgcgcaacaattccccctatgagattgagaacggcgtggtctgggtttctttccgcggagccgactattccctgagggccgtaaggatgaagataaggcctcttgttacacag

SEQ ID NO: 11141 - DNA, 2598 bp, Artificial Sequence
  Description of Artificial Sequence: Synthetic coding sequence
atgttctcgatgcgcatcgtgtgcttggtcttatccgtggtcgggaccgcatggacagctgactccggtgagggcgatttcctcgctgagggtggcggcgtgaggggccctcgcgtcgttgaacgtcatcagtccgcatgtaaggattcggattggccattctgttcggatgaggactggaactataagtgcccctctggctgcagaatgaaagggttgatagacgaagtcaatcaggacttcacaaatcggattaacaaactgaagaactctttgttcgaatatcagaagaataataaggactctcatagtctcactaccaatatcatggagatcctaagaggggacttcagctccgctaacaatcgcgacaatacgtataaccgcgtcagtgaagacctgagaagtcgtatagaggtcctgaagcgaaaagtcatagagaaagtgcaacacattcaactgctccagaagaatgttagagcgcaactggttgatatgaaaagacttgaagttgatatagacatcaaaatcagatcttgtcgtggctcgtgcagtagagccttggctcgtgaagtcgatctcaaggactacgaagaccagcaaaagcaattggagcaggtcatagctaaagatctgttaccgagtcgagaccgacaacatctacctttgataaagatgaagccggttcctgatctcgtgccgggaaattttaagagccaacttcaaaaggtcccaccagagtggaaggccttgaccgatatgcctcagatgcgaatggaacttgagcggccaggaggtaatgaaattactcgtggtggctctacctcgtacggcaccggttcagagacggagtcacctcggaaccccagcagtgccggtagctggaactcgggttctagtggcccaggcagcacgggaaaccggaaccctggttccagtggtacgggaggcaccgcaacttggaagcctgggtcttccggacccggttctactgggtcctggaatagtggctcttcaggaaccgggtccacggggaatcagaatccggggtctccacgccctggatccacggggacatggaatccgggttcgtctgagagaggtagtgcgggtcattggacgtcagagagcagcgtatcggggtctactggccagtggcatagcgagtctggcagtttccgtcctgattctccgggaagcggcaatgcccggcccaacaatccagattggggaacttttgaggaagtctcgggcaacgtaagtccgggcacacgtcgtgaatatcatacagagaaacttgtgacatctaaaggtgataaagagcttcggaccggtaaggagaaggttacgtccggctcaacaacgacgactaggcgctcgtgttcgaagacagttacgaagaccgtcataggccccgatgggcataaggaggtaacaaaggaggtggttacgtccgaggatggcagcgactgcccagaggcgatggaccttggcacgctgtcaggaattgggaccctggatggctttcgtcaccgacacccggatgaagcagcatttttcgataccgcttcaacaggcaagaccttccccggtttctttagcccgatgctaggggagttcgtatcggagacagagtcgcgagggtcggagtccggaatcttcacgaacacgaaagagtcttcatcacatcaccccggcattgcagagtttccctctaggggaaagagcagtagttactctaagcaattcacgagctcaacttcttataacaggggagacagcacgttcgaaagcaagagttacaagatggccgatgaggcaggaagcgaggcagatcatgaaggcactcactctacgaagcgcggtcatgcgaagtcacgaccggttcgcgactgtgatgacgtattgcagacccacccaagcggcacacaaagtggaatctttaacattaagcttccggggtcttctaaaatcttttcagtctattgtgatcaggagacttccctcggcggatggcttttaatacagcaacgtatggatggctcccttaattttaatcggacatggcaggactataagcgtgggtttggctctttgaatgatgaaggtgaaggtgaattttggctggggaacgattatctacatctgcttacccaacgtggatcggttttgagagtggagcttgaggactgggctggtaatgaagcatacgctgagtaccactttcgtgtcggctctgaagcagagggctatgcgctgcaggtctcgtcttatgaaggaactgctggggacgcgcttatcgagggctctgtcgaggagggagcagagtacacttcccataacaacatgcaattttccacattcgatcgcgatgctgaccaatgggaggaaaactgcgcggaagtctacggcggcggatggtggtataacaattgccaagccgccaaccttaacggaatctactaccctggcggttcctatgatccaagaaataattcgccctacgagatagagaacggggtagtttgggtctctttccgtggagccgattactcactgcgtgcggtgcgaatgaaaatacgaccactcgttacccaa

SEQ ID NO: 11142 - DNA, 2598 bp, Artificial Sequence
  Description of Artificial Sequence: Synthetic coding sequence
atgttttcgatgaggattgtctgcttggtcctttcggtcgtgggtactgcatggaccgccgactctggcgagggtgacttcctcgccgagggaggcggggtgcggggtcccagggtggtggaacgccatcagagtgcatgcaaggactctgattggccattctgttcggacgaagactggaattacaagtgcccgtccggctgtcgcatgaagggacttatcgatgaggtgaaccaagattttaccaaccgaattaacaagctaaagaactcacttttcgaatatcagaaaaataataaggatagtcactccttaaccaccaacattatggaaatcttaagaggcgattttagttccgccaataaccgcgataatacctataatagagtgagcgaagacctcaggtctcggatcgaagtgttgaagaggaaggtgatcgagaaggtccagcacatacagctgctgcaaaaaaacgtgcgagctcaactggtcgacatgaagcgcctggaagtagatattgatatcaagattaggtcttgccgcggctcgtgctccagagccctggctcgggaggtggacctgaaggattacgaagatcaacaaaagcagctcgaacaggttatcgccaaggatctgcttccatctagagatcgccagcatctgcctttaattaagatgaagccagtgccagacctggttccaggaaatttcaagtcccagttgcagaaagttcccccagaatggaaggccctcactgatatgccgcagatgcggatggaactcgaaagacctggaggcaacgagattacaaggggtggcagtaccagctatggcaccggatctgaaacagaatcccctcggaaccccagtagtgcaggaagctggaacagcgggagttccggaccgggttccacagggaacagaaatcccggctcttccggcaccgggggcacagccacatggaagcccggatcctctggtccgggttctactggtagttggaacagcggctcatcaggaaccgggtcaaccggtaatcagaatcccggcagcccacgacctggctccactggcacgtggaatccaggttcatctgagcggggaagtgcagggcactggactagcgagagttccgtaagcggctcaactggacagtggcacagcgagtcaggctcattcaggcctgacagtccgggctcaggtaacgctcgcccgaacaaccctgactggggcacatttgaggaggttagcgggaatgtttcaccggggacgcgcagagaataccatactgaaaaactggtgacttctaagggggataaggagctgcgcacaggcaaagaaaaggtaactagtggctcaactactaccacacgtcgatcttgttcaaagacagtgacgaaaaccgtgataggtcccgacggtcacaaggaggtcacaaaggaggtagttacaagcgaagatgggtcagattgccccgaggctatggaccttggaacactttcaggcatcggtacgctcgacgggtttaggcatagacatccagatgaggctgcttttttcgacactgcctctactggcaagaccttcccaggcttctttagtcccatgctgggggagtttgtgagtgagaccgaatcaaggggcagcgagagtggaatcttcactaacactaaggagtcctctagccaccaccctggcatcgccgaattcccctccaggggaaagagttcgtcatattccaagcagttcacgtcaagtacatcatacaaccgcggagattccactttcgaatcaaagtcctataaaatggccgatgaggccgggtctgaggccgatcacgaagggacacattcaaccaaaagaggtcacgccaaaagtcgtcctgtgagagactgcgatgacgtgctccagacacatcctagcgggacacagagtggcattttcaatattaagcttccagggtctagtaagatattttccgtctactgcgaccaggagacaagccttggtgggtggctcctaatccaacagaggatggacggaagtctaaacttcaataggacttggcaggactacaagcggggctttggcagcctcaatgacgaaggggaaggagagttctggctgggcaacgactatctccacctgctgactcagcgcgggtcagtgttgcgcgtggagttggaggactgggcgggaaatgaagcctacgcggagtatcatttccgtgtcggcagtgaggcagaggggtatgctttgcaggtaagtagttatgagggaaccgctggtgatgcgctcattgagggatccgtggaagagggcgcggaatacacaagccacaataatatgcagtttagcacgttcgacagagatgcagaccagtgggaagagaattgcgctgaagtgtatggaggcggatggtggtacaacaactgccaggctgccaacctgaacggaatctattaccccggaggctcatatgacccgaggaataactctccgtatgagatcgagaacggcgtggtgtgggtttccttcagaggagcagattactcccttcgcgctgtgcgaatgaagatccgcccactggtcacacag

SEQ ID NO: 11143 - DNA, 2598 bp, Artificial Sequence
  Description of Artificial Sequence: Synthetic coding sequence
atgttctcaatgaggatagtttgcttggtcctcagcgtggtgggtactgcctggacagctgacagcggagaaggagattttctggctgaaggcggtggtgtgcggggcccgagagtcgtcgaacggcaccaatctgcctgcaaggattctgattggcctttttgttcagatgaagactggaattacaaatgcccaagtggatgcagaatgaagggcctgatcgacgaagtgaatcaggacttcactaatcgaatcaataagctgaagaatagtttatttgaataccagaaaaacaacaaagatagccactccctgaccaccaacataatggaaatccttaggggcgacttttccagtgccaacaatcgtgataacacctacaaccgcgtgagcgaagatctgagaagccggatagaagtgctgaagcggaaagtaatagagaaagtgcagcatatccagctcctacagaagaacgtgagagcgcagttagtcgatatgaagaggctcgaggtggacatcgacattaagattcggtcttgtcggggcagttgcagccgggctctcgcaagagaagttgatctgaaggattacgaagaccagcagaaacaactggagcaggtcatcgccaaggacctcctgccctcaagggataggcagcatcttcctctgatcaaaatgaagcctgtcccagatctggttccaggaaatttcaaatcacagttgcagaaggtaccacccgaatggaaagctctcactgatatgcctcagatgaggatggagctcgaacgccccggaggcaacgagatcacccgcggcggatccacctcatacgggacaggtagcgagactgagagccctcgcaacccttcatcagctggcagctggaacagcggatccagcggccctggctcaaccggcaaccgaaaccccggtagtagtggcacagggggaacagcaacttggaaacctgggagctcaggccctggctccacaggctcctggaacagcggatccagcggcaccgggagcaccggaaaccagaacccaggcagtcccaggccaggctccaccgggacctggaaccctggcagtagcgagaggggcagcgcaggccattggacatcggaatcgtccgtcagtggcagcactggacaatggcacagcgagagcggcagctttcgacctgactctccaggatctggtaacgcacgccctaacaaccctgattggggtacctttgaggaagtctccggcaatgtctctcccgggacaagaagagaataccacactgagaagttagtcactagcaaaggggacaaagagctccgcacaggaaaggaaaaagtcacctcaggttccacaaccaccacccggcggagctgttctaaaacagtgaccaaaaccgtcatcgggcctgatggccacaaagaagtgaccaaggaagtggtgacttctgaagatggttcggattgcccagaggctatggatctgggcacactcagcggcatcggaactctggatggcttccgtcacagacatccggatgaggccgccttcttcgacaccgcatctaccggaaagacatttccaggttttttttccccgatgttgggcgaatttgtcagtgagaccgagtcacggggatccgagtctggcatcttcactaacacaaaggaaagttccagccaccacccaggcatcgcggaatttccaagtcgaggaaagagcagcagttattcaaagcagtttacctcctcaactagctacaacaggggggacagcactttcgaaagcaagagctacaagatggccgacgaagccggcagtgaggccgaccacgaaggaacacattcaacaaagagaggtcatgctaaatctaggcctgtccgggattgtgacgatgtactacaaacccacccctctggcacccagagtggcatttttaacattaagctcccaggaagttccaaaatcttctccgtttattgcgatcaggaaaccagcttagggggctggctgttgatccagcagagaatggatggaagcctcaattttaacagaacatggcaggattataaaagaggctttggaagcctcaacgacgaaggggaaggcgagttttggttggggaacgattatttgcatctcctgacccagcgggggagcgtccttagggttgaattggaggactgggcgggtaacgaagcttatgccgaataccacttcagggtcggcagcgaagctgagggctatgcactccaggtatcaagctacgagggaacagcaggcgacgctctgatcgagggatccgtcgaagaaggtgccgaatacacctcccacaataatatgcagttcagtacctttgaccgggatgccgatcagtgggaggaaaactgtgctgaggtgtatggaggaggctggtggtataacaactgccaggcagctaacctcaacggaatttattatccaggaggaagttatgacccccgaaataactccccgtatgaaattgagaacggagtcgtctgggttagttttagaggagctgactattctcttcgagccgttagaatgaagatcaggcccctggtgactcaa

SEQ ID NO: 11144 - DNA, 2598 bp, Artificial Sequence
  Description of Artificial Sequence: Synthetic coding sequence
atgttcagtatgcggattgtctgcctggtgttatctgtcgtcggaacagcgtggaccgctgattctggagagggagattttttagcggaaggcggtggagtgagagggcctcgagtggtcgagaggcaccagtcagcctgtaaggattcagactggcctttttgttctgacgaggattggaactacaagtgcccttccggctgccggatgaaggggcttattgatgaggtgaatcaagatttcacgaatcgaatcaataagctcaaaaacagtctgttcgaataccaaaagaacaataaggactctcatagccttactaccaatatcatggagatcttgaggggcgactttagctcagccaacaatcgagataatacgtataaccgcgtgagtgaggatctcaggtccagaatagaggtgcttaaaaggaaggtgattgagaaggtgcagcatatccagctgttgcagaagaatgtgagagctcaacttgtggatatgaagcgcctggaagtggatatagatattaagattcggagctgccgggggagctgttcacgggccttggccagagaagtggatctgaaagactatgaagaccagcagaagcaactcgaacaggtgatcgcaaaagatctgctgccgtcgagagatcgtcagcacctgcctttaatcaaaatgaagccagtgccggatcttgttccaggtaactttaagagccagctccagaaagtgcctcctgagtggaaagccctgactgacatgcctcagatgaggatggagctggaaagacccgggggtaatgagattactagggggggctccaccagttatggcactggttctgagacagaaagcccccgcaatccctccagtgccggttcttggaattccgggagctccggccctggttccacagggaatagaaacccaggatcctcaggaacgggaggaacagccacctggaaacctggatccagtggacctggcagtacgggatcatggaacagcggctcctccggaaccgggagcaccggaaaccagaatcccggctctcctagaccggggtccactggaacatggaaccctggatcttcggagagaggatctgctggccattggacaagcgagagctctgtatccggcagtaccggacagtggcactctgagtcagggagctttcggcccgattcccctggctcaggcaacgcacgtcccaataatcctgattggggaacttttgaggaggtatcgggaaacgtctctcctgggacccgcagagaatatcacacggaaaaactagtgactagcaaaggggataaggagttgcggacgggcaaggagaaagtgacgagtggatctaccactaccacgaggcgtagttgttcaaagacagtaaccaagactgtgatcggaccggacggccataaagaggtaacgaaggaagttgttaccagcgaggacggctccgattgccccgaggccatggacctcggaaccctcagtggcattggaaccctggatggattcaggcataggcacccagatgaggctgcattcttcgataccgcatctactggcaagaccttccctggcttcttcagccccatgctgggtgaatttgtgtcggagaccgaatccaggggttctgagtcaggaattttcacaaacacaaaggaaagctcgtcccatcaccctgggatcgccgagttcccaagccgtggtaagtcttcaagctattcaaagcagttcacctcctccactagctataaccgaggagattcaacttttgagtctaaaagctataagatggcagatgaagccgggtcagaggctgatcacgaaggcactcactccacaaaaagagggcacgcaaaaagtaggccagtgcgggattgtgatgacgttctgcagacgcatccctctggaacccagtctggaatattcaatatcaagctacctggctcgagcaagatctttagtgtgtactgtgaccaggagacctccctgggtgggtggttgctgatccagcagcgtatggatggctctctgaatttcaatcgaacctggcaggactacaagagaggtttcgggtctttaaatgacgagggcgagggagagttttggctcgggaacgactacctccatctgctcacccagcgcgggtctgtcctcagggtggagttggaagattgggccgggaacgaggcgtacgccgagtaccactttcgggttggttctgaggctgaaggttacgccctgcaggtaagctcatatgagggcaccgccggggacgccctgatcgaaggctcagtcgaggagggggccgagtatacgtcccacaataatatgcagtttagcaccttcgatagggacgccgatcagtgggaggaaaattgtgctgaggtctacggaggaggatggtggtataacaactgccaggccgccaacctcaacggaatttattacccgggcggatcctacgatccccggaacaacagcccatatgaaatcgagaacggagtggtgtgggtgtcctttcgcggcgccgattattccttgagagccgtgcgtatgaagatcaggcctctagtgacacag

SEQ ID NO: 11145 - DNA, 2598 bp, Artificial Sequence
  Description of Artificial Sequence: Synthetic coding sequence
atgttctccatgaggatcgtgtgcctcgttctgtccgtggtcggaactgcgtggactgcggatagcggagagggggactttctcgccgagggtggcggcgtgaggggacctcgagtggtggagagacaccagagcgcctgcaaggactcagactggccgttttgtagcgacgaggactggaattacaagtgcccgagcggctgccggatgaaggggctgatcgacgaagtgaaccaggacttcaccaatcgcatcaacaagttgaagaactccctgttcgaataccagaagaacaataaggactcgcactcgctcaccaccaacatcatggaaatactgcggggagacttcagctcggcgaataaccgcgacaacacctacaatcgcgtgtcggaggatcttcgctcccggatcgaagtgctgaagagaaaggtgatcgagaaggtccagcatatccaactgctgcaaaagaacgttagagcgcaactcgtggatatgaagagactggaagtggatatcgacatcaaaatccgcagctgtagaggttcatgttcgcgggcgctggcccgcgaggtggacctgaaagattacgaggaccagcagaaacagctggaacaagtgatcgctaaggatttgctcccgagccgcgaccggcagcatctgccgttgatcaaaatgaaacctgtgccggacctcgtcccgggcaacttcaagtcccagctgcaaaaagtgccgccagaatggaaggcactgaccgatatgccacagatgagaatggagctggaacgccctggcggcaatgaaatcacccgcggcggatcaacttcttacggtactggctctgagactgaatcgccgcgaaatccatcgtccgctggctcgtggaactccggctccagcgggcccgggtctacgggaaaccgcaatccgggatcctcgggaacgggaggaaccgctacttggaaaccgggaagcagcggcccagggtcaaccggatcgtggaattcgggatcgtccggcactggatcaactggaaaccaaaacccgggatcacctagaccaggaagcactggaacctggaacccaggttcgtcggagcgtggatcggccggacattggacttcggaatcctccgtgtcgggctctacggggcagtggcatagcgagtcaggcagctttcgccccgattcgcctggatcgggtaatgcgcgcccgaacaatcccgactggggtacgttcgaggaagtctcgggaaacgtgtcccccggcacccggagagagtaccacactgaaaagctggtcaccagtaaaggtgacaaggagttgagaaccggaaaggagaaggtcactagcggttcaaccacgaccactcggcggtcgtgttcaaagactgtgaccaaaaccgtgattggaccggacggacataaggaagtgaccaaggaggtggtgacctccgaggatggaagcgactgcccagaggcaatggacctggggaccttgagcggaatcggcaccctggatggcttccggcaccgacaccccgatgaggcagcattctttgacaccgcttcgactggaaaaaccttcccaggatttttctcgcccatgcttggagaattcgtgagcgaaaccgaatcacgtggttccgaatccggaattttcactaacacgaaggaatcatcgtcccaccatccggggatcgcagaattcccgtcccggggcaagtccagctcatactcaaagcagttcacctcatccacctcatacaataggggggactccacctttgaaagcaagagctacaaaatggcggacgaggccgggtccgaggcagaccacgagggaactcactccactaagcggggacatgcgaaatcacggccggtgcgggattgcgatgacgtcctccagactcacccatcggggactcagtctggaatcttcaatatcaagctccctggcagctccaaaattttctccgtctattgcgaccaggaaacttcgctgggaggctggctgctcatccaacaacgcatggacggaagtctgaacttcaataggacttggcaggattataagcggggctttggctccctcaatgatgaaggtgaaggagaattctggctggggaacgactacctgcacctccttactcaacgcggatcggttcttagagttgaactcgaagattgggccgggaacgaggcttacgccgagtaccacttccgcgtcggatcggaagcagagggatacgcgctgcaagtgtcaagctacgaagggactgccggagacgccctcattgaaggatcagtcgaggaaggagcagaatacacctcccataataacatgcaattctccacgtttgaccgcgatgccgatcagtgggaagaaaactgcgccgaagtctatggcggaggttggtggtacaacaactgccaggctgccaaccttaacggaatctactaccctggtggtagctacgatccacggaacaacagtccgtacgagattgagaatggggtcgtctgggtgtcattcagaggcgccgattactcgctgagggccgtgcgcatgaagatcaggcctctcgtgacccag

SEQ ID NO: 11146 - DNA, 2598 bp, Artificial Sequence
  Description of Artificial Sequence: Synthetic coding sequence
atgttttcaatgcgcatagtgtgcctcgtccttagcgttgtggggaccgcttggactgctgactctggagagggcgatttccttgccgagggcgggggcgttcgcggcccccgcgtagtcgagcgacaccaatccgcctgtaaggatagtgattggcctttttgctccgacgaggattggaactataagtgcccaagtggctgcagaatgaaggggttgatcgatgaggttaatcaggattttactaatagaatcaataagttgaaaaatagcctgttcgagtatcagaaaaataacaaagactcccactcactgaccaccaatattatggagattctacggggtgatttctcttccgcaaataaccgggataacacatataatcgcgtaagtgaagatctacggtctaggatcgaagtgcttaaaagaaaagttatcgagaaagttcagcacatccagctgctgcagaagaatgttcgtgcacagctggtggacatgaagcggctggaggtggatatagacattaagataaggagctgtcgcgggagttgttctcgcgcccttgcaagagaggtggacctgaaagactacgaagatcaacagaaacagcttgagcaggttatagctaaggacctgttaccaagccgagaccgccagcatctacccctgattaagatgaagcccgtgccagacctcgtgcccgggaacttcaaaagccagttacagaaggtgccaccagaatggaaagcccttaccgacatgccacagatgcggatggaactggagagaccaggaggtaatgaaattactagggggggatccacttcttacggtacagggtctgaaactgagtctccacggaacccatcctccgcaggctcatggaatagtggctccagtggtcccgggagtaccggcaaccgcaatcctggatcaagcggaacaggcggcaccgcaacttggaaacccgggtccagtggacccggctccactggctcttggaattctggatccagtggaactggctctaccggcaaccagaaccctgggtccccacgacccggctccacaggcacatggaaccccggatcatcagaaagggggtctgctggccattggacctccgagtcttccgtgtccgggtccaccgggcagtggcactctgaatccggctcttttcggccagactctcctggcagcggcaacgcccggccaaacaatccagactggggcaccttcgaagaagtgtccgggaacgtgtctcccgggacacgccgggagtaccacactgagaaactggtgaccagtaaaggcgacaaggaactgcgcactggcaaggagaaggttacctctggctctacaactactacccggcgatcctgttcaaagactgtcacaaaaacagtgataggtcctgacggacataaagaggtgactaaggaggttgtgacttccgaagacgggagcgactgtccagaagctatggatttaggcactctatccggtattggcaccctagacggtttccgccaccgccatccagatgaagctgcattcttcgacaccgcttctacaggaaagacatttcctggctttttctcacccatgttaggcgagttcgtcagcgaaaccgaaagcagaggctctgagagtggcatattcaccaacaccaaggaatctagttctcaccacccaggaattgctgaatttccttccagaggaaaatcctcttcttattcaaagcagttcaccagctccacctcatacaacagaggcgatagtaccttcgaatctaaatcctataaaatggctgacgaggccgggtccgaggcagatcatgaaggaacacattccactaagcgcgggcacgctaagtcacgcccagtgagggactgcgatgatgtgctgcaaacccacccttctggcactcagagcggaattttcaatataaaactacctggctcctctaagatatttagtgtgtattgtgatcaagagaccagcttgggaggatggctactgatccagcaacgtatggacggcagtctaaactttaataggacctggcaggactacaaacggggtttcggcagtctgaatgatgagggcgagggcgaattttggcttggcaacgattacctccatctactgacacagaggggaagcgtccttcgagtggaactggaggactgggccggcaacgaggcctacgccgagtatcatttcagggtaggcagtgaggctgaaggttacgccctgcaggtttcctcatatgaagggactgctggagacgccctaatagaggggtccgtggaagagggagctgaatatacctctcacaacaacatgcagttcagcaccttcgaccgcgacgccgatcagtgggaggagaactgtgcagaagtctatggcggcggttggtggtataataattgtcaggctgctaacctgaacggtatttattatccaggcgggagctacgatccaaggaataactctccttacgagatagaaaacggtgtggtttgggtgtcctttcgtggggccgactactctctacgggcagtacgcatgaaaatcagacctctggtgacccag

SEQ ID NO: 11147 - DNA, 2598 bp, Artificial Sequence
  Description of Artificial Sequence: Synthetic coding sequence
atgttctctatgcggatcgtgtgtctggttttgtccgtagtcgggacagcatggaccgccgatagtggggagggagacttcttagccgagggtggaggcgttcggggtccccgcgtggtggaaaggcatcagtcagcttgcaaagattccgactggccattctgctccgacgaggattggaactacaagtgccctagcggctgtcgcatgaagggcctcatcgacgaagtgaaccaggatttcaccaaccggatcaataagctgaaaaattccctgtttgagtaccagaagaacaacaaagacagtcacagcctcaccactaatatcatggaaatattacgaggcgatttctctagcgcgaacaacagggacaatacatataatcgggtgtcggaggatctgcgatcacgaatcgaggtcctgaaaagaaaggtgatcgaaaaagtgcagcacatccaactgctccagaaaaatgtgcgagctcagttggttgacatgaaaagattagaggtggatatcgatattaaaattcgctcctgtagaggcagttgctcccgcgctctcgcaagggaggtcgaccttaaagattacgaagatcagcagaaacagctggagcaggttatcgccaaagacctgcttccatcgagagaccgccagcatctgccacttattaagatgaagcctgttcctgatctggtgcctggcaattttaagagccagctccagaaggtgcccccagagtggaaggcacttaccgacatgccccagatgagaatggaactcgaacgacctggaggaaacgaaattacgcggggaggcagcacgtcctacggcacaggaagcgagactgaaagcccgagaaaccctagctccgctgggagctggaatagcggaagcagcgggcctggttctacggggaacagaaacccggggtcatccggtacggggggcactgccacatggaagccaggctcttcgggtcccggatcaaccggctcatggaactccggttccagcgggaccggcagcacagggaaccagaaccccgggtctccacgccccggtagcacaggaacctggaatcccgggagctctgaacggggctcagcaggtcattggacaagcgagtcctctgtgtctgggagtacagggcagtggcacagcgaatccggaagcttcagacctgattctcctggttcgggaaatgctaggccaaacaatcccgattggggaactttcgaggaagtcagcggaaacgtgagtcccggtacacgtagagaatatcacaccgaaaaactggttacatcaaagggggataaagaacttcgcaccgggaaggagaaagttaccagtggaagcacaaccacaacccgcagaagctgcagtaaaaccgtaacaaagacagtgattggtcccgacggccacaaagaggtcacaaaagaggtggtcacatccgaagacggatcagactgtcctgaggccatggacctgggaaccctgtccggaatcggaacactcgacggattcaggcacagacatcctgacgaggcagcctttttcgatacagccagtacaggcaaaacgtttcctggattcttcagccctatgctcggtgagtttgtgtctgaaacggaaagtcgcggcagcgagtcaggcatcttcacaaatactaaggaatcctcatctcaccatccgggcatcgcggagtttccatccagaggcaaaagctctagttacagcaagcagtttacgagtagcacatcgtataacaggggagactctacgttcgaaagtaaatcatataaaatggctgatgaggccggttcagaggccgatcacgaaggtacgcattccacaaagagggggcacgctaaaagtcggcccgtgagggactgtgacgatgtactgcagactcatccttctgggactcaaagtggaatattcaatatcaagctaccaggatcctctaagatttttagcgtgtactgtgatcaggaaaccagcctcggagggtggctgcttattcagcagcggatggacggttccctcaactttaaccgcacatggcaggactataagcgtggctttgggtccctaaatgacgaaggggagggggaattctggctgggcaacgattatcttcacctgctgacacagagagggagcgtgcttagagtggagctggaggactgggcgggtaacgaggcttacgctgagtatcatttcagggttggaagtgaggcagaggggtatgctctgcaggtaagtagctacgaaggaactgccggggacgcccttatcgagggtagcgtcgaagaaggcgcagagtatacaagtcacaacaacatgcagttctctacctttgacagagatgcggaccagtgggaagagaactgcgccgaggtctatggtggggggtggtggtataacaattgccaggcggccaatctgaacggtatatactacccaggtgggtcttacgatccgcgaaataacagcccttacgaaatagaaaacggtgtggtttgggtgtcatttcgtggggctgactatagtttgagagccgtgcggatgaagatccgacccctcgtcacacag

SEQ ID NO: 11148 - DNA, 2598 bp, Artificial Sequence
  Description of Artificial Sequence: Synthetic coding sequence
atgttctcaatgcggattgtctgcctggtcctgtccgtggtgggaaccgcatggacggcagactcaggcgagggcgactttctggccgaaggcggaggtgtcagggggcctcgcgtagtagaacgtcaccagagcgcctgtaaagacagcgactggcctttctgcagtgatgaggactggaattacaaatgccccagcggctgtaggatgaagggactcatcgacgaagtgaaccaagactttacaaaccggattaataagttaaagaactctttgtttgaataccaaaagaacaataaagattctcattcactgacaactaacattatggagattctgagaggggactttagcagtgcaaataacagggacaacacctacaaccgtgtttcagaagacttgcggagccgcatcgaagttctgaagcggaaggtgatcgaaaaggtgcaacacattcagctattacaaaaaaatgtgagggcccagctggtcgatatgaagagactggaggtggacatagatatcaagatacggtcttgtcggggtagttgcagtcgggcactcgccagggaggtggatttaaaggattatgaggaccaacaaaagcagctggagcaggtcatcgctaaggatctgctgccctcaagggacagacagcacctcccgctcatcaagatgaaaccggtcccagatttagttcccggcaactttaaatcacaactccagaaggtgcctcccgagtggaaagcgctcaccgacatgccccaaatgcggatggagctggagaggcccggggggaatgaaatcacccgtgggggctccactagttatgggactggcagcgagaccgaatccccccgtaatccctcttcagccggtagttggaacagcggcagctctggtccagggtctacgggaaatagaaatcctggttcatcaggcaccgggggtaccgctacatggaaacccgggagcagtggtcccggtagcacgggctcctggaatagtggttctagcggtaccgggtccactggcaatcagaatcccggctctccaagacctgggtcaaccggaacatggaaccctggatcttctgaacggggctctgcaggccactggacctccgagtctagtgtcagtggttccaccgggcagtggcactctgagtccggatcctttcgaccagactcgccaggctccgggaacgcccgacccaacaaccctgactgggggaccttcgaagaggttagcgggaacgtgagtccaggtacgcgtagagaatatcatacggaaaagctggtaaccagtaaaggagacaaagaattacgaaccggcaaggagaaagttacatcggggagcacgaccacaaccaggcgctcctgttcaaagacagtgacaaagacggttatcggtcccgacgggcacaaagaggttacgaaggaggtggtgacctcggaggatggaagcgactgccctgaagccatggacctgggcactttgagtgggattggcacactggacggattcaggcatcggcaccctgacgaggctgcattcttcgacactgcctctaccgggaaaacctttccaggcttctttagcccgatgttgggtgaattcgtgagtgagaccgaaagccgaggaagcgaatccggaatcttcacgaacactaaagagtcttctagtcatcaccctggaatcgcagaatttccgtcacgcgggaagagttcttcctattcaaagcagttcacgtccagcacctcttacaatcggggcgatagcacattcgaatctaagagctacaaaatggccgatgaagctggttccgaggctgaccacgagggtactcactcgacaaaacgcggccacgctaagagcagaccagttcgagattgtgacgatgtgctgcagacccatcccagcggcacccagtccggcatctttaacatcaagctccccggatcttccaaaatattttccgtgtactgcgaccaagagacctccctcggaggttggctgcttattcagcagaggatggacgggagcctgaattttaaccgcacttggcaggattacaagcgggggttcggatcactaaatgacgagggtgaaggggaattctggttaggcaatgattatctccatctgctgacgcagcggggcagtgtgctgagagtggagctcgaggactgggcaggcaatgaagcttacgccgagtatcacttccgggtgggttctgaagccgagggctatgcgttgcaggtctccagttatgaaggtaccgctggcgacgccctgatcgaaggctcagtagaggaaggtgcagagtacaccagccacaacaatatgcaattctctacatttgaccgcgacgccgaccagtgggaggagaactgcgcagaagtctatggcggggggtggtggtataataactgtcaggccgccaacctaaacggtatctactaccctggtggttcatacgatccaaggaacaacagcccctacgagattgagaacggtgtggtgtgggtctcctttagaggagctgactatagtctaagggcagtgcgcatgaagatccgccccctagtgacccag

SEQ ID NO: 11149 - DNA, 2598 bp, Artificial Sequence
  Description of Artificial Sequence: Synthetic coding sequence
atgttctcgatgcgaattgtctgcctggtattgtccgtagtaggtactgcttggacagctgacagtggtgaaggtgattttttggctgagggaggcggagtgagggggccacgcgttgttgagcggcaccagagcgcctgtaaggacagtgactggcctttttgcagtgatgaagactggaactataagtgcccatcaggatgtaggatgaaaggtctcatcgatgaagtgaatcaggatttcacaaaccgtatcaacaaactgaagaactcactatttgagtatcagaagaataataaggacagtcacagcttaactaccaatatcatggagattcttagaggtgatttctccagcgctaacaatagggataacacttataatagggtgagcgaagatttaagatctaggattgaggtccttaagagaaaggtcattgaaaaagtgcaacacattcaattgcttcaaaagaatgttcgggcccagcttgttgatatgaagcgtttggaggttgatatcgatattaagatccggtcttgcaggggaagttgcagtagggcattggctcgtgaagttgatcttaaagattatgaagatcaacaaaaacaactcgagcaagtgatcgctaaggatttattgccatctcgtgatcgccaacatctgccgttaattaaaatgaagcctgttcctgatctggtgccaggcaactttaagtctcaacttcagaaggtcccacctgaatggaaagcactcaccgatatgccacaaatgagaatggagctcgagaggcctggaggtaacgaaattactaggggaggcagtaccagttatggaaccggaagtgagaccgagtctccaagaaatccaagttctgcgggttcttggaattcaggttcctcgggtcctgggagtactgggaacagaaaccccggatcttctggtactggtgggacggcaacatggaagcccggaagtagcggaccgggaagcactggatcatggaatagcggatccagtggaactggcagcactggcaatcaaaatcctggatcccctcgtcctggatctacaggtacatggaaccccggatcttcagaaagggggagcgcaggccattggacatcggagtcctcagtttcagggtcaaccggccaatggcattccgagagtggctcattccggccagattctcctggttctgggaacgcaaggcctaataatcctgattggggcacttttgaggaagtatctggaaatgtttcgccaggaacaaggagggagtaccacactgagaagctagttacatcaaagggtgataaggaacttcgcaccggtaaagaaaaagtgacatccggctcaactactactactcggaggtcttgtagcaagaccgttactaagactgtcattggtccagatggacataaagaagtgactaaggaggttgtaacgagcgaggatgggtcagattgcccagaggccatggatttagggaccctgtcaggcattggtaccttggatggttttaggcaccgtcatcctgatgaggctgcatttttcgacactgcctccaccgggaaaacatttcctggctttttttctcctatgctgggagagtttgttagtgaaaccgagtctagaggttcggaatcaggaatcttcacaaacaccaaggagtcctcttctcatcatccaggtattgccgaattccctagtagaggaaaatcatcttcatatagtaaacaatttacaagttctacatcctataatagaggtgactcgactttcgagtccaaaagctataaaatggctgatgaagcagggtctgaggcagatcatgaaggaactcattctaccaagcggggacatgcaaaatcacgtccagttagagactgcgatgacgttctacaaacccatccgagtggcactcagagcggaattttcaacattaagcttcctggttcatcaaaaatcttctccgtttattgcgatcaggaaacttcacttggaggatggcttctcattcaacagaggatggacggaagtctcaacttcaaccgaacctggcaagactacaaacggggattcggatcactaaacgatgaaggagagggagagttctggctcggtaatgattatcttcatttgcttacgcaaagaggatctgtcctgcgagtggaattggaggactgggcaggcaacgaagcatatgctgaataccattttagggtcgggtccgaagcggagggatacgctctccaggtcagctcctatgagggaactgctggtgatgcacttatcgaaggttctgttgaggaaggggctgaatacacctcacataacaatatgcagttcagtactttcgatagggatgccgaccaatgggaggagaactgtgctgaagtttacggtgggggatggtggtacaacaattgccaggctgccaacctgaatggtatttactatcccggggggagctatgaccccaggaataacagcccttatgaaattgagaatggggtcgtatgggtgtctttcaggggtgccgattattcattgcgggccgtgcgtatgaaaattcgtccacttgttacgcag

SEQ ID NO: 11150 - DNA, 2598 bp, Artificial Sequence
  Description of Artificial Sequence: Synthetic coding sequence
atgtttagtatgagaattgtgtgccttgtgctgagtgtggtgggtaccgcttggactgctgattctggagagggtgactttctcgctgagggaggtggtgtacgcggcccacgcgtggttgaaaggcaccagagcgcttgtaaagactcagactggccattttgcagtgatgaggactggaactacaagtgcccaagtggatgcagaatgaaaggactgatcgacgaggtcaatcaggacttcacaaacagaatcaataaattgaagaactctctcttcgaataccagaagaacaacaaggacagtcactcccttaccaccaatatcatggaaatcctcagaggcgacttctcctccgctaataatcgcgacaatacttacaatcgcgtcagcgaggatcttcgctcaagaatagaggtgttgaagaggaaggtgatcgagaaagtccagcacatacaactgcttcaaaagaacgtcagggcacagttggtggatatgaagagacttgaggtggatattgacatcaagattaggtcttgcaggggttcttgcagtagagccctggcaagggaggttgacctgaaggattacgaggaccagcaaaagcaactggagcaggttatcgctaaggatcttcttccaagccgcgaccgccagcatctgcctctcatcaagatgaaaccagttccagacctggttccaggaaacttcaaatcacaactgcagaaagtcccacccgagtggaaagccctcacggatatgcctcagatgcgcatggagctggagaggcctggaggtaacgagattaccagaggtggatccacctcttacggtaccggaagcgaaactgagagccccaggaatccaagtagtgcgggtagctggaactccggatcctcaggaccaggcagcaccggcaacaggaatccaggttccagcggcactggcggtacagcgacatggaagcccggttctagcggtccaggaagtactggctcctggaattccggatcaagcggcacaggctccactggcaatcagaaccccggatcacctagaccaggctctacaggaacctggaatccaggatccagcgagagaggatcagcgggccattggactagtgagtcttcagtgagcggatctacaggccaatggcactccgagtccggctctttccgccctgacagcccaggctcaggaaatgccagacctaataacccagactggggtaccttcgaagaggtgagcggaaatgtgtccccaggcactcgcagggaataccacaccgagaagctggtcaccagtaagggagataaagaactgcgcacgggtaaggaaaaggtaaccagcggaagtaccacaactaccaggagatcctgctctaaaactgttactaagaccgtgattggaccagatggacacaaggaggtgactaaggaggttgtcacaagcgaagacggtagtgattgcccggaggccatggacctgggcacactttccggaatcggtacgctggatggattccgccacaggcatcctgatgaagctgcattcttcgacaccgcatcaaccggtaagacattcccaggttttttctcacctatgctgggtgagtttgtgtcagagacggaaagtaggggatccgagagtggtattttcactaacaccaaggagagtagttctcaccatccaggtatcgccgaatttccatcaagaggcaaatctagctcttatagtaaacagttcacttcatctactagctacaaccgcggcgactccacgttcgaaagcaagagctacaaaatggccgatgaagcaggctccgaagccgaccatgagggaacccacagcacaaagaggggacacgcaaagagtcgccctgtgagagactgcgacgatgtgttgcagacccacccctctggaacccagtctggtattttcaacatcaagcttccaggatcttcaaagatatttagcgtgtactgcgaccaggagactagcctcggaggatggctgctgattcaacagcgcatggacggctctctcaacttcaatcgcacatggcaggactacaagcgcggttttggctctctgaacgacgagggagaaggcgagttctggttgggaaacgattatctccaccttctcacccaaaggggatctgtccttagagtggaactcgaagactgggctggcaacgaagcttatgccgagtaccacttcagagtcggatctgaagccgaaggttacgcactccaagtcagctcctacgagggtacggctggtgacgctttgatcgagggatcagtcgaagaaggtgcagaatacacttcacacaataatatgcagttttccacattcgaccgcgatgctgaccagtgggaagagaattgcgcagaggtttatggaggcggttggtggtacaataactgccaggcagccaacctcaacggcatttattacccaggcggttcatatgatccgcgcaacaactccccttatgagattgagaacggcgtggtctgggtatcctttcgcggagccgactactccttgcgcgcagtgaggatgaagatccgccctctcgtgactcag

SEQ ID NO: 11151 - DNA, 2598 bp, Artificial Sequence
  Description of Artificial Sequence: Synthetic coding sequence
atgttttccatgcgaattgtgtgtctcgtgctatcagtggtgggtaccgcatggacagcggactctggagaaggtgattttctcgctgagggcgggggcgtaagggggccccgagttgtggagagacaccagagtgcttgcaaggacagtgattggccattttgttctgatgaggactggaactataaatgcccctcaggctgccgcatgaagggtctgattgacgaagttaatcaagactttacaaaccgcatcaataagctgaaaaattcacttttcgagtaccagaagaataataaggactcccactcattgacaacgaatatcatggagatactccgcggagacttctcaagcgccaacaaccgggacaatacctataatagggtctccgaagacttacgcagccggattgaagtccttaagcgaaaggtgattgagaaagtgcagcacatccaactgctgcagaagaatgttagagcccagctagtggacatgaaacggttggaagtcgatattgatataaagatccgcagctgtcggggatcctgtagtcgggcgttggcaagggaggtcgacctaaaagactacgaggaccagcagaaacagttggagcaggtgatcgccaaggacttacttccctcacgcgacaggcaacatctacccctgatcaaaatgaagcccgtgccagacctagttccaggcaactttaagagccagcttcagaaggtcccgccagagtggaaggccctcacagacatgccgcagatgaggatggagctggaacggccagggggcaacgagatcacccggggagggtcaacgtcctatggcactgggagcgagactgagagtccgcggaaccccagctctgctgggagctggaactctggcagttctggtccggggtccacagggaaccgcaatcctggatcaagtggcactggaggcaccgctacctggaaaccggggtcatcaggcccaggcagcaccggttcctggaattcaggcagctctggtacaggaagtaccggcaatcagaaccccggcagccccagaccgggatcaaccggaacctggaacccagggtcgagcgagagagggagtgctggtcattggacatcggagtcttcagtgtcgggttcaactggccagtggcatagcgaatcagggagctttcggcccgattcacccggtagcggtaatgctaggcctaacaaccccgattggggcacttttgaagaggtatccgggaacgtttctcctggcaccagacgcgaataccacactgagaagctggttacgtccaagggagacaaagagcttcggaccgggaaagagaaagtgaccagtggctcaaccaccacaacacgtcgatcatgttccaagacagtaactaaaaccgtgattggtccagacggtcacaaggaggtgaccaaagaggttgtgacatcggaggacggcagcgactgtcccgaagcaatggatctcggaacactctccggtattggcaccctggatggatttcgccataggcacccggacgaggccgcatttttcgacaccgcgtccacggggaaaactttccccggcttcttttctccaatgttgggggaattcgtttcagagaccgagagccggggaagcgaatccggaatattcaccaacacaaaggagagcagcagccaccatcctggcatcgctgagtttccttcaaggggcaagtcgtcctcttatagtaaacaattcacatcatccacttcctacaaccgaggtgactccacttttgagagtaagagctacaagatggcagatgaagccggctcggaagccgatcatgagggaactcactcgactaaaagggggcatgccaagtctcggcccgttcgggactgcgatgacgtactacagacgcatccttccgggacccagtccggaattttcaatataaaactccctggcagttccaagatcttctccgtgtactgcgaccaggaaacatctctcggcggctggctgctgatacaacaacggatggatggctcactcaactttaatcgaacatggcaagactataaacggggcttcgggtcattgaacgatgaaggcgagggcgagttttggctcggaaacgactatctgcatctgctcacacaaagggggtcagtgttgcgggtcgagctagaagactgggctggaaacgaggcatatgcggagtaccacttcagggtgggttcagaagctgagggatatgccctgcaggtgtcttcatatgaaggaaccgcaggcgacgcattgatcgagggatccgttgaagaaggcgccgagtatacgtcacacaataacatgcagttttccactttcgaccgggatgctgatcagtgggaggaaaactgcgcggaagtgtacggcggcggctggtggtacaataactgccaagccgcgaacctcaatggcatctactatcccggcggtagctatgaccctcggaacaactctccctacgagatcgaaaacggtgtggtctgggtttcctttcgaggcgctgactactctttacgggcagtgagaatgaaaatccgtcctctcgttacccag

SEQ ID NO: 11152 - DNA, 2598 bp, Artificial Sequence
  Description of Artificial Sequence: Synthetic coding sequence
atgttttcaatgcggatagtatgtctcgtgttgtctgtagtcggaacagcttggacagcggatagtggggaaggggattttcttgctgaaggggggggagtcaggggacccagagtggttgaacggcatcagtcagcctgtaaagattcggattggccattttgctcagatgaagattggaactataaatgtccctccggatgtcggatgaaaggacttatagacgaggtcaatcaggattttactaaccggataaataaactcaaaaattccctgtttgaataccagaagaacaacaaggattcacactcgttaactacaaacataatggagattctgcggggagatttttcatcggcaaataacagggataatacttataatcgggtgtcagaggatctaagatctcgaattgaagtgctcaaaagaaaggtcatcgaaaaagtgcagcatatccagctgctccagaaaaacgttagagctcagttagtcgatatgaaaagattggaggttgatattgatataaaaatccgttcatgcagaggatcatgctcccgcgcccttgcccgtgaagtggaccttaaagattatgaagatcagcagaaacagttagaacaggtgatcgccaaagatttgttaccctctcgcgatcgccagcatcttcccctgattaaaatgaaaccagttcccgatctagtgcccgggaactttaagtctcagttgcagaaagtgcctcccgagtggaaagctcttactgatatgccacagatgcggatggagcttgagcgcccaggagggaacgaaataacacggggagggtctactagttatgggacaggatctgaaactgaatcaccccgaaacccttcgtccgctggatcctggaattccggaagttccggacctggatctacaggaaatcgcaatcctgggtcttctggaacaggaggaacagcaacttggaaacccgggtcttcagggccaggatccacggggtcttggaatagtgggtcctccggaactggaagtacaggaaaccagaatccaggatctcctaggccaggatcaactggaacttggaatccgggatcctccgaacgagggtctgctgggcactggacttcagaatcctcagtgtcagggagtactgggcagtggcatagtgagtctggatcctttcggccggattctcccgggtcaggaaacgccagacccaataatcctgattggggaacttttgaagaagttagtggaaacgtgtcccccgggactcggcgagaataccatactgagaaactagttacttcaaaaggagataaagaattgcggacaggaaaagaaaaagtgacttctgggtccacaacaacaacacggaggtcatgttctaaaacagtcacaaaaacagttatcggacccgatggacacaaagaagtcactaaagaagtggtcacaagtgaagacggaagtgattgtcccgaggctatggatctaggaactttgtctggaatcgggacactagatgggtttagacatcggcatccagacgaagctgctttttttgacactgcttccactggaaagactttcccaggatttttctcccctatgcttggggaattcgtgtctgaaactgaatcccgaggatctgaaagtggaatattcactaatactaaagaatcatcttcccatcatcccgggatagccgaatttccaagtcgcggaaaaagttctagttattcaaagcagtttacatccagtacatcctataacagaggggatagtacatttgaaagtaaaagttataaaatggctgatgaagctggatcagaagctgatcacgaagggactcactccactaaacgtgggcacgccaagtccaggcccgtaagggattgcgatgatgttctgcagacacatccttctgggacacagagtgggatattcaatattaaactaccaggatcatctaaaatcttctctgtgtattgtgatcaagagacttctttgggggggtggttgctgatccagcagcggatggatgggtcattgaatttcaatcggacatggcaggattacaaacggggattcgggtccctcaacgatgagggggaaggagaattctggctgggaaacgattacctccatctattaacacagcgcgggtccgtgcttagggtggagctcgaagattgggccgggaacgaagcttatgccgagtatcatttccgggtggggtcagaggcggaggggtacgctttacaggtaagttcttacgaagggactgctggagatgcacttatagaaggaagtgtggaagaaggagccgagtatactagtcacaataacatgcagttttcaacatttgacagggacgccgatcaatgggaagaaaactgcgccgaagtttatggaggaggatggtggtataataattgtcaggccgcaaacttaaacggaatatattaccctggaggatcttatgatccacgaaacaatagtccttacgaaatagaaaatggggtggtgtgggttagttttaggggagccgattactcacttagagctgttcgcatgaagataagaccactggtgacacag

SEQ ID NO: 11153 - DNA, 2598 bp, Artificial Sequence
  Description of Artificial Sequence: Synthetic coding sequence
atgttttccatgagaattgtttgtcttgtgctcagcgtggtcggcacagcctggacggccgatagtggtgagggggacttcttggctgaaggtggcggcgtgcggggaccgcgagtcgtcgaacggcaccagtcagcctgcaaggattctgactggcccttttgctccgacgaggactggaactacaaatgtccaagtggctgtcgcatgaagggcctcatagacgaggtgaaccaggattttaccaatcgcattaacaagctgaagaacagtctctttgagtatcagaaaaataataaagactcccattccctgactactaacattatggaaatccttcgcggtgacttttcctcggccaataacagagataatacgtacaatcgggtttcagaggatctccgctccaggatagaggtgttaaagcgaaaagtaattgagaaggtccagcacattcaactgttgcaaaagaacgtgagggcccagctcgtggatatgaaaagactggaagtggatattgacattaaaattaggagttgccgaggaagctgcagcagggccctggcacgagaagtagacttgaaggactatgaggaccaacaaaagcagcttgagcaggtcatcgcaaaggatctgcttccctcacgggatagacagcatctgcccttgattaagatgaagcctgtccccgatctcgttccagggaatttcaagtctcaactccagaaagttcccccagagtggaaagctttgacagatatgccccagatgagaatggaacttgagcggcccggaggcaacgagatcactaggggaggcagcaccagttatggcactggctcagagaccgagagcccacgcaatccctcatctgccggaagttggaactctggttccagcggcccggggagcactgggaatcgaaatccagggtcttctggaacagggggtacggctacttggaaaccaggatcctctggtcctgggagcacggggtcctggaactcaggctcttcggggaccggaagcacaggaaatcagaacccagggtcccctcgtccaggatctacaggcacatggaacccaggatcctccgagcgaggaagcgcaggtcattggacttcggaatctagcgtttcaggctccacagggcagtggcacagcgaatcaggctcgttcagacccgactcccctgggagcggcaacgcgcggccgaacaaccctgactggggaacattcgaggaagtttctggtaacgttagtccggggaccagaagagagtatcacaccgagaagctggtgacatctaaaggcgataaggaattgaggactggaaaggaaaaggtgacatcaggcagtactacgacaacgagaaggagttgttctaagacggtgaccaaaactgtcatcggccctgatgggcacaaggaggtaaccaaagaggtagtgacgagtgaggatggatccgactgcccagaggcaatggatcttgggacactctctggaatcggcacactcgacggatttaggcaccggcaccctgatgaagctgcctttttcgatactgcaagtactggaaagacttttccaggcttcttttctcccatgctgggcgagtttgtgtcagaaacagagagccgtgggtcagaaagtggcatcttcacaaatacgaaagagagttctagtcaccacccgggaatcgcagagttcccttcccggggtaagtcatccagttatagcaagcaattcacgtccagcacctcttataatcgtggtgactcaacgttcgagtccaagtcctataagatggcagatgaggccggtagcgaagctgatcatgaaggaacccacagcacaaaaagaggtcatgcaaagagtagaccagtacgggattgcgacgacgtactccagacccacccatctggcacgcaatcggggatctttaacataaagcttcccgggagtagtaagattttctctgtatattgcgaccaggaaacaagtctgggcggctggctcttgatccaacagcggatggacgggtctctaaattttaacagaacgtggcaggactacaagcggggctttggttccctgaatgacgagggggagggtgagttttggttgggcaacgactatttacacctgttgactcagaggggcagcgttcttcgtgtggaactggaggattgggccggaaacgaggcatacgccgagtatcatttcagagtcggctctgaagccgagggttacgccctgcaggtctctagttacgaaggaaccgctggagacgccctcattgagggcagcgtggaggagggcgctgagtatacaagtcataacaatatgcaatttagcactttcgaccgggacgccgatcagtgggaggaaaattgcgctgaggtgtacggtggtggatggtggtataataactgtcaggctgccaatcttaacgggatatactacccaggtggatcctatgacccgcgcaacaacagcccttatgaaattgaaaacggagtagtatgggtgagcttccggggtgccgactatagtttgagggcggtgaggatgaagatccgtccgctggtaacccag

SEQ ID NO: 11154 - DNA, 2598 bp, Artificial Sequence
  Description of Artificial Sequence: Synthetic coding sequence
atgttctctatgcgtattgtctgcctggtcctttcggtcgtcggcaccgcctggaccgcggactccggcgagggtgattttctcgcagagggcggaggtgtcagaggcccccgtgtcgtcgagcgtcatcagtcagcctgcaaggacagcgattggcctttctgctcggacgaggactggaactataagtgcccttccggatgccggatgaagggtcttattgacgaggtcaatcaggactttaccaatcgtatcaacaagctaaaaaactccctgtttgagtaccaaaaaaacaacaaggattctcacagtcttacaacgaacatcatggagattctgcgaggcgacttctcgagcgccaacaaccgtgacaatacgtacaaccgagtgagcgaggacctgcgatctagaattgaggtcctgaagcgcaaggtcatcgagaaggtgcaacatatccaacttctgcagaagaacgtccgcgcgcagttggtcgacatgaagagactagaagtcgacattgacatcaaaatacgctcttgccgcggctcttgctcccgcgcattggcgcgtgaggtcgacttgaaggattatgaggatcagcagaagcaattggaacaagtcatcgccaaggacctgctccccagccgtgatcgccagcatctccctttgattaagatgaagcccgtccccgatttggttccgggtaactttaagagccagttgcagaaggtgcccccagaatggaaagccctgaccgacatgcctcagatgcgcatggagttggaacgcccagggggcaacgaaatcacccgtggcggctccacgtcctacgggacgggctccgagacggagagcccgcggaacccgtcctccgcgggaagctggaactcaggctcgagcggtccgggttccaccggcaaccgcaaccctggctccagtggcaccggcggcactgcaacctggaagcccggttcctctggtcctggaagtacggggagctggaactctggttcttccggcaccggttcgaccggtaatcagaaccccggctcgcctcgtcccggcagcacaggtacttggaaccccggttcatctgagcgagggtctgctggccactggacttccgaatcctccgtttcgggtagcactggccagtggcacagcgagtcgggtagtttccgccccgattcccctggatccggaaacgcccgccccaataacccagactggggaaccttcgaagaggtctcgggaaacgtcagtccgggaacccgacgtgagtaccatactgagaagcttgtgaccagtaagggagacaaggagctccggaccggtaaggaaaaggtgacctcaggtagcaccacgacgacgcgaaggtcgtgcagcaagaccgtgacgaagaccgtcatcgggcccgatggccacaaagaggtcaccaaggaggtcgtcacttcagaggatggcagtgattgccccgaggcaatggatcttgggaccctgagcggtatcggtaccctcgatggcttccgacacagacatcccgatgaagctgcttttttcgatactgcatccacgggcaagacgtttccaggtttcttcagccccatgcttggtgaatttgtttccgagacggaatcgcgcggttcagaatctggcatcttcactaacaccaaagagagttccagtcaccatcctgggattgccgagtttccctcccgtggaaaaagcagcagttactccaagcagttcactagttctaccagctataaccgcggcgacagtaccttcgaatccaagtcctacaaaatggcggatgaggccggaagcgaggccgatcacgaaggtacccactccaccaagcgcggtcatgcgaagtcgcgaccggtgcgagactgcgatgacgtccttcagacccatcccagtggtacccagtcgggaattttcaatatcaagctccctggaagttccaagatctttagcgtctactgcgaccaggagactagcctaggcggctggctgctcatccagcaacgtatggacggttcgctgaacttcaaccgcacttggcaggactacaagcgcggttttggttctctgaatgacgagggcgaaggtgagttctggctggggaacgattacctgcatctcctcacccagagaggctctgtgctccgcgtggagcttgaggactgggccggcaacgaggcatatgccgagtaccatttccgcgtcggaagtgaggctgagggttatgctctccaggtcagctcctatgaaggtaccgctggtgacgcactgatcgagggttccgtggaagagggggctgagtacacctcgcacaacaacatgcagttttcgacgtttgatagagacgcggaccaatgggaagaaaactgcgccgaagtctacggtggcggttggtggtacaataactgccaagcggcaaacctcaatggcatttattaccccggtggcagctatgaccccagaaataactccccctacgagatcgagaacggagttgtttgggtcagtttccgtggagctgactactccttgcgggccgtccgcatgaagatcaggcccctcgtcactcag

SEQ ID NO: 11155 - DNA, 2598 bp, Artificial Sequence
  Description of Artificial Sequence: Synthetic coding sequence
atgttcagcatgaggatcgtgtgcctcgtgttgtctgtggtgggcacagcctggaccgcagattctggagaaggcgacttccttgcggaggggggcggggtgagaggacccagagtggtggaaaggcaccaatccgcttgcaaggattccgattggcccttctgttctgacgaagattggaattataagtgccctagtgggtgccgaatgaagggccttatcgatgaggtcaatcaggacttcactaatcggataaataaactgaagaactcactgttcgagtatcagaagaacaacaaagacagccacagtctgacgactaacatcatggagatcctgagaggcgatttcagctccgccaataacagagacaacacctacaacagagtgtccgaagacctgagaagccggattgaagttctgaaacggaaagtgattgagaaagtgcaacacatccagctgctccagaagaacgtcagggcacagcttgtggacatgaaaaggctcgaagtagacatcgatatcaaaattcgcagctgcagagggagctgtagtagagccttggccagggaagtggatctgaaagattacgaagaccagcaaaaacagctcgaacaagtaattgcgaaggaccttctgccgtccagagatagacagcatctgccactgattaagatgaagccagtccccgatctcgtgccgggcaatttcaagagccaactgcaaaaagtgccaccggaatggaaggctctgaccgatatgccccagatgcgcatggagctcgaacgcccggggggtaatgagattactagaggcggcagtacctcctatggaacgggctcagaaaccgagtccccgaggaatccgtcatccgcaggaagctggaatagcggaagtagcggaccgggctccacagggaacaggaaccccggctcatctgggacaggtggaaccgccacatggaagccgggctcctccgggccaggatctactgggtcctggaactccggatcctccggtactgggagcacagggaatcaaaacccggggtctccgagacctggctccactggaacctggaatccaggaagttccgagcgggggagtgcggggcattggaccagtgagtcctctgtgagtggttcaaccggccagtggcactcagaatctggcagctttcggccagactctcctgggtctggcaacgcccgacccaataaccctgactggggcacttttgaagaggtctccggaaacgttagcccaggcactaggagggaatatcacaccgagaagcttgtcaccagcaagggcgataaagagctgaggacagggaaggaaaaggtgacatctggctccactacaacaactcgacggagctgttcaaagaccgtgacgaagacggtgatcggccccgacggtcacaaagaggtcacgaaggaagtggtgacaagtgaggatggttctgattgtccggaggcaatggacctgggaaccctctctggcatcggcaccctggacggatttcgacatcggcaccctgacgaagcggcctttttcgataccgcatccaccggaaagacttttcccgggttcttctcccccatgctgggcgaattcgtttcagaaactgaaagtcgaggaagcgagtccggtatcttcaccaacacaaaggaaagctcaagtcaccatccgggaatcgccgagtttccctcaaggggtaagagtagttcctattccaaacagtttacctcctccacttcatataatagaggagattcaacctttgagtctaagtcctacaagatggccgacgaagccggctctgaagccgatcacgaggggacgcactctactaaacgaggccacgcaaagtctcgcccagtacgcgactgcgatgacgtgctgcagacacatcccagcggcactcagagcggcatcttcaacatcaagctgccggggtcatctaagattttcagtgtgtattgcgaccaggaaacgtctctcgggggatggctccttattcagcagaggatggacggaagcctcaattttaataggacgtggcaagactacaagcgcggatttggtagcttgaacgatgagggcgagggagaattttggctgggaaatgattatctccacctcctgacccaacggggatctgttctccgggtggagctggaagattgggctggaaatgaagcttatgctgaatatcacttccgggttgggagtgaggcagaaggctatgcgctgcaggtgtcttcatatgaggggacagcaggtgacgctctgatcgagggaagcgtggaagaaggcgccgaatataccagtcacaataacatgcagttcagtaccttcgacagagacgcagaccaatgggaggagaactgcgcagaggtgtacgggggtggttggtggtacaacaactgccaggccgcaaatcttaacggtatctactacccaggtggttcatacgatccgagaaacaattccccctatgagattgaaaatggagtggtctgggtgagcttccggggcgccgactacagcctgcgagccgtgaggatgaaaatccgaccgctcgttactcag

SEQ ID NO: 11156 - DNA, 2598 bp, Artificial Sequence
  Description of Artificial Sequence: Synthetic coding sequence
atgttcagtatgaggatcgtgtgcctagtcctgtccgtcgtggggacagcatggaccgctgattccggggaaggcgacttcctggctgaaggcggcggggttcggggtccacgcgttgtggagcgacaccagtccgcttgcaaggacagtgactggcctttttgctcggacgaggattggaactataagtgcccctctggttgccgcatgaaagggctaatcgacgaggtgaaccaggatttcactaaccgaatcaacaaattgaagaactctttattcgagtaccagaaaaacaataaagactcccacagtctgactactaatattatggagatcctgagaggtgacttttctagcgctaacaacagggacaacacctacaacagggtttctgaggacctacgctcacgcatagaagtgcttaaacgtaaagtaattgaaaaggtccaacacatccagcttcttcagaaaaatgtaagagcgcagctcgtggacatgaagagactggaggtggacatcgacattaagatccgctcctgccggggctcctgcagtcgggccctggccagggaggtggacctcaaagattatgaagaccagcagaaacagctcgagcaggtgatcgccaaggacctgttgccaagtcgcgacaggcagcacctcccactcatcaaaatgaagccagtgccagacttggtgcctgggaacttcaagtctcagctgcagaaagtgcccccagaatggaaagccctgaccgacatgccccagatgaggatggagctcgagagaccaggggggaacgagattacacgcggcggttccacaagttatggcaccggatccgaaactgaatccccacgcaacccgtcctcagctggcagctggaactccggaagcagtggacccgggtccacaggtaatcggaatccgggatcaagcggaaccgggggaactgccacctggaaacctggctcatctggtcctggcagcaccggaagttggaatagcggctctagtggtactggctccacgggcaatcagaatcccgggtcccccaggccaggctccacgggtacctggaacccaggttcctccgaacgggggtccgccgggcattggactagcgagagttcagtcagtgggtccactggacagtggcattcagaaagcgggtcttttagacccgactccccaggctccggcaacgcgcgtccaaataaccccgactggggaacatttgaagaggttagcggaaacgtgagtcctggcacgaggagagaatatcacactgagaagctagtcacctctaaaggggacaaggagttacgcacagggaaagagaaagtgactagcgggtcaaccacaaccacccgacgtagctgctctaagactgtgaccaagaccgtgataggaccagatgggcacaaagaggttaccaaggaggtcgtgacatccgaagacggaagtgattgccccgaggccatggaccttggcaccctctccggtatcggcacactggatggcttccgacacaggcacccggacgaggccgcttttttcgacaccgctagcactggaaagaccttccccgggttcttttcccccatgctgggcgaattcgtgtctgaaaccgagtcccgaggatcagagtctggcatttttacgaatactaaggagagtagcagccaccacccaggaatagctgagtttccttcgcggggcaagagttcgagctactcgaagcagtttactagcagcactagctacaataggggcgacagcaccttcgaaagtaagtcttacaagatggctgatgaggccgggagtgaggctgaccacgagggaacacactctacgaagcgagggcacgcaaagtcgcgccccgtgagagactgcgatgacgtgctgcagactcatccaagcggtacgcagtccgggattttcaacattaaactcccgggctcctcaaagatcttcagcgtgtactgtgatcaagagacctctctgggcggctggctgctgatccagcagcgcatggatgggagcctaaatttcaaccgaacctggcaggattacaaaaggggttttggcagccttaacgatgaaggcgagggtgagttctggctggggaatgattaccttcacctgctgactcagcgcggctccgtgcttcgagtggagctcgaggattgggccgggaacgaggcctatgctgagtatcattttagagtcgggagtgaagctgagggttacgccctgcaggtctcttcgtacgagggtaccgccggggatgcacttatcgaaggatcagtggaagagggggcagaatacactagccacaacaacatgcaattcagtacattcgacagggatgctgatcaatgggaggagaattgcgctgaggtttatgggggcggctggtggtacaacaattgtcaggcagcgaacctgaacggcatttactaccctggcggttcctacgatccccgtaataacagtccgtatgagattgaaaacggtgtcgtctgggtgtctttcaggggagccgactattccctgagagccgtccggatgaagataagacccttagtcacacag

SEQ ID NO: 11157 - DNA, 2598 bp, Artificial Sequence
  Description of Artificial Sequence: Synthetic coding sequence
atgttttcgatgcgtattgtctgcctcgtcctttcagtagtcgggacagcgtggacagcggacagcggtgaaggggactttctggctgaaggcggaggagtccgcggcccccgagttgtcgagcggcaccagagcgcctgtaaagactctgattggcctttttgctccgatgaggattggaactataaatgtcctagcggctgtaggatgaagggcctcattgatgaagtaaaccaggatttcaccaacaggattaataaactgaaaaatagtctctttgagtaccaaaaaaacaataaagattcccactcactgaccacgaacatcatggagattctgcggggcgatttctcgtccgcgaacaatcgagacaacacatataacagagtctctgaagacctgcgcagtcgtatagaagtccttaagcgcaaagtaattgagaaggtgcagcacatccagctactgcaaaagaatgtccgagctcagctggtggacatgaaacgcctcgaggtggatatcgacatcaaaattcgttcctgtcgtggatcctgttcaagggcgctggcgagggaagtcgacttaaaggactacgaggaccaacagaagcaactggagcaggttatcgctaaggatctccttccatctcgagaccgccaacacctacccctgattaaaatgaaaccggtgccagatctggtaccaggcaattttaaatcccagttgcagaaagtacccccagagtggaaggcccttacagacatgccgcagatgcggatggagttggaaagacctggtggtaacgagatcacacgaggaggaagcacctcttatggaacgggctcagagactgaatcaccccgcaatccatccagcgccggcagctggaacagcggctcaagtggccctggttccacaggaaaccgtaatcctggttccagtggcaccggtggcaccgccacttggaagccagggtccagcggccccggaagcaccgggtcttggaattctggatcctcaggaaccggcagcacaggcaaccagaatcctgggtccccgagaccgggttcaacaggaacctggaaccctggttccagcgaacgtggatcagcaggtcactggacctcagagagttccgtcagcggtagcaccgggcagtggcactctgaatccggctcatttagacccgacagcccaggcagcggcaatgccagaccaaataaccccgattggggtacgttcgaggaagtaagtgggaacgtttcacctggcacacgccgggagtatcacaccgagaaacttgttacgtccaaaggcgataaggaactacgcacaggcaaggaaaaagtgacaagcggaagcaccaccacaactaggcggagctgttccaagacggtcactaagaccgtgataggccctgacgggcataaagaggtcacaaaggaagtggtgacaagtgaagatgggtcagattgtccagaggctatggacctgggcaccctgtcaggcatcggcactctggacggatttcgccaccgccaccccgacgaggctgccttctttgacacagcctcaactggtaagaccttccccggatttttttcccctatgctcggcgagttcgtgagcgagaccgaaagccgaggcagcgagtccggaatctttacaaatacaaaagaatccagttcccaccaccctggtattgcagagttccctagtagggggaagagcagctcgtattcaaaacagttcacgtcctctacttcttacaaccgcggagattcaacctttgagtcaaaatcctacaaaatggccgacgaggctgggtccgaagccgaccacgaggggacccactccaccaaaagggggcacgcgaagtccaggcccgtacgggactgcgacgacgtcctccaaactcatccgagcgggacccagtctgggatatttaatatcaagctaccaggaagcagcaagatcttcagcgtatattgtgatcaggagacaagcctgggtggctggcttctgattcagcagcgcatggatggatctctgaatttcaacagaacctggcaggactacaagcgggggttcgggagcttgaatgatgagggcgaaggtgaattctggttgggaaatgattatctgcatttgctgacacagcgaggttccgtgcttcgcgtggagttggaagactgggctgggaacgaggcgtatgcagagtatcattttcgggtgggctccgaggctgagggttacgctctgcaagtctcttcttacgagggaaccgcaggggatgccttgattgagggctctgtggaggagggcgccgaatacacctcccacaataacatgcagttctctacctttgaccgggacgcagaccaatgggaggaaaattgcgccgaagtttatggtggcggttggtggtataacaactgccaggcggctaacctaaatggcatctattaccccggaggaagctatgatccgagaaataattctccttacgagatagagaacggcgtcgtttgggtctcctttcgaggcgcagactactcgcttagggccgtcaggatgaaaatccgaccccttgtgacacag

SEQ ID NO: 11158 - DNA, 2598 bp, Artificial Sequence
  Description of Artificial Sequence: Synthetic coding sequence
atgttctccatgcggatcgtgtgtcttgtgcttagcgtggttggaaccgcatggacagcagactcgggagagggagactttctagctgaaggtggaggagttcgtggaccacgagttgtagagcgacatcagtcggcttgtaaagattcagactggccattttgctctgacgaagattggaactataaatgtcctagcggttgtaggatgaaagggctcatagatgaagttaatcaagactttacaaaccgaatcaacaagttaaaaaattcactgtttgagtaccagaagaataataaagattcacattccctcacaactaacattatggaaatattgaggggagatttctcctccgctaacaatcgagacaatacatacaacagagtgtccgaagatctcagatcacgaatcgaagtgctaaagagaaaagtgattgaaaaagttcaacatattcaacttctccaaaaaaatgtacgagctcaacttgttgatatgaagagacttgaagtcgacatagatattaaaattagatcttgtcgtggctcatgctcacgtgcacttgcaagagaggtcgatctcaaagactacgaggatcagcaaaagcaacttgaacaggttattgctaaagacctgctgccgtcacgtgatcgtcaacatttgcctttgatcaaaatgaaacctgttccagaccttgtaccgggtaattttaaatcacagttgcaaaaagtcccaccagagtggaaggctttaacagatatgcctcaaatgcgaatggaactcgagaggcctggtggaaacgaaataactagaggaggaagcacctcatatggaactggatcagaaactgagtctccacgtaatccgtcatcagccggttcatggaatagcggctcgtcaggcccaggatcgacaggtaacagaaatccaggatcatctggaaccggaggcacagccacgtggaagccaggatctagtggaccgggttccacaggatcctggaactcaggatcatcgggaactggcagtacaggaaaccaaaacccaggaagcccacgtcccggatccaccggaacttggaatccgggctcttcggagcgtggatcagccggacattggacgtcagaatcgtcggttagtggatccacaggtcagtggcattcagaatctggatcttttcgaccagactcacccggatccgggaatgctcggccaaataatcctgactggggaacttttgaagaagtgagcggaaacgtttccccaggaacgagacgtgaatatcataccgaaaagcttgttacgtcaaagggagataaagaactgagaactggaaaagaaaaggttacgtcgggatcaacgaccacaacgcgtcgttcttgcagtaagacagttaccaagacagtcattggaccggacggacacaaggaggttaccaaagaggttgtcacatcggaagatggaagtgattgtccagaagctatggacttagggactctctccggaattggaactctagacggcttccgtcaccgtcacccggatgaagctgcatttttcgatacagcctctacgggaaaaacttttccaggatttttctctccaatgctcggagaattcgtttctgagacagaatcgcgtggctcagagtctggaatttttactaataccaaagaatcctcgagtcaccacccaggaatagcggaatttccatcgcgtggaaaaagttcatcctattctaagcaattcacaagttcaacctcgtacaatcgaggagattcaacgtttgaatcaaaaagctataaaatggctgatgaggcaggatccgaggctgaccatgagggcactcacagtactaagcgcggtcatgcaaagtcgcgcccagtgcgtgattgcgatgatgtcctacagacccacccaagcggaactcaatccggaatttttaacataaagctcccagggtctagcaagattttttcagtatattgcgatcaagagacctctcttggaggatggctactcatacagcagcgaatggacggatcactaaactttaatcggacttggcaagattataagaggggatttggaagtctcaacgatgaaggagaaggagaattctggcttgggaatgattatcttcatctgctaactcaaagagggagcgttctgagagtggaattagaagattgggctggaaacgaggcttatgcagagtaccatttcagagttggaagtgaagctgaaggttatgctctacaggtatcctcatatgagggaacggctggagatgcattgattgaaggatccgttgaagaaggtgctgaatacacgtcacacaataatatgcagttcagcacgtttgacagagatgcagatcaatgggaggaaaattgcgcggaagtgtacggaggaggatggtggtataataactgccaagctgctaatctaaacggaatttactatcctggaggaagttacgacccaagaaataactctccttatgaaatcgagaatggggtcgtgtgggtgtctttccgcggtgctgattattcattgagagctgtacgtatgaagatcagacctttagttactcag

SEQ ID NO: 11159 - DNA, 2598 bp, Artificial Sequence
  Description of Artificial Sequence: Synthetic coding sequence
atgttcagtatgcgaattgtttgtctcgttttatctgtggtcggaactgcgtggacagccgatagcggcgagggggactttttagcggaaggaggcggagtacgcgggccgagggtcgttgaacgccatcagtcggcgtgtaaagactccgactggccgttttgttctgatgaagactggaattataaatgtccgagcggctgtagaatgaaagggctgatcgacgaggttaaccaagattttacaaaccgtattaacaaactgaagaattctttatttgagtaccaaaaaaacaacaaggatagccattcgctcacaactaacattatggaaatcttaaggggagacttctcttcggccaacaaccgcgataacacctataatagagttagcgaagatctgcgctcgaggatagaagtattaaagcgaaaagtaatcgaaaaagtgcagcatatccaattattgcaaaagaacgttcgtgcacaacttgtcgacatgaagcggctggaggtcgacattgatataaagatccggagctgtcgtggaagctgctcacgcgcactcgccagagaggtagacctgaaagattacgaagatcaacaaaaacagttagagcaggtcatcgctaaagaccttttgcctagcagagatcgccagcatctaccgttgattaaaatgaagcccgttcctgatcttgtgccgggaaactttaaatcacaactgcagaaagtccctccagaatggaaagcacttactgatatgcctcaaatgcgtatggaattagagcgacctgggggaaatgagattacacgaggaggctctacttcatacgggacaggaagtgagacagaaagtccgagaaatccgtctagcgctggatcatggaattccggatcttctggcccgggctcaactggaaatagaaaccctgggagcagcggcacagggggcaccgctacatggaagccaggctcatctggcccgggctctacgggatcatggaattccggatcatccggcaccggaagcacaggaaaccagaatcctggttctcctcggcctgggtcaactgggacgtggaaccccggttcaagcgaacgagggtctgccggacactggacaagcgaatcatcagtgtctggctctacaggacaatggcattccgaatcaggatcatttaggccggatagcccgggcagcggtaacgcgcggcctaataatccggattgggggacctttgaagaggtttcaggtaacgtttcaccgggtacgcgcagagagtatcatacagaaaagttagtgacaagtaaaggagacaaagagcttcggacggggaaagagaaagtcacatcaggaagtacgaccacgacgaggaggtcgtgttctaaaactgtgacgaaaacagtcattgggcctgatgggcacaaggaggttacaaaggaagttgtcacgtctgaggacggctctgactgtccggaagcaatggatttaggcacactgtctggcattggtacgctggatggattcagacacagacatcctgatgaagcggcattcttcgacacggcatccacaggtaaaacgtttccgggattcttttcaccgatgctgggagaatttgtttcagagacagaatcacgtggctctgaaagcggaatctttacgaatacaaaagaatcctcctcacatcatccaggtatagccgagtttccgagccgcggcaaaagctcaagctattccaaacaatttacgtcatcaacgagctataacagaggggactcaacatttgagagcaaatcttataaaatggcggacgaggcgggtagcgaggcagaccacgagggtacgcatagcacgaaacgcggtcatgcgaagtctagaccagtcagagattgtgatgatgttttacagacacacccatccggaacccagagtggtatttttaatattaaactgccaggcagcagcaaaattttttctgtctattgcgatcaggagacctctttgggaggttggcttctaattcaacaaagaatggatggcagcttaaattttaacaggacatggcaagattataagaggggttttggtagccttaacgacgaaggtgaaggcgagttttggttgggcaatgactatcttcatttgctgacgcaaagaggcagtgtcctacgagttgaactggaggattgggctggcaatgaggcctatgccgaatatcattttcgcgtaggctcagaagccgaaggatatgcccttcaagtttcatcttatgagggcaccgcaggagacgcgttgattgaagggtctgtagaggaaggggcagaatacacatcgcataataatatgcagttctctacatttgatcgtgatgcagatcaatgggaagagaattgcgctgaggtttatggtggcggctggtggtacaacaattgccaagccgcaaatttgaatggaatctattatccgggtggatcctatgacccaagaaataatagcccatatgaaatcgaaaatggggtagtctgggtcagctttcgaggcgcagattattctcttcgggcagttaggatgaaaattcgccctttagtaacccaa

SEQ ID NO: 11160 - DNA, 2598 bp, Artificial Sequence
  Description of Artificial Sequence: Synthetic coding sequence
atgttctcaatgcggatcgtgtgtctggtgttgagtgtggtgggcacagcctggaccgctgatagtggcgagggcgattttctcgctgagggcggaggcgtgagaggcccaagggtcgttgaaaggcaccagtccgcctgcaaggactctgattggccattctgttcggacgaggactggaactacaagtgtcctagcggctgtcgaatgaagggactgatcgatgaggtgaaccaggatttcaccaaccggatcaacaaactgaagaatagcttattcgagtaccagaagaacaataaggactcccactcactcactaccaatattatggagatactccggggtgattttagttccgcgaataacagagacaacacctacaatcgggtgtcggaggacctgaggagtcgaatcgaagtgttaaagcgcaaggtgatagagaaagttcagcatattcaactgttgcagaagaatgtccgcgcgcaattggtggacatgaagcgacttgaggtggatatcgacattaagatcaggtcttgccgggggtcttgctctcgggcattggcccgagaggtggacctaaaagactatgaggatcaacagaagcagctggaacaagtcattgctaaggatttactgccgagcagggataggcagcatttacccctcatcaagatgaaacctgttcctgacctggtacccggtaacttcaagtcacagcttcaaaaggtgccccctgaatggaaggccttgacggacatgccacagatgagaatggagttggaacgaccaggtggcaacgagatcactaggggagggtcaacatcctatggcaccggcagcgagaccgaaagcccccgcaaccccagtagcgctgggtcttggaactctgggtcttcggggcctggatctaccggtaacaggaatcctggttcctccggcacgggcggcacagcaacatggaagcctgggagttccgggcccgggagtacaggcagctggaatagcggcagttcaggcaccggctctaccggtaaccagaaccccggatcaccacgcccaggatccacggggacttggaaccctggttccagcgaacgtggctccgctggacactggacctcggagtcttcagtgagcggttcaaccggacagtggcactcagagtctgggagctttaggccagattctccaggatctgggaatgcaaggcctaacaacccagattggggaacatttgaggaagtttccggcaacgtgtcgccaggcacgcgacgcgagtaccatactgaaaagctcgtgactagcaaaggcgacaaggagctcaggacaggcaaagaaaaggttacaagcggaagcaccacaacgacccggcggtcttgctctaaaactgtgactaaaacagttattggaccagatggacataaggaggttaccaaagaagttgtcacaagcgaggacggctccgactgtcccgaggctatggacctgggcaccctgagcggcataggtacattggacgggttccgccacaggcacccagacgaggccgcctttttcgacacggcatccaccgggaagaccttcccagggtttttcagcccaatgctgggtgaattcgtctctgagactgagagtagagggtccgaaagcggaatctttacgaacactaaagagtcaagctcccatcatccggggattgctgagtttccatcaagaggtaaatcttcctcatacagcaagcagtttacctcttcgacatcatacaaccgcggggatagcacctttgaatctaagtcttataagatggctgatgaggcaggctccgaagcagatcatgaaggcacacacagtaccaagagggggcacgctaaatcaagaccagtgagagattgcgatgacgtgctgcagacgcatccttcagggacacagagtggcatattcaatatcaagctccctggctcatccaaaatcttcagtgtctactgtgaccaagagacttccttaggtggttggttactgatccaacagagaatggatggcagtctcaattttaaccgcacctggcaagactataagaggggctttgggtcgctgaacgatgagggtgagggggaattttggctcggcaatgattatctccaccttctcacccaaaggggcagtgtgctgagagtggagctggaagattgggccggtaacgaagcgtatgccgagtaccattttcgagtgggctcagaagccgaaggatatgcgttacaggtgtcttcctacgaggggacagccggggacgccctcatcgagggatcggtggaagagggcgcggagtatacaagccacaataacatgcaattcagcacctttgatagagacgccgaccagtgggaagaaaactgtgctgaggtttacggaggtggatggtggtacaacaactgtcaggcagcgaacttaaatggcatctactatcctgggggctcttatgacccaaggaataactccccttatgaaattgaaaatggagtagtgtgggtgtcttttcgcggcgcggattactctttgagagctgtgcggatgaagatccgacctctcgtaactcag

SEQ ID NO: 11161 - DNA, 2598 bp, Artificial Sequence
  Description of Artificial Sequence: Synthetic coding sequence
atgttctccatgcggattgtctgcttagttctgtccgtagtgggaaccgcttggacagctgactctggtgaaggcgatttcttagcggagggcggcggcgtacgtggaccgcgggtggtggagagacatcaatcagcatgcaaggactcagactggcctttctgctcagatgaagattggaattacaaatgtcctagcgggtgcaggatgaaggggcttattgatgaggtgaatcaggacttcaccaaccggatcaataagctaaagaattctctgttcgagtatcaaaagaacaataaagactcacatagtttgacgacaaatatcatggaaattctcagaggcgacttctcatccgcaaataatcgggataacacatacaaccgcgtgtcagaagatttgcgctctaggattgaagtgcttaaacgtaaagtaatcgagaaagtgcagcatatccagctgctgcagaagaatgtgagagcccaactagtcgatatgaagaggctggaggtggatattgatatcaagattcggagttgtcggggttcttgcagcagagctctggctagggaggttgatctaaaagactacgaggaccagcaaaagcagctcgaacaggtgatcgcaaaggaccttttgccgagtcgggataggcagcatttacctttgatcaaaatgaagccggttcccgaccttgtgccggggaatttcaagtctcagctgcagaaggtcccaccagagtggaaagccctgaccgacatgccccagatgagaatggaactggaaaggcctggggggaacgagataaccagaggcggtagcacttcatacgggactggaagtgagacagagtcaccacgcaatccttcttccgccgggtcgtggaactctggatcctcaggacccggttccaccggaaatcgcaatccaggttcaagtggcaccggcggcactgctacctggaagcctggaagtagcggaccagggagcactgggtcctggaactccggaagctcaggaacaggttcaaccgggaaccagaatcctggaagtcccaggccgggttcaactggcacttggaatccgggctcctccgagcggggttcagccggacattggacttccgagagcagcgtaagtggttctacagggcagtggcatagcgagtccggatcattccgacccgatagccccggaagcggaaacgctcgcccaaacaaccctgattggggtacattcgaggaagtctcgggtaacgtgtcacccggaacacggcgtgaataccacacggagaaactagtaacgtcaaagggagacaaagagctcagaactggtaaggagaaagtcacgtcgggctctactacaacgactcgaagatcttgctccaaaaccgtgaccaaaactgtgatagggccggacggacacaaggaagtgactaaggaggtagtgacctccgaggacggatctgattgccccgaggcaatggatctgggtacattaagcggcatcgggacactggatgggtttcgacatagacatcccgacgaggctgcctttttcgacactgcgagcactggaaagacctttccggggtttttttccccaatgttgggtgagttcgtcagtgagacggagagtcggggttctgagtcaggtatctttacaaataccaaggagtcctcctcccaccaccccggcatcgccgaattccccagcaggggaaagagctccagctattcaaaacagttcacatccagtacttcctacaaccggggtgattctacttttgaaagcaaatcatacaaaatggccgatgaagccggcagtgaggccgaccacgagggtactcattctaccaaacgcggtcacgctaaaagtaggccagtgcgcgattgcgatgacgtcctgcagacgcacccctcaggaacccaatccggcatctttaacatcaagcttccgggcagtagcaagatcttctctgtttactgcgatcaggagacatctctgggagggtggctactgatccagcaaagaatggacgggtctctcaattttaataggacttggcaggattacaaacgcggctttggttcactcaatgatgagggggagggggagttttggttgggaaacgactatcttcacctgttgacccagaggggatccgtgcttcgggttgaactcgaagactgggcgggaaacgaggcttatgccgagtaccactttcgggtgggttctgaagccgagggctacgctttgcaggtctcaagttacgaaggaacagccggtgatgcactaattgaggggtcggtcgaagagggagctgagtatacaagccacaacaatatgcagttcagcacgtttgatcgggatgccgatcagtgggaggaaaattgtgccgaggtctacgggggaggttggtggtataataactgtcaggcggctaacttgaacggaatctactacccagggggcagctatgatccgaggaacaatagcccatatgaaattgagaatggcgtcgtgtgggtctcctttcgcggtgcagactacagcctgcgtgcagtcagaatgaagattagacctcttgtaactcag

SEQ ID NO: 11162 - DNA, 2598 bp, Artificial Sequence
  Description of Artificial Sequence: Synthetic coding sequence
atgttctcaatgcgcattgtgtgcctagttctgagcgtagttggtacggcttggacggccgactccggggagggcgactttctcgcggaaggcggcggcgtccgtggcccccgtgtggtggagcgacatcagagtgcctgtaaggacagcgattggccgttttgctcagatgaggactggaattacaaatgtccatcagggtgcagaatgaaaggcctgattgacgaggtcaatcaggacttcacaaatagaattaacaaactcaagaatagtctgtttgaatatcaaaagaataacaaggattcccactctctcactacaaacattatggaaatcctcaggggcgattttagtagcgctaacaaccgggacaacacctacaaccgtgtcagtgaggatctcagatctaggattgaggttttgaagaggaaggtgattgaaaaagtgcagcacatccaattgttgcagaagaatgtacgggcacaattagtggacatgaagagactggaggtggacattgatatcaagattaggtcatgtaggggtagctgtagccgggctctggctagagaagtggatctgaaggactatgaagatcaacagaagcagttggaacaagtcatagcaaaggaccttctgccatcacgagaccgtcagcatctcccactgattaagatgaaacctgtccctgatctcgtgcctggcaactttaagtcacagctgcaaaaagtgcccccagaatggaaggccctaactgatatgccccagatgagaatggagctcgagagacctggaggtaatgaaataactagggggggcagcacgagttacgggactgggagcgagacagaatcccccaggaatccctcttctgcaggttcctggaacagcggtagctctggacctggatctactggcaatcgtaacccggggagctcagggaccggggggactgccacatggaagcccgggtcgagcggacctgggtcgactgggtcttggaactccgggagctctggaaccgggagtacaggaaaccagaaccccggcagcccccggccaggaagcactggcacttggaacccgggctcaagcgagcgggggtctgcgggacactggacttcagaatcttccgtttccggatccactgggcaatggcacagtgaatccggaagcttcagacctgactcgcctggcagtggaaacgctagacctaataatccggattgggggacattcgaggaggtgagtggcaatgttagtcccggcaccaggcgggaataccacaccgagaaactagtaacctctaaaggcgacaaggaattaagaacgggcaaagaaaaggtaaccagtggcagtactacaactacacggagaagttgtagcaaaacagttactaagaccgtgataggaccggacgggcacaaagaagtgactaaggaggtcgtcacttccgaggatggctctgattgcccagaagcgatggacctggggacactttccggaatcggcacactggatgggtttaggcaccggcacccagacgaggccgccttctttgacacggcgtcgacgggcaagacatttcccggattcttctccccaatgctgggggagttcgtgtcagaaacggaatcccgcggatcagagtcggggatcttcaccaacactaaagagtccagcagccaccaccccggaattgctgagttcccctctcgaggtaagtcttcatcatactctaaacagttcacatctagtaccagttacaatcgaggcgattccacttttgaaagtaagtcatacaagatggcagacgaagccggctcagaggcagaccatgaggggacccatagcaccaaaaggggccatgccaagtcacgaccagttcgggattgtgacgatgtgttacagacgcatccatctggcacacagagcggcatctttaatataaaattacctgggtcatctaagatctttagtgtctactgtgatcaggaaacttctcttggcggttggttgttaatccagcaacgtatggatggcagcctgaactttaatcgaacgtggcaggactacaaaagagggttcggttctctaaacgacgaaggcgagggcgagttttggctggggaacgattatcttcatctgcttacacagagagggtccgtgctgcgcgtagagctggaagactgggcgggtaacgaggcctacgcagaataccattttagggtgggctctgaggccgagggttatgccctgcaggtgagctcgtacgagggcactgccggcgatgcactcatcgagggctcggtggaggaaggggcagaatatacaagtcataacaacatgcagttttccacgttcgaccgagatgcagaccagtgggaggagaactgcgctgaggtctacggaggaggctggtggtataacaattgccaggccgcgaacctgaatgggatctactacccaggaggatcctatgatcccagaaacaacagtccttacgaaatcgagaacggtgtggtctgggtgtcatttcgaggagccgattacagcctgagggccgtcagaatgaagattcgcccactcgtaacacag

SEQ ID NO: 11163 - DNA, 2598 bp, Artificial Sequence
  Description of Artificial Sequence: Synthetic coding sequence
atgttttcaatgagaatcgtgtgtctcgtcctctccgttgtaggtactgcatggaccgcagactcaggcgaaggtgacttcttagctgaaggcggaggcgtgcggggacccagggtggttgaacgccaccaatctgcttgtaaagacagcgactggcctttttgttcagatgaagattggaactataaatgtccgtctggctgcaggatgaagggcctgatagatgaggttaatcaagactttacgaaccgtatcaacaaactgaagaactccctgttcgagtaccaaaaaaataataaagactctcatagccttaccacaaacattatggaaattctccggggcgactttagctctgctaacaaccgagacaatacgtataaccgagtcagtgaggatctgaggagtaggatcgaggtgctgaagaggaaggtaattgagaaggtacaacatatccagctgctccagaaaaacgtgagggcccaattggtggatatgaagaggctggaagtggacattgacatcaagatacgcagttgccgcggatcctgctctcgggcgctagccagagaggttgatttgaaagattatgaagaccagcagaagcagttagaacaagttatcgcaaaggacctccttccgagccgcgatcgtcagcacctgcctttaattaagatgaaacccgtgcccgacttggtccctggtaatttcaaatcccagctgcagaaggtgcccccagaatggaaggcactgaccgacatgcctcaaatgcgcatggagctcgagaggccagggggcaacgaaattacaagagggggcagtacatcttacgggacaggttcagagactgaaagccctcggaatcctagctccgccggttcctggaactcgggtagctccggccccgggagtactgggaatagaaacccgggttctagcggcacaggggggacagccacatggaagcctggaagcagtggccccgggagcaccggaagctggaattctggctccagcggtaccggctccacgggtaatcagaatcctggatcccccagaccaggctccactgggacttggaaccctggatcttccgagcggggatccgccggccattggacatcagagagctctgtgtcaggctcgacaggccaatggcactcagaatcgggctcctttcggccagattctccagggtcggggaacgcacgtcctaacaatcccgattgggggacatttgaagaagtcagtggaaatgtgagtccaggcacccgaagagagtaccatactgagaaattggttacctctaaaggggataaggagctccggacaggcaaggagaaggtaacatccggcagcactacgaccactaggcggtcttgtagcaaaacagtaacgaagaccgtcataggtccggatggtcacaaggaggttacaaaagaagttgtgacttcagaggatggtagcgactgcccggaggcaatggatctaggcacacttagcgggattggaaccctcgacggattcaggcaccggcaccctgacgaggcggctttcttcgataccgccagtaccgggaaaaccttccctgggtttttttcccccatgctgggcgagtttgtcagcgagaccgagagtcgcgggagtgagtccggaatctttacaaacaccaaggagtcgtcttcccatcatcctggtatcgctgagttccccagtagagggaagagctcaagctactccaagcagttcacttcctccacttcatacaaccgcggagattctacttttgagagtaaatcttacaagatggccgacgaggccggttccgaagcagatcatgagggcacccatagtacgaagagaggccacgcgaaaagccgccccgtgagagattgcgacgatgtgttgcagacccatccctctggtactcagtctggaatcttcaatatcaagttgccgggctcttccaaaatcttctctgtgtattgtgaccaggaaacttcactaggtggttggctgctgattcaacaacgtatggacggttccctaaactttaatcggacctggcaggactacaagcgcgggtttggctccctgaatgatgaaggagaaggcgagttctggctcgggaatgactacttgcacctgcttactcagagaggtagcgtcctgagggtcgaactggaagattgggctggaaacgaggcttacgccgagtatcacttccgcgtggggagcgaagccgaaggatacgccctccaagtgagctcctatgaaggaactgccggtgatgccttgattgaagggtcagtggaagagggagcagagtacacaagccacaacaacatgcaattctcaacattcgacagagatgccgaccagtgggaagaaaactgcgctgaggtatacggtggaggctggtggtacaacaactgccaggccgcaaatctgaatggaatctattaccccggcggctcctacgaccctcgaaacaacagcccttacgaaatcgaaaatggggtggtctgggtcagtttcaggggggcggactacagccttagagccgttcgcatgaagattcggcccttagtgacacaa

SEQ ID NO: 11164 - DNA, 2598 bp, Artificial Sequence
  Description of Artificial Sequence: Synthetic coding sequence
atgttttctatgcggatcgtgtgcctcgtcttgtcggtagtgggaaccgcttggaccgccgactccggggagggagacttcctcgccgagggcggcggcgttaggggcccaagggtagttgagcgtcatcaatccgcatgcaaggactctgactggcccttttgctctgatgaggactggaattacaaatgtccttcaggatgccgcatgaaagggcttatcgacgaggtcaaccaggacttcacaaataggattaataagctgaagaactcactgttcgaatatcagaaaaacaataaggactcccattctctgaccactaacatcatggaaattctgagaggcgacttttccagtgctaacaatagagacaatacatataacagggtgtcagaggatctgcgtagcaggattgaagtccttaagcgcaaagtaatcgagaaggtgcaacatatccaactgttgcaaaagaatgtgagagcgcaactggtagacatgaagcgactggaggtggatatcgacatcaaaatcaggtcatgcagaggctcctgttctagggcattagctagggaggtggacctgaaagactacgaggatcaacagaaacagctggaacaggttatcgccaaggatctactcccgtcaagagaccgacagcacctgcctctgatcaagatgaagccggtaccagacctcgtccctggcaattttaaatcacagctccagaaggtaccgcccgaatggaaggccctgaccgatatgccgcagatgcgaatggaacttgaaaggccaggaggcaatgagataacaaggggcggctccacaagttatgggacagggtccgagacagaatctccaagaaacccctcaagtgcaggatcttggaactccggctcatctggcccaggctctacagggaatcgaaaccccggctcctcgggcacaggcggaacggccacatggaagcccggtagttccggccccggctccaccggctcctggaatagcggatctagcggaaccggctcgacgggtaatcagaacccgggcagtcctagacctggctctaccggtacctggaaccccggatcgtcagaacgaggctccgctggccattggactagcgaaagctctgtgtcgggcagcacgggccaatggcactctgaaagcggttcctttaggccagattcaccaggatctggaaatgcaaggcccaacaacccagactggggcacatttgaggaagtctccggaaatgtgtcgcctgggaccaggagggagtatcacacggaaaaactggtgacatctaaaggagataaggaattgagaacgggaaaagaaaaggttacctctggatccacaaccaccactaggagatcctgtagcaagaccgtcactaaaaccgttataggccctgacggtcataaagaagtgaccaaggaagtcgtcacctctgaggatggcagtgattgccccgaggccatggatctcggcacgctgtcgggaataggtactctggatggttttagacaccgccaccccgacgaagccgcattttttgacaccgcgtccacagggaaaaccttccctggtttcttcagccccatgctcggggagtttgtgtcagaaactgagtctagaggatcggaaagcgggatcttcactaacaccaaggagtccagctcccaccacccggggattgccgaatttccatccaggggcaaatctagctcctactccaaacaattcacctcttccacctcctacaaccgaggagactcaacttttgaaagtaagtcctacaaaatggccgatgaagccggaagcgaagctgatcacgaaggaacccacagcacaaagcgaggccacgccaagagcaggccggttagagattgcgatgatgtactgcagacacacccttcgggaacgcagtccggaatcttcaatatcaagctgcctggctcttctaaaatcttttccgtgtactgcgatcaggaaacttctttgggaggctggctgttgattcagcagcgaatggatggttctcttaactttaatcgaacctggcaggactataagcgaggattcggctccttaaatgacgagggggaaggggaattctggttaggtaacgactacctgcacctcctaactcagagaggctcagtgctgagggttgagttggaggactgggcagggaacgaggcgtatgcagagtaccatttccgcgtcggctctgaagccgagggctatgcgctgcaggtaagttcttacgaaggcacagcaggtgacgcattgatcgagggaagcgttgaagaaggggctgagtatacttcacacaataacatgcaattctctacctttgatagggacgcagaccagtgggaagagaattgcgccgaggtgtatggtgggggctggtggtacaacaactgccaggcagccaatttgaacgggatttactatcccggtggatcttacgatccaagaaacaattctccatacgaaatcgagaatggcgtggtgtgggtttcattccgtggagcggattattcgctgcgggctgtcagaatgaagattcgcccactggtgacacag

SEQ ID NO: 11165 - DNA, 2598 bp, Artificial Sequence
  Description of Artificial Sequence: Synthetic coding sequence
atgttttcaatgagaatagtttgcctggtgctgagtgttgtcggcaccgcctggactgcagacagcggcgagggtgatttcctggcagaggggggcggggtccgtggccctagagttgttgaacggcatcaatcagcctgcaaggattctgactggcctttttgctctgatgaagattggaactataaatgcccaagcgggtgccgcatgaaaggcttaattgacgaggttaaccaagacttcacaaaccggataaacaagctgaagaattctctctttgagtaccagaagaacaataaagactctcattctctgaccaccaatattatggaaatcttgaggggagatttcagtagtgcaaacaatcgcgataatacatacaacagagtctcagaagacttgaggtccagaattgaagttctgaaacggaaagttatagagaaagtgcagcacatccagctgttgcaaaaaaacgtgcgagcccaacttgtggatatgaaacgtttggaagtggacattgatattaaaatcagatcatgccgcggaagctgctcacgagcactggcgagagaagtcgacctcaaagattatgaggatcaacagaaacagctggagcaggtgattgccaaggatttactaccctcaagggacaggcagcatctaccactaattaaaatgaaacctgtcccagacttagtgcccggcaatttcaaatcccagcttcagaaggtgcctccagagtggaaagccctgaccgacatgccccagatgcggatggagttggaacggccaggggggaatgagatcaccaggggcggttctacaagctatggcactggctctgaaacagagtcgccccgcaaccctagtagtgcgggatcttggaatagcggaagctctggccccggctctaccggcaatcggaaccctggcagcagcggcacgggcggaaccgcaacctggaagcccggctccagcggtcccgggagtactgggagttggaactctggaagcagcggtacaggttctacaggcaatcagaacccaggctcgccgaggccaggctccactggaacttggaacccaggctcctcagagcgcggttcagccggccactggacctccgagagcagcgttagcggcagtacaggacaatggcatagcgagtccggtagcttcaggccagactcccccggctccggtaatgcgcgcccaaataaccctgactgggggacgtttgaggaagtaagtggtaatgtgagccctggaacccggcgcgagtaccatactgagaagctagtgacatctaagggcgacaaggagttgaggaccggaaaggagaaagttacctccggtagcactacgaccacccgccgatcctgcagtaaaaccgtcactaaaaccgtgatcgggccggacgggcataaggaggtgactaaggaggtggtaacctctgaggatggctcggattgtccagaagccatggacctaggcacactgtcgggcatcggcaccttggacggatttcggcacagacaccctgatgaggccgcctttttcgacacagcctccaccggaaagacgtttcccggtttcttttcacctatgcttggcgagtttgtgtccgaaacagagtctcggggaagcgagtccggcatcttcacgaacacaaaggagtcctcctcacaccaccccggaatcgctgagtttcctagtagaggcaagtcaagttcctacagtaaacaatttaccagttccacatcatacaaccgcggtgactccactttcgagtctaaaagttataagatggctgatgaggccggttccgaggctgatcatgaaggaacacactctacaaagcgtggccacgctaagtcgcggccagttagggactgtgacgacgtgctccagacacacccttccgggacccaaagcggcattttcaacatcaaattgccaggaagctctaaaatctttagcgtgtactgcgaccaggaaacgtcactcggcggctggcttctgatccaacagcggatggacggctctcttaatttcaatcgaacatggcaggattacaagcgggggttcgggtctctgaatgatgaaggagaaggcgagttttggctgggcaacgattatcttcatcttctgacccagcgaggaagcgtcctgcgagtggagctggaggactgggctggaaatgaggcctatgcggaataccacttccgagtcggatccgaagccgagggctatgccctgcaggtcagtagctacgagggaaccgccggggatgcccttatcgagggaagcgtggaagagggggcggagtatacatctcataacaatatgcagttttctacatttgaccgcgatgcagaccagtgggaggagaactgtgctgaagtgtacggcggtgggtggtggtataataactgccaagcagccaacctgaacggtatctattatccaggaggctcctatgacccgcgcaacaattcgccatacgagatagagaatggggtggtgtgggtaagttttagaggtgctgattatagcttgagggccgttcgcatgaaaattagacccttagtgactcaa

SEQ ID NO: 11166 - DNA, 2598 bp, Artificial Sequence
  Description of Artificial Sequence: Synthetic coding sequence
atgttcagcatgcgaatcgtgtgtctagtgctgagtgtggtcggaacggcctggactgctgatagtggcgagggcgacttcttggcggaggggggcggcgtgaggggaccgcgcgtagtggagcgacaccagtcagcatgcaaagactccgactggcctttctgtagcgacgaggactggaactacaaatgcccttcaggctgccgtatgaaagggctcatagacgaagtaaaccaggacttcaccaaccgcatcaacaaacttaagaactcactttttgagtaccagaaaaacaataaagacagccacagtctaaccaccaatattatggaaattctgagaggtgacttctccagcgccaataaccgcgataacacctataatcgcgtctctgaagacctccgaagtaggatcgaggtgctgaaaagaaaggtgatcgagaaggtgcagcatatccagctgcttcagaagaacgtgcgggcccagctcgttgatatgaaacgcctggaggtcgacattgatatcaaaatcaggagctgcagggggagttgctctagagctctggccagagaagtcgacctcaaagactatgaggaccagcagaaacagctggagcaggtaatcgccaaagacctcctgccctccagggaccggcagcacctaccacttatcaagatgaaaccggttccggacttagtgccagggaatttcaagagtcaacttcagaaagtgcccccagagtggaaggccttgactgacatgccacagatgagaatggaactagagagacccggcggaaacgagataacaagaggcggttctactagttacggcacagggtccgagaccgaaagtccacgtaacccgagtagcgccggtagctggaattctgggtcctcggggccaggttctactggcaatcggaaccctggctcttctggtactggcggaacagctacatggaagccaggctcttccggccccggctccactgggtcatggaactccgggtccagtggcactgggtccactggcaatcagaacccaggctcaccaagacctggctccacaggaacctggaaccctgggagctctgaaaggggatccgctggtcactggacatccgagtcaagcgtgtctggatctactggacagtggcattccgaaagtgggagttttcgccccgactctcctggtagtggaaacgcacgtccaaataatccagactggggaacctttgaagaggtttccggcaatgtctcacctgggactagaagggaatatcacaccgagaagcttgtcacgtccaagggtgataaagagctgaggaccggtaaggaaaaggtgacaagcggcagtacaaccactaccaggaggtcttgttccaagaccgttactaagacagtaattgggccagatggacacaaagaggtcactaaagaggtcgtcacttcggaagacgggagtgactgtcccgaagcgatggacttggggactctgagtggcataggaacattggatggttttcggcatcgacacccagatgaagccgccttctttgacactgcgtcaacgggtaaaacgtttcctggattcttctcacctatgctcggagagtttgtaagcgaaacagagagtcgggggtccgaatctggcattttcactaatacaaaagaatcgagctcccatcaccccggaattgccgagtttcctagtagaggcaagagcagttcttactccaagcaattcactagtagtacttcatacaacaggggcgattccacattcgaatccaagtcctataaaatggccgatgaggctgggagtgaagccgaccacgagggtacccacagcactaagagaggccacgctaagagcagacccgtgcgggactgtgatgatgtgcttcagacacacccatctggaactcagagcggaatcttcaatatcaagctgccggggagttcaaagatatttagtgtctattgtgaccaagagacctcactgggtgggtggctcctcatccagcaacgaatggacggaagtttgaacttcaacaggacctggcaggactataagagggggttcgggtcactgaatgacgagggggaaggggagttctggctgggtaacgactatctgcatctcctcactcagagaggtagcgtgctgagggtggaactcgaggattgggccggcaatgaagcttacgccgaatatcacttccgggtggggtctgaggcggaggggtatgctttacaggtgtcttcttatgagggaaccgccggagatgccctcatagaaggatcagtggaggagggtgccgaatacacgtcccacaacaatatgcaatttagcacgttcgaccgcgacgccgaccagtgggaggagaattgcgccgaggtctacggcggtggatggtggtacaacaattgccaggcagcaaatctgaatggaatatactacccaggcggctcatatgatcctcgaaacaacagcccttatgagatagagaatggcgtcgtgtgggtgtccttcagaggagctgactattccctgagggctgtccggatgaaaatcaggcccttggttactcaa

SEQ ID NO: 11167 - DNA, 2598 bp, Artificial Sequence
  Description of Artificial Sequence: Synthetic coding sequence
atgttctcaatgcgaatcgtgtgcctggtcctatcggtagtgggaacagcctggacagccgattctggggaaggagatttcctcgctgagggagggggggtaagagggcctcgggtagttgaacggcatcagtctgcttgtaaagattcagattggccattttgcagtgatgaagattggaactataagtgtccctcaggatgtaggatgaaagggcttatagatgaagtcaatcaggactttactaaccgaataaacaaactcaaaaacagtctgtttgaataccagaaaaataataaagattcccatagtctcacaactaacatcatggaaatattacggggggatttttcatcagcaaacaacagggataacacgtataacagggtgtctgaagatctgagatctcggatagaagtgctgaaacgcaaagtgatagaaaaagtacaacatattcagctgcttcagaagaacgtgcgggcccagctagtcgatatgaaaaggctagaagttgacattgatataaaaatccggtcgtgtcgcgggagttgctctagggccttagcacgggaagtcgatctcaaagattacgaagatcagcagaaacagctagagcaggtcatagcaaaggatttactcccttcacgagatagacagcacctacccctgattaagatgaagccagtgcctgatctcgtgcctggaaattttaaatctcaacttcagaaggtacccccagaatggaaagccttgactgatatgccacagatgcggatggagctggaaagacccgggggaaacgagataactcgcggagggtccacatcctatggaacagggtcggaaacagagagtccacgaaatccctcatccgcaggatcatggaattctgggtcctccggaccaggatccacagggaatcgaaaccctgggagttcagggactggggggacagccacttggaaaccaggatcttccgggcctggatccacaggaagttggaactccgggagttctgggactgggtctactgggaatcagaaccctgggtccccccgacctggatccacaggaacatggaaccccggaagttctgaaaggggaagtgcgggacactggacttccgagtcatctgttagtggatcaacaggacagtggcactctgaatcaggatctttcagaccagattcccccgggtccggaaatgcccgacccaacaatcccgattggggaacatttgaggaagtctcggggaatgtgtcacctggaacaaggcgcgaatatcacacagaaaaactagtcactagtaaaggggataaagagctacgcactgggaaagagaaagtcacttctggatctacaacaactactaggcggagttgttctaaaacagtgactaagactgtaattggaccagatgggcacaaagaagtgacaaaagaagttgttacatccgaagacgggtccgattgtcctgaagctatggatctcggaactctctcgggaatagggactttggatgggttcagacatcgacacccagatgaagccgcgttctttgatacagcatcaacagggaaaacattccctgggttcttttcccctatgctgggggaattcgtgtcagaaactgaatctcggggatctgaatcagggatatttactaatactaaagaatccagttcccaccaccctggaatagctgagttcccctctcgcgggaaaagtagtagttattcgaaacagtttacatcctcaacttcatataataggggagatagtacatttgagagtaaatcttataagatggctgatgaagctggatctgaagctgatcacgaaggaactcattcgactaaacggggacatgctaaatcccgcccagttcgggattgtgatgatgtcctccagacacacccatccgggactcagtccgggatctttaacatcaaactgcccgggtcctcgaaaatattttccgtatattgcgatcaggaaacttctttaggagggtggttacttatacagcagaggatggatgggtcgctgaattttaaccgaacatggcaggattacaaaaggggattcgggtccctcaacgatgaaggagaaggagaattttggttaggaaacgattatctgcaccttctgactcagcgggggtctgtcctcagagtggagcttgaagattgggccggaaatgaagcctatgcagaatatcatttccgagtcgggtcagaagctgaggggtatgcactacaggtatcaagttacgagggaacagcaggggatgcccttattgaggggtctgttgaagaaggggctgaatatacatcccacaataatatgcagttttccacttttgatcgggatgcagatcagtgggaagagaactgcgcagaagtttacgggggagggtggtggtataacaactgccaggcggccaatctaaacgggatctattacccagggggatcttacgatccacggaataattcaccttatgaaatcgagaatggggtggtatgggtgtctttcaggggagccgactattccctccgcgccgtacgaatgaaaataaggccactggtgacacag

SEQ ID NO: 11168 - DNA, 2598 bp, Artificial Sequence
  Description of Artificial Sequence: Synthetic coding sequence
atgttcagtatgcgtatcgtctgtctagtgctctctgtggtgggaactgcatggaccgcagattcaggcgaaggagactttttagctgagggaggaggcgtgaggggacctcgggtcgtagaaaggcaccagagcgcatgcaaagactctgactggccattttgcagtgatgaagactggaattataagtgcccatcagggtgccggatgaagggactaattgacgaagtcaatcaggattttacgaatcgaataaacaagttgaagaacagcctgttcgagtaccagaaaaacaataaagacagtcatagcctgaccactaacatcatggagattttgcgtggagatttttcctccgcaaataacagggacaacacatacaacagggtttccgaagatctgcgctcaaggatagaggtgctgaagcgcaaggtcatcgagaaggtccagcacatccagctactccaaaagaacgtcagggcacaactggtggacatgaaaaggttggaggtcgatattgatataaaaatccgctcatgcagaggctcttgctcaagagctctggcccgtgaggttgatctcaaggattacgaggaccagcagaagcagttagaacaggtcatcgctaaagacttgctaccaagccgtgaccgccagcacctgccactgataaagatgaagcctgtccccgaccttgtaccagggaattttaagtcccagcttcagaaagtgccgcccgaatggaaagcattgactgatatgcctcagatgcgtatggagctggaacggccgggtggtaacgagattaccagaggaggctccacctcttatggcacaggatccgaaacagagtccccaaggaatcctagcagcgcagggtcctggaactctggctctagcggcccgggttccacaggaaatcgtaacccagggtcctccggaactggcggcacggcaacctggaagcccggctctagcgggcccggatctactggttcctggaactctggcagctccggcactggaagcaccggcaaccagaaccctggcagccccagacccggctccaccgggacctggaatccaggtagttccgagcgaggcagtgctggccactggacatccgaatctagcgtctccggctcaaccggtcagtggcactccgagtcaggcagtttccggcctgacagcccaggctcagggaacgctcggccaaataaccctgattggggaacgtttgaggaggtctccgggaatgttagccctggcacacggcgcgagtatcatacagagaaactcgtcacgtctaaaggcgataaagaacttcggacgggaaaggagaaggttacgtctggctcaactactaccaccagacgtagctgttccaagaccgttactaagaccgtgattggacctgatggtcacaaggaagtcaccaaagaagtggtgacctcagaggatgggtccgactgcccagaggcaatggatctcggaaccctgagcggaattgggacgctagacggctttcgtcaccggcacccagacgaggctgcgttttttgacactgccagcacaggaaaaactttccccggcttctttagccccatgctgggagagtttgtgtcagaaacggagtcgagggggtcagaatcaggcatcttcacaaacactaaggaatcctcatctcatcatcccgggattgctgaattccctagccgaggcaagtcttcctcctattccaaacagttcacgtcctcaactagttataatcgtggtgacagtacattcgaaagcaagtcctacaaaatggcagacgaggcgggctcagaggcagaccacgagggcacccacagtacaaaaagaggtcacgctaaatcacggcccgttagggactgtgacgacgtactgcagacccacccaagcggcacccaaagtgggatcttcaacattaagctgccaggtagttccaagattttttcagtatattgtgatcaggaaacctccctgggagggtggctgctaattcagcagcggatggatggtagtttgaatttcaaccgtacttggcaggattacaaacgagggtttgggagtctaaacgatgaaggcgaaggagagttttggctggggaacgattacctgcacctgctgacacagagaggatctgtgctgagggtggagcttgaggattgggctgggaatgaagcttatgccgagtaccatttcagagtgggcagcgaagccgagggctatgctttacaagtgagttcttatgaggggactgctggggatgcactgatcgaaggctcagtcgaggaaggcgcagagtacacctctcacaacaacatgcagttcagcacttttgacagggacgcagaccagtgggaggagaattgtgctgaggtgtacggcggcggctggtggtacaataattgccaggctgcgaatctgaatggtatatattatcccggcggaagctatgatcctcgaaataacagtccgtatgagatagagaacggagtggtttgggtgtctttccggggcgctgattattctctgagagcagtccgaatgaaaatcaggcctctcgtcacacag

SEQ ID NO: 11169 - DNA, 2598 bp, Artificial Sequence
  Description of Artificial Sequence: Synthetic coding sequence
atgttcagcatgaggatcgtgtgcctcgtcctgagcgtggtgggaacagcttggacagctgacagcggggaaggagactttttagctgaaggaggcggcgtaaggggtcctagggtagtggagaggcatcaatcggcatgcaaggattcagactggcccttctgcagtgatgaggactggaactacaagtgccccagcggctgtcgcatgaaagggctgatcgacgaagtgaatcaagactttacaaatcgtatcaataagctgaagaactcgctgtttgagtatcaaaagaataacaaagatagtcactcccttaccactaacatcatggagatcctccgcggtgacttttcgagtgcaaataaccgagacaatacatacaaccgtgtgtccgaggatctcagatcacggattgaggtattgaagcgcaaggtcatcgagaaagtacagcatatccagttattgcagaaaaacgtgcgcgcccagctggtcgatatgaaacgacttgaagttgacatagacataaagattagatcttgccgcggctcctgtagtcgggccctcgcccgcgaggtggatttaaaagactacgaagaccagcagaagcagctggaacaagttatcgccaaggatcttctgccaagtcgagataggcagcacctccctctgattaaaatgaagcccgtgcctgatcttgtgccaggtaatttcaaaagccaactccagaaagttcctccagagtggaaagcattgactgacatgccacagatgcgaatggagctggagcgacccggaggaaacgagataaccaggggtggtagtacgtcctatggcaccggcagcgagacagaaagcccgcgcaatccctcttcagccggctcatggaacagtggcagtagcggacccggctccactggaaaccgtaaccccgggagttccggcaccggcgggacagctacatggaagccaggatcttccggacccggctccaccgggtcctggaattccgggtcatcggggactggctcgacagggaaccagaatcccggatcccctcgtcccgggtctaccggaacatggaacccaggctcttcggagcgcggaagtgcaggtcactggacaagcgagagtagtgtgagcgggagtacaggtcagtggcattccgaaagcggctcttttcgccccgattccccaggctcaggcaacgcccgtccgaacaatccagactggggcacgttcgaggaagtcagcgggaatgtgtccccagggacccgcagagaataccacacagagaagctggtgaccagcaaaggggacaaagagcttcgcacaggcaaagaaaaagtgacgagtgggtcaacgacgacgaccaggcggagttgtagcaagacagtcaccaaaaccgtgataggacctgatggtcataaagaggtcacaaaagaagtagtcaccagtgaggatggaagtgactgccctgaggcaatggatctcggtaccttatcaggaattggtaccctggatggcttcagacaccggcatcccgatgaagccgctttctttgacacagcctcaaccggaaagactttccctggttttttttctcctatgctgggcgaattcgtctccgagacagagtcaagaggttccgaatccggaatatttacaaacaccaaagagtccagtagtcatcatccgggaattgcagagtttccgtctcgcggtaagtcgagttcgtactcaaagcagttcactagtagtacctcatataaccgtggcgactccacatttgagtcaaaatcttacaaaatggctgacgaggccgggtcggaagctgaccatgaggggacccattcgacaaaaagaggacatgctaagtctcgaccagtgagggattgcgacgacgtgcttcagacgcacccttccggaacccagagtggcatcttcaacataaagctgccagggtcctcaaaaatcttctctgtgtactgcgatcaggaaacgtcattgggcggctggttgctcatccagcagaggatggatgggtccctgaactttaaccgcacttggcaggactataagcggggctttggctctctaaacgatgaaggggagggagagttctggctagggaacgattatctccatctccttactcagcgcgggtcagtcttgcgagttgaactcgaggactgggccggcaatgaggcgtatgccgagtatcattttcgggtcggctcagaagctgaaggctacgccttacaggtgagcagctatgagggaaccgccggagatgccctaattgaaggctcagtagaggaaggggccgaatacacatctcataacaacatgcagttttcaacctttgacagggacgccgaccagtgggaagagaattgtgccgaagtctacggagggggatggtggtataataattgtcaagccgcaaatctgaacggaatatattatccgggtggttcctatgatcctcgcaacaattccccctacgagatcgaaaacggagtggtgtgggtatcatttcgtggagccgactactcattgagagcagttcggatgaaaattcggcccctagtgacccag

SEQ ID NO: 11170 - DNA, 2598 bp, Artificial Sequence
  Description of Artificial Sequence: Synthetic coding sequence
atgttcagcatgcgcatcgtatgtctagtgctgtcggtcgtcggcactgcttggaccgccgactcaggtgaaggagattttctggcggagggcggcggcgttagggggccacgtgttgtcgaacgacaccagtccgcctgcaaagattcagactggcccttctgcagcgatgaggattggaattacaagtgccctagtggctgtcggatgaaagggctcattgacgaggtgaatcaggattttaccaaccggatcaataagctaaagaattctttatttgaataccagaaaaacaataaagattcgcacagtttgaccactaacattatggaaattctgcgtggcgatttttcaagtgccaataatcgagataacacgtacaaccgagttagcgaggatttacgatccagaattgaggtgcttaaacggaaggtcatcgagaaagttcagcacatccagctcctgcagaaaaatgtgcgtgcccaactggttgacatgaagaggctggaggtcgatattgatatcaagatccgctcctgcaggggctcttgctctagagcactcgcccgcgaggttgacctgaaagactacgaagatcaacagaaacaactagagcaggtgatcgcaaaggatctactcccgtccagagatcgacagcacctgcccctgattaaaatgaaaccagttccggatcttgtccccggcaacttcaaatcccagctacagaaggtgcccccggagtggaaggcactgaccgacatgccccaaatgaggatggagttggagcgcccagggggaaacgagatcacacgtggtggcagtacctcctatggaactggatccgagaccgaatctcccagaaacccgtcctctgctggcagctggaattcgggctcaagcggacctggttccactgggaaccgcaaccctggtagctctgggacagggggtactgcaacctggaagccagggagcagcggtccaggctccaccgggtcatggaacagcggttcaagcggaaccgggagtacaggcaaccaaaatcctgggagccctagacccgggagtacgggcacatggaatcccggtagttctgaaagggggtcggccggccactggaccagcgagtcgagcgtaagtgggagtactggccagtggcatagtgaaagcggctctttcaggccggactctccaggttcggggaatgcaaggcctaacaaccccgactggggcactttcgaggaagtaagcgggaacgtgtcccctggtacccgtcgtgagtatcacaccgaaaaactggttacgtctaagggcgacaaagagctaaggacaggtaaagagaaggtgacctcaggcagtacaacgaccacgaggagaagttgttctaagactgtcaccaagaccgtgatcggccccgacggccacaaagaagttacaaaggaggttgtgacatcagaggatggaagtgactgccctgaagctatggatctaggcactctgtccggcattggcaccttggatggattccggcacaggcaccccgacgaggctgcctttttcgatactgcatctactggtaaaacctttcccgggtttttttcccctatgctcggggagttcgtgagcgagacagagagtcgaggctcagaatcgggaatcttcaccaacaccaaggagtcttcttctcatcacccaggtatcgctgaatttccatcacgcggcaagtctagctcttattcgaagcagtttacaagctcaacctcatacaatagaggcgacagcaccttcgagtccaaaagctacaagatggctgacgaggcgggctcggaagcggatcacgaaggtactcatagtacaaagaggggtcacgccaagtccagaccagtgagagattgcgatgatgttctgcagacacacccaagcgggactcagagcggcatcttcaacattaaattgcctggtagtagcaaaattttttcagtgtattgtgatcaggaaacttctctgggaggctggctgctgattcagcagcgcatggacggcagccttaatttcaacaggacctggcaggactacaagcggggctttggctctcttaacgacgagggcgagggagagttctggttggggaatgattatttgcatctgcttacccagcgcggttcagtcctgcgcgtcgaacttgaagattgggccggaaatgaggcttacgcagaataccattttcgggtgggctcagaggctgaaggatatgcgttacaagttagttcttatgaaggaactgccggggatgccctcattgaaggaagcgttgaggagggcgcagaatatacttcccacaacaacatgcaattctccacctttgaccgcgatgctgaccagtgggaagaaaattgcgcggaggtatatggaggaggctggtggtacaacaactgccaggcagccaatctcaatgggatttactaccccgggggttcctacgatcctagaaataactctccttacgaaatagagaacggtgtagtttgggtcagcttccggggagccgactatagtttgagggcagtacggatgaaaatccgccctctggttactcag

SEQ ID NO: 11171 - DNA, 2598 bp, Artificial Sequence
  Description of Artificial Sequence: Synthetic coding sequence
atgttctcaatgcgtattgtttgtcttgttttatctgttgttggtacagcatggactgcagatagtggagaaggagattttcttgcagaagggggaggagtacgtggtccaagagtagtcgaaagacatcaaagcgcatgtaaagattcagactggccattttgtagtgatgaagattggaattataaatgtccatcaggatgtagaatgaaaggattaattgatgaagtaaatcaagattttacaaatagaattaataagcttaagaattcattatttgagtatcaaaaaaataataaagattctcattcattaacaacaaatattatggaaatactacgtggagatttctcatcagcaaataatagagataatacatataatagagtttctgaagatctccgttcaagaatagaagttctaaagcgtaaggttattgaaaaggttcaacatattcaattattacaaaaaaatgtaagagcacaacttgttgatatgaaaagacttgaagttgatattgatattaaaattagatcatgcagaggatcatgttcaagagctcttgcaagagaagttgatcttaaggattatgaagatcaacaaaaacaattagaacaagttatcgctaaagatttactcccatcaagagatagacaacatttacctttaattaaaatgaaaccagttccagatcttgttcctggaaattttaaaagtcaattacaaaaagtaccacctgaatggaaagctttaactgatatgccacaaatgagaatggaattagaacgtccaggaggaaatgagattacaagaggaggatcaacatcctatggaacaggtagtgaaactgaatcgccaagaaatccttcatcagctggatcatggaatagtggatcaagtggaccaggttctactggtaatcgtaatccaggaagttcaggtacaggtggaactgctacatggaaaccaggttcatcaggtccaggatcaaccggatcatggaattcaggaagtagtggaaccggttcaacgggaaatcaaaaccctgggtcaccaagaccaggatcaacaggaacatggaatccagggtcatctgagagaggatctgctggtcattggacatcagaaagttcagtctctggatctactggacaatggcatagtgaatcaggaagtttcagaccagattcaccaggaagtggaaatgcaagaccaaataatccagattggggaacgtttgaagaagttagtggaaatgtttctcctggaacacgaagagaatatcatactgaaaagttagttacttcaaaaggggacaaagaattaagaactggtaaggaaaaagtaacaagtggatcaacaactactacacgtcgttcatgtagtaagacagttacaaaaactgtaattggaccagatggacataaagaagtaactaaggaagttgttacatcagaagatggtagtgattgtccagaggctatggacttaggaacattaagtggaattggaacattagatggtttcagacatagacatccagacgaagctgcattctttgacacagcttctacaggaaaaacatttccaggatttttttcaccaatgttaggagaatttgtttcagaaacagaatctagaggatcagagagtggtatttttacaaatactaaagaatcatcttcacatcatccagggattgcagaatttccatctagaggaaaatcttcttcatattcaaaacaatttactagtagtacatcatataatagaggtgattcaacttttgaatcaaaaagttataaaatggctgatgaagcaggatcagaagcagaccatgaaggtacgcatagtacaaaacgaggtcatgcaaagtcaagaccagttagagattgtgacgatgtattacaaactcatccaagtggaactcaatcaggaatttttaatattaaattacctggatcttcaaaaatattttcagtttattgtgatcaagaaacttcattgggaggatggttactaattcaacaaaggatggatggatcattaaactttaataggacatggcaagattataagagaggttttggaagcttaaatgatgaaggagaaggagaattctggcttggaaacgattatttacatttattaacacaaagaggaagtgttttaagagttgaacttgaagattgggcaggaaatgaagcatatgcagagtatcattttagagttggttcagaagctgaaggatatgctttgcaagtttcatcttatgaaggaacagcaggtgatgctttgattgaaggaagtgttgaagaaggagctgagtatacatcacataataatatgcaatttagtacatttgatagagacgctgatcaatgggaagaaaattgtgcagaagtatatggaggtggatggtggtataataattgtcaagctgcaaatttaaatggaatatattatccaggaggaagttacgatccaagaaataactcaccatatgaaattgaaaatggagttgtatgggttagttttagaggtgcagattactcattaagagcagttagaatgaaaattcgaccattagttacacaa

SEQ ID NO: 11172 - DNA, 2598 bp, Artificial Sequence
  Description of Artificial Sequence: Synthetic coding sequence
atgttcagtatgcggattgtgtgcctcgtgctgagcgttgtcggcacagcctggaccgcagatagcggcgaaggcgatttccttgctgagggaggcggtgttaggggccctagggtggtggaaaggcaccagtccgcctgcaaagattccgattggcctttttgctccgatgaggactggaattataaatgcccatcagggtgcaggatgaagggccttattgacgaggtgaaccaggacttcacaaatcgcattaacaaactgaagaattccttgtttgaataccagaaaaacaataaggatagccactccctgactaccaatatcatggagattttgcggggcgacttttcttccgccaataaccgggacaatacttataaccgggtctctgaagacctgcgcagtagaatcgaggttctcaagagaaaggtgatcgaaaaggtgcaacatattcagctgctgcagaagaacgtcagggcccaattggtggatatgaaacggctggaggttgatattgacataaagattcgcagttgtaggggttcctgtagccgagcactggcccgagaggtggatctgaaagactacgaggaccagcagaagcagctcgagcaggtgatcgctaaagacctccttccttcccgggacagacaacatctgcccctcatcaagatgaagcctgtccctgatttggttccaggaaactttaaatcccagctccagaaagtcccacctgaatggaaagcccttactgatatgcctcaaatgagaatggagctcgagaggcccggaggtaatgaaattaccaggggcgggtccacaagctatggaaccggctccgagacagagtctccccgaaatccgagcagtgctggatcttggaatagcggcagctccggtccaggtagtacaggaaatagaaatcccggttctagcgggaccggagggactgccacctggaagccaggatcctccggaccagggagcaccgggagttggaattctggcagctctgggactggctcaacaggcaaccagaacccagggtccccgcgccccggcagcacaggaacctggaaccctggctctagtgagcgggggagcgccggacactggacttctgagagttccgtctcagggagcactgggcaatggcatagcgaaagcggcagctttagacccgacagtcctgggagcgggaacgcccgaccgaataatccggactggggaacatttgaggaggtctccggaaatgtgtcacctggaacccggcgggaataccacacggagaagttggtgacatcaaagggggacaaggagctgcgaacaggcaaggagaaggtgacttctggctccacaacaacaaccaggcgaagctgcagcaaaacagtcactaagaccgtgatcggtccggatgggcataaggaggttacgaaggaagtcgtcacgagtgaagatggcagcgactgccctgaagcaatggatctgggtacactctccgggatcggtacgctcgacggctttagacacaggcacccagatgaggccgctttctttgacaccgcaagcactgggaagacctttcccggcttcttcagccctatgttgggcgagtttgtgtccgagacagagtcccgggggagcgaaagcgggatctttaccaataccaaggagagcagctcacatcatcccggaattgccgagttcccatccagggggaaaagctcatcttactctaagcagtttacgagcagtacctcctacaatcggggcgacagcaccttcgagtcaaaatcttataagatggcagacgaagccggctcagaggcagatcatgaagggacacactctaccaaaagaggacatgccaaatcccgacccgttcgcgattgcgacgacgtgctgcagacccacccgtccggcacccagagcgggatctttaatatcaaactgcccggatcctccaaaattttttccgtgtactgcgatcaggagaccagcctcgggggatggctcctgattcaacaaaggatggatggctcattgaatttcaaccgcacctggcaggactataagcggggcttcggctcccttaatgacgagggggaaggggaattttggctgggtaacgactatttgcatctgctgacccagagaggatctgtcttgcgggtcgagctggaagactgggccgggaacgaagcgtacgccgagtatcactttcgcgtggggtctgaggctgaaggctatgctctgcaggtgagctcttatgaagggacggccggagacgcactgatagagggcagcgtagaggagggcgctgagtacacaagccataataacatgcagttctcaaccttcgatagagacgcggatcagtgggaagagaattgtgctgaagtctacggtggcggttggtggtacaacaactgccaggctgctaatcttaatgggatttactaccctggaggctcttacgacccccggaataattctccttacgagatcgaaaacggagtggtctgggtgagctttcggggtgccgactattccctgcgggctgtacgaatgaaaattagaccccttgtgacccag
